United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 10

SEQ ID NO: 402462 - RNA, 22 nt, Human
uaaguucauaagcuuauucuua

SEQ ID NO: 402463 - RNA, 22 nt, Human
uaagacuucauuaguaauaugg

SEQ ID NO: 402464 - RNA, 22 nt, Human
guacagaauuaugccaugaggg

SEQ ID NO: 402465 - RNA, 22 nt, Human
uuccaugaagggcagccucuca

SEQ ID NO: 402466 - RNA, 22 nt, Human
uuaauaaaguaugaauuggaaa

SEQ ID NO: 402467 - RNA, 22 nt, Human
aaauguauugcauaggauauuu

SEQ ID NO: 402468 - RNA, 22 nt, Human
aucacauucuuucaaagcaguc

SEQ ID NO: 402469 - RNA, 22 nt, Human
aaggaguuuggguagucauaca

SEQ ID NO: 402470 - RNA, 22 nt, Human
uaauuucaauagcuugcauaau

SEQ ID NO: 402471 - RNA, 20 nt, Human
aacaguaccauuuaucucag

SEQ ID NO: 402472 - RNA, 22 nt, Human
cucuucuugaaagaggaauuca

SEQ ID NO: 402473 - RNA, 22 nt, Human
gacaguccuugcccaguaucua

SEQ ID NO: 402474 - RNA, 22 nt, Human
auugugcaaauauuaucuguag

SEQ ID NO: 402475 - RNA, 22 nt, Human
gguacaaugguucauuuuaugu

SEQ ID NO: 402476 - RNA, 22 nt, Human
aagucaccccacacucuuggga

SEQ ID NO: 402477 - RNA, 22 nt, Human
uauuuaucgagugucuacuaug

SEQ ID NO: 402478 - RNA, 22 nt, Human
uucuucuuaauguccugggaac

SEQ ID NO: 402479 - RNA, 22 nt, Human
uaugaaaagguggccaauguag

SEQ ID NO: 402480 - RNA, 22 nt, Human
uucauuaauucauucagugacu

SEQ ID NO: 402481 - RNA, 22 nt, Human
aauuuacacuucauuuggaggg

SEQ ID NO: 402482 - RNA, 22 nt, Human
uaaugcuuuuccuucaaauaag

SEQ ID NO: 402483 - RNA, 22 nt, Human
uuuacagagagagaacuggacu

SEQ ID NO: 402484 - RNA, 22 nt, Human
uagcugcugcagcacagggagg

SEQ ID NO: 402485 - RNA, 22 nt, Human
guucuucaguaaaauuaaaugu

SEQ ID NO: 402486 - RNA, 22 nt, Human
caagauuugccaguggccaacu

SEQ ID NO: 402487 - RNA, 21 nt, Human
uuccagagauuguuucaccug

SEQ ID NO: 402488 - RNA, 22 nt, Human
gugguaauagagcuccaaacua

SEQ ID NO: 402489 - RNA, 22 nt, Human
aaagauaauguuuccuuauucu

SEQ ID NO: 402490 - RNA, 22 nt, Human
uauuuccagcaguaagaagaca

SEQ ID NO: 402491 - RNA, 22 nt, Human
uuccacaauguaugaauaagau

SEQ ID NO: 402492 - RNA, 22 nt, Human
aucaggaugcugucaguuacca

SEQ ID NO: 402493 - RNA, 22 nt, Human
aauguucaaacagaucacuuag

SEQ ID NO: 402494 - RNA, 22 nt, Human
ucuuagcacagcuauauaaguu

SEQ ID NO: 402495 - RNA, 22 nt, Human
gcaucuaauccaguccagcauc

SEQ ID NO: 402496 - RNA, 22 nt, Human
acuuuuaaaugaguuucaguug

SEQ ID NO: 402497 - RNA, 22 nt, Human
ugucuucagcaaaugccuuucu

SEQ ID NO: 402498 - RNA, 22 nt, Human
uuaacauacaucaugaacaaug

SEQ ID NO: 402499 - RNA, 22 nt, Human
ugcagagaaaccaguggaggac

SEQ ID NO: 402500 - RNA, 22 nt, Human
ccacugaggcaggcaguaucua

SEQ ID NO: 402501 - RNA, 22 nt, Human
ugaaggcccagccacagaaugg

SEQ ID NO: 402502 - RNA, 22 nt, Human
uuaauuacaaaacacauagguu

SEQ ID NO: 402503 - RNA, 22 nt, Human
aauaaaaugaacugguagaguu

SEQ ID NO: 402504 - RNA, 22 nt, Human
aguccuuacucgggggcccaga

SEQ ID NO: 402505 - RNA, 22 nt, Human
ucucagucagccuugauguccc

SEQ ID NO: 402506 - RNA, 22 nt, Human
ucaggauguccaaaauccagcc

SEQ ID NO: 402507 - RNA, 22 nt, Human
auguucuuccaaaucuguaaca

SEQ ID NO: 402508 - RNA, 22 nt, Human
auugaggcagcauaguucaggg

SEQ ID NO: 402509 - RNA, 22 nt, Human
gauuuacagaucuaagggucac

SEQ ID NO: 402510 - RNA, 22 nt, Human
uuacagaaguuucagcguuuua

SEQ ID NO: 402511 - RNA, 22 nt, Human
cagucucucagcuuucagcugu

SEQ ID NO: 402512 - RNA, 22 nt, Human
caaguccucgcuucuagcugug

SEQ ID NO: 402513 - RNA, 22 nt, Human
auaauucaugggccuuucaccu

SEQ ID NO: 402514 - RNA, 22 nt, Human
uucacagagaguaugcagagaa

SEQ ID NO: 402515 - RNA, 22 nt, Human
ugaaggccagcagagugaaggc

SEQ ID NO: 402516 - RNA, 22 nt, Human
guacaauagucccuguuuggau

SEQ ID NO: 402517 - RNA, 22 nt, Human
gauuuauaaagguugcacugga

SEQ ID NO: 402518 - RNA, 22 nt, Human
cuacagaaaccuuuuucauaca

SEQ ID NO: 402519 - RNA, 21 nt, Human
aaagaaucauggguaauuuca

SEQ ID NO: 402520 - RNA, 22 nt, Human
uaaagcaguguugggucggacg

SEQ ID NO: 402521 - RNA, 22 nt, Human
gucaggauuugaacucaggucu

SEQ ID NO: 402522 - RNA, 22 nt, Human
aaagaaucagaagucucaaaca

SEQ ID NO: 402523 - RNA, 22 nt, Human
caucagaaccaguggggacauu

SEQ ID NO: 402524 - RNA, 22 nt, Human
uuaaugauaccuauguuaauuu

SEQ ID NO: 402525 - RNA, 22 nt, Human
acaguuaucuuugaaauagaga

SEQ ID NO: 402526 - RNA, 22 nt, Human
aguggcaggcggagauguagga

SEQ ID NO: 402527 - RNA, 22 nt, Human
aguaaacacugucuuuauauau

SEQ ID NO: 402528 - RNA, 22 nt, Human
aguggacucuucccagugcuug

SEQ ID NO: 402529 - RNA, 18 nt, Human
augaucuuagcaaauauu

SEQ ID NO: 402530 - RNA, 22 nt, Human
uucaggaucauuuguuuuaucu

SEQ ID NO: 402531 - RNA, 22 nt, Human
gugguaaucggauucuuaccgg

SEQ ID NO: 402532 - RNA, 22 nt, Human
aaacaggcuuccauuagagcaa

SEQ ID NO: 402533 - RNA, 21 nt, Human
cacucaggguaugugccaggc

SEQ ID NO: 402534 - RNA, 22 nt, Human
uuuauccagaaucaggauuuuu

SEQ ID NO: 402535 - RNA, 20 nt, Human
gauuucaaagcagaguggcc

SEQ ID NO: 402536 - RNA, 22 nt, Human
auucuucagcaggggacacuau

SEQ ID NO: 402537 - RNA, 22 nt, Human
ugauuuaaaagaaacauugucu

SEQ ID NO: 402538 - RNA, 22 nt, Human
auuucaacagaguuugaaggca

SEQ ID NO: 402539 - RNA, 22 nt, Human
uaaggccaaguucauauacaac

SEQ ID NO: 402540 - RNA, 20 nt, Human
uguuccaagcuaaugaauga

SEQ ID NO: 402541 - RNA, 22 nt, Human
ucagaauuuuuguuacccuuga

SEQ ID NO: 402542 - RNA, 19 nt, Human
agauuuaccucauauaguu

SEQ ID NO: 402543 - RNA, 22 nt, Human
cauaagaauauuccauccuuug

SEQ ID NO: 402544 - RNA, 22 nt, Human
cugaauaauuuuauaguugcug

SEQ ID NO: 402545 - RNA, 22 nt, Human
uucaggauggcggauguugggg

SEQ ID NO: 402546 - RNA, 22 nt, Human
ucuucaauuuagaauggauuua

SEQ ID NO: 402547 - RNA, 22 nt, Human
uucauguguauggaacauuuuu

SEQ ID NO: 402548 - RNA, 22 nt, Human
uuucuucagccacuccaaacug

SEQ ID NO: 402549 - RNA, 22 nt, Human
aacaugauggggaagaacaaga

SEQ ID NO: 402550 - RNA, 22 nt, Human
gagucaccuuggccgcuguccc

SEQ ID NO: 402551 - RNA, 22 nt, Human
guuaggcagcccaagaugucag

SEQ ID NO: 402552 - RNA, 22 nt, Human
uauuucuaagagauaucuguac

SEQ ID NO: 402553 - RNA, 22 nt, Human
augaaggcuguguagauggaug

SEQ ID NO: 402554 - RNA, 22 nt, Human
uggcuauugagugaucucuaga

SEQ ID NO: 402555 - RNA, 22 nt, Human
auuguauaacagcauguauuuu

SEQ ID NO: 402556 - RNA, 22 nt, Human
aucagaaaguucaucauguuug

SEQ ID NO: 402557 - RNA, 22 nt, Human
cucaggauauugggcuggagca

SEQ ID NO: 402558 - RNA, 22 nt, Human
uuucuaguaaucaauauaaagu

SEQ ID NO: 402559 - RNA, 22 nt, Human
ugagacaaccuaauuaaacacc

SEQ ID NO: 402560 - RNA, 22 nt, Human
aguccuuaugagaugcugccuu

SEQ ID NO: 402561 - RNA, 22 nt, Human
cgucuuccucuuacgaugcgcu

SEQ ID NO: 402562 - RNA, 22 nt, Human
aaacggauauaacagcaaacgc

SEQ ID NO: 402563 - RNA, 22 nt, Human
auuuagaagcuaauuuuucaga

SEQ ID NO: 402564 - RNA, 19 nt, Human
uucauucucuuauuguugu

SEQ ID NO: 402565 - RNA, 22 nt, Human
auuaaauuggacgcugggggaa

SEQ ID NO: 402566 - RNA, 22 nt, Human
aaggccagaguacuagaggcug

SEQ ID NO: 402567 - RNA, 19 nt, Human
caguccuuuccgcuuucuc

SEQ ID NO: 402568 - RNA, 22 nt, Human
ucauuucaaguucugacagcua

SEQ ID NO: 402569 - RNA, 22 nt, Human
uaggaaaacgugauuuucucac

SEQ ID NO: 402570 - RNA, 22 nt, Human
uuuauuauucucuggagaaugu

SEQ ID NO: 402571 - RNA, 22 nt, Human
uauacaaugaguacauucuggg

SEQ ID NO: 402572 - RNA, 22 nt, Human
ucuaaagccuuccauauaacgc

SEQ ID NO: 402573 - RNA, 22 nt, Human
gaugccuccaaaugagggcaga

SEQ ID NO: 402574 - RNA, 22 nt, Human
uccaauauggauaaaaggggcc

SEQ ID NO: 402575 - RNA, 22 nt, Human
caucucaugggcaugccaagcu

SEQ ID NO: 402576 - RNA, 22 nt, Human
auuccaaacucuuucccugucg

SEQ ID NO: 402577 - RNA, 22 nt, Human
ugccuggauucgguuguuguca

SEQ ID NO: 402578 - RNA, 22 nt, Human
uuuaaagagaaugugaaggagu

SEQ ID NO: 402579 - RNA, 22 nt, Human
aaauucuucagguaauuuugau

SEQ ID NO: 402580 - RNA, 22 nt, Human
aacuuucuuggaugucucaaca

SEQ ID NO: 402581 - RNA, 22 nt, Human
acaugcuuuaacuuauuuugau

SEQ ID NO: 402582 - RNA, 22 nt, Human
cuugaaagauuuggccucugug

SEQ ID NO: 402583 - RNA, 22 nt, Human
agcugcuacugcucugccagag

SEQ ID NO: 402584 - RNA, 22 nt, Human
aaggcaguaaaaucuaccuugc

SEQ ID NO: 402585 - RNA, 22 nt, Human
aaagaaggggucuacauccaau

SEQ ID NO: 402586 - RNA, 22 nt, Human
uaauuucacugauaugaaguca

SEQ ID NO: 402587 - RNA, 22 nt, Human
gugaaggacuagcauggagggc

SEQ ID NO: 402588 - RNA, 22 nt, Human
caaggccagagccagcgauaag

SEQ ID NO: 402589 - RNA, 22 nt, Human
uguucacaaggugaugcuuuga

SEQ ID NO: 402590 - RNA, 22 nt, Human
augugaaauauuaagccgagga

SEQ ID NO: 402591 - RNA, 22 nt, Human
uugauggcugugauuuacucag

SEQ ID NO: 402592 - RNA, 22 nt, Human
acaugcuuccaaauuauguugg

SEQ ID NO: 402593 - RNA, 22 nt, Human
ccauggcucuagagauugaaaa

SEQ ID NO: 402594 - RNA, 22 nt, Human
aucagaaacucuuagagcaggg

SEQ ID NO: 402595 - RNA, 21 nt, Human
agucccauccgguaagcaagc

SEQ ID NO: 402596 - RNA, 20 nt, Human
auaggaaagggaggggcuuu

SEQ ID NO: 402597 - RNA, 22 nt, Human
ugugugaaucuauugaauauau

SEQ ID NO: 402598 - RNA, 22 nt, Human
auuucacaucuaucucagauuu

SEQ ID NO: 402599 - RNA, 22 nt, Human
cagauauuaggagcucaauaau

SEQ ID NO: 402600 - RNA, 22 nt, Human
uucagcaaacacgaugcuuguu

SEQ ID NO: 402601 - RNA, 22 nt, Human
aagcaauauacugauaugauua

SEQ ID NO: 402602 - RNA, 22 nt, Human
uguggaaagucaaguuccagga

SEQ ID NO: 402603 - RNA, 22 nt, Human
gcauguguggaggagaugugcu

SEQ ID NO: 402604 - RNA, 22 nt, Human
ucagaaauagucuuuaaaauga

SEQ ID NO: 402605 - RNA, 22 nt, Human
uuucccagagguaugaauaagu

SEQ ID NO: 402606 - RNA, 19 nt, Human
acagaaauuaguuauuuuc

SEQ ID NO: 402607 - RNA, 22 nt, Human
uaacauguuaagaaauuagaua

SEQ ID NO: 402608 - RNA, 22 nt, Human
uuuccaaaggcuaaacucaguu

SEQ ID NO: 402609 - RNA, 22 nt, Human
aggauuuauuccagaaaugcaa

SEQ ID NO: 402610 - RNA, 22 nt, Human
aggaaaaauaaggcagcagggc

SEQ ID NO: 402611 - RNA, 22 nt, Human
ucaaacaggacuacauucucau

SEQ ID NO: 402612 - RNA, 22 nt, Human
uuucauugaacuaaagaaucug

SEQ ID NO: 402613 - RNA, 22 nt, Human
caagaaucagaccugucagggu

SEQ ID NO: 402614 - RNA, 21 nt, Human
uccaaaaaggagcguccuucu

SEQ ID NO: 402615 - RNA, 22 nt, Human
uuuuauguuccucuuuaugcga

SEQ ID NO: 402616 - RNA, 22 nt, Human
uuccucuagcuucucacuaaca

SEQ ID NO: 402617 - RNA, 22 nt, Human
uaugaacauguucauugacuua

SEQ ID NO: 402618 - RNA, 22 nt, Human
ggagcuguucaggacugcuuca

SEQ ID NO: 402619 - RNA, 22 nt, Human
agucauaaagccagugggaggc

SEQ ID NO: 402620 - RNA, 22 nt, Human
aagauauacuauuaaguaccau

SEQ ID NO: 402621 - RNA, 22 nt, Human
uuuauacauggagaauuuuugc

SEQ ID NO: 402622 - RNA, 22 nt, Human
ggacagaggguugacagaguau

SEQ ID NO: 402623 - RNA, 22 nt, Human
acaaaauuaccuaguuauuuuc

SEQ ID NO: 402624 - RNA, 22 nt, Human
cagucaccugaagacuugacca

SEQ ID NO: 402625 - RNA, 22 nt, Human
acuuaaaaagaaucuuuucacg

SEQ ID NO: 402626 - RNA, 22 nt, Human
acagaauugaaaguauaaucug

SEQ ID NO: 402627 - RNA, 22 nt, Human
uccaugagcuagcuuuccaaag

SEQ ID NO: 402628 - RNA, 22 nt, Human
cucugcauuuuaacagaugauu

SEQ ID NO: 402629 - RNA, 22 nt, Human
cauaacaguggcuucagcaagu

SEQ ID NO: 402630 - RNA, 22 nt, Human
caaauguaaauucuuuugaagc

SEQ ID NO: 402631 - RNA, 22 nt, Human
cccauucauccucgcuuccuuc

SEQ ID NO: 402632 - RNA, 22 nt, Human
uuucuucaauugcuaacaagga

SEQ ID NO: 402633 - RNA, 22 nt, Human
cauuucaaggaccacccuggga

SEQ ID NO: 402634 - RNA, 22 nt, Human
agaguucugcucuucucaguga

SEQ ID NO: 402635 - RNA, 22 nt, Human
guaaacaucagccacucuauuu

SEQ ID NO: 402636 - RNA, 22 nt, Human
caaauaguaugagcaaugauuc

SEQ ID NO: 402637 - RNA, 22 nt, Human
cauagaaacuugcagcaagcac

SEQ ID NO: 402638 - RNA, 22 nt, Human
acagaauuaaugaaaauuacaa

SEQ ID NO: 402639 - RNA, 22 nt, Human
ucaguucuuuauuucacaguga

SEQ ID NO: 402640 - RNA, 22 nt, Human
uuccuuagugacuucuagcuac

SEQ ID NO: 402641 - RNA, 22 nt, Human
uuuaggcaaacucauugucaga

SEQ ID NO: 402642 - RNA, 22 nt, Human
caucagaaccagcugggugagg

SEQ ID NO: 402643 - RNA, 22 nt, Human
caagaauccuguucuugaagau

SEQ ID NO: 402644 - RNA, 22 nt, Human
augaacaagagagggaagauuc

SEQ ID NO: 402645 - RNA, 22 nt, Human
uucacagauguauuggaacucc

SEQ ID NO: 402646 - RNA, 22 nt, Human
uuguuaaaaauagauuuccagg

SEQ ID NO: 402647 - RNA, 22 nt, Human
auuaaauuggaucugcauaguu

SEQ ID NO: 402648 - RNA, 22 nt, Human
acaaugaacacacaaggaauuc

SEQ ID NO: 402649 - RNA, 18 nt, Human
ucauagaagugaaucaga

SEQ ID NO: 402650 - RNA, 22 nt, Human
gcuggauccacaaauaacuuug

SEQ ID NO: 402651 - RNA, 22 nt, Human
ucaguaaaugguugcuguuauu

SEQ ID NO: 402652 - RNA, 22 nt, Human
cucuacucuuaacacagcuagg

SEQ ID NO: 402653 - RNA, 18 nt, Human
cuggcuuucuuauccauc

SEQ ID NO: 402654 - RNA, 22 nt, Human
cauuguuaauugguaucuuaca

SEQ ID NO: 402655 - RNA, 22 nt, Human
cugaauaauuuucuguuguaug

SEQ ID NO: 402656 - RNA, 22 nt, Human
acuggaucagaaucugauuuuu

SEQ ID NO: 402657 - RNA, 22 nt, Human
cuuaaauuuucaucuacaagaa

SEQ ID NO: 402658 - RNA, 22 nt, Human
guauagaaacccagaaagauag

SEQ ID NO: 402659 - RNA, 22 nt, Human
gucuucuuguuuugaaggaaau

SEQ ID NO: 402660 - RNA, 22 nt, Human
guuaggcaugaguguguauuaa

SEQ ID NO: 402661 - RNA, 22 nt, Human
auauccaagaaacaauuaauuc

SEQ ID NO: 402662 - RNA, 22 nt, Human
uguagaaagaauauguuucaua

SEQ ID NO: 402663 - RNA, 22 nt, Human
ucauaaaaugcuccugauauug

SEQ ID NO: 402664 - RNA, 22 nt, Human
uuagaaaaaacgucuucuagug

SEQ ID NO: 402665 - RNA, 22 nt, Human
uaaguccuucaccuaauccuca

SEQ ID NO: 402666 - RNA, 22 nt, Human
auucuucaccugagucagucua

SEQ ID NO: 402667 - RNA, 22 nt, Human
uggcuuuaaaucuguauucaua

SEQ ID NO: 402668 - RNA, 22 nt, Human
guccuuaguuacuuuucauguc

SEQ ID NO: 402669 - RNA, 22 nt, Human
uuugaaauaugaggcauuauga

SEQ ID NO: 402670 - RNA, 22 nt, Human
gucauaaagcuuguugcauuua

SEQ ID NO: 402671 - RNA, 22 nt, Human
auagaauagcauagaaaauuga

SEQ ID NO: 402672 - RNA, 22 nt, Human
agugugagcccuggaguggugc

SEQ ID NO: 402673 - RNA, 22 nt, Human
cuggcuuucuauuuggugcuau

SEQ ID NO: 402674 - RNA, 19 nt, Human
uuagccauccacagugaaa

SEQ ID NO: 402675 - RNA, 22 nt, Human
uuuuucagccaugaauuacacu

SEQ ID NO: 402676 - RNA, 22 nt, Human
caaguccaggucaauuuaaagc

SEQ ID NO: 402677 - RNA, 22 nt, Human
aucaggaucacagaaacuuuua

SEQ ID NO: 402678 - RNA, 22 nt, Human
cauggcugcgagaagagugggu

SEQ ID NO: 402679 - RNA, 22 nt, Human
augaaggcuguguggagccccc

SEQ ID NO: 402680 - RNA, 22 nt, Human
ggcaccagccaccuauuucuag

SEQ ID NO: 402681 - RNA, 22 nt, Human
gaaguucaaaagacagauuuga

SEQ ID NO: 402682 - RNA, 22 nt, Human
gcuggaucaaguccuucaccca

SEQ ID NO: 402683 - RNA, 22 nt, Human
gaugaaaaucuugagaugucga

SEQ ID NO: 402684 - RNA, 22 nt, Human
ucugggaagcugcgugccuguu

SEQ ID NO: 402685 - RNA, 22 nt, Human
ugcaggaaaacaccuaucaccc

SEQ ID NO: 402686 - RNA, 22 nt, Human
uaaaaguauacuuucaaaggag

SEQ ID NO: 402687 - RNA, 22 nt, Human
uaaaauugcggugaauauuucc

SEQ ID NO: 402688 - RNA, 22 nt, Human
ugaagaaucagauuggccugcg

SEQ ID NO: 402689 - RNA, 17 nt, Human
cuguuaauucauuuccc

SEQ ID NO: 402690 - RNA, 22 nt, Human
acauauauuacuaguaaagaca

SEQ ID NO: 402691 - RNA, 22 nt, Human
ugguuuaaccugucucuuauua

SEQ ID NO: 402692 - RNA, 22 nt, Human
ucaggaugagcucauaacuaug

SEQ ID NO: 402693 - RNA, 22 nt, Human
uuauuuaaaagugguaagauuc

SEQ ID NO: 402694 - RNA, 22 nt, Human
ucuggaucggguuccucagguc

SEQ ID NO: 402695 - RNA, 22 nt, Human
ccaguuuaagacuuaucucaau

SEQ ID NO: 402696 - RNA, 22 nt, Human
uuacagaaaggaaggacugacu

SEQ ID NO: 402697 - RNA, 22 nt, Human
aaagucaucuaggagcagauuu

SEQ ID NO: 402698 - RNA, 22 nt, Human
aggcuucugcugauauuucauu

SEQ ID NO: 402699 - RNA, 22 nt, Human
cuucaggauuuaggaagaugaa

SEQ ID NO: 402700 - RNA, 22 nt, Human
cucaacagcucugccauacucc

SEQ ID NO: 402701 - RNA, 22 nt, Human
cuucuucaucuguaaaacuugg

SEQ ID NO: 402702 - RNA, 22 nt, Human
aucaggaugacuauaaggcugc

SEQ ID NO: 402703 - RNA, 23 nt, Human
agaucugauguuaccaagaauug

SEQ ID NO: 402704 - RNA, 22 nt, Human
uaagaaguacaaaaauuuucug

SEQ ID NO: 402705 - RNA, 21 nt, Human
gauuugcagaaacuagacagg

SEQ ID NO: 402706 - RNA, 22 nt, Human
uugauuaaucccaugugaguag

SEQ ID NO: 402707 - RNA, 22 nt, Human
aguauuuagcauagugguuagu

SEQ ID NO: 402708 - RNA, 23 nt, Human
uguaacaauucccagccuuugcc

SEQ ID NO: 402709 - RNA, 22 nt, Human
ucauaaagcucuuccaaaugua

SEQ ID NO: 402710 - RNA, 22 nt, Human
ugagacaaaauugacagacaaa

SEQ ID NO: 402711 - RNA, 22 nt, Human
cauuucaaacaguuacagcugc

SEQ ID NO: 402712 - RNA, 22 nt, Human
gaauuucaacaguccucaaaug

SEQ ID NO: 402713 - RNA, 22 nt, Human
ccuggauccaugaaaaggcuac

SEQ ID NO: 402714 - RNA, 22 nt, Human
agaccuggauuccaauccuacc

SEQ ID NO: 402715 - RNA, 22 nt, Human
uuuaucuuuaggacuuugcaga

SEQ ID NO: 402716 - RNA, 22 nt, Human
auguauccuuauacacauuuau

SEQ ID NO: 402717 - RNA, 22 nt, Human
uguuugaauuuugcuaacgugu

SEQ ID NO: 402718 - RNA, 20 nt, Human
cucaggauacugcaaaguug

SEQ ID NO: 402719 - RNA, 22 nt, Human
aagcauuuuguuuuaagaauga

SEQ ID NO: 402720 - RNA, 22 nt, Human
uccaugaggcagggaggcuggc

SEQ ID NO: 402721 - RNA, 22 nt, Human
uacagcuaggcaaaaaugacau

SEQ ID NO: 402722 - RNA, 22 nt, Human
aaucagaaaauucaguggaauu

SEQ ID NO: 402723 - RNA, 22 nt, Human
augcuuaauacacuguuaaagg

SEQ ID NO: 402724 - RNA, 22 nt, Human
aucaguuaguuacugcuaagau

SEQ ID NO: 402725 - RNA, 21 nt, Human
ucagagaacccggcaggcaag

SEQ ID NO: 402726 - RNA, 22 nt, Human
aucauucuaguccuuauggucu

SEQ ID NO: 402727 - RNA, 22 nt, Human
guccucuguuagaaaugugcuu

SEQ ID NO: 402728 - RNA, 22 nt, Human
uaaguccuggcugguuugaagc

SEQ ID NO: 402729 - RNA, 22 nt, Human
aucaggaucugggagccugaaa

SEQ ID NO: 402730 - RNA, 22 nt, Human
uuuuugcugauaagcagaauuc

SEQ ID NO: 402731 - RNA, 23 nt, Human
acauacauggagauaaagugaug

SEQ ID NO: 402732 - RNA, 22 nt, Human
auacagaauucacuacaguuuc

SEQ ID NO: 402733 - RNA, 22 nt, Human
auuccaaagguuaaugcccauu

SEQ ID NO: 402734 - RNA, 22 nt, Human
caaauguauaaauguacuuucu

SEQ ID NO: 402735 - RNA, 22 nt, Human
ugauauuuaagcaaaaauaugg

SEQ ID NO: 402736 - RNA, 22 nt, Human
auuaaacugagcaaauuaacau

SEQ ID NO: 402737 - RNA, 22 nt, Human
aaguuacacauuuucauuguaa

SEQ ID NO: 402738 - RNA, 22 nt, Human
ucagaauuuugguuugguuggu

SEQ ID NO: 402739 - RNA, 22 nt, Human
uuacagaagugaaggccuuuaa

SEQ ID NO: 402740 - RNA, 22 nt, Human
caucagaaagaguccuggacuu

SEQ ID NO: 402741 - RNA, 22 nt, Human
ccucaggauccgcaggugcagu

SEQ ID NO: 402742 - RNA, 22 nt, Human
gguacaauccacuguggguuag

SEQ ID NO: 402743 - RNA, 22 nt, Human
auacuaaaguauagaacuuagu

SEQ ID NO: 402744 - RNA, 22 nt, Human
ccagucacucugugagagcuac

SEQ ID NO: 402745 - RNA, 22 nt, Human
cauuuguuaaccaguguggauu

SEQ ID NO: 402746 - RNA, 22 nt, Human
cacagacccagaagggaugaag

SEQ ID NO: 402747 - RNA, 22 nt, Human
aaguccuucccaagcauguacc

SEQ ID NO: 402748 - RNA, 22 nt, Human
ucuuuaauauaaaggaaugaau

SEQ ID NO: 402749 - RNA, 21 nt, Human
caagccagaccaauagcagcc

SEQ ID NO: 402750 - RNA, 22 nt, Human
ucauuauccuaguaucuugaau

SEQ ID NO: 402751 - RNA, 22 nt, Human
ugcaggaagcaaccagguccaa

SEQ ID NO: 402752 - RNA, 22 nt, Human
gucaggauuuuaaaaucccagu

SEQ ID NO: 402753 - RNA, 22 nt, Human
ggauggcagucugcaugagaaa

SEQ ID NO: 402754 - RNA, 22 nt, Human
uguccuuacaaggucccuuucg

SEQ ID NO: 402755 - RNA, 22 nt, Human
ggcucagaccucccagcuccag

SEQ ID NO: 402756 - RNA, 22 nt, Human
uuagccauuuuauacaagugua

SEQ ID NO: 402757 - RNA, 22 nt, Human
uaaauuguuuucuagaaguugu

SEQ ID NO: 402758 - RNA, 18 nt, Human
aagucaccccugcucccu

SEQ ID NO: 402759 - RNA, 22 nt, Human
agacaacaucacuaaagcugag

SEQ ID NO: 402760 - RNA, 21 nt, Human
acagucuccccagaucucucc

SEQ ID NO: 402761 - RNA, 22 nt, Human
auuucccagcuuugaucaguuu

SEQ ID NO: 402762 - RNA, 22 nt, Human
ugcuuauucuuuccacaauuca

SEQ ID NO: 402763 - RNA, 22 nt, Human
aaaguccuuuuugccaugcaag

SEQ ID NO: 402764 - RNA, 22 nt, Human
uuccuuagcuccucauggccug

SEQ ID NO: 402765 - RNA, 22 nt, Human
uacuuaaugccacugaauugua

SEQ ID NO: 402766 - RNA, 22 nt, Human
ucuacagacagagcagguggga

SEQ ID NO: 402767 - RNA, 22 nt, Human
augaauaaacaggugccucuuc

SEQ ID NO: 402768 - RNA, 22 nt, Human
caauacuuccuuguuagaggca

SEQ ID NO: 402769 - RNA, 22 nt, Human
caauuucaauacaaaauacauu

SEQ ID NO: 402770 - RNA, 22 nt, Human
augcuaaauggccaguaccaaa

SEQ ID NO: 402771 - RNA, 22 nt, Human
auauucuuccaaaacaucauuu

SEQ ID NO: 402772 - RNA, 22 nt, Human
uuugaaagccuggcuuuucucu

SEQ ID NO: 402773 - RNA, 22 nt, Human
auuaggcagugccauuguacgg

SEQ ID NO: 402774 - RNA, 22 nt, Human
ucaauaaaucccucugacccug

SEQ ID NO: 402775 - RNA, 22 nt, Human
gcaggcuccaaggccugggaga

SEQ ID NO: 402776 - RNA, 22 nt, Human
uuacagaaaagggcuuuaagag

SEQ ID NO: 402777 - RNA, 22 nt, Human
aaguauaagcuauucuucauga

SEQ ID NO: 402778 - RNA, 22 nt, Human
aaguauuucguucugaaaaagu

SEQ ID NO: 402779 - RNA, 22 nt, Human
ucuuucaaugagcauucuuucc

SEQ ID NO: 402780 - RNA, 20 nt, Human
gagauggacagaugaagggg

SEQ ID NO: 402781 - RNA, 22 nt, Human
cacaauuuccuugcuucacuuu

SEQ ID NO: 402782 - RNA, 22 nt, Human
uacuaaacaucuggcauuaaau

SEQ ID NO: 402783 - RNA, 22 nt, Human
cuguaaauaugaagaauauaug

SEQ ID NO: 402784 - RNA, 22 nt, Human
uaaagccacuucauucuagucu

SEQ ID NO: 402785 - RNA, 22 nt, Human
uugguuuagagagugugguuac

SEQ ID NO: 402786 - RNA, 22 nt, Human
caggauggucucgaucuccuga

SEQ ID NO: 402787 - RNA, 22 nt, Human
uuauuuaaugugaucugaagag

SEQ ID NO: 402788 - RNA, 22 nt, Human
ccaugcacaccagcaggcagac

SEQ ID NO: 402789 - RNA, 22 nt, Human
ucaauucugguccucaggaacu

SEQ ID NO: 402790 - RNA, 22 nt, Human
ucauuuguacuugugugcuugu

SEQ ID NO: 402791 - RNA, 22 nt, Human
aaauuguugaucuacaguaagg

SEQ ID NO: 402792 - RNA, 22 nt, Human
aagacuuucaaaccuauguuug

SEQ ID NO: 402793 - RNA, 22 nt, Human
cuggcuuuggucaugugaucau

SEQ ID NO: 402794 - RNA, 20 nt, Human
uuucaagucagcaauucuca

SEQ ID NO: 402795 - RNA, 22 nt, Human
uacagauauagagauuuauaga

SEQ ID NO: 402796 - RNA, 22 nt, Human
uaugucaaaguuaagaaauagg

SEQ ID NO: 402797 - RNA, 22 nt, Human
uagcagaaacuguuacagaagg

SEQ ID NO: 402798 - RNA, 22 nt, Human
uaauaaacugcuacgcuuaguu

SEQ ID NO: 402799 - RNA, 22 nt, Human
gcaacuuuagggccagcaagua

SEQ ID NO: 402800 - RNA, 22 nt, Human
cagauccacccuuguagugaca

SEQ ID NO: 402801 - RNA, 22 nt, Human
cauggcuuuguucauauaauuu

SEQ ID NO: 402802 - RNA, 22 nt, Human
aaucuucuuucuuaacaguaca

SEQ ID NO: 402803 - RNA, 22 nt, Human
uaaagaucuuaggaagauuuuc

SEQ ID NO: 402804 - RNA, 22 nt, Human
ugugaauagugccgcaauaaac

SEQ ID NO: 402805 - RNA, 22 nt, Human
ccucagaugucuuaaggcacug

SEQ ID NO: 402806 - RNA, 22 nt, Human
cuacagaaucuaccucaagcca

SEQ ID NO: 402807 - RNA, 22 nt, Human
caggccagguggcaggcaaaac

SEQ ID NO: 402808 - RNA, 22 nt, Human
aaaggcauuuuaauucuaaaga

SEQ ID NO: 402809 - RNA, 23 nt, Human
auugaugacuugauuacacuuuu

SEQ ID NO: 402810 - RNA, 22 nt, Human
ccuggacucaggcugugggcac

SEQ ID NO: 402811 - RNA, 22 nt, Human
uaaaguuuguagcaauugauau

SEQ ID NO: 402812 - RNA, 22 nt, Human
ucuauacugaugggauacuauu

SEQ ID NO: 402813 - RNA, 22 nt, Human
ucauuauuuuggacuggagugu

SEQ ID NO: 402814 - RNA, 22 nt, Human
cuugaaagucagcagaguggau

SEQ ID NO: 402815 - RNA, 22 nt, Human
ggcucagagaccugcgaucuga

SEQ ID NO: 402816 - RNA, 22 nt, Human
uucuucaguguagcaacuguau

SEQ ID NO: 402817 - RNA, 22 nt, Human
aguuauaugugaaaacacguau

SEQ ID NO: 402818 - RNA, 22 nt, Human
ucugggaaaugcuguuccuugu

SEQ ID NO: 402819 - RNA, 22 nt, Human
uuucacagguacaaacacuccu

SEQ ID NO: 402820 - RNA, 22 nt, Human
uacuuuuagccuauuugauucu

SEQ ID NO: 402821 - RNA, 22 nt, Human
cccaugagauucugaauuuggc

SEQ ID NO: 402822 - RNA, 22 nt, Human
auacaaugauaauaguacuuua

SEQ ID NO: 402823 - RNA, 22 nt, Human
uuauacaguuuauacuuagaau

SEQ ID NO: 402824 - RNA, 21 nt, Human
gcucagaguauugcacuguuu

SEQ ID NO: 402825 - RNA, 22 nt, Human
ccaugagcuucaacugacacag

SEQ ID NO: 402826 - RNA, 22 nt, Human
ucucuguacaguacaugccgug

SEQ ID NO: 402827 - RNA, 22 nt, Human
uggagaauuuugucaccagaca

SEQ ID NO: 402828 - RNA, 22 nt, Human
uucauuaguucugaagaugucu

SEQ ID NO: 402829 - RNA, 22 nt, Human
aagauauagauaaaacuaugca

SEQ ID NO: 402830 - RNA, 21 nt, Human
uuuuauugaugaauggccacu

SEQ ID NO: 402831 - RNA, 22 nt, Human
ugaauagauuuuuaacauauaa

SEQ ID NO: 402832 - RNA, 22 nt, Human
ggaggcugagaaguccaagauc

SEQ ID NO: 402833 - RNA, 20 nt, Human
aaucagaaagugugagcucu

SEQ ID NO: 402834 - RNA, 22 nt, Human
cuauuacauuucuggacauuca

SEQ ID NO: 402835 - RNA, 22 nt, Human
aaauacugucucugagagagcc

SEQ ID NO: 402836 - RNA, 22 nt, Human
aguaaacaguaucuuuaguguc

SEQ ID NO: 402837 - RNA, 21 nt, Human
auacagaacauugauccaaga

SEQ ID NO: 402838 - RNA, 22 nt, Human
gguuuaauggagauauuucaga

SEQ ID NO: 402839 - RNA, 22 nt, Human
ucagccagugccuugaucuugc

SEQ ID NO: 402840 - RNA, 22 nt, Human
uaacagaaaggggacagaaaua

SEQ ID NO: 402841 - RNA, 22 nt, Human
aaugugaucgcuuuagaagcuu

SEQ ID NO: 402842 - RNA, 22 nt, Human
ucgagcucuggagccaaggaug

SEQ ID NO: 402843 - RNA, 22 nt, Human
aauacagaggggucacaauuca

SEQ ID NO: 402844 - RNA, 22 nt, Human
cugauacauaguagcaugucau

SEQ ID NO: 402845 - RNA, 22 nt, Human
uugacaauguccuuugaauuuc

SEQ ID NO: 402846 - RNA, 22 nt, Human
uuuuaucuucauuccuaucuac

SEQ ID NO: 402847 - RNA, 22 nt, Human
ucacauaaauuauacaauuuca

SEQ ID NO: 402848 - RNA, 22 nt, Human
acaauguguuuuuauacauuug

SEQ ID NO: 402849 - RNA, 22 nt, Human
uuuacagauguggaaagugagc

SEQ ID NO: 402850 - RNA, 22 nt, Human
aaugcaaagcaagcagagauuu

SEQ ID NO: 402851 - RNA, 22 nt, Human
uucacauuggugauauguuucu

SEQ ID NO: 402852 - RNA, 22 nt, Human
uuagaaagcuuuccauagucaa

SEQ ID NO: 402853 - RNA, 22 nt, Human
auacuguuucucuucuacauga

SEQ ID NO: 402854 - RNA, 22 nt, Human
auucuuauuuaaauagagucug

SEQ ID NO: 402855 - RNA, 22 nt, Human
aaagccauaagccuaauacuaa

SEQ ID NO: 402856 - RNA, 22 nt, Human
acaacauuauacauagaaagcu

SEQ ID NO: 402857 - RNA, 22 nt, Human
cuuaggcagggcuggaagaucu

SEQ ID NO: 402858 - RNA, 22 nt, Human
agaauuuccuaugagagauucc

SEQ ID NO: 402859 - RNA, 22 nt, Human
uccauuuuagagaugaagaaac

SEQ ID NO: 402860 - RNA, 22 nt, Human
augugaaagagguguucagugg

SEQ ID NO: 402861 - RNA, 22 nt, Human
cauggcuuuuuagcauauucaa

SEQ ID NO: 402862 - RNA, 22 nt, Human
uaagucauaagucaugauguua

SEQ ID NO: 402863 - RNA, 22 nt, Human
aaagucaucauuucuuuucaaa

SEQ ID NO: 402864 - RNA, 22 nt, Human
gcucaggacuggaggagcgggg

SEQ ID NO: 402865 - RNA, 22 nt, Human
uaaagucaucuuuacaucuuug

SEQ ID NO: 402866 - RNA, 22 nt, Human
aggauuuacuagcaaggauucu

SEQ ID NO: 402867 - RNA, 22 nt, Human
ugaguucuaguggcugcagauu

SEQ ID NO: 402868 - RNA, 22 nt, Human
ucuacugcacuggugucucauc

SEQ ID NO: 402869 - RNA, 22 nt, Human
uuuaggcaauagauggcagugu

SEQ ID NO: 402870 - RNA, 22 nt, Human
uuccuuaggggacagggggaua

SEQ ID NO: 402871 - RNA, 22 nt, Human
uucacagagagaacucaaacca

SEQ ID NO: 402872 - RNA, 22 nt, Human
augcuuuagugucaaguuuggg

SEQ ID NO: 402873 - RNA, 22 nt, Human
gagauuuagcugcuuaacuccu

SEQ ID NO: 402874 - RNA, 22 nt, Human
ucauaaagcauuucagcuuuug

SEQ ID NO: 402875 - RNA, 22 nt, Human
ucagaauucugaccuuggguca

SEQ ID NO: 402876 - RNA, 22 nt, Human
auuacagaaugcaguuccuuau

SEQ ID NO: 402877 - RNA, 22 nt, Human
ucuggaucccaccgccacacac

SEQ ID NO: 402878 - RNA, 22 nt, Human
uaagagaauguuguggcuaggu

SEQ ID NO: 402879 - RNA, 21 nt, Human
aaucauacaaaacaugucagg

SEQ ID NO: 402880 - RNA, 22 nt, Human
aaaggccacacagagcagggag

SEQ ID NO: 402881 - RNA, 22 nt, Human
cagucucuugcuucauuaguug

SEQ ID NO: 402882 - RNA, 21 nt, Human
auaagcaugcugauuacauuu

SEQ ID NO: 402883 - RNA, 22 nt, Human
auucuacaacccaauaauaauu

SEQ ID NO: 402884 - RNA, 22 nt, Human
uauuauuaaauggcagaauuuu

SEQ ID NO: 402885 - RNA, 22 nt, Human
cauuuauauaaaauguccagaa

SEQ ID NO: 402886 - RNA, 19 nt, Human
auucauuuuugccuucuaa

SEQ ID NO: 402887 - RNA, 22 nt, Human
cauuuguauguuccuccuuagg

SEQ ID NO: 402888 - RNA, 22 nt, Human
cuuaggcauccaggguucuucc

SEQ ID NO: 402889 - RNA, 23 nt, Human
aauaucaaggugauguucccaga

SEQ ID NO: 402890 - RNA, 22 nt, Human
ugguuuuagaugccuuuacugc

SEQ ID NO: 402891 - RNA, 22 nt, Human
caucagaaugaauguucuggag

SEQ ID NO: 402892 - RNA, 22 nt, Human
gcagaggggaagcugaggaauu

SEQ ID NO: 402893 - RNA, 22 nt, Human
uuuauucugugcuacaugaaga

SEQ ID NO: 402894 - RNA, 22 nt, Human
ucagccuacacuccaacagcau

SEQ ID NO: 402895 - RNA, 20 nt, Human
guaaaauauggucuuugggu

SEQ ID NO: 402896 - RNA, 22 nt, Human
auguuauuaaaguacagauucu

SEQ ID NO: 402897 - RNA, 22 nt, Human
ucuuuaauucagcaugaugcgg

SEQ ID NO: 402898 - RNA, 22 nt, Human
agagaauuggagcagugacagg

SEQ ID NO: 402899 - RNA, 22 nt, Human
ucacugcucuccaauguggagu

SEQ ID NO: 402900 - RNA, 22 nt, Human
ucacaaauauuuuaacaguagg

SEQ ID NO: 402901 - RNA, 20 nt, Human
caggaugauuggacacgaug

SEQ ID NO: 402902 - RNA, 22 nt, Human
aaugucuuuaaagugcaauaga

SEQ ID NO: 402903 - RNA, 22 nt, Human
aggccagaaauuuggaguaugu

SEQ ID NO: 402904 - RNA, 22 nt, Human
gaggccuggagccgccuaggcg

SEQ ID NO: 402905 - RNA, 22 nt, Human
ugaagaaucccagggaauuugg

SEQ ID NO: 402906 - RNA, 22 nt, Human
guuuauaaggcccaauauuucu

SEQ ID NO: 402907 - RNA, 22 nt, Human
ccauccugcauugcuauucaga

SEQ ID NO: 402908 - RNA, 22 nt, Human
agcuucuuggcucagcacuugg

SEQ ID NO: 402909 - RNA, 21 nt, Human
cucagagaaaugucugggagc

SEQ ID NO: 402910 - RNA, 22 nt, Human
uucagaaugugaccuuauuugg

SEQ ID NO: 402911 - RNA, 22 nt, Human
augauauuugcaaugugcuugc

SEQ ID NO: 402912 - RNA, 22 nt, Human
auuucagaugaccaaauggaaa

SEQ ID NO: 402913 - RNA, 22 nt, Human
ccauggcaauggucagucuauu

SEQ ID NO: 402914 - RNA, 22 nt, Human
uaaggccagccagcaaaucugu

SEQ ID NO: 402915 - RNA, 22 nt, Human
cuuuacauccuguuucccguuu

SEQ ID NO: 402916 - RNA, 22 nt, Human
auuguuaauguugcacuaaggu

SEQ ID NO: 402917 - RNA, 22 nt, Human
aucuaacagcaacaccagaaua

SEQ ID NO: 402918 - RNA, 22 nt, Human
uaaaacuuaacuauccagauua

SEQ ID NO: 402919 - RNA, 22 nt, Human
aggauuuagauuuggaggaacu

SEQ ID NO: 402920 - RNA, 22 nt, Human
gcauggcugguguccugaggga

SEQ ID NO: 402921 - RNA, 22 nt, Human
gaggccaggagugcuguaaguu

SEQ ID NO: 402922 - RNA, 22 nt, Human
ucuucagaggaagucagucuuu

SEQ ID NO: 402923 - RNA, 22 nt, Human
auacuuaacuguggagucauug

SEQ ID NO: 402924 - RNA, 22 nt, Human
uaauuccaaguugagacaugca

SEQ ID NO: 402925 - RNA, 22 nt, Human
uguaaauaaugcauguaaauca

SEQ ID NO: 402926 - RNA, 22 nt, Human
acaugcuuugauguauuuugca

SEQ ID NO: 402927 - RNA, 22 nt, Human
ugaauaaucuuggguauuaaua

SEQ ID NO: 402928 - RNA, 22 nt, Human
uguaagaaucagucuuuaaugu

SEQ ID NO: 402929 - RNA, 22 nt, Human
uuagaaaucugcugccaugcaa

SEQ ID NO: 402930 - RNA, 22 nt, Human
uuucaaacauaucuucauuacu

SEQ ID NO: 402931 - RNA, 22 nt, Human
uguguaaauuuauuuacauaaa

SEQ ID NO: 402932 - RNA, 22 nt, Human
aagacuuucaaguaugcaugca

SEQ ID NO: 402933 - RNA, 22 nt, Human
ucuucacaugaccuucaugucu

SEQ ID NO: 402934 - RNA, 22 nt, Human
aaaauaacuucuacuauuugca

SEQ ID NO: 402935 - RNA, 22 nt, Human
acacauuuacauguuuacguau

SEQ ID NO: 402936 - RNA, 22 nt, Human
uaacagaagaaaacauauugga

SEQ ID NO: 402937 - RNA, 22 nt, Human
uaaguccuaacagacugggggc

SEQ ID NO: 402938 - RNA, 22 nt, Human
ucacacagauugguagagcuga

SEQ ID NO: 402939 - RNA, 19 nt, Human
uggggcuguguuuugaccc

SEQ ID NO: 402940 - RNA, 22 nt, Human
uucagaaacaucaguggaugga

SEQ ID NO: 402941 - RNA, 21 nt, Human
uucauaaaccauucucaugca

SEQ ID NO: 402942 - RNA, 22 nt, Human
aaugaaaauuggacccuagaac

SEQ ID NO: 402943 - RNA, 22 nt, Human
ucucuuaauuuuggaauagugu

SEQ ID NO: 402944 - RNA, 22 nt, Human
uaaguggaagguuauaugcuaa

SEQ ID NO: 402945 - RNA, 22 nt, Human
uugguuuaggaacuggcuugga

SEQ ID NO: 402946 - RNA, 22 nt, Human
uaaauaugcauguauccuuauc

SEQ ID NO: 402947 - RNA, 22 nt, Human
aagauauagauggugguauaaa

SEQ ID NO: 402948 - RNA, 22 nt, Human
acauucacgcucucaaagcuga

SEQ ID NO: 402949 - RNA, 22 nt, Human
uguguaaaaucugauuaauacu

SEQ ID NO: 402950 - RNA, 22 nt, Human
agagggagcccagucauagcug

SEQ ID NO: 402951 - RNA, 22 nt, Human
aaacugugcuucccaaaugccc

SEQ ID NO: 402952 - RNA, 18 nt, Human
ugagaggcagguagagga

SEQ ID NO: 402953 - RNA, 22 nt, Human
acaugcauaggagaagucuuua

SEQ ID NO: 402954 - RNA, 22 nt, Human
gugaauaaucacccuucuggau

SEQ ID NO: 402955 - RNA, 20 nt, Human
uuccuuaggcauuggaagaa

SEQ ID NO: 402956 - RNA, 22 nt, Human
uaaucugaagaaacaggacuug

SEQ ID NO: 402957 - RNA, 22 nt, Human
ccuuuaauuuacaauguuaauu

SEQ ID NO: 402958 - RNA, 22 nt, Human
cuguuaauugugaauuuuacau

SEQ ID NO: 402959 - RNA, 22 nt, Human
caaggccauaagagauacaaaa

SEQ ID NO: 402960 - RNA, 22 nt, Human
ugaaggccuaacuuccagugcu

SEQ ID NO: 402961 - RNA, 22 nt, Human
gcuggcuugauaguuucugcuu

SEQ ID NO: 402962 - RNA, 22 nt, Human
uacauacaagauguguuuaaaa

SEQ ID NO: 402963 - RNA, 22 nt, Human
ucagcauaucuugagcuucaug

SEQ ID NO: 402964 - RNA, 22 nt, Human
uucaggaugcagagguuguagu

SEQ ID NO: 402965 - RNA, 22 nt, Human
aacuggauuuaggaacagagaa

SEQ ID NO: 402966 - RNA, 22 nt, Human
uggcauuuucuccuuugaguuu

SEQ ID NO: 402967 - RNA, 23 nt, Human
aaugauuucaugaugauagcagc

SEQ ID NO: 402968 - RNA, 22 nt, Human
auuaaauguuggacguauacau

SEQ ID NO: 402969 - RNA, 22 nt, Human
caaagccauagaguagauaaga

SEQ ID NO: 402970 - RNA, 22 nt, Human
uugaauaguguuuucaguauac

SEQ ID NO: 402971 - RNA, 22 nt, Human
aaguaaauaucuguuuauagca

SEQ ID NO: 402972 - RNA, 22 nt, Human
uaauuucaaauuucuuagcgug

SEQ ID NO: 402973 - RNA, 22 nt, Human
gucaggaugagggaugaggagu

SEQ ID NO: 402974 - RNA, 20 nt, Human
uggccuuuaaauaguauucc

SEQ ID NO: 402975 - RNA, 23 nt, Human
uguaacaauuucauauacaugca

SEQ ID NO: 402976 - RNA, 22 nt, Human
ccauccuaucugaccuacuugu

SEQ ID NO: 402977 - RNA, 22 nt, Human
uuccuuagccugccuuccaggg

SEQ ID NO: 402978 - RNA, 22 nt, Human
ucuucacaggagccugccugcc

SEQ ID NO: 402979 - RNA, 21 nt, Human
uacagaaugcgcuucagucug

SEQ ID NO: 402980 - RNA, 22 nt, Human
cuucucaaaguugugaaucagg

SEQ ID NO: 402981 - RNA, 22 nt, Human
uaaauuauggcuggcagagcag

SEQ ID NO: 402982 - RNA, 22 nt, Human
auaaacaguagagaaagguggu

SEQ ID NO: 402983 - RNA, 22 nt, Human
ucaggaggccaccaggaccugu

SEQ ID NO: 402984 - RNA, 22 nt, Human
uucuuuucuuuaggcauugugu

SEQ ID NO: 402985 - RNA, 22 nt, Human
cauagaaaagaguagguaaugu

SEQ ID NO: 402986 - RNA, 22 nt, Human
uacuuuuuagcacagugugugc

SEQ ID NO: 402987 - RNA, 22 nt, Human
gucccaggugggcuccaccucu

SEQ ID NO: 402988 - RNA, 22 nt, Human
uuucaaguguccugauuaaugg

SEQ ID NO: 402989 - RNA, 22 nt, Human
auuaaagaaacccagcauguga

SEQ ID NO: 402990 - RNA, 22 nt, Human
uuuaauauuucuuuccugaagc

SEQ ID NO: 402991 - RNA, 22 nt, Human
aguaugaacggaaggccuggga

SEQ ID NO: 402992 - RNA, 21 nt, Human
aaaggccauaaucacggagca

SEQ ID NO: 402993 - RNA, 20 nt, Human
agaaaaaguguggaaauuuc

SEQ ID NO: 402994 - RNA, 22 nt, Human
auuucaggagcaguuucagugg

SEQ ID NO: 402995 - RNA, 21 nt, Human
ucauuugugaucugauuucca

SEQ ID NO: 402996 - RNA, 22 nt, Human
cauuucaaugccuucaacauag

SEQ ID NO: 402997 - RNA, 20 nt, Human
ucagugauuuugaagaggaa

SEQ ID NO: 402998 - RNA, 22 nt, Human
cuuuuaaugggagcaguauuug

SEQ ID NO: 402999 - RNA, 22 nt, Human
ucucaagaucucaagauggccc

SEQ ID NO: 403000 - RNA, 22 nt, Human
aguucacagccauguucaugug

SEQ ID NO: 403001 - RNA, 22 nt, Human
augcuuuuaugucacaugguca

SEQ ID NO: 403002 - RNA, 22 nt, Human
gcacaauaacagccaagguuau

SEQ ID NO: 403003 - RNA, 22 nt, Human
gaguccuuuugugccacaggga

SEQ ID NO: 403004 - RNA, 22 nt, Human
uuugaaagcuacuuucggguca

SEQ ID NO: 403005 - RNA, 22 nt, Human
cucaggauugugccuagggaga

SEQ ID NO: 403006 - RNA, 21 nt, Human
aucauucuggaaaauucaagc

SEQ ID NO: 403007 - RNA, 22 nt, Human
uacaugaaccuuuaugugugau

SEQ ID NO: 403008 - RNA, 22 nt, Human
aaguccuuaggaagcagucguu

SEQ ID NO: 403009 - RNA, 22 nt, Human
cauaauuacugauaugcugauu

SEQ ID NO: 403010 - RNA, 22 nt, Human
uuucuaggcacagugucuuccc

SEQ ID NO: 403011 - RNA, 22 nt, Human
cacaauuuccaagucauguuau

SEQ ID NO: 403012 - RNA, 23 nt, Human
augcaagaguuucucaaacugga

SEQ ID NO: 403013 - RNA, 22 nt, Human
cuggcuuucucugugguguuca

SEQ ID NO: 403014 - RNA, 21 nt, Human
uucaaagacuugaugcugacc

SEQ ID NO: 403015 - RNA, 22 nt, Human
caguccuuagucuggauggcuu

SEQ ID NO: 403016 - RNA, 22 nt, Human
caugcuuuucaaucuaucuuaa

SEQ ID NO: 403017 - RNA, 22 nt, Human
uauuuccaagcugaauccaaug

SEQ ID NO: 403018 - RNA, 22 nt, Human
aaaggccacugcaagggaaggu

SEQ ID NO: 403019 - RNA, 22 nt, Human
aguguuuaaacugaagugauga

SEQ ID NO: 403020 - RNA, 22 nt, Human
uuccuuagggucagccagaucu

SEQ ID NO: 403021 - RNA, 22 nt, Human
uucaacuauuaugaauaaaauu

SEQ ID NO: 403022 - RNA, 22 nt, Human
aaguccaugaucaagauguggc

SEQ ID NO: 403023 - RNA, 20 nt, Human
guugaaaguaauaugaugcu

SEQ ID NO: 403024 - RNA, 22 nt, Human
ugucccucugaggcuucccugg

SEQ ID NO: 403025 - RNA, 22 nt, Human
uguccuuagggauauaaaauau

SEQ ID NO: 403026 - RNA, 22 nt, Human
auggcuuugaaguaauguaauu

SEQ ID NO: 403027 - RNA, 23 nt, Human
aaaguguagccagguuaagaacc

SEQ ID NO: 403028 - RNA, 22 nt, Human
gaagaauccuguccucuuuagg

SEQ ID NO: 403029 - RNA, 22 nt, Human
uaauagaauaguggaaacauug

SEQ ID NO: 403030 - RNA, 22 nt, Human
gcauaauauacaugcuugaucc

SEQ ID NO: 403031 - RNA, 22 nt, Human
cacaauuuguuuuaucaguauu

SEQ ID NO: 403032 - RNA, 22 nt, Human
uggggcucaccuaggcuggaag

SEQ ID NO: 403033 - RNA, 22 nt, Human
acauaaguuauggauaaaaugu

SEQ ID NO: 403034 - RNA, 22 nt, Human
agucaccagguuuuagagaccu

SEQ ID NO: 403035 - RNA, 22 nt, Human
cugagccagcuggcaugugcua

SEQ ID NO: 403036 - RNA, 22 nt, Human
uuucugcugugcuuucuugcgu

SEQ ID NO: 403037 - RNA, 22 nt, Human
agauaaugaaugccaugacauu

SEQ ID NO: 403038 - RNA, 22 nt, Human
ccagaucuaguguuguaaagcu

SEQ ID NO: 403039 - RNA, 22 nt, Human
aucagcaucuuuaacaauuacc

SEQ ID NO: 403040 - RNA, 22 nt, Human
aaauacuguugaaugaaguaag

SEQ ID NO: 403041 - RNA, 22 nt, Human
uucagaaaaaacuucaauaagu

SEQ ID NO: 403042 - RNA, 22 nt, Human
uauggcuuuuaacugucguaug

SEQ ID NO: 403043 - RNA, 22 nt, Human
ucuagacacuacuaguaaccgg

SEQ ID NO: 403044 - RNA, 22 nt, Human
aguuggagugaacaugagauug

SEQ ID NO: 403045 - RNA, 22 nt, Human
auuccaaagccugaauaaugga

SEQ ID NO: 403046 - RNA, 22 nt, Human
cuauaauuaugcucaaaaugua

SEQ ID NO: 403047 - RNA, 22 nt, Human
acauucuuaacaguuaaaaacu

SEQ ID NO: 403048 - RNA, 19 nt, Human
agcaaauacaucaaaauug

SEQ ID NO: 403049 - RNA, 22 nt, Human
uucacagaauugucuugacugg

SEQ ID NO: 403050 - RNA, 22 nt, Human
auucuucauaccuacugagguu

SEQ ID NO: 403051 - RNA, 22 nt, Human
uuaaauuagucaagcuucucug

SEQ ID NO: 403052 - RNA, 22 nt, Human
agaaacauccugcuuuccauuu

SEQ ID NO: 403053 - RNA, 22 nt, Human
uaucagaaaucaacacacagug

SEQ ID NO: 403054 - RNA, 22 nt, Human
auuuccagacuuuuuccaggaa

SEQ ID NO: 403055 - RNA, 22 nt, Human
uuucaaauagaaucuuuccaaa

SEQ ID NO: 403056 - RNA, 22 nt, Human
uuuauaaacaguaccacggugc

SEQ ID NO: 403057 - RNA, 22 nt, Human
ugucucugaggugagggucagc

SEQ ID NO: 403058 - RNA, 22 nt, Human
uugaaauacugcauuguucagu

SEQ ID NO: 403059 - RNA, 22 nt, Human
guauuugcaaaucuaaaagaga

SEQ ID NO: 403060 - RNA, 22 nt, Human
uaaauuauguuccauguccuuu

SEQ ID NO: 403061 - RNA, 22 nt, Human
aaaaguguucaggaagaauaau

SEQ ID NO: 403062 - RNA, 22 nt, Human
uuuauucaucaucuguucauau

SEQ ID NO: 403063 - RNA, 22 nt, Human
aagaaaucagaaaagcauucgu

SEQ ID NO: 403064 - RNA, 23 nt, Human
augaaugaauaaggcaggaaagc

SEQ ID NO: 403065 - RNA, 22 nt, Human
cucuucuugucucugguuagaa

SEQ ID NO: 403066 - RNA, 22 nt, Human
uaaacauggcuguuucaguuau

SEQ ID NO: 403067 - RNA, 22 nt, Human
aagauuauggcagauaacaauu

SEQ ID NO: 403068 - RNA, 22 nt, Human
uguguaaauggcaucucucagc

SEQ ID NO: 403069 - RNA, 22 nt, Human
aaaauuauagaucuagugccug

SEQ ID NO: 403070 - RNA, 22 nt, Human
uguuccaagcugcuggauaagc

SEQ ID NO: 403071 - RNA, 22 nt, Human
auacagaagccuguauuucugg

SEQ ID NO: 403072 - RNA, 22 nt, Human
uuacacaacaucuguauuauua

SEQ ID NO: 403073 - RNA, 22 nt, Human
uuugaaaguccuaggagagucc

SEQ ID NO: 403074 - RNA, 22 nt, Human
uucugugaaucuuuuuucccac

SEQ ID NO: 403075 - RNA, 22 nt, Human
uuauauuaguuagacuugcugu

SEQ ID NO: 403076 - RNA, 22 nt, Human
cuguggaauugaugcuuagugu

SEQ ID NO: 403077 - RNA, 22 nt, Human
ugucucugggugauucaguccu

SEQ ID NO: 403078 - RNA, 22 nt, Human
gugaauaagaccuaaggaugaa

SEQ ID NO: 403079 - RNA, 22 nt, Human
aauuuacaguugcugaugguac

SEQ ID NO: 403080 - RNA, 22 nt, Human
auacauaauuacuuccgauguu

SEQ ID NO: 403081 - RNA, 22 nt, Human
caaguccuaaauguauuuguug

SEQ ID NO: 403082 - RNA, 22 nt, Human
cagaauguagaucaucaucaag

SEQ ID NO: 403083 - RNA, 22 nt, Human
gaaggucaccuccccucucugg

SEQ ID NO: 403084 - RNA, 22 nt, Human
auauaugcauguguacuuaugu

SEQ ID NO: 403085 - RNA, 22 nt, Human
uguauuuuuagaccuuuagacc

SEQ ID NO: 403086 - RNA, 22 nt, Human
uacagaauuagauuauuagaga

SEQ ID NO: 403087 - RNA, 22 nt, Human
uaauuuuaugacaguguauuuu

SEQ ID NO: 403088 - RNA, 22 nt, Human
aauaacagagaaggguggcuuc

SEQ ID NO: 403089 - RNA, 22 nt, Human
uucuuauagaagcaaccauugu

SEQ ID NO: 403090 - RNA, 22 nt, Human
gucaacuuuaagaugaucuuuu

SEQ ID NO: 403091 - RNA, 22 nt, Human
acaaagaucuugcuuuccuacu

SEQ ID NO: 403092 - RNA, 22 nt, Human
auuuagccucauuuuugacaua

SEQ ID NO: 403093 - RNA, 22 nt, Human
uggcauuuagaaaacaacaugu

SEQ ID NO: 403094 - RNA, 22 nt, Human
uucauucuuauuugugaucugg

SEQ ID NO: 403095 - RNA, 22 nt, Human
ggccagaaguuggaaaagagcc

SEQ ID NO: 403096 - RNA, 22 nt, Human
agaggccagguccagaguuugu

SEQ ID NO: 403097 - RNA, 22 nt, Human
uauacagaaagaauucaagucu

SEQ ID NO: 403098 - RNA, 22 nt, Human
auagcuuuacagaagaguuuag

SEQ ID NO: 403099 - RNA, 22 nt, Human
aaggccagacaggaccacaucu

SEQ ID NO: 403100 - RNA, 22 nt, Human
uucaggaugaaagugugcaaca

SEQ ID NO: 403101 - RNA, 22 nt, Human
ucacugcugcugccaugaugga

SEQ ID NO: 403102 - RNA, 17 nt, Human
uccaugagacaugaaga

SEQ ID NO: 403103 - RNA, 22 nt, Human
uauauguaagcuauguaagagu

SEQ ID NO: 403104 - RNA, 22 nt, Human
cauauaauguuugaagaugugg

SEQ ID NO: 403105 - RNA, 21 nt, Human
agagacugucacugcaguacc

SEQ ID NO: 403106 - RNA, 22 nt, Human
cauuuacauuuaagguuaauau

SEQ ID NO: 403107 - RNA, 22 nt, Human
ucucaguguguuuucucucaga

SEQ ID NO: 403108 - RNA, 22 nt, Human
uguacaauguggccaguguuaa

SEQ ID NO: 403109 - RNA, 22 nt, Human
uuuacagagaauguacauaaag

SEQ ID NO: 403110 - RNA, 23 nt, Human
ccacuagcaccuguucaacuucu

SEQ ID NO: 403111 - RNA, 20 nt, Human
auccaugagagucuggauuc

SEQ ID NO: 403112 - RNA, 22 nt, Human
uuacagaaaagggguuguccuu

SEQ ID NO: 403113 - RNA, 22 nt, Human
gaaguccucaaugcauugucuu

SEQ ID NO: 403114 - RNA, 22 nt, Human
cuuaauuacccaaugugguagg

SEQ ID NO: 403115 - RNA, 22 nt, Human
aagcauuuauagauaagaauuu

SEQ ID NO: 403116 - RNA, 22 nt, Human
aaugucuugagaagagaaaucu

SEQ ID NO: 403117 - RNA, 22 nt, Human
uggcuuuauaaauccacugguu

SEQ ID NO: 403118 - RNA, 22 nt, Human
uacagacaguuuuucagauauu

SEQ ID NO: 403119 - RNA, 22 nt, Human
ucaguaaaugagcaaaaauuuc

SEQ ID NO: 403120 - RNA, 22 nt, Human
aaaggugacugcagcagcuauu

SEQ ID NO: 403121 - RNA, 22 nt, Human
uauuucaagaacuucuauccau

SEQ ID NO: 403122 - RNA, 22 nt, Human
ugcuuuaaauaugaauuagcau

SEQ ID NO: 403123 - RNA, 22 nt, Human
ucauuuguaccauuuuuuaaga

SEQ ID NO: 403124 - RNA, 21 nt, Human
uugaaaguaaauucagcagcu

SEQ ID NO: 403125 - RNA, 22 nt, Human
uuacagaaaauguguuuuaacu

SEQ ID NO: 403126 - RNA, 22 nt, Human
cagagggcacaugguuuccuca

SEQ ID NO: 403127 - RNA, 22 nt, Human
guuccaaagcaaaggaggugag

SEQ ID NO: 403128 - RNA, 21 nt, Human
aaugcauuaacauaaagcuga

SEQ ID NO: 403129 - RNA, 22 nt, Human
uaucagaaggcacauggagucu

SEQ ID NO: 403130 - RNA, 22 nt, Human
aaggcaguaggaucuuccacag

SEQ ID NO: 403131 - RNA, 20 nt, Human
uucuauacauaucacugaaa

SEQ ID NO: 403132 - RNA, 22 nt, Human
aaguccuuucucauggaggaau

SEQ ID NO: 403133 - RNA, 22 nt, Human
uaauacagaaguguauuaaaau

SEQ ID NO: 403134 - RNA, 22 nt, Human
auauaacauacauacagaaaag

SEQ ID NO: 403135 - RNA, 22 nt, Human
ucuacccagagcuaugaccuga

SEQ ID NO: 403136 - RNA, 22 nt, Human
aucaggaucagggcuagcagag

SEQ ID NO: 403137 - RNA, 22 nt, Human
agaaccucuggauacaguuuaa

SEQ ID NO: 403138 - RNA, 22 nt, Human
cuugcuucauuagugucuuagu

SEQ ID NO: 403139 - RNA, 22 nt, Human
gagaggucaucucccaucagca

SEQ ID NO: 403140 - RNA, 22 nt, Human
uucagcaagaccaccauguacc

SEQ ID NO: 403141 - RNA, 22 nt, Human
aagauggaguaguguaaugguu

SEQ ID NO: 403142 - RNA, 22 nt, Human
ucugucccugagagcucaggag

SEQ ID NO: 403143 - RNA, 22 nt, Human
aauuccagcuaggaaaagcuuc

SEQ ID NO: 403144 - RNA, 22 nt, Human
aagcauuugguucugaagacuc

SEQ ID NO: 403145 - RNA, 22 nt, Human
gaggccaaucaauagggcaaua

SEQ ID NO: 403146 - RNA, 22 nt, Human
uucaauucugcucugaucuuag

SEQ ID NO: 403147 - RNA, 21 nt, Human
gauugaaaccauggcagugag

SEQ ID NO: 403148 - RNA, 22 nt, Human
uuugcaguagacaucuuauuuu

SEQ ID NO: 403149 - RNA, 22 nt, Human
uaauuucacaguucaacgcaca

SEQ ID NO: 403150 - RNA, 22 nt, Human
uucaggauuguguuuuuccuga

SEQ ID NO: 403151 - RNA, 22 nt, Human
auucuucacaaauauauagaag

SEQ ID NO: 403152 - RNA, 22 nt, Human
cuuauauuuuaggaacagacaa

SEQ ID NO: 403153 - RNA, 23 nt, Human
agaugagccaacaccuccaugcc

SEQ ID NO: 403154 - RNA, 21 nt, Human
ucauuuauugagaaaugacug

SEQ ID NO: 403155 - RNA, 22 nt, Human
uuauuuauggcccucaccugau

SEQ ID NO: 403156 - RNA, 22 nt, Human
cugcagagcuuucugaaugaag

SEQ ID NO: 403157 - RNA, 22 nt, Human
aagacaauuugauacuaguugc

SEQ ID NO: 403158 - RNA, 22 nt, Human
ucaaaaguggccuguaaaaucu

SEQ ID NO: 403159 - RNA, 22 nt, Human
agucaauucuuuucaacucaag

SEQ ID NO: 403160 - RNA, 22 nt, Human
caugguuuugagccuauuaugc

SEQ ID NO: 403161 - RNA, 22 nt, Human
agauggagaaugacaauuaagg

SEQ ID NO: 403162 - RNA, 22 nt, Human
uucugggagagaaagggccuug

SEQ ID NO: 403163 - RNA, 22 nt, Human
ucaggaugaccacgagccucua

SEQ ID NO: 403164 - RNA, 22 nt, Human
cauuuacagcagacugaugaaa

SEQ ID NO: 403165 - RNA, 22 nt, Human
uuugcaaagaaauuauugcugu

SEQ ID NO: 403166 - RNA, 21 nt, Human
ucacuagugccuucugucauu

SEQ ID NO: 403167 - RNA, 22 nt, Human
gcucaggaaauaguuuaguguu

SEQ ID NO: 403168 - RNA, 22 nt, Human
guacagaaaugugaugacgcaa

SEQ ID NO: 403169 - RNA, 22 nt, Human
cucaggaugcaauuccaucaag

SEQ ID NO: 403170 - RNA, 22 nt, Human
gagucaccacugugauagucga

SEQ ID NO: 403171 - RNA, 22 nt, Human
cagaccagcucuaugaacccaa

SEQ ID NO: 403172 - RNA, 22 nt, Human
ugcaggaaugagguucucaguu

SEQ ID NO: 403173 - RNA, 22 nt, Human
uguauacaggcauaagagauac

SEQ ID NO: 403174 - RNA, 22 nt, Human
cuucagaggggacucaaaguca

SEQ ID NO: 403175 - RNA, 22 nt, Human
uuucaagaacaacauucauuca

SEQ ID NO: 403176 - RNA, 18 nt, Human
aacaguuuccagauucuc

SEQ ID NO: 403177 - RNA, 22 nt, Human
ugcuuuaaccaucuuguuugga

SEQ ID NO: 403178 - RNA, 22 nt, Human
uucaggauuauacucucuuccc

SEQ ID NO: 403179 - RNA, 22 nt, Human
ucuccucucuuaccugguacaa

SEQ ID NO: 403180 - RNA, 22 nt, Human
aguucacagaauggccagaacu

SEQ ID NO: 403181 - RNA, 22 nt, Human
uucaaacacagacagcagcaug

SEQ ID NO: 403182 - RNA, 22 nt, Human
caguccuuucaauggugaccuu

SEQ ID NO: 403183 - RNA, 22 nt, Human
gaaggccauugcguccugggau

SEQ ID NO: 403184 - RNA, 22 nt, Human
aguuucaguucugucauuuaua

SEQ ID NO: 403185 - RNA, 22 nt, Human
auaggcuuauauaaaaacaucu

SEQ ID NO: 403186 - RNA, 22 nt, Human
uaccaaaaccaagccauuaucu

SEQ ID NO: 403187 - RNA, 22 nt, Human
guucuaauuuggggcuccuuag

SEQ ID NO: 403188 - RNA, 22 nt, Human
gcuccucugucaaaugagagug

SEQ ID NO: 403189 - RNA, 22 nt, Human
cuugggaaugcuaacagaugac

SEQ ID NO: 403190 - RNA, 22 nt, Human
gaacuguaguuaauacuacaca

SEQ ID NO: 403191 - RNA, 22 nt, Human
uucagaauauuuguuuuacaug

SEQ ID NO: 403192 - RNA, 22 nt, Human
cauagaaaguauuauggaauuu

SEQ ID NO: 403193 - RNA, 22 nt, Human
auggcuuugcucaaguuuagcc

SEQ ID NO: 403194 - RNA, 22 nt, Human
uauaagaaacaaggcaaauuuu

SEQ ID NO: 403195 - RNA, 22 nt, Human
aaagcagguugcaauuacagug

SEQ ID NO: 403196 - RNA, 22 nt, Human
uuugcagugauucuugcaguga

SEQ ID NO: 403197 - RNA, 19 nt, Human
ugaggggcucacagucuca

SEQ ID NO: 403198 - RNA, 22 nt, Human
guuaaauucgaugauggauaaa

SEQ ID NO: 403199 - RNA, 22 nt, Human
aucaggauagucuguaaauugu

SEQ ID NO: 403200 - RNA, 22 nt, Human
auaacaugaccugugcuucaca

SEQ ID NO: 403201 - RNA, 22 nt, Human
auuaggcauauaugcuuuuaau

SEQ ID NO: 403202 - RNA, 22 nt, Human
auacaacuuuaucuguaaugag

SEQ ID NO: 403203 - RNA, 22 nt, Human
auuucaacauucucaguuguag

SEQ ID NO: 403204 - RNA, 22 nt, Human
uuuuauagcugaauaguauucc

SEQ ID NO: 403205 - RNA, 22 nt, Human
ucugggaauuuauuggcacuuu

SEQ ID NO: 403206 - RNA, 22 nt, Human
uuugcaaagugacuauuauaug

SEQ ID NO: 403207 - RNA, 22 nt, Human
ugucaaauuuuuauugcaguau

SEQ ID NO: 403208 - RNA, 22 nt, Human
gcagaauuggauaguugugaua

SEQ ID NO: 403209 - RNA, 20 nt, Human
caauuucaucauuuccugug

SEQ ID NO: 403210 - RNA, 22 nt, Human
uuuaggcagcagugaggaugaa

SEQ ID NO: 403211 - RNA, 20 nt, Human
caguccaaucagaggccacc

SEQ ID NO: 403212 - RNA, 22 nt, Human
gaccauuucuaggaaucagacu

SEQ ID NO: 403213 - RNA, 22 nt, Human
uagaauucauguuacuguuagc

SEQ ID NO: 403214 - RNA, 22 nt, Human
cuuaaagaguauuuaauauaau

SEQ ID NO: 403215 - RNA, 22 nt, Human
ucagugugaguaccaugcucag

SEQ ID NO: 403216 - RNA, 22 nt, Human
uaauuuaugaugcaaagaaaag

SEQ ID NO: 403217 - RNA, 22 nt, Human
acaacuuuucuaucauguggaa

SEQ ID NO: 403218 - RNA, 22 nt, Human
aaaggccaccaacaugaagcau

SEQ ID NO: 403219 - RNA, 22 nt, Human
aaaauuauggaguaucccaaag

SEQ ID NO: 403220 - RNA, 22 nt, Human
aaauuucaguuaccuuuacguu

SEQ ID NO: 403221 - RNA, 22 nt, Human
gagaagguggaccugaaggagc

SEQ ID NO: 403222 - RNA, 22 nt, Human
agaagucaaguggucuaugaaa

SEQ ID NO: 403223 - RNA, 22 nt, Human
cuugcacacauguacaugugua

SEQ ID NO: 403224 - RNA, 22 nt, Human
cauuaauauuguucuucuuuag

SEQ ID NO: 403225 - RNA, 22 nt, Human
ucaguuuccucaucuacaaaag

SEQ ID NO: 403226 - RNA, 22 nt, Human
aguguucauuuauucauucacu

SEQ ID NO: 403227 - RNA, 22 nt, Human
cauuuguauagugcuuagacca

SEQ ID NO: 403228 - RNA, 22 nt, Human
ucauuucucccggccaaaaacu

SEQ ID NO: 403229 - RNA, 22 nt, Human
caugcuuuuuucuaguauaaau

SEQ ID NO: 403230 - RNA, 22 nt, Human
auagaaauggcagcuggugcua

SEQ ID NO: 403231 - RNA, 22 nt, Human
uuugaaagcaggugugggaggg

SEQ ID NO: 403232 - RNA, 22 nt, Human
uuugaaagcaccauuugaguag

SEQ ID NO: 403233 - RNA, 22 nt, Human
ccaugagccaggcugaggaagc

SEQ ID NO: 403234 - RNA, 22 nt, Human
aguuacagugaccauuuauuua

SEQ ID NO: 403235 - RNA, 22 nt, Human
uggaaauguauuugggcaugcc

SEQ ID NO: 403236 - RNA, 22 nt, Human
uuagccauggacugaauugacu

SEQ ID NO: 403237 - RNA, 22 nt, Human
aagaaaucugauauuuguuuca

SEQ ID NO: 403238 - RNA, 22 nt, Human
gauggcuucacuuacauggcug

SEQ ID NO: 403239 - RNA, 22 nt, Human
caucagucuagauucuaguacc

SEQ ID NO: 403240 - RNA, 22 nt, Human
uacuagaaccucacaacaaucc

SEQ ID NO: 403241 - RNA, 22 nt, Human
aaucuguuuaguucugcguaug

SEQ ID NO: 403242 - RNA, 22 nt, Human
uaaaaugacuuccuccaacauc

SEQ ID NO: 403243 - RNA, 22 nt, Human
gucaggaugacaagugcuuuca

SEQ ID NO: 403244 - RNA, 22 nt, Human
uuccaugaaauguguuaugcuu

SEQ ID NO: 403245 - RNA, 22 nt, Human
uuuucaguaaugucuacauaau

SEQ ID NO: 403246 - RNA, 22 nt, Human
auauuucaugggguuccauacu

SEQ ID NO: 403247 - RNA, 22 nt, Human
uuccaugaaagugaaauggagc

SEQ ID NO: 403248 - RNA, 22 nt, Human
uacauaguauucacauuguuuu

SEQ ID NO: 403249 - RNA, 22 nt, Human
auacaacuuuacaugcaauucc

SEQ ID NO: 403250 - RNA, 22 nt, Human
uuacaagauuaauuauuggagu

SEQ ID NO: 403251 - RNA, 22 nt, Human
agacugaauaacaagcaaauaa

SEQ ID NO: 403252 - RNA, 22 nt, Human
ggauggcaggacaaggacccag

SEQ ID NO: 403253 - RNA, 22 nt, Human
auauacugaggagacuuuauau

SEQ ID NO: 403254 - RNA, 22 nt, Human
ugcagucuccaccuccugggug

SEQ ID NO: 403255 - RNA, 22 nt, Human
uuucaguuagcugagacccagg

SEQ ID NO: 403256 - RNA, 22 nt, Human
aacaugcuuugauaaauaaaag

SEQ ID NO: 403257 - RNA, 22 nt, Human
gauggcagcagcagccagggau

SEQ ID NO: 403258 - RNA, 22 nt, Human
uucugaaagccaauucauugaa

SEQ ID NO: 403259 - RNA, 22 nt, Human
agucaaaugaguaaauauauaa

SEQ ID NO: 403260 - RNA, 22 nt, Human
ccucaggaaccacauugcugcu

SEQ ID NO: 403261 - RNA, 22 nt, Human
aguguguccagaaaucuguauu

SEQ ID NO: 403262 - RNA, 22 nt, Human
caacauuucaaggucuuuagga

SEQ ID NO: 403263 - RNA, 22 nt, Human
gcacaauaauucuuguuuugcu

SEQ ID NO: 403264 - RNA, 22 nt, Human
aauaauuagugggacagagaac

SEQ ID NO: 403265 - RNA, 22 nt, Human
ugcuuauugcuuucaagacugu

SEQ ID NO: 403266 - RNA, 22 nt, Human
acagccaggaggaacucaguga

SEQ ID NO: 403267 - RNA, 22 nt, Human
caaauagugucacauugugagg

SEQ ID NO: 403268 - RNA, 18 nt, Human
uaaauauauuucccccuu

SEQ ID NO: 403269 - RNA, 22 nt, Human
uuuccaaaggaggaaccaguuu

SEQ ID NO: 403270 - RNA, 22 nt, Human
auuucccaugugaaucaauugg

SEQ ID NO: 403271 - RNA, 22 nt, Human
ccacagagcauuagauuucaga

SEQ ID NO: 403272 - RNA, 22 nt, Human
cauuucaauacuaucugagaau

SEQ ID NO: 403273 - RNA, 22 nt, Human
uaggcagaauuguugaaugaag

SEQ ID NO: 403274 - RNA, 22 nt, Human
gaaugaaagauuugcauucuau

SEQ ID NO: 403275 - RNA, 22 nt, Human
gauaaaauaacuauggaauacu

SEQ ID NO: 403276 - RNA, 22 nt, Human
ccuggaucuuuguuguaaauau

SEQ ID NO: 403277 - RNA, 22 nt, Human
ccaagaugaucuuuacaguguu

SEQ ID NO: 403278 - RNA, 22 nt, Human
auuuccaauuucauccaugucc

SEQ ID NO: 403279 - RNA, 22 nt, Human
cauuguuaccaucuuuuaccua

SEQ ID NO: 403280 - RNA, 22 nt, Human
aauguucauugauuaaaugaau

SEQ ID NO: 403281 - RNA, 22 nt, Human
uuuauuauguacaggcacuaua

SEQ ID NO: 403282 - RNA, 22 nt, Human
aucaggauucaccccagagcug

SEQ ID NO: 403283 - RNA, 22 nt, Human
uagaaaucagcaggcauaugua

SEQ ID NO: 403284 - RNA, 22 nt, Human
uuaauucuaguuuaacacuuag

SEQ ID NO: 403285 - RNA, 22 nt, Human
aaaugcuuauuagugucacaaa

SEQ ID NO: 403286 - RNA, 17 nt, Human
aggccagaugaggcaag

SEQ ID NO: 403287 - RNA, 22 nt, Human
auccaaacauguaccacacuaa

SEQ ID NO: 403288 - RNA, 22 nt, Human
gugauuuagauguugaaaguga

SEQ ID NO: 403289 - RNA, 22 nt, Human
aaacuuuggauugugauugugc

SEQ ID NO: 403290 - RNA, 22 nt, Human
aagcuggagaguuaggugaaua

SEQ ID NO: 403291 - RNA, 22 nt, Human
uacuuucuguccuucuguuaaa

SEQ ID NO: 403292 - RNA, 22 nt, Human
ucuuagcauuucauaacaacug

SEQ ID NO: 403293 - RNA, 22 nt, Human
uuaacacuaucugucauaauua

SEQ ID NO: 403294 - RNA, 22 nt, Human
ugaaagcacaaguucuaacagg

SEQ ID NO: 403295 - RNA, 22 nt, Human
uuuuuguagucauuagaagagg

SEQ ID NO: 403296 - RNA, 22 nt, Human
caauuucagguggauagguuuu

SEQ ID NO: 403297 - RNA, 22 nt, Human
gcaaacaagcugccugaagauu

SEQ ID NO: 403298 - RNA, 22 nt, Human
uuaugauuugccacagauuggu

SEQ ID NO: 403299 - RNA, 22 nt, Human
uuucuagucucgaucucuuaau

SEQ ID NO: 403300 - RNA, 22 nt, Human
uucuucuugaaacuuuagguug

SEQ ID NO: 403301 - RNA, 22 nt, Human
aaggccaacuaggaugagcuag

SEQ ID NO: 403302 - RNA, 19 nt, Human
auacagauguauccaugau

SEQ ID NO: 403303 - RNA, 22 nt, Human
aaagacauggaacuagagaugg

SEQ ID NO: 403304 - RNA, 22 nt, Human
ccauggcuuuugagucucaaga

SEQ ID NO: 403305 - RNA, 22 nt, Human
uggcauuugggcuggcuuuucu

SEQ ID NO: 403306 - RNA, 22 nt, Human
ucaguucaguauacacuauucu

SEQ ID NO: 403307 - RNA, 22 nt, Human
uucuuuugggaauuacguaugc

SEQ ID NO: 403308 - RNA, 17 nt, Human
acagagcacaucaagau

SEQ ID NO: 403309 - RNA, 23 nt, Human
cauuucaacgaauuuuccuucug

SEQ ID NO: 403310 - RNA, 22 nt, Human
uguacaaugccagggaacacca

SEQ ID NO: 403311 - RNA, 22 nt, Human
cacccagugaaggagcaagagg

SEQ ID NO: 403312 - RNA, 23 nt, Human
uuucuucagaagccuugcgaggc

SEQ ID NO: 403313 - RNA, 22 nt, Human
aaaucaguuggaacacaagcag

SEQ ID NO: 403314 - RNA, 22 nt, Human
uguucuucuagauugccuuuua

SEQ ID NO: 403315 - RNA, 22 nt, Human
aagaaugauuacaaagcaacga

SEQ ID NO: 403316 - RNA, 22 nt, Human
cuuucaacuacauacaggcgau

SEQ ID NO: 403317 - RNA, 18 nt, Human
ugaaacaagaauggugca

SEQ ID NO: 403318 - RNA, 22 nt, Human
ugauaauauuuugaaucauaag

SEQ ID NO: 403319 - RNA, 22 nt, Human
aauuaaaugacaggggaagaug

SEQ ID NO: 403320 - RNA, 22 nt, Human
uuuaggcaaauuucagaugugc

SEQ ID NO: 403321 - RNA, 22 nt, Human
agucaccaacaugguucccagg

SEQ ID NO: 403322 - RNA, 22 nt, Human
uggaagggagugacagucagag

SEQ ID NO: 403323 - RNA, 16 nt, Human
gcaacuuugggguuga

SEQ ID NO: 403324 - RNA, 19 nt, Human
uacauacuuauucuaaaag

SEQ ID NO: 403325 - RNA, 22 nt, Human
auuguuaugaaaauaagauguu

SEQ ID NO: 403326 - RNA, 22 nt, Human
uaagaacuucggacauguuauc

SEQ ID NO: 403327 - RNA, 22 nt, Human
gaccuggaggauccucuucuug

SEQ ID NO: 403328 - RNA, 22 nt, Human
aggauuuagcaugaaaugugaa

SEQ ID NO: 403329 - RNA, 22 nt, Human
ucacacagguuugcaaugauuu

SEQ ID NO: 403330 - RNA, 22 nt, Human
auuuugaugcuaucuaaugaau

SEQ ID NO: 403331 - RNA, 22 nt, Human
uuucaguuacugcuauaucauu

SEQ ID NO: 403332 - RNA, 22 nt, Human
auaaagauuucuuuuucucuac

SEQ ID NO: 403333 - RNA, 22 nt, Human
ccaaagcaagucacaugaucaa

SEQ ID NO: 403334 - RNA, 22 nt, Human
aauuuauauguaauuaggcaca

SEQ ID NO: 403335 - RNA, 23 nt, Human
cagaaaucugaaaucuagaaaug

SEQ ID NO: 403336 - RNA, 22 nt, Human
ucaggaugguccuuuaugagaa

SEQ ID NO: 403337 - RNA, 22 nt, Human
aauaauuuuagcucagaguugu

SEQ ID NO: 403338 - RNA, 22 nt, Human
aagcgccaugguuccugcgcag

SEQ ID NO: 403339 - RNA, 22 nt, Human
uuucaacuugaagaauugauac

SEQ ID NO: 403340 - RNA, 22 nt, Human
uuuaaaauuuagaccucuccac

SEQ ID NO: 403341 - RNA, 22 nt, Human
uagucaccuguugugugaugcc

SEQ ID NO: 403342 - RNA, 22 nt, Human
acuucaugcagaagagagcugu

SEQ ID NO: 403343 - RNA, 22 nt, Human
auucacaaaaugauauagauac

SEQ ID NO: 403344 - RNA, 22 nt, Human
uuucacauuuaggcgugaauug

SEQ ID NO: 403345 - RNA, 22 nt, Human
ucaauaaauagcuuggcucagc

SEQ ID NO: 403346 - RNA, 22 nt, Human
gcucaggaucagccaccucuuu

SEQ ID NO: 403347 - RNA, 22 nt, Human
ugaaagggguugaguuacagcu

SEQ ID NO: 403348 - RNA, 22 nt, Human
uuucaacauauaccauaaugcc

SEQ ID NO: 403349 - RNA, 22 nt, Human
uggcuuaagauuuaugcuuuua

SEQ ID NO: 403350 - RNA, 22 nt, Human
gaauuucacaaggugaggauaa

SEQ ID NO: 403351 - RNA, 22 nt, Human
ucaauaauggcaggauaaauuu

SEQ ID NO: 403352 - RNA, 22 nt, Human
uuauacuaaaacgcauugaauu

SEQ ID NO: 403353 - RNA, 22 nt, Human
acacaaugcauauuuuuccaga

SEQ ID NO: 403354 - RNA, 22 nt, Human
cuuaauuuuuguaguagaugga

SEQ ID NO: 403355 - RNA, 22 nt, Human
aggccagacagcuagaaacagg

SEQ ID NO: 403356 - RNA, 22 nt, Human
aaagucauacauggugcuuacu

SEQ ID NO: 403357 - RNA, 22 nt, Human
uucuacaauaugaauaaugaag

SEQ ID NO: 403358 - RNA, 22 nt, Human
aaaggcaggcuuucacaucuca

SEQ ID NO: 403359 - RNA, 19 nt, Human
ugaaauggcaguugcuaaa

SEQ ID NO: 403360 - RNA, 18 nt, Human
uauaaacacacuuagguu

SEQ ID NO: 403361 - RNA, 22 nt, Human
uaugcccagcuuaaaguacaca

SEQ ID NO: 403362 - RNA, 22 nt, Human
ugcugugagguugagaaggaag

SEQ ID NO: 403363 - RNA, 22 nt, Human
cacauuuagagguuagcauggu

SEQ ID NO: 403364 - RNA, 22 nt, Human
gaaggccaguuuugagauaggu

SEQ ID NO: 403365 - RNA, 22 nt, Human
aucaggauggguuuggcuuagg

SEQ ID NO: 403366 - RNA, 23 nt, Human
aaauuauugcucuucaauugccu

SEQ ID NO: 403367 - RNA, 22 nt, Human
uaauuauuugaagacauuagag

SEQ ID NO: 403368 - RNA, 22 nt, Human
gaagcacauggcuauagcuauu

SEQ ID NO: 403369 - RNA, 19 nt, Human
uuugcagugguuccuuugu

SEQ ID NO: 403370 - RNA, 19 nt, Human
gaaagucauagagcuuguc

SEQ ID NO: 403371 - RNA, 22 nt, Human
uuugaagauuaugccagaguga

SEQ ID NO: 403372 - RNA, 22 nt, Human
caguccuugcucugggaugaug

SEQ ID NO: 403373 - RNA, 22 nt, Human
augguuuacugaucuuuuuggu

SEQ ID NO: 403374 - RNA, 22 nt, Human
aucugccuccaaguccaugugu

SEQ ID NO: 403375 - RNA, 22 nt, Human
ugcuuauuuauagucaauagag

SEQ ID NO: 403376 - RNA, 22 nt, Human
aagcaauagcaacaacuuuaca

SEQ ID NO: 403377 - RNA, 22 nt, Human
aucuuucaaucaggaaaaaucu

SEQ ID NO: 403378 - RNA, 22 nt, Human
caaggccacuccagagacuggu

SEQ ID NO: 403379 - RNA, 22 nt, Human
gagucaccuugggucagcgaua

SEQ ID NO: 403380 - RNA, 22 nt, Human
acagaacugggggcacagauag

SEQ ID NO: 403381 - RNA, 22 nt, Human
cagcuucugcuaucgaacaucu

SEQ ID NO: 403382 - RNA, 23 nt, Human
ucguugaauagcaauagcacaac

SEQ ID NO: 403383 - RNA, 22 nt, Human
uacuaaauaguuuaauuccuca

SEQ ID NO: 403384 - RNA, 22 nt, Human
caaacauucaaguacaagucuu

SEQ ID NO: 403385 - RNA, 22 nt, Human
caagaaucuugcagcuuagacu

SEQ ID NO: 403386 - RNA, 22 nt, Human
acaugucuuuuaaagucuaaua

SEQ ID NO: 403387 - RNA, 20 nt, Human
uuuuccagaaaguaucauug

SEQ ID NO: 403388 - RNA, 21 nt, Human
uucuucuuggacuguuuuggc

SEQ ID NO: 403389 - RNA, 22 nt, Human
auuccaaaggcuggccuggagg

SEQ ID NO: 403390 - RNA, 22 nt, Human
cagagaaaaaauccugcucuca

SEQ ID NO: 403391 - RNA, 22 nt, Human
ggcgcacaaugugcagguuugu

SEQ ID NO: 403392 - RNA, 22 nt, Human
uaaagccaacacuuuacugcuc

SEQ ID NO: 403393 - RNA, 22 nt, Human
uaagcugugggagauuggcaua

SEQ ID NO: 403394 - RNA, 22 nt, Human
aaagucauugcuguuaucaaug

SEQ ID NO: 403395 - RNA, 22 nt, Human
aauuauccuuaaugcaguaagc

SEQ ID NO: 403396 - RNA, 21 nt, Human
gcugcaucaaucuacccaggg

SEQ ID NO: 403397 - RNA, 22 nt, Human
auugaaagcacaaagaacaagu

SEQ ID NO: 403398 - RNA, 22 nt, Human
acagaauuaucaggaaauguua

SEQ ID NO: 403399 - RNA, 22 nt, Human
guucuucagucacaucacagaa

SEQ ID NO: 403400 - RNA, 22 nt, Human
ucucccaggcugcccuguggac

SEQ ID NO: 403401 - RNA, 22 nt, Human
uggcaucucaaacaggcagauu

SEQ ID NO: 403402 - RNA, 22 nt, Human
aagauuauuuaagacaggaacc

SEQ ID NO: 403403 - RNA, 19 nt, Human
aaucagaaauaucgaggcc

SEQ ID NO: 403404 - RNA, 22 nt, Human
uuacagaaugugccauuugguc

SEQ ID NO: 403405 - RNA, 22 nt, Human
ggauggcauguugggcucuguu

SEQ ID NO: 403406 - RNA, 22 nt, Human
uuuguuaauucuuauguuagag

SEQ ID NO: 403407 - RNA, 22 nt, Human
caaaacugucuagagagagaag

SEQ ID NO: 403408 - RNA, 22 nt, Human
uaguuuuacuugcgaugauaau

SEQ ID NO: 403409 - RNA, 22 nt, Human
gucaggauuauaauccccaugg

SEQ ID NO: 403410 - RNA, 22 nt, Human
augugcuuguaauguuaaaugu

SEQ ID NO: 403411 - RNA, 22 nt, Human
gugguaauuuaauccuacacug

SEQ ID NO: 403412 - RNA, 22 nt, Human
caauauauaaugaguacuuucc

SEQ ID NO: 403413 - RNA, 21 nt, Human
agaagucaauugaacugaaau

SEQ ID NO: 403414 - RNA, 21 nt, Human
ugaaagaaggugcagucugaa

SEQ ID NO: 403415 - RNA, 22 nt, Human
gcuggaucccugugggaguggu

SEQ ID NO: 403416 - RNA, 22 nt, Human
uuuuccaaaguaccaugucccu

SEQ ID NO: 403417 - RNA, 22 nt, Human
uaucagaagacuuacaguaucg

SEQ ID NO: 403418 - RNA, 22 nt, Human
uuugacauggaauaacucauuu

SEQ ID NO: 403419 - RNA, 22 nt, Human
uuggcuucuucgcacagcagua

SEQ ID NO: 403420 - RNA, 22 nt, Human
uuuggacuuagccugcagaauu

SEQ ID NO: 403421 - RNA, 22 nt, Human
aaaggcaugauuaauucugugu

SEQ ID NO: 403422 - RNA, 22 nt, Human
aucuacccacugaacacaauau

SEQ ID NO: 403423 - RNA, 22 nt, Human
gugaauaauuuuuuaguauaag

SEQ ID NO: 403424 - RNA, 22 nt, Human
auuaaagacagcagauggaugg

SEQ ID NO: 403425 - RNA, 22 nt, Human
agaagucaauaguuguuugaug

SEQ ID NO: 403426 - RNA, 22 nt, Human
ugaaacauuugaugaucuuugg

SEQ ID NO: 403427 - RNA, 22 nt, Human
ugaaauaggaaacagauguuuc

SEQ ID NO: 403428 - RNA, 22 nt, Human
uggcuucuugggaugggucauu

SEQ ID NO: 403429 - RNA, 22 nt, Human
aauacaguagguaauaguucau

SEQ ID NO: 403430 - RNA, 22 nt, Human
augaaauaucuugaagaaauuc

SEQ ID NO: 403431 - RNA, 22 nt, Human
ccugccugcaccuucucugggg

SEQ ID NO: 403432 - RNA, 22 nt, Human
ugcacaaacuugugucccaggg

SEQ ID NO: 403433 - RNA, 22 nt, Human
auugaaagcauggauuuggauu

SEQ ID NO: 403434 - RNA, 22 nt, Human
auggcuuaugaauaacaguagg

SEQ ID NO: 403435 - RNA, 22 nt, Human
uugcagcuuagugauguuaucu

SEQ ID NO: 403436 - RNA, 22 nt, Human
uuugaaguggaaaaggauuuaa

SEQ ID NO: 403437 - RNA, 22 nt, Human
uuauagaaggagcauucacuua

SEQ ID NO: 403438 - RNA, 23 nt, Human
cauaaaauauuaguaugguagca

SEQ ID NO: 403439 - RNA, 23 nt, Human
uuuuccagaaucgacucuguaga

SEQ ID NO: 403440 - RNA, 22 nt, Human
ucuucauuccguagauauuuau

SEQ ID NO: 403441 - RNA, 22 nt, Human
uuuaggcagaacauggacuuug

SEQ ID NO: 403442 - RNA, 22 nt, Human
uauauaacuacuauuuugcuca

SEQ ID NO: 403443 - RNA, 22 nt, Human
caagaaucaacauuauuuagug

SEQ ID NO: 403444 - RNA, 22 nt, Human
acaacuuuguagcaauuccacg

SEQ ID NO: 403445 - RNA, 22 nt, Human
gauagaaagaauauagauucca

SEQ ID NO: 403446 - RNA, 22 nt, Human
cucacuguuuaauagcuggauc

SEQ ID NO: 403447 - RNA, 22 nt, Human
aaaggagacuucagaucuccuu

SEQ ID NO: 403448 - RNA, 22 nt, Human
uaaagacaugguguaggugaac

SEQ ID NO: 403449 - RNA, 22 nt, Human
aucagaaauugcuaccagugga

SEQ ID NO: 403450 - RNA, 22 nt, Human
caucagaacgugagcuccuugu

SEQ ID NO: 403451 - RNA, 22 nt, Human
auggcuuuccugggacaugggc

SEQ ID NO: 403452 - RNA, 22 nt, Human
agucaauuaucucuaggucauc

SEQ ID NO: 403453 - RNA, 22 nt, Human
aaagaaggaugggagaaauccu

SEQ ID NO: 403454 - RNA, 22 nt, Human
cacaaugugguuugucaucuuu

SEQ ID NO: 403455 - RNA, 22 nt, Human
uuuguaaaggccugaauuucag

SEQ ID NO: 403456 - RNA, 22 nt, Human
acacagauuuuacauguuaugc

SEQ ID NO: 403457 - RNA, 22 nt, Human
gcguuaauaacauuaauaaugc

SEQ ID NO: 403458 - RNA, 22 nt, Human
auucuucagaauaucuggcacu

SEQ ID NO: 403459 - RNA, 22 nt, Human
uuaacacuugaacucuacaugu

SEQ ID NO: 403460 - RNA, 21 nt, Human
cuguggaagggaacuagaggg

SEQ ID NO: 403461 - RNA, 22 nt, Human
uuucaacuagccccuaaguccu

SEQ ID NO: 403462 - RNA, 22 nt, Human
uacuaucucuucuaacuucaga

SEQ ID NO: 403463 - RNA, 22 nt, Human
uugauacaggcucuauuucauc

SEQ ID NO: 403464 - RNA, 22 nt, Human
aaaacugaaauacgauccaaug

SEQ ID NO: 403465 - RNA, 22 nt, Human
caucagaauguuauggggggcu

SEQ ID NO: 403466 - RNA, 22 nt, Human
aagacagugacagucacaauug

SEQ ID NO: 403467 - RNA, 22 nt, Human
ugacccauggucugaucauagg

SEQ ID NO: 403468 - RNA, 22 nt, Human
caguccuugauccaauaguggg

SEQ ID NO: 403469 - RNA, 21 nt, Human
auagaacaccaggcauauaua

SEQ ID NO: 403470 - RNA, 22 nt, Human
aggauuuaucaggaacucucuu

SEQ ID NO: 403471 - RNA, 22 nt, Human
ucauuuuucacacagggucacc

SEQ ID NO: 403472 - RNA, 22 nt, Human
aucugccugcaguggagguggg

SEQ ID NO: 403473 - RNA, 17 nt, Human
aaucagauuucugagga

SEQ ID NO: 403474 - RNA, 22 nt, Human
uuaaauauuauguugucugcaa

SEQ ID NO: 403475 - RNA, 22 nt, Human
auggcuuuucacagaggguucu

SEQ ID NO: 403476 - RNA, 22 nt, Human
uucaacacaggaacaugauaua

SEQ ID NO: 403477 - RNA, 22 nt, Human
gugcauuuaggucacaugaugu

SEQ ID NO: 403478 - RNA, 22 nt, Human
uucaacucuucaagaucacauc

SEQ ID NO: 403479 - RNA, 22 nt, Human
cagauuucuauuucaaauacau

SEQ ID NO: 403480 - RNA, 22 nt, Human
uuuaauacuauggggaugaaca

SEQ ID NO: 403481 - RNA, 22 nt, Human
augaacaaguauuugcaugagc

SEQ ID NO: 403482 - RNA, 22 nt, Human
uuccaagaguaaauucaaauug

SEQ ID NO: 403483 - RNA, 22 nt, Human
auccaaaggugacacagaauac

SEQ ID NO: 403484 - RNA, 22 nt, Human
auggcauuauagcaaugguuug

SEQ ID NO: 403485 - RNA, 19 nt, Human
gaaguccucuaguaaauuu

SEQ ID NO: 403486 - RNA, 22 nt, Human
aaguggacuaauacaaggacua

SEQ ID NO: 403487 - RNA, 22 nt, Human
auauaauuguucugaaguguuu

SEQ ID NO: 403488 - RNA, 22 nt, Human
aaauccuuuucuauacagcaua

SEQ ID NO: 403489 - RNA, 19 nt, Human
cuauacagccucugaggaa

SEQ ID NO: 403490 - RNA, 22 nt, Human
uuaggaaaggguuuucuaacag

SEQ ID NO: 403491 - RNA, 21 nt, Human
caaguccuuugccaaagugcu

SEQ ID NO: 403492 - RNA, 22 nt, Human
aguuuucacacucaccaaaagg

SEQ ID NO: 403493 - RNA, 22 nt, Human
caucagaauuacuuggggagcu

SEQ ID NO: 403494 - RNA, 22 nt, Human
uguuuuaaucucccauugcucu

SEQ ID NO: 403495 - RNA, 22 nt, Human
ucuuaaagagcgcaauuugagg

SEQ ID NO: 403496 - RNA, 22 nt, Human
uauuuucuggacagucuugcuu

SEQ ID NO: 403497 - RNA, 22 nt, Human
aaauugcagaugcuaaaugacu

SEQ ID NO: 403498 - RNA, 22 nt, Human
acuuugaaacuaaaauucauua

SEQ ID NO: 403499 - RNA, 22 nt, Human
uccaugagcuagggauucauca

SEQ ID NO: 403500 - RNA, 22 nt, Human
uaaaaugcacagcaguugaaag

SEQ ID NO: 403501 - RNA, 22 nt, Human
uagaugcuacaauuuuguacuc

SEQ ID NO: 403502 - RNA, 22 nt, Human
uugauguacagaauuguucaca

SEQ ID NO: 403503 - RNA, 23 nt, Human
uggaauaauaagguacauuaaca

SEQ ID NO: 403504 - RNA, 22 nt, Human
auuucauagauuguaaaucccu

SEQ ID NO: 403505 - RNA, 22 nt, Human
augaaaauugacagcggaagua

SEQ ID NO: 403506 - RNA, 22 nt, Human
uggggcuccuccuggcaggagg

SEQ ID NO: 403507 - RNA, 22 nt, Human
uccaugaggaccaaauucguag

SEQ ID NO: 403508 - RNA, 22 nt, Human
cauuuguaggaugcuucuuguu

SEQ ID NO: 403509 - RNA, 21 nt, Human
ucacaucuauguuaagcaaac

SEQ ID NO: 403510 - RNA, 22 nt, Human
gaugccucuuuuggcugaauua

SEQ ID NO: 403511 - RNA, 22 nt, Human
uggauuuaguucuucacaggcc

SEQ ID NO: 403512 - RNA, 22 nt, Human
cucaggauggaagccuacagga

SEQ ID NO: 403513 - RNA, 22 nt, Human
aauaagauccugaagauauguu

SEQ ID NO: 403514 - RNA, 22 nt, Human
acaccauacucauguugguucc

SEQ ID NO: 403515 - RNA, 22 nt, Human
aauuucaauuacuuuugcacca

SEQ ID NO: 403516 - RNA, 22 nt, Human
aaaaccugauugaauucuauuu

SEQ ID NO: 403517 - RNA, 22 nt, Human
uauggcuugucuuuauaccagg

SEQ ID NO: 403518 - RNA, 22 nt, Human
ucagccaggccaccuucagcuu

SEQ ID NO: 403519 - RNA, 19 nt, Human
ugcugaaguugucagucug

SEQ ID NO: 403520 - RNA, 22 nt, Human
ucagagagccucaggcacugcc

SEQ ID NO: 403521 - RNA, 22 nt, Human
ugcaggaacuugguuuuacuca

SEQ ID NO: 403522 - RNA, 22 nt, Human
ucuuuccauggccacacagucu

SEQ ID NO: 403523 - RNA, 22 nt, Human
uucucuuugacauuauucaggu

SEQ ID NO: 403524 - RNA, 22 nt, Human
caggaaacauaugugcuugagg

SEQ ID NO: 403525 - RNA, 22 nt, Human
gcaucuaaauaaacgugggagu

SEQ ID NO: 403526 - RNA, 22 nt, Human
uguauuaacauuaauaaaaugg

SEQ ID NO: 403527 - RNA, 18 nt, Human
caagaaucucuaaagaag

SEQ ID NO: 403528 - RNA, 22 nt, Human
uuucuuguaagauguuuauuaa

SEQ ID NO: 403529 - RNA, 22 nt, Human
cuuaaauucuuaaugcccucau

SEQ ID NO: 403530 - RNA, 22 nt, Human
ccagaagaccccguccaccucc

SEQ ID NO: 403531 - RNA, 22 nt, Human
ucauuucccuccuacaaagagg

SEQ ID NO: 403532 - RNA, 22 nt, Human
uguugagacugagggagucagc

SEQ ID NO: 403533 - RNA, 22 nt, Human
auacaucaugcuccauauauuu

SEQ ID NO: 403534 - RNA, 20 nt, Human
gaaguccuuucacucuuccc

SEQ ID NO: 403535 - RNA, 22 nt, Human
uaaucuaccacuauugcaauau

SEQ ID NO: 403536 - RNA, 22 nt, Human
cauuuucagcacccaucugaaa

SEQ ID NO: 403537 - RNA, 22 nt, Human
aaaaccuucagguuuggaguuu

SEQ ID NO: 403538 - RNA, 22 nt, Human
uacaucauaauaauacuuagaa

SEQ ID NO: 403539 - RNA, 22 nt, Human
gucuucaauagagccucaauuu

SEQ ID NO: 403540 - RNA, 22 nt, Human
gguacaaugucuuacagaccca

SEQ ID NO: 403541 - RNA, 22 nt, Human
ugcuauacauguacauauuagu

SEQ ID NO: 403542 - RNA, 22 nt, Human
acagaaauugggcaaauggaag

SEQ ID NO: 403543 - RNA, 22 nt, Human
gugaauaaagggaguuuucaaa

SEQ ID NO: 403544 - RNA, 22 nt, Human
ucaucugucccaggcuuuuuuc

SEQ ID NO: 403545 - RNA, 22 nt, Human
guuccaaacaagucauaaagua

SEQ ID NO: 403546 - RNA, 22 nt, Human
acaucucaugaaugauaaauca

SEQ ID NO: 403547 - RNA, 22 nt, Human
auguuucauuuagauaucaggc

SEQ ID NO: 403548 - RNA, 20 nt, Human
cuucuucagccuaugcuuca

SEQ ID NO: 403549 - RNA, 22 nt, Human
cagaucuguaguaaaagaucuc

SEQ ID NO: 403550 - RNA, 22 nt, Human
uagaauucaagauucaacaggc

SEQ ID NO: 403551 - RNA, 22 nt, Human
uugaucaucuaagaguaauagu

SEQ ID NO: 403552 - RNA, 22 nt, Human
aaaguucaugguguuauagaaa

SEQ ID NO: 403553 - RNA, 22 nt, Human
cuucuucagcacaauauugaug

SEQ ID NO: 403554 - RNA, 22 nt, Human
aaaaggcauggagguugauagu

SEQ ID NO: 403555 - RNA, 22 nt, Human
ucagaauucagagggagugggg

SEQ ID NO: 403556 - RNA, 22 nt, Human
auucuucauacagacaaguccu

SEQ ID NO: 403557 - RNA, 22 nt, Human
acaaauauuuacugaauccacu

SEQ ID NO: 403558 - RNA, 22 nt, Human
ucacuucacacccacuaucaug

SEQ ID NO: 403559 - RNA, 22 nt, Human
aguacaauuuaaugaagauagc

SEQ ID NO: 403560 - RNA, 23 nt, Human
acagacaacacugaugagagaaa

SEQ ID NO: 403561 - RNA, 22 nt, Human
uucaggauucucucccauuuac

SEQ ID NO: 403562 - RNA, 22 nt, Human
caaugucaugauuuuccauuag

SEQ ID NO: 403563 - RNA, 22 nt, Human
uucugaaaauugggucauacuu

SEQ ID NO: 403564 - RNA, 22 nt, Human
cucaggauagauuguccucuca

SEQ ID NO: 403565 - RNA, 22 nt, Human
ugguuuaauuuccauuuccuug

SEQ ID NO: 403566 - RNA, 22 nt, Human
aggcacaguuucauccccgggc

SEQ ID NO: 403567 - RNA, 22 nt, Human
gcaguucuacuuauccauagac

SEQ ID NO: 403568 - RNA, 22 nt, Human
aaauacagaguugcuuaaaagc

SEQ ID NO: 403569 - RNA, 22 nt, Human
caguuucuacgaaggucaaccc

SEQ ID NO: 403570 - RNA, 22 nt, Human
auuuccaagaaagcuuuaggau

SEQ ID NO: 403571 - RNA, 22 nt, Human
agaaaauauucauugagaggcu

SEQ ID NO: 403572 - RNA, 22 nt, Human
uuuucagaggccuaagagguuu

SEQ ID NO: 403573 - RNA, 22 nt, Human
caauuucacuaauaauauuuac

SEQ ID NO: 403574 - RNA, 21 nt, Human
uuucagaccuaucuuugaagg

SEQ ID NO: 403575 - RNA, 22 nt, Human
auuaggcagggcaugguggcuc

SEQ ID NO: 403576 - RNA, 22 nt, Human
aggauuuaaauccuuaaccacu

SEQ ID NO: 403577 - RNA, 22 nt, Human
agaaaucaugucuuauuucuau

SEQ ID NO: 403578 - RNA, 20 nt, Human
uuucugugcccaggucuguu

SEQ ID NO: 403579 - RNA, 22 nt, Human
ugaaugaauccuaacaaagaca

SEQ ID NO: 403580 - RNA, 22 nt, Human
auuaugcugguuuacacauuuu

SEQ ID NO: 403581 - RNA, 22 nt, Human
ucuggaucaccacuucugccuc

SEQ ID NO: 403582 - RNA, 20 nt, Human
gcccaagguccagaaggggg

SEQ ID NO: 403583 - RNA, 22 nt, Human
uuacagauggaucuagcaaaau

SEQ ID NO: 403584 - RNA, 22 nt, Human
augguuuugaagggaggucaaa

SEQ ID NO: 403585 - RNA, 22 nt, Human
uguccucuuccagugcuccuuc

SEQ ID NO: 403586 - RNA, 22 nt, Human
cuaaucaucuuucucuuaaagc

SEQ ID NO: 403587 - RNA, 22 nt, Human
uacuuccuguuuccaugucugu

SEQ ID NO: 403588 - RNA, 22 nt, Human
cauacuuugggauaagagugga

SEQ ID NO: 403589 - RNA, 22 nt, Human
gcagaauugauggagaacuuaa

SEQ ID NO: 403590 - RNA, 22 nt, Human
auucuucacuguuucagaauga

SEQ ID NO: 403591 - RNA, 22 nt, Human
gaagaaucaagcaguaauuugu

SEQ ID NO: 403592 - RNA, 22 nt, Human
ccguagcacaugcuccuggggc

SEQ ID NO: 403593 - RNA, 22 nt, Human
aacacuuucuauuauuaugguu

SEQ ID NO: 403594 - RNA, 20 nt, Human
agaggccaguuaggagucua

SEQ ID NO: 403595 - RNA, 22 nt, Human
guguugaugacauuuuagaaac

SEQ ID NO: 403596 - RNA, 21 nt, Human
aucacauuggcuguuauuauu

SEQ ID NO: 403597 - RNA, 22 nt, Human
auucuuaaauuuaggucuguga

SEQ ID NO: 403598 - RNA, 22 nt, Human
uuccaaagugcuggaauuacau

SEQ ID NO: 403599 - RNA, 22 nt, Human
uguacauagaucuugaaaauua

SEQ ID NO: 403600 - RNA, 23 nt, Human
aggcccaacucugugagggcugc

SEQ ID NO: 403601 - RNA, 22 nt, Human
gucuucuuuaaccuacuaaagc

SEQ ID NO: 403602 - RNA, 22 nt, Human
auacagaaguuuuccacuuauu

SEQ ID NO: 403603 - RNA, 22 nt, Human
uucaguaaaacacugcaauguc

SEQ ID NO: 403604 - RNA, 22 nt, Human
ugaaucauggauaaauagcuua

SEQ ID NO: 403605 - RNA, 22 nt, Human
uucacauaaugauacaaagcuu

SEQ ID NO: 403606 - RNA, 22 nt, Human
cuggauuuuagaaggcuuccua

SEQ ID NO: 403607 - RNA, 22 nt, Human
agaggagugggaagcagugcaa

SEQ ID NO: 403608 - RNA, 22 nt, Human
agguacaaaagaguauaugaga

SEQ ID NO: 403609 - RNA, 22 nt, Human
ccaaaugugccuguuucaacaa

SEQ ID NO: 403610 - RNA, 21 nt, Human
ugaucauuuguguaaaggaga

SEQ ID NO: 403611 - RNA, 22 nt, Human
cuacagaaaaucagccacaggc

SEQ ID NO: 403612 - RNA, 22 nt, Human
aaucagaaauugagggucuggu

SEQ ID NO: 403613 - RNA, 22 nt, Human
guugaaugaaucauucuaugua

SEQ ID NO: 403614 - RNA, 22 nt, Human
accauuuuggguauuuucagag

SEQ ID NO: 403615 - RNA, 22 nt, Human
cuuaauuuaaaauaguucaggc

SEQ ID NO: 403616 - RNA, 22 nt, Human
auuaggcacuagaaugucaauu

SEQ ID NO: 403617 - RNA, 22 nt, Human
uggcauuugcucccuuguguuc

SEQ ID NO: 403618 - RNA, 22 nt, Human
acaauacaggcuucuggacuua

SEQ ID NO: 403619 - RNA, 22 nt, Human
ggcauuuagauugaauuucugu

SEQ ID NO: 403620 - RNA, 22 nt, Human
ggauggagguucucagaugcuc

SEQ ID NO: 403621 - RNA, 22 nt, Human
ccucaggaaaugaauaaauggc

SEQ ID NO: 403622 - RNA, 22 nt, Human
aaauauagugacacuuauaguc

SEQ ID NO: 403623 - RNA, 22 nt, Human
uuccuuagugccucuuccgcug

SEQ ID NO: 403624 - RNA, 22 nt, Human
uuauaacaucaaucagaguuaa

SEQ ID NO: 403625 - RNA, 22 nt, Human
uuucuagugguuaagauuuaca

SEQ ID NO: 403626 - RNA, 22 nt, Human
guuccaaauuuggaucuuuagg

SEQ ID NO: 403627 - RNA, 22 nt, Human
uuauaacaacaguuuacuuuaa

SEQ ID NO: 403628 - RNA, 22 nt, Human
uggcauuucaguauuuucauaa

SEQ ID NO: 403629 - RNA, 22 nt, Human
caucagaacaaaucgguuaaga

SEQ ID NO: 403630 - RNA, 22 nt, Human
auccuuaguuaagaacaggagu

SEQ ID NO: 403631 - RNA, 22 nt, Human
auggcauuccaagucuucuuuu

SEQ ID NO: 403632 - RNA, 22 nt, Human
cuuaaacugaaagcuacaagau

SEQ ID NO: 403633 - RNA, 22 nt, Human
auagaauuugcacuaaaucugc

SEQ ID NO: 403634 - RNA, 21 nt, Human
uucuucaugaugauuaauggc

SEQ ID NO: 403635 - RNA, 22 nt, Human
uucuucuugucugcccucacau

SEQ ID NO: 403636 - RNA, 22 nt, Human
caagucauuacugaaaugucac

SEQ ID NO: 403637 - RNA, 22 nt, Human
uuucacauaugguuguugauug

SEQ ID NO: 403638 - RNA, 22 nt, Human
acaaauaugguacucggagaaa

SEQ ID NO: 403639 - RNA, 22 nt, Human
ugaucugaaggacaugggaccc

SEQ ID NO: 403640 - RNA, 22 nt, Human
uggauuuaauggaugaggggca

SEQ ID NO: 403641 - RNA, 22 nt, Human
caaacuggcuaugggaaucuug

SEQ ID NO: 403642 - RNA, 22 nt, Human
aauaucaacaguguccuucuaa

SEQ ID NO: 403643 - RNA, 22 nt, Human
uauuucagggagaauaaauuug

SEQ ID NO: 403644 - RNA, 22 nt, Human
cccucuacagggaagcgcuuuc

SEQ ID NO: 403645 - RNA, 22 nt, Human
acaacuuugacccuuguucuua

SEQ ID NO: 403646 - RNA, 22 nt, Human
aaguccuuuauccuaaaagguc

SEQ ID NO: 403647 - RNA, 22 nt, Human
caucaucaaaagugacagagaa

SEQ ID NO: 403648 - RNA, 22 nt, Human
agcaucuggcagaaagucagaa

SEQ ID NO: 403649 - RNA, 22 nt, Human
acucaggagggaucagcuauca

SEQ ID NO: 403650 - RNA, 22 nt, Human
agaaaucauugaauuauuugcu

SEQ ID NO: 403651 - RNA, 22 nt, Human
auguguaugcaugcacuaagau

SEQ ID NO: 403652 - RNA, 22 nt, Human
cuuccaaauguaaauaaguuuc

SEQ ID NO: 403653 - RNA, 22 nt, Human
gcugggaagugcaagaucaagg

SEQ ID NO: 403654 - RNA, 22 nt, Human
aggcacaguggcucacaccugu

SEQ ID NO: 403655 - RNA, 22 nt, Human
ucuucccuaaucaccaucuuca

SEQ ID NO: 403656 - RNA, 22 nt, Human
uuuaggcauugaauuagaauag

SEQ ID NO: 403657 - RNA, 21 nt, Human
uuucacaaaaguaugugacaa

SEQ ID NO: 403658 - RNA, 22 nt, Human
aaguuugcauagauuaagcauu

SEQ ID NO: 403659 - RNA, 22 nt, Human
aagcauuuuagauaaagcauca

SEQ ID NO: 403660 - RNA, 22 nt, Human
uucuuaacucaaauauauaucc

SEQ ID NO: 403661 - RNA, 22 nt, Human
caguccuucuccauuaaggcuc

SEQ ID NO: 403662 - RNA, 22 nt, Human
agcagagccugggcuaggggug

SEQ ID NO: 403663 - RNA, 22 nt, Human
ugaaacaaugugaaguugcuga

SEQ ID NO: 403664 - RNA, 22 nt, Human
aaucagaaagaucuugaugaga

SEQ ID NO: 403665 - RNA, 22 nt, Human
uuuuaagaugcuaguauuucag

SEQ ID NO: 403666 - RNA, 22 nt, Human
aaagccauuacaaaauuucaua

SEQ ID NO: 403667 - RNA, 22 nt, Human
ucuucacauggaacaugaagcu

SEQ ID NO: 403668 - RNA, 22 nt, Human
ugucaccaugcgaggcuaauuu

SEQ ID NO: 403669 - RNA, 22 nt, Human
agcacauaccagaaccacaggu

SEQ ID NO: 403670 - RNA, 22 nt, Human
ucauuuguucaucugcucuucu

SEQ ID NO: 403671 - RNA, 22 nt, Human
ugugaaaagcguguguucuagg

SEQ ID NO: 403672 - RNA, 22 nt, Human
acagaaguuggaauuagauacu

SEQ ID NO: 403673 - RNA, 21 nt, Human
auuauuauaaagaccacaggg

SEQ ID NO: 403674 - RNA, 22 nt, Human
gccugcagaacugugaggcaau

SEQ ID NO: 403675 - RNA, 22 nt, Human
ggagcuguuggcagcuaucuug

SEQ ID NO: 403676 - RNA, 20 nt, Human
augugucuguaaacaacucu

SEQ ID NO: 403677 - RNA, 22 nt, Human
ucagccagaggcuucuugguuu

SEQ ID NO: 403678 - RNA, 20 nt, Human
agauuauuccuaagauuucu

SEQ ID NO: 403679 - RNA, 22 nt, Human
auuaggcagacaacguagccgg

SEQ ID NO: 403680 - RNA, 22 nt, Human
uuccauaauaggcuuaagugaa

SEQ ID NO: 403681 - RNA, 22 nt, Human
cuacagaaguuucccuugcuua

SEQ ID NO: 403682 - RNA, 22 nt, Human
cuuuccaaugcauuuccaaugu

SEQ ID NO: 403683 - RNA, 22 nt, Human
gauuuuauuagcccaaacuuug

SEQ ID NO: 403684 - RNA, 22 nt, Human
uuuaaagaaauuccucaucuuu

SEQ ID NO: 403685 - RNA, 22 nt, Human
aaaauuauucauggcuuuugga

SEQ ID NO: 403686 - RNA, 22 nt, Human
ugaaacuaggccaaucaaauua

SEQ ID NO: 403687 - RNA, 23 nt, Human
uaucagugugaugaggcugcugc

SEQ ID NO: 403688 - RNA, 22 nt, Human
aaacuuugguauguagcaaaac

SEQ ID NO: 403689 - RNA, 22 nt, Human
aaucuagucuccuuaagucuuu

SEQ ID NO: 403690 - RNA, 22 nt, Human
ggcucagacucccaggcccucu

SEQ ID NO: 403691 - RNA, 22 nt, Human
cauuuguaguuaaaaaugucuc

SEQ ID NO: 403692 - RNA, 22 nt, Human
auuaaauuaaguggcuaauuua

SEQ ID NO: 403693 - RNA, 22 nt, Human
cuacagaagaaacuaucacuau

SEQ ID NO: 403694 - RNA, 22 nt, Human
caauuuuuuccaugcucuuaca

SEQ ID NO: 403695 - RNA, 22 nt, Human
caggaugggauguagugggccc

SEQ ID NO: 403696 - RNA, 22 nt, Human
acagucucuccacacugcaggg

SEQ ID NO: 403697 - RNA, 22 nt, Human
uccauuuucuugcucuagguaa

SEQ ID NO: 403698 - RNA, 17 nt, Human
cuuuuaauuuacuuccc

SEQ ID NO: 403699 - RNA, 22 nt, Human
gucaggaugcuauuguuauuaa

SEQ ID NO: 403700 - RNA, 22 nt, Human
caggaugaagggcaaaggcaag

SEQ ID NO: 403701 - RNA, 22 nt, Human
aguagaauagauggauacuauu

SEQ ID NO: 403702 - RNA, 22 nt, Human
gaacccaggcuuuugaggcugu

SEQ ID NO: 403703 - RNA, 22 nt, Human
uccauguguuuuccuguccaca

SEQ ID NO: 403704 - RNA, 22 nt, Human
uuugaauaaucacugggcauua

SEQ ID NO: 403705 - RNA, 22 nt, Human
uauaaaacagaaagcacuaccu

SEQ ID NO: 403706 - RNA, 22 nt, Human
caagauggacauaaggagagaa

SEQ ID NO: 403707 - RNA, 22 nt, Human
cauaauauacuacauugaugaa

SEQ ID NO: 403708 - RNA, 22 nt, Human
aggccagaaaugucagggagug

SEQ ID NO: 403709 - RNA, 22 nt, Human
acacaauacagggcucaaaaua

SEQ ID NO: 403710 - RNA, 22 nt, Human
aacacuuugggcauggccuucc

SEQ ID NO: 403711 - RNA, 22 nt, Human
aggauuuaccgucauuuagucu

SEQ ID NO: 403712 - RNA, 22 nt, Human
agcacaauagagcaguuaaaaa

SEQ ID NO: 403713 - RNA, 22 nt, Human
aauuccagaggaggacaguccu

SEQ ID NO: 403714 - RNA, 22 nt, Human
uuccuuaguugacugucuuagu

SEQ ID NO: 403715 - RNA, 22 nt, Human
cagugauggauauggagaaguc

SEQ ID NO: 403716 - RNA, 22 nt, Human
uuuucaguuccaucucugcucu

SEQ ID NO: 403717 - RNA, 22 nt, Human
aaacauguaauucugcuuaaga

SEQ ID NO: 403718 - RNA, 22 nt, Human
ccuggaucagucacuguugcug

SEQ ID NO: 403719 - RNA, 22 nt, Human
uaggaagaugaguaucaacuug

SEQ ID NO: 403720 - RNA, 22 nt, Human
acaucagauuaugcuuugcuua

SEQ ID NO: 403721 - RNA, 22 nt, Human
cuuucauucuuagauauuagug

SEQ ID NO: 403722 - RNA, 22 nt, Human
agucucugucguagaucagcgu

SEQ ID NO: 403723 - RNA, 22 nt, Human
aaaucaguuagugguaggauug

SEQ ID NO: 403724 - RNA, 22 nt, Human
caauuucauuaauagauauaga

SEQ ID NO: 403725 - RNA, 22 nt, Human
ccagcugucagugugaaaauaa

SEQ ID NO: 403726 - RNA, 22 nt, Human
aaguccuuuccaguccugugau

SEQ ID NO: 403727 - RNA, 22 nt, Human
caggauagaaaggccauggagu

SEQ ID NO: 403728 - RNA, 22 nt, Human
gucaggauuauuuuauuaaaag

SEQ ID NO: 403729 - RNA, 22 nt, Human
uuccaaacugccaauucagaag

SEQ ID NO: 403730 - RNA, 22 nt, Human
ugucaccacauuugucaauauc

SEQ ID NO: 403731 - RNA, 22 nt, Human
uacuuguagcagguggcauuua

SEQ ID NO: 403732 - RNA, 22 nt, Human
uagaaacaucagcuaaccaaaa

SEQ ID NO: 403733 - RNA, 22 nt, Human
uggaguuccuuugaaaggcucu

SEQ ID NO: 403734 - RNA, 22 nt, Human
uuuauccauaucauuaaaaucu

SEQ ID NO: 403735 - RNA, 22 nt, Human
gaggccaaguuggagaccaggu

SEQ ID NO: 403736 - RNA, 22 nt, Human
uugcagcuucuaccacuguuuc

SEQ ID NO: 403737 - RNA, 22 nt, Human
cucaggauagcugcgcagccug

SEQ ID NO: 403738 - RNA, 22 nt, Human
uauuucagcaagaagaaugugg

SEQ ID NO: 403739 - RNA, 22 nt, Human
uuacagaacugucuugaaauuu

SEQ ID NO: 403740 - RNA, 22 nt, Human
uuacaagauaaccugaugcugu

SEQ ID NO: 403741 - RNA, 22 nt, Human
aaaggccaugguuggaguguuu

SEQ ID NO: 403742 - RNA, 22 nt, Human
aucacugucgucaucugagauu

SEQ ID NO: 403743 - RNA, 22 nt, Human
aggauuuaggagcuggcuaacg

SEQ ID NO: 403744 - RNA, 22 nt, Human
cucaggauuuaaaggggcacuc

SEQ ID NO: 403745 - RNA, 22 nt, Human
uucccucucacuuaaagcuugg

SEQ ID NO: 403746 - RNA, 21 nt, Human
uucaaaaugguguguuugucu

SEQ ID NO: 403747 - RNA, 22 nt, Human
cauucauucuguaaguaacuau

SEQ ID NO: 403748 - RNA, 22 nt, Human
gaaccucagugaaacuggaggu

SEQ ID NO: 403749 - RNA, 23 nt, Human
uucaaaacuggaaaaucagaugc

SEQ ID NO: 403750 - RNA, 22 nt, Human
uucaacuuuggagauuuaauaa

SEQ ID NO: 403751 - RNA, 22 nt, Human
gagucaccacacggugcugacu

SEQ ID NO: 403752 - RNA, 22 nt, Human
aaugguauuugucaagcauagu

SEQ ID NO: 403753 - RNA, 21 nt, Human
auccuuagcacuuagaagagu

SEQ ID NO: 403754 - RNA, 22 nt, Human
uaauuauuaugacaacaauugc

SEQ ID NO: 403755 - RNA, 22 nt, Human
ccuccuuuccuguuuuccugag

SEQ ID NO: 403756 - RNA, 22 nt, Human
ugcuucugggcaaaugugugug

SEQ ID NO: 403757 - RNA, 22 nt, Human
cagauaaaggcuuacuaguagu

SEQ ID NO: 403758 - RNA, 22 nt, Human
cuuccaaagcacuuuauggacc

SEQ ID NO: 403759 - RNA, 22 nt, Human
uauacaauggcugaaucaucca

SEQ ID NO: 403760 - RNA, 22 nt, Human
auagcuguuagauuggggucga

SEQ ID NO: 403761 - RNA, 22 nt, Human
aaaauugagagucuugugcaag

SEQ ID NO: 403762 - RNA, 22 nt, Human
ggccagcagucacagggucaga

SEQ ID NO: 403763 - RNA, 22 nt, Human
ucaaacagaggaacaauuguuu

SEQ ID NO: 403764 - RNA, 22 nt, Human
acauaauaaaaauaacagcuca

SEQ ID NO: 403765 - RNA, 19 nt, Human
uuucagacucaucuccagc

SEQ ID NO: 403766 - RNA, 22 nt, Human
uuuaggcauacuuuugggagaa

SEQ ID NO: 403767 - RNA, 22 nt, Human
caguucuuauuuggccaguguc

SEQ ID NO: 403768 - RNA, 22 nt, Human
ucagccaguuuguuuauuccgg

SEQ ID NO: 403769 - RNA, 22 nt, Human
aaguuucaugauguaauuauug

SEQ ID NO: 403770 - RNA, 22 nt, Human
aauuucaaugcacucaugguug

SEQ ID NO: 403771 - RNA, 22 nt, Human
auggcauuugaccgcuuugugg

SEQ ID NO: 403772 - RNA, 22 nt, Human
ucaauacuuaagcuuaauucua

SEQ ID NO: 403773 - RNA, 22 nt, Human
cuagaaaugcucaagagaaagu

SEQ ID NO: 403774 - RNA, 22 nt, Human
auaacagauacucucugugagg

SEQ ID NO: 403775 - RNA, 22 nt, Human
ugucaccaccggaagaaacugc

SEQ ID NO: 403776 - RNA, 22 nt, Human
agaccauagggaccucagguug

SEQ ID NO: 403777 - RNA, 22 nt, Human
ugcccacauggugccauggcca

SEQ ID NO: 403778 - RNA, 22 nt, Human
uguccuuagaagaagugaaaga

SEQ ID NO: 403779 - RNA, 22 nt, Human
gucuucuuuucagucugcuugu

SEQ ID NO: 403780 - RNA, 22 nt, Human
auuuucagagacaucuggacuu

SEQ ID NO: 403781 - RNA, 22 nt, Human
cagcuuucaucagugacacuca

SEQ ID NO: 403782 - RNA, 22 nt, Human
agaucugaaucucauccgagga

SEQ ID NO: 403783 - RNA, 22 nt, Human
auaaagcaagcauaccauuaag

SEQ ID NO: 403784 - RNA, 22 nt, Human
uauccaaaggaacaaucacagc

SEQ ID NO: 403785 - RNA, 22 nt, Human
ucauuuguugcuguuaccugag

SEQ ID NO: 403786 - RNA, 22 nt, Human
uugcuucaguagcucuuuaaag

SEQ ID NO: 403787 - RNA, 22 nt, Human
ccagcuauugcuguguaacagu

SEQ ID NO: 403788 - RNA, 22 nt, Human
auucuucauuuacuguuacuug

SEQ ID NO: 403789 - RNA, 22 nt, Human
cagugucuccagaugcuccaau

SEQ ID NO: 403790 - RNA, 22 nt, Human
guagaaauagugguugacagga

SEQ ID NO: 403791 - RNA, 19 nt, Human
ucaucucacagggccuggc

SEQ ID NO: 403792 - RNA, 22 nt, Human
aguaaacauuucagauuuauuu

SEQ ID NO: 403793 - RNA, 22 nt, Human
cuacagaagccguggucaggaa

SEQ ID NO: 403794 - RNA, 22 nt, Human
uggcuuuagguugcauguuucu

SEQ ID NO: 403795 - RNA, 22 nt, Human
uaaagcacgucuauuuaaugau

SEQ ID NO: 403796 - RNA, 22 nt, Human
acagcauucaauaaauaauaac

SEQ ID NO: 403797 - RNA, 22 nt, Human
cuagaaaucucuguuuacauca

SEQ ID NO: 403798 - RNA, 22 nt, Human
uuccaagagcuuuaauuguuga

SEQ ID NO: 403799 - RNA, 22 nt, Human
uaugcugugcuagauacaauau

SEQ ID NO: 403800 - RNA, 19 nt, Human
ucuuucauuucuagcucug

SEQ ID NO: 403801 - RNA, 22 nt, Human
guuaggcagugugguauagcag

SEQ ID NO: 403802 - RNA, 22 nt, Human
cugucauugagccugucagggc

SEQ ID NO: 403803 - RNA, 22 nt, Human
uauacagauuaacagauuuaaa

SEQ ID NO: 403804 - RNA, 22 nt, Human
gaaaaaggauaaauacaguguu

SEQ ID NO: 403805 - RNA, 22 nt, Human
caguuucagaaucaaaacauca

SEQ ID NO: 403806 - RNA, 23 nt, Human
ggauuuaguggaugagcugagug

SEQ ID NO: 403807 - RNA, 22 nt, Human
ucaguaaaugaaugaauauaug

SEQ ID NO: 403808 - RNA, 22 nt, Human
aaucuucuacuugacaguucuc

SEQ ID NO: 403809 - RNA, 22 nt, Human
ggagaaugauauauagcucagu

SEQ ID NO: 403810 - RNA, 22 nt, Human
cucuccucagaacaggcccucu

SEQ ID NO: 403811 - RNA, 22 nt, Human
aggguccugggugcaguugcuu

SEQ ID NO: 403812 - RNA, 21 nt, Human
uuuaguucaaguacagaacca

SEQ ID NO: 403813 - RNA, 22 nt, Human
uuccaugagcucugaguucaca

SEQ ID NO: 403814 - RNA, 22 nt, Human
uacuauaccauguaagauauga

SEQ ID NO: 403815 - RNA, 22 nt, Human
uccagccuaggggaacagcugc

SEQ ID NO: 403816 - RNA, 22 nt, Human
auucuucaaagagugucaaagu

SEQ ID NO: 403817 - RNA, 22 nt, Human
caucauaaaauugagauaacug

SEQ ID NO: 403818 - RNA, 22 nt, Human
ucagaauugcagggagggcagg

SEQ ID NO: 403819 - RNA, 22 nt, Human
ucugaagaacugaguaaacaug

SEQ ID NO: 403820 - RNA, 22 nt, Human
guuuucugauuagcaaaucuga

SEQ ID NO: 403821 - RNA, 22 nt, Human
aucaggauccaccuugagccug

SEQ ID NO: 403822 - RNA, 22 nt, Human
uuucuagggcucuugucuucug

SEQ ID NO: 403823 - RNA, 22 nt, Human
gucaggaugggcagccaaacua

SEQ ID NO: 403824 - RNA, 22 nt, Human
gaucuucuauguaaugaagugu

SEQ ID NO: 403825 - RNA, 22 nt, Human
uccuucuuucccccuagucauu

SEQ ID NO: 403826 - RNA, 22 nt, Human
uuucuucauagaccuugucuug

SEQ ID NO: 403827 - RNA, 22 nt, Human
agaccaagugcaggugccacua

SEQ ID NO: 403828 - RNA, 22 nt, Human
uuucaucucucuaaaagacagu

SEQ ID NO: 403829 - RNA, 22 nt, Human
caucagaaggaaggacgauuau

SEQ ID NO: 403830 - RNA, 22 nt, Human
auucuucauuguugauucaugu

SEQ ID NO: 403831 - RNA, 22 nt, Human
cagaaggcuggcagauugagau

SEQ ID NO: 403832 - RNA, 23 nt, Human
uuccagaggaagaagucaugacu

SEQ ID NO: 403833 - RNA, 22 nt, Human
aaauccuuuggaggacaugaug

SEQ ID NO: 403834 - RNA, 22 nt, Human
aaagaaucguguguaguuugaa

SEQ ID NO: 403835 - RNA, 22 nt, Human
aauacaguaauuuugaugaguu

SEQ ID NO: 403836 - RNA, 22 nt, Human
ggcauuuauuugucucauucuu

SEQ ID NO: 403837 - RNA, 22 nt, Human
auaagcauguuagaauauuuga

SEQ ID NO: 403838 - RNA, 22 nt, Human
gcuugaaaauucauagguauuu

SEQ ID NO: 403839 - RNA, 22 nt, Human
auucaaauuaaguuaauucagc

SEQ ID NO: 403840 - RNA, 22 nt, Human
gccuuaauuuuuuauaaucucu

SEQ ID NO: 403841 - RNA, 22 nt, Human
auggaguucuuuaaauucacag

SEQ ID NO: 403842 - RNA, 22 nt, Human
cuggaguuagaguagacacuga

SEQ ID NO: 403843 - RNA, 22 nt, Human
acagaauuuacacaucucuaaa

SEQ ID NO: 403844 - RNA, 22 nt, Human
ucuaaacacuaagucuugaugc

SEQ ID NO: 403845 - RNA, 22 nt, Human
uuggaugaagucuagcuuuagu

SEQ ID NO: 403846 - RNA, 22 nt, Human
uguucagcccucuauuaaucag

SEQ ID NO: 403847 - RNA, 22 nt, Human
ucuaaacaguuucacucuuaau

SEQ ID NO: 403848 - RNA, 22 nt, Human
augcaucuauucccaagggcag

SEQ ID NO: 403849 - RNA, 22 nt, Human
accauccugaaaccuucaugcu

SEQ ID NO: 403850 - RNA, 22 nt, Human
ucagccaguuugauucuauuug

SEQ ID NO: 403851 - RNA, 22 nt, Human
cuucuucauguauugauagucu

SEQ ID NO: 403852 - RNA, 22 nt, Human
aucuaaaaggagcucuuuaucu

SEQ ID NO: 403853 - RNA, 22 nt, Human
aguaaaaauugaggugcaaaau

SEQ ID NO: 403854 - RNA, 22 nt, Human
uaucagaacacagccacagcca

SEQ ID NO: 403855 - RNA, 22 nt, Human
caagauggaguccgggaaugug

SEQ ID NO: 403856 - RNA, 22 nt, Human
uguaaauaguuagcuugccucu

SEQ ID NO: 403857 - RNA, 20 nt, Human
gggagucuggaugaaagaug

SEQ ID NO: 403858 - RNA, 22 nt, Human
uggauuuaccacagggccacag

SEQ ID NO: 403859 - RNA, 22 nt, Human
cagaaccaggaacugauggaga

SEQ ID NO: 403860 - RNA, 22 nt, Human
auuugcuuucagguauaaaagg

SEQ ID NO: 403861 - RNA, 22 nt, Human
auauauuugagaauauucauga

SEQ ID NO: 403862 - RNA, 21 nt, Human
gaacauuuggguuguuucuac

SEQ ID NO: 403863 - RNA, 22 nt, Human
ccagauaaggcuuuuuaaaagc

SEQ ID NO: 403864 - RNA, 22 nt, Human
ccaggcugugguuuagauagag

SEQ ID NO: 403865 - RNA, 22 nt, Human
gcugcaggcauuuuccugggca

SEQ ID NO: 403866 - RNA, 19 nt, Human
aacuggauaauggccacau

SEQ ID NO: 403867 - RNA, 22 nt, Human
auacaaguugugauaauguaaa

SEQ ID NO: 403868 - RNA, 23 nt, Human
ugaaggccuggaggacgcguugu

SEQ ID NO: 403869 - RNA, 22 nt, Human
aagcucauuaauuagaagcuaa

SEQ ID NO: 403870 - RNA, 22 nt, Human
aucauaaaauugcaccauuucu

SEQ ID NO: 403871 - RNA, 22 nt, Human
uuacagaaagguugugggauag

SEQ ID NO: 403872 - RNA, 21 nt, Human
aaauacagaaacuuguuuuca

SEQ ID NO: 403873 - RNA, 22 nt, Human
uuauauaaagauaacuuuucuu

SEQ ID NO: 403874 - RNA, 22 nt, Human
uucuucaaaauccagcaugauu

SEQ ID NO: 403875 - RNA, 22 nt, Human
cauucuuauauuuacucauuca

SEQ ID NO: 403876 - RNA, 22 nt, Human
uaagaaucaguagauauagauu

SEQ ID NO: 403877 - RNA, 22 nt, Human
uguccuuauauuguggaagggg

SEQ ID NO: 403878 - RNA, 22 nt, Human
uccuuaauauggaagaguucuc

SEQ ID NO: 403879 - RNA, 22 nt, Human
ccuauacaggcuucuuuacaug

SEQ ID NO: 403880 - RNA, 22 nt, Human
aaaacauguccauacagaaacu

SEQ ID NO: 403881 - RNA, 22 nt, Human
cauauaaauacaacauguguua

SEQ ID NO: 403882 - RNA, 22 nt, Human
uaccaaaagcuuguuucauaca

SEQ ID NO: 403883 - RNA, 19 nt, Human
cauguuaugcuguaguauc

SEQ ID NO: 403884 - RNA, 22 nt, Human
auuuaguuuaggaaaaguaggu

SEQ ID NO: 403885 - RNA, 22 nt, Human
ucagucuucccuccagugcaac

SEQ ID NO: 403886 - RNA, 22 nt, Human
ucagaauugucuggggaauguu

SEQ ID NO: 403887 - RNA, 22 nt, Human
ucuggaucuccagcacuuauca

SEQ ID NO: 403888 - RNA, 22 nt, Human
auugaaaggcaaaguaggaagc

SEQ ID NO: 403889 - RNA, 22 nt, Human
acuugcauuauauuuaucacaa

SEQ ID NO: 403890 - RNA, 22 nt, Human
uugaaaguuaucuagauucuga

SEQ ID NO: 403891 - RNA, 22 nt, Human
aacauaauguggccaaagucac

SEQ ID NO: 403892 - RNA, 22 nt, Human
uuaauuacuaagcacaaugcaa

SEQ ID NO: 403893 - RNA, 22 nt, Human
agacaaaugguaauuaugucua

SEQ ID NO: 403894 - RNA, 22 nt, Human
ucuguggauuuuaguguucaug

SEQ ID NO: 403895 - RNA, 22 nt, Human
acaauauuguacccagaaguuu

SEQ ID NO: 403896 - RNA, 23 nt, Human
uagaauucaaucuguuccacauc

SEQ ID NO: 403897 - RNA, 22 nt, Human
cuaauuauguuguuauaaucaa

SEQ ID NO: 403898 - RNA, 22 nt, Human
gcuauacagcaggagaauggaa

SEQ ID NO: 403899 - RNA, 22 nt, Human
gccagagguucaacaacugucu

SEQ ID NO: 403900 - RNA, 22 nt, Human
cauggucuacaauuucauuuua

SEQ ID NO: 403901 - RNA, 22 nt, Human
agucucagaaaagaagcaugga

SEQ ID NO: 403902 - RNA, 22 nt, Human
uuugaagacagaucaauauaag

SEQ ID NO: 403903 - RNA, 22 nt, Human
aaaguccuguuugaaggaccug

SEQ ID NO: 403904 - RNA, 22 nt, Human
auuugcuugugcuaugaaaguu

SEQ ID NO: 403905 - RNA, 22 nt, Human
cauagaaacugagacaaggauu

SEQ ID NO: 403906 - RNA, 22 nt, Human
ucucuuucuauaugugagucuu

SEQ ID NO: 403907 - RNA, 22 nt, Human
gauuucaauccagcuuucuucu

SEQ ID NO: 403908 - RNA, 22 nt, Human
caggauggucagaugcauuguc

SEQ ID NO: 403909 - RNA, 22 nt, Human
uugagaagaggcuuuguaggaa

SEQ ID NO: 403910 - RNA, 22 nt, Human
uuucaguuguccuguuaauagc

SEQ ID NO: 403911 - RNA, 22 nt, Human
caauauauaggaacaacuuagg

SEQ ID NO: 403912 - RNA, 22 nt, Human
gaggacaggagacucacuguuu

SEQ ID NO: 403913 - RNA, 22 nt, Human
gcucaggagcucuugguggcgc

SEQ ID NO: 403914 - RNA, 22 nt, Human
ccagaucuaaguccaaaguacu

SEQ ID NO: 403915 - RNA, 22 nt, Human
cguauacaugaagacauugcug

SEQ ID NO: 403916 - RNA, 22 nt, Human
aaguuucauuguucauguaaca

SEQ ID NO: 403917 - RNA, 22 nt, Human
auauaggcuaacaacuauugag

SEQ ID NO: 403918 - RNA, 22 nt, Human
aauuccaaauguuuucaaucca

SEQ ID NO: 403919 - RNA, 22 nt, Human
cauagaaaucaggugagaaucu

SEQ ID NO: 403920 - RNA, 22 nt, Human
uuaaaauagccagugccccucu

SEQ ID NO: 403921 - RNA, 22 nt, Human
gccucugcaauuacauugugcc

SEQ ID NO: 403922 - RNA, 22 nt, Human
aaguccuucuuuauaugagagu

SEQ ID NO: 403923 - RNA, 22 nt, Human
aaugugauuagccucuacugga

SEQ ID NO: 403924 - RNA, 22 nt, Human
aaguuucaaauauaaaauuaca

SEQ ID NO: 403925 - RNA, 23 nt, Human
ucuaauacaugaaaccuagaugu

SEQ ID NO: 403926 - RNA, 22 nt, Human
cucaggaucgcuugcccuaggg

SEQ ID NO: 403927 - RNA, 22 nt, Human
cucaugauguagcgaaugagaa

SEQ ID NO: 403928 - RNA, 19 nt, Human
uccuucagucagaucuggg

SEQ ID NO: 403929 - RNA, 22 nt, Human
uccagaauacucugaaaucauu

SEQ ID NO: 403930 - RNA, 22 nt, Human
aauuccaaguagcaucccauca

SEQ ID NO: 403931 - RNA, 23 nt, Human
aaucuauacuuaggcugguaaua

SEQ ID NO: 403932 - RNA, 22 nt, Human
cauuaaaauaucucaugguguu

SEQ ID NO: 403933 - RNA, 22 nt, Human
ucuaaagaagaggguucugcgg

SEQ ID NO: 403934 - RNA, 22 nt, Human
uucaacuagauuuauacaauuc

SEQ ID NO: 403935 - RNA, 22 nt, Human
uugaagagugccuuccagacau

SEQ ID NO: 403936 - RNA, 22 nt, Human
auaauaaaccaggaugggucug

SEQ ID NO: 403937 - RNA, 22 nt, Human
gaacuuuaaaacaaaguacagu

SEQ ID NO: 403938 - RNA, 22 nt, Human
agaaaucaauaucuauauguug

SEQ ID NO: 403939 - RNA, 22 nt, Human
ccaauacacuuuauagaagaaa

SEQ ID NO: 403940 - RNA, 22 nt, Human
ucuucaaguuccaaagugcagg

SEQ ID NO: 403941 - RNA, 22 nt, Human
cacacuuugugcuaaucuauuu

SEQ ID NO: 403942 - RNA, 22 nt, Human
agaccaagacuauaaugagagg

SEQ ID NO: 403943 - RNA, 22 nt, Human
cuggaucaugggaaagggauca

SEQ ID NO: 403944 - RNA, 22 nt, Human
ucauaaaaauagacucuaaagu

SEQ ID NO: 403945 - RNA, 22 nt, Human
caaugaaaauuuaaguugcagc

SEQ ID NO: 403946 - RNA, 22 nt, Human
cuuccuucugaagcauagaagc

SEQ ID NO: 403947 - RNA, 22 nt, Human
uuauccaaacuggugaaucauu

SEQ ID NO: 403948 - RNA, 22 nt, Human
uugaaggacauccuauuucuag

SEQ ID NO: 403949 - RNA, 22 nt, Human
acuauacaccaaaauauuaagg

SEQ ID NO: 403950 - RNA, 22 nt, Human
acaggccacaguggagucucug

SEQ ID NO: 403951 - RNA, 22 nt, Human
caaagucagcugccagucccaa

SEQ ID NO: 403952 - RNA, 22 nt, Human
ugcuauacggagcaucuucagg

SEQ ID NO: 403953 - RNA, 22 nt, Human
gaaacaacuacuauugauuucu

SEQ ID NO: 403954 - RNA, 22 nt, Human
auggccuuagugaugauuaaua

SEQ ID NO: 403955 - RNA, 22 nt, Human
guuaggcauuugccuuaauuuu

SEQ ID NO: 403956 - RNA, 22 nt, Human
cuggcuuucauuucaagcacgu

SEQ ID NO: 403957 - RNA, 22 nt, Human
cauggauugaauauaaauuaga

SEQ ID NO: 403958 - RNA, 22 nt, Human
uuuacagaaugucaauuucuau

SEQ ID NO: 403959 - RNA, 22 nt, Human
ugaaguaacuguccaggaucca

SEQ ID NO: 403960 - RNA, 22 nt, Human
cuugaaagaagggucuuuuaau

SEQ ID NO: 403961 - RNA, 22 nt, Human
auacuguaauaccuaaaugaac

SEQ ID NO: 403962 - RNA, 22 nt, Human
uacugaaauacuaagaaguuaa

SEQ ID NO: 403963 - RNA, 22 nt, Human
cauuguuauagcauuacacacc

SEQ ID NO: 403964 - RNA, 22 nt, Human
uuuccaaauaaggucacacuca

SEQ ID NO: 403965 - RNA, 22 nt, Human
caaggccaagucucugugaaga

SEQ ID NO: 403966 - RNA, 22 nt, Human
uuuauccaaggguuuuaacugu

SEQ ID NO: 403967 - RNA, 22 nt, Human
aaucaguguguaaaguggcugc

SEQ ID NO: 403968 - RNA, 22 nt, Human
ccagaauucagaaagggcauaa

SEQ ID NO: 403969 - RNA, 22 nt, Human
aguccaaggagagacagcauuu

SEQ ID NO: 403970 - RNA, 22 nt, Human
uuuaggaaugugguuuuugagc

SEQ ID NO: 403971 - RNA, 22 nt, Human
gaaagccagagagaaagggcuc

SEQ ID NO: 403972 - RNA, 22 nt, Human
guuucacagaugguguucauau

SEQ ID NO: 403973 - RNA, 22 nt, Human
cauuuguagcuauuuacuguau

SEQ ID NO: 403974 - RNA, 22 nt, Human
ucucuuaacugguucagcaauu

SEQ ID NO: 403975 - RNA, 22 nt, Human
augcaaaauaaggcagaaacau

SEQ ID NO: 403976 - RNA, 22 nt, Human
augugaggaagaaagagguaag

SEQ ID NO: 403977 - RNA, 22 nt, Human
augaaaauguacauguguauaa

SEQ ID NO: 403978 - RNA, 22 nt, Human
gcucagagcuugaaguuccacu

SEQ ID NO: 403979 - RNA, 22 nt, Human
agaaaaacuaagaguggguggu

SEQ ID NO: 403980 - RNA, 22 nt, Human
ccaaaauuaagccucuuauguu

SEQ ID NO: 403981 - RNA, 22 nt, Human
auguuaaauaaucccuuaaagc

SEQ ID NO: 403982 - RNA, 22 nt, Human
guuccaaagucucugagcugag

SEQ ID NO: 403983 - RNA, 21 nt, Human
aacugguucaauucaacuaga

SEQ ID NO: 403984 - RNA, 22 nt, Human
uaaacauggauucugaucacag

SEQ ID NO: 403985 - RNA, 22 nt, Human
acuaagugauucuaagcaucuu

SEQ ID NO: 403986 - RNA, 22 nt, Human
uaaggccaauuacauauguuca

SEQ ID NO: 403987 - RNA, 22 nt, Human
uagaagcaguaauagaaauagg

SEQ ID NO: 403988 - RNA, 22 nt, Human
agucaccaggguuugcuggguu

SEQ ID NO: 403989 - RNA, 22 nt, Human
guucuucaucauuuuagauagg

SEQ ID NO: 403990 - RNA, 22 nt, Human
ucuuccaagguugcacacuauc

SEQ ID NO: 403991 - RNA, 22 nt, Human
gaaugaaaaccuuggcucaaau

SEQ ID NO: 403992 - RNA, 22 nt, Human
uuaacagagugccuggcaugua

SEQ ID NO: 403993 - RNA, 21 nt, Human
acucaggagacuaacuauguc

SEQ ID NO: 403994 - RNA, 21 nt, Human
acuuuaauauacaugaggagg

SEQ ID NO: 403995 - RNA, 22 nt, Human
uuaaagggccgauuuccaggcc

SEQ ID NO: 403996 - RNA, 22 nt, Human
agaagugagugugacucagcag

SEQ ID NO: 403997 - RNA, 22 nt, Human
agaauaaucacugaaguucaaa

SEQ ID NO: 403998 - RNA, 19 nt, Human
uugaaagauuagcuuucua

SEQ ID NO: 403999 - RNA, 22 nt, Human
aaucagaacuucucaggguggg

SEQ ID NO: 404000 - RNA, 22 nt, Human
aggauuuaccuccagcuaggcu

SEQ ID NO: 404001 - RNA, 22 nt, Human
uggaauaaagugcuuugaucag

SEQ ID NO: 404002 - RNA, 22 nt, Human
gugaacuauuggguaucauaaa

SEQ ID NO: 404003 - RNA, 22 nt, Human
uggaaauggaucugaugagucu

SEQ ID NO: 404004 - RNA, 22 nt, Human
aguucucaagacaauuaccugu

SEQ ID NO: 404005 - RNA, 22 nt, Human
aaauugaaugauuaagugguga

SEQ ID NO: 404006 - RNA, 22 nt, Human
ucagugaucuaaggguauggcc

SEQ ID NO: 404007 - RNA, 22 nt, Human
uuuauccagcagcuauucaaaa

SEQ ID NO: 404008 - RNA, 22 nt, Human
uuuaggcaagaacucacugaga

SEQ ID NO: 404009 - RNA, 22 nt, Human
cagaauaaaagucccaaggcau

SEQ ID NO: 404010 - RNA, 22 nt, Human
ugaugaaauguugaggcaguga

SEQ ID NO: 404011 - RNA, 22 nt, Human
uaacagaaauuuuaguuagggg

SEQ ID NO: 404012 - RNA, 22 nt, Human
cuuaaagaugucaaggcuguuu

SEQ ID NO: 404013 - RNA, 22 nt, Human
ucuuuccaaggacucuguagca

SEQ ID NO: 404014 - RNA, 20 nt, Human
ccucaggaugagggugagca

SEQ ID NO: 404015 - RNA, 19 nt, Human
uuugaaaggauuguuauuu

SEQ ID NO: 404016 - RNA, 22 nt, Human
aaugggauaggucuucaggaau

SEQ ID NO: 404017 - RNA, 22 nt, Human
uuucaguuuaugucuugaauua

SEQ ID NO: 404018 - RNA, 22 nt, Human
auguauaaugcuaauuagcuag

SEQ ID NO: 404019 - RNA, 22 nt, Human
cagagauuauuauaacuaauua

SEQ ID NO: 404020 - RNA, 22 nt, Human
uacacagaggcugaugucuuag

SEQ ID NO: 404021 - RNA, 22 nt, Human
uaaucauggccucaaauuuuau

SEQ ID NO: 404022 - RNA, 22 nt, Human
agaccgagaaguucuccaggcc

SEQ ID NO: 404023 - RNA, 22 nt, Human
uuuguaaauagcaguacucaug

SEQ ID NO: 404024 - RNA, 22 nt, Human
uaaggccaaggggccauagucu

SEQ ID NO: 404025 - RNA, 22 nt, Human
auggcuuuuuagacuuugguac

SEQ ID NO: 404026 - RNA, 22 nt, Human
aaacaaacaauuaguugugugg

SEQ ID NO: 404027 - RNA, 22 nt, Human
aaucuguucuacucuauucaga

SEQ ID NO: 404028 - RNA, 22 nt, Human
acuuuagaccaucuuccacagu

SEQ ID NO: 404029 - RNA, 22 nt, Human
uagaaacagcauauauuagccc

SEQ ID NO: 404030 - RNA, 22 nt, Human
agccaacuaggagauuaaggua

SEQ ID NO: 404031 - RNA, 22 nt, Human
uucacagaugccugaugugugg

SEQ ID NO: 404032 - RNA, 22 nt, Human
augguuuaagggagaauauuga

SEQ ID NO: 404033 - RNA, 22 nt, Human
gugaauaacuuucuauguuaau

SEQ ID NO: 404034 - RNA, 22 nt, Human
auguuucagauacagaucaaau

SEQ ID NO: 404035 - RNA, 22 nt, Human
gaagaaucugaggacagucauu

SEQ ID NO: 404036 - RNA, 22 nt, Human
ugauugaacugagcuucaagau

SEQ ID NO: 404037 - RNA, 22 nt, Human
acuauacagaagaggauaggaa

SEQ ID NO: 404038 - RNA, 22 nt, Human
ucaaacauguuagcagucugug

SEQ ID NO: 404039 - RNA, 22 nt, Human
uuuucauuuuuguagaugcaag

SEQ ID NO: 404040 - RNA, 22 nt, Human
aaucagcuaaauaaacuaguca

SEQ ID NO: 404041 - RNA, 22 nt, Human
ucauaauacaaagaguucugca

SEQ ID NO: 404042 - RNA, 22 nt, Human
augcuuaacucuguacauaguu

SEQ ID NO: 404043 - RNA, 22 nt, Human
uuagaaaugucacagaucugau

SEQ ID NO: 404044 - RNA, 22 nt, Human
agugugucugaucacuugugag

SEQ ID NO: 404045 - RNA, 22 nt, Human
uuucuucagagagagcuuuccc

SEQ ID NO: 404046 - RNA, 22 nt, Human
ccuggauucaagucuuucuuuc

SEQ ID NO: 404047 - RNA, 22 nt, Human
aaaaugcuauuucauggaggag

SEQ ID NO: 404048 - RNA, 22 nt, Human
uuuccaaauaaggucacauucu

SEQ ID NO: 404049 - RNA, 22 nt, Human
uugcugaaguuaaugcuugcaa

SEQ ID NO: 404050 - RNA, 22 nt, Human
aaucagaaucaguugacacagc

SEQ ID NO: 404051 - RNA, 22 nt, Human
auuccaguuggguucuaauaca

SEQ ID NO: 404052 - RNA, 22 nt, Human
ucauacacaagagcauguaaca

SEQ ID NO: 404053 - RNA, 22 nt, Human
gauagucaccucccuuaacuuu

SEQ ID NO: 404054 - RNA, 22 nt, Human
guaaugaaugaaagaaacuggg

SEQ ID NO: 404055 - RNA, 22 nt, Human
uggcauuuggcuuacuuauguu

SEQ ID NO: 404056 - RNA, 22 nt, Human
cacaaagucugcagcugcugua

SEQ ID NO: 404057 - RNA, 21 nt, Human
uccuuccuugagguccuuucc

SEQ ID NO: 404058 - RNA, 22 nt, Human
cucacugugccuuuucccaaac

SEQ ID NO: 404059 - RNA, 22 nt, Human
auuaaauuuucacuaggcuccc

SEQ ID NO: 404060 - RNA, 22 nt, Human
gcuuuaaugcaauuucaccuca

SEQ ID NO: 404061 - RNA, 19 nt, Human
uaaggccaaaaguaagugu

SEQ ID NO: 404062 - RNA, 22 nt, Human
ggauucagugucuguuaauagu

SEQ ID NO: 404063 - RNA, 22 nt, Human
uauuucagucacuucuucucug

SEQ ID NO: 404064 - RNA, 20 nt, Human
aguuauaguaucuagccaug

SEQ ID NO: 404065 - RNA, 20 nt, Human
uuucaguugguuaauggcau

SEQ ID NO: 404066 - RNA, 22 nt, Human
auucugauaucuuauucuagcu

SEQ ID NO: 404067 - RNA, 22 nt, Human
cuggaaauuggagaugauguuu

SEQ ID NO: 404068 - RNA, 22 nt, Human
ucagucuuugcuuaugacaaua

SEQ ID NO: 404069 - RNA, 22 nt, Human
augaauaaguaaacuccuuugg

SEQ ID NO: 404070 - RNA, 22 nt, Human
uaugaaaauuuagcugaagcau

SEQ ID NO: 404071 - RNA, 22 nt, Human
cagaauuuaaguggauuauucu

SEQ ID NO: 404072 - RNA, 22 nt, Human
uuugcacuagcauuuguccaug

SEQ ID NO: 404073 - RNA, 22 nt, Human
uaacagaaauaguaggugaggg

SEQ ID NO: 404074 - RNA, 22 nt, Human
acucaggaagaaagcagcuggu

SEQ ID NO: 404075 - RNA, 22 nt, Human
auaguuugaaggcuguucuacu

SEQ ID NO: 404076 - RNA, 22 nt, Human
gaucuucucuuuaguagaaaca

SEQ ID NO: 404077 - RNA, 22 nt, Human
uugaaagaggcaaaguuugauc

SEQ ID NO: 404078 - RNA, 22 nt, Human
aaaggccaauaaagacaagcug

SEQ ID NO: 404079 - RNA, 22 nt, Human
ucuggauccuaugcacuggacu

SEQ ID NO: 404080 - RNA, 22 nt, Human
gaaggccauuagagccugugcc

SEQ ID NO: 404081 - RNA, 22 nt, Human
guuauacauauguguuaacaaa

SEQ ID NO: 404082 - RNA, 22 nt, Human
aaguccuuauguggaggggcua

SEQ ID NO: 404083 - RNA, 22 nt, Human
auucuucaguauguguggauug

SEQ ID NO: 404084 - RNA, 22 nt, Human
ucacagacauggugagguaaca

SEQ ID NO: 404085 - RNA, 22 nt, Human
cugaauaaagcccucgcgcgcu

SEQ ID NO: 404086 - RNA, 22 nt, Human
auuauucuuaugucaucauggc

SEQ ID NO: 404087 - RNA, 22 nt, Human
gagagucuagugcaccuaguuu

SEQ ID NO: 404088 - RNA, 22 nt, Human
cagaguggcgacccccucagcu

SEQ ID NO: 404089 - RNA, 22 nt, Human
uucugugauugacauguggcuu

SEQ ID NO: 404090 - RNA, 22 nt, Human
gucuccugagacugcagucacc

SEQ ID NO: 404091 - RNA, 22 nt, Human
auuucaacacuuuuggaauuag

SEQ ID NO: 404092 - RNA, 22 nt, Human
augaggcaguacacacaaagcc

SEQ ID NO: 404093 - RNA, 22 nt, Human
guauuuaauuccauuaaguuag

SEQ ID NO: 404094 - RNA, 22 nt, Human
guccaugauucugugacacccu

SEQ ID NO: 404095 - RNA, 22 nt, Human
caaauaguuuuucauguauuau

SEQ ID NO: 404096 - RNA, 22 nt, Human
ucauaaaguuaucaccaaaucc

SEQ ID NO: 404097 - RNA, 22 nt, Human
caaggccaaagggccacuguca

SEQ ID NO: 404098 - RNA, 22 nt, Human
aaugucugagucucuguauccc

SEQ ID NO: 404099 - RNA, 15 nt, Human
cuccaugauuuugca

SEQ ID NO: 404100 - RNA, 21 nt, Human
uguguaaaguugaaauccugu

SEQ ID NO: 404101 - RNA, 19 nt, Human
caggaaugagguaauggcu

SEQ ID NO: 404102 - RNA, 22 nt, Human
uucuucuucaagugcugcauuc

SEQ ID NO: 404103 - RNA, 22 nt, Human
aauaaaauggucaguuuucuca

SEQ ID NO: 404104 - RNA, 22 nt, Human
cccaaaguacaaguaaacaugu

SEQ ID NO: 404105 - RNA, 22 nt, Human
ucugucuucaucagcaugugau

SEQ ID NO: 404106 - RNA, 20 nt, Human
uuacagaaaugauguuauuu

SEQ ID NO: 404107 - RNA, 22 nt, Human
uggauuagugcugaaaugaugg

SEQ ID NO: 404108 - RNA, 22 nt, Human
auuucacucauucauguuacuu

SEQ ID NO: 404109 - RNA, 22 nt, Human
uuucaugaggggcaaaaucuca

SEQ ID NO: 404110 - RNA, 22 nt, Human
uuugaaugcaggacauacagaa

SEQ ID NO: 404111 - RNA, 22 nt, Human
gguggagcuggaccaggagagg

SEQ ID NO: 404112 - RNA, 22 nt, Human
cuucuucaagagaaugggagac

SEQ ID NO: 404113 - RNA, 22 nt, Human
cuucuucaguugcauguauugg

SEQ ID NO: 404114 - RNA, 22 nt, Human
uugaagaggacuuugcagcugu

SEQ ID NO: 404115 - RNA, 21 nt, Human
ucaguaaaccuaaagauugua

SEQ ID NO: 404116 - RNA, 22 nt, Human
auucaacggguagaagggucuu

SEQ ID NO: 404117 - RNA, 22 nt, Human
agagacagaggcaauauagcuu

SEQ ID NO: 404118 - RNA, 22 nt, Human
uucauaaucaccaaaaacugga

SEQ ID NO: 404119 - RNA, 22 nt, Human
cauggcuuguaauaaauuuaua

SEQ ID NO: 404120 - RNA, 22 nt, Human
uaaggccaccguuauagaacca

SEQ ID NO: 404121 - RNA, 22 nt, Human
acaacaaaaucacuagucuucc

SEQ ID NO: 404122 - RNA, 22 nt, Human
cagucccuaguggagcucacag

SEQ ID NO: 404123 - RNA, 20 nt, Human
aauaaacuacugagagaugu

SEQ ID NO: 404124 - RNA, 22 nt, Human
auuaggcauucaugcagcuccu

SEQ ID NO: 404125 - RNA, 22 nt, Human
gguaugaauucacuacuuccaa

SEQ ID NO: 404126 - RNA, 22 nt, Human
ugcuuuaagagauuguuaguac

SEQ ID NO: 404127 - RNA, 22 nt, Human
cauuuguaauacugacuugcag

SEQ ID NO: 404128 - RNA, 22 nt, Human
ucaauaaaauuguuuuccuauc

SEQ ID NO: 404129 - RNA, 23 nt, Human
acuauaaaguuguucugauuuac

SEQ ID NO: 404130 - RNA, 22 nt, Human
uuaaauuccagccucauaauag

SEQ ID NO: 404131 - RNA, 22 nt, Human
aauaucagcacuuuugugguau

SEQ ID NO: 404132 - RNA, 22 nt, Human
ugaaagguguccaauauuucuc

SEQ ID NO: 404133 - RNA, 22 nt, Human
uucagaaaugaauauugguauu

SEQ ID NO: 404134 - RNA, 23 nt, Human
uaauacugcuucagaggcuuaga

SEQ ID NO: 404135 - RNA, 22 nt, Human
uaaaacugaauacauacugagg

SEQ ID NO: 404136 - RNA, 22 nt, Human
ucuuuaauuguggaagagcagc

SEQ ID NO: 404137 - RNA, 17 nt, Human
acucaggaucugggagu

SEQ ID NO: 404138 - RNA, 22 nt, Human
aaaaauugcugagaacggaauu

SEQ ID NO: 404139 - RNA, 22 nt, Human
ugccuugcacauaauauacauu

SEQ ID NO: 404140 - RNA, 22 nt, Human
aagugaagaaauacaugagaau

SEQ ID NO: 404141 - RNA, 22 nt, Human
uaaagucagauaucuggguuga

SEQ ID NO: 404142 - RNA, 22 nt, Human
ugcaggaacagaacucacuccc

SEQ ID NO: 404143 - RNA, 22 nt, Human
gaagaauccaugcuaauuuacc

SEQ ID NO: 404144 - RNA, 22 nt, Human
aaaggccaagcaugagguggac

SEQ ID NO: 404145 - RNA, 22 nt, Human
gcauucuuuuuaggagguuccu

SEQ ID NO: 404146 - RNA, 22 nt, Human
aaggcaguagguguuucaaacu

SEQ ID NO: 404147 - RNA, 22 nt, Human
uugguacaaugugcuagguagg

SEQ ID NO: 404148 - RNA, 20 nt, Human
aggauuuacuacuaccugcu

SEQ ID NO: 404149 - RNA, 22 nt, Human
uucuaacaaguggcuuguuagu

SEQ ID NO: 404150 - RNA, 22 nt, Human
guccucuggaagaugaguucuu

SEQ ID NO: 404151 - RNA, 22 nt, Human
ucugggaacacacgucacuuca

SEQ ID NO: 404152 - RNA, 22 nt, Human
augugcuuuauuaaguaaaaau

SEQ ID NO: 404153 - RNA, 22 nt, Human
gucaggauguuuauucuccagu

SEQ ID NO: 404154 - RNA, 22 nt, Human
ggcauuuaucuaauauaguuua

SEQ ID NO: 404155 - RNA, 22 nt, Human
agaaagcaucuccauuguaggu

SEQ ID NO: 404156 - RNA, 22 nt, Human
uauguuauuuucauacaacaga

SEQ ID NO: 404157 - RNA, 22 nt, Human
uaucagaaaugccuuaaauugg

SEQ ID NO: 404158 - RNA, 22 nt, Human
uuuccaagacuccaguucuccc

SEQ ID NO: 404159 - RNA, 22 nt, Human
auaaagucauuaugaagaucua

SEQ ID NO: 404160 - RNA, 22 nt, Human
uagucaccagcuacaggacagc

SEQ ID NO: 404161 - RNA, 22 nt, Human
agggcaguucaacuucauagug

SEQ ID NO: 404162 - RNA, 22 nt, Human
uugauacuauuaagcacugggc

SEQ ID NO: 404163 - RNA, 22 nt, Human
aucaggaugaagcuguagcgaa

SEQ ID NO: 404164 - RNA, 22 nt, Human
gucaaacagccuccuguucuaa

SEQ ID NO: 404165 - RNA, 22 nt, Human
auucuuauuauaguaaaacagu

SEQ ID NO: 404166 - RNA, 22 nt, Human
gcacaauuauuuaugcaguaug

SEQ ID NO: 404167 - RNA, 22 nt, Human
gcucaggaccgaggggugggaa

SEQ ID NO: 404168 - RNA, 22 nt, Human
auggcuuucucuaaugugguau

SEQ ID NO: 404169 - RNA, 22 nt, Human
aacagaauaguugauguacagu

SEQ ID NO: 404170 - RNA, 22 nt, Human
ucaguuucuaaaucuuaccaau

SEQ ID NO: 404171 - RNA, 22 nt, Human
uucuuaacuggaaaaugucaga

SEQ ID NO: 404172 - RNA, 22 nt, Human
acacauuucucuuuuuguaagu

SEQ ID NO: 404173 - RNA, 22 nt, Human
caauuucaaugaggccacaggg

SEQ ID NO: 404174 - RNA, 22 nt, Human
aucauaaagugcuaucugauug

SEQ ID NO: 404175 - RNA, 22 nt, Human
cuggcuuucccuggacaacagc

SEQ ID NO: 404176 - RNA, 22 nt, Human
ugcuuagacgucaaguacagcc

SEQ ID NO: 404177 - RNA, 22 nt, Human
uuucaaagucaauaucauuacc

SEQ ID NO: 404178 - RNA, 22 nt, Human
aaauuucaguuggaaugagcuc

SEQ ID NO: 404179 - RNA, 23 nt, Human
uaauucacauauacauugcuuca

SEQ ID NO: 404180 - RNA, 22 nt, Human
guacagaaggauuucuaguagu

SEQ ID NO: 404181 - RNA, 22 nt, Human
ugaaggccacuuccugugagcu

SEQ ID NO: 404182 - RNA, 21 nt, Human
acaugucuggucauuuuuagc

SEQ ID NO: 404183 - RNA, 22 nt, Human
ucuaaccuuugaaacugcuuuc

SEQ ID NO: 404184 - RNA, 22 nt, Human
uucaacuaauguuuauuuuaug

SEQ ID NO: 404185 - RNA, 22 nt, Human
ggcauuaagaauaucauuaaaa

SEQ ID NO: 404186 - RNA, 22 nt, Human
uauggaaagggaguuuaauuug

SEQ ID NO: 404187 - RNA, 21 nt, Human
augucaaaugcuuuauuuuau

SEQ ID NO: 404188 - RNA, 22 nt, Human
gcagagaacccagcagauuggc

SEQ ID NO: 404189 - RNA, 22 nt, Human
cuuaggcaagcagagcccaucc

SEQ ID NO: 404190 - RNA, 22 nt, Human
uacaaaguaauguauaauaucg

SEQ ID NO: 404191 - RNA, 22 nt, Human
uuaucacuuaugagcuuuuugc

SEQ ID NO: 404192 - RNA, 22 nt, Human
ucucauugguauauacaugugu

SEQ ID NO: 404193 - RNA, 22 nt, Human
aauauaugagggagcuauuuga

SEQ ID NO: 404194 - RNA, 22 nt, Human
ggauuuacaaguuuaacucuca

SEQ ID NO: 404195 - RNA, 22 nt, Human
uucuccucuguuggccuucccu

SEQ ID NO: 404196 - RNA, 22 nt, Human
aguuugaauugaaaugcagaug

SEQ ID NO: 404197 - RNA, 22 nt, Human
uuagaaaucaccucugaagauc

SEQ ID NO: 404198 - RNA, 22 nt, Human
aaaucaguuaagaugaggccau

SEQ ID NO: 404199 - RNA, 22 nt, Human
uuggagagauuaucagaccagc

SEQ ID NO: 404200 - RNA, 22 nt, Human
cauuuacauaacaguaacgcug

SEQ ID NO: 404201 - RNA, 20 nt, Human
uccaugaguuagagacuaua

SEQ ID NO: 404202 - RNA, 19 nt, Human
acaaaugauguugcacuga

SEQ ID NO: 404203 - RNA, 22 nt, Human
uucuucaaacaaaaguggcaug

SEQ ID NO: 404204 - RNA, 22 nt, Human
gccacaggcacuuaagggcugg

SEQ ID NO: 404205 - RNA, 22 nt, Human
cugaaaauguuacacaggaaga

SEQ ID NO: 404206 - RNA, 22 nt, Human
auuuccaggagaaaggauuuua

SEQ ID NO: 404207 - RNA, 19 nt, Human
acauuuaaauucagaucuc

SEQ ID NO: 404208 - RNA, 22 nt, Human
acauuguuugagaauacagaug

SEQ ID NO: 404209 - RNA, 22 nt, Human
guuaggcaguuuucuucauucu

SEQ ID NO: 404210 - RNA, 22 nt, Human
uagaacuacaagcauuaaaagu

SEQ ID NO: 404211 - RNA, 22 nt, Human
aaacugugaagcaaguacaagg

SEQ ID NO: 404212 - RNA, 22 nt, Human
cuugaaagucacaugcagcccu

SEQ ID NO: 404213 - RNA, 22 nt, Human
uuucauggcuaggacuagagug

SEQ ID NO: 404214 - RNA, 22 nt, Human
aucaggauuauuaaaucuggau

SEQ ID NO: 404215 - RNA, 22 nt, Human
uuaaaaucuaaagcaguugucu

SEQ ID NO: 404216 - RNA, 22 nt, Human
guuauauauaguauuucucuga

SEQ ID NO: 404217 - RNA, 22 nt, Human
cuuguaauuauaauguacuguu

SEQ ID NO: 404218 - RNA, 22 nt, Human
aaugccuucaaguaucugagga

SEQ ID NO: 404219 - RNA, 22 nt, Human
auguucaaacuuuuuacacacc

SEQ ID NO: 404220 - RNA, 22 nt, Human
uuuaggcagucauugaacaagu

SEQ ID NO: 404221 - RNA, 22 nt, Human
ucucacugcaaauauuauguau

SEQ ID NO: 404222 - RNA, 22 nt, Human
ucucaggacuuugggaagcuca

SEQ ID NO: 404223 - RNA, 22 nt, Human
uucaggaucacuaaacccucca

SEQ ID NO: 404224 - RNA, 22 nt, Human
gugcuuucugcugcauuccucu

SEQ ID NO: 404225 - RNA, 22 nt, Human
ucuaaacagccucuuaccaacu

SEQ ID NO: 404226 - RNA, 22 nt, Human
aaauuauucucauguguuucuu

SEQ ID NO: 404227 - RNA, 22 nt, Human
aaaugcuuagagguguucaaau

SEQ ID NO: 404228 - RNA, 22 nt, Human
guuauaaauaccuaauaggauu

SEQ ID NO: 404229 - RNA, 22 nt, Human
uuugaaagggaaauaaacuccu

SEQ ID NO: 404230 - RNA, 22 nt, Human
acuagaaauuacucagaauaaa

SEQ ID NO: 404231 - RNA, 22 nt, Human
auauaauacaaccugcuaagug

SEQ ID NO: 404232 - RNA, 22 nt, Human
ccucacugcuauguguuugcuc

SEQ ID NO: 404233 - RNA, 22 nt, Human
gcucucuuuuuccagugguggu

SEQ ID NO: 404234 - RNA, 20 nt, Human
aggcucagcugagcucuugg

SEQ ID NO: 404235 - RNA, 22 nt, Human
aggaugaauaacugaaauggug

SEQ ID NO: 404236 - RNA, 22 nt, Human
auuauuauauagggaaaguccc

SEQ ID NO: 404237 - RNA, 22 nt, Human
aaucaguguggugacuugucug

SEQ ID NO: 404238 - RNA, 22 nt, Human
ugugugaaggaauauauacuca

SEQ ID NO: 404239 - RNA, 22 nt, Human
uaacauuagguagacauaagcc

SEQ ID NO: 404240 - RNA, 22 nt, Human
ucaggagggugacaggcccugg

SEQ ID NO: 404241 - RNA, 22 nt, Human
gaauuucaagcagugcaauguu

SEQ ID NO: 404242 - RNA, 22 nt, Human
aaucagaauuuguccccugagu

SEQ ID NO: 404243 - RNA, 22 nt, Human
cuucugugcuucacaguugcca

SEQ ID NO: 404244 - RNA, 21 nt, Human
auacagaaggcagacucucuc

SEQ ID NO: 404245 - RNA, 22 nt, Human
caagaucagggugccagaaugg

SEQ ID NO: 404246 - RNA, 22 nt, Human
uucuagaugauaaaccagcagc

SEQ ID NO: 404247 - RNA, 23 nt, Human
ucaggauauugugugccaaggug

SEQ ID NO: 404248 - RNA, 22 nt, Human
cuguuaaucugcuugcaugaug

SEQ ID NO: 404249 - RNA, 22 nt, Human
auuauaaauauuuucuaggggu

SEQ ID NO: 404250 - RNA, 19 nt, Human
caggaugaucccaugacac

SEQ ID NO: 404251 - RNA, 22 nt, Human
aaaguccuugcaguuuccucuu

SEQ ID NO: 404252 - RNA, 23 nt, Human
uuuggacuugugacucuucuccu

SEQ ID NO: 404253 - RNA, 22 nt, Human
auaaagcauacuuuguaugacu

SEQ ID NO: 404254 - RNA, 22 nt, Human
uacugcaugguggaguggagcu

SEQ ID NO: 404255 - RNA, 22 nt, Human
cuucagaauccagaaucagaau

SEQ ID NO: 404256 - RNA, 19 nt, Human
augcuuuauguuauuucuu

SEQ ID NO: 404257 - RNA, 22 nt, Human
gugauuuaguguuaaguauguu

SEQ ID NO: 404258 - RNA, 22 nt, Human
ccauggcucuuaccuuguuaua

SEQ ID NO: 404259 - RNA, 22 nt, Human
aaauagauugcugaggcauuac

SEQ ID NO: 404260 - RNA, 22 nt, Human
cauuuguuaauuacuauuaucu

SEQ ID NO: 404261 - RNA, 22 nt, Human
aacaugaaaagcccagagaggu

SEQ ID NO: 404262 - RNA, 22 nt, Human
ugaugaaacugagguuccaaga

SEQ ID NO: 404263 - RNA, 22 nt, Human
ugucauaacuuagugacaaauc

SEQ ID NO: 404264 - RNA, 22 nt, Human
auucauuuagguauucacuuac

SEQ ID NO: 404265 - RNA, 22 nt, Human
uucauucugggcucuaaggaac

SEQ ID NO: 404266 - RNA, 22 nt, Human
uacagaaaucacaucgcuuuga

SEQ ID NO: 404267 - RNA, 22 nt, Human
ucacagaagaugcuggauguug

SEQ ID NO: 404268 - RNA, 22 nt, Human
aaucagugguucccagcccagg

SEQ ID NO: 404269 - RNA, 22 nt, Human
ucaauacauacaauguauagug

SEQ ID NO: 404270 - RNA, 22 nt, Human
aucuaacacuguaaacugucuu

SEQ ID NO: 404271 - RNA, 22 nt, Human
auucaaguccagcuucucuaca

SEQ ID NO: 404272 - RNA, 22 nt, Human
auugaaagauauacuguucuca

SEQ ID NO: 404273 - RNA, 22 nt, Human
uuugaauagcauaggauuacau

SEQ ID NO: 404274 - RNA, 22 nt, Human
uaaauaugcauguauccuuauc

SEQ ID NO: 404275 - RNA, 22 nt, Human
caaguccucgcuucuagcugug

SEQ ID NO: 404276 - RNA, 22 nt, Human
accagcugcugauugcuaaaug

SEQ ID NO: 404277 - RNA, 22 nt, Human
uuuauccagaaucaggauuuuu

SEQ ID NO: 404278 - RNA, 22 nt, Human
aaauggaucuguggaauacauu

SEQ ID NO: 404279 - RNA, 22 nt, Human
aaaugcuuagagguguucaaau

SEQ ID NO: 404280 - RNA, 22 nt, Human
uucuauacaaagauuucucaca

SEQ ID NO: 404281 - RNA, 22 nt, Human
aucaagaacuuauuuuggaaau

SEQ ID NO: 404282 - RNA, 22 nt, Human
uauuccaacugucauagucaua

SEQ ID NO: 404283 - RNA, 23 nt, Human
augcaagaguuucucaaacugga

SEQ ID NO: 404284 - RNA, 22 nt, Human
uacagaaguaaauaccaaaagc

SEQ ID NO: 404285 - RNA, 23 nt, Human
aauaucaaggugauguucccaga

SEQ ID NO: 404286 - RNA, 22 nt, Human
caaauucaaauuucaucagugu

SEQ ID NO: 404287 - RNA, 22 nt, Human
ugucaccaguuccaggaaauaa

SEQ ID NO: 404288 - RNA, 22 nt, Human
auaugcuugggacugauacagu

SEQ ID NO: 404289 - RNA, 22 nt, Human
cugaaagaauaagauguuuaca

SEQ ID NO: 404290 - RNA, 21 nt, Human
agaauucuuaaguauucuaau

SEQ ID NO: 404291 - RNA, 22 nt, Human
uacaugaaguugucuaaacugg

SEQ ID NO: 404292 - RNA, 22 nt, Human
uacuuugaagacaauaucugga

SEQ ID NO: 404293 - RNA, 22 nt, Human
gugaacuauuggguaucauaaa

SEQ ID NO: 404294 - RNA, 22 nt, Human
ugaucugagagcagaucaccau

SEQ ID NO: 404295 - RNA, 22 nt, Human
uuagaaaucaccucugaagauc

SEQ ID NO: 404296 - RNA, 22 nt, Human
agucuuaauagagaaaaacugu

SEQ ID NO: 404297 - RNA, 22 nt, Human
agaaagcaucuccauuguaggu

SEQ ID NO: 404298 - RNA, 22 nt, Human
uucacagaauggcaaguuaugg

SEQ ID NO: 404299 - RNA, 22 nt, Human
uuauuauugugguugcauuauc

SEQ ID NO: 404300 - RNA, 22 nt, Human
uuacagaacugcccuaguuggc

SEQ ID NO: 404301 - RNA, 22 nt, Human
aaguccuuuaauaucacauagu

SEQ ID NO: 404302 - RNA, 22 nt, Human
aucuaucccaguuuaacucauu

SEQ ID NO: 404303 - RNA, 22 nt, Human
ggcauuaagaauaucauuaaaa

SEQ ID NO: 404304 - RNA, 22 nt, Human
cagagacauucaguaaauuauc

SEQ ID NO: 404305 - RNA, 22 nt, Human
gugaauaacuuucuauguuaau

SEQ ID NO: 404306 - RNA, 22 nt, Human
auacuagacuguucuguuauca

SEQ ID NO: 404307 - RNA, 22 nt, Human
uuucaacauauaccauaaugcc

SEQ ID NO: 404308 - RNA, 22 nt, Human
guccuuaguuacuuuucauguc

SEQ ID NO: 404309 - RNA, 22 nt, Human
augaaacaguguguauagcaaa

SEQ ID NO: 404310 - RNA, 22 nt, Human
uuuaggcauacuuuugggagaa

SEQ ID NO: 404311 - RNA, 17 nt, Human
aaucagauuucugagga

SEQ ID NO: 404312 - RNA, 22 nt, Human
guuccaaauuuggaucuuuagg

SEQ ID NO: 404313 - RNA, 22 nt, Human
uggcauuucuguuagacucuca

SEQ ID NO: 404314 - RNA, 23 nt, Human
uaauacugcuucagaggcuuaga

SEQ ID NO: 404315 - RNA, 22 nt, Human
cauaacaguggcuucagcaagu

SEQ ID NO: 404316 - RNA, 22 nt, Human
uaaacauggauucugaucacag

SEQ ID NO: 404317 - RNA, 22 nt, Human
ugcaggaagacuucccaagcca

SEQ ID NO: 404318 - RNA, 22 nt, Human
aucauaaaccacuuuguaaucu

SEQ ID NO: 404319 - RNA, 22 nt, Human
gcagagacuaguagugcagacu

SEQ ID NO: 404320 - RNA, 22 nt, Human
aauuaaaugacaggggaagaug

SEQ ID NO: 404321 - RNA, 22 nt, Human
uuugaauaaucacugggcauua

SEQ ID NO: 404322 - RNA, 22 nt, Human
uucaaacauucaaauaaaccgg

SEQ ID NO: 404323 - RNA, 22 nt, Human
acaugcuuuaacuuauuuugau

SEQ ID NO: 404324 - RNA, 22 nt, Human
uaagaaucuauuaggaauaugu

SEQ ID NO: 404325 - RNA, 21 nt, Human
cucagagaaaugucugggagc

SEQ ID NO: 404326 - RNA, 22 nt, Human
uccagaauauuugggaaagaug

SEQ ID NO: 404327 - RNA, 22 nt, Human
auucauaaguaaaugauuaccu

SEQ ID NO: 404328 - RNA, 22 nt, Human
aaucagaaucaguugacacagc

SEQ ID NO: 404329 - RNA, 22 nt, Human
auaaaaguucaagagaguacag

SEQ ID NO: 404330 - RNA, 22 nt, Human
aaagcaauggaugagaaucugu

SEQ ID NO: 404331 - RNA, 19 nt, Human
aucugagauuauaaacaga

SEQ ID NO: 404332 - RNA, 22 nt, Human
aguaaacauagaauguucuucc

SEQ ID NO: 404333 - RNA, 23 nt, Human
ggauuuaguggaugagcugagug

SEQ ID NO: 404334 - RNA, 22 nt, Human
uggcauuucaguauuuucauaa

SEQ ID NO: 404335 - RNA, 22 nt, Human
aaagaaucagaagucucaaaca

SEQ ID NO: 404336 - RNA, 22 nt, Human
ugucaccaccggaagaaacugc

SEQ ID NO: 404337 - RNA, 22 nt, Human
agaauaucguagcauauuaucu

SEQ ID NO: 404338 - RNA, 22 nt, Human
aaaugucagaggaacauauuga

SEQ ID NO: 404339 - RNA, 22 nt, Human
acauaauaaaaauaacagcuca

SEQ ID NO: 404340 - RNA, 22 nt, Human
aauuccaggaugcaggaggugc

SEQ ID NO: 404341 - RNA, 21 nt, Human
acaugucuggucauuuuuagc

SEQ ID NO: 404342 - RNA, 22 nt, Human
agaagugagugugacucagcag

SEQ ID NO: 404343 - RNA, 22 nt, Human
auuucaacagaguuugaaggca

SEQ ID NO: 404344 - RNA, 22 nt, Human
uguaagaaucagucuuuaaugu

SEQ ID NO: 404345 - RNA, 22 nt, Human
augugaaaccugugaguagagu

SEQ ID NO: 404346 - RNA, 22 nt, Human
acuggauuccauugugcaaaga

SEQ ID NO: 404347 - RNA, 21 nt, Human
accaaaaccuauacuuucugu

SEQ ID NO: 404348 - RNA, 22 nt, Human
uauaacaggaaguauucaaaca

SEQ ID NO: 404349 - RNA, 22 nt, Human
ucccaguuuuucuccacuaagg

SEQ ID NO: 404350 - RNA, 21 nt, Human
caaucaguuggcauuugagca

SEQ ID NO: 404351 - RNA, 22 nt, Human
uggagaauuuugucaccagaca

SEQ ID NO: 404352 - RNA, 22 nt, Human
gcauggcugguguccugaggga

SEQ ID NO: 404353 - RNA, 20 nt, Human
uacagaaugcaauaaaaugg

SEQ ID NO: 404354 - RNA, 22 nt, Human
aaguccuuggagaauagaaagg

SEQ ID NO: 404355 - RNA, 22 nt, Human
aaucaguguggugacuugucug

SEQ ID NO: 404356 - RNA, 22 nt, Human
auuuaguguauucuaauaugug

SEQ ID NO: 404357 - RNA, 22 nt, Human
uaugaacauguucauugacuua

SEQ ID NO: 404358 - RNA, 22 nt, Human
ucauaauacaaagaguucugca

SEQ ID NO: 404359 - RNA, 22 nt, Human
caacuuuucugugaauuuaagu

SEQ ID NO: 404360 - RNA, 22 nt, Human
aucaaaaccuugacuuuuaaug

SEQ ID NO: 404361 - RNA, 22 nt, Human
ucuuuaauguacuuucuuucac

SEQ ID NO: 404362 - RNA, 22 nt, Human
uuuccaaaaugaaucuaaugca

SEQ ID NO: 404363 - RNA, 22 nt, Human
gaaguucaaaagacagauuuga

SEQ ID NO: 404364 - RNA, 22 nt, Human
caucagaagaaagacaaaugau

SEQ ID NO: 404365 - RNA, 22 nt, Human
uagucaccuuuggcaccugcaa

SEQ ID NO: 404366 - RNA, 22 nt, Human
gacaauacagaaagggacaugc

SEQ ID NO: 404367 - RNA, 22 nt, Human
ccagaauuuggaucaugauuuu

SEQ ID NO: 404368 - RNA, 22 nt, Human
auuauucaaucauauuaaaagu

SEQ ID NO: 404369 - RNA, 22 nt, Human
guaaacauuacugugcuguaua

SEQ ID NO: 404370 - RNA, 22 nt, Human
caguccuuagucuggauggcuu

SEQ ID NO: 404371 - RNA, 22 nt, Human
uggcuuuauaaauccacugguu

SEQ ID NO: 404372 - RNA, 22 nt, Human
ugaaguaacuguccaggaucca

SEQ ID NO: 404373 - RNA, 22 nt, Human
uucaccgugaaccgauuccuca

SEQ ID NO: 404374 - RNA, 22 nt, Human
uuuuugcugauaagcagaauuc

SEQ ID NO: 404375 - RNA, 22 nt, Human
uucauagaucucaauuuugagg

SEQ ID NO: 404376 - RNA, 22 nt, Human
gauuucaaggauguuagaggug

SEQ ID NO: 404377 - RNA, 22 nt, Human
cagucaccuagacagaacuuac

SEQ ID NO: 404378 - RNA, 22 nt, Human
uguccuuacaaggucccuuucg

SEQ ID NO: 404379 - RNA, 22 nt, Human
uucacagaauugucuugacugg

SEQ ID NO: 404380 - RNA, 22 nt, Human
cugaaaggguuacauaguaagu

SEQ ID NO: 404381 - RNA, 22 nt, Human
uuacagaaagguugugggauag

SEQ ID NO: 404382 - RNA, 22 nt, Human
gaauuucaaagagguuaagagg

SEQ ID NO: 404383 - RNA, 22 nt, Human
caggccagggagaauaugaagc

SEQ ID NO: 404384 - RNA, 22 nt, Human
agucaccauuuucaccugccuc

SEQ ID NO: 404385 - RNA, 22 nt, Human
gaguccuuuugugccacaggga

SEQ ID NO: 404386 - RNA, 22 nt, Human
aauuuacacuucauuuggaggg

SEQ ID NO: 404387 - RNA, 22 nt, Human
aauucucagguaaaaguuaagu

SEQ ID NO: 404388 - RNA, 22 nt, Human
augacaaaagaagacaugaggu

SEQ ID NO: 404389 - RNA, 22 nt, Human
aggauuuaggagcuggcuaacg

SEQ ID NO: 404390 - RNA, 22 nt, Human
uuuaggaaugugguuuuugagc

SEQ ID NO: 404391 - RNA, 22 nt, Human
uuuauccaguguuggaauuuuu

SEQ ID NO: 404392 - RNA, 22 nt, Human
uagaauucaagauucaacaggc

SEQ ID NO: 404393 - RNA, 22 nt, Human
auuucaacguuagauguaauag

SEQ ID NO: 404394 - RNA, 22 nt, Human
ucaaaucagcaagcagcuuccc

SEQ ID NO: 404395 - RNA, 22 nt, Human
cugugcagcuggcuuccuggaa

SEQ ID NO: 404396 - RNA, 22 nt, Human
guaaacauuuucaucugugccc

SEQ ID NO: 404397 - RNA, 22 nt, Human
ucuauaaauuaugcagucucag

SEQ ID NO: 404398 - RNA, 22 nt, Human
gauaaaauauguggccuuuagu

SEQ ID NO: 404399 - RNA, 22 nt, Human
ucuggauccuaugcacuggacu

SEQ ID NO: 404400 - RNA, 22 nt, Human
aacauguugcuuuaauaauauu

SEQ ID NO: 404401 - RNA, 22 nt, Human
cagaagucacccucagaauaac

SEQ ID NO: 404402 - RNA, 22 nt, Human
uaauuauaacaguuacaucuua

SEQ ID NO: 404403 - RNA, 22 nt, Human
aaguccuuaggaagcagucguu

SEQ ID NO: 404404 - RNA, 22 nt, Human
cacaauuuccaagucauguuau

SEQ ID NO: 404405 - RNA, 22 nt, Human
cauaagaagguaacauccuuaa

SEQ ID NO: 404406 - RNA, 22 nt, Human
uucagaaaaaacuucaauaagu

SEQ ID NO: 404407 - RNA, 22 nt, Human
uauggcuuuuaacugucguaug

SEQ ID NO: 404408 - RNA, 22 nt, Human
uuuacagaugaggauacugagg

SEQ ID NO: 404409 - RNA, 22 nt, Human
uuacagaaggaacacuacucag

SEQ ID NO: 404410 - RNA, 22 nt, Human
uuagaaauacaagugagguuga

SEQ ID NO: 404411 - RNA, 22 nt, Human
uaaaacuuaacuauccagauua

SEQ ID NO: 404412 - RNA, 22 nt, Human
acauucacuauguccaaacucu

SEQ ID NO: 404413 - RNA, 22 nt, Human
uuaauuaugcaaaaggccccau

SEQ ID NO: 404414 - RNA, 22 nt, Human
uaguccuuuaucaaacauuuau

SEQ ID NO: 404415 - RNA, 22 nt, Human
aauauaugagggagcuauuuga

SEQ ID NO: 404416 - RNA, 19 nt, Human
gcaggaaaugagugauugc

SEQ ID NO: 404417 - RNA, 22 nt, Human
uucacagagaguaugcagagaa

SEQ ID NO: 404418 - RNA, 22 nt, Human
agaaccucuggauacaguuuaa

SEQ ID NO: 404419 - RNA, 22 nt, Human
ggcauuuacauaaucuuauuua

SEQ ID NO: 404420 - RNA, 22 nt, Human
gaaagccaucuggcugcuggga

SEQ ID NO: 404421 - RNA, 22 nt, Human
guuaggcagugugguauagcag

SEQ ID NO: 404422 - RNA, 22 nt, Human
gugauuuaguguuaaguauguu

SEQ ID NO: 404423 - RNA, 22 nt, Human
gauuuucauuugcacucuagaa

SEQ ID NO: 404424 - RNA, 22 nt, Human
aacagugaguugaugacugaau

SEQ ID NO: 404425 - RNA, 22 nt, Human
aauuccagaggaggacaguccu

SEQ ID NO: 404426 - RNA, 22 nt, Human
caaagucagcugccagucccaa

SEQ ID NO: 404427 - RNA, 22 nt, Human
uaaguccuaacagacugggggc

SEQ ID NO: 404428 - RNA, 22 nt, Human
guagaaaugguguguuucuucu

SEQ ID NO: 404429 - RNA, 22 nt, Human
agcaauuuucccuuagucuuug

SEQ ID NO: 404430 - RNA, 22 nt, Human
uaaagcaguguugggucggacg

SEQ ID NO: 404431 - RNA, 17 nt, Human
uaucagaauguguuuac

SEQ ID NO: 404432 - RNA, 20 nt, Human
uggccuuuaaauaguauucc

SEQ ID NO: 404433 - RNA, 22 nt, Human
cuauagaaaauuguaucacacg

SEQ ID NO: 404434 - RNA, 22 nt, Human
acagaauuugcuugggcaaugg

SEQ ID NO: 404435 - RNA, 21 nt, Human
gcuauacagaauggccagagg

SEQ ID NO: 404436 - RNA, 21 nt, Human
auccuuagcacuuagaagagu

SEQ ID NO: 404437 - RNA, 22 nt, Human
ugcuuaauguacgugaguguac

SEQ ID NO: 404438 - RNA, 22 nt, Human
cuuaggcaaccaggucaaugcu

SEQ ID NO: 404439 - RNA, 22 nt, Human
cuauacagagcauccuuaacuu

SEQ ID NO: 404440 - RNA, 22 nt, Human
cauacuuugggauaagagugga

SEQ ID NO: 404441 - RNA, 22 nt, Human
auuaggcagggcaugguggcuc

SEQ ID NO: 404442 - RNA, 22 nt, Human
agauuuacugagaacugauuac

SEQ ID NO: 404443 - RNA, 22 nt, Human
cauagaaacugagacaaggauu

SEQ ID NO: 404444 - RNA, 22 nt, Human
uuucuagugguuaagauuuaca

SEQ ID NO: 404445 - RNA, 22 nt, Human
augaauaaguaaacuccuuugg

SEQ ID NO: 404446 - RNA, 22 nt, Human
uucauacucacuccaauaacug

SEQ ID NO: 404447 - RNA, 22 nt, Human
ucaaacauguuagcagucugug

SEQ ID NO: 404448 - RNA, 22 nt, Human
acaaaauuguguuaaacuuuau

SEQ ID NO: 404449 - RNA, 22 nt, Human
agcauauaaauggacauauuug

SEQ ID NO: 404450 - RNA, 22 nt, Human
auuaaauguuggacguauacau

SEQ ID NO: 404451 - RNA, 22 nt, Human
uaauuucacugauaugaaguca

SEQ ID NO: 404452 - RNA, 22 nt, Human
uuacagaauguucuuccaacag

SEQ ID NO: 404453 - RNA, 22 nt, Human
augcuuaacucuguacauaguu

SEQ ID NO: 404454 - RNA, 22 nt, Human
agauuucacaugcugcucuauu

SEQ ID NO: 404455 - RNA, 22 nt, Human
aaucagaaagaucuugaugaga

SEQ ID NO: 404456 - RNA, 22 nt, Human
gauuuacaaagcucucuagugu

SEQ ID NO: 404457 - RNA, 22 nt, Human
augaaaacggaccagagcuauu

SEQ ID NO: 404458 - RNA, 22 nt, Human
uguggaaagucaaguuccagga

SEQ ID NO: 404459 - RNA, 22 nt, Human
uaaaauguuugcaagagaccag

SEQ ID NO: 404460 - RNA, 22 nt, Human
aguauaauuagauaucaaaagu

SEQ ID NO: 404461 - RNA, 22 nt, Human
auauaggcuaacaacuauugag

SEQ ID NO: 404462 - RNA, 22 nt, Human
aagaaugauuacaaagcaacga

SEQ ID NO: 404463 - RNA, 22 nt, Human
uauuccaaaauaguuaagcacu

SEQ ID NO: 404464 - RNA, 22 nt, Human
ugguuuaaccugucucuuauua

SEQ ID NO: 404465 - RNA, 22 nt, Human
ccuggaucccgauggcugugag

SEQ ID NO: 404466 - RNA, 21 nt, Human
agccagucuguuuucuagugc

SEQ ID NO: 404467 - RNA, 22 nt, Human
auggcuuuucacagaggguucu

SEQ ID NO: 404468 - RNA, 22 nt, Human
acuucacacagcaaauuuaucu

SEQ ID NO: 404469 - RNA, 22 nt, Human
auucuacaacccaauaauaauu

SEQ ID NO: 404470 - RNA, 15 nt, Human
aaucagaaguguggc

SEQ ID NO: 404471 - RNA, 22 nt, Human
uucaagacugcgacuaaugccc

SEQ ID NO: 404472 - RNA, 22 nt, Human
aacauguaaccagcauucaucu

SEQ ID NO: 404473 - RNA, 22 nt, Human
ugcaacuuguuuggagagaaag

SEQ ID NO: 404474 - RNA, 22 nt, Human
uuucaacuugaagaauugauac

SEQ ID NO: 404475 - RNA, 22 nt, Human
aaacauguaauucugcuuaaga

SEQ ID NO: 404476 - RNA, 22 nt, Human
uacugaaauacuaagaaguuaa

SEQ ID NO: 404477 - RNA, 20 nt, Human
gaaguccuuucacucuuccc

SEQ ID NO: 404478 - RNA, 22 nt, Human
auacaucaugcuccauauauuu

SEQ ID NO: 404479 - RNA, 22 nt, Human
auaggcuuauauaaaaacaucu

SEQ ID NO: 404480 - RNA, 22 nt, Human
acaugcuuguuuuucacaaccu

SEQ ID NO: 404481 - RNA, 22 nt, Human
ucauaaaaguacucauguucau

SEQ ID NO: 404482 - RNA, 22 nt, Human
aauaauuuccagccaacuggaa

SEQ ID NO: 404483 - RNA, 22 nt, Human
augcuuuaaaugucuuuugcuu

SEQ ID NO: 404484 - RNA, 22 nt, Human
ccauggcuuuugagucucaaga

SEQ ID NO: 404485 - RNA, 22 nt, Human
cauaagaauauuccauccuuug

SEQ ID NO: 404486 - RNA, 22 nt, Human
aaauucaauuaacuuucaugcu

SEQ ID NO: 404487 - RNA, 22 nt, Human
uauggaaauaauuagacaagug

SEQ ID NO: 404488 - RNA, 22 nt, Human
aagcauuuuagauaaagcauca

SEQ ID NO: 404489 - RNA, 19 nt, Human
acagaaauuaguuauuuuc

SEQ ID NO: 404490 - RNA, 22 nt, Human
uuccacaauguaugaauaagau

SEQ ID NO: 404491 - RNA, 22 nt, Human
uuccuuagccugccuuccaggg

SEQ ID NO: 404492 - RNA, 22 nt, Human
cauggcuuuuuagcauauucaa

SEQ ID NO: 404493 - RNA, 22 nt, Human
ucagccaguugccccaguuagu

SEQ ID NO: 404494 - RNA, 22 nt, Human
gaguccuuaauacacuggugga

SEQ ID NO: 404495 - RNA, 22 nt, Human
cuacagaaggagaaauggguaa

SEQ ID NO: 404496 - RNA, 22 nt, Human
auguacaaaauguuuugaaaug

SEQ ID NO: 404497 - RNA, 22 nt, Human
aaauugcagaugcuaaaugacu

SEQ ID NO: 404498 - RNA, 21 nt, Human
auucagaguaauucaucuuua

SEQ ID NO: 404499 - RNA, 22 nt, Human
aaagccuuugucucaggcucug

SEQ ID NO: 404500 - RNA, 22 nt, Human
aaagaaucuauauaucaccacc

SEQ ID NO: 404501 - RNA, 22 nt, Human
cagaauuuuucgaauguacugu

SEQ ID NO: 404502 - RNA, 22 nt, Human
caucagaaccagcugggugagg

SEQ ID NO: 404503 - RNA, 22 nt, Human
ugugugaaggaauauauacuca

SEQ ID NO: 404504 - RNA, 22 nt, Human
augaaaauugacagcggaagua

SEQ ID NO: 404505 - RNA, 22 nt, Human
aauaagauccugaagauauguu

SEQ ID NO: 404506 - RNA, 22 nt, Human
cagaucuguaguaaaagaucuc

SEQ ID NO: 404507 - RNA, 22 nt, Human
uccagaauacucugaaaucauu

SEQ ID NO: 404508 - RNA, 22 nt, Human
ucacacauucuagguauguuga

SEQ ID NO: 404509 - RNA, 22 nt, Human
augguuuacugaucuuuuuggu

SEQ ID NO: 404510 - RNA, 22 nt, Human
aauuucaaacucuugcccucag

SEQ ID NO: 404511 - RNA, 22 nt, Human
caacuuucuguuaaauguuagu

SEQ ID NO: 404512 - RNA, 22 nt, Human
cuuuaacaaaugacucuugucu

SEQ ID NO: 404513 - RNA, 22 nt, Human
auaaagcaucuagucugucacu

SEQ ID NO: 404514 - RNA, 20 nt, Human
uguuccaagcuaaugaauga

SEQ ID NO: 404515 - RNA, 22 nt, Human
cuagaaauacaggcacgugcca

SEQ ID NO: 404516 - RNA, 22 nt, Human
auaaaugccucagaaucauccc

SEQ ID NO: 404517 - RNA, 22 nt, Human
auggaucagaaucccgggaggg

SEQ ID NO: 404518 - RNA, 22 nt, Human
aucagaaauagucauguuacuu

SEQ ID NO: 404519 - RNA, 22 nt, Human
ccaaagcaagucacaugaucaa

SEQ ID NO: 404520 - RNA, 22 nt, Human
agaaucugguagaaccaaggau

SEQ ID NO: 404521 - RNA, 22 nt, Human
auacagaaaaguggauagccag

SEQ ID NO: 404522 - RNA, 22 nt, Human
ucagaacauugacauucuuauu

SEQ ID NO: 404523 - RNA, 22 nt, Human
aguacaauuuaaugaagauagc

SEQ ID NO: 404524 - RNA, 22 nt, Human
uucucuuagcuguaaagucaau

SEQ ID NO: 404525 - RNA, 22 nt, Human
uuaacacuaucugucauaauua

SEQ ID NO: 404526 - RNA, 22 nt, Human
cuggcuuuggucaugugaucau

SEQ ID NO: 404527 - RNA, 22 nt, Human
gcagaauucuacagaugauaaa

SEQ ID NO: 404528 - RNA, 21 nt, Human
aaaguguucagaccaguucug

SEQ ID NO: 404529 - RNA, 22 nt, Human
acauaauagguaccugaauaau

SEQ ID NO: 404530 - RNA, 22 nt, Human
acaacaaaaucacuagucuucc

SEQ ID NO: 404531 - RNA, 22 nt, Human
auuuaguuuaggaaaaguaggu

SEQ ID NO: 404532 - RNA, 22 nt, Human
augugaaauagcuggauaugaa

SEQ ID NO: 404533 - RNA, 22 nt, Human
gauggcuucacuuacauggcug

SEQ ID NO: 404534 - RNA, 22 nt, Human
caguccuucauuccuccuuuga

SEQ ID NO: 404535 - RNA, 22 nt, Human
cugaauaauuuucuguuguaug

SEQ ID NO: 404536 - RNA, 22 nt, Human
ugcagagaagaggacaguucua

SEQ ID NO: 404537 - RNA, 22 nt, Human
aggaaaaauaaggcagcagggc

SEQ ID NO: 404538 - RNA, 22 nt, Human
aaucaugugggauagucugcuc

SEQ ID NO: 404539 - RNA, 22 nt, Human
caagaaucagaccugucagggu

SEQ ID NO: 404540 - RNA, 22 nt, Human
caaaagucuguccuuuaacuuc

SEQ ID NO: 404541 - RNA, 22 nt, Human
uuugaacaugcugcaugauaau

SEQ ID NO: 404542 - RNA, 18 nt, Human
aaaaagugcucaggccua

SEQ ID NO: 404543 - RNA, 21 nt, Human
acuuuaauauacaugaggagg

SEQ ID NO: 404544 - RNA, 22 nt, Human
uuucaucucucuaaaagacagu

SEQ ID NO: 404545 - RNA, 22 nt, Human
aauuccagcuaggaaaagcuuc

SEQ ID NO: 404546 - RNA, 22 nt, Human
gaguccuuggcaucaucaguac

SEQ ID NO: 404547 - RNA, 21 nt, Human
uccaaaaaggagcguccuucu

SEQ ID NO: 404548 - RNA, 22 nt, Human
uggcauuugggcuggcuuuucu

SEQ ID NO: 404549 - RNA, 22 nt, Human
cuuaaagaaauugaggagagga

SEQ ID NO: 404550 - RNA, 22 nt, Human
auauacugaggagacuuuauau

SEQ ID NO: 404551 - RNA, 22 nt, Human
uuaauaaaguaugaauuggaaa

SEQ ID NO: 404552 - RNA, 22 nt, Human
cuauuacauuucuggacauuca

SEQ ID NO: 404553 - RNA, 22 nt, Human
guacagaaauggggccccaggu

SEQ ID NO: 404554 - RNA, 22 nt, Human
gauagaaagaauauagauucca

SEQ ID NO: 404555 - RNA, 22 nt, Human
guuuaaucagaggaauuauaga

SEQ ID NO: 404556 - RNA, 22 nt, Human
aaagucaucagaaccuuccaga

SEQ ID NO: 404557 - RNA, 22 nt, Human
uguaaauaaugcauguaaauca

SEQ ID NO: 404558 - RNA, 22 nt, Human
caccagacagguguaugcauau

SEQ ID NO: 404559 - RNA, 22 nt, Human
agucaccaggguuugcuggguu

SEQ ID NO: 404560 - RNA, 22 nt, Human
uuucauugaacuaaagaaucug

SEQ ID NO: 404561 - RNA, 22 nt, Human
uccaaaguguugggauuauagg

SEQ ID NO: 404562 - RNA, 22 nt, Human
uauaagaaauugccaaccuguu

SEQ ID NO: 404563 - RNA, 19 nt, Human
uuccuuagaggaggcggug

SEQ ID NO: 404564 - RNA, 22 nt, Human
ugugugaauggauuauucuauu

SEQ ID NO: 404565 - RNA, 22 nt, Human
aaaugucagaagcuuuacuucu

SEQ ID NO: 404566 - RNA, 22 nt, Human
uggauuuaccacagggccacag

SEQ ID NO: 404567 - RNA, 18 nt, Human
gcacuucacccagcuagu

SEQ ID NO: 404568 - RNA, 22 nt, Human
ucagaaaauaacuguuaguuug

SEQ ID NO: 404569 - RNA, 22 nt, Human
uuaugaaggaucagguacuugg

SEQ ID NO: 404570 - RNA, 23 nt, Human
uuaaaggcagauguugaguauua

SEQ ID NO: 404571 - RNA, 22 nt, Human
agaaccucaauuauuuuugcac

SEQ ID NO: 404572 - RNA, 22 nt, Human
uauuaaagggaaguuaugcaug

SEQ ID NO: 404573 - RNA, 22 nt, Human
uaaauaucaccuggaauuguua

SEQ ID NO: 404574 - RNA, 22 nt, Human
augguuuuagaaucaggaaaaa

SEQ ID NO: 404575 - RNA, 22 nt, Human
uaggcagaauuguugaaugaag

SEQ ID NO: 404576 - RNA, 19 nt, Human
uggcauuuggaggcaaccu

SEQ ID NO: 404577 - RNA, 22 nt, Human
caaucaguuucuguuguauaau

SEQ ID NO: 404578 - RNA, 22 nt, Human
aucagaaauugcccagcuguuu

SEQ ID NO: 404579 - RNA, 22 nt, Human
auuccaaagcacaucagaacua

SEQ ID NO: 404580 - RNA, 22 nt, Human
guauuugcaaaucuaaaagaga

SEQ ID NO: 404581 - RNA, 22 nt, Human
cguauacaugaagacauugcug

SEQ ID NO: 404582 - RNA, 22 nt, Human
uaaagucaucuuuaaacaugcc

SEQ ID NO: 404583 - RNA, 21 nt, Human
auacagaaggcagacucucuc

SEQ ID NO: 404584 - RNA, 22 nt, Human
gaaguccuccuaucuugcucuu

SEQ ID NO: 404585 - RNA, 22 nt, Human
ucauaaagcauuucagcuuuug

SEQ ID NO: 404586 - RNA, 22 nt, Human
uuuccaaaggaguaccacgcau

SEQ ID NO: 404587 - RNA, 22 nt, Human
auauuaaauggauuuugggagc

SEQ ID NO: 404588 - RNA, 22 nt, Human
uucuaacaaguggcuuguuagu

SEQ ID NO: 404589 - RNA, 22 nt, Human
aaagcagguugcaauuacagug

SEQ ID NO: 404590 - RNA, 22 nt, Human
uuacagaacugucuugaaauuu

SEQ ID NO: 404591 - RNA, 22 nt, Human
gugaauaauauuguuuauaaaa

SEQ ID NO: 404592 - RNA, 22 nt, Human
guacagaaaugugaugacgcaa

SEQ ID NO: 404593 - RNA, 22 nt, Human
ucuaaacaguuucacucuuaau

SEQ ID NO: 404594 - RNA, 22 nt, Human
acagguuuuuguggauauaugu

SEQ ID NO: 404595 - RNA, 22 nt, Human
cuguuaauugugaauuuuacau

SEQ ID NO: 404596 - RNA, 22 nt, Human
acagcauugagagcuaaauuua

SEQ ID NO: 404597 - RNA, 18 nt, Human
aacaguuuccagauucuc

SEQ ID NO: 404598 - RNA, 18 nt, Human
uauaaacacacuuagguu

SEQ ID NO: 404599 - RNA, 22 nt, Human
aguccuuaugagaugcugccuu

SEQ ID NO: 404600 - RNA, 22 nt, Human
auaugaaaguaagcaugugugu

SEQ ID NO: 404601 - RNA, 22 nt, Human
guuauaaauaccuaauaggauu

SEQ ID NO: 404602 - RNA, 22 nt, Human
ugguuuuagaugccuuuacugc

SEQ ID NO: 404603 - RNA, 22 nt, Human
caaguccaucagauaagcaaga

SEQ ID NO: 404604 - RNA, 23 nt, Human
auauggcuguuguguguuaacau

SEQ ID NO: 404605 - RNA, 22 nt, Human
guuaggcagcccaagaugucag

SEQ ID NO: 404606 - RNA, 22 nt, Human
ucuauacaugugcacacacauc

SEQ ID NO: 404607 - RNA, 22 nt, Human
ugucaccaaguugaugaaugca

SEQ ID NO: 404608 - RNA, 22 nt, Human
auuccaaacagugcugcagacu

SEQ ID NO: 404609 - RNA, 22 nt, Human
agaauaaucacugaaguucaaa

SEQ ID NO: 404610 - RNA, 22 nt, Human
auuccaaagacagaagcagcug

SEQ ID NO: 404611 - RNA, 22 nt, Human
uuauaacaacaguuuacuuuaa

SEQ ID NO: 404612 - RNA, 22 nt, Human
ucuauacaaguuucacuuugac

SEQ ID NO: 404613 - RNA, 22 nt, Human
uuuaggcaagaacucacugaga

SEQ ID NO: 404614 - RNA, 22 nt, Human
uuuauuaugauggacaccuucg

SEQ ID NO: 404615 - RNA, 22 nt, Human
gaaguccucaaugcauugucuu

SEQ ID NO: 404616 - RNA, 22 nt, Human
gaugaaaaaagacgagcauaua

SEQ ID NO: 404617 - RNA, 22 nt, Human
uguacaaucugaugauguaugg

SEQ ID NO: 404618 - RNA, 22 nt, Human
caaguccuaggucugauugaac

SEQ ID NO: 404619 - RNA, 22 nt, Human
auggcauuccaagucuucuuuu

SEQ ID NO: 404620 - RNA, 22 nt, Human
caucagaagauggcucuggaaa

SEQ ID NO: 404621 - RNA, 22 nt, Human
uuccuuagcagaccugguaucc

SEQ ID NO: 404622 - RNA, 22 nt, Human
cuggauuugccuauggugcuuu

SEQ ID NO: 404623 - RNA, 22 nt, Human
uacugugacagaguacuuaaac

SEQ ID NO: 404624 - RNA, 22 nt, Human
aagcagggcuuuaagcgguuuu

SEQ ID NO: 404625 - RNA, 22 nt, Human
aguccuuacucgggggcccaga

SEQ ID NO: 404626 - RNA, 22 nt, Human
caaguccuccaugugacuaggu

SEQ ID NO: 404627 - RNA, 22 nt, Human
uaaagacaauaggaaaguuguu

SEQ ID NO: 404628 - RNA, 22 nt, Human
aaauagauugcugaggcauuac

SEQ ID NO: 404629 - RNA, 22 nt, Human
cuacagaagaaacuaucacuau

SEQ ID NO: 404630 - RNA, 22 nt, Human
caaauuccucagaaucagaaaa

SEQ ID NO: 404631 - RNA, 22 nt, Human
ugcuuaauagugcacugguuuc

SEQ ID NO: 404632 - RNA, 22 nt, Human
aacacuuucuauuauuaugguu

SEQ ID NO: 404633 - RNA, 22 nt, Human
cagagauuauuauaacuaauua

SEQ ID NO: 404634 - RNA, 22 nt, Human
uacagaaaaacuggcauugaag

SEQ ID NO: 404635 - RNA, 22 nt, Human
acuagaaacuaauggauuauua

SEQ ID NO: 404636 - RNA, 22 nt, Human
guacagaaugcuugguaaggca

SEQ ID NO: 404637 - RNA, 22 nt, Human
uaacagaaauaguaggugaggg

SEQ ID NO: 404638 - RNA, 22 nt, Human
gauuucaaccuaacaguaugac

SEQ ID NO: 404639 - RNA, 22 nt, Human
caacuuuaugauugguuuguca

SEQ ID NO: 404640 - RNA, 20 nt, Human
cuguaucagguuacaaagua

SEQ ID NO: 404641 - RNA, 22 nt, Human
ccuggaucgaugccgagggaaa

SEQ ID NO: 404642 - RNA, 22 nt, Human
aaaugcauggcuguuuuaaagc

SEQ ID NO: 404643 - RNA, 22 nt, Human
cuuauacacccucuucccaggc

SEQ ID NO: 404644 - RNA, 22 nt, Human
ugcagagaaaccaguggaggac

SEQ ID NO: 404645 - RNA, 22 nt, Human
uacaauacuuaaccuauuuugc

SEQ ID NO: 404646 - RNA, 22 nt, Human
uuacagauggaucuagcaaaau

SEQ ID NO: 404647 - RNA, 22 nt, Human
acaacuuugacccuuguucuua

SEQ ID NO: 404648 - RNA, 22 nt, Human
aaucagugguucccagcccagg

SEQ ID NO: 404649 - RNA, 22 nt, Human
uuggagagaggcugcucaggcu

SEQ ID NO: 404650 - RNA, 22 nt, Human
uuagaaauauggugcugccgcc

SEQ ID NO: 404651 - RNA, 22 nt, Human
ucagagaaauaauugcugaguu

SEQ ID NO: 404652 - RNA, 20 nt, Human
aaucagaaagugugagcucu

SEQ ID NO: 404653 - RNA, 22 nt, Human
uuaguacugauagggucaauca

SEQ ID NO: 404654 - RNA, 22 nt, Human
agacaacaucacuaaagcugag

SEQ ID NO: 404655 - RNA, 23 nt, Human
cauaaaauauuaguaugguagca

SEQ ID NO: 404656 - RNA, 22 nt, Human
aaagcaaugcuuguggaaugua

SEQ ID NO: 404657 - RNA, 22 nt, Human
uaaagccacgcuggaaaucagg

SEQ ID NO: 404658 - RNA, 22 nt, Human
aguguuuaccccaaucaguuua

SEQ ID NO: 404659 - RNA, 22 nt, Human
aucagaaaggugggcaagcaga

SEQ ID NO: 404660 - RNA, 22 nt, Human
aauuccaaguagcaucccauca

SEQ ID NO: 404661 - RNA, 22 nt, Human
uuuacagaaugucaauuucuau

SEQ ID NO: 404662 - RNA, 21 nt, Human
cuacagaagcucuccuaucca

SEQ ID NO: 404663 - RNA, 22 nt, Human
aaguccaugaucaagauguggc

SEQ ID NO: 404664 - RNA, 22 nt, Human
aagucauagucgggaaagacau

SEQ ID NO: 404665 - RNA, 22 nt, Human
acaucugaccauuacaagacau

SEQ ID NO: 404666 - RNA, 22 nt, Human
caaagcaccacaaaccagguga

SEQ ID NO: 404667 - RNA, 20 nt, Human
aacaguaccauuuaucucag

SEQ ID NO: 404668 - RNA, 22 nt, Human
aauguucaaacagaucacuuag

SEQ ID NO: 404669 - RNA, 19 nt, Human
uauuucaaagugccgucua

SEQ ID NO: 404670 - RNA, 22 nt, Human
uaaguccuaauggcagaagucu

SEQ ID NO: 404671 - RNA, 22 nt, Human
agcacaauagagcaguuaaaaa

SEQ ID NO: 404672 - RNA, 22 nt, Human
uacagacaguuuuucagauauu

SEQ ID NO: 404673 - RNA, 22 nt, Human
cuggaucaugggaaagggauca

SEQ ID NO: 404674 - RNA, 22 nt, Human
uggguuuaaacucaacucuaaa

SEQ ID NO: 404675 - RNA, 22 nt, Human
auagaaauguauuuuggacuag

SEQ ID NO: 404676 - RNA, 22 nt, Human
uuuacagaugaggaaacugaga

SEQ ID NO: 404677 - RNA, 22 nt, Human
aaacaaacauagguuugaaagu

SEQ ID NO: 404678 - RNA, 22 nt, Human
uggauuuauuagguuggugaaa

SEQ ID NO: 404679 - RNA, 22 nt, Human
cauuucaaaagaauugccagaa

SEQ ID NO: 404680 - RNA, 22 nt, Human
guagaaauguaaccaggagaua

SEQ ID NO: 404681 - RNA, 22 nt, Human
guuaauauuuaccugucaagaa

SEQ ID NO: 404682 - RNA, 22 nt, Human
aaaaccuucagguuuggaguuu

SEQ ID NO: 404683 - RNA, 22 nt, Human
ucauaaaguuaucaccaaaucc

SEQ ID NO: 404684 - RNA, 22 nt, Human
aaauccuuuggaggacaugaug

SEQ ID NO: 404685 - RNA, 19 nt, Human
gaaguccucuaguaaauuu

SEQ ID NO: 404686 - RNA, 22 nt, Human
gaaguccugguccucucauuca

SEQ ID NO: 404687 - RNA, 22 nt, Human
gucaacuuuaagaugaucuuuu

SEQ ID NO: 404688 - RNA, 22 nt, Human
agaauuccucuaggaucugccc

SEQ ID NO: 404689 - RNA, 22 nt, Human
aaaucaguaaauguucauuaac

SEQ ID NO: 404690 - RNA, 22 nt, Human
acagccaggaggaacucaguga

SEQ ID NO: 404691 - RNA, 22 nt, Human
gucuaacaagcauuaggaaccc

SEQ ID NO: 404692 - RNA, 22 nt, Human
aaauugcaaaaguacuuuuagg

SEQ ID NO: 404693 - RNA, 21 nt, Human
auggauuuaaacaggccacaa

SEQ ID NO: 404694 - RNA, 19 nt, Human
cauguuaugcuguaguauc

SEQ ID NO: 404695 - RNA, 22 nt, Human
cauuuacagugagaguuuuuac

SEQ ID NO: 404696 - RNA, 22 nt, Human
ugaaauaggaaacagauguuuc

SEQ ID NO: 404697 - RNA, 22 nt, Human
caggaaacauaugugcuugagg

SEQ ID NO: 404698 - RNA, 22 nt, Human
gcuauacagcaggagaauggaa

SEQ ID NO: 404699 - RNA, 22 nt, Human
ucagccaguuuguuuauuccgg

SEQ ID NO: 404700 - RNA, 22 nt, Human
uucaacacaggaacaugauaua

SEQ ID NO: 404701 - RNA, 22 nt, Human
uuuauuauguacaggcacuaua

SEQ ID NO: 404702 - RNA, 22 nt, Human
caauuucaucuugugcuucaau

SEQ ID NO: 404703 - RNA, 22 nt, Human
uguucagcccucuauuaaucag

SEQ ID NO: 404704 - RNA, 22 nt, Human
auguuaaaugguuuauuauuaa

SEQ ID NO: 404705 - RNA, 22 nt, Human
caaguccucugguuucaaauag

SEQ ID NO: 404706 - RNA, 22 nt, Human
augaaaauacugugguugauag

SEQ ID NO: 404707 - RNA, 22 nt, Human
ucaauaaauagcuuggcucagc

SEQ ID NO: 404708 - RNA, 22 nt, Human
agguauuauuagcaucucuauu

SEQ ID NO: 404709 - RNA, 22 nt, Human
uaaguaaauuuauaaugugauu

SEQ ID NO: 404710 - RNA, 22 nt, Human
uccauacauugaaauaccauuc

SEQ ID NO: 404711 - RNA, 22 nt, Human
ggcauuuagauugaauuucugu

SEQ ID NO: 404712 - RNA, 22 nt, Human
gaguccuuuucucuguccacug

SEQ ID NO: 404713 - RNA, 22 nt, Human
caguccuuggcaaguucucagu

SEQ ID NO: 404714 - RNA, 22 nt, Human
uuauauaaagauaacuuuucuu

SEQ ID NO: 404715 - RNA, 22 nt, Human
aaucuuuaaggacucagucucu

SEQ ID NO: 404716 - RNA, 22 nt, Human
uaucuaaauggaauauuccaga

SEQ ID NO: 404717 - RNA, 22 nt, Human
uaguacaguuuaaauauuaaua

SEQ ID NO: 404718 - RNA, 22 nt, Human
gaguccuugacacauaguaggu

SEQ ID NO: 404719 - RNA, 22 nt, Human
uauggcuuuaaacaacuuaggu

SEQ ID NO: 404720 - RNA, 22 nt, Human
ccuggaucuuucugacugacaa

SEQ ID NO: 404721 - RNA, 22 nt, Human
ucauaaaaugcuccugauauug

SEQ ID NO: 404722 - RNA, 22 nt, Human
augaaauauuucagagcagagu

SEQ ID NO: 404723 - RNA, 22 nt, Human
ucagccagcaucagcuaagugc

SEQ ID NO: 404724 - RNA, 22 nt, Human
uuggaucacucugaagccuuac

SEQ ID NO: 404725 - RNA, 22 nt, Human
agccauucauugugcucucaga

SEQ ID NO: 404726 - RNA, 18 nt, Human
aauuuccauaugaauugc

SEQ ID NO: 404727 - RNA, 17 nt, Human
ugaaaucagcacccagg

SEQ ID NO: 404728 - RNA, 22 nt, Human
cagucaccuugaggacucagac

SEQ ID NO: 404729 - RNA, 22 nt, Human
uuauuccauucaguucaacaag

SEQ ID NO: 404730 - RNA, 22 nt, Human
uagaugcuguagaaauacuuau

SEQ ID NO: 404731 - RNA, 22 nt, Human
uuccuuagacagagguggucau

SEQ ID NO: 404732 - RNA, 20 nt, Human
uauggcuuggcaaagcuuca

SEQ ID NO: 404733 - RNA, 22 nt, Human
gcaaacaagcugccugaagauu

SEQ ID NO: 404734 - RNA, 22 nt, Human
uguacaaucuuggucccuuuau

SEQ ID NO: 404735 - RNA, 22 nt, Human
uauaaaauggcaucagcuccaa

SEQ ID NO: 404736 - RNA, 22 nt, Human
aaguuucauuguucauguaaca

SEQ ID NO: 404737 - RNA, 22 nt, Human
caguuucagaaucaaaacauca

SEQ ID NO: 404738 - RNA, 22 nt, Human
ucuaaacacgucucuuugaaua

SEQ ID NO: 404739 - RNA, 22 nt, Human
uggauuagugcugaaaugaugg

SEQ ID NO: 404740 - RNA, 22 nt, Human
aauacuaguuauuaaagcuuuu

SEQ ID NO: 404741 - RNA, 22 nt, Human
uuuccaaauaaggucacacuca

SEQ ID NO: 404742 - RNA, 22 nt, Human
acuggaugaggggaaagagaca

SEQ ID NO: 404743 - RNA, 22 nt, Human
aucagaaaucuaggauucagaa

SEQ ID NO: 404744 - RNA, 22 nt, Human
uaaacauguugacaucuuaccu

SEQ ID NO: 404745 - RNA, 22 nt, Human
uuccuuaguguuagauucugug

SEQ ID NO: 404746 - RNA, 22 nt, Human
gucaacuugcaagaugcugggc

SEQ ID NO: 404747 - RNA, 22 nt, Human
aguccuuagaacagugccuggg

SEQ ID NO: 404748 - RNA, 22 nt, Human
uuggcuucuucgcacagcagua

SEQ ID NO: 404749 - RNA, 22 nt, Human
uuuauccauaucauuaaaaucu

SEQ ID NO: 404750 - RNA, 22 nt, Human
uuucagacagauucuucucagu

SEQ ID NO: 404751 - RNA, 22 nt, Human
guacagaauuaugccaugaggg

SEQ ID NO: 404752 - RNA, 22 nt, Human
gauagucaccucccuuaacuuu

SEQ ID NO: 404753 - RNA, 22 nt, Human
aucuauacuacaaauggcuggu

SEQ ID NO: 404754 - RNA, 22 nt, Human
ugcuuaaacacauacauacaua

SEQ ID NO: 404755 - RNA, 22 nt, Human
gucaaacaaauuaacauaucca

SEQ ID NO: 404756 - RNA, 22 nt, Human
cuugccuuugucuucaaaggcu

SEQ ID NO: 404757 - RNA, 22 nt, Human
ugcagagacuugugugcauuug

SEQ ID NO: 404758 - RNA, 22 nt, Human
acagaauugauggaaaucucag

SEQ ID NO: 404759 - RNA, 22 nt, Human
auguuucaaauauauagaguug

SEQ ID NO: 404760 - RNA, 22 nt, Human
ucacagaagaugcuggauguug

SEQ ID NO: 404761 - RNA, 22 nt, Human
acagaguucccacuccagaagc

SEQ ID NO: 404762 - RNA, 22 nt, Human
gcuggauccugauucgucuuug

SEQ ID NO: 404763 - RNA, 22 nt, Human
cauggucuacaauuucauuuua

SEQ ID NO: 404764 - RNA, 22 nt, Human
ccagaucuaguguuguaaagcu

SEQ ID NO: 404765 - RNA, 22 nt, Human
aacauguaucgcuuuuuaauau

SEQ ID NO: 404766 - RNA, 22 nt, Human
uuucaacuuguuugcuuccaua

SEQ ID NO: 404767 - RNA, 22 nt, Human
auggcuuaugaauaacaguagg

SEQ ID NO: 404768 - RNA, 22 nt, Human
aaugugauuagccucuacugga

SEQ ID NO: 404769 - RNA, 22 nt, Human
aaaacugaaauacgauccaaug

SEQ ID NO: 404770 - RNA, 22 nt, Human
agaucauaugaaaaauuucaag

SEQ ID NO: 404771 - RNA, 22 nt, Human
aaagaaucguguguaguuugaa

SEQ ID NO: 404772 - RNA, 22 nt, Human
cauuuacacacagaggugugcu

SEQ ID NO: 404773 - RNA, 19 nt, Human
uacauacuuauucuaaaag

SEQ ID NO: 404774 - RNA, 22 nt, Human
uuucaacuagccccuaaguccu

SEQ ID NO: 404775 - RNA, 20 nt, Human
uauuccaaggguagagaaaa

SEQ ID NO: 404776 - RNA, 22 nt, Human
uucacagaguuauuuuuaugcu

SEQ ID NO: 404777 - RNA, 19 nt, Human
agauuuaccucauauaguu

SEQ ID NO: 404778 - RNA, 22 nt, Human
uaaguccuucaccuaauccuca

SEQ ID NO: 404779 - RNA, 22 nt, Human
uuauaagaguauauaguguacu

SEQ ID NO: 404780 - RNA, 22 nt, Human
gugcauuuaggucacaugaugu

SEQ ID NO: 404781 - RNA, 22 nt, Human
uaacagaagaugaaacuucuuu

SEQ ID NO: 404782 - RNA, 20 nt, Human
guaaugaauguaaacaguaa

SEQ ID NO: 404783 - RNA, 22 nt, Human
ucuggaucuccagcacuuauca

SEQ ID NO: 404784 - RNA, 22 nt, Human
aaacuuuggauugugauugugc

SEQ ID NO: 404785 - RNA, 22 nt, Human
acacaagauuguguauugaauu

SEQ ID NO: 404786 - RNA, 22 nt, Human
guuauaaaugacugcaaaaguu

SEQ ID NO: 404787 - RNA, 22 nt, Human
acagaauuaucaggaaauguua

SEQ ID NO: 404788 - RNA, 22 nt, Human
ucaaauaccagcaauuucaugu

SEQ ID NO: 404789 - RNA, 22 nt, Human
gauuuacagguuagguccugua

SEQ ID NO: 404790 - RNA, 22 nt, Human
uucccaauauucugcuuuuaug

SEQ ID NO: 404791 - RNA, 22 nt, Human
uagucaccugugagcugcguag

SEQ ID NO: 404792 - RNA, 22 nt, Human
uuccuuagaguuuccagaaagc

SEQ ID NO: 404793 - RNA, 22 nt, Human
auggcauuugaccgcuuugugg

SEQ ID NO: 404794 - RNA, 22 nt, Human
uuugaagaccuuaucucuaaau

SEQ ID NO: 404795 - RNA, 22 nt, Human
acaacaaagacacuugaaauga

SEQ ID NO: 404796 - RNA, 22 nt, Human
cauuaauauuguucuucuuuag

SEQ ID NO: 404797 - RNA, 22 nt, Human
guaaauuauuucaagaucaucu

SEQ ID NO: 404798 - RNA, 22 nt, Human
acaacuuuguagcaauuccacg

SEQ ID NO: 404799 - RNA, 20 nt, Human
uacaauacacaugcauauga

SEQ ID NO: 404800 - RNA, 22 nt, Human
caaugaaaauuuaaguugcagc

SEQ ID NO: 404801 - RNA, 22 nt, Human
aaucagaaaggcuaaggaagca

SEQ ID NO: 404802 - RNA, 22 nt, Human
acuauacauugaauguuaaggu

SEQ ID NO: 404803 - RNA, 22 nt, Human
cucuaacacuguaaugcuuucu

SEQ ID NO: 404804 - RNA, 22 nt, Human
gaugaaaaauugcugugucaua

SEQ ID NO: 404805 - RNA, 22 nt, Human
cuagaaaucucuguuuacauca

SEQ ID NO: 404806 - RNA, 22 nt, Human
cagucaccaccagguggcagua

SEQ ID NO: 404807 - RNA, 22 nt, Human
agaucuauuagcaaacugccau

SEQ ID NO: 404808 - RNA, 22 nt, Human
uuuauaaaauagacugggucua

SEQ ID NO: 404809 - RNA, 22 nt, Human
ucauagaaugaguuaaugaacu

SEQ ID NO: 404810 - RNA, 22 nt, Human
cuucuuaaucccuuauauauuu

SEQ ID NO: 404811 - RNA, 21 nt, Human
caauuucaugggaagauggga

SEQ ID NO: 404812 - RNA, 22 nt, Human
uucauuuguugacagagacaug

SEQ ID NO: 404813 - RNA, 22 nt, Human
aacaugucuggguauucacaag

SEQ ID NO: 404814 - RNA, 22 nt, Human
aaguuucaaauauaaaauuaca

SEQ ID NO: 404815 - RNA, 22 nt, Human
uuuaggcacagggaguugguuu

SEQ ID NO: 404816 - RNA, 22 nt, Human
aaaacagacagccaguguagag

SEQ ID NO: 404817 - RNA, 22 nt, Human
auggcuuuccugggacaugggc

SEQ ID NO: 404818 - RNA, 22 nt, Human
gauaauaagcacagcaggaugu

SEQ ID NO: 404819 - RNA, 22 nt, Human
ugauaauauuuugaaucauaag

SEQ ID NO: 404820 - RNA, 22 nt, Human
auauccaagaaacaauuaauuc

SEQ ID NO: 404821 - RNA, 22 nt, Human
caaaauuguugaugcugcuuug

SEQ ID NO: 404822 - RNA, 22 nt, Human
uuccugggacuggagcagccca

SEQ ID NO: 404823 - RNA, 22 nt, Human
auacauaauuacuuccgauguu

SEQ ID NO: 404824 - RNA, 22 nt, Human
guaaugaaugaaagaaacuggg

SEQ ID NO: 404825 - RNA, 22 nt, Human
ugauuuaugcauuauacuguug

SEQ ID NO: 404826 - RNA, 22 nt, Human
uguccuuaucuccaaacaauca

SEQ ID NO: 404827 - RNA, 22 nt, Human
aagcauuuuguuuuaagaauga

SEQ ID NO: 404828 - RNA, 22 nt, Human
uguccuuaaggagcuuaauguc

SEQ ID NO: 404829 - RNA, 22 nt, Human
uugaauaauaugcuucguucuc

SEQ ID NO: 404830 - RNA, 23 nt, Human
aguucacugagguugaccacugg

SEQ ID NO: 404831 - RNA, 22 nt, Human
aagccagauuucacucuuaauu

SEQ ID NO: 404832 - RNA, 22 nt, Human
gucauaaagcuuguugcauuua

SEQ ID NO: 404833 - RNA, 22 nt, Human
uaguccuuacuuacuagaauaa

SEQ ID NO: 404834 - RNA, 22 nt, Human
aauagaaaggaggggcucuugu

SEQ ID NO: 404835 - RNA, 22 nt, Human
ccauggcucuagagauugaaaa

SEQ ID NO: 404836 - RNA, 22 nt, Human
uguguaaaaucugauuaauacu

SEQ ID NO: 404837 - RNA, 22 nt, Human
aaugggauaauuguucauggga

SEQ ID NO: 404838 - RNA, 22 nt, Human
cagaauguagaucaucaucaag

SEQ ID NO: 404839 - RNA, 22 nt, Human
guuauaaaaugcacaguuguuu

SEQ ID NO: 404840 - RNA, 22 nt, Human
uggcauuuggcuuacuuauguu

SEQ ID NO: 404841 - RNA, 22 nt, Human
cugaauaaagcccucgcgcgcu

SEQ ID NO: 404842 - RNA, 22 nt, Human
uggcauuuucuccuuugaguuu

SEQ ID NO: 404843 - RNA, 22 nt, Human
gugugaaaguuccuaagacuau

SEQ ID NO: 404844 - RNA, 20 nt, Human
acuggaucuggcuggagcug

SEQ ID NO: 404845 - RNA, 22 nt, Human
uugauuaaucccaugugaguag

SEQ ID NO: 404846 - RNA, 18 nt, Human
agaugaaagcaaaugaca

SEQ ID NO: 404847 - RNA, 22 nt, Human
aauaaaauggucaguuuucuca

SEQ ID NO: 404848 - RNA, 22 nt, Human
auuucauacuaaggcucaaaaa

SEQ ID NO: 404849 - RNA, 23 nt, Human
cagaaaucugaaaucuagaaaug

SEQ ID NO: 404850 - RNA, 22 nt, Human
uuuauucuugagagugagaaga

SEQ ID NO: 404851 - RNA, 22 nt, Human
auacaaugaaguauagaugaaa

SEQ ID NO: 404852 - RNA, 22 nt, Human
aucagcaucuuuaacaauuacc

SEQ ID NO: 404853 - RNA, 22 nt, Human
cuuaaccagaaaaugcacuugu

SEQ ID NO: 404854 - RNA, 22 nt, Human
aaaucaguuagugguaggauug

SEQ ID NO: 404855 - RNA, 22 nt, Human
uuccuuaguuauuugguccccu

SEQ ID NO: 404856 - RNA, 22 nt, Human
ucacaccaguuuccuuucaauu

SEQ ID NO: 404857 - RNA, 22 nt, Human
acuauacauaaaacauuugggu

SEQ ID NO: 404858 - RNA, 22 nt, Human
auuucacaucuaucucagauuu

SEQ ID NO: 404859 - RNA, 22 nt, Human
uuacaaaguguuaugauaaaca

SEQ ID NO: 404860 - RNA, 22 nt, Human
auucuucacaaauauauagaag

SEQ ID NO: 404861 - RNA, 22 nt, Human
auucauaacggcaaaugucacc

SEQ ID NO: 404862 - RNA, 22 nt, Human
ggauuugaauuguugaaaugau

SEQ ID NO: 404863 - RNA, 22 nt, Human
agaauucauaggaaguuuccua

SEQ ID NO: 404864 - RNA, 22 nt, Human
gaguguucccacaccccaguug

SEQ ID NO: 404865 - RNA, 22 nt, Human
uaaagccauacugaaagccacu

SEQ ID NO: 404866 - RNA, 22 nt, Human
caacauuugaguaaagaaaugg

SEQ ID NO: 404867 - RNA, 22 nt, Human
agucaaaugaguaaauauauaa

SEQ ID NO: 404868 - RNA, 22 nt, Human
auuucaacacuuuuggaauuag

SEQ ID NO: 404869 - RNA, 21 nt, Human
aaauggauagggcaauggaag

SEQ ID NO: 404870 - RNA, 22 nt, Human
caguccuuaaggaaacauuugu

SEQ ID NO: 404871 - RNA, 22 nt, Human
uggcauuugcucccuuguguuc

SEQ ID NO: 404872 - RNA, 22 nt, Human
cagaauaaagguacaauugagu

SEQ ID NO: 404873 - RNA, 22 nt, Human
guuccaaagcaaaggaggugag

SEQ ID NO: 404874 - RNA, 22 nt, Human
auauaauacaaccugcuaagug

SEQ ID NO: 404875 - RNA, 22 nt, Human
gauuucaaaaguagauccauca

SEQ ID NO: 404876 - RNA, 22 nt, Human
gugaauaaucacccuucuggau

SEQ ID NO: 404877 - RNA, 22 nt, Human
cauuuacagcagacugaugaaa

SEQ ID NO: 404878 - RNA, 22 nt, Human
uuuuccaaaguaccaugucccu

SEQ ID NO: 404879 - RNA, 22 nt, Human
uuauagugggcccaacauggcg

SEQ ID NO: 404880 - RNA, 22 nt, Human
uagcaucuggagaaacaagucc

SEQ ID NO: 404881 - RNA, 22 nt, Human
aggauuuaccgucauuuagucu

SEQ ID NO: 404882 - RNA, 22 nt, Human
uuccaaacugccaauucagaag

SEQ ID NO: 404883 - RNA, 22 nt, Human
uuuauuauucucuggagaaugu

SEQ ID NO: 404884 - RNA, 22 nt, Human
auggcuuuguuccaauaaaacu

SEQ ID NO: 404885 - RNA, 22 nt, Human
acaugucuguaauuauuuuagg

SEQ ID NO: 404886 - RNA, 22 nt, Human
ccagauuugagcgucuuaaacc

SEQ ID NO: 404887 - RNA, 22 nt, Human
uucagaaagguaaauggauuuc

SEQ ID NO: 404888 - RNA, 22 nt, Human
uauaaagcugacucaugaaacu

SEQ ID NO: 404889 - RNA, 22 nt, Human
cauuuauauaaaauguccagaa

SEQ ID NO: 404890 - RNA, 22 nt, Human
uucaauaggaugcaugauauaa

SEQ ID NO: 404891 - RNA, 22 nt, Human
caucagaauagcucuguggaua

SEQ ID NO: 404892 - RNA, 22 nt, Human
uuggaucaaauuucaugcuguc

SEQ ID NO: 404893 - RNA, 22 nt, Human
cauauaauguuugaagaugugg

SEQ ID NO: 404894 - RNA, 22 nt, Human
ugaagaauaagauagauggagc

SEQ ID NO: 404895 - RNA, 22 nt, Human
ccauaauauuaaaugcuuuugu

SEQ ID NO: 404896 - RNA, 22 nt, Human
auuaaagacagcagauggaugg

SEQ ID NO: 404897 - RNA, 22 nt, Human
aacauuggauauuuauuaaaag

SEQ ID NO: 404898 - RNA, 22 nt, Human
auccaaaccuggacaugagugg

SEQ ID NO: 404899 - RNA, 22 nt, Human
aauuucaaagcucacuggcaua

SEQ ID NO: 404900 - RNA, 22 nt, Human
uaggaagaugaguaucaacuug

SEQ ID NO: 404901 - RNA, 22 nt, Human
ucaguucaguauacacuauucu

SEQ ID NO: 404902 - RNA, 22 nt, Human
caugcuuuucaaucuaucuuaa

SEQ ID NO: 404903 - RNA, 22 nt, Human
ugugaauaaugccgcaauaaac

SEQ ID NO: 404904 - RNA, 22 nt, Human
uuuacagagaauguacauaaag

SEQ ID NO: 404905 - RNA, 22 nt, Human
caugcuuuuuucuaguauaaau

SEQ ID NO: 404906 - RNA, 22 nt, Human
gugaauaaccuacuccaggccu

SEQ ID NO: 404907 - RNA, 22 nt, Human
cuuacagagaagaaaauguagu

SEQ ID NO: 404908 - RNA, 22 nt, Human
uaaagccaacacuuuacugcuc

SEQ ID NO: 404909 - RNA, 22 nt, Human
uuuauccagcagcuauucaaaa

SEQ ID NO: 404910 - RNA, 22 nt, Human
ucagagaagcugccaggcgagc

SEQ ID NO: 404911 - RNA, 22 nt, Human
uacauauacugagugauuugcu

SEQ ID NO: 404912 - RNA, 20 nt, Human
ucuuauacagaaaacauuuu

SEQ ID NO: 404913 - RNA, 22 nt, Human
acaauauuguacccagaaguuu

SEQ ID NO: 404914 - RNA, 22 nt, Human
aguguuuauauuauggaaauau

SEQ ID NO: 404915 - RNA, 22 nt, Human
gaauaaucaugaaauucaguga

SEQ ID NO: 404916 - RNA, 22 nt, Human
uaucagaacacauguuuugcag

SEQ ID NO: 404917 - RNA, 22 nt, Human
uaucagaaggaagugccuuuaa

SEQ ID NO: 404918 - RNA, 22 nt, Human
ugcagagaaaguguagacaggc

SEQ ID NO: 404919 - RNA, 22 nt, Human
guucuaauaggagaaaagacag

SEQ ID NO: 404920 - RNA, 22 nt, Human
uaauuacagguccaaaacaauc

SEQ ID NO: 404921 - RNA, 21 nt, Human
uaucagaagagaaagaaugau

SEQ ID NO: 404922 - RNA, 19 nt, Human
aaaauugcguauuuugagg

SEQ ID NO: 404923 - RNA, 22 nt, Human
ugugaaaagcguguguucuagg

SEQ ID NO: 404924 - RNA, 22 nt, Human
uucagaaaaagaccauugcaau

SEQ ID NO: 404925 - RNA, 22 nt, Human
uacaagaaugucuuaaaagcuc

SEQ ID NO: 404926 - RNA, 22 nt, Human
gaacuuuaccauuuagguaacu

SEQ ID NO: 404927 - RNA, 22 nt, Human
agaacaucuaaauaucugagac

SEQ ID NO: 404928 - RNA, 22 nt, Human
auccuuagaagggagugaggac

SEQ ID NO: 404929 - RNA, 22 nt, Human
auauaacauacauacagaaaag

SEQ ID NO: 404930 - RNA, 22 nt, Human
aauacauguuuucuacuauucu

SEQ ID NO: 404931 - RNA, 22 nt, Human
uaucagaacacagccacagcca

SEQ ID NO: 404932 - RNA, 22 nt, Human
gagaagguggaccugaaggagc

SEQ ID NO: 404933 - RNA, 22 nt, Human
ugcaggaacauagguuccuugg

SEQ ID NO: 404934 - RNA, 22 nt, Human
cuuugaauugccguuucaucug

SEQ ID NO: 404935 - RNA, 22 nt, Human
augguuuuccucugcugcuuaa

SEQ ID NO: 404936 - RNA, 22 nt, Human
gauaaaauaacuauggaauacu

SEQ ID NO: 404937 - RNA, 22 nt, Human
gaguccuuuguuccuugccaca

SEQ ID NO: 404938 - RNA, 22 nt, Human
aaacaugaauagauauuaaaca

SEQ ID NO: 404939 - RNA, 22 nt, Human
aaguccuuguauacagaaucaa

SEQ ID NO: 404940 - RNA, 22 nt, Human
agaaacauccugcuuuccauuu

SEQ ID NO: 404941 - RNA, 20 nt, Human
aaguuacauuguauuguacc

SEQ ID NO: 404942 - RNA, 22 nt, Human
auuaggcauucugaaugagguc

SEQ ID NO: 404943 - RNA, 22 nt, Human
aaaguccuugcaguuuccucuu

SEQ ID NO: 404944 - RNA, 22 nt, Human
aauacagaggggucacaauuca

SEQ ID NO: 404945 - RNA, 22 nt, Human
gaauuucauugcucugcugugu

SEQ ID NO: 404946 - RNA, 23 nt, Human
cuuucauugugguuucacagagc

SEQ ID NO: 404947 - RNA, 22 nt, Human
augcacaagcaagagauaaugg

SEQ ID NO: 404948 - RNA, 22 nt, Human
caaauucaaugaacauguuuaa

SEQ ID NO: 404949 - RNA, 22 nt, Human
auguuaaauaaucccuuaaagc

SEQ ID NO: 404950 - RNA, 22 nt, Human
aaggacagggaugguugauugu

SEQ ID NO: 404951 - RNA, 22 nt, Human
gauuucaauccagcuuucuucu

SEQ ID NO: 404952 - RNA, 22 nt, Human
cuuaauuuaaaauaguucaggc

SEQ ID NO: 404953 - RNA, 22 nt, Human
gaaugaaaaccuuggcucaaau

SEQ ID NO: 404954 - RNA, 22 nt, Human
cuuaggcauccaggguucuucc

SEQ ID NO: 404955 - RNA, 22 nt, Human
ugaauagauuuuuaacauauaa

SEQ ID NO: 404956 - RNA, 22 nt, Human
uuccuuagggucagccagaucu

SEQ ID NO: 404957 - RNA, 22 nt, Human
caguccuugcucaaagucuaca

SEQ ID NO: 404958 - RNA, 22 nt, Human
cacaaagucugcagcugcugua

SEQ ID NO: 404959 - RNA, 22 nt, Human
ucaaacaggacuacauucucau

SEQ ID NO: 404960 - RNA, 22 nt, Human
auauuuaaacaggguaccaaua

SEQ ID NO: 404961 - RNA, 22 nt, Human
uguggaaaauuggaacguuccu

SEQ ID NO: 404962 - RNA, 18 nt, Human
auacaagaucaaguguuc

SEQ ID NO: 404963 - RNA, 22 nt, Human
augguuuaguuagggcuuuuca

SEQ ID NO: 404964 - RNA, 22 nt, Human
auaaaaucagaguuggauugga

SEQ ID NO: 404965 - RNA, 22 nt, Human
caacuuugugugaccuagauag

SEQ ID NO: 404966 - RNA, 22 nt, Human
ucacagaacaauguuuaguucu

SEQ ID NO: 404967 - RNA, 22 nt, Human
auaauucaugggccuuucaccu

SEQ ID NO: 404968 - RNA, 22 nt, Human
aacagacaacuccuguggcuca

SEQ ID NO: 404969 - RNA, 22 nt, Human
uaggcaacaugucgaauacugu

SEQ ID NO: 404970 - RNA, 22 nt, Human
aagacagugaucucugagagau

SEQ ID NO: 404971 - RNA, 22 nt, Human
gauuuauaaagguugcacugga

SEQ ID NO: 404972 - RNA, 22 nt, Human
guaaacaucagccacucuauuu

SEQ ID NO: 404973 - RNA, 22 nt, Human
uacuuguagcagguggcauuua

SEQ ID NO: 404974 - RNA, 22 nt, Human
uccaaaaaacguuugaauaguu

SEQ ID NO: 404975 - RNA, 22 nt, Human
ggauuuccucuugacucuaaag

SEQ ID NO: 404976 - RNA, 22 nt, Human
acuuuaucaggaaucacacagc

SEQ ID NO: 404977 - RNA, 22 nt, Human
aggauuuaccuccagcuaggcu

SEQ ID NO: 404978 - RNA, 22 nt, Human
guuaggcauuugccuuaauuuu

SEQ ID NO: 404979 - RNA, 22 nt, Human
cagaaagcuuaggcaaguugga

SEQ ID NO: 404980 - RNA, 22 nt, Human
acacaauacagggcucaaaaua

SEQ ID NO: 404981 - RNA, 17 nt, Human
uccauacaauucucucu

SEQ ID NO: 404982 - RNA, 22 nt, Human
auugaaaauaaggccagaaaca

SEQ ID NO: 404983 - RNA, 22 nt, Human
uaguccuugcugggcacagagu

SEQ ID NO: 404984 - RNA, 22 nt, Human
uagcagaaacuguuacagaagg

SEQ ID NO: 404985 - RNA, 22 nt, Human
auguuucaccagcaaauuaccu

SEQ ID NO: 404986 - RNA, 22 nt, Human
gauggcuucagucuccuugggu

SEQ ID NO: 404987 - RNA, 22 nt, Human
gcauaauauacaugcuugaucc

SEQ ID NO: 404988 - RNA, 22 nt, Human
cagaaucagcccuugcuauuaa

SEQ ID NO: 404989 - RNA, 22 nt, Human
uccuggauaucaaacaaacauu

SEQ ID NO: 404990 - RNA, 22 nt, Human
uucaccacagucucaucuacgc

SEQ ID NO: 404991 - RNA, 22 nt, Human
auggcuuucagauuucuauguu

SEQ ID NO: 404992 - RNA, 22 nt, Human
caaguccuuuucuuggcucagg

SEQ ID NO: 404993 - RNA, 22 nt, Human
acuggaucuaauugguuauagu

SEQ ID NO: 404994 - RNA, 22 nt, Human
ucagaauuugauuccugggaua

SEQ ID NO: 404995 - RNA, 22 nt, Human
agaugaaaagauaagcagcaau

SEQ ID NO: 404996 - RNA, 22 nt, Human
auuauaaaccuuugaggguggg

SEQ ID NO: 404997 - RNA, 22 nt, Human
aauuucaaguggcaucuuugau

SEQ ID NO: 404998 - RNA, 22 nt, Human
gguacaauucugggguaugcuc

SEQ ID NO: 404999 - RNA, 22 nt, Human
gaucagaaugggacauauccug

SEQ ID NO: 405000 - RNA, 22 nt, Human
cuuccaaaauuuauauguugaa

SEQ ID NO: 405001 - RNA, 22 nt, Human
aagaaaucauaucauuucuugg

SEQ ID NO: 405002 - RNA, 22 nt, Human
gcuuaauucuggcucaguuucc

SEQ ID NO: 405003 - RNA, 22 nt, Human
caguccuuggcuucauccgagu

SEQ ID NO: 405004 - RNA, 22 nt, Human
auauacaguuuuacaggguuuc

SEQ ID NO: 405005 - RNA, 22 nt, Human
uuaaaauuauggcccauuugga

SEQ ID NO: 405006 - RNA, 22 nt, Human
acuauacaccaaaauauuaagg

SEQ ID NO: 405007 - RNA, 22 nt, Human
auaaaauuugcuacuguuaaau

SEQ ID NO: 405008 - RNA, 22 nt, Human
auuuccagacuuuuuccaggaa

SEQ ID NO: 405009 - RNA, 22 nt, Human
aauucuaaauguaauuuagaau

SEQ ID NO: 405010 - RNA, 18 nt, Human
uaagucauuuugccagca

SEQ ID NO: 405011 - RNA, 22 nt, Human
auaauaaaccaggaugggucug

SEQ ID NO: 405012 - RNA, 22 nt, Human
acagaacugggggcacagauag

SEQ ID NO: 405013 - RNA, 22 nt, Human
aaaagccaugcauaccuaagag

SEQ ID NO: 405014 - RNA, 22 nt, Human
uagucaccuguugugugaugcc

SEQ ID NO: 405015 - RNA, 22 nt, Human
uugguacagaugagguauucuc

SEQ ID NO: 405016 - RNA, 23 nt, Human
aggauuuaaaggcaaugcauuuu

SEQ ID NO: 405017 - RNA, 22 nt, Human
auaucagaaauaguaagcagag

SEQ ID NO: 405018 - RNA, 22 nt, Human
uugaauaauauguucaggagga

SEQ ID NO: 405019 - RNA, 22 nt, Human
ucaauaaaucccucugacccug

SEQ ID NO: 405020 - RNA, 22 nt, Human
gauagaaagguguugaaaucca

SEQ ID NO: 405021 - RNA, 20 nt, Human
agaaaucagaccacacacua

SEQ ID NO: 405022 - RNA, 22 nt, Human
cuacagaauucaacaaaugguu

SEQ ID NO: 405023 - RNA, 22 nt, Human
agcucacaguguccuuccucaa

SEQ ID NO: 405024 - RNA, 22 nt, Human
ugaaaauggccugaagaagcaa

SEQ ID NO: 405025 - RNA, 22 nt, Human
ucacagaagagauauugacaga

SEQ ID NO: 405026 - RNA, 18 nt, Human
gcaggcuuuuccuggguc

SEQ ID NO: 405027 - RNA, 22 nt, Human
augaaaauucuaugcaggccag

SEQ ID NO: 405028 - RNA, 22 nt, Human
gcaacuuucaagcaccaugggg

SEQ ID NO: 405029 - RNA, 20 nt, Human
gaaguccuguuauauccuuu

SEQ ID NO: 405030 - RNA, 22 nt, Human
uauuuaucgagugucuacuaug

SEQ ID NO: 405031 - RNA, 22 nt, Human
auguucaaacaaguuaaugcca

SEQ ID NO: 405032 - RNA, 22 nt, Human
uaucagaaacucuggggcaggg

SEQ ID NO: 405033 - RNA, 22 nt, Human
caaguccuaaauguauuuguug

SEQ ID NO: 405034 - RNA, 22 nt, Human
aguccuuaugugguggagagag

SEQ ID NO: 405035 - RNA, 22 nt, Human
aaauuucaguuggaaugagcuc

SEQ ID NO: 405036 - RNA, 22 nt, Human
acaacuuuagucuggagggaaa

SEQ ID NO: 405037 - RNA, 22 nt, Human
aauguuaauuuacugucuucau

SEQ ID NO: 405038 - RNA, 22 nt, Human
caguucacacugugcuaucugc

SEQ ID NO: 405039 - RNA, 22 nt, Human
aauaacuggcacauaucacaua

SEQ ID NO: 405040 - RNA, 22 nt, Human
ucagaaaugaucguuauucauu

SEQ ID NO: 405041 - RNA, 22 nt, Human
uuacagaaaagggcuuuaagag

SEQ ID NO: 405042 - RNA, 22 nt, Human
cuuauaaaguccaucugaacaa

SEQ ID NO: 405043 - RNA, 22 nt, Human
guuccaaagucucugagcugag

SEQ ID NO: 405044 - RNA, 20 nt, Human
acaauacagguugugucuga

SEQ ID NO: 405045 - RNA, 22 nt, Human
ccagaauucagaaagggcauaa

SEQ ID NO: 405046 - RNA, 21 nt, Human
uucaaagacuugaugcugacc

SEQ ID NO: 405047 - RNA, 22 nt, Human
uuauacaguuuauacuuagaau

SEQ ID NO: 405048 - RNA, 22 nt, Human
cauuucaaugccuucaacauag

SEQ ID NO: 405049 - RNA, 19 nt, Human
ugcuuaauuccuaguaggu

SEQ ID NO: 405050 - RNA, 22 nt, Human
gaucagaauuuacuuauaauug

SEQ ID NO: 405051 - RNA, 22 nt, Human
acuucacagaaauuuuaugagg

SEQ ID NO: 405052 - RNA, 22 nt, Human
gcugcaggcauuuuccugggca

SEQ ID NO: 405053 - RNA, 22 nt, Human
ccuggaucuaaggaagcuggga

SEQ ID NO: 405054 - RNA, 22 nt, Human
gaaagccagagagaaagggcuc

SEQ ID NO: 405055 - RNA, 22 nt, Human
agacugaauaacaagcaaauaa

SEQ ID NO: 405056 - RNA, 20 nt, Human
auaggaaagggaggggcuuu

SEQ ID NO: 405057 - RNA, 22 nt, Human
gagcccagcuugcacauggagc

SEQ ID NO: 405058 - RNA, 22 nt, Human
cauuuacaauguacagguugug

SEQ ID NO: 405059 - RNA, 22 nt, Human
ucaacuuuaguguagcuauuua

SEQ ID NO: 405060 - RNA, 22 nt, Human
ccagauaaggcuuuuuaaaagc

SEQ ID NO: 405061 - RNA, 22 nt, Human
aauguuuuaaaagagauugaga

SEQ ID NO: 405062 - RNA, 22 nt, Human
uuugaaguguuauuucuaucac

SEQ ID NO: 405063 - RNA, 22 nt, Human
auggcuuaugguaaauauuucu

SEQ ID NO: 405064 - RNA, 22 nt, Human
uacacagaggcugaugucuuag

SEQ ID NO: 405065 - RNA, 22 nt, Human
cuggaagagcauuugcauaggg

SEQ ID NO: 405066 - RNA, 22 nt, Human
ugcuuuaagagauuguuaguac

SEQ ID NO: 405067 - RNA, 22 nt, Human
aguuacagugaccauuuauuua

SEQ ID NO: 405068 - RNA, 22 nt, Human
cauuuaguuauacuaaaacauu

SEQ ID NO: 405069 - RNA, 22 nt, Human
uuacuacugcuuuacuacuggg

SEQ ID NO: 405070 - RNA, 22 nt, Human
agagaauuggagcagugacagg

SEQ ID NO: 405071 - RNA, 21 nt, Human
aaagaaucauggguaauuuca

SEQ ID NO: 405072 - RNA, 22 nt, Human
ugugaauaccuugaauucauca

SEQ ID NO: 405073 - RNA, 22 nt, Human
uaugcuguggaaaauacaaaga

SEQ ID NO: 405074 - RNA, 22 nt, Human
acagaauugaaaguauaaucug

SEQ ID NO: 405075 - RNA, 22 nt, Human
aauaacagauuuucaagcugug

SEQ ID NO: 405076 - RNA, 22 nt, Human
ggccuuuaagcaauugaaaaga

SEQ ID NO: 405077 - RNA, 22 nt, Human
ucaguuucuucaucucccuaac

SEQ ID NO: 405078 - RNA, 22 nt, Human
cauggcuucuaagugauaacgu

SEQ ID NO: 405079 - RNA, 22 nt, Human
agauuggaucaagcagcaguug

SEQ ID NO: 405080 - RNA, 22 nt, Human
aguuauccgaaggcacugagau

SEQ ID NO: 405081 - RNA, 22 nt, Human
cacaagaaauaagcugccuuuc

SEQ ID NO: 405082 - RNA, 22 nt, Human
agcauuuauuucuuagaaauug

SEQ ID NO: 405083 - RNA, 22 nt, Human
auaaaacuuggguaugaucccu

SEQ ID NO: 405084 - RNA, 22 nt, Human
ucagccaggccaggcauucaca

SEQ ID NO: 405085 - RNA, 22 nt, Human
aauaauaagauacuaagggagu

SEQ ID NO: 405086 - RNA, 22 nt, Human
gcuauacaaguguagaauagag

SEQ ID NO: 405087 - RNA, 22 nt, Human
uaauccaaaacugaaucugugg

SEQ ID NO: 405088 - RNA, 22 nt, Human
augguuuugaagggaggucaaa

SEQ ID NO: 405089 - RNA, 19 nt, Human
uuccaaaaucaggauuuga

SEQ ID NO: 405090 - RNA, 22 nt, Human
aagucacaagcauauaugcauu

SEQ ID NO: 405091 - RNA, 22 nt, Human
ccagaucuucuuuucagugucu

SEQ ID NO: 405092 - RNA, 22 nt, Human
gcaggcuccaaggccugggaga

SEQ ID NO: 405093 - RNA, 22 nt, Human
caauuucaaugaggccacaggg

SEQ ID NO: 405094 - RNA, 22 nt, Human
aauuaauggaaaguaaggaagg

SEQ ID NO: 405095 - RNA, 22 nt, Human
ucaaaaguuucacauagagaua

SEQ ID NO: 405096 - RNA, 22 nt, Human
gccuaauaacuagcuguguaac

SEQ ID NO: 405097 - RNA, 22 nt, Human
uucagaaacccauugggucucu

SEQ ID NO: 405098 - RNA, 22 nt, Human
gaaauagacacuuucuaugaau

SEQ ID NO: 405099 - RNA, 22 nt, Human
cagaucuagagcuuuuccaucu

SEQ ID NO: 405100 - RNA, 18 nt, Human
cuggcuuucuuauccauc

SEQ ID NO: 405101 - RNA, 22 nt, Human
acaucagauuaugcuuugcuua

SEQ ID NO: 405102 - RNA, 22 nt, Human
uauauacuuucuuccuggguag

SEQ ID NO: 405103 - RNA, 22 nt, Human
cagauuucuauuucaaauacau

SEQ ID NO: 405104 - RNA, 22 nt, Human
aaugguuugauggacaaaauga

SEQ ID NO: 405105 - RNA, 19 nt, Human
ugcugaaguugucagucug

SEQ ID NO: 405106 - RNA, 22 nt, Human
uuuccauauuuaaucaaaauaa

SEQ ID NO: 405107 - RNA, 23 nt, Human
uggaauaauaagguacauuaaca

SEQ ID NO: 405108 - RNA, 22 nt, Human
guauagaaacccagaaagauag

SEQ ID NO: 405109 - RNA, 22 nt, Human
uauacagucuuuugcuauauuc

SEQ ID NO: 405110 - RNA, 23 nt, Human
uauggcuuacagugcuuuaggua

SEQ ID NO: 405111 - RNA, 23 nt, Human
uguaacaauuucauauacaugca

SEQ ID NO: 405112 - RNA, 22 nt, Human
aguaaacauuucagauuuauuu

SEQ ID NO: 405113 - RNA, 22 nt, Human
ucaauaaaauuguuuuccuauc

SEQ ID NO: 405114 - RNA, 22 nt, Human
augaacaauaaaauagaucaca

SEQ ID NO: 405115 - RNA, 22 nt, Human
uggcaauuuuaggugguuuagu

SEQ ID NO: 405116 - RNA, 22 nt, Human
auaucagacagaaagcauugac

SEQ ID NO: 405117 - RNA, 22 nt, Human
aucuaacagcaacaccagaaua

SEQ ID NO: 405118 - RNA, 22 nt, Human
ugcuuuaacauaagauaucuuu

SEQ ID NO: 405119 - RNA, 22 nt, Human
uaaagaucuuaggaagauuuuc

SEQ ID NO: 405120 - RNA, 22 nt, Human
caugcuuauucauucugcuaac

SEQ ID NO: 405121 - RNA, 21 nt, Human
uuuuauugaugaauggccacu

SEQ ID NO: 405122 - RNA, 22 nt, Human
uacugaaaguggucaacagugg

SEQ ID NO: 405123 - RNA, 22 nt, Human
aaucagaacgcucgaucuucgg

SEQ ID NO: 405124 - RNA, 22 nt, Human
auaaagcaaauaggacuauugc

SEQ ID NO: 405125 - RNA, 22 nt, Human
uaagaaucggucgcaacagagg

SEQ ID NO: 405126 - RNA, 22 nt, Human
uucauuugccaucaguguaaug

SEQ ID NO: 405127 - RNA, 22 nt, Human
caggccagguggcaggcaaaac

SEQ ID NO: 405128 - RNA, 22 nt, Human
aagauauacuauuaaguaccau

SEQ ID NO: 405129 - RNA, 22 nt, Human
gcuuuaaugaagucacgcaaag

SEQ ID NO: 405130 - RNA, 20 nt, Human
aacacacugguggcaucagg

SEQ ID NO: 405131 - RNA, 22 nt, Human
aauaaugucuuuggcuugacca

SEQ ID NO: 405132 - RNA, 22 nt, Human
acaugcuuuucccacaauuaua

SEQ ID NO: 405133 - RNA, 22 nt, Human
uaugcugugcuagauacaauau

SEQ ID NO: 405134 - RNA, 22 nt, Human
ccauggcucuuaccuuguuaua

SEQ ID NO: 405135 - RNA, 22 nt, Human
ccaguuuaagacuuaucucaau

SEQ ID NO: 405136 - RNA, 22 nt, Human
uguaaauaguuagcuugccucu

SEQ ID NO: 405137 - RNA, 22 nt, Human
ucagagaaaugaaguagggauu

SEQ ID NO: 405138 - RNA, 22 nt, Human
uuuccaaaggaggaaccaguuu

SEQ ID NO: 405139 - RNA, 22 nt, Human
cucuacucuuaacacagcuagg

SEQ ID NO: 405140 - RNA, 22 nt, Human
augaauaaaacauuuuaaucag

SEQ ID NO: 405141 - RNA, 22 nt, Human
caauuucagaccuuuccuugga

SEQ ID NO: 405142 - RNA, 22 nt, Human
caguaaauuugagggaucuaau

SEQ ID NO: 405143 - RNA, 22 nt, Human
aaagucauuuuccagaccagua

SEQ ID NO: 405144 - RNA, 22 nt, Human
ucugaagauuaccagcuaaaug

SEQ ID NO: 405145 - RNA, 22 nt, Human
gaaauauacauugcaggaagag

SEQ ID NO: 405146 - RNA, 22 nt, Human
agccagucggggccaugcuggg

SEQ ID NO: 405147 - RNA, 22 nt, Human
ggauucuaacugaacagaauau

SEQ ID NO: 405148 - RNA, 22 nt, Human
uguacaauguggccaguguuaa

SEQ ID NO: 405149 - RNA, 22 nt, Human
auaaacucaugccaagaaauga

SEQ ID NO: 405150 - RNA, 18 nt, Human
gaaagccaugcagcagug

SEQ ID NO: 405151 - RNA, 22 nt, Human
acagaauuuacacaucucuaaa

SEQ ID NO: 405152 - RNA, 22 nt, Human
uuucacacaacgugaauauacu

SEQ ID NO: 405153 - RNA, 22 nt, Human
acuuauuagcugugugaccuug

SEQ ID NO: 405154 - RNA, 22 nt, Human
uucuuuuacauuaagauuucag

SEQ ID NO: 405155 - RNA, 22 nt, Human
ggcauuuagagggcuuuucuga

SEQ ID NO: 405156 - RNA, 22 nt, Human
uaggauuuaggcuuuaacaucu

SEQ ID NO: 405157 - RNA, 22 nt, Human
acagauuuuugguaaauaauuu

SEQ ID NO: 405158 - RNA, 22 nt, Human
ugauauuuaagcaaaaauaugg

SEQ ID NO: 405159 - RNA, 22 nt, Human
aaaggcaugauuaauucugugu

SEQ ID NO: 405160 - RNA, 22 nt, Human
acauaaguuauggauaaaaugu

SEQ ID NO: 405161 - RNA, 22 nt, Human
auguuacacauaggcauaaaug

SEQ ID NO: 405162 - RNA, 22 nt, Human
uugaucaucuaagaguaauagu

SEQ ID NO: 405163 - RNA, 22 nt, Human
uauuacaauuuacauugcacuu

SEQ ID NO: 405164 - RNA, 22 nt, Human
aggauuuauuacaagccauggu

SEQ ID NO: 405165 - RNA, 22 nt, Human
auagaauucguguuuguaauuc

SEQ ID NO: 405166 - RNA, 22 nt, Human
ucuuuaauauaaaggaaugaau

SEQ ID NO: 405167 - RNA, 22 nt, Human
cuuaggcagggcuggaagaucu

SEQ ID NO: 405168 - RNA, 22 nt, Human
augcuuaauacacuguuaaagg

SEQ ID NO: 405169 - RNA, 22 nt, Human
caucagaauguuauggggggcu

SEQ ID NO: 405170 - RNA, 22 nt, Human
augcaaaauaaggcagaaacau

SEQ ID NO: 405171 - RNA, 22 nt, Human
auaaacaguagagaaagguggu

SEQ ID NO: 405172 - RNA, 22 nt, Human
uacuauaccauguaagauauga

SEQ ID NO: 405173 - RNA, 22 nt, Human
gagacaggauuuaaccaaagcu

SEQ ID NO: 405174 - RNA, 22 nt, Human
ugaaacaaauuuggaaaaucua

SEQ ID NO: 405175 - RNA, 22 nt, Human
cuuaggcaagcagagcccaucc

SEQ ID NO: 405176 - RNA, 22 nt, Human
uuacagaaaggaaggacugacu

SEQ ID NO: 405177 - RNA, 22 nt, Human
ugaaauagacacagugcuauac

SEQ ID NO: 405178 - RNA, 22 nt, Human
aguaaaauuucugcugaggaga

SEQ ID NO: 405179 - RNA, 22 nt, Human
ugcagagagauauggcaagagg

SEQ ID NO: 405180 - RNA, 22 nt, Human
aaaugcuuguaaauuuuccaug

SEQ ID NO: 405181 - RNA, 22 nt, Human
cuaaagaagcuagcaaucuaua

SEQ ID NO: 405182 - RNA, 23 nt, Human
uaagaacagacaagcauuuacau

SEQ ID NO: 405183 - RNA, 22 nt, Human
ccagaucuaaguccaaaguacu

SEQ ID NO: 405184 - RNA, 22 nt, Human
acaugcuuugauguauuuugca

SEQ ID NO: 405185 - RNA, 22 nt, Human
gcaacuuuagaaaaaucuauaa

SEQ ID NO: 405186 - RNA, 22 nt, Human
uuuagaaugugacuguauuuga

SEQ ID NO: 405187 - RNA, 22 nt, Human
aucauaaagugcuaucugauug

SEQ ID NO: 405188 - RNA, 22 nt, Human
auaacaugaccugugcuucaca

SEQ ID NO: 405189 - RNA, 22 nt, Human
aaaugcuuauuagugucacaaa

SEQ ID NO: 405190 - RNA, 22 nt, Human
auacagaacaagccucaccucc

SEQ ID NO: 405191 - RNA, 22 nt, Human
guuccaaacaagucauaaagua

SEQ ID NO: 405192 - RNA, 22 nt, Human
uuaauuacuaagcacaaugcaa

SEQ ID NO: 405193 - RNA, 22 nt, Human
ucaacuuugaaaccauagugaa

SEQ ID NO: 405194 - RNA, 22 nt, Human
acaugcuucauauuauaaccaa

SEQ ID NO: 405195 - RNA, 22 nt, Human
uauggcuugucuuuauaccagg

SEQ ID NO: 405196 - RNA, 22 nt, Human
guuaggcaguuuucuucauucu

SEQ ID NO: 405197 - RNA, 18 nt, Human
auagaaaccuuuaaucag

SEQ ID NO: 405198 - RNA, 22 nt, Human
uaaguccuggcugguuugaagc

SEQ ID NO: 405199 - RNA, 22 nt, Human
gauuuccauuuucaacuccugc

SEQ ID NO: 405200 - RNA, 22 nt, Human
caaguccucaaagggcucugcu

SEQ ID NO: 405201 - RNA, 19 nt, Human
ucucuacacuacauuucua

SEQ ID NO: 405202 - RNA, 22 nt, Human
uaauuucacaguucaacgcaca

SEQ ID NO: 405203 - RNA, 22 nt, Human
ucagaaauacaaaacacuuacu

SEQ ID NO: 405204 - RNA, 22 nt, Human
uacuuaaugccacugaauugua

SEQ ID NO: 405205 - RNA, 22 nt, Human
ucaauacauacaauguauagug

SEQ ID NO: 405206 - RNA, 22 nt, Human
uccaauauggauaaaaggggcc

SEQ ID NO: 405207 - RNA, 22 nt, Human
gaguccuuuucauagcaguggg

SEQ ID NO: 405208 - RNA, 22 nt, Human
gcagagaacccagcagauuggc

SEQ ID NO: 405209 - RNA, 22 nt, Human
caauuucagugcuguggagagg

SEQ ID NO: 405210 - RNA, 23 nt, Human
aagucaccaagaggaaggcggag

SEQ ID NO: 405211 - RNA, 22 nt, Human
guaggaaaguaaaugaaauaca

SEQ ID NO: 405212 - RNA, 22 nt, Human
aauguuaauguguuugcuuaug

SEQ ID NO: 405213 - RNA, 22 nt, Human
ucuucaauuuagaauggauuua

SEQ ID NO: 405214 - RNA, 22 nt, Human
uuuucauuuuuguagaugcaag

SEQ ID NO: 405215 - RNA, 22 nt, Human
gauuucaaguaucuugggcgag

SEQ ID NO: 405216 - RNA, 22 nt, Human
uaugcccagcuuaaaguacaca

SEQ ID NO: 405217 - RNA, 22 nt, Human
aaaucagucccucuuggaauuu

SEQ ID NO: 405218 - RNA, 22 nt, Human
uguccuuagggauauaaaauau

SEQ ID NO: 405219 - RNA, 22 nt, Human
auuuagaagcuaauuuuucaga

SEQ ID NO: 405220 - RNA, 22 nt, Human
uaaaaugacuuccuccaacauc

SEQ ID NO: 405221 - RNA, 22 nt, Human
uuuaggcauugggugcucaagu

SEQ ID NO: 405222 - RNA, 22 nt, Human
aucugacuucacgcccaugcca

SEQ ID NO: 405223 - RNA, 22 nt, Human
uacaagaaauuucugcauauau

SEQ ID NO: 405224 - RNA, 22 nt, Human
auuuagcaaaaaaugaugaagc

SEQ ID NO: 405225 - RNA, 22 nt, Human
caucagaaagaguccuggacuu

SEQ ID NO: 405226 - RNA, 22 nt, Human
uaccaaaaccaagccauuaucu

SEQ ID NO: 405227 - RNA, 22 nt, Human
aaguccauucuuccagccagcu

SEQ ID NO: 405228 - RNA, 22 nt, Human
ucauaaaguuacccaaauuuua

SEQ ID NO: 405229 - RNA, 20 nt, Human
uucuauacauaucacugaaa

SEQ ID NO: 405230 - RNA, 22 nt, Human
ccuucaaucagcagucuagcuu

SEQ ID NO: 405231 - RNA, 22 nt, Human
cuaucaaacagccauuaauaua

SEQ ID NO: 405232 - RNA, 22 nt, Human
uagcaucuguucuuucauuaaa

SEQ ID NO: 405233 - RNA, 22 nt, Human
augaaaauguacauguguauaa

SEQ ID NO: 405234 - RNA, 22 nt, Human
gcacaauaacagccaagguuau

SEQ ID NO: 405235 - RNA, 22 nt, Human
ccguagcacaugcuccuggggc

SEQ ID NO: 405236 - RNA, 22 nt, Human
gagucaccacugugauagucga

SEQ ID NO: 405237 - RNA, 22 nt, Human
caguaaauuaucucaucucugu

SEQ ID NO: 405238 - RNA, 22 nt, Human
aaacugugcuucccaaaugccc

SEQ ID NO: 405239 - RNA, 22 nt, Human
ugucaccacuggcugaaacacc

SEQ ID NO: 405240 - RNA, 19 nt, Human
augcuuuauguuauuucuu

SEQ ID NO: 405241 - RNA, 22 nt, Human
ucucuuaacugguucagcaauu

SEQ ID NO: 405242 - RNA, 22 nt, Human
acaaaauuaugaagaggccuug

SEQ ID NO: 405243 - RNA, 22 nt, Human
auauacaaagggcaaccucgcu

SEQ ID NO: 405244 - RNA, 22 nt, Human
uugauccaguugaaagugauga

SEQ ID NO: 405245 - RNA, 22 nt, Human
uaaagucaucuuuacaucuuug

SEQ ID NO: 405246 - RNA, 22 nt, Human
aagaaaucagaaaagcauucgu

SEQ ID NO: 405247 - RNA, 20 nt, Human
aauaaacuacugagagaugu

SEQ ID NO: 405248 - RNA, 22 nt, Human
gagauuuagcugcuuaacuccu

SEQ ID NO: 405249 - RNA, 22 nt, Human
guuaaagaagaauaguuccuuu

SEQ ID NO: 405250 - RNA, 22 nt, Human
aaucagaauuuauugaaucuuu

SEQ ID NO: 405251 - RNA, 22 nt, Human
uaaagacacugguuuuaaucau

SEQ ID NO: 405252 - RNA, 22 nt, Human
uuccaaaccucaaauaauuaau

SEQ ID NO: 405253 - RNA, 22 nt, Human
ucuuuaaugugauuguaauuau

SEQ ID NO: 405254 - RNA, 22 nt, Human
uugaagaaauuauuuuauauag

SEQ ID NO: 405255 - RNA, 22 nt, Human
acaacuuuaauggguuucagcu

SEQ ID NO: 405256 - RNA, 22 nt, Human
aaaguccuagcgauccacagaa

SEQ ID NO: 405257 - RNA, 22 nt, Human
aucuaaacagguguucuuuaga

SEQ ID NO: 405258 - RNA, 22 nt, Human
gaagaauccaugcuaauuuacc

SEQ ID NO: 405259 - RNA, 22 nt, Human
aggauuuacaaugauucuaggu

SEQ ID NO: 405260 - RNA, 23 nt, Human
uucaaaacuggaaaaucagaugc

SEQ ID NO: 405261 - RNA, 22 nt, Human
uuucauaauacuguacaugaaa

SEQ ID NO: 405262 - RNA, 22 nt, Human
agaauuucuggaagauugcaag

SEQ ID NO: 405263 - RNA, 22 nt, Human
acagaaauaacuuuuuauguuu

SEQ ID NO: 405264 - RNA, 22 nt, Human
ucagccuacacuccaacagcau

SEQ ID NO: 405265 - RNA, 22 nt, Human
uuuaggcaagggcaagauuauc

SEQ ID NO: 405266 - RNA, 22 nt, Human
caguccuuagauuuuacugcca

SEQ ID NO: 405267 - RNA, 22 nt, Human
uuaggaaaggguuuucuaacag

SEQ ID NO: 405268 - RNA, 22 nt, Human
auaaagucuaccguauuaaaga

SEQ ID NO: 405269 - RNA, 22 nt, Human
aaucagaacuucucaggguggg

SEQ ID NO: 405270 - RNA, 22 nt, Human
aaggcauaggacaaaucaguga

SEQ ID NO: 405271 - RNA, 22 nt, Human
acuauaaccuguuagaauagau

SEQ ID NO: 405272 - RNA, 22 nt, Human
agucauaaagccagugggaggc

SEQ ID NO: 405273 - RNA, 22 nt, Human
uguucacaagaugucuguggcu

SEQ ID NO: 405274 - RNA, 22 nt, Human
agaaaagaggcuuucuaagcau

SEQ ID NO: 405275 - RNA, 22 nt, Human
aaauuccagaaacucaguauau

SEQ ID NO: 405276 - RNA, 23 nt, Human
uagaauucaaucuguuccacauc

SEQ ID NO: 405277 - RNA, 22 nt, Human
caagauuugccaguggccaacu

SEQ ID NO: 405278 - RNA, 22 nt, Human
cuaauuauguuguuauaaucaa

SEQ ID NO: 405279 - RNA, 22 nt, Human
ggcaauuucaugugguuuaaac

SEQ ID NO: 405280 - RNA, 22 nt, Human
uauggaaacuaauucauuuuuc

SEQ ID NO: 405281 - RNA, 22 nt, Human
aaaugaaaugagugccuggagg

SEQ ID NO: 405282 - RNA, 22 nt, Human
aaagaaggggucuacauccaau

SEQ ID NO: 405283 - RNA, 22 nt, Human
uacaguaagaugaaauagcaau

SEQ ID NO: 405284 - RNA, 22 nt, Human
agauaaaaugguucaaaggcua

SEQ ID NO: 405285 - RNA, 21 nt, Human
auacagaacauugauccaaga

SEQ ID NO: 405286 - RNA, 22 nt, Human
gaucagaaucuucauuuucagu

SEQ ID NO: 405287 - RNA, 22 nt, Human
ucauaaaaauagacucuaaagu

SEQ ID NO: 405288 - RNA, 22 nt, Human
aaaucauguuggcacaauaaaa

SEQ ID NO: 405289 - RNA, 22 nt, Human
aaucaguguguaaaguggcugc

SEQ ID NO: 405290 - RNA, 22 nt, Human
aaugggauaggucuucaggaau

SEQ ID NO: 405291 - RNA, 23 nt, Human
augguuuaugucacacuuuugau

SEQ ID NO: 405292 - RNA, 22 nt, Human
uuauccaaacuggugaaucauu

SEQ ID NO: 405293 - RNA, 22 nt, Human
uuauacuuuauacuacaucauu

SEQ ID NO: 405294 - RNA, 22 nt, Human
gaauuucacaaggugaggauaa

SEQ ID NO: 405295 - RNA, 22 nt, Human
cagaauuuagcacaauguaugg

SEQ ID NO: 405296 - RNA, 22 nt, Human
uauuuauaccaggugaucggag

SEQ ID NO: 405297 - RNA, 22 nt, Human
uuccuuaggggacagggggaua

SEQ ID NO: 405298 - RNA, 22 nt, Human
aaugcaaagcaagcagagauuu

SEQ ID NO: 405299 - RNA, 22 nt, Human
uuugaagacauauuguuacaua

SEQ ID NO: 405300 - RNA, 22 nt, Human
ugcuggcuacauuauugcuguc

SEQ ID NO: 405301 - RNA, 22 nt, Human
acaagauaaggugucagugugu

SEQ ID NO: 405302 - RNA, 21 nt, Human
aacugguucaauucaacuaga

SEQ ID NO: 405303 - RNA, 22 nt, Human
aauuccaaauguuuucaaucca

SEQ ID NO: 405304 - RNA, 22 nt, Human
gaucugaaucaauagaauaacu

SEQ ID NO: 405305 - RNA, 22 nt, Human
uucagaaacagagugagugagu

SEQ ID NO: 405306 - RNA, 22 nt, Human
aauaaaaugaacugguagaguu

SEQ ID NO: 405307 - RNA, 22 nt, Human
cuggaucaugcauugcuugucc

SEQ ID NO: 405308 - RNA, 22 nt, Human
auagaauucuuugaaauuuaug

SEQ ID NO: 405309 - RNA, 22 nt, Human
aaaucaguuggaacacaagcag

SEQ ID NO: 405310 - RNA, 22 nt, Human
gguacaauggaccauaaaagcu

SEQ ID NO: 405311 - RNA, 18 nt, Human
auuguuaauagaguacuu

SEQ ID NO: 405312 - RNA, 22 nt, Human
uucaauacaaagaaaggaauuu

SEQ ID NO: 405313 - RNA, 22 nt, Human
agauucuacucuagauccaugg

SEQ ID NO: 405314 - RNA, 22 nt, Human
aggauuuacuagcaaggauucu

SEQ ID NO: 405315 - RNA, 22 nt, Human
ucagaauugucuggggaauguu

SEQ ID NO: 405316 - RNA, 17 nt, Human
cuguuaauucauuuccc

SEQ ID NO: 405317 - RNA, 22 nt, Human
ugcugagaucugccaguagaug

SEQ ID NO: 405318 - RNA, 22 nt, Human
augguuuaaagaguaugacuuu

SEQ ID NO: 405319 - RNA, 22 nt, Human
ucagaauuagagcucuucuuga

SEQ ID NO: 405320 - RNA, 21 nt, Human
gauaaaaugggccuugguccu

SEQ ID NO: 405321 - RNA, 22 nt, Human
caauuucagguggauagguuuu

SEQ ID NO: 405322 - RNA, 22 nt, Human
uauggaaaaauguaucuuguca

SEQ ID NO: 405323 - RNA, 22 nt, Human
gugaauaaagggaguuuucaaa

SEQ ID NO: 405324 - RNA, 22 nt, Human
gauaucauaucagacaaccucu

SEQ ID NO: 405325 - RNA, 22 nt, Human
uaacacaaaagaauaugugugu

SEQ ID NO: 405326 - RNA, 23 nt, Human
cauuucaacgaauuuuccuucug

SEQ ID NO: 405327 - RNA, 22 nt, Human
ugagacaaaauugacagacaaa

SEQ ID NO: 405328 - RNA, 22 nt, Human
uagaugcuacaauuuuguacuc

SEQ ID NO: 405329 - RNA, 22 nt, Human
aacaugcuuugauaaauaaaag

SEQ ID NO: 405330 - RNA, 22 nt, Human
gaguucuaaaggcagaacauaa

SEQ ID NO: 405331 - RNA, 19 nt, Human
acuguaaggcauuuuuuuc

SEQ ID NO: 405332 - RNA, 22 nt, Human
uucugaaaauugggucauacuu

SEQ ID NO: 405333 - RNA, 22 nt, Human
gaauuucaacaguccucaaaug

SEQ ID NO: 405334 - RNA, 22 nt, Human
gaugauaacagcauuucaacug

SEQ ID NO: 405335 - RNA, 22 nt, Human
uguauacauuuaacuagauaga

SEQ ID NO: 405336 - RNA, 23 nt, Human
aaguacauauauuuagauaguga

SEQ ID NO: 405337 - RNA, 23 nt, Human
ucagagaacucgggcagaugacc

SEQ ID NO: 405338 - RNA, 22 nt, Human
gauuuacagcuauacccaaugg

SEQ ID NO: 405339 - RNA, 22 nt, Human
gauuuagagcaggaaugcaugg

SEQ ID NO: 405340 - RNA, 22 nt, Human
cuucuuaaauuggauugcuauu

SEQ ID NO: 405341 - RNA, 18 nt, Human
caagaaucucuaaagaag

SEQ ID NO: 405342 - RNA, 22 nt, Human
uagaaaucagcaggcauaugua

SEQ ID NO: 405343 - RNA, 18 nt, Human
aguccuuacgaggcuaua

SEQ ID NO: 405344 - RNA, 22 nt, Human
cuacagaagccguggucaggaa

SEQ ID NO: 405345 - RNA, 22 nt, Human
uaauuucaaauuucuuagcgug

SEQ ID NO: 405346 - RNA, 22 nt, Human
auggcauuauagcaaugguuug

SEQ ID NO: 405347 - RNA, 22 nt, Human
auuaaacugagcaaauuaacau

SEQ ID NO: 405348 - RNA, 22 nt, Human
augaacaaguauuugcaugagc

SEQ ID NO: 405349 - RNA, 22 nt, Human
aaucaaaaccuacagagguaau

SEQ ID NO: 405350 - RNA, 22 nt, Human
augguuuauugcuuuaaugaaa

SEQ ID NO: 405351 - RNA, 22 nt, Human
uacagagauuuauugcuaaggc

SEQ ID NO: 405352 - RNA, 22 nt, Human
aaaguccugacugcaggggaug

SEQ ID NO: 405353 - RNA, 22 nt, Human
guacagaaggauuucuaguagu

SEQ ID NO: 405354 - RNA, 22 nt, Human
uauacaauggcugaaucaucca

SEQ ID NO: 405355 - RNA, 22 nt, Human
uaaucugaagaaacaggacuug

SEQ ID NO: 405356 - RNA, 22 nt, Human
uuaggaaacgcugcuauugacu

SEQ ID NO: 405357 - RNA, 21 nt, Human
auagaacaccaggcauauaua

SEQ ID NO: 405358 - RNA, 22 nt, Human
ucaguuucuccaucgcuccagu

SEQ ID NO: 405359 - RNA, 22 nt, Human
ccaauacacuuuauagaagaaa

SEQ ID NO: 405360 - RNA, 22 nt, Human
gcguuaauaacauuaauaaugc

SEQ ID NO: 405361 - RNA, 22 nt, Human
acuggaucagaaucugauuuuu

SEQ ID NO: 405362 - RNA, 22 nt, Human
aguucacugcuuaagccuuuga

SEQ ID NO: 405363 - RNA, 22 nt, Human
caauuucauggauaaaagaugu

SEQ ID NO: 405364 - RNA, 22 nt, Human
auuaaagaaacccagcauguga

SEQ ID NO: 405365 - RNA, 22 nt, Human
ucaaaauuuuauuucucaagga

SEQ ID NO: 405366 - RNA, 22 nt, Human
uacacauguauuuauguguaca

SEQ ID NO: 405367 - RNA, 22 nt, Human
cauaaaauggcuuguucuuuaa

SEQ ID NO: 405368 - RNA, 22 nt, Human
caguaucugucaguaaucaggu

SEQ ID NO: 405369 - RNA, 19 nt, Human
gaaagucauagagcuuguc

SEQ ID NO: 405370 - RNA, 22 nt, Human
aaagucauugcuguuaucaaug

SEQ ID NO: 405371 - RNA, 22 nt, Human
aaaauugagagucuugugcaag

SEQ ID NO: 405372 - RNA, 20 nt, Human
uacuggauuagggcucaccc

SEQ ID NO: 405373 - RNA, 22 nt, Human
gagauuuaauuggauuaacuua

SEQ ID NO: 405374 - RNA, 22 nt, Human
uuuccaaacccagcgagcuaca

SEQ ID NO: 405375 - RNA, 22 nt, Human
agccaacuaggagauuaaggua

SEQ ID NO: 405376 - RNA, 22 nt, Human
uucuuaaucccacaaaucuuca

SEQ ID NO: 405377 - RNA, 20 nt, Human
uuacagaaaugauguuauuu

SEQ ID NO: 405378 - RNA, 22 nt, Human
agauuuacuggagucuuuggug

SEQ ID NO: 405379 - RNA, 22 nt, Human
uaaugcuuaauuuucacaagcc

SEQ ID NO: 405380 - RNA, 22 nt, Human
ccagcuauugcuguguaacagu

SEQ ID NO: 405381 - RNA, 22 nt, Human
aagacuuucaaguaugcaugca

SEQ ID NO: 405382 - RNA, 22 nt, Human
auucuuaaauuuaggucuguga

SEQ ID NO: 405383 - RNA, 22 nt, Human
auuacaagaugcauccauauuu

SEQ ID NO: 405384 - RNA, 22 nt, Human
uuuaggcagcagugaggaugaa

SEQ ID NO: 405385 - RNA, 22 nt, Human
uuuacagagagagaacuggacu

SEQ ID NO: 405386 - RNA, 22 nt, Human
auccaaaggugacacagaauac

SEQ ID NO: 405387 - RNA, 21 nt, Human
aggauuuacuauuaacugugu

SEQ ID NO: 405388 - RNA, 22 nt, Human
uaaaaguauacuuucaaaggag

SEQ ID NO: 405389 - RNA, 21 nt, Human
auacagaagguggcaaaguac

SEQ ID NO: 405390 - RNA, 23 nt, Human
uuccagaggaagaagucaugacu

SEQ ID NO: 405391 - RNA, 22 nt, Human
auuuagccucauuuuugacaua

SEQ ID NO: 405392 - RNA, 22 nt, Human
aaaucucaauuugaauuguagc

SEQ ID NO: 405393 - RNA, 22 nt, Human
gugcauuugacgaauacucacu

SEQ ID NO: 405394 - RNA, 22 nt, Human
aagccaaugagagaggccucag

SEQ ID NO: 405395 - RNA, 22 nt, Human
cuaacuuuagcuuagauuauca

SEQ ID NO: 405396 - RNA, 22 nt, Human
agagauucauguuuacuguagg

SEQ ID NO: 405397 - RNA, 22 nt, Human
aauuuauauguaauuaggcaca

SEQ ID NO: 405398 - RNA, 22 nt, Human
uagucaccucuuuaaauguccu

SEQ ID NO: 405399 - RNA, 23 nt, Human
gaaucaguggcuaacaaggaaac

SEQ ID NO: 405400 - RNA, 22 nt, Human
auuguuaauguugcacuaaggu

SEQ ID NO: 405401 - RNA, 22 nt, Human
uaugaaaauuuagcugaagcau

SEQ ID NO: 405402 - RNA, 19 nt, Human
uacuaaacaugcauauugg

SEQ ID NO: 405403 - RNA, 22 nt, Human
agucuuaacuaugcaaguacua

SEQ ID NO: 405404 - RNA, 22 nt, Human
gacaguccuugcccaguaucua

SEQ ID NO: 405405 - RNA, 22 nt, Human
aaguuacacauuuucauuguaa

SEQ ID NO: 405406 - RNA, 22 nt, Human
ugugaaagcaagucuaguucuc

SEQ ID NO: 405407 - RNA, 22 nt, Human
cacacuuugugcuaaucuauuu

SEQ ID NO: 405408 - RNA, 22 nt, Human
ucauuucucccggccaaaaacu

SEQ ID NO: 405409 - RNA, 20 nt, Human
gauuucaaagcagaguggcc

SEQ ID NO: 405410 - RNA, 23 nt, Human
caauuucauaugauucuaccuaa

SEQ ID NO: 405411 - RNA, 22 nt, Human
ucuggaucucccucauccuggg

SEQ ID NO: 405412 - RNA, 22 nt, Human
guucuaauuuggggcuccuuag

SEQ ID NO: 405413 - RNA, 22 nt, Human
cuagaaauguagauucuuagug

SEQ ID NO: 405414 - RNA, 22 nt, Human
ucaguaaaugaaugaauauaug

SEQ ID NO: 405415 - RNA, 22 nt, Human
guacagaaggagcuuuggauuc

SEQ ID NO: 405416 - RNA, 22 nt, Human
uuuccaaaguugccauaagcuu

SEQ ID NO: 405417 - RNA, 22 nt, Human
uuggaucagaugauaucuuugu

SEQ ID NO: 405418 - RNA, 22 nt, Human
aaauccuuuucuauacagcaua

SEQ ID NO: 405419 - RNA, 22 nt, Human
caauauauaaugaguacuuucc

SEQ ID NO: 405420 - RNA, 22 nt, Human
acauguauugacauuauauucu

SEQ ID NO: 405421 - RNA, 22 nt, Human
uauuaaagagagaaucaucauc

SEQ ID NO: 405422 - RNA, 22 nt, Human
auauaauuguucugaaguguuu

SEQ ID NO: 405423 - RNA, 22 nt, Human
uuaauucagucaaagaaaccau

SEQ ID NO: 405424 - RNA, 22 nt, Human
gaguccuuccagcaggcauuua

SEQ ID NO: 405425 - RNA, 22 nt, Human
acagaauuaaugaaaauuacaa

SEQ ID NO: 405426 - RNA, 22 nt, Human
uaauauguguuacugacuuuuu

SEQ ID NO: 405427 - RNA, 22 nt, Human
cagaucuguuugccagaucagc

SEQ ID NO: 405428 - RNA, 22 nt, Human
auauauaaccuggauaaggcuu

SEQ ID NO: 405429 - RNA, 22 nt, Human
cacaauacuauuuuuaggucuu

SEQ ID NO: 405430 - RNA, 20 nt, Human
uacagacaugacaauaaugg

SEQ ID NO: 405431 - RNA, 22 nt, Human
uucagaaaggauaauuggaagg

SEQ ID NO: 405432 - RNA, 22 nt, Human
caauuucacugacacccuggaa

SEQ ID NO: 405433 - RNA, 22 nt, Human
gcagggcagaccuccagccuau

SEQ ID NO: 405434 - RNA, 22 nt, Human
uacagagauacucuagaucaaa

SEQ ID NO: 405435 - RNA, 22 nt, Human
aucaguuaguuacugcuaagau

SEQ ID NO: 405436 - RNA, 20 nt, Human
auacuuguuuucaggcuuuu

SEQ ID NO: 405437 - RNA, 22 nt, Human
ccagucacucugugagagcuac

SEQ ID NO: 405438 - RNA, 22 nt, Human
acuuuagaccaucuuccacagu

SEQ ID NO: 405439 - RNA, 22 nt, Human
uucaaacaguguagaauauaug

SEQ ID NO: 405440 - RNA, 22 nt, Human
acugcagagguggggugcagag

SEQ ID NO: 405441 - RNA, 22 nt, Human
aguucacagccauguucaugug

SEQ ID NO: 405442 - RNA, 21 nt, Human
caaagccaggcaacucucucc

SEQ ID NO: 405443 - RNA, 21 nt, Human
gauuugcagaaacuagacagg

SEQ ID NO: 405444 - RNA, 22 nt, Human
ccuggaucuccucuauucauau

SEQ ID NO: 405445 - RNA, 22 nt, Human
uaucaaaguuguccugugaagu

SEQ ID NO: 405446 - RNA, 22 nt, Human
auauacaggugguauguguaaa

SEQ ID NO: 405447 - RNA, 22 nt, Human
ugaaauaauaucuggaucaauc

SEQ ID NO: 405448 - RNA, 22 nt, Human
guuaaagaguuuggcuuucuuc

SEQ ID NO: 405449 - RNA, 22 nt, Human
caguccuuccuugccccuuggg

SEQ ID NO: 405450 - RNA, 22 nt, Human
agucaccaacaugguucccagg

SEQ ID NO: 405451 - RNA, 22 nt, Human
ccagcugucagugugaaaauaa

SEQ ID NO: 405452 - RNA, 22 nt, Human
aaaaggcauggagguugauagu

SEQ ID NO: 405453 - RNA, 22 nt, Human
caagaaucaacauuauuuagug

SEQ ID NO: 405454 - RNA, 22 nt, Human
aguacaaugucugacacaguag

SEQ ID NO: 405455 - RNA, 22 nt, Human
caggccagcuuccugacauccu

SEQ ID NO: 405456 - RNA, 22 nt, Human
uuccuuagauccuucaaucacg

SEQ ID NO: 405457 - RNA, 22 nt, Human
cuuccaaacccaggguaugggc

SEQ ID NO: 405458 - RNA, 22 nt, Human
cuacagaauggagggucagaga

SEQ ID NO: 405459 - RNA, 22 nt, Human
aaucccagcuacucaggaaguu

SEQ ID NO: 405460 - RNA, 22 nt, Human
cuagaaaugcucaagagaaagu

SEQ ID NO: 405461 - RNA, 22 nt, Human
aacauguaaauaucauuguacu

SEQ ID NO: 405462 - RNA, 22 nt, Human
agaauuucaaauggaaguuuua

SEQ ID NO: 405463 - RNA, 22 nt, Human
aaauaauguuaggccuuugcuc

SEQ ID NO: 405464 - RNA, 22 nt, Human
aaugccaacuuggauauacauu

SEQ ID NO: 405465 - RNA, 22 nt, Human
augcuuaagcucaguuauauau

SEQ ID NO: 405466 - RNA, 22 nt, Human
uaaagccaauauaccuagcaua

SEQ ID NO: 405467 - RNA, 21 nt, Human
ucauucacaggguauuguaua

SEQ ID NO: 405468 - RNA, 22 nt, Human
uauauaacuacuauuuugcuca

SEQ ID NO: 405469 - RNA, 22 nt, Human
uuuauccaaggguuuuaacugu

SEQ ID NO: 405470 - RNA, 22 nt, Human
uacuucauuccuuuguaaaaug

SEQ ID NO: 405471 - RNA, 22 nt, Human
uucagaaaucgaguuucauguc

SEQ ID NO: 405472 - RNA, 22 nt, Human
auuuacugagguaaauaaacug

SEQ ID NO: 405473 - RNA, 22 nt, Human
ucuaaacagccucuuaccaacu

SEQ ID NO: 405474 - RNA, 22 nt, Human
caaugucaugauuuuccauuag

SEQ ID NO: 405475 - RNA, 22 nt, Human
auuauccagcaccaaugucaga

SEQ ID NO: 405476 - RNA, 22 nt, Human
ucuggaucccaccgccacacac

SEQ ID NO: 405477 - RNA, 18 nt, Human
caauuucauccuuaagcc

SEQ ID NO: 405478 - RNA, 22 nt, Human
gugaauaagaccuaaggaugaa

SEQ ID NO: 405479 - RNA, 22 nt, Human
uagaauucauguuacuguuagc

SEQ ID NO: 405480 - RNA, 23 nt, Human
uuccacaaugaaaauaaagcagg

SEQ ID NO: 405481 - RNA, 22 nt, Human
auagaauuauggaaagcaucuu

SEQ ID NO: 405482 - RNA, 21 nt, Human
uaaauaauaaguugcugagau

SEQ ID NO: 405483 - RNA, 22 nt, Human
gauuucaaggaguuuucacagu

SEQ ID NO: 405484 - RNA, 22 nt, Human
ggcuuaaugguucuuuuucuca

SEQ ID NO: 405485 - RNA, 22 nt, Human
acauuccaaaaacuagcagaua

SEQ ID NO: 405486 - RNA, 22 nt, Human
uaauuauagccgcuauuuugcu

SEQ ID NO: 405487 - RNA, 22 nt, Human
ucucuuaauuuuggaauagugu

SEQ ID NO: 405488 - RNA, 22 nt, Human
aaaaagguugauccagauuagg

SEQ ID NO: 405489 - RNA, 22 nt, Human
aguaaaauuaauggaucagaag

SEQ ID NO: 405490 - RNA, 22 nt, Human
caauuucauuaauagauauaga

SEQ ID NO: 405491 - RNA, 22 nt, Human
uauaagaaacaaggcaaauuuu

SEQ ID NO: 405492 - RNA, 19 nt, Human
guuaggcaggguggggagu

SEQ ID NO: 405493 - RNA, 22 nt, Human
guccaaauuuuucacauguaga

SEQ ID NO: 405494 - RNA, 22 nt, Human
cacaauuuggugcuaaagaaag

SEQ ID NO: 405495 - RNA, 22 nt, Human
uaauuuuuccacguacacuggg

SEQ ID NO: 405496 - RNA, 22 nt, Human
ucuggaucaccacuucugccuc

SEQ ID NO: 405497 - RNA, 22 nt, Human
cauguauaguuggaacuacauc

SEQ ID NO: 405498 - RNA, 22 nt, Human
auacagaaaaugaugcagaguu

SEQ ID NO: 405499 - RNA, 22 nt, Human
gcaaaauuuacacuccuucuuc

SEQ ID NO: 405500 - RNA, 22 nt, Human
acaacuuucuggguuaucugau

SEQ ID NO: 405501 - RNA, 22 nt, Human
ggcauuuaguuuucauauucug

SEQ ID NO: 405502 - RNA, 22 nt, Human
cauuuacauaacaguaacgcug

SEQ ID NO: 405503 - RNA, 22 nt, Human
augguuuuguccucuuugguuc

SEQ ID NO: 405504 - RNA, 22 nt, Human
cauagaaacuugcagcaagcac

SEQ ID NO: 405505 - RNA, 22 nt, Human
cacauuuagagguuagcauggu

SEQ ID NO: 405506 - RNA, 22 nt, Human
auacagaagccuguauuucugg

SEQ ID NO: 405507 - RNA, 22 nt, Human
uuauauuaguuagacuugcugu

SEQ ID NO: 405508 - RNA, 22 nt, Human
ugcacaaacuugugucccaggg

SEQ ID NO: 405509 - RNA, 22 nt, Human
aaagucauuggaauauuaauga

SEQ ID NO: 405510 - RNA, 22 nt, Human
aagcccagaugggagcauuuca

SEQ ID NO: 405511 - RNA, 22 nt, Human
aucagaaaguucaucauguuug

SEQ ID NO: 405512 - RNA, 22 nt, Human
ugcaggaaugagguucucaguu

SEQ ID NO: 405513 - RNA, 22 nt, Human
aaguaaauaucuguuuauagca

SEQ ID NO: 405514 - RNA, 22 nt, Human
cuuaauuuuuguaguagaugga

SEQ ID NO: 405515 - RNA, 22 nt, Human
aucagcuuuucucaucagaaau

SEQ ID NO: 405516 - RNA, 22 nt, Human
uguaacaauuucuuacuauugu

SEQ ID NO: 405517 - RNA, 22 nt, Human
uucaaagcugcagacuccuggg

SEQ ID NO: 405518 - RNA, 22 nt, Human
ucagccagugccuugaucuugc

SEQ ID NO: 405519 - RNA, 22 nt, Human
aguguuagauucuuacucaguu

SEQ ID NO: 405520 - RNA, 22 nt, Human
aaguccuuucucauggaggaau

SEQ ID NO: 405521 - RNA, 22 nt, Human
cauuucaauacaguuuguaaau

SEQ ID NO: 405522 - RNA, 22 nt, Human
uuauuauuccccaagucauuau

SEQ ID NO: 405523 - RNA, 22 nt, Human
uauaaaacagaaagcacuaccu

SEQ ID NO: 405524 - RNA, 22 nt, Human
uauccaaacauauagucucucu

SEQ ID NO: 405525 - RNA, 22 nt, Human
augcaaaauuaccauucuguuc

SEQ ID NO: 405526 - RNA, 22 nt, Human
aaucagaaaauucaguggaauu

SEQ ID NO: 405527 - RNA, 21 nt, Human
uguccuuaaugcaauguccuu

SEQ ID NO: 405528 - RNA, 22 nt, Human
uuucuaguaaucaauauaaagu

SEQ ID NO: 405529 - RNA, 22 nt, Human
acagcauugcuccaucucaaga

SEQ ID NO: 405530 - RNA, 22 nt, Human
uucaacuuuggagauuuaauaa

SEQ ID NO: 405531 - RNA, 22 nt, Human
gcuuuaaugcuucguggggcca

SEQ ID NO: 405532 - RNA, 22 nt, Human
uaauuuuaugacaguguauuuu

SEQ ID NO: 405533 - RNA, 22 nt, Human
ugcuuuaaauaugaauuagcau

SEQ ID NO: 405534 - RNA, 22 nt, Human
gaauacaaacuuaaggcuuuac

SEQ ID NO: 405535 - RNA, 22 nt, Human
uaucagaaagauauuacugggg

SEQ ID NO: 405536 - RNA, 22 nt, Human
auguucaaacuuuuuacacacc

SEQ ID NO: 405537 - RNA, 23 nt, Human
aaauaggaguaucuggaucauga

SEQ ID NO: 405538 - RNA, 22 nt, Human
uuagacaagggcuccuuaaaag

SEQ ID NO: 405539 - RNA, 22 nt, Human
cagaaaauaaaguuucuacgca

SEQ ID NO: 405540 - RNA, 22 nt, Human
aaguccuuuccaguccugugau

SEQ ID NO: 405541 - RNA, 22 nt, Human
caaaauugaugaauguaugauu

SEQ ID NO: 405542 - RNA, 22 nt, Human
uacuaaacccucgauggaucuu

SEQ ID NO: 405543 - RNA, 22 nt, Human
ugaaaagacugcaagagagcau

SEQ ID NO: 405544 - RNA, 22 nt, Human
auuauaaauauuuucuaggggu

SEQ ID NO: 405545 - RNA, 22 nt, Human
gagucaccacacggugcugacu

SEQ ID NO: 405546 - RNA, 22 nt, Human
caagaucagggugccagaaugg

SEQ ID NO: 405547 - RNA, 22 nt, Human
cacccaguugacuacaaagggg

SEQ ID NO: 405548 - RNA, 22 nt, Human
gagucaccuuggccgcuguccc

SEQ ID NO: 405549 - RNA, 22 nt, Human
caucagaaccaguggggacauu

SEQ ID NO: 405550 - RNA, 22 nt, Human
uuuaaugaauaauucaaaucug

SEQ ID NO: 405551 - RNA, 22 nt, Human
ucauacacaagagcauguaaca

SEQ ID NO: 405552 - RNA, 22 nt, Human
uuugguccugagcaaaacuaug

SEQ ID NO: 405553 - RNA, 22 nt, Human
augugaaauauuaagccgagga

SEQ ID NO: 405554 - RNA, 23 nt, Human
uacagaaggaguagucacuaaga

SEQ ID NO: 405555 - RNA, 22 nt, Human
uccuuguugcugcagucaccug

SEQ ID NO: 405556 - RNA, 22 nt, Human
uuuaggcaugcaguucuauuua

SEQ ID NO: 405557 - RNA, 22 nt, Human
caaagccauagaguagauaaga

SEQ ID NO: 405558 - RNA, 22 nt, Human
auggauuuggaugagauuacuu

SEQ ID NO: 405559 - RNA, 22 nt, Human
gggauuuaguaggauaguauac

SEQ ID NO: 405560 - RNA, 22 nt, Human
uauguuaagugggauaaucaaa

SEQ ID NO: 405561 - RNA, 22 nt, Human
uaaagcacgucuauuuaaugau

SEQ ID NO: 405562 - RNA, 22 nt, Human
aaagucauccaaauuuuuaugu

SEQ ID NO: 405563 - RNA, 22 nt, Human
uaacagaaauuuuaguuagggg

SEQ ID NO: 405564 - RNA, 22 nt, Human
ucuaaacacuaagucuugaugc

SEQ ID NO: 405565 - RNA, 22 nt, Human
ucagccaggccaccuucagcuu

SEQ ID NO: 405566 - RNA, 22 nt, Human
ucaccagucuuucuuaccauug

SEQ ID NO: 405567 - RNA, 22 nt, Human
aaaguucaugguguuauagaaa

SEQ ID NO: 405568 - RNA, 22 nt, Human
auaacagauacucucugugagg

SEQ ID NO: 405569 - RNA, 22 nt, Human
uaaaauugcggugaauauuucc

SEQ ID NO: 405570 - RNA, 22 nt, Human
uuaaggauguugugauuuauua

SEQ ID NO: 405571 - RNA, 22 nt, Human
auacagaauucacuacaguuuc

SEQ ID NO: 405572 - RNA, 22 nt, Human
cagaaaaggaagagcuauguaa

SEQ ID NO: 405573 - RNA, 22 nt, Human
auuccaaacuuaccccagagga

SEQ ID NO: 405574 - RNA, 22 nt, Human
auucaacggguagaagggucuu

SEQ ID NO: 405575 - RNA, 22 nt, Human
aagucacccuagggccuggacu

SEQ ID NO: 405576 - RNA, 22 nt, Human
guaugaaaauuguaaaguucuu

SEQ ID NO: 405577 - RNA, 22 nt, Human
acauucacgcucucaaagcuga

SEQ ID NO: 405578 - RNA, 22 nt, Human
gauggcuuugugcaccaugauu

SEQ ID NO: 405579 - RNA, 22 nt, Human
acaaugaacacacaaggaauuc

SEQ ID NO: 405580 - RNA, 22 nt, Human
uuaacacuccuaacuacagucu

SEQ ID NO: 405581 - RNA, 22 nt, Human
acuaaacugaagcaugaaaagg

SEQ ID NO: 405582 - RNA, 22 nt, Human
ucauauaaguuuaaaacuaucu

SEQ ID NO: 405583 - RNA, 22 nt, Human
ugugaaagauacuaggcagagg

SEQ ID NO: 405584 - RNA, 20 nt, Human
caauuucaucauuuccugug

SEQ ID NO: 405585 - RNA, 23 nt, Human
aucaaaggauguagagaagaagc

SEQ ID NO: 405586 - RNA, 22 nt, Human
cauuucaauacuaucugagaau

SEQ ID NO: 405587 - RNA, 22 nt, Human
aguguucauuuauucauucacu

SEQ ID NO: 405588 - RNA, 22 nt, Human
aaucagcuaaauaaacuaguca

SEQ ID NO: 405589 - RNA, 22 nt, Human
uuaauaaacaggugcagcugaa

SEQ ID NO: 405590 - RNA, 22 nt, Human
uguuuauaccugcaaccuguca

SEQ ID NO: 405591 - RNA, 22 nt, Human
uuuaaugauagcuguuucacau

SEQ ID NO: 405592 - RNA, 23 nt, Human
uuacagaaaguaugcuuuuguuu

SEQ ID NO: 405593 - RNA, 22 nt, Human
uuuaggcagaacauggacuuug

SEQ ID NO: 405594 - RNA, 21 nt, Human
cuacagaaucgagcauucugg

SEQ ID NO: 405595 - RNA, 22 nt, Human
uacaaaaaauugauacugacga

SEQ ID NO: 405596 - RNA, 22 nt, Human
caaguccuuagaugguucuuug

SEQ ID NO: 405597 - RNA, 22 nt, Human
ucauagaagcaccagaagauau

SEQ ID NO: 405598 - RNA, 22 nt, Human
ugugaauacagcaugugcuucu

SEQ ID NO: 405599 - RNA, 22 nt, Human
uaauuucagugcaagcucacgg

SEQ ID NO: 405600 - RNA, 22 nt, Human
agagugaaguuuuugaaaguga

SEQ ID NO: 405601 - RNA, 22 nt, Human
ugcuggaggauuaaacaaguca

SEQ ID NO: 405602 - RNA, 21 nt, Human
uuucagaccuaucuuugaagg

SEQ ID NO: 405603 - RNA, 22 nt, Human
aggauuuaaauccuuaaccacu

SEQ ID NO: 405604 - RNA, 22 nt, Human
guacauaaaggaggcucuuugc

SEQ ID NO: 405605 - RNA, 22 nt, Human
ucagaauugcagggagggcagg

SEQ ID NO: 405606 - RNA, 22 nt, Human
auagcuuuacagaagaguuuag

SEQ ID NO: 405607 - RNA, 22 nt, Human
ucaguuuccucaucuacaaaag

SEQ ID NO: 405608 - RNA, 22 nt, Human
acuuuuaaggggccuugauuua

SEQ ID NO: 405609 - RNA, 22 nt, Human
aaacaggcuuccauuagagcaa

SEQ ID NO: 405610 - RNA, 22 nt, Human
uuugaaguggaaaaggauuuaa

SEQ ID NO: 405611 - RNA, 22 nt, Human
auacaaugagugagugaauggg

SEQ ID NO: 405612 - RNA, 22 nt, Human
uggcuuuaaaucuguauucaua

SEQ ID NO: 405613 - RNA, 22 nt, Human
ucuggaucggguuccucagguc

SEQ ID NO: 405614 - RNA, 22 nt, Human
ucuggaucgccggcgccugggc

SEQ ID NO: 405615 - RNA, 22 nt, Human
aaucagaaccuugggucauaac

SEQ ID NO: 405616 - RNA, 22 nt, Human
acaaaguccugguguauggcca

SEQ ID NO: 405617 - RNA, 22 nt, Human
guuauaaaggugauaaugguca

SEQ ID NO: 405618 - RNA, 22 nt, Human
gauaaaauucuuauuuuacccg

SEQ ID NO: 405619 - RNA, 22 nt, Human
caaucaguaaccggaucauggu

SEQ ID NO: 405620 - RNA, 22 nt, Human
ugaaauagaaaaacaggcuucu

SEQ ID NO: 405621 - RNA, 22 nt, Human
gaauuucaagcagugcaauguu

SEQ ID NO: 405622 - RNA, 22 nt, Human
uaucugagaaagaagcaccaga

SEQ ID NO: 405623 - RNA, 22 nt, Human
cuauacaguaaccacagugauu

SEQ ID NO: 405624 - RNA, 22 nt, Human
cauacuuucuuuuucacgcaua

SEQ ID NO: 405625 - RNA, 22 nt, Human
uauauguaagcuauguaagagu

SEQ ID NO: 405626 - RNA, 22 nt, Human
guagaaauauuuaucucugaga

SEQ ID NO: 405627 - RNA, 22 nt, Human
uggcuauugagugaucucuaga

SEQ ID NO: 405628 - RNA, 22 nt, Human
ugucauaacuuagugacaaauc

SEQ ID NO: 405629 - RNA, 22 nt, Human
cuuuuaaugggagcaguauuug

SEQ ID NO: 405630 - RNA, 22 nt, Human
uggcauuucuggccauuugugu

SEQ ID NO: 405631 - RNA, 22 nt, Human
uucaacccaaguucuccauuuu

SEQ ID NO: 405632 - RNA, 22 nt, Human
gauuucaaagguucugcaugcc

SEQ ID NO: 405633 - RNA, 22 nt, Human
auauacugauagcugcacuucu

SEQ ID NO: 405634 - RNA, 22 nt, Human
ucuaaagccuuccauauaacgc

SEQ ID NO: 405635 - RNA, 22 nt, Human
caaauacuaaacauaagauuuu

SEQ ID NO: 405636 - RNA, 22 nt, Human
gauaaugaugacaaugacaacc

SEQ ID NO: 405637 - RNA, 22 nt, Human
aaaguccuuuuugccaugcaag

SEQ ID NO: 405638 - RNA, 23 nt, Human
uacuuaggguuuagaucugacug

SEQ ID NO: 405639 - RNA, 22 nt, Human
uaagaaucugcauuuuaacaag

SEQ ID NO: 405640 - RNA, 22 nt, Human
aguucacauaucuguuuuauuu

SEQ ID NO: 405641 - RNA, 22 nt, Human
uccuuaauauggaagaguucuc

SEQ ID NO: 405642 - RNA, 20 nt, Human
ucauaaagaggaaauaaaua

SEQ ID NO: 405643 - RNA, 22 nt, Human
ccaaacaaauccccauucuuag

SEQ ID NO: 405644 - RNA, 21 nt, Human
ugaucauuuguguaaaggaga

SEQ ID NO: 405645 - RNA, 22 nt, Human
aacacuuugggcauggccuucc

SEQ ID NO: 405646 - RNA, 22 nt, Human
gcuggaucaaguccuucaccca

SEQ ID NO: 405647 - RNA, 22 nt, Human
ucuauaaagggccagauaguag

SEQ ID NO: 405648 - RNA, 22 nt, Human
aacaugaaaagcccagagaggu

SEQ ID NO: 405649 - RNA, 22 nt, Human
auacugaauuagguaaagcaua

SEQ ID NO: 405650 - RNA, 22 nt, Human
ccacuucaucagugcuccauuu

SEQ ID NO: 405651 - RNA, 22 nt, Human
aaacuuuguagagaaugcuggc

SEQ ID NO: 405652 - RNA, 22 nt, Human
auugauggcggccucuccauau

SEQ ID NO: 405653 - RNA, 22 nt, Human
ucagaauuuuuguuacccuuga

SEQ ID NO: 405654 - RNA, 22 nt, Human
aguccuuacaccuggaaccuau

SEQ ID NO: 405655 - RNA, 22 nt, Human
aauauuucugcagaaugguuuu

SEQ ID NO: 405656 - RNA, 22 nt, Human
uauuucaagaacuucuauccau

SEQ ID NO: 405657 - RNA, 22 nt, Human
aucauaaaauugcaccauuucu

SEQ ID NO: 405658 - RNA, 22 nt, Human
cugcagagcuuucugaaugaag

SEQ ID NO: 405659 - RNA, 22 nt, Human
uagcagaagaacaacaugaucu

SEQ ID NO: 405660 - RNA, 21 nt, Human
uucauaaaccauucucaugca

SEQ ID NO: 405661 - RNA, 22 nt, Human
ggauucagugucuguuaauagu

SEQ ID NO: 405662 - RNA, 22 nt, Human
aaugguauuugucaagcauagu

SEQ ID NO: 405663 - RNA, 22 nt, Human
caauuucaagauucuguucuuu

SEQ ID NO: 405664 - RNA, 22 nt, Human
uugguccacugugaaauuggga

SEQ ID NO: 405665 - RNA, 22 nt, Human
auacaaauuuauagaugcauuu

SEQ ID NO: 405666 - RNA, 17 nt, Human
caauuucauagguuuug

SEQ ID NO: 405667 - RNA, 22 nt, Human
cugaauaauauuccauuaugag

SEQ ID NO: 405668 - RNA, 22 nt, Human
aaagcaguauauugguaguugu

SEQ ID NO: 405669 - RNA, 22 nt, Human
uuucagaaccgcuaaaauaaau

SEQ ID NO: 405670 - RNA, 22 nt, Human
aguccagugaacuguaaauagg

SEQ ID NO: 405671 - RNA, 22 nt, Human
gaagaauccuguccucuuuagg

SEQ ID NO: 405672 - RNA, 22 nt, Human
uccaaauacauuuacuguauuu

SEQ ID NO: 405673 - RNA, 22 nt, Human
caauuuuuguacuuauaguacu

SEQ ID NO: 405674 - RNA, 22 nt, Human
uaucagaaugcagccaugugca

SEQ ID NO: 405675 - RNA, 22 nt, Human
cuuauauuuuaggaacagacaa

SEQ ID NO: 405676 - RNA, 22 nt, Human
aaaagccaagguccucuucaga

SEQ ID NO: 405677 - RNA, 22 nt, Human
aguuaucagguguuuucaugga

SEQ ID NO: 405678 - RNA, 22 nt, Human
aaagccagguugugugcaggaa

SEQ ID NO: 405679 - RNA, 22 nt, Human
aaaguccuguuaacuguuaaca

SEQ ID NO: 405680 - RNA, 22 nt, Human
aggauuuauuauaugcccucau

SEQ ID NO: 405681 - RNA, 22 nt, Human
uuucaagaacaacauucauuca

SEQ ID NO: 405682 - RNA, 22 nt, Human
uguguaaauggcaucucucagc

SEQ ID NO: 405683 - RNA, 22 nt, Human
augcuuaacuuccuagucuaua

SEQ ID NO: 405684 - RNA, 22 nt, Human
cauagaaaagaguagguaaugu

SEQ ID NO: 405685 - RNA, 22 nt, Human
aagcauuuauagauaagaauuu

SEQ ID NO: 405686 - RNA, 22 nt, Human
aucacaaaggguuuucucugag

SEQ ID NO: 405687 - RNA, 22 nt, Human
auacaaguugugauaauguaaa

SEQ ID NO: 405688 - RNA, 22 nt, Human
ugcauaauacguuuccuauaac

SEQ ID NO: 405689 - RNA, 22 nt, Human
auuauaaagaacaugugugugg

SEQ ID NO: 405690 - RNA, 22 nt, Human
ggcauuuaucuaauauaguuua

SEQ ID NO: 405691 - RNA, 22 nt, Human
auaaagucauuaugaagaucua

SEQ ID NO: 405692 - RNA, 22 nt, Human
uuuaggcaauagauggcagugu

SEQ ID NO: 405693 - RNA, 22 nt, Human
uucacagagagaacucaaacca

SEQ ID NO: 405694 - RNA, 22 nt, Human
uuuggacaaguuacugguuucc

SEQ ID NO: 405695 - RNA, 22 nt, Human
auuuccaauuucauccaugucc

SEQ ID NO: 405696 - RNA, 22 nt, Human
ucugauaacucuggccccaggc

SEQ ID NO: 405697 - RNA, 22 nt, Human
acuauacagaagaggauaggaa

SEQ ID NO: 405698 - RNA, 22 nt, Human
cuuaaacugaaagcuacaagau

SEQ ID NO: 405699 - RNA, 22 nt, Human
cuuuacauccuguuucccguuu

SEQ ID NO: 405700 - RNA, 22 nt, Human
uuacagaaaagggguuguccuu

SEQ ID NO: 405701 - RNA, 22 nt, Human
auuacagaaugcaguuccuuau

SEQ ID NO: 405702 - RNA, 22 nt, Human
aguaaacacugucuuuauauau

SEQ ID NO: 405703 - RNA, 22 nt, Human
auuccaaagccugaauaaugga

SEQ ID NO: 405704 - RNA, 22 nt, Human
ugaucugaaggacaugggaccc

SEQ ID NO: 405705 - RNA, 22 nt, Human
uaguccuuuccggcugcuauaa

SEQ ID NO: 405706 - RNA, 21 nt, Human
ucuauucauuacaguuauuug

SEQ ID NO: 405707 - RNA, 22 nt, Human
aaagccauaagccuaauacuaa

SEQ ID NO: 405708 - RNA, 22 nt, Human
uuuaggcaaacucauugucaga

SEQ ID NO: 405709 - RNA, 22 nt, Human
gcaaacaaggacauacauccug

SEQ ID NO: 405710 - RNA, 22 nt, Human
aucacaaaggucucagagcaca

SEQ ID NO: 405711 - RNA, 22 nt, Human
gcuucacacuaaaaauguuaaa

SEQ ID NO: 405712 - RNA, 22 nt, Human
aguguuuagcaugaaguucauu

SEQ ID NO: 405713 - RNA, 22 nt, Human
cuuaaagaugucaaggcuguuu

SEQ ID NO: 405714 - RNA, 22 nt, Human
caauuucacuaauaauauuuac

SEQ ID NO: 405715 - RNA, 22 nt, Human
uggcuuuaggagcuauauaccu

SEQ ID NO: 405716 - RNA, 22 nt, Human
cuuugaauuccaguacaauaac

SEQ ID NO: 405717 - RNA, 22 nt, Human
uaauauauuucugcuaagcuca

SEQ ID NO: 405718 - RNA, 22 nt, Human
aaagccauuacaaaauuucaua

SEQ ID NO: 405719 - RNA, 22 nt, Human
ugucaccaugcgaggcuaauuu

SEQ ID NO: 405720 - RNA, 22 nt, Human
agcauuuaagcuucugcaaagc

SEQ ID NO: 405721 - RNA, 22 nt, Human
uuacagaaguuucagcguuuua

SEQ ID NO: 405722 - RNA, 22 nt, Human
aaugucuucaguguauacaugg

SEQ ID NO: 405723 - RNA, 22 nt, Human
uuuucuuaggugcuccaaguag

SEQ ID NO: 405724 - RNA, 22 nt, Human
uguccuuagaagaagugaaaga

SEQ ID NO: 405725 - RNA, 22 nt, Human
ucaccgucgggggucgcugucu

SEQ ID NO: 405726 - RNA, 22 nt, Human
uaguccuuuaauaguuaaugug

SEQ ID NO: 405727 - RNA, 22 nt, Human
uaugucaaaguuaagaaauagg

SEQ ID NO: 405728 - RNA, 22 nt, Human
agcacauaccagaaccacaggu

SEQ ID NO: 405729 - RNA, 22 nt, Human
acuauacaguauguacgugcac

SEQ ID NO: 405730 - RNA, 22 nt, Human
agaauaauacugaaaugcugaa

SEQ ID NO: 405731 - RNA, 22 nt, Human
auaaagauuuuuaggcauuucu

SEQ ID NO: 405732 - RNA, 22 nt, Human
auuucacaaaccauccugauuu

SEQ ID NO: 405733 - RNA, 22 nt, Human
aaaugccuguguaaauucuagc

SEQ ID NO: 405734 - RNA, 20 nt, Human
caccagucaugagucaauac

SEQ ID NO: 405735 - RNA, 22 nt, Human
uuuuaagaugcuaguauuucag

SEQ ID NO: 405736 - RNA, 22 nt, Human
cuggcuuucauuucaagcacgu

SEQ ID NO: 405737 - RNA, 22 nt, Human
augaaacaugcuuuguggauga

SEQ ID NO: 405738 - RNA, 22 nt, Human
aaaacuguaucuucuugggacu

SEQ ID NO: 405739 - RNA, 22 nt, Human
auagaauuugcacuaaaucugc

SEQ ID NO: 405740 - RNA, 22 nt, Human
gaaaauagcagauagaccaaug

SEQ ID NO: 405741 - RNA, 22 nt, Human
aaaauccugcugacucgagaug

SEQ ID NO: 405742 - RNA, 22 nt, Human
acauaauaggugccugaauauu

SEQ ID NO: 405743 - RNA, 22 nt, Human
uucauaaucaccaaaaacugga

SEQ ID NO: 405744 - RNA, 22 nt, Human
uggauuuaauggaugaggggca

SEQ ID NO: 405745 - RNA, 22 nt, Human
ugaaauagucuaaaaaaccaga

SEQ ID NO: 405746 - RNA, 21 nt, Human
ugaaacaaucagacagagucu

SEQ ID NO: 405747 - RNA, 22 nt, Human
uacagaauuagauuauuagaga

SEQ ID NO: 405748 - RNA, 22 nt, Human
uaucagaaaucaacacacagug

SEQ ID NO: 405749 - RNA, 22 nt, Human
caaugaaagcaacugccuauaa

SEQ ID NO: 405750 - RNA, 22 nt, Human
aaugguuuucuagaacaugaaa

SEQ ID NO: 405751 - RNA, 22 nt, Human
auacagaaguuuuccacuuauu

SEQ ID NO: 405752 - RNA, 22 nt, Human
gaagaaucaagcaguaauuugu

SEQ ID NO: 405753 - RNA, 22 nt, Human
uacugaaaagccacaaggacca

SEQ ID NO: 405754 - RNA, 22 nt, Human
agaaaucauugaauuauuugcu

SEQ ID NO: 405755 - RNA, 22 nt, Human
acacagauuuuacauguuaugc

SEQ ID NO: 405756 - RNA, 22 nt, Human
auacagaacucucaguuguaua

SEQ ID NO: 405757 - RNA, 22 nt, Human
aaaucucacuguagucaaagug

SEQ ID NO: 405758 - RNA, 22 nt, Human
gcaaaauuaaacuuagcaucau

SEQ ID NO: 405759 - RNA, 22 nt, Human
agccaacuaauuaaacaacuuu

SEQ ID NO: 405760 - RNA, 18 nt, Human
caauuucaauggucugaa

SEQ ID NO: 405761 - RNA, 22 nt, Human
caucagaacaaaucgguuaaga

SEQ ID NO: 405762 - RNA, 22 nt, Human
uuagaaaugauuucaccucuuu

SEQ ID NO: 405763 - RNA, 22 nt, Human
gaaacaacuacuauugauuucu

SEQ ID NO: 405764 - RNA, 22 nt, Human
auucucaaaacauaacuucacu

SEQ ID NO: 405765 - RNA, 22 nt, Human
uuuaggcagucauugaacaagu

SEQ ID NO: 405766 - RNA, 22 nt, Human
cauggauugaauauaaauuaga

SEQ ID NO: 405767 - RNA, 21 nt, Human
agaauaaugguaucauuugcu

SEQ ID NO: 405768 - RNA, 22 nt, Human
aauacugucuuucacagauauu

SEQ ID NO: 405769 - RNA, 22 nt, Human
caucagaaugaauguucuggag

SEQ ID NO: 405770 - RNA, 22 nt, Human
ccuggaucuuuguuguaaauau

SEQ ID NO: 405771 - RNA, 22 nt, Human
uggcuuuacaucaaauugagua

SEQ ID NO: 405772 - RNA, 22 nt, Human
uaaucuacuguuuauaugaaau

SEQ ID NO: 405773 - RNA, 22 nt, Human
gcagaauuuggggguaaccuuu

SEQ ID NO: 405774 - RNA, 22 nt, Human
augguauugcaacaacugucau

SEQ ID NO: 405775 - RNA, 22 nt, Human
uggcauuuagaaaacaacaugu

SEQ ID NO: 405776 - RNA, 22 nt, Human
aaaauugaggcucauguuaaau

SEQ ID NO: 405777 - RNA, 22 nt, Human
auuccaaagguuaaugcccauu

SEQ ID NO: 405778 - RNA, 23 nt, Human
ucuguacacaucagcaucuccca

SEQ ID NO: 405779 - RNA, 22 nt, Human
ugcuauacauguacauauuagu

SEQ ID NO: 405780 - RNA, 22 nt, Human
aaagucaucuaggagcagauuu

SEQ ID NO: 405781 - RNA, 22 nt, Human
ggaucugauuaauaagguggac

SEQ ID NO: 405782 - RNA, 22 nt, Human
agaucugaggguccaagggagg

SEQ ID NO: 405783 - RNA, 22 nt, Human
gcuuuuauugucuuuacgacga

SEQ ID NO: 405784 - RNA, 22 nt, Human
uuacagaaucuacucgugguga

SEQ ID NO: 405785 - RNA, 22 nt, Human
gaauuucaggacaacuggaagg

SEQ ID NO: 405786 - RNA, 22 nt, Human
gugcuucaaguucuuaauguuu

SEQ ID NO: 405787 - RNA, 22 nt, Human
ccauggcuuucuuucauuguaa

SEQ ID NO: 405788 - RNA, 22 nt, Human
ucuauaaaugcagauaugugug

SEQ ID NO: 405789 - RNA, 23 nt, Human
acuuuauccuauaucuuuguucu

SEQ ID NO: 405790 - RNA, 22 nt, Human
aggaucugugagugcugcagac

SEQ ID NO: 405791 - RNA, 22 nt, Human
uguacaaugccagggaacacca

SEQ ID NO: 405792 - RNA, 22 nt, Human
ucuauacacacaaagaaugcuu

SEQ ID NO: 405793 - RNA, 22 nt, Human
uuuaucuguuguacauuuaugc

SEQ ID NO: 405794 - RNA, 22 nt, Human
aauggcuucugaagcacacuuu

SEQ ID NO: 405795 - RNA, 22 nt, Human
uaaaaugcacagcaguugaaag

SEQ ID NO: 405796 - RNA, 22 nt, Human
guacagaaaguacccauagaag

SEQ ID NO: 405797 - RNA, 22 nt, Human
uaagaaguacaaaaauuuucug

SEQ ID NO: 405798 - RNA, 22 nt, Human
aauguaaacagcaagagaaggg

SEQ ID NO: 405799 - RNA, 22 nt, Human
uucugugacuccucagagauuu

SEQ ID NO: 405800 - RNA, 22 nt, Human
aaucagaacuccuaccacagag

SEQ ID NO: 405801 - RNA, 22 nt, Human
acaaaauuuuuagacaaggcuu

SEQ ID NO: 405802 - RNA, 22 nt, Human
acaugucuuuuaaagucuaaua

SEQ ID NO: 405803 - RNA, 16 nt, Human
uuuccaaagggcagcu

SEQ ID NO: 405804 - RNA, 22 nt, Human
uuuaggcacaacuacucagcua

SEQ ID NO: 405805 - RNA, 20 nt, Human
uacagaaacaggacuuuugg

SEQ ID NO: 405806 - RNA, 21 nt, Human
uucaauacuauuucaauaguc

SEQ ID NO: 405807 - RNA, 22 nt, Human
gaagugaagagauuagaaauca

SEQ ID NO: 405808 - RNA, 22 nt, Human
uuacagaaugugccauuugguc

SEQ ID NO: 405809 - RNA, 22 nt, Human
auagucacugccuuccauuugu

SEQ ID NO: 405810 - RNA, 22 nt, Human
auacuuaacuguggagucauug

SEQ ID NO: 405811 - RNA, 22 nt, Human
gauuuauaguaugugcuuucag

SEQ ID NO: 405812 - RNA, 22 nt, Human
ucagaauucuacaauagaucag

SEQ ID NO: 405813 - RNA, 22 nt, Human
aagguucuaagggaagccaugc

SEQ ID NO: 405814 - RNA, 22 nt, Human
gccccagcguggcuguguuagg

SEQ ID NO: 405815 - RNA, 22 nt, Human
uuuaacuuaaucugcuugauga

SEQ ID NO: 405816 - RNA, 22 nt, Human
uucauacuaaaguguaagaugu

SEQ ID NO: 405817 - RNA, 22 nt, Human
uguauguugggucaaaguacau

SEQ ID NO: 405818 - RNA, 22 nt, Human
uuauuaaugaguacaaguuauu

SEQ ID NO: 405819 - RNA, 21 nt, Human
auuauuauaaagaccacaggg

SEQ ID NO: 405820 - RNA, 22 nt, Human
aucagaauaauuagauuucaga

SEQ ID NO: 405821 - RNA, 22 nt, Human
cuagaaauucugauucaguagg

SEQ ID NO: 405822 - RNA, 22 nt, Human
ucauaaaguucuaagaauugua

SEQ ID NO: 405823 - RNA, 22 nt, Human
aagacuuucaaaccuauguuug

SEQ ID NO: 405824 - RNA, 23 nt, Human
auagaagauuauugcaacagucc

SEQ ID NO: 405825 - RNA, 22 nt, Human
acaguccuuguguggaacauua

SEQ ID NO: 405826 - RNA, 22 nt, Human
auggaucacagugccgugggug

SEQ ID NO: 405827 - RNA, 22 nt, Human
acaacuuuucuaucauguggaa

SEQ ID NO: 405828 - RNA, 22 nt, Human
auaucaaagcuaguggaaauuu

SEQ ID NO: 405829 - RNA, 22 nt, Human
aaaaucugcuuccuuuuacaga

SEQ ID NO: 405830 - RNA, 22 nt, Human
uuuuauguuccucuuuaugcga

SEQ ID NO: 405831 - RNA, 22 nt, Human
ugauuauauucuaacuucauaa

SEQ ID NO: 405832 - RNA, 22 nt, Human
aaauacuguagauaauagaguu

SEQ ID NO: 405833 - RNA, 22 nt, Human
ucagaaauagucuuuaaaauga

SEQ ID NO: 405834 - RNA, 22 nt, Human
uaagagaacuggauagauagga

SEQ ID NO: 405835 - RNA, 22 nt, Human
uuuauaaacaguaccacggugc

SEQ ID NO: 405836 - RNA, 22 nt, Human
aauuucaaugcacucaugguug

SEQ ID NO: 405837 - RNA, 22 nt, Human
uaaaugauuuauguaugugaaa

SEQ ID NO: 405838 - RNA, 22 nt, Human
ugugaauagugccgcaauaaac

SEQ ID NO: 405839 - RNA, 22 nt, Human
cuacagaaacacuggacaugug

SEQ ID NO: 405840 - RNA, 22 nt, Human
auuauccucagaaaacauguga

SEQ ID NO: 405841 - RNA, 22 nt, Human
aaguucuaauuuugcauucagg

SEQ ID NO: 405842 - RNA, 22 nt, Human
ggaucugagagcaagcaggacc

SEQ ID NO: 405843 - RNA, 22 nt, Human
aauuccaggcagaaaugugagu

SEQ ID NO: 405844 - RNA, 22 nt, Human
caguccuugcucugggaugaug

SEQ ID NO: 405845 - RNA, 22 nt, Human
aaagccaucuguauuaagugaa

SEQ ID NO: 405846 - RNA, 22 nt, Human
uaagaaucgauguuuauuuaga

SEQ ID NO: 405847 - RNA, 22 nt, Human
gcaggaaagguugagacuuugc

SEQ ID NO: 405848 - RNA, 22 nt, Human
uaauuuaugaugcaaagaaaag

SEQ ID NO: 405849 - RNA, 22 nt, Human
aaagucauacauggugcuuacu

SEQ ID NO: 405850 - RNA, 22 nt, Human
caauuucagucucagagaguuc

SEQ ID NO: 405851 - RNA, 22 nt, Human
aaauaucauuuauaacuuuuaa

SEQ ID NO: 405852 - RNA, 22 nt, Human
gaaugaauucagcacauggaau

SEQ ID NO: 405853 - RNA, 22 nt, Human
auacagaagaccccuccgucau

SEQ ID NO: 405854 - RNA, 22 nt, Human
ugagaaaagguugagaugauaa

SEQ ID NO: 405855 - RNA, 22 nt, Human
augguuuuucaaguauucagaa

SEQ ID NO: 405856 - RNA, 22 nt, Human
uggcuuuacacauccacugccu

SEQ ID NO: 405857 - RNA, 22 nt, Human
aguauuuagcauagugguuagu

SEQ ID NO: 405858 - RNA, 21 nt, Human
ucauuuauugagaaaugacug

SEQ ID NO: 405859 - RNA, 22 nt, Human
gccuuaauuuuuuauaaucucu

SEQ ID NO: 405860 - RNA, 22 nt, Human
aaagccaugaauguuauagagg

SEQ ID NO: 405861 - RNA, 22 nt, Human
ccuggaucagucacuguugcug

SEQ ID NO: 405862 - RNA, 22 nt, Human
caguccuuucaauggugaccuu

SEQ ID NO: 405863 - RNA, 22 nt, Human
ucauaaagcucuuccaaaugua

SEQ ID NO: 405864 - RNA, 22 nt, Human
gaagaaucugaggacagucauu

SEQ ID NO: 405865 - RNA, 22 nt, Human
caacagucugguuuauauaaua

SEQ ID NO: 405866 - RNA, 22 nt, Human
uuacagaagugaaggccuuuaa

SEQ ID NO: 405867 - RNA, 22 nt, Human
ucuuuaauuguggaagagcagc

SEQ ID NO: 405868 - RNA, 22 nt, Human
guuuauaaggcccaauauuucu

SEQ ID NO: 405869 - RNA, 22 nt, Human
caaguccaggucaauuuaaagc

SEQ ID NO: 405870 - RNA, 22 nt, Human
ugaauaauuaugggaguccuaa

SEQ ID NO: 405871 - RNA, 22 nt, Human
gaugaucaucuguaaaguuaga

SEQ ID NO: 405872 - RNA, 22 nt, Human
uggcuuaagauuuaugcuuuua

SEQ ID NO: 405873 - RNA, 22 nt, Human
auaaagcaagcauaccauuaag

SEQ ID NO: 405874 - RNA, 22 nt, Human
aagccauuuguuguccuucagg

SEQ ID NO: 405875 - RNA, 22 nt, Human
aaaucaguucacguucugaggu

SEQ ID NO: 405876 - RNA, 22 nt, Human
uaauuccaccuuuuuccaacuu

SEQ ID NO: 405877 - RNA, 22 nt, Human
uuccuuagugccucuuccgcug

SEQ ID NO: 405878 - RNA, 22 nt, Human
aagaaaucugauauuuguuuca

SEQ ID NO: 405879 - RNA, 22 nt, Human
uacaguauguucuugaauuugg

SEQ ID NO: 405880 - RNA, 22 nt, Human
uuuuaugugcuggacuggcagu

SEQ ID NO: 405881 - RNA, 22 nt, Human
uguauuaacauuaauaaaaugg

SEQ ID NO: 405882 - RNA, 22 nt, Human
uaaagccacuucauucuagucu

SEQ ID NO: 405883 - RNA, 22 nt, Human
auuucauagauuguaaaucccu

SEQ ID NO: 405884 - RNA, 22 nt, Human
uggauuaguuaagaaauguuag

SEQ ID NO: 405885 - RNA, 22 nt, Human
aaaacaguuuaggcaucacagu

SEQ ID NO: 405886 - RNA, 22 nt, Human
gcaacuuuagggccagcaagua

SEQ ID NO: 405887 - RNA, 22 nt, Human
cagaauuuaaguggauuauucu

SEQ ID NO: 405888 - RNA, 22 nt, Human
gaaagaggaaggagauguauua

SEQ ID NO: 405889 - RNA, 22 nt, Human
uuacagaaaguuucccaugccg

SEQ ID NO: 405890 - RNA, 22 nt, Human
uuucaguuagcugagacccagg

SEQ ID NO: 405891 - RNA, 20 nt, Human
uuccaacucacaucucuaca

SEQ ID NO: 405892 - RNA, 22 nt, Human
uugguacaaugugcuagguagg

SEQ ID NO: 405893 - RNA, 21 nt, Human
augugaaauaucaucagagca

SEQ ID NO: 405894 - RNA, 22 nt, Human
ugcaggaacagaacucacuccc

SEQ ID NO: 405895 - RNA, 22 nt, Human
uucagaaaugaauauugguauu

SEQ ID NO: 405896 - RNA, 22 nt, Human
uuuaaagagaaugugaaggagu

SEQ ID NO: 405897 - RNA, 22 nt, Human
gaauuucagaucagagaccauu

SEQ ID NO: 405898 - RNA, 22 nt, Human
aaaucaguuguuauauuaaaga

SEQ ID NO: 405899 - RNA, 22 nt, Human
uauggcuuuuuauucaucuuac

SEQ ID NO: 405900 - RNA, 19 nt, Human
caguccuuuccgcuuucuc

SEQ ID NO: 405901 - RNA, 17 nt, Human
uaaauacacaaggguau

SEQ ID NO: 405902 - RNA, 22 nt, Human
guuaggcaugaguguguauuaa

SEQ ID NO: 405903 - RNA, 22 nt, Human
ucaauaauggcaggauaaauuu

SEQ ID NO: 405904 - RNA, 22 nt, Human
guuucacagaugguguucauau

SEQ ID NO: 405905 - RNA, 22 nt, Human
uaaacauggcuguuucaguuau

SEQ ID NO: 405906 - RNA, 22 nt, Human
acagaauuuaaagcucuagacu

SEQ ID NO: 405907 - RNA, 22 nt, Human
ugcuuauugcuuucaagacugu

SEQ ID NO: 405908 - RNA, 22 nt, Human
aauaauuagugggacagagaac

SEQ ID NO: 405909 - RNA, 22 nt, Human
auaacaugagccagauugaaag

SEQ ID NO: 405910 - RNA, 22 nt, Human
aaaguccuguuugaaggaccug

SEQ ID NO: 405911 - RNA, 22 nt, Human
gguaugaauucacuacuuccaa

SEQ ID NO: 405912 - RNA, 22 nt, Human
gcuggauccacaaauaacuuug

SEQ ID NO: 405913 - RNA, 22 nt, Human
cuggacucugcagagaaaagua

SEQ ID NO: 405914 - RNA, 22 nt, Human
uuuauucugugcuacaugaaga

SEQ ID NO: 405915 - RNA, 22 nt, Human
gugauuuagauguugaaaguga

SEQ ID NO: 405916 - RNA, 22 nt, Human
ucagcauaucuugagcuucaug

SEQ ID NO: 405917 - RNA, 22 nt, Human
uguuccaagcugcuggauaagc

SEQ ID NO: 405918 - RNA, 22 nt, Human
uuuccaaauaaggucacauucu

SEQ ID NO: 405919 - RNA, 22 nt, Human
uggcauuuuguucaguauaugg

SEQ ID NO: 405920 - RNA, 22 nt, Human
auuucaggauagccuaguuuug

SEQ ID NO: 405921 - RNA, 22 nt, Human
ccaaaauuaagccucuuauguu

SEQ ID NO: 405922 - RNA, 22 nt, Human
uuuccaaaggcuaaacucaguu

SEQ ID NO: 405923 - RNA, 22 nt, Human
cagcccagagauguuaucuagu

SEQ ID NO: 405924 - RNA, 22 nt, Human
uaucagaagacuuacaguaucg

SEQ ID NO: 405925 - RNA, 22 nt, Human
uuaauauguugaaauuuauuag

SEQ ID NO: 405926 - RNA, 22 nt, Human
cuuccaaagcacuuuauggacc

SEQ ID NO: 405927 - RNA, 22 nt, Human
uuugaauaucacaaacuuucaa

SEQ ID NO: 405928 - RNA, 22 nt, Human
ucagaaaagagaaaaucuuaua

SEQ ID NO: 405929 - RNA, 22 nt, Human
uaagagaauguuguggcuaggu

SEQ ID NO: 405930 - RNA, 22 nt, Human
uuuccaaaaguuuguucugugc

SEQ ID NO: 405931 - RNA, 22 nt, Human
uuugaagugcaaugaggauucu

SEQ ID NO: 405932 - RNA, 22 nt, Human
uuaauucuaguuuaacacuuag

SEQ ID NO: 405933 - RNA, 22 nt, Human
uacuaaacaucuggcauuaaau

SEQ ID NO: 405934 - RNA, 22 nt, Human
uuaaaaucuaaagcaguugucu

SEQ ID NO: 405935 - RNA, 22 nt, Human
cccaaaguacaaguaaacaugu

SEQ ID NO: 405936 - RNA, 19 nt, Human
auucauuuuugccuucuaa

SEQ ID NO: 405937 - RNA, 22 nt, Human
agaauuuccuaugagagauucc

SEQ ID NO: 405938 - RNA, 22 nt, Human
auggauuugcuuauacacaugu

SEQ ID NO: 405939 - RNA, 22 nt, Human
acagaauucuaguauguggcuu

SEQ ID NO: 405940 - RNA, 22 nt, Human
aauuaaauugguuuagagagga

SEQ ID NO: 405941 - RNA, 22 nt, Human
cauggcuuuguucuguuagaug

SEQ ID NO: 405942 - RNA, 22 nt, Human
cguccuuacagagggucacagc

SEQ ID NO: 405943 - RNA, 22 nt, Human
cuggcuuucuauuuggugcuau

SEQ ID NO: 405944 - RNA, 20 nt, Human
uauaacaguguugggugugu

SEQ ID NO: 405945 - RNA, 22 nt, Human
uaaguccuagcuuugguaggaa

SEQ ID NO: 405946 - RNA, 22 nt, Human
aaguccuuauguggaggggcua

SEQ ID NO: 405947 - RNA, 22 nt, Human
aguagaauagauggauacuauu

SEQ ID NO: 405948 - RNA, 22 nt, Human
cauuuacacuucuaaccacaag

SEQ ID NO: 405949 - RNA, 22 nt, Human
aguucucauugcaugagacaga

SEQ ID NO: 405950 - RNA, 22 nt, Human
cauuucaagcauugacuucuau

SEQ ID NO: 405951 - RNA, 22 nt, Human
agaaaucaugucuuauuucuau

SEQ ID NO: 405952 - RNA, 22 nt, Human
auucaagauuaauucuauguca

SEQ ID NO: 405953 - RNA, 22 nt, Human
aaagucauuguaauauaugcua

SEQ ID NO: 405954 - RNA, 22 nt, Human
aggauuuagauuuggaggaacu

SEQ ID NO: 405955 - RNA, 22 nt, Human
uaugaaagaaucucagagcaca

SEQ ID NO: 405956 - RNA, 22 nt, Human
caucagaaucugagucucugcc

SEQ ID NO: 405957 - RNA, 19 nt, Human
guuccaaaggccagaccuu

SEQ ID NO: 405958 - RNA, 18 nt, Human
augaucuuagcaaauauu

SEQ ID NO: 405959 - RNA, 18 nt, Human
uacagauuauagauacau

SEQ ID NO: 405960 - RNA, 18 nt, Human
aagucaccccugcucccu

SEQ ID NO: 405961 - RNA, 22 nt, Human
acagguuugucugauguaauga

SEQ ID NO: 405962 - RNA, 22 nt, Human
uuuaggcagcacgggcagcccu

SEQ ID NO: 405963 - RNA, 22 nt, Human
uucagaaacaucaguggaugga

SEQ ID NO: 405964 - RNA, 22 nt, Human
uaucaagugacuaucacagaac

SEQ ID NO: 405965 - RNA, 22 nt, Human
uauacagauuaacagauuuaaa

SEQ ID NO: 405966 - RNA, 22 nt, Human
uguauaaauuuaaauuccugcu

SEQ ID NO: 405967 - RNA, 22 nt, Human
aaguccuuuauccuaaaagguc

SEQ ID NO: 405968 - RNA, 22 nt, Human
uuauagaacagccuccucuaga

SEQ ID NO: 405969 - RNA, 22 nt, Human
aagaaugagcucaaagaucuua

SEQ ID NO: 405970 - RNA, 22 nt, Human
aauuucaaacuaauaggaacca

SEQ ID NO: 405971 - RNA, 22 nt, Human
uagauauaagguccuuagaaca

SEQ ID NO: 405972 - RNA, 22 nt, Human
uuaacagagugccuggcaugua

SEQ ID NO: 405973 - RNA, 22 nt, Human
gugaauaaaacaccugccaaga

SEQ ID NO: 405974 - RNA, 22 nt, Human
uuuaauauucugcauucuccuu

SEQ ID NO: 405975 - RNA, 22 nt, Human
aauaaccuuacuuauuacaugg

SEQ ID NO: 405976 - RNA, 22 nt, Human
aaugaaaauuggacccuagaac

SEQ ID NO: 405977 - RNA, 22 nt, Human
uaaugcuuuuccuucaaauaag

SEQ ID NO: 405978 - RNA, 22 nt, Human
aaaaccugauugaauucuauuu

SEQ ID NO: 405979 - RNA, 22 nt, Human
cagauauuaggagcucaauaau

SEQ ID NO: 405980 - RNA, 22 nt, Human
caaagauuuuagaauuugcaau

SEQ ID NO: 405981 - RNA, 22 nt, Human
cuucuuaaaguugucacagcug

SEQ ID NO: 405982 - RNA, 22 nt, Human
aaguuucaugauguaauuauug

SEQ ID NO: 405983 - RNA, 22 nt, Human
aagaauucacugguagagucaa

SEQ ID NO: 405984 - RNA, 22 nt, Human
auguuucauuuagauaucaggc

SEQ ID NO: 405985 - RNA, 22 nt, Human
aauaauuacccaucuuuuugua

SEQ ID NO: 405986 - RNA, 22 nt, Human
aaugccuuuccacuggguauca

SEQ ID NO: 405987 - RNA, 22 nt, Human
aucagaaauugcuaccagugga

SEQ ID NO: 405988 - RNA, 22 nt, Human
auacagaauacuaauuccugag

SEQ ID NO: 405989 - RNA, 22 nt, Human
cuacagaaucuaccucaagcca

SEQ ID NO: 405990 - RNA, 22 nt, Human
aaagacauggaacuagagaugg

SEQ ID NO: 405991 - RNA, 22 nt, Human
ugucauaaucaguuuugcaugu

SEQ ID NO: 405992 - RNA, 22 nt, Human
aaugaaacuguauauagacugu

SEQ ID NO: 405993 - RNA, 22 nt, Human
ugugaaagagucuuauaguuuc

SEQ ID NO: 405994 - RNA, 22 nt, Human
aggcuucugcugauauuucauu

SEQ ID NO: 405995 - RNA, 22 nt, Human
uuugaagucaaagauugauucc

SEQ ID NO: 405996 - RNA, 22 nt, Human
guagaaauagugguugacagga

SEQ ID NO: 405997 - RNA, 22 nt, Human
gaaaaaggauaaauacaguguu

SEQ ID NO: 405998 - RNA, 22 nt, Human
ccaugcacaccagcaggcagac

SEQ ID NO: 405999 - RNA, 22 nt, Human
gaauuucagggucugguaggaa

SEQ ID NO: 406000 - RNA, 22 nt, Human
auuauagaggguuacaguuaau

SEQ ID NO: 406001 - RNA, 22 nt, Human
gauagaaagagugguucuuuuu

SEQ ID NO: 406002 - RNA, 19 nt, Human
uccauaaugaagauagagg

SEQ ID NO: 406003 - RNA, 22 nt, Human
aaagcuaugaggcaugcauuuc

SEQ ID NO: 406004 - RNA, 22 nt, Human
aaacggauauaacagcaaacgc

SEQ ID NO: 406005 - RNA, 22 nt, Human
gaguccuugucauaauucagug

SEQ ID NO: 406006 - RNA, 22 nt, Human
cuuaggcagacugcugaugcag

SEQ ID NO: 406007 - RNA, 21 nt, Human
gauuuauaagccuuaagccua

SEQ ID NO: 406008 - RNA, 23 nt, Human
agaucugauguuaccaagaauug

SEQ ID NO: 406009 - RNA, 20 nt, Human
aguacaauguaugauucaga

SEQ ID NO: 406010 - RNA, 21 nt, Human
auggcuuuuuuaaagcuugug

SEQ ID NO: 406011 - RNA, 22 nt, Human
aaugaacauauaaagagaucuu

SEQ ID NO: 406012 - RNA, 23 nt, Human
ucaucaaacagcugcucaagaaa

SEQ ID NO: 406013 - RNA, 22 nt, Human
ugucaccaugccagcuucugcc

SEQ ID NO: 406014 - RNA, 22 nt, Human
ugaauaaucuuggguauuaaua

SEQ ID NO: 406015 - RNA, 22 nt, Human
gcacaauaauuuuuuuaagagg

SEQ ID NO: 406016 - RNA, 22 nt, Human
uguacaaugccgagacuaacuc

SEQ ID NO: 406017 - RNA, 19 nt, Human
uggauuuauauucuuuauc

SEQ ID NO: 406018 - RNA, 22 nt, Human
uguacaauagcuauuaucucca

SEQ ID NO: 406019 - RNA, 19 nt, Human
uuucagacucaucuccagc

SEQ ID NO: 406020 - RNA, 22 nt, Human
gcagggcaaacccagguguuca

SEQ ID NO: 406021 - RNA, 22 nt, Human
caaagucauggggaugcagguc

SEQ ID NO: 406022 - RNA, 22 nt, Human
ugaaacaaugugaaguugcuga

SEQ ID NO: 406023 - RNA, 21 nt, Human
uuacagaauccaugggaaguc

SEQ ID NO: 406024 - RNA, 22 nt, Human
agaucugaccuaaccccaccac

SEQ ID NO: 406025 - RNA, 22 nt, Human
gcuagaucucucauaaauucca

SEQ ID NO: 406026 - RNA, 22 nt, Human
auacagaauuugcccuuuucau

SEQ ID NO: 406027 - RNA, 22 nt, Human
ccuggaucagagccagagaagc

SEQ ID NO: 406028 - RNA, 22 nt, Human
uagaacauaagucauucauuug

SEQ ID NO: 406029 - RNA, 22 nt, Human
uuccucuagcuucucacuaaca

SEQ ID NO: 406030 - RNA, 22 nt, Human
caggccaggguugagaagagaa

SEQ ID NO: 406031 - RNA, 22 nt, Human
aucuauacccaucaugauuuaa

SEQ ID NO: 406032 - RNA, 22 nt, Human
ugaaagguguccaauauuucuc

SEQ ID NO: 406033 - RNA, 22 nt, Human
uggauuuaguucuucacaggcc

SEQ ID NO: 406034 - RNA, 19 nt, Human
cuauacagccucugaggaa

SEQ ID NO: 406035 - RNA, 20 nt, Human
agaaaaaguguggaaauuuc

SEQ ID NO: 406036 - RNA, 22 nt, Human
auuucaacauucucaguuguag

SEQ ID NO: 406037 - RNA, 22 nt, Human
agauuuccuaugguaauuauag

SEQ ID NO: 406038 - RNA, 22 nt, Human
uguacaauguguuuguuggcuu

SEQ ID NO: 406039 - RNA, 22 nt, Human
caauuucaauacaaaauacauu

SEQ ID NO: 406040 - RNA, 21 nt, Human
caagccagaccaauagcagcc

SEQ ID NO: 406041 - RNA, 22 nt, Human
acaaaaagggagaugagguaga

SEQ ID NO: 406042 - RNA, 22 nt, Human
ugaagaaucagauuggccugcg

SEQ ID NO: 406043 - RNA, 22 nt, Human
aaugaacagauacacauaggca

SEQ ID NO: 406044 - RNA, 22 nt, Human
aaaucaguuaagaugaggccau

SEQ ID NO: 406045 - RNA, 22 nt, Human
gucacagaguuauuaauugugu

SEQ ID NO: 406046 - RNA, 22 nt, Human
aaagcagucacuccagugugau

SEQ ID NO: 406047 - RNA, 22 nt, Human
uguagaaagaauauguuucaua

SEQ ID NO: 406048 - RNA, 22 nt, Human
auucauuagccacuaacuagca

SEQ ID NO: 406049 - RNA, 22 nt, Human
cuuccaaauguaaauaaguuuc

SEQ ID NO: 406050 - RNA, 22 nt, Human
gaauuuuucuggaagcaauuau

SEQ ID NO: 406051 - RNA, 22 nt, Human
auagcuuucuuaaauauauaaa

SEQ ID NO: 406052 - RNA, 22 nt, Human
gcagaauuuucuguuuucuaga

SEQ ID NO: 406053 - RNA, 22 nt, Human
auuccaaaaggauguuagaaug

SEQ ID NO: 406054 - RNA, 22 nt, Human
aggauuuaucaggaacucucuu

SEQ ID NO: 406055 - RNA, 22 nt, Human
aaacaggcaucacucagcaaag

SEQ ID NO: 406056 - RNA, 22 nt, Human
uggcuucaaaaucuaguggucu

SEQ ID NO: 406057 - RNA, 22 nt, Human
aaaacauguccauacagaaacu

SEQ ID NO: 406058 - RNA, 22 nt, Human
aguccuuagaacacuguaucug

SEQ ID NO: 406059 - RNA, 22 nt, Human
uaauuucaaguuuagggcucua

SEQ ID NO: 406060 - RNA, 22 nt, Human
uacuagaaccucacaacaaucc

SEQ ID NO: 406061 - RNA, 18 nt, Human
ucauagaagugaaucaga

SEQ ID NO: 406062 - RNA, 22 nt, Human
caguccuugauccaauaguggg

SEQ ID NO: 406063 - RNA, 22 nt, Human
aagacagugacagucacaauug

SEQ ID NO: 406064 - RNA, 22 nt, Human
uuggagagauuaucagaccagc

SEQ ID NO: 406065 - RNA, 22 nt, Human
aagauauagauaaaacuaugca

SEQ ID NO: 406066 - RNA, 22 nt, Human
acaauuccacauggcaugcagg

SEQ ID NO: 406067 - RNA, 23 nt, Human
acaacuuuacagauacauuuugu

SEQ ID NO: 406068 - RNA, 22 nt, Human
ccaguacugucuccaauauucc

SEQ ID NO: 406069 - RNA, 22 nt, Human
ucacaucauuaagacuucuccu

SEQ ID NO: 406070 - RNA, 22 nt, Human
cuaaaauuaucaagauaauucc

SEQ ID NO: 406071 - RNA, 22 nt, Human
aaauagcagccuuuaguuaaca

SEQ ID NO: 406072 - RNA, 22 nt, Human
uuaauuacaaaacacauagguu

SEQ ID NO: 406073 - RNA, 22 nt, Human
uggcuuuagguugcauguuucu

SEQ ID NO: 406074 - RNA, 22 nt, Human
ucuuuaaucauaaccaagaugg

SEQ ID NO: 406075 - RNA, 22 nt, Human
uuuaggcauugaauuagaauag

SEQ ID NO: 406076 - RNA, 22 nt, Human
uauacagauggaaagauacaca

SEQ ID NO: 406077 - RNA, 22 nt, Human
aguguuuaaacugaagugauga

SEQ ID NO: 406078 - RNA, 22 nt, Human
auggcuuuuuagacuuugguac

SEQ ID NO: 406079 - RNA, 22 nt, Human
aauuauauuguggugugaaugu

SEQ ID NO: 406080 - RNA, 22 nt, Human
acuuuuaaaugaguuucaguug

SEQ ID NO: 406081 - RNA, 22 nt, Human
ucaguaaaguucuuucuugcug

SEQ ID NO: 406082 - RNA, 22 nt, Human
aaauucuucagguaauuuugau

SEQ ID NO: 406083 - RNA, 22 nt, Human
aaaaugcugggaaaguuggaau

SEQ ID NO: 406084 - RNA, 22 nt, Human
cauagaaaucaggugagaaucu

SEQ ID NO: 406085 - RNA, 22 nt, Human
uccuuaauucugugcaauaugu

SEQ ID NO: 406086 - RNA, 22 nt, Human
auucucaauggcuacuuucaua

SEQ ID NO: 406087 - RNA, 22 nt, Human
gcuucacaggcaaguuaagccu

SEQ ID NO: 406088 - RNA, 22 nt, Human
ugaaagguuaaaaguaguauug

SEQ ID NO: 406089 - RNA, 22 nt, Human
aauuauccuuaaugcaguaagc

SEQ ID NO: 406090 - RNA, 22 nt, Human
acugguuuuccagguuacuucu

SEQ ID NO: 406091 - RNA, 22 nt, Human
uauguaaaguagauggcaggua

SEQ ID NO: 406092 - RNA, 22 nt, Human
auccaaagauggaaagaacuuu

SEQ ID NO: 406093 - RNA, 22 nt, Human
agaagucaaguggucuaugaaa

SEQ ID NO: 406094 - RNA, 22 nt, Human
ggauuuacaaguuuaacucuca

SEQ ID NO: 406095 - RNA, 22 nt, Human
uucaaacacagacagcagcaug

SEQ ID NO: 406096 - RNA, 22 nt, Human
aaagucauggaaaaucuuggaa

SEQ ID NO: 406097 - RNA, 22 nt, Human
aauuuacaguugcugaugguac

SEQ ID NO: 406098 - RNA, 22 nt, Human
cuucuuaacuguauauacuaug

SEQ ID NO: 406099 - RNA, 22 nt, Human
auauaugcauguguacuuaugu

SEQ ID NO: 406100 - RNA, 22 nt, Human
aaucagaaagaggucauguugc

SEQ ID NO: 406101 - RNA, 22 nt, Human
gcagaauuggauaguugugaua

SEQ ID NO: 406102 - RNA, 22 nt, Human
uuaacacuugaacucuacaugu

SEQ ID NO: 406103 - RNA, 22 nt, Human
auccuuagguggugcaucaggg

SEQ ID NO: 406104 - RNA, 22 nt, Human
ugaauaaucauguccauagugu

SEQ ID NO: 406105 - RNA, 22 nt, Human
auggcuuugcucaaguuuagcc

SEQ ID NO: 406106 - RNA, 22 nt, Human
uccauuuagcuggcaaacaaug

SEQ ID NO: 406107 - RNA, 22 nt, Human
aucuauacucagaguuaauauc

SEQ ID NO: 406108 - RNA, 22 nt, Human
cuggcuuucccuggacaacagc

SEQ ID NO: 406109 - RNA, 22 nt, Human
agcauaaaggcacuagaaagag

SEQ ID NO: 406110 - RNA, 22 nt, Human
ugcuuauucuuuccacaauuca

SEQ ID NO: 406111 - RNA, 22 nt, Human
aggauuuauuccagaaaugcaa

SEQ ID NO: 406112 - RNA, 22 nt, Human
uaaagucauaagaguggauccg

SEQ ID NO: 406113 - RNA, 22 nt, Human
uaugaaauuuaaacacagauca

SEQ ID NO: 406114 - RNA, 22 nt, Human
cucuaauccuuugucccugggu

SEQ ID NO: 406115 - RNA, 22 nt, Human
augaaacacacacgcgcauacu

SEQ ID NO: 406116 - RNA, 22 nt, Human
aauauuaucaaaagcuuuuuca

SEQ ID NO: 406117 - RNA, 22 nt, Human
caauacaauuaccaguuaauca

SEQ ID NO: 406118 - RNA, 22 nt, Human
auacaugugggucuaaacauau

SEQ ID NO: 406119 - RNA, 22 nt, Human
ugcuuuaaccaucuuguuugga

SEQ ID NO: 406120 - RNA, 22 nt, Human
cuauaauuaugcucaaaaugua

SEQ ID NO: 406121 - RNA, 22 nt, Human
ccuuuaauuuacaauguuaauu

SEQ ID NO: 406122 - RNA, 22 nt, Human
aaacugauaaaauaaguacauu

SEQ ID NO: 406123 - RNA, 22 nt, Human
ugaagaaucccagggaauuugg

SEQ ID NO: 406124 - RNA, 22 nt, Human
auucuuaauugccaugcuguau

SEQ ID NO: 406125 - RNA, 22 nt, Human
auacuguaauaccuaaaugaac

SEQ ID NO: 406126 - RNA, 22 nt, Human
ugaauaauccacagucauucau

SEQ ID NO: 406127 - RNA, 22 nt, Human
ucaaaauuagugaccaaaggca

SEQ ID NO: 406128 - RNA, 22 nt, Human
aucuaaaguguuucaugaaaga

SEQ ID NO: 406129 - RNA, 22 nt, Human
gaauuucauuuguuuccuacca

SEQ ID NO: 406130 - RNA, 22 nt, Human
uggauuuauggagaccgaaagu

SEQ ID NO: 406131 - RNA, 22 nt, Human
uacaugaaccuuuaugugugau

SEQ ID NO: 406132 - RNA, 22 nt, Human
uuugaagacagaucaauauaag

SEQ ID NO: 406133 - RNA, 22 nt, Human
cugauacauaguagcaugucau

SEQ ID NO: 406134 - RNA, 22 nt, Human
cucuuaaugaccuuaauucaag

SEQ ID NO: 406135 - RNA, 22 nt, Human
ugucaccagcugcuccucagga

SEQ ID NO: 406136 - RNA, 22 nt, Human
aaugucuuuaaagugcaauaga

SEQ ID NO: 406137 - RNA, 22 nt, Human
cagauacuguaaaauuucagua

SEQ ID NO: 406138 - RNA, 22 nt, Human
aaaguguacuaugucaugaaca

SEQ ID NO: 406139 - RNA, 20 nt, Human
agaagucagcucagaaguga

SEQ ID NO: 406140 - RNA, 22 nt, Human
uagucaccagcuacaggacagc

SEQ ID NO: 406141 - RNA, 22 nt, Human
uaacagaaaggggacagaaaua

SEQ ID NO: 406142 - RNA, 22 nt, Human
uacacauguuuggcaaguaugu

SEQ ID NO: 406143 - RNA, 22 nt, Human
gagauuuagagagacuuaaaca

SEQ ID NO: 406144 - RNA, 22 nt, Human
uaacagaagaaaacauauugga

SEQ ID NO: 406145 - RNA, 22 nt, Human
ucuuaauugagaacaguguagg

SEQ ID NO: 406146 - RNA, 22 nt, Human
auuaggcagacaacguagccgg

SEQ ID NO: 406147 - RNA, 22 nt, Human
uugaagaaagucauauauaaug

SEQ ID NO: 406148 - RNA, 20 nt, Human
ugcaggaauuugcauuccuu

SEQ ID NO: 406149 - RNA, 22 nt, Human
cauucauucuguaaguaacuau

SEQ ID NO: 406150 - RNA, 22 nt, Human
acuuuaauuaaugaacuguggc

SEQ ID NO: 406151 - RNA, 22 nt, Human
augaacaagagagggaagauuc

SEQ ID NO: 406152 - RNA, 22 nt, Human
aaucagucucauuuagcaggga

SEQ ID NO: 406153 - RNA, 22 nt, Human
auggcuuucagauggugaaaga

SEQ ID NO: 406154 - RNA, 22 nt, Human
auggcuuugaaguaauguaauu

SEQ ID NO: 406155 - RNA, 22 nt, Human
aauaauauuugaagcuucaaag

SEQ ID NO: 406156 - RNA, 22 nt, Human
ugugugaaucuauugaauauau

SEQ ID NO: 406157 - RNA, 22 nt, Human
uuucaaguguccugauuaaugg

SEQ ID NO: 406158 - RNA, 22 nt, Human
aaacauguuuucugaauauuuu

SEQ ID NO: 406159 - RNA, 22 nt, Human
aguaugaacggaaggccuggga

SEQ ID NO: 406160 - RNA, 20 nt, Human
agaaucugacccagagagac

SEQ ID NO: 406161 - RNA, 22 nt, Human
gcacaauaauucuuguuuugcu

SEQ ID NO: 406162 - RNA, 22 nt, Human
uuuaggcagcuacauacuaacu

SEQ ID NO: 406163 - RNA, 22 nt, Human
uggauuagguacuaugaauaua

SEQ ID NO: 406164 - RNA, 20 nt, Human
caucagaaauccugacccac

SEQ ID NO: 406165 - RNA, 22 nt, Human
gcuggaucccugugggaguggu

SEQ ID NO: 406166 - RNA, 22 nt, Human
aaauacugggcucaaaaggguu

SEQ ID NO: 406167 - RNA, 22 nt, Human
cuacagaaaccuuuuucauaca

SEQ ID NO: 406168 - RNA, 22 nt, Human
aaaaguguucaggaagaauaau

SEQ ID NO: 406169 - RNA, 22 nt, Human
caucagaaggccagaggguagc

SEQ ID NO: 406170 - RNA, 22 nt, Human
cauuucaaguaacagauugcuu

SEQ ID NO: 406171 - RNA, 22 nt, Human
uuuaauacuauggggaugaaca

SEQ ID NO: 406172 - RNA, 22 nt, Human
guauuuaauuccauuaaguuag

SEQ ID NO: 406173 - RNA, 22 nt, Human
aaacuuugguauguagcaaaac

SEQ ID NO: 406174 - RNA, 21 nt, Human
agaagucaauugaacugaaau

SEQ ID NO: 406175 - RNA, 22 nt, Human
cuccuuagugccucugcacgag

SEQ ID NO: 406176 - RNA, 22 nt, Human
uuauccaagcagaagcugcaca

SEQ ID NO: 406177 - RNA, 21 nt, Human
cauuucaaagagcuggaaauc

SEQ ID NO: 406178 - RNA, 22 nt, Human
ugccauuuugagauguuaauga

SEQ ID NO: 406179 - RNA, 22 nt, Human
gauuuacagaucuaagggucac

SEQ ID NO: 406180 - RNA, 22 nt, Human
aggcaacuguuugauaauguug

SEQ ID NO: 406181 - RNA, 22 nt, Human
augcuuuaaacuauaaauccac

SEQ ID NO: 406182 - RNA, 22 nt, Human
gaugggauuuuuuauguguuca

SEQ ID NO: 406183 - RNA, 22 nt, Human
cuuaauuacccaaugugguagg

SEQ ID NO: 406184 - RNA, 22 nt, Human
guuuacauguacucauuauacu

SEQ ID NO: 406185 - RNA, 22 nt, Human
caucagaauguuagagaaggga

SEQ ID NO: 406186 - RNA, 22 nt, Human
caucagaacgugagcuccuugu

SEQ ID NO: 406187 - RNA, 22 nt, Human
uagaaacagcauauauuagccc

SEQ ID NO: 406188 - RNA, 22 nt, Human
aaagucauguaaugauaugauu

SEQ ID NO: 406189 - RNA, 22 nt, Human
auggcauuugaaucugucuuuu

SEQ ID NO: 406190 - RNA, 22 nt, Human
ugaauaauuccuuuuugucaag

SEQ ID NO: 406191 - RNA, 22 nt, Human
aucuaaaaggagcucuuuaucu

SEQ ID NO: 406192 - RNA, 22 nt, Human
uaucauaaguuaauuaaacagu

SEQ ID NO: 406193 - RNA, 19 nt, Human
agcaaauacaucaaaauug

SEQ ID NO: 406194 - RNA, 22 nt, Human
uauggaaagggaguuuaauuug

SEQ ID NO: 406195 - RNA, 22 nt, Human
gauuuccaggucauuaauaaag

SEQ ID NO: 406196 - RNA, 22 nt, Human
ugcuuaauacguauuugcugga

SEQ ID NO: 406197 - RNA, 22 nt, Human
aaagcauuucaugucuagaaag

SEQ ID NO: 406198 - RNA, 22 nt, Human
ugguuuaauuuccauuuccuug

SEQ ID NO: 406199 - RNA, 22 nt, Human
caaugaaauugagauccagaga

SEQ ID NO: 406200 - RNA, 18 nt, Human
auauguuaauuagguagg

SEQ ID NO: 406201 - RNA, 22 nt, Human
uucacagauuucccugcacaug

SEQ ID NO: 406202 - RNA, 22 nt, Human
agauauaauaauuuacaagugu

SEQ ID NO: 406203 - RNA, 22 nt, Human
uguccuuauaagaaaaggaaau

SEQ ID NO: 406204 - RNA, 22 nt, Human
auccauuugaaagaacagucca

SEQ ID NO: 406205 - RNA, 22 nt, Human
uaguaucuauuaguaacaagag

SEQ ID NO: 406206 - RNA, 22 nt, Human
ucaauacuuaagcuuaauucua

SEQ ID NO: 406207 - RNA, 22 nt, Human
aaguccuucccaagcauguacc

SEQ ID NO: 406208 - RNA, 21 nt, Human
gaguccuuccaauguccucag

SEQ ID NO: 406209 - RNA, 22 nt, Human
aagcauuugugaaauucagaug

SEQ ID NO: 406210 - RNA, 22 nt, Human
auuccaaaggcuggccuggagg

SEQ ID NO: 406211 - RNA, 22 nt, Human
ucaguaaaugguugcuguuauu

SEQ ID NO: 406212 - RNA, 22 nt, Human
uuacagaaguauugagagaucc

SEQ ID NO: 406213 - RNA, 22 nt, Human
augugaaaaauuucuuauuaca

SEQ ID NO: 406214 - RNA, 22 nt, Human
uaacauguuaagaaauuagaua

SEQ ID NO: 406215 - RNA, 22 nt, Human
aaaaugcuauuucauggaggag

SEQ ID NO: 406216 - RNA, 22 nt, Human
uacacaugaucauuuaguagca

SEQ ID NO: 406217 - RNA, 23 nt, Human
aguacaauaaguauaauucuuuc

SEQ ID NO: 406218 - RNA, 22 nt, Human
auuccaaacgccucgcggacuu

SEQ ID NO: 406219 - RNA, 22 nt, Human
uagaauaaguugaugauauaug

SEQ ID NO: 406220 - RNA, 22 nt, Human
uuccuuagcuccucauggccug

SEQ ID NO: 406221 - RNA, 22 nt, Human
gucaaacauagggacuuugugg

SEQ ID NO: 406222 - RNA, 22 nt, Human
uugauacuauuaagcacugggc

SEQ ID NO: 406223 - RNA, 22 nt, Human
ugcaggaaaacaccuaucaccc

SEQ ID NO: 406224 - RNA, 22 nt, Human
cugaaagguauaaauaagacuu

SEQ ID NO: 406225 - RNA, 22 nt, Human
aaagaaucacauccuucagcaa

SEQ ID NO: 406226 - RNA, 22 nt, Human
ucaaacagaggaacaauuguuu

SEQ ID NO: 406227 - RNA, 22 nt, Human
ugcaggaauagcuacagagcug

SEQ ID NO: 406228 - RNA, 22 nt, Human
uuaauucugccuuucauguaac

SEQ ID NO: 406229 - RNA, 22 nt, Human
cuggcuuucuguuauaaagaca

SEQ ID NO: 406230 - RNA, 22 nt, Human
uuuacagaauguugaauuuggg

SEQ ID NO: 406231 - RNA, 22 nt, Human
cauagcuuagggguuaaacuca

SEQ ID NO: 406232 - RNA, 22 nt, Human
aaugcuuauaccuaaugaucuu

SEQ ID NO: 406233 - RNA, 22 nt, Human
aauaauuuuagcucagaguugu

SEQ ID NO: 406234 - RNA, 22 nt, Human
auacacagcgaugagaggaggc

SEQ ID NO: 406235 - RNA, 22 nt, Human
uguauacaauucacacuuccca

SEQ ID NO: 406236 - RNA, 22 nt, Human
aagucauugguagcuugauagg

SEQ ID NO: 406237 - RNA, 22 nt, Human
caaaggcaggcccccugugcag

SEQ ID NO: 406238 - RNA, 22 nt, Human
gcagaauugauggagaacuuaa

SEQ ID NO: 406239 - RNA, 22 nt, Human
uuacagaaaauguguuuuaacu

SEQ ID NO: 406240 - RNA, 22 nt, Human
ucaaaauuaaaccaacguccag

SEQ ID NO: 406241 - RNA, 22 nt, Human
ugcagggcccucauuccugucc

SEQ ID NO: 406242 - RNA, 22 nt, Human
uguuuaauaauucuaugauagu

SEQ ID NO: 406243 - RNA, 22 nt, Human
uuucauaaggguuucuagacuu

SEQ ID NO: 406244 - RNA, 23 nt, Human
ucuauacauacugcagccucugg

SEQ ID NO: 406245 - RNA, 21 nt, Human
agucccauccgguaagcaagc

SEQ ID NO: 406246 - RNA, 22 nt, Human
uuccaaaguuaguuauuagaaa

SEQ ID NO: 406247 - RNA, 22 nt, Human
uuauuuauggcccucaccugau

SEQ ID NO: 406248 - RNA, 22 nt, Human
gaaugaaagauuugcauucuau

SEQ ID NO: 406249 - RNA, 22 nt, Human
aaucauaauucaaauaagcuua

SEQ ID NO: 406250 - RNA, 22 nt, Human
uuacauaacgguaugaaaaaug

SEQ ID NO: 406251 - RNA, 22 nt, Human
acaaagaucuugcuuuccuacu

SEQ ID NO: 406252 - RNA, 22 nt, Human
auguauaaugcuaauuagcuag

SEQ ID NO: 406253 - RNA, 22 nt, Human
ucccugggcuucuccagacuug

SEQ ID NO: 406254 - RNA, 21 nt, Human
uuuaaagaauaggaagggagg

SEQ ID NO: 406255 - RNA, 22 nt, Human
cacccagugaaggagcaagagg

SEQ ID NO: 406256 - RNA, 22 nt, Human
aaauuucaguuaccuuuacguu

SEQ ID NO: 406257 - RNA, 22 nt, Human
uguaacaaaauaccuuggauug

SEQ ID NO: 406258 - RNA, 23 nt, Human
uuaagacuggcugaacuuaguag

SEQ ID NO: 406259 - RNA, 22 nt, Human
uaagucaucacauugcagagau

SEQ ID NO: 406260 - RNA, 22 nt, Human
auuuccaggagaaaggauuuua

SEQ ID NO: 406261 - RNA, 22 nt, Human
aggcagaccaugaaucaugacc

SEQ ID NO: 406262 - RNA, 22 nt, Human
ucccaaagcuacucuucugacu

SEQ ID NO: 406263 - RNA, 17 nt, Human
uaaagccagucaaguca

SEQ ID NO: 406264 - RNA, 22 nt, Human
gacuaugugaagugugaauagg

SEQ ID NO: 406265 - RNA, 22 nt, Human
cuuaaagaguauuuaauauaau

SEQ ID NO: 406266 - RNA, 22 nt, Human
ggcaccagccaccuauuucuag

SEQ ID NO: 406267 - RNA, 22 nt, Human
uugaauaauuaauuacacucag

SEQ ID NO: 406268 - RNA, 23 nt, Human
aagaaugcuucugaagagcugcc

SEQ ID NO: 406269 - RNA, 22 nt, Human
ugucaccacauuugucaauauc

SEQ ID NO: 406270 - RNA, 22 nt, Human
auucuaacacaugcucuaagaa

SEQ ID NO: 406271 - RNA, 22 nt, Human
gaucagaauucuuguguguuuc

SEQ ID NO: 406272 - RNA, 22 nt, Human
guaaacaacacaaaucauuuga

SEQ ID NO: 406273 - RNA, 22 nt, Human
gugaauaauuuuuuaguauaag

SEQ ID NO: 406274 - RNA, 22 nt, Human
uaauuucagugggcucugggcu

SEQ ID NO: 406275 - RNA, 22 nt, Human
aaaguccagagggcacacugaa

SEQ ID NO: 406276 - RNA, 22 nt, Human
caguccuucuccauuaaggcuc

SEQ ID NO: 406277 - RNA, 19 nt, Human
cagaaauagcgaaguguaa

SEQ ID NO: 406278 - RNA, 22 nt, Human
auaaagcauacuuuguaugacu

SEQ ID NO: 406279 - RNA, 22 nt, Human
aaucagaauuuguccccugagu

SEQ ID NO: 406280 - RNA, 22 nt, Human
uguagaaauuaguaagaucaac

SEQ ID NO: 406281 - RNA, 22 nt, Human
uuccuuagcugucccuggaaau

SEQ ID NO: 406282 - RNA, 22 nt, Human
gucaaacagccuccuguucuaa

SEQ ID NO: 406283 - RNA, 22 nt, Human
uaaaguuuguagcaauugauau

SEQ ID NO: 406284 - RNA, 22 nt, Human
ugaaacaagauccacagacuug

SEQ ID NO: 406285 - RNA, 22 nt, Human
aggcuucugugagcucauacaa

SEQ ID NO: 406286 - RNA, 22 nt, Human
uuuauucuauaggcauuaagca

SEQ ID NO: 406287 - RNA, 22 nt, Human
auaaaaguaggaccaacuuaca

SEQ ID NO: 406288 - RNA, 22 nt, Human
cugaauaauuuuauaguugcug

SEQ ID NO: 406289 - RNA, 20 nt, Human
auucuacaagaauaagcaug

SEQ ID NO: 406290 - RNA, 22 nt, Human
uaggaaaacgugauuuucucac

SEQ ID NO: 406291 - RNA, 22 nt, Human
ccuggauccaugaaaaggcuac

SEQ ID NO: 406292 - RNA, 22 nt, Human
uauauuaaaugaccaguuuuaa

SEQ ID NO: 406293 - RNA, 22 nt, Human
auuccaaacucuuucccugucg

SEQ ID NO: 406294 - RNA, 22 nt, Human
ggcgcacaaugugcagguuugu

SEQ ID NO: 406295 - RNA, 22 nt, Human
cuuaauuacuguccaauaugca

SEQ ID NO: 406296 - RNA, 22 nt, Human
ucaaaauucuagggagaauggu

SEQ ID NO: 406297 - RNA, 22 nt, Human
uggcuuuacugucauucuuaug

SEQ ID NO: 406298 - RNA, 22 nt, Human
agucaccaucuguggcagccug

SEQ ID NO: 406299 - RNA, 22 nt, Human
aauuuacaggugcacucgccau

SEQ ID NO: 406300 - RNA, 22 nt, Human
aagcauuugguucugaagacuc

SEQ ID NO: 406301 - RNA, 22 nt, Human
auaugaaaagaagucaccauug

SEQ ID NO: 406302 - RNA, 22 nt, Human
augguuuacaauguuuucaguu

SEQ ID NO: 406303 - RNA, 22 nt, Human
cuggauuuaggacuaguccaag

SEQ ID NO: 406304 - RNA, 22 nt, Human
uaaagucagauaucuggguuga

SEQ ID NO: 406305 - RNA, 22 nt, Human
uugaauaaaugagcagugaauu

SEQ ID NO: 406306 - RNA, 22 nt, Human
ucuuuaauaucugccccagagc

SEQ ID NO: 406307 - RNA, 23 nt, Human
aaaguguagccagguuaagaacc

SEQ ID NO: 406308 - RNA, 22 nt, Human
ugaaugaacuaaaucauaguuc

SEQ ID NO: 406309 - RNA, 22 nt, Human
uuuacagauguggaaagugagc

SEQ ID NO: 406310 - RNA, 22 nt, Human
uucaauucuaaacuaauauucu

SEQ ID NO: 406311 - RNA, 22 nt, Human
gaucugaagagcaaugaaauau

SEQ ID NO: 406312 - RNA, 22 nt, Human
ucacaucaacauuauagcauga

SEQ ID NO: 406313 - RNA, 22 nt, Human
caaacuggcuaugggaaucuug

SEQ ID NO: 406314 - RNA, 22 nt, Human
gguacaaugguucauuuuaugu

SEQ ID NO: 406315 - RNA, 22 nt, Human
auggcuuucucuaaugugguau

SEQ ID NO: 406316 - RNA, 22 nt, Human
acuagaaauuacucagaauaaa

SEQ ID NO: 406317 - RNA, 22 nt, Human
uaucagaaaugccuuaaauugg

SEQ ID NO: 406318 - RNA, 22 nt, Human
uauacuuuccugcaacuuugau

SEQ ID NO: 406319 - RNA, 21 nt, Human
cauuuacaugacagauugguu

SEQ ID NO: 406320 - RNA, 22 nt, Human
uucuucaaaauccagcaugauu

SEQ ID NO: 406321 - RNA, 22 nt, Human
aaucagaaauucuacaucacaa

SEQ ID NO: 406322 - RNA, 22 nt, Human
uauacagaacugcacgugcacg

SEQ ID NO: 406323 - RNA, 22 nt, Human
gagucaccuugggucagcgaua

SEQ ID NO: 406324 - RNA, 21 nt, Human
agagacugucacugcaguacc

SEQ ID NO: 406325 - RNA, 22 nt, Human
aagcaauagcaacaacuuuaca

SEQ ID NO: 406326 - RNA, 22 nt, Human
augaauaaacaggugccucuuc

SEQ ID NO: 406327 - RNA, 22 nt, Human
uuagaaaugucacagaucugau

SEQ ID NO: 406328 - RNA, 22 nt, Human
agcauuuagucuuuauugcagc

SEQ ID NO: 406329 - RNA, 22 nt, Human
uucacacacagcuuccuauugu

SEQ ID NO: 406330 - RNA, 22 nt, Human
cacauacuuguguguacauaug

SEQ ID NO: 406331 - RNA, 22 nt, Human
caucagucuagauucuaguacc

SEQ ID NO: 406332 - RNA, 22 nt, Human
augccaaagcccaaguucauca

SEQ ID NO: 406333 - RNA, 22 nt, Human
cagauuuaagagauaaacagug

SEQ ID NO: 406334 - RNA, 22 nt, Human
agccauuuuccugaaauauaac

SEQ ID NO: 406335 - RNA, 22 nt, Human
uguucuagcaacacaguuuugg

SEQ ID NO: 406336 - RNA, 21 nt, Human
ccaagacucccaucuaguggu

SEQ ID NO: 406337 - RNA, 22 nt, Human
uuauccaacaugacuuaugucc

SEQ ID NO: 406338 - RNA, 22 nt, Human
aguucacagaauggccagaacu

SEQ ID NO: 406339 - RNA, 22 nt, Human
acaaagucacaauaauuaaccu

SEQ ID NO: 406340 - RNA, 22 nt, Human
aucagaaacucuuagagcaggg

SEQ ID NO: 406341 - RNA, 22 nt, Human
auggcuuaagaaugcuuuugug

SEQ ID NO: 406342 - RNA, 22 nt, Human
cuuaggcaguuuaggaaagaga

SEQ ID NO: 406343 - RNA, 22 nt, Human
auuacacuuguucaucaucacc

SEQ ID NO: 406344 - RNA, 22 nt, Human
guacaauagucccuguuuggau

SEQ ID NO: 406345 - RNA, 22 nt, Human
aaagacauuagcuuagauguca

SEQ ID NO: 406346 - RNA, 22 nt, Human
aaucuagucuccuuaagucuuu

SEQ ID NO: 406347 - RNA, 22 nt, Human
gauucaauguugcagauggaau

SEQ ID NO: 406348 - RNA, 22 nt, Human
auauaaagaaguggaaaaugag

SEQ ID NO: 406349 - RNA, 22 nt, Human
caagucauuacugaaaugucac

SEQ ID NO: 406350 - RNA, 22 nt, Human
uuucagacaggacuucauaugu

SEQ ID NO: 406351 - RNA, 22 nt, Human
aaauuucaagcaaaguagcuau

SEQ ID NO: 406352 - RNA, 22 nt, Human
aacuggauuaacuggcucaaau

SEQ ID NO: 406353 - RNA, 22 nt, Human
agucaccagguuuuagagaccu

SEQ ID NO: 406354 - RNA, 22 nt, Human
uuccauaauaggcuuaagugaa

SEQ ID NO: 406355 - RNA, 22 nt, Human
ucaagacaucacugugcauuuu

SEQ ID NO: 406356 - RNA, 22 nt, Human
ucagccagaggcuucuugguuu

SEQ ID NO: 406357 - RNA, 22 nt, Human
ugaaugaauccuaacaaagaca

SEQ ID NO: 406358 - RNA, 22 nt, Human
aaguccuucuuuauaugagagu

SEQ ID NO: 406359 - RNA, 22 nt, Human
augcuuuagugucaaguuuggg

SEQ ID NO: 406360 - RNA, 22 nt, Human
aaugcuuaauucaauacugugu

SEQ ID NO: 406361 - RNA, 22 nt, Human
aauauaaugcuguuuuaugcca

SEQ ID NO: 406362 - RNA, 22 nt, Human
uuagaaaugcacccaagaccua

SEQ ID NO: 406363 - RNA, 22 nt, Human
uaaagacaugguguaggugaac

SEQ ID NO: 406364 - RNA, 22 nt, Human
agguacaaaagaguauaugaga

SEQ ID NO: 406365 - RNA, 22 nt, Human
uaauuguagcuuuguaaucagc

SEQ ID NO: 406366 - RNA, 22 nt, Human
agauaucaccaguuuuacauac

SEQ ID NO: 406367 - RNA, 22 nt, Human
guucuaauauuuuaaaagccaa

SEQ ID NO: 406368 - RNA, 22 nt, Human
acauaauagcauuucuaauuug

SEQ ID NO: 406369 - RNA, 22 nt, Human
ucuauacugaugggauacuauu

SEQ ID NO: 406370 - RNA, 22 nt, Human
aguacaacauuagaguaucuua

SEQ ID NO: 406371 - RNA, 22 nt, Human
aaucagaaauugagggucuggu

SEQ ID NO: 406372 - RNA, 22 nt, Human
uucuuaauaccuauuuucuacc

SEQ ID NO: 406373 - RNA, 22 nt, Human
ugauuuaaaagaaacauugucu

SEQ ID NO: 406374 - RNA, 22 nt, Human
aaauacugucucugagagagcc

SEQ ID NO: 406375 - RNA, 22 nt, Human
ucacauaaauuauacaauuuca

SEQ ID NO: 406376 - RNA, 22 nt, Human
agaaaucaauaucuauauguug

SEQ ID NO: 406377 - RNA, 22 nt, Human
uuauaacaucaaucagaguuaa

SEQ ID NO: 406378 - RNA, 22 nt, Human
uuacagaagagaaagaauucag

SEQ ID NO: 406379 - RNA, 22 nt, Human
caguccagcccccugcuaaaag

SEQ ID NO: 406380 - RNA, 22 nt, Human
uuaaaacagcgugaaucuggca

SEQ ID NO: 406381 - RNA, 22 nt, Human
uaugaaaagguggccaauguag

SEQ ID NO: 406382 - RNA, 22 nt, Human
uaauagaauaguggaaacauug

SEQ ID NO: 406383 - RNA, 22 nt, Human
aaguccuugaagaaacaguucu

SEQ ID NO: 406384 - RNA, 22 nt, Human
ucaguuucacagucugugcaga

SEQ ID NO: 406385 - RNA, 22 nt, Human
aaugugaucgcuuuagaagcuu

SEQ ID NO: 406386 - RNA, 22 nt, Human
uauaaaauucucaguuuggggu

SEQ ID NO: 406387 - RNA, 22 nt, Human
ugcuuaauauugugauguaaua

SEQ ID NO: 406388 - RNA, 17 nt, Human
cuuuuaauuuacuuccc

SEQ ID NO: 406389 - RNA, 22 nt, Human
uagaauaugauuaauuuucuua

SEQ ID NO: 406390 - RNA, 22 nt, Human
agaagucaauaguuguuugaug

SEQ ID NO: 406391 - RNA, 22 nt, Human
acaaagucaaauugcagccgcc

SEQ ID NO: 406392 - RNA, 22 nt, Human
aagucaccccacacucuuggga

SEQ ID NO: 406393 - RNA, 22 nt, Human
agcaucuggcagaaagucagaa

SEQ ID NO: 406394 - RNA, 22 nt, Human
aaacaaacaauuaguugugugg

SEQ ID NO: 406395 - RNA, 22 nt, Human
uuccuuaguugacugucuuagu

SEQ ID NO: 406396 - RNA, 22 nt, Human
uuacagaagaguaacuuggcaa

SEQ ID NO: 406397 - RNA, 20 nt, Human
uguaacaaucuggauguugc

SEQ ID NO: 406398 - RNA, 22 nt, Human
aaauuauaggugccaccuugga

SEQ ID NO: 406399 - RNA, 22 nt, Human
uuccaaagugcuggaauuacau

SEQ ID NO: 406400 - RNA, 22 nt, Human
gaauauauuggugaaaauaguu

SEQ ID NO: 406401 - RNA, 22 nt, Human
auguauccuuauacacauuuau

SEQ ID NO: 406402 - RNA, 22 nt, Human
auuaggcacuagaaugucaauu

SEQ ID NO: 406403 - RNA, 22 nt, Human
uuuccaaagguggcaggaacaa

SEQ ID NO: 406404 - RNA, 22 nt, Human
aaaacaguuuuugcuaacugcu

SEQ ID NO: 406405 - RNA, 23 nt, Human
uuccuuaacuguuaagauugucu

SEQ ID NO: 406406 - RNA, 22 nt, Human
aauucacaaaaguuagauccau

SEQ ID NO: 406407 - RNA, 22 nt, Human
gguacaaugucuuacagaccca

SEQ ID NO: 406408 - RNA, 22 nt, Human
uugguacaaaaguaacuguggu

SEQ ID NO: 406409 - RNA, 22 nt, Human
auagaaauggcagcuggugcua

SEQ ID NO: 406410 - RNA, 22 nt, Human
aggauuuagcaugaaaugugaa

SEQ ID NO: 406411 - RNA, 22 nt, Human
uauacagaaagaauucaagucu

SEQ ID NO: 406412 - RNA, 22 nt, Human
aacaaacaaacauuuugucauc

SEQ ID NO: 406413 - RNA, 22 nt, Human
uuucaacguguaaucuuauuua

SEQ ID NO: 406414 - RNA, 22 nt, Human
ucugaagaacugaguaaacaug

SEQ ID NO: 406415 - RNA, 22 nt, Human
cuagaaauauuuuacagucaag

SEQ ID NO: 406416 - RNA, 22 nt, Human
auuuccaagaaagcuuuaggau

SEQ ID NO: 406417 - RNA, 22 nt, Human
ugcaggaagcaaccagguccaa

SEQ ID NO: 406418 - RNA, 22 nt, Human
uuugaagauuaugccagaguga

SEQ ID NO: 406419 - RNA, 22 nt, Human
guagaaauuccauuuacuuuga

SEQ ID NO: 406420 - RNA, 22 nt, Human
uguaaauaauuccuaggcuuuu

SEQ ID NO: 406421 - RNA, 21 nt, Human
caaguccuuugccaaagugcu

SEQ ID NO: 406422 - RNA, 22 nt, Human
gaauuacaugacccugaguaga

SEQ ID NO: 406423 - RNA, 22 nt, Human
caucagaaggaaggacgauuau

SEQ ID NO: 406424 - RNA, 21 nt, Human
aauccuuaaugaggaguuggu

SEQ ID NO: 406425 - RNA, 22 nt, Human
uaagaaacccaggaauuucuua

SEQ ID NO: 406426 - RNA, 22 nt, Human
uacauacaagauguguuuaaaa

SEQ ID NO: 406427 - RNA, 22 nt, Human
auguaaaucaagcagugcuggu

SEQ ID NO: 406428 - RNA, 19 nt, Human
aaucagaaauaucgaggcc

SEQ ID NO: 406429 - RNA, 22 nt, Human
aauuucaagucuugaagaagua

SEQ ID NO: 406430 - RNA, 22 nt, Human
aggcuucuucuuccuauuuagu

SEQ ID NO: 406431 - RNA, 22 nt, Human
cuacagaaaaucagccacaggc

SEQ ID NO: 406432 - RNA, 22 nt, Human
ucaguguauggagugcuggauu

SEQ ID NO: 406433 - RNA, 23 nt, Human
uaaagucacauauuagagugagc

SEQ ID NO: 406434 - RNA, 22 nt, Human
ugcaggaacuugguuuuacuca

SEQ ID NO: 406435 - RNA, 22 nt, Human
aagcauuuugccacuugaaguu

SEQ ID NO: 406436 - RNA, 22 nt, Human
agaucaguuagauagcuugaug

SEQ ID NO: 406437 - RNA, 22 nt, Human
auuucuuacauaacaaauuguu

SEQ ID NO: 406438 - RNA, 20 nt, Human
auaaaauaacugccacaaga

SEQ ID NO: 406439 - RNA, 21 nt, Human
ugaaagaaggugcagucugaa

SEQ ID NO: 406440 - RNA, 22 nt, Human
guuaggcaaauaacuguggagc

SEQ ID NO: 406441 - RNA, 22 nt, Human
uuuuuugucuugaagaaauggu

SEQ ID NO: 406442 - RNA, 22 nt, Human
ucagaauucagagggagugggg

SEQ ID NO: 406443 - RNA, 22 nt, Human
ucaguaaacagguuuaaguccu

SEQ ID NO: 406444 - RNA, 23 nt, Human
ugguucuaggccuauaauuauau

SEQ ID NO: 406445 - RNA, 22 nt, Human
uaaucuaccacuauugcaauau

SEQ ID NO: 406446 - RNA, 22 nt, Human
uuagaaaucugcugccaugcaa

SEQ ID NO: 406447 - RNA, 22 nt, Human
cuggcuuuaacccuacaaaccu

SEQ ID NO: 406448 - RNA, 22 nt, Human
auuauucaacacuugagaaauu

SEQ ID NO: 406449 - RNA, 22 nt, Human
caaagaagagauuuacagagcu

SEQ ID NO: 406450 - RNA, 22 nt, Human
aaagccauugaacuguacuuua

SEQ ID NO: 406451 - RNA, 22 nt, Human
augaaacagugaauuagucaag

SEQ ID NO: 406452 - RNA, 22 nt, Human
caugauaauuguuaacaaagua

SEQ ID NO: 406453 - RNA, 22 nt, Human
uucagagaagcaaaggcagauu

SEQ ID NO: 406454 - RNA, 22 nt, Human
uuaaagauucugaggcugauua

SEQ ID NO: 406455 - RNA, 22 nt, Human
caauauauaggaacaacuuagg

SEQ ID NO: 406456 - RNA, 22 nt, Human
uuugaacaggaguaucuauagu

SEQ ID NO: 406457 - RNA, 22 nt, Human
aauacaagauuuauaguuguuu

SEQ ID NO: 406458 - RNA, 22 nt, Human
auuaggcaauucugggcaucuc

SEQ ID NO: 406459 - RNA, 22 nt, Human
caaagccaggcuuucuaaugua

SEQ ID NO: 406460 - RNA, 22 nt, Human
aagcucauuaauuagaagcuaa

SEQ ID NO: 406461 - RNA, 22 nt, Human
cagaaaucauugugaugacagg

SEQ ID NO: 406462 - RNA, 22 nt, Human
caucagaauuacuuggggagcu

SEQ ID NO: 406463 - RNA, 22 nt, Human
uaucagaaggcacauggagucu

SEQ ID NO: 406464 - RNA, 22 nt, Human
caucagaaaccuugaggaaacu

SEQ ID NO: 406465 - RNA, 22 nt, Human
aaaucaguucucccuuucuuca

SEQ ID NO: 406466 - RNA, 22 nt, Human
aguaaaauuguauuggaaaaca

SEQ ID NO: 406467 - RNA, 22 nt, Human
cauuucaaggaccacccuggga

SEQ ID NO: 406468 - RNA, 22 nt, Human
uaaagacaauuucgagcuguag

SEQ ID NO: 406469 - RNA, 21 nt, Human
ucaguaaaccuaaagauugua

SEQ ID NO: 406470 - RNA, 22 nt, Human
ucagaauuuugguuugguuggu

SEQ ID NO: 406471 - RNA, 22 nt, Human
aagcccagcugaaagcauuuuu

SEQ ID NO: 406472 - RNA, 22 nt, Human
auuaggcauauaugcuuuuaau

SEQ ID NO: 406473 - RNA, 22 nt, Human
uuuaggcagaagcccugcugau

SEQ ID NO: 406474 - RNA, 22 nt, Human
uuccuuagggaaagggauaagg

SEQ ID NO: 406475 - RNA, 22 nt, Human
uuuauacauggagaauuuuugc

SEQ ID NO: 406476 - RNA, 22 nt, Human
cagcacagggacaauagcagau

SEQ ID NO: 406477 - RNA, 22 nt, Human
caagaaucuugcagcuuagacu

SEQ ID NO: 406478 - RNA, 22 nt, Human
gucauuucuguuucuucagugc

SEQ ID NO: 406479 - RNA, 21 nt, Human
uuuaguucaaguacagaacca

SEQ ID NO: 406480 - RNA, 22 nt, Human
aaacugugaagcaaguacaagg

SEQ ID NO: 406481 - RNA, 22 nt, Human
caauuucaugccauguauugcu

SEQ ID NO: 406482 - RNA, 22 nt, Human
cuuuacauaaggauaaaccugg

SEQ ID NO: 406483 - RNA, 22 nt, Human
aguacaauuauauuuagauggu

SEQ ID NO: 406484 - RNA, 22 nt, Human
aaagucaugaugaaccaccgua

SEQ ID NO: 406485 - RNA, 22 nt, Human
uuaggaaauuccaccuguauuc

SEQ ID NO: 406486 - RNA, 22 nt, Human
ugagauuuguuuuauaaaauag

SEQ ID NO: 406487 - RNA, 22 nt, Human
uguucacaucgauggauuuugc

SEQ ID NO: 406488 - RNA, 22 nt, Human
gaaagccauagcccagcuuuac

SEQ ID NO: 406489 - RNA, 19 nt, Human
uccuucagucagaucuggg

SEQ ID NO: 406490 - RNA, 22 nt, Human
aacagaauaguugauguacagu

SEQ ID NO: 406491 - RNA, 22 nt, Human
aaauacuguugaaugaaguaag

SEQ ID NO: 406492 - RNA, 22 nt, Human
gaguccuucuggcuggcaggau

SEQ ID NO: 406493 - RNA, 22 nt, Human
uauaauuaguaaauggcagauu

SEQ ID NO: 406494 - RNA, 22 nt, Human
uguguacacagauaguaauggc

SEQ ID NO: 406495 - RNA, 22 nt, Human
uagauuuaagacccugaauuug

SEQ ID NO: 406496 - RNA, 22 nt, Human
uagauauaucugucauacuggu

SEQ ID NO: 406497 - RNA, 22 nt, Human
ccaaaauuauuacauuuguagg

SEQ ID NO: 406498 - RNA, 22 nt, Human
aagucacccacaggcagcagaa

SEQ ID NO: 406499 - RNA, 22 nt, Human
caugguuuauuagagcuuauuu

SEQ ID NO: 406500 - RNA, 22 nt, Human
uaaucauggccucaaauuuuau

SEQ ID NO: 406501 - RNA, 22 nt, Human
aaagaaggaugggagaaauccu

SEQ ID NO: 406502 - RNA, 22 nt, Human
aaauauagcaauuaugccuacu

SEQ ID NO: 406503 - RNA, 20 nt, Human
aaaaacaguaaugcugaaga

SEQ ID NO: 406504 - RNA, 22 nt, Human
aagauauagauggugguauaaa

SEQ ID NO: 406505 - RNA, 22 nt, Human
ggagaaugauauauagcucagu

SEQ ID NO: 406506 - RNA, 22 nt, Human
cauaauuacugauaugcugauu

SEQ ID NO: 406507 - RNA, 22 nt, Human
auagaauagcauagaaaauuga

SEQ ID NO: 406508 - RNA, 22 nt, Human
uuuauccaccuuacccuguucc

SEQ ID NO: 406509 - RNA, 22 nt, Human
auccuuaguuaagaacaggagu

SEQ ID NO: 406510 - RNA, 22 nt, Human
agucauuuugccagucuucagg

SEQ ID NO: 406511 - RNA, 22 nt, Human
acagcauucaauaaauaauaac

SEQ ID NO: 406512 - RNA, 18 nt, Human
aaguccuuccuuugcuuu

SEQ ID NO: 406513 - RNA, 22 nt, Human
uucauuaauucauucagugacu

SEQ ID NO: 406514 - RNA, 22 nt, Human
cugaauaauguucucuuguaug

SEQ ID NO: 406515 - RNA, 23 nt, Human
ccaaagucgaagucuaguccaga

SEQ ID NO: 406516 - RNA, 22 nt, Human
gaauuucagagguaacaucauc

SEQ ID NO: 406517 - RNA, 22 nt, Human
aaugccuucaaguaucugagga

SEQ ID NO: 406518 - RNA, 22 nt, Human
uaauuucaauagcuugcauaau

SEQ ID NO: 406519 - RNA, 22 nt, Human
aaucaagucaaccaucaugugc

SEQ ID NO: 406520 - RNA, 23 nt, Human
gagauuuagcagacaaagcucuu

SEQ ID NO: 406521 - RNA, 22 nt, Human
cagaaacauguauaaaguugua

SEQ ID NO: 406522 - RNA, 22 nt, Human
aacuggauuuaggaacagagaa

SEQ ID NO: 406523 - RNA, 22 nt, Human
auacagaagaacuauagccacu

SEQ ID NO: 406524 - RNA, 22 nt, Human
uguacaauggcuauaauacccu

SEQ ID NO: 406525 - RNA, 22 nt, Human
uauggcuuuucauuccuaugug

SEQ ID NO: 406526 - RNA, 22 nt, Human
acaggauuagcaaguaaucagg

SEQ ID NO: 406527 - RNA, 22 nt, Human
uuugaagauaaauauggagaaa

SEQ ID NO: 406528 - RNA, 22 nt, Human
uuuccaaagcugaguugagcaa

SEQ ID NO: 406529 - RNA, 22 nt, Human
guuccaaaguuagaguguauug

SEQ ID NO: 406530 - RNA, 22 nt, Human
agagaugaacauaaaacaagga

SEQ ID NO: 406531 - RNA, 22 nt, Human
ucuuaauucugugucuucacua

SEQ ID NO: 406532 - RNA, 23 nt, Human
aaaugacauaugguuucugaagg

SEQ ID NO: 406533 - RNA, 22 nt, Human
aacauaauguggccaaagucac

SEQ ID NO: 406534 - RNA, 22 nt, Human
uuggaucauggaaugucugcuu

SEQ ID NO: 406535 - RNA, 22 nt, Human
augcugaauugaugcgagggag

SEQ ID NO: 406536 - RNA, 22 nt, Human
uucagaaagguuaaucuggauu

SEQ ID NO: 406537 - RNA, 22 nt, Human
uugauggcugugauuuacucag

SEQ ID NO: 406538 - RNA, 22 nt, Human
auuaggcauucaugcagcuccu

SEQ ID NO: 406539 - RNA, 22 nt, Human
uacagaaaucacaucgcuuuga

SEQ ID NO: 406540 - RNA, 20 nt, Human
aucaaaggcugauucagucc

SEQ ID NO: 406541 - RNA, 22 nt, Human
cugaauaauacagacuagcuuc

SEQ ID NO: 406542 - RNA, 22 nt, Human
ucucacuuuguugcccagacuu

SEQ ID NO: 406543 - RNA, 22 nt, Human
ugaaacuaggccaaucaaauua

SEQ ID NO: 406544 - RNA, 22 nt, Human
ucaaguuucucucagauuaugg

SEQ ID NO: 406545 - RNA, 19 nt, Human
aacuguaauuaauacccua

SEQ ID NO: 406546 - RNA, 22 nt, Human
uguuuauaccuugguauaacca

SEQ ID NO: 406547 - RNA, 22 nt, Human
uuuaaagaaauuccucaucuuu

SEQ ID NO: 406548 - RNA, 22 nt, Human
ucaguuucuaaaucuuaccaau

SEQ ID NO: 406549 - RNA, 22 nt, Human
uucuuaaucuguguggguucga

SEQ ID NO: 406550 - RNA, 22 nt, Human
auccaaacauguaccacacuaa

SEQ ID NO: 406551 - RNA, 22 nt, Human
augugaaagagguguucagugg

SEQ ID NO: 406552 - RNA, 20 nt, Human
gaguccuuaugggcugaggu

SEQ ID NO: 406553 - RNA, 22 nt, Human
ugcagguaggccugacuuccag

SEQ ID NO: 406554 - RNA, 22 nt, Human
aaguguuaaagacuugaacacu

SEQ ID NO: 406555 - RNA, 22 nt, Human
agauaaugaaugccaugacauu

SEQ ID NO: 406556 - RNA, 22 nt, Human
uaagacuucauuaguaauaugg

SEQ ID NO: 406557 - RNA, 22 nt, Human
uagaaacagauguuuuugaaga

SEQ ID NO: 406558 - RNA, 22 nt, Human
auauuauucuaguaacagugau

SEQ ID NO: 406559 - RNA, 22 nt, Human
augcuaaauggccaguaccaaa

SEQ ID NO: 406560 - RNA, 22 nt, Human
uuccuuaggcuguuugcagugc

SEQ ID NO: 406561 - RNA, 22 nt, Human
cuaugacacaggccauuauaua

SEQ ID NO: 406562 - RNA, 22 nt, Human
aaaacuuucagggauacagaaa

SEQ ID NO: 406563 - RNA, 22 nt, Human
uccaaaguaauuucacuucugu

SEQ ID NO: 406564 - RNA, 22 nt, Human
uauacaaugaguacauucuggg

SEQ ID NO: 406565 - RNA, 22 nt, Human
auagacauagccguaauuuauu

SEQ ID NO: 406566 - RNA, 22 nt, Human
uuuuauauggcacauugguugg

SEQ ID NO: 406567 - RNA, 22 nt, Human
cauuuacauuuaagguuaauau

SEQ ID NO: 406568 - RNA, 22 nt, Human
uuuaggcaaauuucagaugugc

SEQ ID NO: 406569 - RNA, 22 nt, Human
uguucacaaggugaugcuuuga

SEQ ID NO: 406570 - RNA, 22 nt, Human
uauuucaacguaugaaaagcug

SEQ ID NO: 406571 - RNA, 22 nt, Human
aaagucaugcaguugaacuuuu

SEQ ID NO: 406572 - RNA, 20 nt, Human
uuccuuaggcauuggaagaa

SEQ ID NO: 406573 - RNA, 22 nt, Human
auuaggcagugccauuguacgg

SEQ ID NO: 406574 - RNA, 22 nt, Human
uaaauacagucauuugagccau

SEQ ID NO: 406575 - RNA, 22 nt, Human
ucaaguuuaauugagauguuua

SEQ ID NO: 406576 - RNA, 22 nt, Human
uuccuuagugacuucuagcuac

SEQ ID NO: 406577 - RNA, 22 nt, Human
gcuauacacauuucuugguagu

SEQ ID NO: 406578 - RNA, 22 nt, Human
caguaaauacauaucagagaag

SEQ ID NO: 406579 - RNA, 22 nt, Human
uggcuuaauauuucauauuuaa

SEQ ID NO: 406580 - RNA, 22 nt, Human
uguacaaugcugagguuugggg

SEQ ID NO: 406581 - RNA, 23 nt, Human
guaaaauacgcagugcaguguga

SEQ ID NO: 406582 - RNA, 22 nt, Human
acacacucaauugcauaagcac

SEQ ID NO: 406583 - RNA, 22 nt, Human
uaauuucaccguugcuagaaau

SEQ ID NO: 406584 - RNA, 22 nt, Human
uucaacucuucaagaucacauc

SEQ ID NO: 406585 - RNA, 22 nt, Human
aaaauacuguggaguguugaaa

SEQ ID NO: 406586 - RNA, 22 nt, Human
guuuaauaauguugaauuacua

SEQ ID NO: 406587 - RNA, 22 nt, Human
uuguccaaaguaacacaucuag

SEQ ID NO: 406588 - RNA, 22 nt, Human
auuucaggagcaguuucagugg

SEQ ID NO: 406589 - RNA, 22 nt, Human
cuuucaacuacauacaggcgau

SEQ ID NO: 406590 - RNA, 22 nt, Human
uuaagcaacacacauuaauuau

SEQ ID NO: 406591 - RNA, 22 nt, Human
uguauacaggcauaagagauac

SEQ ID NO: 406592 - RNA, 22 nt, Human
uauuaucauuaacuguugaauu

SEQ ID NO: 406593 - RNA, 22 nt, Human
gccuuaauuuaugucuaacaua

SEQ ID NO: 406594 - RNA, 22 nt, Human
cagaauaaaagucccaaggcau

SEQ ID NO: 406595 - RNA, 22 nt, Human
aaauugaaugauuaagugguga

SEQ ID NO: 406596 - RNA, 22 nt, Human
augaaauaucuugaagaaauuc

SEQ ID NO: 406597 - RNA, 22 nt, Human
auggccuuagugaugauuaaua

SEQ ID NO: 406598 - RNA, 22 nt, Human
cauuucaaacaguuacagcugc

SEQ ID NO: 406599 - RNA, 20 nt, Human
ucuaauuaaaauugucuagu

SEQ ID NO: 406600 - RNA, 22 nt, Human
agaaaaacuaagaguggguggu

SEQ ID NO: 406601 - RNA, 22 nt, Human
caguaaaugcagauauagauac

SEQ ID NO: 406602 - RNA, 22 nt, Human
aggaaaaaagucugugauuaua

SEQ ID NO: 406603 - RNA, 22 nt, Human
augugcuucauucuacaugaca

SEQ ID NO: 406604 - RNA, 22 nt, Human
caauuuuuaaacuaugaaguug

SEQ ID NO: 406605 - RNA, 22 nt, Human
acauaauaccuaggacaguuug

SEQ ID NO: 406606 - RNA, 22 nt, Human
uaauuuacuugcaaauaacaau

SEQ ID NO: 406607 - RNA, 22 nt, Human
gauucuuacuucuaagcaagcu

SEQ ID NO: 406608 - RNA, 22 nt, Human
cagauaaaggcuuacuaguagu

SEQ ID NO: 406609 - RNA, 20 nt, Human
uauuuacaacuuagagccuc

SEQ ID NO: 406610 - RNA, 22 nt, Human
aauugcaauuuucuuaaggucu

SEQ ID NO: 406611 - RNA, 22 nt, Human
ucaauucaauugaacaguuacu

SEQ ID NO: 406612 - RNA, 22 nt, Human
acuuugaaucucagauaaccaa

SEQ ID NO: 406613 - RNA, 22 nt, Human
ggcauuuauuugucucauucuu

SEQ ID NO: 406614 - RNA, 23 nt, Human
uuuaacuuuccaauaauucauug

SEQ ID NO: 406615 - RNA, 22 nt, Human
ccuauacagccucagcugagau

SEQ ID NO: 406616 - RNA, 22 nt, Human
cagaaauaaacuucucacaucg

SEQ ID NO: 406617 - RNA, 22 nt, Human
aaauauaguaaaugcauaguuc

SEQ ID NO: 406618 - RNA, 23 nt, Human
uauuacaauuggucuuauuaaga

SEQ ID NO: 406619 - RNA, 22 nt, Human
acagaaguuggaauuagauacu

SEQ ID NO: 406620 - RNA, 22 nt, Human
gcuggaucauauggugguucua

SEQ ID NO: 406621 - RNA, 22 nt, Human
caguccuuucugaaauccuaua

SEQ ID NO: 406622 - RNA, 23 nt, Human
cagaaauaaacugguuuguagau

SEQ ID NO: 406623 - RNA, 22 nt, Human
auguguaugcaugcacuaagau

SEQ ID NO: 406624 - RNA, 22 nt, Human
aauuucaauuacuuuugcacca

SEQ ID NO: 406625 - RNA, 22 nt, Human
ucaguaaaugagcaaaaauuuc

SEQ ID NO: 406626 - RNA, 22 nt, Human
uaaacagaaugcguaagaagug

SEQ ID NO: 406627 - RNA, 22 nt, Human
uuaaagaauagugccccuauug

SEQ ID NO: 406628 - RNA, 22 nt, Human
gauuucaagcccccagagauuc

SEQ ID NO: 406629 - RNA, 22 nt, Human
uagaaacaucagcuaaccaaaa

SEQ ID NO: 406630 - RNA, 21 nt, Human
gagauuuagaaggaucaauuu

SEQ ID NO: 406631 - RNA, 22 nt, Human
uauccaaaggaacaaucacagc

SEQ ID NO: 406632 - RNA, 22 nt, Human
uucuuagaugauuaaugauggg

SEQ ID NO: 406633 - RNA, 22 nt, Human
auuauauaggacuugcccuucc

SEQ ID NO: 406634 - RNA, 22 nt, Human
aaauggauggaaagcaauuuuu

SEQ ID NO: 406635 - RNA, 22 nt, Human
acaaaauuaccuaguuauuuuc

SEQ ID NO: 406636 - RNA, 22 nt, Human
ucaaaaguggccuguaaaaucu

SEQ ID NO: 406637 - RNA, 22 nt, Human
cagauuucagcucauauauuau

SEQ ID NO: 406638 - RNA, 22 nt, Human
uuuaggcacagaguugagggac

SEQ ID NO: 406639 - RNA, 23 nt, Human
aaucuauacuuaggcugguaaua

SEQ ID NO: 406640 - RNA, 23 nt, Human
uuaaacuucagugcagaacacuc

SEQ ID NO: 406641 - RNA, 18 nt, Human
ugaaacaagaauggugca

SEQ ID NO: 406642 - RNA, 22 nt, Human
cagucaccauagaauaaaacau

SEQ ID NO: 406643 - RNA, 22 nt, Human
ugcuauacggagcaucuucagg

SEQ ID NO: 406644 - RNA, 22 nt, Human
uaugaagaaaccuauccucuag

SEQ ID NO: 406645 - RNA, 22 nt, Human
ugcuuaauaggaguugaacauu

SEQ ID NO: 406646 - RNA, 22 nt, Human
uaacaagucauuuuaaauuaug

SEQ ID NO: 406647 - RNA, 22 nt, Human
aaaucucaguguucuaagcauu

SEQ ID NO: 406648 - RNA, 16 nt, Human
ccuggauccccugugg

SEQ ID NO: 406649 - RNA, 22 nt, Human
uucaacuuuaugcauauguauu

SEQ ID NO: 406650 - RNA, 22 nt, Human
gcucuaauugaaaaauacugca

SEQ ID NO: 406651 - RNA, 22 nt, Human
uuguuaaaaauagauuuccagg

SEQ ID NO: 406652 - RNA, 22 nt, Human
caagaauccuguucuugaagau

SEQ ID NO: 406653 - RNA, 19 nt, Human
aggauuuauuaugugcuca

SEQ ID NO: 406654 - RNA, 22 nt, Human
aucagaaaaacauaauguuauu

SEQ ID NO: 406655 - RNA, 22 nt, Human
uucauacuguguuuccaaguuu

SEQ ID NO: 406656 - RNA, 22 nt, Human
cuacagaaguuucccuugcuua

SEQ ID NO: 406657 - RNA, 22 nt, Human
ugcagucuccaccuccugggug

SEQ ID NO: 406658 - RNA, 22 nt, Human
aaaaauugcugagaacggaauu

SEQ ID NO: 406659 - RNA, 22 nt, Human
cugcagagaccuaggucagguu

SEQ ID NO: 406660 - RNA, 19 nt, Human
acaagucacuuacuuagua

SEQ ID NO: 406661 - RNA, 23 nt, Human
uguaacaauucccagccuuugcc

SEQ ID NO: 406662 - RNA, 22 nt, Human
ugcaggaaaaccaacacgccuu

SEQ ID NO: 406663 - RNA, 22 nt, Human
uaaaacugaauacauacugagg

SEQ ID NO: 406664 - RNA, 22 nt, Human
cuauuauuuccucaucuauaaa

SEQ ID NO: 406665 - RNA, 22 nt, Human
auuaggcauuauggggauaagg

SEQ ID NO: 406666 - RNA, 22 nt, Human
cuuugaagauggcaaauuuaga

SEQ ID NO: 406667 - RNA, 22 nt, Human
aauacugagaucccacaaagca

SEQ ID NO: 406668 - RNA, 22 nt, Human
acagaaugggauuugaauauuu

SEQ ID NO: 406669 - RNA, 22 nt, Human
uuuaauauuucuuuccugaagc

SEQ ID NO: 406670 - RNA, 22 nt, Human
uaucaaaggcuaugugauuuuu

SEQ ID NO: 406671 - RNA, 22 nt, Human
ucaaaauuucagcacuagcccu

SEQ ID NO: 406672 - RNA, 22 nt, Human
acacaaacugcuagaaaauugg

SEQ ID NO: 406673 - RNA, 22 nt, Human
uaccaaaagcuuguuucauaca

SEQ ID NO: 406674 - RNA, 22 nt, Human
cucauacauaugccauuccugc

SEQ ID NO: 406675 - RNA, 22 nt, Human
caucauaaaauugagauaacug

SEQ ID NO: 406676 - RNA, 22 nt, Human
aaacagacugcacugccaguca

SEQ ID NO: 406677 - RNA, 22 nt, Human
aaaucagugcucauuugaaagg

SEQ ID NO: 406678 - RNA, 22 nt, Human
ucagccaguuugauucuauuug

SEQ ID NO: 406679 - RNA, 22 nt, Human
gacauaauccuccucaccuacu

SEQ ID NO: 406680 - RNA, 22 nt, Human
uuccauaauaaccugagagaaa

SEQ ID NO: 406681 - RNA, 22 nt, Human
acuuugaaggggaacauuuuaa

SEQ ID NO: 406682 - RNA, 22 nt, Human
aauguucauugauuaaaugaau

SEQ ID NO: 406683 - RNA, 22 nt, Human
agaucugaaucucauccgagga

SEQ ID NO: 406684 - RNA, 22 nt, Human
aaauagcauaaaauaggaagcu

SEQ ID NO: 406685 - RNA, 22 nt, Human
gguacaauccacuguggguuag

SEQ ID NO: 406686 - RNA, 19 nt, Human
aacuggauaauggccacau

SEQ ID NO: 406687 - RNA, 22 nt, Human
caguccuuauuccuauauuccu

SEQ ID NO: 406688 - RNA, 22 nt, Human
ggcauuuaauccaucugauuga

SEQ ID NO: 406689 - RNA, 22 nt, Human
uuacaagauuaauuauuggagu

SEQ ID NO: 406690 - RNA, 22 nt, Human
acuuugaaacuaaaauucauua

SEQ ID NO: 406691 - RNA, 22 nt, Human
ucuagacacuacuaguaaccgg

SEQ ID NO: 406692 - RNA, 22 nt, Human
cauuucaauuauuugcucuucu

SEQ ID NO: 406693 - RNA, 22 nt, Human
ccuauacaggcuucuuuacaug

SEQ ID NO: 406694 - RNA, 22 nt, Human
cauggcuuguaauaaauuuaua

SEQ ID NO: 406695 - RNA, 16 nt, Human
gcaacuuugggguuga

SEQ ID NO: 406696 - RNA, 22 nt, Human
uaagaaucaguagauauagauu

SEQ ID NO: 406697 - RNA, 22 nt, Human
aacuuuguguguuuaauauggc

SEQ ID NO: 406698 - RNA, 22 nt, Human
uuagaaaaaacgucuucuagug

SEQ ID NO: 406699 - RNA, 22 nt, Human
acagaugauuuuuaugaaaaca

SEQ ID NO: 406700 - RNA, 22 nt, Human
cauagaaaguauuauggaauuu

SEQ ID NO: 406701 - RNA, 21 nt, Human
auuuccaaauaaggucacauu

SEQ ID NO: 406702 - RNA, 21 nt, Human
ucagagaacccggcaggcaag

SEQ ID NO: 406703 - RNA, 22 nt, Human
acuuugaaagccuuggccccgg

SEQ ID NO: 406704 - RNA, 22 nt, Human
gaagugaagguuacucuagauu

SEQ ID NO: 406705 - RNA, 23 nt, Human
ucuaauacaugaaaccuagaugu

SEQ ID NO: 406706 - RNA, 20 nt, Human
aggauuuacuacuaccugcu

SEQ ID NO: 406707 - RNA, 23 nt, Human
augaaugaauaaggcaggaaagc

SEQ ID NO: 406708 - RNA, 17 nt, Human
ugcuuaauuuugacugg

SEQ ID NO: 406709 - RNA, 22 nt, Human
augcuuaaccuugguguacaau

SEQ ID NO: 406710 - RNA, 22 nt, Human
caaauacuggguaaguuaauuu

SEQ ID NO: 406711 - RNA, 22 nt, Human
aggauuuauuggugggaaguua

SEQ ID NO: 406712 - RNA, 21 nt, Human
uguguaaaguugaaauccugu

SEQ ID NO: 406713 - RNA, 22 nt, Human
aauugagugcagccagcccagu

SEQ ID NO: 406714 - RNA, 22 nt, Human
ucuuuaauucagcaugaugcgg

SEQ ID NO: 406715 - RNA, 17 nt, Human
uaaguccuaguuauuuu

SEQ ID NO: 406716 - RNA, 22 nt, Human
agauuucagaugcucggcaguu

SEQ ID NO: 406717 - RNA, 22 nt, Human
augguuuaagggagaauauuga

SEQ ID NO: 406718 - RNA, 22 nt, Human
aucuaacacuguaaacugucuu

SEQ ID NO: 406719 - RNA, 22 nt, Human
aauaacagagaaggguggcuuc

SEQ ID NO: 406720 - RNA, 22 nt, Human
ucagaauucugaccuuggguca

SEQ ID NO: 406721 - RNA, 22 nt, Human
ugagacaaccuaauuaaacacc

SEQ ID NO: 406722 - RNA, 22 nt, Human
uucacauaaugauacaaagcuu

SEQ ID NO: 406723 - RNA, 22 nt, Human
uaaagacaaacccacuaggguu

SEQ ID NO: 406724 - RNA, 22 nt, Human
uaaguccuagaugauucacaga

SEQ ID NO: 406725 - RNA, 22 nt, Human
gcuuuaaugcaauuucaccuca

SEQ ID NO: 406726 - RNA, 22 nt, Human
agagacaaugccaaugcacacg

SEQ ID NO: 406727 - RNA, 22 nt, Human
uacauagaacauguuuaauguc

SEQ ID NO: 406728 - RNA, 22 nt, Human
acaugcuuccaaauuauguugg

SEQ ID NO: 406729 - RNA, 22 nt, Human
caaacauucaaguacaagucuu

SEQ ID NO: 406730 - RNA, 22 nt, Human
ugacuucaagguucagcaccuu

SEQ ID NO: 406731 - RNA, 22 nt, Human
uucaaguuuugccuccccaucc

SEQ ID NO: 406732 - RNA, 22 nt, Human
aguaaacaguaucuuuaguguc

SEQ ID NO: 406733 - RNA, 22 nt, Human
gaaauauacaugaagucggcug

SEQ ID NO: 406734 - RNA, 22 nt, Human
agaauuccuccucugggacacu

SEQ ID NO: 406735 - RNA, 22 nt, Human
uaaguccuauuccaggucucuc

SEQ ID NO: 406736 - RNA, 22 nt, Human
augugcuuguaauguuaaaugu

SEQ ID NO: 406737 - RNA, 22 nt, Human
auuuaucucuggaaacuaagca

SEQ ID NO: 406738 - RNA, 22 nt, Human
aucuagaacuuaaagucaguca

SEQ ID NO: 406739 - RNA, 20 nt, Human
uuuaggcauuacucuuuugu

SEQ ID NO: 406740 - RNA, 22 nt, Human
acuauacaagauuagggauuug

SEQ ID NO: 406741 - RNA, 22 nt, Human
uggaauaaagugcuuugaucag

SEQ ID NO: 406742 - RNA, 22 nt, Human
cucuaacaccacagugugguuu

SEQ ID NO: 406743 - RNA, 22 nt, Human
uuaaugauaccuauguuaauuu

SEQ ID NO: 406744 - RNA, 22 nt, Human
aaugucuugagaagagaaaucu

SEQ ID NO: 406745 - RNA, 22 nt, Human
aaagucaucauuucuuuucaaa

SEQ ID NO: 406746 - RNA, 22 nt, Human
ucacagaaauaagauaguuauu

SEQ ID NO: 406747 - RNA, 22 nt, Human
uagaacuacaagcauuaaaagu

SEQ ID NO: 406748 - RNA, 20 nt, Human
guaaaauauggucuuugggu

SEQ ID NO: 406749 - RNA, 22 nt, Human
uaauacuuuugccuuguauuca

SEQ ID NO: 406750 - RNA, 22 nt, Human
cauggcuuuguucauauaauuu

SEQ ID NO: 406751 - RNA, 23 nt, Human
uaucagugugaugaggcugcugc

SEQ ID NO: 406752 - RNA, 22 nt, Human
guuaggcaauaccucuuacacc

SEQ ID NO: 406753 - RNA, 22 nt, Human
gaugaaaaucuugagaugucga

SEQ ID NO: 406754 - RNA, 22 nt, Human
aagugauuuguacaaaaugucg

SEQ ID NO: 406755 - RNA, 22 nt, Human
ucagaauaugcuaaugacauuu

SEQ ID NO: 406756 - RNA, 22 nt, Human
acaagccaauuacugugccagg

SEQ ID NO: 406757 - RNA, 22 nt, Human
acaugaaacuguugcauuagaa

SEQ ID NO: 406758 - RNA, 22 nt, Human
uaguccuugguaaaauucuaug

SEQ ID NO: 406759 - RNA, 22 nt, Human
auacaaugauaauaguacuuua

SEQ ID NO: 406760 - RNA, 22 nt, Human
agaaaugcucaggucaacuuaa

SEQ ID NO: 406761 - RNA, 22 nt, Human
ccuucaaucuuaagucagccca

SEQ ID NO: 406762 - RNA, 22 nt, Human
caugguuuugagccuauuaugc

SEQ ID NO: 406763 - RNA, 22 nt, Human
aucagaaaauacccaguguuua

SEQ ID NO: 406764 - RNA, 22 nt, Human
acaugcuuugcacuuacaucau

SEQ ID NO: 406765 - RNA, 22 nt, Human
aacuuugaggucacugaauucc

SEQ ID NO: 406766 - RNA, 22 nt, Human
uucaauucaauucuaaauauau

SEQ ID NO: 406767 - RNA, 22 nt, Human
uaauaaacugcuacgcuuaguu

SEQ ID NO: 406768 - RNA, 22 nt, Human
uuaaagucccugccuuaauucc

SEQ ID NO: 406769 - RNA, 22 nt, Human
gcauguuauguaucugcccagc

SEQ ID NO: 406770 - RNA, 21 nt, Human
aaauacagaugcaaaucuguu

SEQ ID NO: 406771 - RNA, 22 nt, Human
aaacuuuguucgucugaugugg

SEQ ID NO: 406772 - RNA, 22 nt, Human
caguccuugcuaugacccugag

SEQ ID NO: 406773 - RNA, 22 nt, Human
cuuuacagaauaagaauacugg

SEQ ID NO: 406774 - RNA, 22 nt, Human
aaagucauuuguauauacccuu

SEQ ID NO: 406775 - RNA, 22 nt, Human
gaauuucaaaagccagaacggg

SEQ ID NO: 406776 - RNA, 22 nt, Human
gaacuuuaaaacaaaguacagu

SEQ ID NO: 406777 - RNA, 22 nt, Human
uaagucauaagucaugauguua

SEQ ID NO: 406778 - RNA, 22 nt, Human
ugaaugaaugaauuaauagagu

SEQ ID NO: 406779 - RNA, 22 nt, Human
agaucacagcccccagaugcca

SEQ ID NO: 406780 - RNA, 22 nt, Human
ugaagaauaaaugguugagacu

SEQ ID NO: 406781 - RNA, 22 nt, Human
aaaggcauuuuaauucuaaaga

SEQ ID NO: 406782 - RNA, 22 nt, Human
caauuucacuaaugaugugggg

SEQ ID NO: 406783 - RNA, 22 nt, Human
gccagucugcucccacaaguuc

SEQ ID NO: 406784 - RNA, 22 nt, Human
uagcauaacagguaagagugag

SEQ ID NO: 406785 - RNA, 22 nt, Human
auggguuucccucugaaauuau

SEQ ID NO: 406786 - RNA, 22 nt, Human
ccauuucacucuuccugaagga

SEQ ID NO: 406787 - RNA, 23 nt, Human
ggccauuucauuugguucaaacu

SEQ ID NO: 406788 - RNA, 22 nt, Human
uacaggaaguaaguaaugaaau

SEQ ID NO: 406789 - RNA, 22 nt, Human
uagaaacagaaaacuguaauag

SEQ ID NO: 406790 - RNA, 22 nt, Human
caauuuuuuccaugcucuuaca

SEQ ID NO: 406791 - RNA, 22 nt, Human
uauccaaaguuucucagaaacu

SEQ ID NO: 406792 - RNA, 22 nt, Human
auuaugcugguuuacacauuuu

SEQ ID NO: 406793 - RNA, 21 nt, Human
uccagaaaagaggucauuagc

SEQ ID NO: 406794 - RNA, 22 nt, Human
aguuucaguucugucauuuaua

SEQ ID NO: 406795 - RNA, 22 nt, Human
aagaaacaaccacugcucuccu

SEQ ID NO: 406796 - RNA, 22 nt, Human
ucacagcaaaugcugcuucuca

SEQ ID NO: 406797 - RNA, 18 nt, Human
uaaauauauuucccccuu

SEQ ID NO: 406798 - RNA, 22 nt, Human
cagucaccugaagacuugacca

SEQ ID NO: 406799 - RNA, 22 nt, Human
augugcuuuauuaaguaaaaau

SEQ ID NO: 406800 - RNA, 22 nt, Human
auucacuggcagacagaacuca

SEQ ID NO: 406801 - RNA, 22 nt, Human
caaaacugucuagagagagaag

SEQ ID NO: 406802 - RNA, 22 nt, Human
ugcuuauuuauagucaauagag

SEQ ID NO: 406803 - RNA, 22 nt, Human
uguccuuauauuguggaagggg

SEQ ID NO: 406804 - RNA, 22 nt, Human
caugcuuaugauuugcuaagcc

SEQ ID NO: 406805 - RNA, 22 nt, Human
auagacauuuugcauucaagca

SEQ ID NO: 406806 - RNA, 22 nt, Human
ugcuuuaaaauggacuguuuug

SEQ ID NO: 406807 - RNA, 22 nt, Human
acaugaaaaauguuugcaguuu

SEQ ID NO: 406808 - RNA, 22 nt, Human
uuauaugaguaucauaucacuu

SEQ ID NO: 406809 - RNA, 22 nt, Human
cuggauuuuagaaggcuuccua

SEQ ID NO: 406810 - RNA, 22 nt, Human
guauacagauacuuagacgugc

SEQ ID NO: 406811 - RNA, 22 nt, Human
gguuuaauggagauauuucaga

SEQ ID NO: 406812 - RNA, 22 nt, Human
aaagccaucaguaaaaugauuu

SEQ ID NO: 406813 - RNA, 22 nt, Human
uugaauaauguguauguuguua

SEQ ID NO: 406814 - RNA, 22 nt, Human
aguaaacauuuucauauuuucu

SEQ ID NO: 406815 - RNA, 22 nt, Human
uggcuuaagcgcaacucugucu

SEQ ID NO: 406816 - RNA, 18 nt, Human
uacaggaaaaguguuaca

SEQ ID NO: 406817 - RNA, 22 nt, Human
augcuuaaugaggguauauaug

SEQ ID NO: 406818 - RNA, 22 nt, Human
uguguaaauuuauuuacauaaa

SEQ ID NO: 406819 - RNA, 22 nt, Human
uacagauauagagauuuauaga

SEQ ID NO: 406820 - RNA, 23 nt, Human
agaauuccaguuucuuaugucac

SEQ ID NO: 406821 - RNA, 22 nt, Human
ugcuuuaagacacuaaguuuga

SEQ ID NO: 406822 - RNA, 22 nt, Human
cauaagaaauuuaacagaacuu

SEQ ID NO: 406823 - RNA, 22 nt, Human
aaagacuuggcuuaugauuugc

SEQ ID NO: 406824 - RNA, 22 nt, Human
uaugucaugucuuagagaauga

SEQ ID NO: 406825 - RNA, 22 nt, Human
uacugugcaaaaaugaauauug

SEQ ID NO: 406826 - RNA, 22 nt, Human
acagugcacauccugagugauu

SEQ ID NO: 406827 - RNA, 22 nt, Human
agcugugccuugcugcacggug

SEQ ID NO: 406828 - RNA, 22 nt, Human
aaacaugagcaucucuucaagc

SEQ ID NO: 406829 - RNA, 22 nt, Human
ugcugugcaucauaguguuugg

SEQ ID NO: 406830 - RNA, 22 nt, Human
uguacaugaauaaaagaucuug

SEQ ID NO: 406831 - RNA, 22 nt, Human
auacauucaaaggaaggauaga

SEQ ID NO: 406832 - RNA, 22 nt, Human
acaccauacucauguugguucc

SEQ ID NO: 406833 - RNA, 22 nt, Human
uucuguuuuagaaauaaguagu

SEQ ID NO: 406834 - RNA, 22 nt, Human
ucauaaaacacaccagguaguu

SEQ ID NO: 406835 - RNA, 22 nt, Human
agaugcugauugaauagauuuc

SEQ ID NO: 406836 - RNA, 22 nt, Human
gcugugcagaggugagaaucca

SEQ ID NO: 406837 - RNA, 22 nt, Human
auucaaacuguguuaggcagca

SEQ ID NO: 406838 - RNA, 22 nt, Human
aacuauuuuuggagcuaacucu

SEQ ID NO: 406839 - RNA, 22 nt, Human
ugcaugaaauauuuucuguagg

SEQ ID NO: 406840 - RNA, 22 nt, Human
uacaggaagucucaguacagua

SEQ ID NO: 406841 - RNA, 22 nt, Human
auuacaugagagaauguaaaua

SEQ ID NO: 406842 - RNA, 22 nt, Human
ucaaauggguaugcuuuauaau

SEQ ID NO: 406843 - RNA, 22 nt, Human
uugagcaauuaggaaauaaaga

SEQ ID NO: 406844 - RNA, 21 nt, Human
uuagaguugccauuauaugua

SEQ ID NO: 406845 - RNA, 22 nt, Human
cagcacauaaucagugauugug

SEQ ID NO: 406846 - RNA, 22 nt, Human
auguacaucuuuauaacaagcu

SEQ ID NO: 406847 - RNA, 22 nt, Human
gcauaucagcaucaaaacacag

SEQ ID NO: 406848 - RNA, 22 nt, Human
ugagcugagaacacuugggcua

SEQ ID NO: 406849 - RNA, 22 nt, Human
aguuagagacacaugcacaugc

SEQ ID NO: 406850 - RNA, 20 nt, Human
acauuugaguaucaucuacu

SEQ ID NO: 406851 - RNA, 22 nt, Human
aaacaguuucuaaucauggaga

SEQ ID NO: 406852 - RNA, 22 nt, Human
gucaaacaaauuaacauaucca

SEQ ID NO: 406853 - RNA, 22 nt, Human
acugugcagguagaugccuggg

SEQ ID NO: 406854 - RNA, 22 nt, Human
uuguauuuccuauaaccuuucu

SEQ ID NO: 406855 - RNA, 21 nt, Human
gaacauuuggguuguuucuac

SEQ ID NO: 406856 - RNA, 22 nt, Human
cauaacauccuugcuacuuuga

SEQ ID NO: 406857 - RNA, 22 nt, Human
uuucugcagguauugcauaagu

SEQ ID NO: 406858 - RNA, 22 nt, Human
acauuugagaugccuuuuaggu

SEQ ID NO: 406859 - RNA, 22 nt, Human
acccuguugguggaucagauug

SEQ ID NO: 406860 - RNA, 22 nt, Human
uaggaaaauaucucuuauuggg

SEQ ID NO: 406861 - RNA, 22 nt, Human
aauaugcacucugauuuagcag

SEQ ID NO: 406862 - RNA, 22 nt, Human
uuugauaucuugguauacagau

SEQ ID NO: 406863 - RNA, 18 nt, Human
ucauuuguuuugcaugaa

SEQ ID NO: 406864 - RNA, 22 nt, Human
aaauggaaaaugcuguuuuggu

SEQ ID NO: 406865 - RNA, 22 nt, Human
uacagugacccuauuuccaaau

SEQ ID NO: 406866 - RNA, 22 nt, Human
aaaagaggagugguuuaugaca

SEQ ID NO: 406867 - RNA, 20 nt, Human
augcaaaucccaaaaucagg

SEQ ID NO: 406868 - RNA, 22 nt, Human
uagacauuuuaagacauauacc

SEQ ID NO: 406869 - RNA, 22 nt, Human
aacagcugucugccuaucucug

SEQ ID NO: 406870 - RNA, 22 nt, Human
uuuauaguagcaugauuuauaa

SEQ ID NO: 406871 - RNA, 22 nt, Human
aguacaugugguccuggccaga

SEQ ID NO: 406872 - RNA, 22 nt, Human
uucaucugcugguuuuuggcau

SEQ ID NO: 406873 - RNA, 22 nt, Human
uaaugguuuuuuggagacugcu

SEQ ID NO: 406874 - RNA, 22 nt, Human
uaucuguuuauuguuacuguca

SEQ ID NO: 406875 - RNA, 22 nt, Human
aagguauuuucuaauguauacu

SEQ ID NO: 406876 - RNA, 22 nt, Human
agagaugcuguggguagaggca

SEQ ID NO: 406877 - RNA, 22 nt, Human
cagugaaguucuacugaauggu

SEQ ID NO: 406878 - RNA, 22 nt, Human
ugauuacaauugucuuagauuu

SEQ ID NO: 406879 - RNA, 22 nt, Human
uuauagcagcaugauuuacaau

SEQ ID NO: 406880 - RNA, 22 nt, Human
ugcacaguuggcuacaucgugg

SEQ ID NO: 406881 - RNA, 22 nt, Human
uacaggaaguuacagacuauga

SEQ ID NO: 406882 - RNA, 22 nt, Human
uugaaacaguagcucauagacc

SEQ ID NO: 406883 - RNA, 22 nt, Human
auguacaaccugcaugacaguc

SEQ ID NO: 406884 - RNA, 18 nt, Human
cuucagugacagucuggc

SEQ ID NO: 406885 - RNA, 22 nt, Human
uaacucacuccaaaaaggcauu

SEQ ID NO: 406886 - RNA, 22 nt, Human
uuuuagugccugauuaaugggu

SEQ ID NO: 406887 - RNA, 22 nt, Human
aaaggauuaaauaaaugugcug

SEQ ID NO: 406888 - RNA, 22 nt, Human
gcugugcauggagggccguuca

SEQ ID NO: 406889 - RNA, 22 nt, Human
cauuuucagcacccaucugaaa

SEQ ID NO: 406890 - RNA, 17 nt, Human
agcugcagaugaaguug

SEQ ID NO: 406891 - RNA, 22 nt, Human
augauauacuuccuagaacagu

SEQ ID NO: 406892 - RNA, 22 nt, Human
aaacagugauguugaguguaaa

SEQ ID NO: 406893 - RNA, 22 nt, Human
acagugaaugagaauggagaaa

SEQ ID NO: 406894 - RNA, 22 nt, Human
uacaacaguucaugaaaugaaa

SEQ ID NO: 406895 - RNA, 22 nt, Human
cauuuguaauacugacuugcag

SEQ ID NO: 406896 - RNA, 22 nt, Human
uuaaauuccagccucauaauag

SEQ ID NO: 406897 - RNA, 22 nt, Human
uuauagugcauaauuaacaugg

SEQ ID NO: 406898 - RNA, 22 nt, Human
acacagugugugcagucggacg

SEQ ID NO: 406899 - RNA, 20 nt, Human
agguuuauauuuagaggugu

SEQ ID NO: 406900 - RNA, 22 nt, Human
auuugcaaugauuucagugcuu

SEQ ID NO: 406901 - RNA, 22 nt, Human
uuauuugcccauguuuagcaga

SEQ ID NO: 406902 - RNA, 22 nt, Human
aauaaaauggucaguuuucuca

SEQ ID NO: 406903 - RNA, 22 nt, Human
ucugugcaaguauuugacauuu

SEQ ID NO: 406904 - RNA, 22 nt, Human
acugugcaagucaaagaugggc

SEQ ID NO: 406905 - RNA, 22 nt, Human
auucugauaucuuauucuagcu

SEQ ID NO: 406906 - RNA, 22 nt, Human
aaaaaugucauuauggaacuga

SEQ ID NO: 406907 - RNA, 22 nt, Human
cauucugagcuaauaugcuuau

SEQ ID NO: 406908 - RNA, 22 nt, Human
cagguauucauagaauucagag

SEQ ID NO: 406909 - RNA, 22 nt, Human
acaauguaggaguaugacagua

SEQ ID NO: 406910 - RNA, 22 nt, Human
cacaggaauuagcagccuaaaa

SEQ ID NO: 406911 - RNA, 22 nt, Human
uaagacauagccaagagcaucc

SEQ ID NO: 406912 - RNA, 22 nt, Human
uuaugcaacaggugagcagaca

SEQ ID NO: 406913 - RNA, 19 nt, Human
agcuaacucacuaacuaug

SEQ ID NO: 406914 - RNA, 22 nt, Human
agaugcuggauggaaaaugauc

SEQ ID NO: 406915 - RNA, 22 nt, Human
acagcugcugcuucucacuggg

SEQ ID NO: 406916 - RNA, 22 nt, Human
agaguuauggacuuaaugcagg

SEQ ID NO: 406917 - RNA, 22 nt, Human
uaagacauuugaaaugugaucc

SEQ ID NO: 406918 - RNA, 22 nt, Human
uuacaagauaaccugaugcugu

SEQ ID NO: 406919 - RNA, 21 nt, Human
uacagugagguguuaggaugu

SEQ ID NO: 406920 - RNA, 22 nt, Human
uuacaugaauacauaaccauuc

SEQ ID NO: 406921 - RNA, 22 nt, Human
agcucaguggcucaguggguau

SEQ ID NO: 406922 - RNA, 22 nt, Human
ugagaugcugcuguaacaaaua

SEQ ID NO: 406923 - RNA, 22 nt, Human
aagacuugaccagguugaaggc

SEQ ID NO: 406924 - RNA, 19 nt, Human
agagaugcuaagagucuuu

SEQ ID NO: 406925 - RNA, 22 nt, Human
acauucuuugaguuuuguuaaa

SEQ ID NO: 406926 - RNA, 20 nt, Human
uggcugugggcaucuguuuc

SEQ ID NO: 406927 - RNA, 22 nt, Human
auaacuucaucaaauaggcaca

SEQ ID NO: 406928 - RNA, 22 nt, Human
agagaugcaggguacauggaau

SEQ ID NO: 406929 - RNA, 22 nt, Human
uacaggagagauuuaguaauca

SEQ ID NO: 406930 - RNA, 22 nt, Human
auaacagugaccucucagcacc

SEQ ID NO: 406931 - RNA, 22 nt, Human
agggaaaucuuucaacacuuca

SEQ ID NO: 406932 - RNA, 22 nt, Human
augcauaaagaaagcuaucugg

SEQ ID NO: 406933 - RNA, 22 nt, Human
agagaugccaccuuuuugcugu

SEQ ID NO: 406934 - RNA, 17 nt, Human
gagugcagacacaagca

SEQ ID NO: 406935 - RNA, 22 nt, Human
uuagagcuucccaauuaaaacg

SEQ ID NO: 406936 - RNA, 19 nt, Human
ccugugcacauguguccuu

SEQ ID NO: 406937 - RNA, 22 nt, Human
uagcuuccagaauuuaauguca

SEQ ID NO: 406938 - RNA, 22 nt, Human
uugcacaugauagaugauuucu

SEQ ID NO: 406939 - RNA, 22 nt, Human
acacacuuuaaauuaaaccucu

SEQ ID NO: 406940 - RNA, 22 nt, Human
augagcaaggcuuugugauagu

SEQ ID NO: 406941 - RNA, 22 nt, Human
uuauagcagcaugauuuauaau

SEQ ID NO: 406942 - RNA, 22 nt, Human
agacagugagaaugaguugaaa

SEQ ID NO: 406943 - RNA, 22 nt, Human
acagugaugagggaauuuugug

SEQ ID NO: 406944 - RNA, 22 nt, Human
uacaguacacagguaccaagcu

SEQ ID NO: 406945 - RNA, 18 nt, Human
ggcugugcguggaggcug

SEQ ID NO: 406946 - RNA, 22 nt, Human
uucuguuugccauauauaguag

SEQ ID NO: 406947 - RNA, 22 nt, Human
uuagagcugauaguacacuggu

SEQ ID NO: 406948 - RNA, 22 nt, Human
ggagaugccagaauugcaaauu

SEQ ID NO: 406949 - RNA, 22 nt, Human
caugauuauauuaauggcuuca

SEQ ID NO: 406950 - RNA, 22 nt, Human
ucauuacacaguucaguggaaa

SEQ ID NO: 406951 - RNA, 22 nt, Human
guaagcacaugugugugcaugg

SEQ ID NO: 406952 - RNA, 22 nt, Human
gaugcaaagauaaaacagacgc

SEQ ID NO: 406953 - RNA, 22 nt, Human
auuugucauauauaauacucuu

SEQ ID NO: 406954 - RNA, 22 nt, Human
agaugcugugaggaagcuagga

SEQ ID NO: 406955 - RNA, 23 nt, Human
aguacauucgaaaaauucuguga

SEQ ID NO: 406956 - RNA, 22 nt, Human
agcuaacaugacuagaagcuuc

SEQ ID NO: 406957 - RNA, 22 nt, Human
aaauuaguacauugcaaagucc

SEQ ID NO: 406958 - RNA, 22 nt, Human
uacagugcuugguaucuaguaa

SEQ ID NO: 406959 - RNA, 22 nt, Human
uauaugcagugugucauucaag

SEQ ID NO: 406960 - RNA, 22 nt, Human
agucacuaggcugaaaguggag

SEQ ID NO: 406961 - RNA, 22 nt, Human
gugcugaggauacagcugugaa

SEQ ID NO: 406962 - RNA, 22 nt, Human
uuuauaugaaagugaccagugg

SEQ ID NO: 406963 - RNA, 22 nt, Human
ugugagcagagccugacaugag

SEQ ID NO: 406964 - RNA, 22 nt, Human
uacaguuccaggaucauagggu

SEQ ID NO: 406965 - RNA, 22 nt, Human
auuuaaauuuucugauggagag

SEQ ID NO: 406966 - RNA, 22 nt, Human
acugugcacccuggacaguguc

SEQ ID NO: 406967 - RNA, 22 nt, Human
auuaugcauuccaaccuuauuc

SEQ ID NO: 406968 - RNA, 22 nt, Human
aaauuauuaugccccucuauaa

SEQ ID NO: 406969 - RNA, 23 nt, Human
aagguauuuauuuuaaagguaag

SEQ ID NO: 406970 - RNA, 22 nt, Human
auggagauuuuuagaauuacag

SEQ ID NO: 406971 - RNA, 22 nt, Human
agcuaagcucucagauacuaag

SEQ ID NO: 406972 - RNA, 22 nt, Human
uaugcacacauguaugcaugug

SEQ ID NO: 406973 - RNA, 22 nt, Human
aaugcacagcuaaagugguucc

SEQ ID NO: 406974 - RNA, 22 nt, Human
ucuaaaugucaguacagaauga

SEQ ID NO: 406975 - RNA, 22 nt, Human
cauuguuaccaucuuuuaccua

SEQ ID NO: 406976 - RNA, 22 nt, Human
ggaaucuuuuucauaagccuca

SEQ ID NO: 406977 - RNA, 22 nt, Human
acugugcauuccccaaccugug

SEQ ID NO: 406978 - RNA, 22 nt, Human
gagaugcugucaggcuaucugu

SEQ ID NO: 406979 - RNA, 22 nt, Human
cuggcuuucugcacagaauugg

SEQ ID NO: 406980 - RNA, 22 nt, Human
ugcugagacaacaggaaacaag

SEQ ID NO: 406981 - RNA, 22 nt, Human
uugcagcugcaguaaauguuca

SEQ ID NO: 406982 - RNA, 22 nt, Human
aguuagagcgcauauuuuauua

SEQ ID NO: 406983 - RNA, 22 nt, Human
aggucauuacaauuaucauuuu

SEQ ID NO: 406984 - RNA, 22 nt, Human
caacagugauucugcaugagga

SEQ ID NO: 406985 - RNA, 22 nt, Human
gauguaaauggucuuuggcaga

SEQ ID NO: 406986 - RNA, 22 nt, Human
agguauauugaaugcuuacuua

SEQ ID NO: 406987 - RNA, 22 nt, Human
gaacauuuggauuuguaaauuu

SEQ ID NO: 406988 - RNA, 22 nt, Human
caucuugaagguuucuuuagcu

SEQ ID NO: 406989 - RNA, 22 nt, Human
agaucauagcacaaaagugaca

SEQ ID NO: 406990 - RNA, 22 nt, Human
auagacauggucuuuugucauu

SEQ ID NO: 406991 - RNA, 22 nt, Human
auuacaguaaaugcuacaggca

SEQ ID NO: 406992 - RNA, 20 nt, Human
uuucacaucugucccuuuaa

SEQ ID NO: 406993 - RNA, 22 nt, Human
acagugauuuuaggauagaugg

SEQ ID NO: 406994 - RNA, 20 nt, Human
ugucaauagcacugaggcug

SEQ ID NO: 406995 - RNA, 22 nt, Human
aucagugcugagagacuaucaa

SEQ ID NO: 406996 - RNA, 22 nt, Human
ucacaucauuaagacuucuccu

SEQ ID NO: 406997 - RNA, 22 nt, Human
gauaacauuuugaagugcuagu

SEQ ID NO: 406998 - RNA, 22 nt, Human
uaugcacauucacacaaaaaug

SEQ ID NO: 406999 - RNA, 22 nt, Human
uugauacagcagccugugaucc

SEQ ID NO: 407000 - RNA, 19 nt, Human
uuuaagcauagaggccaga

SEQ ID NO: 407001 - RNA, 19 nt, Human
agcauuuggaauucuacac

SEQ ID NO: 407002 - RNA, 22 nt, Human
uaacugauguucccuuacugua

SEQ ID NO: 407003 - RNA, 22 nt, Human
ucugugcagaacucacagaagg

SEQ ID NO: 407004 - RNA, 22 nt, Human
auguacaaucuaucacaagaag

SEQ ID NO: 407005 - RNA, 22 nt, Human
uuugacaugaaguagcuuauaa

SEQ ID NO: 407006 - RNA, 22 nt, Human
uggagaugcacgagcaggugga

SEQ ID NO: 407007 - RNA, 22 nt, Human
augcacaucuuacagaugcaga

SEQ ID NO: 407008 - RNA, 22 nt, Human
aauaacagagucuucaagauag

SEQ ID NO: 407009 - RNA, 22 nt, Human
acugcccucccaucuauugcaa

SEQ ID NO: 407010 - RNA, 22 nt, Human
augaguaaaaccacuauuuaca

SEQ ID NO: 407011 - RNA, 22 nt, Human
auuuuaguuuuagcauccaugc

SEQ ID NO: 407012 - RNA, 22 nt, Human
cauaacauguacauauaaaugc

SEQ ID NO: 407013 - RNA, 22 nt, Human
augcuacaggaagacgucaggc

SEQ ID NO: 407014 - RNA, 22 nt, Human
auuugcauuuacauagcauaga

SEQ ID NO: 407015 - RNA, 22 nt, Human
cauguacacacaaagggacaau

SEQ ID NO: 407016 - RNA, 22 nt, Human
acuaaaugcauugguaucuauu

SEQ ID NO: 407017 - RNA, 22 nt, Human
aguaaacaggcaugauaguguu

SEQ ID NO: 407018 - RNA, 22 nt, Human
acugugcaugaaccgaaacaaa

SEQ ID NO: 407019 - RNA, 22 nt, Human
acauucauugagcaacaacaau

SEQ ID NO: 407020 - RNA, 22 nt, Human
cuacaugaacucuuaagucaca

SEQ ID NO: 407021 - RNA, 22 nt, Human
uggaaauacaagaaguauguca

SEQ ID NO: 407022 - RNA, 22 nt, Human
acacauuugcauaauaccucau

SEQ ID NO: 407023 - RNA, 22 nt, Human
ucaguaaccuuuagcacaguug

SEQ ID NO: 407024 - RNA, 22 nt, Human
uauaugcaugcccauguauaca

SEQ ID NO: 407025 - RNA, 22 nt, Human
gcugugcaggggauuugguuau

SEQ ID NO: 407026 - RNA, 22 nt, Human
agguauuaugcugcugaaugcu

SEQ ID NO: 407027 - RNA, 20 nt, Human
ucugugcauugccugcuggu

SEQ ID NO: 407028 - RNA, 22 nt, Human
augaaacacacacgcgcauacu

SEQ ID NO: 407029 - RNA, 22 nt, Human
ggaaucuuaauggcauggaguu

SEQ ID NO: 407030 - RNA, 19 nt, Human
agcacaguuuccacaugca

SEQ ID NO: 407031 - RNA, 22 nt, Human
gacaggaaacaagaaggcagga

SEQ ID NO: 407032 - RNA, 22 nt, Human
auguuuuauguuccacucaagg

SEQ ID NO: 407033 - RNA, 22 nt, Human
aaaugauugucaaaguucuguu

SEQ ID NO: 407034 - RNA, 22 nt, Human
agcugcccccagggcugugcuu

SEQ ID NO: 407035 - RNA, 22 nt, Human
uagcagcuuaaguaauuagaau

SEQ ID NO: 407036 - RNA, 22 nt, Human
gacauucuaaaaaauauggaag

SEQ ID NO: 407037 - RNA, 22 nt, Human
uuugaaauaugaggcauuauga

SEQ ID NO: 407038 - RNA, 22 nt, Human
cauguauaguuggaacuacauc

SEQ ID NO: 407039 - RNA, 22 nt, Human
acaugaaacuguugcauuagaa

SEQ ID NO: 407040 - RNA, 22 nt, Human
uuugacaaaggaaaaaugcaca

SEQ ID NO: 407041 - RNA, 22 nt, Human
augaucaagaauuuuguauucc

SEQ ID NO: 407042 - RNA, 22 nt, Human
cacaggaagagguauacaauuc

SEQ ID NO: 407043 - RNA, 22 nt, Human
auucugaucauucaagauguca

SEQ ID NO: 407044 - RNA, 22 nt, Human
agacagugacuuagugaccaga

SEQ ID NO: 407045 - RNA, 22 nt, Human
ggcugugcugagggggaagccc

SEQ ID NO: 407046 - RNA, 22 nt, Human
auuacaguaacagcuacaaugc

SEQ ID NO: 407047 - RNA, 22 nt, Human
uuauacauguguuuugagauga

SEQ ID NO: 407048 - RNA, 22 nt, Human
acuaugaauagccagauaguga

SEQ ID NO: 407049 - RNA, 22 nt, Human
acauuuugaaagggaaauuguu

SEQ ID NO: 407050 - RNA, 22 nt, Human
aguuugauaaacaccagcuagu

SEQ ID NO: 407051 - RNA, 22 nt, Human
acuaacauuuguguaugucuug

SEQ ID NO: 407052 - RNA, 22 nt, Human
ugagcacauuucacaugacagg

SEQ ID NO: 407053 - RNA, 22 nt, Human
agaugcagaaaaacuaagugau

SEQ ID NO: 407054 - RNA, 22 nt, Human
gugcugugucuaucaggaauaa

SEQ ID NO: 407055 - RNA, 22 nt, Human
agcugcagagguuugugcaaca

SEQ ID NO: 407056 - RNA, 22 nt, Human
caucauaauaacccagacacag

SEQ ID NO: 407057 - RNA, 22 nt, Human
auauacguauauuccaaagggu

SEQ ID NO: 407058 - RNA, 22 nt, Human
ugaucaguguugguucuaucua

SEQ ID NO: 407059 - RNA, 22 nt, Human
uaugcacaguuacaagaauauc

SEQ ID NO: 407060 - RNA, 22 nt, Human
uacaacauuguguugcuucaua

SEQ ID NO: 407061 - RNA, 22 nt, Human
uuauacauguuuauaagguuga

SEQ ID NO: 407062 - RNA, 21 nt, Human
auggaaauuggcaaaugcuac

SEQ ID NO: 407063 - RNA, 22 nt, Human
cuaaacauggcuuagaacacuc

SEQ ID NO: 407064 - RNA, 22 nt, Human
agacaacaccaaaugcuagugu

SEQ ID NO: 407065 - RNA, 22 nt, Human
ucugugcauuucaggaccugaa

SEQ ID NO: 407066 - RNA, 22 nt, Human
gcugagauuacgggcaugagcc

SEQ ID NO: 407067 - RNA, 22 nt, Human
aaugcaaacuccacuggagcag

SEQ ID NO: 407068 - RNA, 22 nt, Human
aaugaacacagcccucuacuuu

SEQ ID NO: 407069 - RNA, 21 nt, Human
gcugugcaggauugaaagcag

SEQ ID NO: 407070 - RNA, 22 nt, Human
uaacugaugugaacuuaccauu

SEQ ID NO: 407071 - RNA, 22 nt, Human
aaggaaauuagguuauuuugcu

SEQ ID NO: 407072 - RNA, 22 nt, Human
uuucuacuuuggaaugcacuga

SEQ ID NO: 407073 - RNA, 22 nt, Human
ugaucaaagugcuggaauuaca

SEQ ID NO: 407074 - RNA, 22 nt, Human
gacaucauaucaggaggcaugu

SEQ ID NO: 407075 - RNA, 22 nt, Human
aaggucauuguugcauguucuc

SEQ ID NO: 407076 - RNA, 19 nt, Human
cauuuagaaguacauauua

SEQ ID NO: 407077 - RNA, 22 nt, Human
auacacuaaucaugugcucagu

SEQ ID NO: 407078 - RNA, 22 nt, Human
acugugcauuucaugucuuuuc

SEQ ID NO: 407079 - RNA, 17 nt, Human
gcagugaaaagagauca

SEQ ID NO: 407080 - RNA, 22 nt, Human
ucauuuguugcuguuaccugag

SEQ ID NO: 407081 - RNA, 22 nt, Human
uguuuauaccugcaaccuguca

SEQ ID NO: 407082 - RNA, 22 nt, Human
ucacaucacccugcucuuaauu

SEQ ID NO: 407083 - RNA, 22 nt, Human
uuauaugauugagcaucuuggu

SEQ ID NO: 407084 - RNA, 22 nt, Human
augcaagacauaaauaaucuuu

SEQ ID NO: 407085 - RNA, 22 nt, Human
acaugcuaugagagauuacuuc

SEQ ID NO: 407086 - RNA, 22 nt, Human
uguuauacuauuuagagguaca

SEQ ID NO: 407087 - RNA, 22 nt, Human
ugagcacagcuuucacuagaaa

SEQ ID NO: 407088 - RNA, 22 nt, Human
ugagcugauaggcugugagccu

SEQ ID NO: 407089 - RNA, 22 nt, Human
ucauucaucugguguuaguccu

SEQ ID NO: 407090 - RNA, 22 nt, Human
uaaacagagugcuaguucacgg

SEQ ID NO: 407091 - RNA, 22 nt, Human
cauggaacuguauaaaggcacu

SEQ ID NO: 407092 - RNA, 22 nt, Human
augauauauguguugagcuugc

SEQ ID NO: 407093 - RNA, 22 nt, Human
aaauuagucgguuuaggaauuu

SEQ ID NO: 407094 - RNA, 22 nt, Human
ugucauauagauauuagacagg

SEQ ID NO: 407095 - RNA, 22 nt, Human
agcacaauagagcaguuaaaaa

SEQ ID NO: 407096 - RNA, 20 nt, Human
uauaugcagccaacacuccc

SEQ ID NO: 407097 - RNA, 22 nt, Human
uacaguucuuugaaggaucuag

SEQ ID NO: 407098 - RNA, 22 nt, Human
ugaaauaauaucuggaucaauc

SEQ ID NO: 407099 - RNA, 22 nt, Human
aaacagauaagggacaauuuca

SEQ ID NO: 407100 - RNA, 22 nt, Human
ugacauuugagagagauauaca

SEQ ID NO: 407101 - RNA, 22 nt, Human
gcacuagauacuguucaggaaa

SEQ ID NO: 407102 - RNA, 22 nt, Human
uucugucaaauuugccauaugg

SEQ ID NO: 407103 - RNA, 22 nt, Human
auacaguauaacuaauaaaccc

SEQ ID NO: 407104 - RNA, 22 nt, Human
ucauaaacacacuaguaugauu

SEQ ID NO: 407105 - RNA, 22 nt, Human
ugauuaaauuaauuaagaugag

SEQ ID NO: 407106 - RNA, 22 nt, Human
agaggauuguuacugauuagcu

SEQ ID NO: 407107 - RNA, 22 nt, Human
uguuagcagagcagcugacaga

SEQ ID NO: 407108 - RNA, 22 nt, Human
gcaaauaaaugcucacugcugu

SEQ ID NO: 407109 - RNA, 22 nt, Human
ugucaauaucaggcagaccuaa

SEQ ID NO: 407110 - RNA, 23 nt, Human
auguuuuaugucucuagcugcca

SEQ ID NO: 407111 - RNA, 22 nt, Human
augaaaacggaccagagcuauu

SEQ ID NO: 407112 - RNA, 22 nt, Human
gcacagugauaggcaguugugc

SEQ ID NO: 407113 - RNA, 22 nt, Human
uaucaugaucagcaacuaauca

SEQ ID NO: 407114 - RNA, 22 nt, Human
uucuugauguaccaacuuggga

SEQ ID NO: 407115 - RNA, 22 nt, Human
uuggauccaucucaggcauagg

SEQ ID NO: 407116 - RNA, 22 nt, Human
gcugugcauugagccugagagu

SEQ ID NO: 407117 - RNA, 22 nt, Human
gauaacauuauaaguucacugu

SEQ ID NO: 407118 - RNA, 22 nt, Human
augauugaaaaugacauugcca

SEQ ID NO: 407119 - RNA, 19 nt, Human
acuagcacccagguaaaug

SEQ ID NO: 407120 - RNA, 22 nt, Human
guacaugagcauaaacacacau

SEQ ID NO: 407121 - RNA, 22 nt, Human
auaauaacaccugaauaggaaa

SEQ ID NO: 407122 - RNA, 22 nt, Human
aaaucugaaauagugugaagua

SEQ ID NO: 407123 - RNA, 22 nt, Human
uaaacauggcuguuucaguuau

SEQ ID NO: 407124 - RNA, 23 nt, Human
uucauauguugcugaaaacagca

SEQ ID NO: 407125 - RNA, 22 nt, Human
aacauacagugagcaguggacu

SEQ ID NO: 407126 - RNA, 23 nt, Human
gcugugcacgagccacugccugu

SEQ ID NO: 407127 - RNA, 19 nt, Human
uucauucucuuauuguugu

SEQ ID NO: 407128 - RNA, 22 nt, Human
cauucugacccuaugauuuaag

SEQ ID NO: 407129 - RNA, 22 nt, Human
cucauaaaagcuuuguuuacac

SEQ ID NO: 407130 - RNA, 22 nt, Human
gaugcugagcuguauggcuggu

SEQ ID NO: 407131 - RNA, 22 nt, Human
auggaaaugauggaacauuaaa

SEQ ID NO: 407132 - RNA, 18 nt, Human
gauguaaaauaguagcuu

SEQ ID NO: 407133 - RNA, 22 nt, Human
aauaugcauguauacaugugua

SEQ ID NO: 407134 - RNA, 22 nt, Human
acuaaacacaugagauuccugc

SEQ ID NO: 407135 - RNA, 22 nt, Human
agugcagugaugaauaaugguu

SEQ ID NO: 407136 - RNA, 22 nt, Human
cuggcuuucugaacaucaguga

SEQ ID NO: 407137 - RNA, 22 nt, Human
ucuguuuaugugucuaaauaaa

SEQ ID NO: 407138 - RNA, 22 nt, Human
cucuguuuuucaauaguucuug

SEQ ID NO: 407139 - RNA, 22 nt, Human
auguaacauugaauuauauagu

SEQ ID NO: 407140 - RNA, 22 nt, Human
augcacaugaggcaagcaaaau

SEQ ID NO: 407141 - RNA, 22 nt, Human
ugucauacaacaauaaguaccg

SEQ ID NO: 407142 - RNA, 23 nt, Human
uuggaaauggggagaacagauuc

SEQ ID NO: 407143 - RNA, 22 nt, Human
cagcacaguuugcuuggcagag

SEQ ID NO: 407144 - RNA, 22 nt, Human
ugcacaguucgccuucuccaag

SEQ ID NO: 407145 - RNA, 18 nt, Human
acacaguggaugccuggu

SEQ ID NO: 407146 - RNA, 21 nt, Human
uuuaugcagauaaugcuauuu

SEQ ID NO: 407147 - RNA, 22 nt, Human
augcaaacauucgcuugucucu

SEQ ID NO: 407148 - RNA, 22 nt, Human
cauuugauccucacaacaaucu

SEQ ID NO: 407149 - RNA, 22 nt, Human
ccugugcaugccaggguacacc

SEQ ID NO: 407150 - RNA, 22 nt, Human
acagugauugggguaucugcag

SEQ ID NO: 407151 - RNA, 22 nt, Human
aauacacuauuuugugcucagu

SEQ ID NO: 407152 - RNA, 22 nt, Human
uacaucuaucuagaugcucaga

SEQ ID NO: 407153 - RNA, 22 nt, Human
uuacaacagacacauauucuaa

SEQ ID NO: 407154 - RNA, 21 nt, Human
ugcuaagugucacaugucugc

SEQ ID NO: 407155 - RNA, 22 nt, Human
ucuguuuaaugggaaugauacu

SEQ ID NO: 407156 - RNA, 22 nt, Human
gugcacaaucuucauauggcgu

SEQ ID NO: 407157 - RNA, 17 nt, Human
cagugcagauaagugag

SEQ ID NO: 407158 - RNA, 22 nt, Human
ccugugcauugaguuugcaccc

SEQ ID NO: 407159 - RNA, 22 nt, Human
acagcagcgugaaguguguuau

SEQ ID NO: 407160 - RNA, 22 nt, Human
uuaaagcaguuuguauacaugg

SEQ ID NO: 407161 - RNA, 22 nt, Human
cuugugcaaauccucgagcaca

SEQ ID NO: 407162 - RNA, 22 nt, Human
acauucuuucucuucaggaaac

SEQ ID NO: 407163 - RNA, 22 nt, Human
gguuuacucguaguggcgguuu

SEQ ID NO: 407164 - RNA, 22 nt, Human
uaaacauggauucugaucacag

SEQ ID NO: 407165 - RNA, 22 nt, Human
uugagcacaggugaacagcauc

SEQ ID NO: 407166 - RNA, 22 nt, Human
agcugugccuauucguggcaag

SEQ ID NO: 407167 - RNA, 22 nt, Human
augcagcugugggcaagaaaug

SEQ ID NO: 407168 - RNA, 22 nt, Human
ugcaaauguguagguuuacaua

SEQ ID NO: 407169 - RNA, 23 nt, Human
aacacauugcuaauuacauucaa

SEQ ID NO: 407170 - RNA, 22 nt, Human
augaugaaauuuucuaucaugu

SEQ ID NO: 407171 - RNA, 22 nt, Human
ucaauucugccucuaaauauuu

SEQ ID NO: 407172 - RNA, 22 nt, Human
agcugagagccccugcccugug

SEQ ID NO: 407173 - RNA, 22 nt, Human
acuuaaaaagaaucuuuucacg

SEQ ID NO: 407174 - RNA, 20 nt, Human
cagcacagagcuuggcucua

SEQ ID NO: 407175 - RNA, 22 nt, Human
ucaaacagcaggucuuucauag

SEQ ID NO: 407176 - RNA, 22 nt, Human
auagugcauuuuauuaucagca

SEQ ID NO: 407177 - RNA, 22 nt, Human
aauuggaagaauugauuugcuu

SEQ ID NO: 407178 - RNA, 22 nt, Human
uuauauuaguuagacuugcugu

SEQ ID NO: 407179 - RNA, 22 nt, Human
acagugacaacccaggauaaau

SEQ ID NO: 407180 - RNA, 20 nt, Human
ggcugugcccuuccguggcc

SEQ ID NO: 407181 - RNA, 22 nt, Human
accuucaaacuagauagaaguu

SEQ ID NO: 407182 - RNA, 22 nt, Human
augaugaaaugauagguuuguu

SEQ ID NO: 407183 - RNA, 22 nt, Human
acuaaaugagauacugucuuca

SEQ ID NO: 407184 - RNA, 22 nt, Human
gcugugcacuaccuauacaucc

SEQ ID NO: 407185 - RNA, 22 nt, Human
uuuaaucuauucccuaaacacc

SEQ ID NO: 407186 - RNA, 19 nt, Human
acagcacagaaauauuuca

SEQ ID NO: 407187 - RNA, 22 nt, Human
aagaugcuugagaacuguuuga

SEQ ID NO: 407188 - RNA, 22 nt, Human
auaaacaucuguuucucuucug

SEQ ID NO: 407189 - RNA, 22 nt, Human
cuaggcuagauaguauauuggu

SEQ ID NO: 407190 - RNA, 22 nt, Human
acauuugugcaacguauccaca

SEQ ID NO: 407191 - RNA, 22 nt, Human
auacaugauacuuaguacguag

SEQ ID NO: 407192 - RNA, 22 nt, Human
acacuggaggguccagggaugu

SEQ ID NO: 407193 - RNA, 22 nt, Human
uacagugcaaugugauguagau

SEQ ID NO: 407194 - RNA, 22 nt, Human
gagaugcugaaaucugagugua

SEQ ID NO: 407195 - RNA, 22 nt, Human
acacauuuucaacacugucaag

SEQ ID NO: 407196 - RNA, 22 nt, Human
ccugugcagcccuugccaguuu

SEQ ID NO: 407197 - RNA, 22 nt, Human
uuugaucagcaagauaaauaga

SEQ ID NO: 407198 - RNA, 22 nt, Human
uaugaacacuuauuggggaagg

SEQ ID NO: 407199 - RNA, 22 nt, Human
uuacauucauugaagugauuca

SEQ ID NO: 407200 - RNA, 22 nt, Human
caugaacauugcagggauguga

SEQ ID NO: 407201 - RNA, 22 nt, Human
uuugcaaugugaaauuaaagaa

SEQ ID NO: 407202 - RNA, 22 nt, Human
gauacaguauuuaaagagcaac

SEQ ID NO: 407203 - RNA, 22 nt, Human
ggagaugcuuuccaguggggau

SEQ ID NO: 407204 - RNA, 22 nt, Human
caagauaaaaucagcauuccaa

SEQ ID NO: 407205 - RNA, 22 nt, Human
ucugugcaagaccaacuuucaa

SEQ ID NO: 407206 - RNA, 22 nt, Human
aggauaacuauaggauaaugcu

SEQ ID NO: 407207 - RNA, 20 nt, Human
acauuugaagucgcauuucu

SEQ ID NO: 407208 - RNA, 22 nt, Human
agcugagagguggcaagcugua

SEQ ID NO: 407209 - RNA, 22 nt, Human
auuuugaugcuaucuaaugaau

SEQ ID NO: 407210 - RNA, 22 nt, Human
auuaaauuaaguggcuaauuua

SEQ ID NO: 407211 - RNA, 22 nt, Human
ugguuguauaaugucacuaagc

SEQ ID NO: 407212 - RNA, 22 nt, Human
guuuacaugcagaaaaucaaug

SEQ ID NO: 407213 - RNA, 22 nt, Human
augcugagauaaggcuuuaguc

SEQ ID NO: 407214 - RNA, 22 nt, Human
ucugugcaguucuugucuugac

SEQ ID NO: 407215 - RNA, 18 nt, Human
ugcugugcacagcccuau

SEQ ID NO: 407216 - RNA, 22 nt, Human
uauacugagagcaaauacauuc

SEQ ID NO: 407217 - RNA, 22 nt, Human
ugacaaagguguugccagaggg

SEQ ID NO: 407218 - RNA, 22 nt, Human
aauggaaugccucacauguauu

SEQ ID NO: 407219 - RNA, 22 nt, Human
ucacauucuagaauguuaucgu

SEQ ID NO: 407220 - RNA, 22 nt, Human
uuaugcaaggacuuauuacagu

SEQ ID NO: 407221 - RNA, 22 nt, Human
aauuugauuuucuuaaaccaua

SEQ ID NO: 407222 - RNA, 22 nt, Human
ucaauuacagugucaccuuaag

SEQ ID NO: 407223 - RNA, 22 nt, Human
aacauuugagaaaaauacucuu

SEQ ID NO: 407224 - RNA, 22 nt, Human
cugagcugggagccuggcacca

SEQ ID NO: 407225 - RNA, 22 nt, Human
uggaauuuaguuaauuccauuu

SEQ ID NO: 407226 - RNA, 22 nt, Human
uaugcacacaucgcagcaggaa

SEQ ID NO: 407227 - RNA, 22 nt, Human
gugauacagguguucuggauau

SEQ ID NO: 407228 - RNA, 22 nt, Human
acaugauuugcaugauuuguaa

SEQ ID NO: 407229 - RNA, 22 nt, Human
acauuugaggauguuaagaaug

SEQ ID NO: 407230 - RNA, 22 nt, Human
cagaauaaacagaaacguagcu

SEQ ID NO: 407231 - RNA, 17 nt, Human
aauguggaaguacaugc

SEQ ID NO: 407232 - RNA, 22 nt, Human
caccauaaaaauaagagaugcc

SEQ ID NO: 407233 - RNA, 22 nt, Human
uauuauuaugcauagcaugaaa

SEQ ID NO: 407234 - RNA, 22 nt, Human
ccugugcaauguugagguuuca

SEQ ID NO: 407235 - RNA, 22 nt, Human
uuaucacuuaugagcuuuuugc

SEQ ID NO: 407236 - RNA, 20 nt, Human
uuugucaacugcauccagca

SEQ ID NO: 407237 - RNA, 22 nt, Human
ugagagcugggaaauguuagcu

SEQ ID NO: 407238 - RNA, 22 nt, Human
ucauuuauaaggaugcaauuaa

SEQ ID NO: 407239 - RNA, 22 nt, Human
aggucauuuuugccuucuauuu

SEQ ID NO: 407240 - RNA, 22 nt, Human
uaggaaauugccaauauaugac

SEQ ID NO: 407241 - RNA, 22 nt, Human
auuacacuaaugugacaacaau

SEQ ID NO: 407242 - RNA, 22 nt, Human
cacuagaugauaaucagcugga

SEQ ID NO: 407243 - RNA, 22 nt, Human
acaguuacaucacuuacugaca

SEQ ID NO: 407244 - RNA, 19 nt, Human
agugucagaauucauugaa

SEQ ID NO: 407245 - RNA, 22 nt, Human
aucauaaaauugcaccauuucu

SEQ ID NO: 407246 - RNA, 22 nt, Human
guacaguagagccagguucagu

SEQ ID NO: 407247 - RNA, 22 nt, Human
aauggagacccuaaggaagagg

SEQ ID NO: 407248 - RNA, 22 nt, Human
augcugagguguguuuaauuua

SEQ ID NO: 407249 - RNA, 22 nt, Human
ggaaucuuugaaggauuuuaag

SEQ ID NO: 407250 - RNA, 22 nt, Human
cugaaaauguuacacaggaaga

SEQ ID NO: 407251 - RNA, 22 nt, Human
ugcaaauagccugaugaaagaa

SEQ ID NO: 407252 - RNA, 22 nt, Human
cauucauuuacuuucaacagcu

SEQ ID NO: 407253 - RNA, 22 nt, Human
ugauuaaagguggaaggcaggu

SEQ ID NO: 407254 - RNA, 22 nt, Human
ucauuuguucaucugcucuucu

SEQ ID NO: 407255 - RNA, 22 nt, Human
acauuugauggaguuaguaggu

SEQ ID NO: 407256 - RNA, 22 nt, Human
ugcugugcuggcggcagaggcc

SEQ ID NO: 407257 - RNA, 18 nt, Human
ugaugcaagagugagcua

SEQ ID NO: 407258 - RNA, 22 nt, Human
cauuugauuccuuuacucuuau

SEQ ID NO: 407259 - RNA, 22 nt, Human
acauugaugaucccacuuacag

SEQ ID NO: 407260 - RNA, 22 nt, Human
ucugugcagaaucaaggagcuu

SEQ ID NO: 407261 - RNA, 22 nt, Human
gauaaaagaggaaauuuguuca

SEQ ID NO: 407262 - RNA, 22 nt, Human
agaugcagacuugguucaggca

SEQ ID NO: 407263 - RNA, 22 nt, Human
aacauuugugaaguacuuagau

SEQ ID NO: 407264 - RNA, 22 nt, Human
aaugcucaaaauguuucaucua

SEQ ID NO: 407265 - RNA, 22 nt, Human
acaguuugguugcuacaguaaa

SEQ ID NO: 407266 - RNA, 22 nt, Human
uggagauguaaagcaaggcuua

SEQ ID NO: 407267 - RNA, 22 nt, Human
ugcagauacaguauguggaagc

SEQ ID NO: 407268 - RNA, 22 nt, Human
aaauggaagcuauuuaugauuc

SEQ ID NO: 407269 - RNA, 22 nt, Human
agcauauaggaaauguugaauc

SEQ ID NO: 407270 - RNA, 22 nt, Human
uaucuguugucuuuuacaugua

SEQ ID NO: 407271 - RNA, 22 nt, Human
aaauugauguucccaguugaaa

SEQ ID NO: 407272 - RNA, 22 nt, Human
cuggagauguccgggugcuguu

SEQ ID NO: 407273 - RNA, 22 nt, Human
uaggaaauuugaaauauguggg

SEQ ID NO: 407274 - RNA, 22 nt, Human
cauguacaugccuacuaucaau

SEQ ID NO: 407275 - RNA, 22 nt, Human
cccuauuagugaccacaucaua

SEQ ID NO: 407276 - RNA, 22 nt, Human
gaugagcugucuagcuguugga

SEQ ID NO: 407277 - RNA, 22 nt, Human
gcugugcagccaagugccucug

SEQ ID NO: 407278 - RNA, 20 nt, Human
aaacauucauguacaaguga

SEQ ID NO: 407279 - RNA, 23 nt, Human
cugcauauggagguuagcaacuc

SEQ ID NO: 407280 - RNA, 22 nt, Human
uaugauuuguagacauuugauu

SEQ ID NO: 407281 - RNA, 22 nt, Human
gcucaguguuucugguagaaaa

SEQ ID NO: 407282 - RNA, 22 nt, Human
aaaggauucucuugauuucagu

SEQ ID NO: 407283 - RNA, 22 nt, Human
auguuuaaaggagucagagacu

SEQ ID NO: 407284 - RNA, 22 nt, Human
uggagaugaauauguguaccug

SEQ ID NO: 407285 - RNA, 22 nt, Human
gaaaugaacugauuaucauugc

SEQ ID NO: 407286 - RNA, 22 nt, Human
gauaacuacacuuaagacaacc

SEQ ID NO: 407287 - RNA, 22 nt, Human
augaacaacuugaagcuccaug

SEQ ID NO: 407288 - RNA, 22 nt, Human
uagggguuaccuuuagcaucuc

SEQ ID NO: 407289 - RNA, 22 nt, Human
cagcacaucugauuauaugacu

SEQ ID NO: 407290 - RNA, 22 nt, Human
guaaacaggaauguggucaugg

SEQ ID NO: 407291 - RNA, 22 nt, Human
acagugaaaaguagcuaacaca

SEQ ID NO: 407292 - RNA, 22 nt, Human
uucucaaagaaagcugucauua

SEQ ID NO: 407293 - RNA, 22 nt, Human
uagcacauaacuuagaauaguu

SEQ ID NO: 407294 - RNA, 22 nt, Human
ugaauuaaaggaauucgaauuc

SEQ ID NO: 407295 - RNA, 22 nt, Human
uuuaaauuuagaagaaacacug

SEQ ID NO: 407296 - RNA, 22 nt, Human
uguaaagcaucucugucauaua

SEQ ID NO: 407297 - RNA, 22 nt, Human
agaugcugucacacacacuguu

SEQ ID NO: 407298 - RNA, 22 nt, Human
aaacauuugcaacucgguuugg

SEQ ID NO: 407299 - RNA, 22 nt, Human
aaacaugaauagauauuaaaca

SEQ ID NO: 407300 - RNA, 22 nt, Human
gagcacagaaggagaaauaugg

SEQ ID NO: 407301 - RNA, 22 nt, Human
caugcauauuacuagcacagca

SEQ ID NO: 407302 - RNA, 22 nt, Human
uaucacuacacuaagauacaga

SEQ ID NO: 407303 - RNA, 22 nt, Human
ugcauaacuagaguaauuacag

SEQ ID NO: 407304 - RNA, 22 nt, Human
uaaacauguugacaucuuaccu

SEQ ID NO: 407305 - RNA, 18 nt, Human
agauuuugagaaauacaa

SEQ ID NO: 407306 - RNA, 22 nt, Human
augcaaauaaagcaacuauaca

SEQ ID NO: 407307 - RNA, 20 nt, Human
uucaugggagcaaagaggcc

SEQ ID NO: 407308 - RNA, 22 nt, Human
acauuugacuguagauacuugc

SEQ ID NO: 407309 - RNA, 22 nt, Human
ggaaucuucagccaugccaaga

SEQ ID NO: 407310 - RNA, 22 nt, Human
uaugcauaguggaauuagcaaa

SEQ ID NO: 407311 - RNA, 22 nt, Human
cuugucagccaauuguggauuu

SEQ ID NO: 407312 - RNA, 22 nt, Human
aacaugauuggaaaaugcuguc

SEQ ID NO: 407313 - RNA, 22 nt, Human
caugcugugugguuagaacugu

SEQ ID NO: 407314 - RNA, 22 nt, Human
cuucauuuggagaacugugcuu

SEQ ID NO: 407315 - RNA, 22 nt, Human
ugcuacacucaaucagugcuau

SEQ ID NO: 407316 - RNA, 21 nt, Human
agaugcugaugcugcaggucc

SEQ ID NO: 407317 - RNA, 22 nt, Human
ucauaaaaugcuccugauauug

SEQ ID NO: 407318 - RNA, 22 nt, Human
acacagauuucacuggaauaga

SEQ ID NO: 407319 - RNA, 22 nt, Human
ggagaugcaauguagaaucugg

SEQ ID NO: 407320 - RNA, 22 nt, Human
uauuuguauguguguacauaua

SEQ ID NO: 407321 - RNA, 22 nt, Human
uuacacuaugaaugagaauaua

SEQ ID NO: 407322 - RNA, 22 nt, Human
uucauacaugagacuagaugca

SEQ ID NO: 407323 - RNA, 22 nt, Human
auuuguagugaagugaaaauaa

SEQ ID NO: 407324 - RNA, 22 nt, Human
ucacaucauggagaauuauggg

SEQ ID NO: 407325 - RNA, 22 nt, Human
agugcacagcgugauguauugg

SEQ ID NO: 407326 - RNA, 22 nt, Human
aagcauuuuaguaaugaacuug

SEQ ID NO: 407327 - RNA, 22 nt, Human
uuugucaaguuugcaaauacgu

SEQ ID NO: 407328 - RNA, 22 nt, Human
cauuuguaguuaaaaaugucuc

SEQ ID NO: 407329 - RNA, 23 nt, Human
caaaccuguucuccccacaugca

SEQ ID NO: 407330 - RNA, 22 nt, Human
ucugugcacaauaggcauuuuu

SEQ ID NO: 407331 - RNA, 22 nt, Human
acagugauuggcacugauucag

SEQ ID NO: 407332 - RNA, 22 nt, Human
aacauugaauuuaaaauacagu

SEQ ID NO: 407333 - RNA, 18 nt, Human
aacaggauccuccacuuc

SEQ ID NO: 407334 - RNA, 22 nt, Human
ccuguuuauugugaagaaccca

SEQ ID NO: 407335 - RNA, 22 nt, Human
aaacauuguuaugauaaauuac

SEQ ID NO: 407336 - RNA, 22 nt, Human
uuauagcagcaugauuuauagu

SEQ ID NO: 407337 - RNA, 22 nt, Human
ucugugcacuaacauuccuggu

SEQ ID NO: 407338 - RNA, 22 nt, Human
aguaaacaauguaugaggacag

SEQ ID NO: 407339 - RNA, 22 nt, Human
agcugugcuguggucaucuggg

SEQ ID NO: 407340 - RNA, 21 nt, Human
auuugcauuaaaauauuacgc

SEQ ID NO: 407341 - RNA, 21 nt, Human
gacauccaugugaguggcagu

SEQ ID NO: 407342 - RNA, 22 nt, Human
augcggugaauugacuguuucu

SEQ ID NO: 407343 - RNA, 22 nt, Human
uaugagcaagaguuugugaagg

SEQ ID NO: 407344 - RNA, 22 nt, Human
ugcacuccaggcugggugacag

SEQ ID NO: 407345 - RNA, 22 nt, Human
agaugcagaguugcuuaagcau

SEQ ID NO: 407346 - RNA, 17 nt, Human
augauuacaucuuuccu

SEQ ID NO: 407347 - RNA, 22 nt, Human
aauguggauccuuacagauacc

SEQ ID NO: 407348 - RNA, 22 nt, Human
uuucuacaguacugauuucaua

SEQ ID NO: 407349 - RNA, 22 nt, Human
uuuuauacacaugaacaugcag

SEQ ID NO: 407350 - RNA, 22 nt, Human
ucuaaauguaucacaucuggau

SEQ ID NO: 407351 - RNA, 22 nt, Human
gaugcaaacugugacauagagu

SEQ ID NO: 407352 - RNA, 22 nt, Human
uuguuuuaguagguacacugag

SEQ ID NO: 407353 - RNA, 22 nt, Human
uacuucaugaguuaauaugcag

SEQ ID NO: 407354 - RNA, 22 nt, Human
auacaguauuaccuguucagga

SEQ ID NO: 407355 - RNA, 22 nt, Human
auggaaauguuccauauauuga

SEQ ID NO: 407356 - RNA, 22 nt, Human
uuuugucagugagaacagaguu

SEQ ID NO: 407357 - RNA, 22 nt, Human
cuguuuaaugagguguaacaac

SEQ ID NO: 407358 - RNA, 22 nt, Human
cauuuguauguuccuccuuagg

SEQ ID NO: 407359 - RNA, 22 nt, Human
augaauaaaacauuuuaaucag

SEQ ID NO: 407360 - RNA, 22 nt, Human
uacagugagacuggcucaggga

SEQ ID NO: 407361 - RNA, 19 nt, Human
agugagcauggcuugacug

SEQ ID NO: 407362 - RNA, 22 nt, Human
uugaauaauuaauuacacucag

SEQ ID NO: 407363 - RNA, 22 nt, Human
caaauagacuuaagcaucugua

SEQ ID NO: 407364 - RNA, 21 nt, Human
ugucauauuucaauacaguuu

SEQ ID NO: 407365 - RNA, 22 nt, Human
uuauucuucuucucuugccagg

SEQ ID NO: 407366 - RNA, 22 nt, Human
acauuugauuccauccucuacu

SEQ ID NO: 407367 - RNA, 22 nt, Human
caacaguguugcaaucugaaaa

SEQ ID NO: 407368 - RNA, 19 nt, Human
aaaugugaugguacaauuc

SEQ ID NO: 407369 - RNA, 22 nt, Human
cugaucaugugggaggauaugu

SEQ ID NO: 407370 - RNA, 21 nt, Human
uacaagauagagguaauauau

SEQ ID NO: 407371 - RNA, 22 nt, Human
uacaggaaggagcacaucggga

SEQ ID NO: 407372 - RNA, 22 nt, Human
acauuugacucuguucauauua

SEQ ID NO: 407373 - RNA, 22 nt, Human
agcugugcacacugugaaguag

SEQ ID NO: 407374 - RNA, 22 nt, Human
aucuaaacuauaguaccuaguc

SEQ ID NO: 407375 - RNA, 22 nt, Human
uguuaaucaacaacaaacagug

SEQ ID NO: 407376 - RNA, 22 nt, Human
augcaaauuaacauauaguaga

SEQ ID NO: 407377 - RNA, 22 nt, Human
uaucagcaggccaaagcugcaa

SEQ ID NO: 407378 - RNA, 23 nt, Human
gguauucauucauuuaugcuaag

SEQ ID NO: 407379 - RNA, 22 nt, Human
aggcugugggguucugcuuuca

SEQ ID NO: 407380 - RNA, 22 nt, Human
gaacauuuauauuagauagcua

SEQ ID NO: 407381 - RNA, 20 nt, Human
caucuugaaggucuuccaca

SEQ ID NO: 407382 - RNA, 23 nt, Human
uuucucaaagaguggcagcuuca

SEQ ID NO: 407383 - RNA, 22 nt, Human
uugcauauccuccaacacaugg

SEQ ID NO: 407384 - RNA, 22 nt, Human
uggaaucuguauguauguauaa

SEQ ID NO: 407385 - RNA, 22 nt, Human
auaacacuaaauguauguaaca

SEQ ID NO: 407386 - RNA, 22 nt, Human
uuguaaauaguaguaagaugcc

SEQ ID NO: 407387 - RNA, 22 nt, Human
ggcacuaugaguuauaagugga

SEQ ID NO: 407388 - RNA, 22 nt, Human
uaagacaucauuaaacagcaau

SEQ ID NO: 407389 - RNA, 19 nt, Human
auacuaggucaugauaauc

SEQ ID NO: 407390 - RNA, 22 nt, Human
uagcugagagcucacuugagga

SEQ ID NO: 407391 - RNA, 22 nt, Human
caacuacuggugcucaggaaau

SEQ ID NO: 407392 - RNA, 22 nt, Human
gagcugaaguuuccauuuguac

SEQ ID NO: 407393 - RNA, 22 nt, Human
acaauguuucucuuuagucauu

SEQ ID NO: 407394 - RNA, 22 nt, Human
cauuugauuacuaaagauaauu

SEQ ID NO: 407395 - RNA, 22 nt, Human
ggagaugccuuguuucaggaac

SEQ ID NO: 407396 - RNA, 18 nt, Human
gauggaaaguguaugagu

SEQ ID NO: 407397 - RNA, 22 nt, Human
ugcauaaagugccauaguauua

SEQ ID NO: 407398 - RNA, 22 nt, Human
augaacaauaaaauagaucaca

SEQ ID NO: 407399 - RNA, 22 nt, Human
cagcacaggccugucuuugucu

SEQ ID NO: 407400 - RNA, 22 nt, Human
cacagugcuuuaugagagaucu

SEQ ID NO: 407401 - RNA, 22 nt, Human
uauacacugauauaaggaguaa

SEQ ID NO: 407402 - RNA, 23 nt, Human
uuuauauuccuaaugucuugagc

SEQ ID NO: 407403 - RNA, 22 nt, Human
acaguacauagaucucuacccu

SEQ ID NO: 407404 - RNA, 22 nt, Human
uuugucaaaucaaaccacauuc

SEQ ID NO: 407405 - RNA, 22 nt, Human
acauuacagcaaguuuacguua

SEQ ID NO: 407406 - RNA, 23 nt, Human
acagugaaacacgcaguaagagu

SEQ ID NO: 407407 - RNA, 22 nt, Human
auuugucacugagagaguuaga

SEQ ID NO: 407408 - RNA, 20 nt, Human
uuugacauauacaguucagg

SEQ ID NO: 407409 - RNA, 22 nt, Human
aaaggucuuaagguuaagcagg

SEQ ID NO: 407410 - RNA, 22 nt, Human
uacaucauggcuucaugcugca

SEQ ID NO: 407411 - RNA, 22 nt, Human
auauugcaauagaugcaucauu

SEQ ID NO: 407412 - RNA, 22 nt, Human
aaauuauuacaagcuaguuggc

SEQ ID NO: 407413 - RNA, 22 nt, Human
cuuaaauucuuaaugcccucau

SEQ ID NO: 407414 - RNA, 20 nt, Human
aacauuuguagucaggcaca

SEQ ID NO: 407415 - RNA, 22 nt, Human
gacaucauguucugcuaauagu

SEQ ID NO: 407416 - RNA, 22 nt, Human
acugugcaguguuguaacccga

SEQ ID NO: 407417 - RNA, 22 nt, Human
uaacauuucggugacaguggga

SEQ ID NO: 407418 - RNA, 22 nt, Human
agacauuuuagacauaaaagau

SEQ ID NO: 407419 - RNA, 22 nt, Human
uuuacugugcauuagaaucacc

SEQ ID NO: 407420 - RNA, 22 nt, Human
uuugcaaauaaauaagugcucg

SEQ ID NO: 407421 - RNA, 22 nt, Human
augaacaucggaaaugagacug

SEQ ID NO: 407422 - RNA, 21 nt, Human
aacaugauauguguauggauu

SEQ ID NO: 407423 - RNA, 21 nt, Human
agaugcagugacccacugggg

SEQ ID NO: 407424 - RNA, 22 nt, Human
acacuagcuauuaacuucacau

SEQ ID NO: 407425 - RNA, 22 nt, Human
gaaacauuguguucuacagauu

SEQ ID NO: 407426 - RNA, 22 nt, Human
ucacuacaaccgcuaccugaca

SEQ ID NO: 407427 - RNA, 19 nt, Human
acauuuagaauguacuugc

SEQ ID NO: 407428 - RNA, 22 nt, Human
auucauuuagagggauuaagca

SEQ ID NO: 407429 - RNA, 22 nt, Human
ucauucauugcaagcacacgca

SEQ ID NO: 407430 - RNA, 22 nt, Human
ugaugauaugaaagaaucuuua

SEQ ID NO: 407431 - RNA, 22 nt, Human
aguuggguuugugucaguugca

SEQ ID NO: 407432 - RNA, 22 nt, Human
ugcugagaucugccaguagaug

SEQ ID NO: 407433 - RNA, 22 nt, Human
ucauacaggcucaagcuauacg

SEQ ID NO: 407434 - RNA, 22 nt, Human
cugucaauuuauguugacaugc

SEQ ID NO: 407435 - RNA, 22 nt, Human
uauuugaugguucuaaaacagc

SEQ ID NO: 407436 - RNA, 22 nt, Human
agccuauuccaggaugagcuca

SEQ ID NO: 407437 - RNA, 22 nt, Human
uugauucaaaggggacaagugg

SEQ ID NO: 407438 - RNA, 22 nt, Human
gagcucagcaaaggucugugug

SEQ ID NO: 407439 - RNA, 21 nt, Human
acaugagacacacauauaugu

SEQ ID NO: 407440 - RNA, 20 nt, Human
agcuaacccuacuuucuuug

SEQ ID NO: 407441 - RNA, 22 nt, Human
acagugcagggugggaagaagg

SEQ ID NO: 407442 - RNA, 22 nt, Human
uaugaacauugaagaggagccc

SEQ ID NO: 407443 - RNA, 22 nt, Human
augcaagcaaucugagcuuugg

SEQ ID NO: 407444 - RNA, 22 nt, Human
uuaacauuguccuuagcagauu

SEQ ID NO: 407445 - RNA, 22 nt, Human
aagaacuuccuaauauauuuuc

SEQ ID NO: 407446 - RNA, 22 nt, Human
uagguacauuauuagaugcaug

SEQ ID NO: 407447 - RNA, 22 nt, Human
ugaauaaacuaugaggaggaau

SEQ ID NO: 407448 - RNA, 22 nt, Human
uagcagcuaugccauuuugaca

SEQ ID NO: 407449 - RNA, 22 nt, Human
auauaauuuuugguuagcucaa

SEQ ID NO: 407450 - RNA, 22 nt, Human
ggcacaauugcagcaauaaaca

SEQ ID NO: 407451 - RNA, 22 nt, Human
acagugcagggcgggaagaagg

SEQ ID NO: 407452 - RNA, 22 nt, Human
aauuacugucuccugcuggugu

SEQ ID NO: 407453 - RNA, 22 nt, Human
aauaugcaaauagguguaauga

SEQ ID NO: 407454 - RNA, 22 nt, Human
guugauacaccucaugguuacu

SEQ ID NO: 407455 - RNA, 23 nt, Human
uuuugcaauaagucacuggaaua

SEQ ID NO: 407456 - RNA, 22 nt, Human
cagugcaggaagugagaugccu

SEQ ID NO: 407457 - RNA, 22 nt, Human
acauggaucaaccuauuuucuu

SEQ ID NO: 407458 - RNA, 22 nt, Human
uacaucaugaaagcauacauca

SEQ ID NO: 407459 - RNA, 22 nt, Human
ugagaacuugugcuauugcaca

SEQ ID NO: 407460 - RNA, 22 nt, Human
agaugcugggaggcugagugca

SEQ ID NO: 407461 - RNA, 22 nt, Human
gaacauuuaugaugcaauaccu

SEQ ID NO: 407462 - RNA, 22 nt, Human
cuacaggaguaaaauaauuuca

SEQ ID NO: 407463 - RNA, 22 nt, Human
caugauaauuguuaacaaagua

SEQ ID NO: 407464 - RNA, 18 nt, Human
acauuuaggagagucaau

SEQ ID NO: 407465 - RNA, 22 nt, Human
ucauuuguggaagugauugugg

SEQ ID NO: 407466 - RNA, 22 nt, Human
cagcagcagagauacugguuuc

SEQ ID NO: 407467 - RNA, 22 nt, Human
uguugauuaguguuuagacuua

SEQ ID NO: 407468 - RNA, 21 nt, Human
uucuguuuuuuguaccagggc

SEQ ID NO: 407469 - RNA, 22 nt, Human
aguuagaguuaauuuccuaaca

SEQ ID NO: 407470 - RNA, 22 nt, Human
uuaaaaugcagauucugauuca

SEQ ID NO: 407471 - RNA, 22 nt, Human
auacacuacuaagcacagauug

SEQ ID NO: 407472 - RNA, 18 nt, Human
uacaggaagggguucucg

SEQ ID NO: 407473 - RNA, 22 nt, Human
auaccauuuccauguuacauua

SEQ ID NO: 407474 - RNA, 19 nt, Human
auacacauacguaaacuga

SEQ ID NO: 407475 - RNA, 22 nt, Human
auacaguaauuuguaacucauc

SEQ ID NO: 407476 - RNA, 22 nt, Human
uuacuguagaagagaaugauuc

SEQ ID NO: 407477 - RNA, 22 nt, Human
uuauuuaaaagugguaagauuc

SEQ ID NO: 407478 - RNA, 22 nt, Human
cuuaaauuuucaucuacaagaa

SEQ ID NO: 407479 - RNA, 22 nt, Human
gcacaguggguggucauguaca

SEQ ID NO: 407480 - RNA, 22 nt, Human
agcuggaugaauuuggaacacu

SEQ ID NO: 407481 - RNA, 20 nt, Human
gcaauauaugagugcaauaa

SEQ ID NO: 407482 - RNA, 23 nt, Human
uacauucuguauuuuuauagagu

SEQ ID NO: 407483 - RNA, 22 nt, Human
acugugcaugguauccuugaug

SEQ ID NO: 407484 - RNA, 20 nt, Human
ggagaugcagcccaggugcc

SEQ ID NO: 407485 - RNA, 22 nt, Human
auucucaauuuugccaaagggu

SEQ ID NO: 407486 - RNA, 22 nt, Human
ucacaucaacauuauagcauga

SEQ ID NO: 407487 - RNA, 22 nt, Human
uuuguaaauagcaguacucaug

SEQ ID NO: 407488 - RNA, 22 nt, Human
ugcugugcuccauugucuucac

SEQ ID NO: 407489 - RNA, 22 nt, Human
guuagagcacauacuuugcaug

SEQ ID NO: 407490 - RNA, 22 nt, Human
ugcaacaggcugugacauggaa

SEQ ID NO: 407491 - RNA, 22 nt, Human
aaacauuuuucuucaucauccu

SEQ ID NO: 407492 - RNA, 18 nt, Human
cacaggaaggggaauauc

SEQ ID NO: 407493 - RNA, 22 nt, Human
caaauagauuguucaauccuga

SEQ ID NO: 407494 - RNA, 22 nt, Human
aaaugugaguuauagcaauaga

SEQ ID NO: 407495 - RNA, 22 nt, Human
auuucgauagaccuaacaauug

SEQ ID NO: 407496 - RNA, 22 nt, Human
cauucauuagaauagauaugua

SEQ ID NO: 407497 - RNA, 22 nt, Human
augcauuugacgggauauauuu

SEQ ID NO: 407498 - RNA, 22 nt, Human
uaggaaauacuguaaguuuggg

SEQ ID NO: 407499 - RNA, 22 nt, Human
uuuauaugugaagguuugcaga

SEQ ID NO: 407500 - RNA, 22 nt, Human
acauuugucuuccuccucagug

SEQ ID NO: 407501 - RNA, 22 nt, Human
auucacuagguugcaaaacugu

SEQ ID NO: 407502 - RNA, 22 nt, Human
aacaugaaaacuaccugugauu

SEQ ID NO: 407503 - RNA, 22 nt, Human
augauauagagaguagauuaaa

SEQ ID NO: 407504 - RNA, 22 nt, Human
caauuugauuaauaccauacuu

SEQ ID NO: 407505 - RNA, 22 nt, Human
acauucuagauauguuauauuu

SEQ ID NO: 407506 - RNA, 22 nt, Human
auuuagcaaaaaaugaugaagc

SEQ ID NO: 407507 - RNA, 21 nt, Human
uucuucaugaugauuaauggc

SEQ ID NO: 407508 - RNA, 22 nt, Human
cauuuguagcuauuuacuguau

SEQ ID NO: 407509 - RNA, 22 nt, Human
aagugauuugcaugcuuaauuc

SEQ ID NO: 407510 - RNA, 23 nt, Human
uuaugcaagcuuccuggucucag

SEQ ID NO: 407511 - RNA, 22 nt, Human
acagugcagugugaugaguauu

SEQ ID NO: 407512 - RNA, 22 nt, Human
aacauuuguguuugcuaaaaau

SEQ ID NO: 407513 - RNA, 22 nt, Human
caugcauauaugcuacaugcaa

SEQ ID NO: 407514 - RNA, 22 nt, Human
ugcaauacauacuuagacccag

SEQ ID NO: 407515 - RNA, 22 nt, Human
acaauuugaggcuacucaauug

SEQ ID NO: 407516 - RNA, 22 nt, Human
auggaaauaucuuuagagcuua

SEQ ID NO: 407517 - RNA, 22 nt, Human
agcugcccaaggucacagagcu

SEQ ID NO: 407518 - RNA, 22 nt, Human
gaugcugauuuuacuguuuucu

SEQ ID NO: 407519 - RNA, 18 nt, Human
aacaguuuccagauucuc

SEQ ID NO: 407520 - RNA, 22 nt, Human
aauguuugccugacuagagugg

SEQ ID NO: 407521 - RNA, 19 nt, Human
agcugugcagacacuucgc

SEQ ID NO: 407522 - RNA, 22 nt, Human
acauuugacuacauuuauauau

SEQ ID NO: 407523 - RNA, 22 nt, Human
acauugauauuucaaauacagg

SEQ ID NO: 407524 - RNA, 22 nt, Human
ucuaauuuuggcauuuuaaccu

SEQ ID NO: 407525 - RNA, 22 nt, Human
aauuugaaacauagucaccacu

SEQ ID NO: 407526 - RNA, 22 nt, Human
auuugcaauuuuacuuugcagu

SEQ ID NO: 407527 - RNA, 22 nt, Human
ggcugugcuuuguuagguuguc

SEQ ID NO: 407528 - RNA, 22 nt, Human
caucauacuguuuacacucaaa

SEQ ID NO: 407529 - RNA, 22 nt, Human
gcucaguguucaucuguaugca

SEQ ID NO: 407530 - RNA, 22 nt, Human
uuaaauuuuagaaacagacucu

SEQ ID NO: 407531 - RNA, 22 nt, Human
agcaaguggaaucauggaaaag

SEQ ID NO: 407532 - RNA, 22 nt, Human
aaguacauuauaugagcagaau

SEQ ID NO: 407533 - RNA, 22 nt, Human
uaacauuuaaauuuuucacaua

SEQ ID NO: 407534 - RNA, 22 nt, Human
gucuucauucucauagcccugg

SEQ ID NO: 407535 - RNA, 22 nt, Human
acaguucccgucuugcacagcu

SEQ ID NO: 407536 - RNA, 22 nt, Human
ugagcagaggaggcugccaacu

SEQ ID NO: 407537 - RNA, 22 nt, Human
gauaaacaugaaguucugugua

SEQ ID NO: 407538 - RNA, 22 nt, Human
auauggaaugguaaucuacaau

SEQ ID NO: 407539 - RNA, 21 nt, Human
uuacuggcagcagaaaccuga

SEQ ID NO: 407540 - RNA, 22 nt, Human
acuuugcagggcuugauaucca

SEQ ID NO: 407541 - RNA, 22 nt, Human
aagcauuugugaaauucagaug

SEQ ID NO: 407542 - RNA, 22 nt, Human
auuaaauuagcaaacugugaaa

SEQ ID NO: 407543 - RNA, 22 nt, Human
cauaauuuuccaugguuugcua

SEQ ID NO: 407544 - RNA, 22 nt, Human
acgugauauauuuacuucccca

SEQ ID NO: 407545 - RNA, 22 nt, Human
uugauacauagcacaguuuagg

SEQ ID NO: 407546 - RNA, 22 nt, Human
augcuuuuaugucacaugguca

SEQ ID NO: 407547 - RNA, 22 nt, Human
acugugcaucuauugccauuua

SEQ ID NO: 407548 - RNA, 22 nt, Human
guuagcaccagugcucauaaca

SEQ ID NO: 407549 - RNA, 22 nt, Human
ucaauuacuaaccaaauaaugu

SEQ ID NO: 407550 - RNA, 17 nt, Human
ugugcauagaauaauga

SEQ ID NO: 407551 - RNA, 22 nt, Human
acaggaaguuuggaaagccuca

SEQ ID NO: 407552 - RNA, 22 nt, Human
aaacaguuaauugcuuucaguu

SEQ ID NO: 407553 - RNA, 22 nt, Human
ggagaugcgacucgcggggcug

SEQ ID NO: 407554 - RNA, 22 nt, Human
aagcauuugguucugaagacuc

SEQ ID NO: 407555 - RNA, 22 nt, Human
uuaaugauuuggaacccuuuaa

SEQ ID NO: 407556 - RNA, 22 nt, Human
ugucagaacucuauugaugucc

SEQ ID NO: 407557 - RNA, 22 nt, Human
gaagcuaaugagauaaaugcca

SEQ ID NO: 407558 - RNA, 22 nt, Human
uauuauuauauuggaugagacu

SEQ ID NO: 407559 - RNA, 22 nt, Human
cauaaacucucuguaccaauau

SEQ ID NO: 407560 - RNA, 22 nt, Human
uagcugagaggccaauugaacu

SEQ ID NO: 407561 - RNA, 22 nt, Human
ucaaacaggacuacauucucau

SEQ ID NO: 407562 - RNA, 22 nt, Human
ucuguuuaugcauauuuaaaac

SEQ ID NO: 407563 - RNA, 22 nt, Human
aggugauuuucuccuuacgauu

SEQ ID NO: 407564 - RNA, 20 nt, Human
uaaacaguauuuacuaggag

SEQ ID NO: 407565 - RNA, 22 nt, Human
ucugucauuucaauaugguuaa

SEQ ID NO: 407566 - RNA, 22 nt, Human
uuacuguacuagugagacuagg

SEQ ID NO: 407567 - RNA, 19 nt, Human
ucauaaaaaugguaaccca

SEQ ID NO: 407568 - RNA, 23 nt, Human
ugaaacauuuaggguagaauuuc

SEQ ID NO: 407569 - RNA, 22 nt, Human
aggauuaaaguauauuuuugag

SEQ ID NO: 407570 - RNA, 22 nt, Human
auaaagcuaagacuuacaugaa

SEQ ID NO: 407571 - RNA, 22 nt, Human
agacauuuccuagacaucaaug

SEQ ID NO: 407572 - RNA, 22 nt, Human
acaugcauacacguacauaccu

SEQ ID NO: 407573 - RNA, 20 nt, Human
uauuuguauuugggaaaguu

SEQ ID NO: 407574 - RNA, 22 nt, Human
ucugugcauuguaacaacuaaa

SEQ ID NO: 407575 - RNA, 22 nt, Human
ucauucaugaggugcuagugcu

SEQ ID NO: 407576 - RNA, 21 nt, Human
ugacauaauccauaguacaaa

SEQ ID NO: 407577 - RNA, 22 nt, Human
cauuugcaagagauaaauguuu

SEQ ID NO: 407578 - RNA, 22 nt, Human
ggaaaucaagaagcagaugagu

SEQ ID NO: 407579 - RNA, 22 nt, Human
ucugugcagucagggcucaguc

SEQ ID NO: 407580 - RNA, 22 nt, Human
uguuuauaccuugguauaacca

SEQ ID NO: 407581 - RNA, 22 nt, Human
agguuuaugauucugcacgugg

SEQ ID NO: 407582 - RNA, 22 nt, Human
uacaugcacaugaacaugugug

SEQ ID NO: 407583 - RNA, 22 nt, Human
aauggaauucuccauuagaugu

SEQ ID NO: 407584 - RNA, 22 nt, Human
cagguauuaauaaauggagagu

SEQ ID NO: 407585 - RNA, 22 nt, Human
ugcaauaaguuguguuaucacu

SEQ ID NO: 407586 - RNA, 22 nt, Human
aauuuugugugggaucaaagga

SEQ ID NO: 407587 - RNA, 22 nt, Human
auaaugcaccuuugaguauggc

SEQ ID NO: 407588 - RNA, 22 nt, Human
gaggucaucaccaauauaugcc

SEQ ID NO: 407589 - RNA, 22 nt, Human
acugugcaggggaagagagaaa

SEQ ID NO: 407590 - RNA, 22 nt, Human
uuacaugaugauuucauaaaca

SEQ ID NO: 407591 - RNA, 22 nt, Human
ggagaugcuacaguucagcucu

SEQ ID NO: 407592 - RNA, 22 nt, Human
uuuaaauucugucugccgcuua

SEQ ID NO: 407593 - RNA, 22 nt, Human
acaguacagugcagaggaagau

SEQ ID NO: 407594 - RNA, 22 nt, Human
ugaugacagcaaaaaaugcuag

SEQ ID NO: 407595 - RNA, 20 nt, Human
auuuggcaugaaguauugau

SEQ ID NO: 407596 - RNA, 22 nt, Human
uagagcuagcuucaaaaugcga

SEQ ID NO: 407597 - RNA, 22 nt, Human
gcugugcagauguagggagugg

SEQ ID NO: 407598 - RNA, 22 nt, Human
augcugagacuggagcagcugg

SEQ ID NO: 407599 - RNA, 22 nt, Human
aguguacauaguuaggaacauc

SEQ ID NO: 407600 - RNA, 22 nt, Human
auagaaauguauuuuggacuag

SEQ ID NO: 407601 - RNA, 22 nt, Human
acaagagcccuuucagauugac

SEQ ID NO: 407602 - RNA, 22 nt, Human
uaauaacaauuguaggacauga

SEQ ID NO: 407603 - RNA, 22 nt, Human
cacaggaaucagcauuaauggc

SEQ ID NO: 407604 - RNA, 22 nt, Human
ucagaacagaagaaggaacacg

SEQ ID NO: 407605 - RNA, 19 nt, Human
ugaauacagagauacagaa

SEQ ID NO: 407606 - RNA, 22 nt, Human
cugagcugguucucuugugaaa

SEQ ID NO: 407607 - RNA, 17 nt, Human
cagguauuuaggcauug

SEQ ID NO: 407608 - RNA, 22 nt, Human
uucucacaguaccuaacaugua

SEQ ID NO: 407609 - RNA, 22 nt, Human
aaauuggaugcacauuuagaaa

SEQ ID NO: 407610 - RNA, 19 nt, Human
aggauuuauuaugugcuca

SEQ ID NO: 407611 - RNA, 22 nt, Human
uugauacaugcucuagaguuga

SEQ ID NO: 407612 - RNA, 22 nt, Human
uaacaugaaacuccaaauggua

SEQ ID NO: 407613 - RNA, 22 nt, Human
uacuaggcaauuauguaaauaa

SEQ ID NO: 407614 - RNA, 22 nt, Human
guacaguaguaaaagugaauga

SEQ ID NO: 407615 - RNA, 22 nt, Human
aagguauuauuugcaaucauuu

SEQ ID NO: 407616 - RNA, 22 nt, Human
guauaugagaaccauggaggug

SEQ ID NO: 407617 - RNA, 22 nt, Human
agguuuauuaaguaaauagagc

SEQ ID NO: 407618 - RNA, 22 nt, Human
uuuacugucucagagagacaaa

SEQ ID NO: 407619 - RNA, 23 nt, Human
ggcugugcagccugcggcaaaag

SEQ ID NO: 407620 - RNA, 22 nt, Human
uucaucugcuucuugauuuugc

SEQ ID NO: 407621 - RNA, 22 nt, Human
cacauuuaagugcuuguucaga

SEQ ID NO: 407622 - RNA, 22 nt, Human
gcacacaugcaugcacaggagu

SEQ ID NO: 407623 - RNA, 22 nt, Human
cagcacagggacaauagcagau

SEQ ID NO: 407624 - RNA, 22 nt, Human
uacuuuuagccuauuugauucu

SEQ ID NO: 407625 - RNA, 22 nt, Human
gaugcauagugaagcugacaga

SEQ ID NO: 407626 - RNA, 22 nt, Human
uuaccuguaaaacugcgauaua

SEQ ID NO: 407627 - RNA, 22 nt, Human
cgcugugccuggcacccagugu

SEQ ID NO: 407628 - RNA, 22 nt, Human
uggaaucuugcgggcacauggc

SEQ ID NO: 407629 - RNA, 22 nt, Human
gaacauuugaugaugacauugg

SEQ ID NO: 407630 - RNA, 22 nt, Human
gcugagaugucguuagauaucu

SEQ ID NO: 407631 - RNA, 22 nt, Human
agugcaugaaagcauacaaggc

SEQ ID NO: 407632 - RNA, 22 nt, Human
gaugaagaggcacugacauauu

SEQ ID NO: 407633 - RNA, 22 nt, Human
uuucugcauauguauguaugga

SEQ ID NO: 407634 - RNA, 20 nt, Human
agacaaaaugacuucaugca

SEQ ID NO: 407635 - RNA, 22 nt, Human
uuuaaauuuguguuuagagggu

SEQ ID NO: 407636 - RNA, 22 nt, Human
gacaucauggagaggacaaaca

SEQ ID NO: 407637 - RNA, 22 nt, Human
auaaacuggguaucaagaggcc

SEQ ID NO: 407638 - RNA, 22 nt, Human
uuucucaaguacugcacaugaa

SEQ ID NO: 407639 - RNA, 22 nt, Human
cuacagugaagacuagcuauag

SEQ ID NO: 407640 - RNA, 22 nt, Human
ugaugaaaauaugauucugagg

SEQ ID NO: 407641 - RNA, 22 nt, Human
uacaacagaccuagaugaauga

SEQ ID NO: 407642 - RNA, 22 nt, Human
uuuguucacauuuaggacucuc

SEQ ID NO: 407643 - RNA, 22 nt, Human
acauucuucuugugaauuuacu

SEQ ID NO: 407644 - RNA, 22 nt, Human
gugaagaaggcaauacaaagaa

SEQ ID NO: 407645 - RNA, 22 nt, Human
uggaaauaugcuccauucuuuu

SEQ ID NO: 407646 - RNA, 22 nt, Human
ccugugcaggcuccauaauaga

SEQ ID NO: 407647 - RNA, 22 nt, Human
acaugaagcaagaaagaugcua

SEQ ID NO: 407648 - RNA, 22 nt, Human
auaaaauuugcuacuguuaaau

SEQ ID NO: 407649 - RNA, 22 nt, Human
uacagagacuuuauggcacaaa

SEQ ID NO: 407650 - RNA, 22 nt, Human
ugacauuucuuguugauauaaa

SEQ ID NO: 407651 - RNA, 22 nt, Human
guauucauuuauuuacucaucc

SEQ ID NO: 407652 - RNA, 21 nt, Human
acagcuaagcaacaacuacug

SEQ ID NO: 407653 - RNA, 22 nt, Human
cuaaccuaguucaacaacuguc

SEQ ID NO: 407654 - RNA, 22 nt, Human
uuuuaucaaucauuaagacauu

SEQ ID NO: 407655 - RNA, 17 nt, Human
gcacagugauauuauuu

SEQ ID NO: 407656 - RNA, 22 nt, Human
ugaagacucagaagcuaagaua

SEQ ID NO: 407657 - RNA, 22 nt, Human
cauuugaagaagaaacguacua

SEQ ID NO: 407658 - RNA, 22 nt, Human
agagaugcugcccgcagacgug

SEQ ID NO: 407659 - RNA, 22 nt, Human
ccugugcauugcaggguguuca

SEQ ID NO: 407660 - RNA, 22 nt, Human
caguuaccaucuucagugauga

SEQ ID NO: 407661 - RNA, 22 nt, Human
ugucauaugcugucauagccau

SEQ ID NO: 407662 - RNA, 22 nt, Human
acugugcacacaaaaauagauu

SEQ ID NO: 407663 - RNA, 22 nt, Human
uuuucucaggugcuuaucuaag

SEQ ID NO: 407664 - RNA, 22 nt, Human
acaacauucuuaaauacacuga

SEQ ID NO: 407665 - RNA, 22 nt, Human
cuguuaagcaacaugaguaagu

SEQ ID NO: 407666 - RNA, 22 nt, Human
augagcaauuaggaagaaaaca

SEQ ID NO: 407667 - RNA, 22 nt, Human
uugaaaguaauaacuuuguuca

SEQ ID NO: 407668 - RNA, 22 nt, Human
aggauuuaggagcuggcuaacg

SEQ ID NO: 407669 - RNA, 22 nt, Human
uuaaugcagaaaucaaacugac

SEQ ID NO: 407670 - RNA, 22 nt, Human
uuucuuauacuauauugucauc

SEQ ID NO: 407671 - RNA, 22 nt, Human
uuuguacaauuagcagaggcua

SEQ ID NO: 407672 - RNA, 22 nt, Human
cuauuacauuucuggacauuca

SEQ ID NO: 407673 - RNA, 19 nt, Human
augcaaauagauuuggaau

SEQ ID NO: 407674 - RNA, 22 nt, Human
cauucauucagcaacuguuauu

SEQ ID NO: 407675 - RNA, 22 nt, Human
uuucacauuggcuucuauuucu

SEQ ID NO: 407676 - RNA, 22 nt, Human
cauaauuugauaugcuugaugg

SEQ ID NO: 407677 - RNA, 22 nt, Human
acauuugagcaucuacuaagug

SEQ ID NO: 407678 - RNA, 22 nt, Human
uuaaaaugaauauugauuagca

SEQ ID NO: 407679 - RNA, 21 nt, Human
uaaaacuguaacuuuguccug

SEQ ID NO: 407680 - RNA, 19 nt, Human
aaauggagcuaaucuuguc

SEQ ID NO: 407681 - RNA, 22 nt, Human
aguuuauagcccagauucaugg

SEQ ID NO: 407682 - RNA, 22 nt, Human
ugcacaguuaauaugugacaga

SEQ ID NO: 407683 - RNA, 22 nt, Human
aguaacaugcuaauuugauuau

SEQ ID NO: 407684 - RNA, 22 nt, Human
uacagugcauagaggcaugaua

SEQ ID NO: 407685 - RNA, 22 nt, Human
acuaugaaaguauaauauugaa

SEQ ID NO: 407686 - RNA, 22 nt, Human
aaauggaucuguggaauacauu

SEQ ID NO: 407687 - RNA, 20 nt, Human
caguggcuucuguggaauau

SEQ ID NO: 407688 - RNA, 22 nt, Human
uacaguaccugccacguuguug

SEQ ID NO: 407689 - RNA, 22 nt, Human
cuacaguagagguugucaggga

SEQ ID NO: 407690 - RNA, 22 nt, Human
aucacaucgaggagcaaucaga

SEQ ID NO: 407691 - RNA, 22 nt, Human
agcugcccuuuaugaugcugaa

SEQ ID NO: 407692 - RNA, 22 nt, Human
ucugugcagauguagaccaguu

SEQ ID NO: 407693 - RNA, 22 nt, Human
uagagcuauacacugaguaaaa

SEQ ID NO: 407694 - RNA, 22 nt, Human
caucaugaagaugagaaagcau

SEQ ID NO: 407695 - RNA, 22 nt, Human
aaauacuguugaaugaaguaag

SEQ ID NO: 407696 - RNA, 22 nt, Human
uacaggaaagaaauuugaacuc

SEQ ID NO: 407697 - RNA, 22 nt, Human
gacaucaugucacuaacugcua

SEQ ID NO: 407698 - RNA, 22 nt, Human
uuuauauccaucuuugaaguaa

SEQ ID NO: 407699 - RNA, 23 nt, Human
agggaaauacugcaauuuuugga

SEQ ID NO: 407700 - RNA, 22 nt, Human
gaugauaacucuuuaugaugaa

SEQ ID NO: 407701 - RNA, 22 nt, Human
cagcacaguacaaggcacggau

SEQ ID NO: 407702 - RNA, 22 nt, Human
agcugugcugccaaguugcuga

SEQ ID NO: 407703 - RNA, 22 nt, Human
aaaacauugaauugcacacuau

SEQ ID NO: 407704 - RNA, 22 nt, Human
aacaugaaguuuucuauaguga

SEQ ID NO: 407705 - RNA, 22 nt, Human
agauuuauguggucacacucag

SEQ ID NO: 407706 - RNA, 22 nt, Human
cauguuaaaauauacauucuga

SEQ ID NO: 407707 - RNA, 22 nt, Human
uuaaagcauguugcuuaacagg

SEQ ID NO: 407708 - RNA, 22 nt, Human
cauuuguaucugggcugcugug

SEQ ID NO: 407709 - RNA, 22 nt, Human
uugcagcuucgagucuaucugu

SEQ ID NO: 407710 - RNA, 21 nt, Human
ugagaugcuagaaggcaggga

SEQ ID NO: 407711 - RNA, 22 nt, Human
cccaggaaugagcaggcagggg

SEQ ID NO: 407712 - RNA, 22 nt, Human
aagugauuuucuucuuaguuau

SEQ ID NO: 407713 - RNA, 22 nt, Human
ggcugugccucuggcagcacau

SEQ ID NO: 407714 - RNA, 22 nt, Human
augauuacauguguuaauauac

SEQ ID NO: 407715 - RNA, 22 nt, Human
uauagaggccaccaacaugaaa

SEQ ID NO: 407716 - RNA, 22 nt, Human
uuuauaguagcaugauuuauag

SEQ ID NO: 407717 - RNA, 22 nt, Human
uuacaguuuaguccaagccaga

SEQ ID NO: 407718 - RNA, 22 nt, Human
ucauuuguugaacuuuagugcg

SEQ ID NO: 407719 - RNA, 22 nt, Human
caugcuguccugaaaagauauu

SEQ ID NO: 407720 - RNA, 22 nt, Human
uucugaaugauagucuugaacu

SEQ ID NO: 407721 - RNA, 22 nt, Human
aauaacagauuuucaagcugug

SEQ ID NO: 407722 - RNA, 22 nt, Human
auuauuguacuuucaauaaggu

SEQ ID NO: 407723 - RNA, 22 nt, Human
ucugucauaagugcugaaguau

SEQ ID NO: 407724 - RNA, 22 nt, Human
auuaaagacagcagauggaugg

SEQ ID NO: 407725 - RNA, 22 nt, Human
ucauuugugugagugauuugac

SEQ ID NO: 407726 - RNA, 22 nt, Human
acuggacagaggaaauauggag

SEQ ID NO: 407727 - RNA, 22 nt, Human
uacaguaggauuuucagggucu

SEQ ID NO: 407728 - RNA, 22 nt, Human
ugauuaaaauuuaacuuaguua

SEQ ID NO: 407729 - RNA, 22 nt, Human
auacaguaauugcauaggcuuc

SEQ ID NO: 407730 - RNA, 22 nt, Human
ugaaacauuaggaaaucauuau

SEQ ID NO: 407731 - RNA, 18 nt, Human
uuuauauggauagagacc

SEQ ID NO: 407732 - RNA, 22 nt, Human
agagcaaagggacauggaagag

SEQ ID NO: 407733 - RNA, 22 nt, Human
uuugugcaagacaugcuaagag

SEQ ID NO: 407734 - RNA, 22 nt, Human
aaucacauuacagcauaucugu

SEQ ID NO: 407735 - RNA, 22 nt, Human
gaagcuaaugauuuauuuucug

SEQ ID NO: 407736 - RNA, 22 nt, Human
gagugaugucuguagugaagaa

SEQ ID NO: 407737 - RNA, 22 nt, Human
agugauuagaaaguacacuugg

SEQ ID NO: 407738 - RNA, 22 nt, Human
agugucagcuaauuauucauga

SEQ ID NO: 407739 - RNA, 22 nt, Human
agacauuuccugugaaccuacu

SEQ ID NO: 407740 - RNA, 22 nt, Human
guguuuuauuggugcagucaga

SEQ ID NO: 407741 - RNA, 22 nt, Human
uuaguuuucccaucuuuauggu

SEQ ID NO: 407742 - RNA, 22 nt, Human
ugcauacacaagcauacaugua

SEQ ID NO: 407743 - RNA, 22 nt, Human
aacauuugaaaaucaagaaucu

SEQ ID NO: 407744 - RNA, 20 nt, Human
aguggcaggcgaucauuacu

SEQ ID NO: 407745 - RNA, 22 nt, Human
ucuaauuuuaggcauuuguuca

SEQ ID NO: 407746 - RNA, 22 nt, Human
auaacauggaguuugucauuua

SEQ ID NO: 407747 - RNA, 22 nt, Human
gcacauaacugaccacaucuaa

SEQ ID NO: 407748 - RNA, 22 nt, Human
uacaacaguaaucaagguuuuu

SEQ ID NO: 407749 - RNA, 22 nt, Human
acacuugauaggucaaaucagu

SEQ ID NO: 407750 - RNA, 22 nt, Human
uucauacauguguacuguucca

SEQ ID NO: 407751 - RNA, 22 nt, Human
uacaggaaggcucuggaggugc

SEQ ID NO: 407752 - RNA, 22 nt, Human
gauuuaaaguagaccuuuguuu

SEQ ID NO: 407753 - RNA, 22 nt, Human
caucaaauuaugugucaaagca

SEQ ID NO: 407754 - RNA, 22 nt, Human
agcugauacauuucuuguagcc

SEQ ID NO: 407755 - RNA, 22 nt, Human
cucauaaagugagaauaugacc

SEQ ID NO: 407756 - RNA, 21 nt, Human
aaacuagaguguggcaaagcu

SEQ ID NO: 407757 - RNA, 22 nt, Human
gauuacugucuacuugggauag

SEQ ID NO: 407758 - RNA, 22 nt, Human
aguaugcaaaugucauaagcau

SEQ ID NO: 407759 - RNA, 22 nt, Human
aacauucugguucuaaaaaccu

SEQ ID NO: 407760 - RNA, 22 nt, Human
auaauaacaaugccagaugccu

SEQ ID NO: 407761 - RNA, 19 nt, Human
augaugcagagcugacuca

SEQ ID NO: 407762 - RNA, 22 nt, Human
uuacaacauaugauaggagucu

SEQ ID NO: 407763 - RNA, 22 nt, Human
aauaugcaaagcguguuaucug

SEQ ID NO: 407764 - RNA, 22 nt, Human
ggcugugcuuugcccaaagggc

SEQ ID NO: 407765 - RNA, 22 nt, Human
uaaacagaaagcagauguacuu

SEQ ID NO: 407766 - RNA, 22 nt, Human
uguacauacauagauauacaca

SEQ ID NO: 407767 - RNA, 22 nt, Human
ugcauacauaaagugcuaucau

SEQ ID NO: 407768 - RNA, 22 nt, Human
uaugcacacauuagcacagggu

SEQ ID NO: 407769 - RNA, 22 nt, Human
acaugauuaaaagauuuuaaag

SEQ ID NO: 407770 - RNA, 21 nt, Human
uuucuccaagugacugauucc

SEQ ID NO: 407771 - RNA, 22 nt, Human
cuugauauuuuaaacauacagu

SEQ ID NO: 407772 - RNA, 22 nt, Human
cauguacaaggaugcucagagu

SEQ ID NO: 407773 - RNA, 22 nt, Human
ugagaugcaggagaugggacug

SEQ ID NO: 407774 - RNA, 22 nt, Human
guagaaaaagcaguaagucuca

SEQ ID NO: 407775 - RNA, 22 nt, Human
augcaagauguauagaagacuu

SEQ ID NO: 407776 - RNA, 22 nt, Human
uuguacauucugaaucuguccu

SEQ ID NO: 407777 - RNA, 22 nt, Human
ucaggauuauuucaguggcuuu

SEQ ID NO: 407778 - RNA, 20 nt, Human
gugcugagggcugggcaaug

SEQ ID NO: 407779 - RNA, 22 nt, Human
uguacaugugucuguauaucuu

SEQ ID NO: 407780 - RNA, 22 nt, Human
uauacugaguguguuaaugaug

SEQ ID NO: 407781 - RNA, 21 nt, Human
ucauuugugaucugauuucca

SEQ ID NO: 407782 - RNA, 23 nt, Human
acuuugcauacccaaauuguuuu

SEQ ID NO: 407783 - RNA, 17 nt, Human
ggcugugccaggugaga

SEQ ID NO: 407784 - RNA, 22 nt, Human
uuguuuaauccuuguacccaug

SEQ ID NO: 407785 - RNA, 22 nt, Human
uacagcuagagggcacgugaac

SEQ ID NO: 407786 - RNA, 22 nt, Human
guaguuacccagaacacuggaa

SEQ ID NO: 407787 - RNA, 22 nt, Human
aaacaguuuuuuaagucucuag

SEQ ID NO: 407788 - RNA, 22 nt, Human
auuugcaaagucguaucuguga

SEQ ID NO: 407789 - RNA, 22 nt, Human
agaguuauauugguugagaauu

SEQ ID NO: 407790 - RNA, 23 nt, Human
aaauuauugcucuucaauugccu

SEQ ID NO: 407791 - RNA, 22 nt, Human
aguggaguugaguugauggauu

SEQ ID NO: 407792 - RNA, 22 nt, Human
agagauauauauuuguuuacca

SEQ ID NO: 407793 - RNA, 22 nt, Human
augaacaagagagggaagauuc

SEQ ID NO: 407794 - RNA, 22 nt, Human
acugugcauuugaagggaucau

SEQ ID NO: 407795 - RNA, 22 nt, Human
ucuaugaaccucugcaaugaca

SEQ ID NO: 407796 - RNA, 23 nt, Human
auaaugcaaguggugguaaucug

SEQ ID NO: 407797 - RNA, 22 nt, Human
auaugcaagcacauagaauacu

SEQ ID NO: 407798 - RNA, 22 nt, Human
agacaacaugaucagcaguccu

SEQ ID NO: 407799 - RNA, 22 nt, Human
augcagcuucaggauuaugaug

SEQ ID NO: 407800 - RNA, 22 nt, Human
uuguaaaugaccuuuucuaauu

SEQ ID NO: 407801 - RNA, 22 nt, Human
uucacuuauagggauguuauug

SEQ ID NO: 407802 - RNA, 22 nt, Human
ucugucauuuuguaucuacaug

SEQ ID NO: 407803 - RNA, 22 nt, Human
cacaucauucaauggugauauu

SEQ ID NO: 407804 - RNA, 15 nt, Human
ucugugcagcaaggg

SEQ ID NO: 407805 - RNA, 21 nt, Human
auaaacagcaugugauccaug

SEQ ID NO: 407806 - RNA, 22 nt, Human
aaagugccugacucauaguuag

SEQ ID NO: 407807 - RNA, 22 nt, Human
acauuucagauucaugaaguga

SEQ ID NO: 407808 - RNA, 22 nt, Human
aaagugccuucuauuuuaguga

SEQ ID NO: 407809 - RNA, 22 nt, Human
ggcugugcaccauccaccuccc

SEQ ID NO: 407810 - RNA, 22 nt, Human
uuacuaagagaaguaaauauuu

SEQ ID NO: 407811 - RNA, 22 nt, Human
gauaaacacaaggugauuucau

SEQ ID NO: 407812 - RNA, 22 nt, Human
aauagugcugcuguggacaugg

SEQ ID NO: 407813 - RNA, 22 nt, Human
uacaucauguaagcagaaucau

SEQ ID NO: 407814 - RNA, 22 nt, Human
uuuaagcaaguugacauagcau

SEQ ID NO: 407815 - RNA, 22 nt, Human
uguuagagcuaagauaacaucu

SEQ ID NO: 407816 - RNA, 20 nt, Human
ucagcacagcugacaagguu

SEQ ID NO: 407817 - RNA, 22 nt, Human
auuugcaauuacucaugucauu

SEQ ID NO: 407818 - RNA, 22 nt, Human
uggaaauacuugccauaaaacu

SEQ ID NO: 407819 - RNA, 22 nt, Human
augcacaucacucugaagaaaa

SEQ ID NO: 407820 - RNA, 22 nt, Human
gcugugcagucuuuggugugcc

SEQ ID NO: 407821 - RNA, 22 nt, Human
uagagcaguguuguccaucaga

SEQ ID NO: 407822 - RNA, 22 nt, Human
uguuaaacuguauugcauaagg

SEQ ID NO: 407823 - RNA, 22 nt, Human
cauuugaucuccugaauaaaca

SEQ ID NO: 407824 - RNA, 22 nt, Human
ccugugcauccgguggucauug

SEQ ID NO: 407825 - RNA, 22 nt, Human
aaacagcagcuguuuaauuugc

SEQ ID NO: 407826 - RNA, 22 nt, Human
uuauaugaacuggacuuuagga

SEQ ID NO: 407827 - RNA, 22 nt, Human
uacagugcacauuucuuaggaa

SEQ ID NO: 407828 - RNA, 22 nt, Human
ugcuuugcaaauaauagaaugu

SEQ ID NO: 407829 - RNA, 22 nt, Human
ugagaugcuaaagggcugcuca

SEQ ID NO: 407830 - RNA, 22 nt, Human
aagguauuauugucuauguacu

SEQ ID NO: 407831 - RNA, 20 nt, Human
acauuuuggcauacucucaa

SEQ ID NO: 407832 - RNA, 22 nt, Human
agagguauuagguaauucagua

SEQ ID NO: 407833 - RNA, 22 nt, Human
uugauuuuaaaauagugacacu

SEQ ID NO: 407834 - RNA, 22 nt, Human
ggcugugcccucacauggggca

SEQ ID NO: 407835 - RNA, 22 nt, Human
ugcucauugcugauuuacaugu

SEQ ID NO: 407836 - RNA, 22 nt, Human
aagauuuuuuuccacagacuca

SEQ ID NO: 407837 - RNA, 22 nt, Human
cuaguugaagaggcugucauca

SEQ ID NO: 407838 - RNA, 22 nt, Human
cuacaguaugaaaccuuuacuc

SEQ ID NO: 407839 - RNA, 22 nt, Human
augcagaaagagaauguaaugu

SEQ ID NO: 407840 - RNA, 22 nt, Human
cauuaaacaaccuugaaucaau

SEQ ID NO: 407841 - RNA, 22 nt, Human
guaaacauuuucaucugugccc

SEQ ID NO: 407842 - RNA, 22 nt, Human
uuugauauccuauacaaguaaa

SEQ ID NO: 407843 - RNA, 22 nt, Human
uaugcauagugauuuagaacag

SEQ ID NO: 407844 - RNA, 18 nt, Human
ucauuuugucugccuuug

SEQ ID NO: 407845 - RNA, 22 nt, Human
gucacuguauccagguuccagc

SEQ ID NO: 407846 - RNA, 22 nt, Human
acaguagcuaauauugcauuau

SEQ ID NO: 407847 - RNA, 22 nt, Human
acaacaguaggaaaacaugucu

SEQ ID NO: 407848 - RNA, 22 nt, Human
uagugucagggagugauaaaug

SEQ ID NO: 407849 - RNA, 23 nt, Human
ggagaugcuuaagagugguugag

SEQ ID NO: 407850 - RNA, 22 nt, Human
cauuuagagaagauuacaagga

SEQ ID NO: 407851 - RNA, 22 nt, Human
cuucauuacuugcucguagcac

SEQ ID NO: 407852 - RNA, 22 nt, Human
acagugaugagccggcugaggc

SEQ ID NO: 407853 - RNA, 22 nt, Human
cauguacauucuguagauggag

SEQ ID NO: 407854 - RNA, 22 nt, Human
cauuacaucuuugaugcaguau

SEQ ID NO: 407855 - RNA, 22 nt, Human
aacaugaugacauuguaagcuu

SEQ ID NO: 407856 - RNA, 22 nt, Human
agagugcaugacaugaucuugg

SEQ ID NO: 407857 - RNA, 22 nt, Human
ugagaucucugccuauauggau

SEQ ID NO: 407858 - RNA, 22 nt, Human
acaggauuucaccauguuggcc

SEQ ID NO: 407859 - RNA, 22 nt, Human
auuugauaguaugacagggcag

SEQ ID NO: 407860 - RNA, 21 nt, Human
gcagaauagucucugucuuca

SEQ ID NO: 407861 - RNA, 22 nt, Human
aauagugcuuuuguacauagga

SEQ ID NO: 407862 - RNA, 22 nt, Human
aauguacaaaagucagccaacu

SEQ ID NO: 407863 - RNA, 22 nt, Human
guggaaaugcccccaaauagug

SEQ ID NO: 407864 - RNA, 22 nt, Human
uggaugaaaaaugagaauuuuc

SEQ ID NO: 407865 - RNA, 22 nt, Human
aacauucuaugugcauucagaa

SEQ ID NO: 407866 - RNA, 20 nt, Human
ucugugcaccugcuacaagg

SEQ ID NO: 407867 - RNA, 22 nt, Human
auuacuaugauuugaucauuac

SEQ ID NO: 407868 - RNA, 22 nt, Human
augcaaaugcuagagaauguug

SEQ ID NO: 407869 - RNA, 22 nt, Human
guuaaauucgaugauggauaaa

SEQ ID NO: 407870 - RNA, 18 nt, Human
gcuuugcagaaauacaga

SEQ ID NO: 407871 - RNA, 22 nt, Human
aguaaacagaaagcaagaugau

SEQ ID NO: 407872 - RNA, 22 nt, Human
gacaacagugguuucagguucc

SEQ ID NO: 407873 - RNA, 22 nt, Human
gcacuauagcugcagcacagag

SEQ ID NO: 407874 - RNA, 22 nt, Human
cuguuucauagaguugugaauu

SEQ ID NO: 407875 - RNA, 22 nt, Human
cagaauaaagguacaauugagu

SEQ ID NO: 407876 - RNA, 22 nt, Human
aauguuaguaacuugaguauuu

SEQ ID NO: 407877 - RNA, 22 nt, Human
uugcagcuuagugauguuaucu

SEQ ID NO: 407878 - RNA, 22 nt, Human
gucugcauacaggacaugcaca

SEQ ID NO: 407879 - RNA, 20 nt, Human
cagguauuacuuccuuuaug

SEQ ID NO: 407880 - RNA, 22 nt, Human
uacaucauggugagcaggaggc

SEQ ID NO: 407881 - RNA, 19 nt, Human
acacauuugcacaauccac

SEQ ID NO: 407882 - RNA, 22 nt, Human
augaaacagugaauuagucaag

SEQ ID NO: 407883 - RNA, 22 nt, Human
auucuguuacuuggugaucuuc

SEQ ID NO: 407884 - RNA, 22 nt, Human
ugcagauaauacuagaacuuac

SEQ ID NO: 407885 - RNA, 20 nt, Human
ggagaugccucucaguccau

SEQ ID NO: 407886 - RNA, 22 nt, Human
gagcucagggcauugagcaaga

SEQ ID NO: 407887 - RNA, 22 nt, Human
uaugaacacacuuuggaaguga

SEQ ID NO: 407888 - RNA, 22 nt, Human
aaacaguaaguucuaguauuau

SEQ ID NO: 407889 - RNA, 22 nt, Human
uuuauauguauugacuuugaug

SEQ ID NO: 407890 - RNA, 22 nt, Human
aaggauuaguagguacaguuca

SEQ ID NO: 407891 - RNA, 22 nt, Human
gcaugcugcagggaaugcuugu

SEQ ID NO: 407892 - RNA, 22 nt, Human
cauuugcaaaccaacaagauga

SEQ ID NO: 407893 - RNA, 22 nt, Human
agagguaugguauauuggaaga

SEQ ID NO: 407894 - RNA, 22 nt, Human
ugcagcaaacaggccuucaggg

SEQ ID NO: 407895 - RNA, 22 nt, Human
ucugucaugccacaggacuugg

SEQ ID NO: 407896 - RNA, 22 nt, Human
aaacaggucugaaaauagcuac

SEQ ID NO: 407897 - RNA, 22 nt, Human
uaccuucuaggugaugguuaca

SEQ ID NO: 407898 - RNA, 22 nt, Human
aagacauuuauuugaaucaauu

SEQ ID NO: 407899 - RNA, 22 nt, Human
acauuuaaugauccuacuguga

SEQ ID NO: 407900 - RNA, 22 nt, Human
agaugcagauuuggauucagga

SEQ ID NO: 407901 - RNA, 22 nt, Human
cacagugcuguuuguaaagaga

SEQ ID NO: 407902 - RNA, 22 nt, Human
aguaaacacugucuuuauauau

SEQ ID NO: 407903 - RNA, 22 nt, Human
caauuugacaaguugcauguuu

SEQ ID NO: 407904 - RNA, 22 nt, Human
ucugugcaggaagucauuauga

SEQ ID NO: 407905 - RNA, 20 nt, Human
uauuuacaacuuagagccuc

SEQ ID NO: 407906 - RNA, 22 nt, Human
auuuaaaugcuuaagaggguuu

SEQ ID NO: 407907 - RNA, 22 nt, Human
ugaguaaagggccagauaguaa

SEQ ID NO: 407908 - RNA, 22 nt, Human
uguguacacagauaguaauggc

SEQ ID NO: 407909 - RNA, 22 nt, Human
uuuauaugguugacuaugaguu

SEQ ID NO: 407910 - RNA, 22 nt, Human
acaggauuaauaaaaaauugua

SEQ ID NO: 407911 - RNA, 22 nt, Human
acuauuagcauaucaugaaugg

SEQ ID NO: 407912 - RNA, 22 nt, Human
ugagcuuuguuguuaguauauu

SEQ ID NO: 407913 - RNA, 22 nt, Human
aauggcacuuuauaaauguuaa

SEQ ID NO: 407914 - RNA, 22 nt, Human
uguauaaaccauggacagcuuu

SEQ ID NO: 407915 - RNA, 22 nt, Human
uugcugugucauuuguuuaauc

SEQ ID NO: 407916 - RNA, 22 nt, Human
ugcagaugagggaugaaaauga

SEQ ID NO: 407917 - RNA, 22 nt, Human
uaacauugucaguucaacugcu

SEQ ID NO: 407918 - RNA, 22 nt, Human
cauuuguaucauauguaucuua

SEQ ID NO: 407919 - RNA, 22 nt, Human
aaauacuggcaagugcuaauuc

SEQ ID NO: 407920 - RNA, 22 nt, Human
auaaaaugguaaacgaagcuga

SEQ ID NO: 407921 - RNA, 22 nt, Human
agaaagagcucgggauuaacag

SEQ ID NO: 407922 - RNA, 23 nt, Human
acaugauacacaauuagcaaacc

SEQ ID NO: 407923 - RNA, 22 nt, Human
uuuguacacugucuacuaugaa

SEQ ID NO: 407924 - RNA, 22 nt, Human
uuugauacugagaaaaacaaau

SEQ ID NO: 407925 - RNA, 19 nt, Human
aacaucauggcucuuucca

SEQ ID NO: 407926 - RNA, 22 nt, Human
uucuuuuacauuaagauuucag

SEQ ID NO: 407927 - RNA, 19 nt, Human
cuuugucagaacaugcuuc

SEQ ID NO: 407928 - RNA, 22 nt, Human
acugugcaaaugacaggcacac

SEQ ID NO: 407929 - RNA, 22 nt, Human
uuaaaugugauuucauuuaugu

SEQ ID NO: 407930 - RNA, 22 nt, Human
uucaggauggcggauguugggg

SEQ ID NO: 407931 - RNA, 22 nt, Human
aaguacauguuguucaaaagcc

SEQ ID NO: 407932 - RNA, 17 nt, Human
uuacaacaauucaugag

SEQ ID NO: 407933 - RNA, 19 nt, Human
uugaaauuguuugauaugg

SEQ ID NO: 407934 - RNA, 22 nt, Human
augcugagaaacagacguguug

SEQ ID NO: 407935 - RNA, 22 nt, Human
cuggcuuuggaaacaauuuauc

SEQ ID NO: 407936 - RNA, 22 nt, Human
ggcugugcgucauccggcugca

SEQ ID NO: 407937 - RNA, 17 nt, Human
ugcaaacaaucacauau

SEQ ID NO: 407938 - RNA, 23 nt, Human
acaucagaguuaguucaaucagg

SEQ ID NO: 407939 - RNA, 22 nt, Human
caugcugugcaucuugaugacc

SEQ ID NO: 407940 - RNA, 21 nt, Human
gcugugcacauaguagaagug

SEQ ID NO: 407941 - RNA, 22 nt, Human
uggaaauagcuccaguuaagca

SEQ ID NO: 407942 - RNA, 22 nt, Human
auuuacauuuauuugagaaggu

SEQ ID NO: 407943 - RNA, 22 nt, Human
aaucuugaguaucagaccaaga

SEQ ID NO: 407944 - RNA, 22 nt, Human
aagacauugucauuuuauaauu

SEQ ID NO: 407945 - RNA, 22 nt, Human
ugaagaaaggugugggauacuc

SEQ ID NO: 407946 - RNA, 22 nt, Human
gcugugcaaaucgauuuguugg

SEQ ID NO: 407947 - RNA, 22 nt, Human
uguuaaaccuaguacagguccu

SEQ ID NO: 407948 - RNA, 22 nt, Human
agagguauuagauuugcauagg

SEQ ID NO: 407949 - RNA, 22 nt, Human
caguagcuugcuuaggcuuuua

SEQ ID NO: 407950 - RNA, 22 nt, Human
acuucauauggacagcaaacua

SEQ ID NO: 407951 - RNA, 22 nt, Human
acauuuugagaaaugacaagcu

SEQ ID NO: 407952 - RNA, 22 nt, Human
aucacaucucaccacugcaacc

SEQ ID NO: 407953 - RNA, 20 nt, Human
auacaguaggugcucaauau

SEQ ID NO: 407954 - RNA, 23 nt, Human
gggggccguccuggggauuauag

SEQ ID NO: 407955 - RNA, 19 nt, Human
ugauucaucuaacugccuc

SEQ ID NO: 407956 - RNA, 22 nt, Human
augcugagguuguuguccuauu

SEQ ID NO: 407957 - RNA, 22 nt, Human
cagcaaaguaagcugacaugua

SEQ ID NO: 407958 - RNA, 22 nt, Human
aguaaacacuaaaaugacugcg

SEQ ID NO: 407959 - RNA, 22 nt, Human
agggaaauuaaugugagcaaug

SEQ ID NO: 407960 - RNA, 22 nt, Human
cuaaacaugcaagagcuucugg

SEQ ID NO: 407961 - RNA, 22 nt, Human
aaacacguauaaugugacagag

SEQ ID NO: 407962 - RNA, 22 nt, Human
uuugauucuguaaaauaacagg

SEQ ID NO: 407963 - RNA, 22 nt, Human
uuauauacugugguaguacugu

SEQ ID NO: 407964 - RNA, 22 nt, Human
agagaugcaucucuuaaaauug

SEQ ID NO: 407965 - RNA, 22 nt, Human
gcuggagaugcuaugcagaggg

SEQ ID NO: 407966 - RNA, 22 nt, Human
uuucucaaccucaacacuauuu

SEQ ID NO: 407967 - RNA, 22 nt, Human
ugcugugcaaaggugaugugag

SEQ ID NO: 407968 - RNA, 22 nt, Human
uacuggcaauuucauauggugc

SEQ ID NO: 407969 - RNA, 22 nt, Human
guuuauauucaacggaguaucu

SEQ ID NO: 407970 - RNA, 22 nt, Human
agaggaauaugggugcacuaga

SEQ ID NO: 407971 - RNA, 22 nt, Human
auaggaaagaaaauuauguagg

SEQ ID NO: 407972 - RNA, 19 nt, Human
ugcugcuguccuugcaggg

SEQ ID NO: 407973 - RNA, 22 nt, Human
aacaucauuauguccauuaaug

SEQ ID NO: 407974 - RNA, 22 nt, Human
caugaaauguuagaauuagaca

SEQ ID NO: 407975 - RNA, 23 nt, Human
ccacuagcaccuguucaacuucu

SEQ ID NO: 407976 - RNA, 22 nt, Human
ugcagcaagaccggauaugucg

SEQ ID NO: 407977 - RNA, 18 nt, Human
auguacauuugcuaaagc

SEQ ID NO: 407978 - RNA, 22 nt, Human
uacaugaauguuucaauauugu

SEQ ID NO: 407979 - RNA, 22 nt, Human
augauuacucccauuugauaga

SEQ ID NO: 407980 - RNA, 18 nt, Human
uacaggaaaaguguuaca

SEQ ID NO: 407981 - RNA, 22 nt, Human
acagcacaggaguugaaugggc

SEQ ID NO: 407982 - RNA, 22 nt, Human
aaaacuuagcuaggcaaguuuu

SEQ ID NO: 407983 - RNA, 22 nt, Human
aaaauugagagucuugugcaag

SEQ ID NO: 407984 - RNA, 22 nt, Human
cugccuuugugaucaguucuuu

SEQ ID NO: 407985 - RNA, 22 nt, Human
cuugcuacuaugccuggcuaau

SEQ ID NO: 407986 - RNA, 22 nt, Human
aaacaugaugccuguacuaaga

SEQ ID NO: 407987 - RNA, 21 nt, Human
uguaaguuucaucugaauugg

SEQ ID NO: 407988 - RNA, 22 nt, Human
gcugugcagugggaguucggug

SEQ ID NO: 407989 - RNA, 22 nt, Human
cugcacaaugcaccaucaaguu

SEQ ID NO: 407990 - RNA, 22 nt, Human
aaacaugaugucauauaugcca

SEQ ID NO: 407991 - RNA, 22 nt, Human
aguuugauggcuuaauaguaga

SEQ ID NO: 407992 - RNA, 22 nt, Human
auacaguagggaccaugucuga

SEQ ID NO: 407993 - RNA, 22 nt, Human
uaggauuauuuguucuauuucu

SEQ ID NO: 407994 - RNA, 22 nt, Human
ggcugugcagggcagagucuca

SEQ ID NO: 407995 - RNA, 22 nt, Human
agagaugcauucagcauggaug

SEQ ID NO: 407996 - RNA, 22 nt, Human
auuaacaugcagccagacacac

SEQ ID NO: 407997 - RNA, 19 nt, Human
uuuucucagcuucuagcgg

SEQ ID NO: 407998 - RNA, 22 nt, Human
auauaauucucagguuugacua

SEQ ID NO: 407999 - RNA, 22 nt, Human
ugcauaaaauaugagaaaugua

SEQ ID NO: 408000 - RNA, 22 nt, Human
uucaggauaugugauaucugaa

SEQ ID NO: 408001 - RNA, 22 nt, Human
cagguauuuucaaggcuugugu

SEQ ID NO: 408002 - RNA, 22 nt, Human
ucuuacauauagcaugaguaca

SEQ ID NO: 408003 - RNA, 22 nt, Human
aagguauuggucuggucuuccu

SEQ ID NO: 408004 - RNA, 22 nt, Human
uguucagaacaaagguaaauga

SEQ ID NO: 408005 - RNA, 22 nt, Human
caauuacugguccacagaaauu

SEQ ID NO: 408006 - RNA, 22 nt, Human
augaacaaucuguugacuucug

SEQ ID NO: 408007 - RNA, 22 nt, Human
aagcagcauaugacagcaucca

SEQ ID NO: 408008 - RNA, 22 nt, Human
augcuuuuccaggagaaauaua

SEQ ID NO: 408009 - RNA, 22 nt, Human
auuugcauaucugauagacuaa

SEQ ID NO: 408010 - RNA, 22 nt, Human
ucacuacaaaagucucccuuuc

SEQ ID NO: 408011 - RNA, 22 nt, Human
aaugugaaaccgcacagaauaa

SEQ ID NO: 408012 - RNA, 22 nt, Human
gucuugaaauucuguuaaagga

SEQ ID NO: 408013 - RNA, 22 nt, Human
augagcagaugcuccugccucu

SEQ ID NO: 408014 - RNA, 22 nt, Human
uauaggauugguucccauuuua

SEQ ID NO: 408015 - RNA, 20 nt, Human
ucugugcaguggaggggcag

SEQ ID NO: 408016 - RNA, 22 nt, Human
ucugugcauccuuaacgccugc

SEQ ID NO: 408017 - RNA, 22 nt, Human
cagcacagcuggcucuggaagc

SEQ ID NO: 408018 - RNA, 22 nt, Human
uaugcauagguaucuauacuca

SEQ ID NO: 408019 - RNA, 22 nt, Human
gauuacaauucagguugauaag

SEQ ID NO: 408020 - RNA, 22 nt, Human
gacaucauagggugggaggaaa

SEQ ID NO: 408021 - RNA, 22 nt, Human
auucucaaaacauaacuucacu

SEQ ID NO: 408022 - RNA, 22 nt, Human
aagacauuggacaauccagagg

SEQ ID NO: 408023 - RNA, 22 nt, Human
gaagauugaaggcugggaauua

SEQ ID NO: 408024 - RNA, 22 nt, Human
uugaauucauuucucauugagu

SEQ ID NO: 408025 - RNA, 22 nt, Human
cuaacauuuauugagcacuuag

SEQ ID NO: 408026 - RNA, 22 nt, Human
aacagugaguugaugacugaau

SEQ ID NO: 408027 - RNA, 22 nt, Human
ucaaucacguguuccauguucu

SEQ ID NO: 408028 - RNA, 22 nt, Human
aaauggaagaagugcaauacug

SEQ ID NO: 408029 - RNA, 18 nt, Human
uuacacuagccuugguuc

SEQ ID NO: 408030 - RNA, 22 nt, Human
uacaguagacaggaccacaggc

SEQ ID NO: 408031 - RNA, 22 nt, Human
guauuaguuaucuacugcugug

SEQ ID NO: 408032 - RNA, 22 nt, Human
cacggucacccaucagagucca

SEQ ID NO: 408033 - RNA, 22 nt, Human
aauaugcauuauacagacugau

SEQ ID NO: 408034 - RNA, 22 nt, Human
ugcaaauccuguuuggaguaag

SEQ ID NO: 408035 - RNA, 22 nt, Human
agauuuugucucaauacuucug

SEQ ID NO: 408036 - RNA, 22 nt, Human
auuacuagauugucaagauuua

SEQ ID NO: 408037 - RNA, 22 nt, Human
uuucacauuuaggcgugaauug

SEQ ID NO: 408038 - RNA, 22 nt, Human
ucuguuuagacucaguugaaac

SEQ ID NO: 408039 - RNA, 22 nt, Human
aaagcacauaguagaaggauuu

SEQ ID NO: 408040 - RNA, 22 nt, Human
cagcagcauugcucuggauucc

SEQ ID NO: 408041 - RNA, 22 nt, Human
uacagugacagauagggauaga

SEQ ID NO: 408042 - RNA, 22 nt, Human
gauguaaaaacuccuuucgaaa

SEQ ID NO: 408043 - RNA, 22 nt, Human
uuuaucuuuaggacuuugcaga

SEQ ID NO: 408044 - RNA, 22 nt, Human
auguaaacaagguuauugucca

SEQ ID NO: 408045 - RNA, 22 nt, Human
ugauuucucuuggcaauauguu

SEQ ID NO: 408046 - RNA, 22 nt, Human
gacaacaggcagacgucagaaa

SEQ ID NO: 408047 - RNA, 22 nt, Human
uuucacaucagagguagauuag

SEQ ID NO: 408048 - RNA, 22 nt, Human
acauaugaguacuauacagugc

SEQ ID NO: 408049 - RNA, 22 nt, Human
uuagaucauuuuagcuaaaugg

SEQ ID NO: 408050 - RNA, 22 nt, Human
ucaucauaauauggaaucuugu

SEQ ID NO: 408051 - RNA, 22 nt, Human
uuugaugaguuuaauaacagcc

SEQ ID NO: 408052 - RNA, 22 nt, Human
uaucaguagauaaacggauugc

SEQ ID NO: 408053 - RNA, 22 nt, Human
aaauggaacugggcuacuaggu

SEQ ID NO: 408054 - RNA, 22 nt, Human
ugagcagaguuguuucuccuga

SEQ ID NO: 408055 - RNA, 22 nt, Human
acaucaguccaccacugcaguu

SEQ ID NO: 408056 - RNA, 22 nt, Human
ugcaaacaauuuccuauaaagu

SEQ ID NO: 408057 - RNA, 22 nt, Human
ucuugcaggcggcucagcaacc

SEQ ID NO: 408058 - RNA, 22 nt, Human
augaaacaugcuuuguggauga

SEQ ID NO: 408059 - RNA, 22 nt, Human
guuuacauuaaguauuagcauc

SEQ ID NO: 408060 - RNA, 22 nt, Human
cugagcugagccaaaucugucu

SEQ ID NO: 408061 - RNA, 22 nt, Human
auuaaacaauguaaaguucuug

SEQ ID NO: 408062 - RNA, 22 nt, Human
uuauuuacaacucuucucuucc

SEQ ID NO: 408063 - RNA, 22 nt, Human
uugugcagcuauaaagaaaugg

SEQ ID NO: 408064 - RNA, 22 nt, Human
gcaaauaauauacuuugaucuc

SEQ ID NO: 408065 - RNA, 22 nt, Human
agacauuuauguuucucuagga

SEQ ID NO: 408066 - RNA, 22 nt, Human
uguacauagaucuugaaaauua

SEQ ID NO: 408067 - RNA, 22 nt, Human
uuuaaauuauaguuaaugucug

SEQ ID NO: 408068 - RNA, 22 nt, Human
uccauguuucagcaucuacauc

SEQ ID NO: 408069 - RNA, 22 nt, Human
cucauuuauguaaugauuaagg

SEQ ID NO: 408070 - RNA, 18 nt, Human
uuaugcaaaacuguuuuc

SEQ ID NO: 408071 - RNA, 22 nt, Human
uuagagcaggaguugacagauu

SEQ ID NO: 408072 - RNA, 22 nt, Human
uaaaacagcagggcagagaagu

SEQ ID NO: 408073 - RNA, 22 nt, Human
auuuugcacacuaugcagcuuu

SEQ ID NO: 408074 - RNA, 23 nt, Human
acugauuaacaugugugauauuc

SEQ ID NO: 408075 - RNA, 19 nt, Human
aggucauugauagugcagg

SEQ ID NO: 408076 - RNA, 22 nt, Human
uuaugcaaaggggccucuuccu

SEQ ID NO: 408077 - RNA, 20 nt, Human
auacacaugcagacagaugc

SEQ ID NO: 408078 - RNA, 22 nt, Human
ucauuguuucugcuuuucauga

SEQ ID NO: 408079 - RNA, 22 nt, Human
gcugaugcaggguugagaggag

SEQ ID NO: 408080 - RNA, 22 nt, Human
aaugcaaacuucuuguuacuug

SEQ ID NO: 408081 - RNA, 22 nt, Human
ggcugugcuugguguccuugga

SEQ ID NO: 408082 - RNA, 22 nt, Human
gauacaguguguuaacgagaaa

SEQ ID NO: 408083 - RNA, 22 nt, Human
caggacaucgucaucaugggga

SEQ ID NO: 408084 - RNA, 22 nt, Human
gucaucauuuuuagcauauggg

SEQ ID NO: 408085 - RNA, 22 nt, Human
ugcauaaacagauacuucaugu

SEQ ID NO: 408086 - RNA, 22 nt, Human
aguaacauuuagcuucucacug

SEQ ID NO: 408087 - RNA, 22 nt, Human
auguuauuaaaguacagauucu

SEQ ID NO: 408088 - RNA, 22 nt, Human
uugagcaaugcugcaaagagau

SEQ ID NO: 408089 - RNA, 22 nt, Human
uggggcagggaugggaaacuau

SEQ ID NO: 408090 - RNA, 22 nt, Human
agaggauugaucaaacacugca

SEQ ID NO: 408091 - RNA, 22 nt, Human
ugaguaaauauuuaugacuaga

SEQ ID NO: 408092 - RNA, 17 nt, Human
cuuauacuuuacggaag

SEQ ID NO: 408093 - RNA, 22 nt, Human
uucaucuggucuaguuuuuagu

SEQ ID NO: 408094 - RNA, 22 nt, Human
ucugugcaccuucuaaugagua

SEQ ID NO: 408095 - RNA, 23 nt, Human
uuuguacauugaggaggcagaau

SEQ ID NO: 408096 - RNA, 22 nt, Human
ugagaugcugggaacaaggaag

SEQ ID NO: 408097 - RNA, 22 nt, Human
uuuguacauguaagauugcauc

SEQ ID NO: 408098 - RNA, 22 nt, Human
aaaacagacagccaguguagag

SEQ ID NO: 408099 - RNA, 22 nt, Human
uucaggaugaaagugugcaaca

SEQ ID NO: 408100 - RNA, 22 nt, Human
caauuacuuuugcaccaauaua

SEQ ID NO: 408101 - RNA, 22 nt, Human
auguacauuuguaguaauauca

SEQ ID NO: 408102 - RNA, 22 nt, Human
ugucauuaguuucagccauucu

SEQ ID NO: 408103 - RNA, 22 nt, Human
ccugugcauugaccacacucuc

SEQ ID NO: 408104 - RNA, 22 nt, Human
ucugugcaauaguuuguuuuac

SEQ ID NO: 408105 - RNA, 23 nt, Human
ugcugugccuuugucugccucca

SEQ ID NO: 408106 - RNA, 22 nt, Human
uacagaccaguaguucucagcg

SEQ ID NO: 408107 - RNA, 22 nt, Human
uuugaucaugaagaggauaaac

SEQ ID NO: 408108 - RNA, 22 nt, Human
acaaauggagaaacugaggccc

SEQ ID NO: 408109 - RNA, 22 nt, Human
uacagucagagugccuuucuaa

SEQ ID NO: 408110 - RNA, 22 nt, Human
augcacuacuagaugcaaaagu

SEQ ID NO: 408111 - RNA, 22 nt, Human
auacacguguguguacaugcac

SEQ ID NO: 408112 - RNA, 22 nt, Human
aaacuagaaaucagcaagauag

SEQ ID NO: 408113 - RNA, 22 nt, Human
acaauuacccuggcuugauaaa

SEQ ID NO: 408114 - RNA, 22 nt, Human
agugcucaugcacauuuauagu

SEQ ID NO: 408115 - RNA, 22 nt, Human
uuugucaaucccuugaaaaccu

SEQ ID NO: 408116 - RNA, 19 nt, Human
agaaaaacugguacugcug

SEQ ID NO: 408117 - RNA, 22 nt, Human
gcaagaaaaaggcuucaugaac

SEQ ID NO: 408118 - RNA, 22 nt, Human
aguaaacauagaauguucuucc

SEQ ID NO: 408119 - RNA, 18 nt, Human
aaacagugccuaaguguc

SEQ ID NO: 408120 - RNA, 22 nt, Human
uuucacauacaguguauaguag

SEQ ID NO: 408121 - RNA, 22 nt, Human
uuuguucaauccagacaauagc

SEQ ID NO: 408122 - RNA, 22 nt, Human
gcugugcauaaguauaauaaac

SEQ ID NO: 408123 - RNA, 22 nt, Human
cagcacaggaauaugguggaca

SEQ ID NO: 408124 - RNA, 22 nt, Human
uucagaaauucauggaguucag

SEQ ID NO: 408125 - RNA, 22 nt, Human
auauuacuuccugguauaaaau

SEQ ID NO: 408126 - RNA, 22 nt, Human
auaugaauuuggcuggaaaggu

SEQ ID NO: 408127 - RNA, 22 nt, Human
uuucucaacuguauuaugcaga

SEQ ID NO: 408128 - RNA, 22 nt, Human
ucaucuuaggugaugagacagu

SEQ ID NO: 408129 - RNA, 22 nt, Human
ggacaucuugguugcuuccaag

SEQ ID NO: 408130 - RNA, 22 nt, Human
cauuuguaguaucuguuuauau

SEQ ID NO: 408131 - RNA, 22 nt, Human
auguuuaagaaagucuuccaua

SEQ ID NO: 408132 - RNA, 22 nt, Human
aagguuuauuaaaaguugaugg

SEQ ID NO: 408133 - RNA, 22 nt, Human
cacaucauguuaauucauuaca

SEQ ID NO: 408134 - RNA, 22 nt, Human
ugauuacacaccacagugcucc

SEQ ID NO: 408135 - RNA, 22 nt, Human
aauaacaggguugauuugcaau

SEQ ID NO: 408136 - RNA, 17 nt, Human
ugaugcaaagucagcug

SEQ ID NO: 408137 - RNA, 22 nt, Human
auugagcagcuucucugccauc

SEQ ID NO: 408138 - RNA, 21 nt, Human
gcugugcaggugccccugcuc

SEQ ID NO: 408139 - RNA, 22 nt, Human
aagcauuuuucacagcaacagc

SEQ ID NO: 408140 - RNA, 22 nt, Human
aauaacagaaacuugagcauca

SEQ ID NO: 408141 - RNA, 22 nt, Human
cugagcugguggaagcaugcag

SEQ ID NO: 408142 - RNA, 22 nt, Human
ucuauguaaagccauauugaua

SEQ ID NO: 408143 - RNA, 22 nt, Human
uuucaaauagaaucuuuccaaa

SEQ ID NO: 408144 - RNA, 22 nt, Human
gcgucaauuccaucauucuucu

SEQ ID NO: 408145 - RNA, 22 nt, Human
ucauaacagcuaagucccuuuc

SEQ ID NO: 408146 - RNA, 22 nt, Human
auguaaacuuagauaagcagua

SEQ ID NO: 408147 - RNA, 22 nt, Human
acauuagaacauuaauauuggg

SEQ ID NO: 408148 - RNA, 22 nt, Human
uugcacaucuaauaaugcuaga

SEQ ID NO: 408149 - RNA, 22 nt, Human
acugauuaaaaacagacauuua

SEQ ID NO: 408150 - RNA, 22 nt, Human
acaguuugagaaccacuagccu

SEQ ID NO: 408151 - RNA, 22 nt, Human
ggagaugcuucuuguguuuauu

SEQ ID NO: 408152 - RNA, 22 nt, Human
acauuuagcuguacaaucuaug

SEQ ID NO: 408153 - RNA, 22 nt, Human
aacacaguccugcucacuuauu

SEQ ID NO: 408154 - RNA, 22 nt, Human
gauacauaaaaaugugcucuau

SEQ ID NO: 408155 - RNA, 22 nt, Human
augcagaagcagaacuuacaca

SEQ ID NO: 408156 - RNA, 22 nt, Human
ugauuuaugaccaaguuagaau

SEQ ID NO: 408157 - RNA, 22 nt, Human
ccugugcacuaucugcauuuuu

SEQ ID NO: 408158 - RNA, 22 nt, Human
acagugaaugcccaagaaaagu

SEQ ID NO: 408159 - RNA, 23 nt, Human
auguuauuauuagcagucuugcc

SEQ ID NO: 408160 - RNA, 23 nt, Human
auggaaauagcaugugucauuua

SEQ ID NO: 408161 - RNA, 20 nt, Human
ucacaggagggaaggcaggu

SEQ ID NO: 408162 - RNA, 20 nt, Human
agcauuugaaauaugacuau

SEQ ID NO: 408163 - RNA, 22 nt, Human
acugugcagcugagugcuaauu

SEQ ID NO: 408164 - RNA, 22 nt, Human
uucacuguccugcaacucuaga

SEQ ID NO: 408165 - RNA, 22 nt, Human
cauuuguacagaacagcuuuau

SEQ ID NO: 408166 - RNA, 22 nt, Human
uucauacauuuuuacuaacagc

SEQ ID NO: 408167 - RNA, 22 nt, Human
acaauucuggguauuuauauag

SEQ ID NO: 408168 - RNA, 22 nt, Human
uuuauauguuuguacaauuaag

SEQ ID NO: 408169 - RNA, 22 nt, Human
uugcaagaaauaaucgaauaga

SEQ ID NO: 408170 - RNA, 22 nt, Human
uugcagcuucuaccacuguuuc

SEQ ID NO: 408171 - RNA, 22 nt, Human
aacagugcugcauucauugagc

SEQ ID NO: 408172 - RNA, 22 nt, Human
acugugcaaugaguaauaaacu

SEQ ID NO: 408173 - RNA, 22 nt, Human
aauuacugaugccuguguucca

SEQ ID NO: 408174 - RNA, 22 nt, Human
cacaucauagagacucaaucca

SEQ ID NO: 408175 - RNA, 22 nt, Human
agcugcuugggaaccaucaauu

SEQ ID NO: 408176 - RNA, 22 nt, Human
aauacugccugugagguaacuc

SEQ ID NO: 408177 - RNA, 22 nt, Human
auucauuuagguauucacuuac

SEQ ID NO: 408178 - RNA, 20 nt, Human
uaacugaucauuuucaccag

SEQ ID NO: 408179 - RNA, 22 nt, Human
acugagcugugacaaugcuuaa

SEQ ID NO: 408180 - RNA, 22 nt, Human
auuaaauuggaucugcauaguu

SEQ ID NO: 408181 - RNA, 22 nt, Human
aagcauuucuguuuaucuaucg

SEQ ID NO: 408182 - RNA, 22 nt, Human
agugagcaguacuuacuccugc

SEQ ID NO: 408183 - RNA, 22 nt, Human
auuaaauuggacgcugggggaa

SEQ ID NO: 408184 - RNA, 22 nt, Human
aucuucaucaaguucacagugg

SEQ ID NO: 408185 - RNA, 22 nt, Human
ugauuagacaaaggaaucaugc

SEQ ID NO: 408186 - RNA, 22 nt, Human
auuauaugugggauagaauuua

SEQ ID NO: 408187 - RNA, 22 nt, Human
ugagcagacuugaugaggcagc

SEQ ID NO: 408188 - RNA, 22 nt, Human
acaaauggaagguguucucuuc

SEQ ID NO: 408189 - RNA, 22 nt, Human
agacauuuauugaacaccuagc

SEQ ID NO: 408190 - RNA, 22 nt, Human
aaacaguuuauaacaugauacu

SEQ ID NO: 408191 - RNA, 22 nt, Human
cagcacagugcagaugcugacu

SEQ ID NO: 408192 - RNA, 22 nt, Human
uugaaacauucuccuauugauu

SEQ ID NO: 408193 - RNA, 22 nt, Human
cagcacagaguauuuuauugau

SEQ ID NO: 408194 - RNA, 22 nt, Human
uucauuuaauuuguguauuaac

SEQ ID NO: 408195 - RNA, 22 nt, Human
agacauuuggaagauacacaua

SEQ ID NO: 408196 - RNA, 21 nt, Human
cccugcuuggggcagaacaac

SEQ ID NO: 408197 - RNA, 22 nt, Human
cauguauacaguagaauacuau

SEQ ID NO: 408198 - RNA, 22 nt, Human
uuaaacacacugagauuuaugu

SEQ ID NO: 408199 - RNA, 22 nt, Human
accuguuuucagaaaaugcaga

SEQ ID NO: 408200 - RNA, 22 nt, Human
ugauggaaaauaaaucuuauuc

SEQ ID NO: 408201 - RNA, 22 nt, Human
uaaauuguuuucuagaaguugu

SEQ ID NO: 408202 - RNA, 22 nt, Human
caggacacagaauaaggcaguu

SEQ ID NO: 408203 - RNA, 22 nt, Human
ucugucauuucauucauaugaa

SEQ ID NO: 408204 - RNA, 22 nt, Human
gaggucaugcaaaauugaauca

SEQ ID NO: 408205 - RNA, 22 nt, Human
gaacuguaguuaauacuacaca

SEQ ID NO: 408206 - RNA, 22 nt, Human
cuaauuguaagcuccuugaggg

SEQ ID NO: 408207 - RNA, 18 nt, Human
auaauaggagauaaaaau

SEQ ID NO: 408208 - RNA, 22 nt, Human
aacagagcugaccagugagggc

SEQ ID NO: 408209 - RNA, 22 nt, Human
cuguuuaaccagaucucauauc

SEQ ID NO: 408210 - RNA, 22 nt, Human
aaacuagagauggcagguggaa

SEQ ID NO: 408211 - RNA, 22 nt, Human
uauaugcagauuuucaucaucg

SEQ ID NO: 408212 - RNA, 22 nt, Human
augaaaacagccuccugugaua

SEQ ID NO: 408213 - RNA, 22 nt, Human
uuugagcagcagaugcacuuag

SEQ ID NO: 408214 - RNA, 20 nt, Human
ugcuauauugaagugcaguu

SEQ ID NO: 408215 - RNA, 22 nt, Human
aacuagaacgagaaagcugaac

SEQ ID NO: 408216 - RNA, 22 nt, Human
uauuuacuuuuaaauugagaac

SEQ ID NO: 408217 - RNA, 22 nt, Human
cauucucaauaguagaugagua

SEQ ID NO: 408218 - RNA, 22 nt, Human
uaagcauuaacucugcugcaag

SEQ ID NO: 408219 - RNA, 22 nt, Human
auuuggcaacauuaauugaauc

SEQ ID NO: 408220 - RNA, 22 nt, Human
ucuuuauaaaagucauuauguc

SEQ ID NO: 408221 - RNA, 22 nt, Human
aaauagauuuccuagcauugga

SEQ ID NO: 408222 - RNA, 22 nt, Human
aauguggaugauacuaguacuu

SEQ ID NO: 408223 - RNA, 22 nt, Human
aguaaacauuucagauuuauuu

SEQ ID NO: 408224 - RNA, 22 nt, Human
auuugaaccacucagaacucau

SEQ ID NO: 408225 - RNA, 22 nt, Human
auuuggucacaccaguccacau

SEQ ID NO: 408226 - RNA, 22 nt, Human
agagaugcgguuccaugguuau

SEQ ID NO: 408227 - RNA, 22 nt, Human
uggauaaauagauacacuugca

SEQ ID NO: 408228 - RNA, 22 nt, Human
ugcagugauuuguacaauuaga

SEQ ID NO: 408229 - RNA, 22 nt, Human
cauaacauuaagccucuauuuc

SEQ ID NO: 408230 - RNA, 23 nt, Human
guguucaucccagucugugcaau

SEQ ID NO: 408231 - RNA, 22 nt, Human
acauuugagucauauuugcuua

SEQ ID NO: 408232 - RNA, 22 nt, Human
aaugugaggccuugguaguuau

SEQ ID NO: 408233 - RNA, 22 nt, Human
uaaaaugguaacuuucauuugc

SEQ ID NO: 408234 - RNA, 22 nt, Human
acauuugagcauauuucuuguc

SEQ ID NO: 408235 - RNA, 22 nt, Human
ucacaucacuagcugguaauga

SEQ ID NO: 408236 - RNA, 22 nt, Human
aauuuuguucuuggaaaucagg

SEQ ID NO: 408237 - RNA, 22 nt, Human
gucaaacagccuccuguucuaa

SEQ ID NO: 408238 - RNA, 22 nt, Human
acaguggagcucagaugaaaau

SEQ ID NO: 408239 - RNA, 20 nt, Human
uacaggaaucaagacugcau

SEQ ID NO: 408240 - RNA, 22 nt, Human
aguaaacauguaauuguucauu

SEQ ID NO: 408241 - RNA, 22 nt, Human
uagcagcuggggcuauucauca

SEQ ID NO: 408242 - RNA, 22 nt, Human
auuaugcauauacauuugacua

SEQ ID NO: 408243 - RNA, 20 nt, Human
cagguauuacaucugcaccu

SEQ ID NO: 408244 - RNA, 22 nt, Human
aaacagguagcccuagccuucu

SEQ ID NO: 408245 - RNA, 21 nt, Human
caauuacuaugaaccaguuga

SEQ ID NO: 408246 - RNA, 22 nt, Human
ugaaacauuauagaauauuuau

SEQ ID NO: 408247 - RNA, 22 nt, Human
ugaugacaaacuuuccugaugc

SEQ ID NO: 408248 - RNA, 20 nt, Human
uuucugcagauguuuacaug

SEQ ID NO: 408249 - RNA, 22 nt, Human
aacaucaucaugaacaacuaau

SEQ ID NO: 408250 - RNA, 22 nt, Human
ugcaaauauuuccuuauagcca

SEQ ID NO: 408251 - RNA, 22 nt, Human
ucugugcaggauuugaggaacc

SEQ ID NO: 408252 - RNA, 22 nt, Human
uuucucaacagaguaugcccuu

SEQ ID NO: 408253 - RNA, 22 nt, Human
ugucaauaacauuuacuucuau

SEQ ID NO: 408254 - RNA, 21 nt, Human
auacauucuauuaagcauuua

SEQ ID NO: 408255 - RNA, 22 nt, Human
uuugacaugcaaagcacuuuag

SEQ ID NO: 408256 - RNA, 22 nt, Human
uugcaagagagucugaaaaaug

SEQ ID NO: 408257 - RNA, 22 nt, Human
agcugaaucucaggcauccuuu

SEQ ID NO: 408258 - RNA, 22 nt, Human
cauguacaguuuuucuguccug

SEQ ID NO: 408259 - RNA, 20 nt, Human
auuugcaucugaauaacuua

SEQ ID NO: 408260 - RNA, 22 nt, Human
agaggucucaguuauguuuaaa

SEQ ID NO: 408261 - RNA, 22 nt, Human
gcugugcagguccccacugccu

SEQ ID NO: 408262 - RNA, 22 nt, Human
cauccauagauugagagauggu

SEQ ID NO: 408263 - RNA, 18 nt, Human
uacaucuauauaguguuu

SEQ ID NO: 408264 - RNA, 22 nt, Human
aagguauuggggaauauuugac

SEQ ID NO: 408265 - RNA, 21 nt, Human
gcugugcagaggauggagugg

SEQ ID NO: 408266 - RNA, 22 nt, Human
uuuaugcagccucaguaucaga

SEQ ID NO: 408267 - RNA, 22 nt, Human
gucaaauaauuuucucaauagu

SEQ ID NO: 408268 - RNA, 22 nt, Human
ucugugcagacauggggaagcc

SEQ ID NO: 408269 - RNA, 22 nt, Human
caguaacauuucaagguagagg

SEQ ID NO: 408270 - RNA, 23 nt, Human
cagcacaguacauuuccugucuc

SEQ ID NO: 408271 - RNA, 22 nt, Human
augagcagcauugcuccucuua

SEQ ID NO: 408272 - RNA, 22 nt, Human
ugaacauugucacauuccuagc

SEQ ID NO: 408273 - RNA, 22 nt, Human
aauacaguaauuuugaugaguu

SEQ ID NO: 408274 - RNA, 22 nt, Human
uacagguaaaauuaucagaaac

SEQ ID NO: 408275 - RNA, 22 nt, Human
uuugaugaugaugauaaaguuu

SEQ ID NO: 408276 - RNA, 22 nt, Human
aaugguaucaccucacagaauu

SEQ ID NO: 408277 - RNA, 21 nt, Human
ugacauuuggauucauaguaa

SEQ ID NO: 408278 - RNA, 22 nt, Human
gcugugcagagcacaggguccc

SEQ ID NO: 408279 - RNA, 22 nt, Human
uacauguacauugggcauuaau

SEQ ID NO: 408280 - RNA, 22 nt, Human
aagaacaguugggaggugagcc

SEQ ID NO: 408281 - RNA, 22 nt, Human
auacagugaauacuuacagugu

SEQ ID NO: 408282 - RNA, 22 nt, Human
auuugaauggcuuaacacaacg

SEQ ID NO: 408283 - RNA, 22 nt, Human
agaagcugagaaugaauuaaga

SEQ ID NO: 408284 - RNA, 22 nt, Human
uucaucuguagcaucuuccaau

SEQ ID NO: 408285 - RNA, 22 nt, Human
augacaaaaugaaugcagcuag

SEQ ID NO: 408286 - RNA, 20 nt, Human
ucugugcaguuuaggaaggc

SEQ ID NO: 408287 - RNA, 22 nt, Human
auuuaucaucagaccuuuuaaa

SEQ ID NO: 408288 - RNA, 22 nt, Human
cuuugcaaaaguuaauuguuga

SEQ ID NO: 408289 - RNA, 22 nt, Human
uacagguagagucucuaguuua

SEQ ID NO: 408290 - RNA, 22 nt, Human
gggaaauagagcuggaaccuug

SEQ ID NO: 408291 - RNA, 22 nt, Human
gacauaaaccuugagauauuaa

SEQ ID NO: 408292 - RNA, 22 nt, Human
gacaucauggagaggauaaaua

SEQ ID NO: 408293 - RNA, 22 nt, Human
ugcugugcucuuuaaggugcug

SEQ ID NO: 408294 - RNA, 19 nt, Human
ugagaugccuuccagcccu

SEQ ID NO: 408295 - RNA, 22 nt, Human
uggaaauauuugcucauuaucu

SEQ ID NO: 408296 - RNA, 22 nt, Human
uagcagcugcaucauuuuacag

SEQ ID NO: 408297 - RNA, 22 nt, Human
uugauacaggcucuauuucauc

SEQ ID NO: 408298 - RNA, 22 nt, Human
auucugauaugaacacacauau

SEQ ID NO: 408299 - RNA, 22 nt, Human
uuuguucaugccuauauucuca

SEQ ID NO: 408300 - RNA, 22 nt, Human
uuuucucaagauccaaugcacu

SEQ ID NO: 408301 - RNA, 22 nt, Human
ugaggauggaaugcugugcaag

SEQ ID NO: 408302 - RNA, 22 nt, Human
augaaucaagugagaacagcau

SEQ ID NO: 408303 - RNA, 22 nt, Human
aauacagugaaagugagcaagg

SEQ ID NO: 408304 - RNA, 22 nt, Human
augacuaagugcauuuuaauug

SEQ ID NO: 408305 - RNA, 18 nt, Human
uguaaacacuuucauucu

SEQ ID NO: 408306 - RNA, 23 nt, Human
ugggaaauguagccuuggcauga

SEQ ID NO: 408307 - RNA, 22 nt, Human
aucauaaaccacuuuguaaucu

SEQ ID NO: 408308 - RNA, 22 nt, Human
uucauaugcagauuaacaaaua

SEQ ID NO: 408309 - RNA, 22 nt, Human
agagcuauaacagcacuguaca

SEQ ID NO: 408310 - RNA, 22 nt, Human
auguaaacuuuaccagcucuga

SEQ ID NO: 408311 - RNA, 22 nt, Human
cagacagagcucacaagucuuu

SEQ ID NO: 408312 - RNA, 22 nt, Human
uauacugaucacugaggucauc

SEQ ID NO: 408313 - RNA, 22 nt, Human
aaacaugaguuaaaaguaacug

SEQ ID NO: 408314 - RNA, 22 nt, Human
acaggauaguuuuuaaucuucc

SEQ ID NO: 408315 - RNA, 22 nt, Human
acauuuguauauaugcagcaua

SEQ ID NO: 408316 - RNA, 21 nt, Human
acugugcagccugaggaugug

SEQ ID NO: 408317 - RNA, 19 nt, Human
gcauaaaaugucaaugugu

SEQ ID NO: 408318 - RNA, 22 nt, Human
aaauagauugcugaggcauuac

SEQ ID NO: 408319 - RNA, 22 nt, Human
auauugaucuuggaacugauuu

SEQ ID NO: 408320 - RNA, 22 nt, Human
uagcauauggaggguaagaggg

SEQ ID NO: 408321 - RNA, 22 nt, Human
ugcagcugaaccuagagucugu

SEQ ID NO: 408322 - RNA, 22 nt, Human
aaauggaaguguauuuaguguu

SEQ ID NO: 408323 - RNA, 22 nt, Human
aacauguaaauaucauuguacu

SEQ ID NO: 408324 - RNA, 22 nt, Human
ucugugcacugugucauuaggu

SEQ ID NO: 408325 - RNA, 22 nt, Human
gcaaccauuuggaauguaaaaa

SEQ ID NO: 408326 - RNA, 22 nt, Human
uuauaacuuuggauaugacaag

SEQ ID NO: 408327 - RNA, 22 nt, Human
aucauaacuguaauucaucuac

SEQ ID NO: 408328 - RNA, 22 nt, Human
aguaaacauaauuuaccuguag

SEQ ID NO: 408329 - RNA, 22 nt, Human
aggaauuaacaauauauuuagg

SEQ ID NO: 408330 - RNA, 22 nt, Human
uaugugcaggggcaggagcuca

SEQ ID NO: 408331 - RNA, 22 nt, Human
uuauagugggcccaacauggcg

SEQ ID NO: 408332 - RNA, 22 nt, Human
auuaaauuuucacuaggcuccc

SEQ ID NO: 408333 - RNA, 22 nt, Human
aacaggaugucauuucucaugu

SEQ ID NO: 408334 - RNA, 22 nt, Human
ugucacuacaucauaaauauau

SEQ ID NO: 408335 - RNA, 22 nt, Human
agagaugcugacguuuacauuu

SEQ ID NO: 408336 - RNA, 22 nt, Human
augcaagaaacagagacgcuga

SEQ ID NO: 408337 - RNA, 22 nt, Human
auguuuuauauuuugcagcagu

SEQ ID NO: 408338 - RNA, 22 nt, Human
auuguuaugaaaauaagauguu

SEQ ID NO: 408339 - RNA, 22 nt, Human
uauuacuguuacuucacacugu

SEQ ID NO: 408340 - RNA, 22 nt, Human
augcacaggaccacacauaaug

SEQ ID NO: 408341 - RNA, 22 nt, Human
uucagugucaauuuuuaaauau

SEQ ID NO: 408342 - RNA, 22 nt, Human
aacauguugcuuuaauaauauu

SEQ ID NO: 408343 - RNA, 22 nt, Human
uuauaccugaagcaggugaugu

SEQ ID NO: 408344 - RNA, 22 nt, Human
aauaugauccuuaaccuucaug

SEQ ID NO: 408345 - RNA, 22 nt, Human
gcugugcaucuucauucuggac

SEQ ID NO: 408346 - RNA, 22 nt, Human
acugagcucugaugagauuugg

SEQ ID NO: 408347 - RNA, 22 nt, Human
auguacauaaaauguauaauga

SEQ ID NO: 408348 - RNA, 22 nt, Human
uagcugaaggcuacagcagaac

SEQ ID NO: 408349 - RNA, 22 nt, Human
auacaugacagcauagcauccu

SEQ ID NO: 408350 - RNA, 18 nt, Human
ugucauaauauaucaccu

SEQ ID NO: 408351 - RNA, 22 nt, Human
caaggauucucacuagacuaga

SEQ ID NO: 408352 - RNA, 22 nt, Human
acaucagagggcucacaugauc

SEQ ID NO: 408353 - RNA, 22 nt, Human
auacaugacucacacauucugc

SEQ ID NO: 408354 - RNA, 22 nt, Human
cgaugcuggaaugacagcugcu

SEQ ID NO: 408355 - RNA, 22 nt, Human
auucugucuuuuuauacaucua

SEQ ID NO: 408356 - RNA, 22 nt, Human
uuagaggcaugauucaguaaag

SEQ ID NO: 408357 - RNA, 22 nt, Human
uuaaauuagucaagcuucucug

SEQ ID NO: 408358 - RNA, 22 nt, Human
guaaacauuacugugcuguaua

SEQ ID NO: 408359 - RNA, 22 nt, Human
guguuuuaucagacaaaguaua

SEQ ID NO: 408360 - RNA, 22 nt, Human
ugcaaaugggugaggguuagga

SEQ ID NO: 408361 - RNA, 18 nt, Human
caucaguauccacuaggu

SEQ ID NO: 408362 - RNA, 22 nt, Human
uauguaaaggauugagaugaau

SEQ ID NO: 408363 - RNA, 19 nt, Human
ucugucauuucuucuguac

SEQ ID NO: 408364 - RNA, 20 nt, Human
ucauacacaugagcaugcag

SEQ ID NO: 408365 - RNA, 22 nt, Human
augcuguguccuagugaaagaa

SEQ ID NO: 408366 - RNA, 22 nt, Human
ugaugacaguguuacagcucca

SEQ ID NO: 408367 - RNA, 22 nt, Human
ucccuguuuuauauccuaacaa

SEQ ID NO: 408368 - RNA, 22 nt, Human
agaaaauauucauugagaggcu

SEQ ID NO: 408369 - RNA, 22 nt, Human
auucucaaagccagagucaacg

SEQ ID NO: 408370 - RNA, 22 nt, Human
uuuaguauccuaucucauuuaa

SEQ ID NO: 408371 - RNA, 22 nt, Human
uuuaugcacaauuagucuuaua

SEQ ID NO: 408372 - RNA, 22 nt, Human
uugagcaaaggaguaaaaugca

SEQ ID NO: 408373 - RNA, 22 nt, Human
uuuguacaugaaugugcaccca

SEQ ID NO: 408374 - RNA, 22 nt, Human
acugugcaggugaacuguuugc

SEQ ID NO: 408375 - RNA, 22 nt, Human
aaacaguuucauuuucaugacc

SEQ ID NO: 408376 - RNA, 22 nt, Human
gaagcuaaaccacagcuaagaa

SEQ ID NO: 408377 - RNA, 22 nt, Human
aagcugaaaaugagacucuaca

SEQ ID NO: 408378 - RNA, 20 nt, Human
gcaaauggacacucagggaa

SEQ ID NO: 408379 - RNA, 22 nt, Human
gaaacauuuguugaguacuugc

SEQ ID NO: 408380 - RNA, 22 nt, Human
guacauucagcuuagcacuucu

SEQ ID NO: 408381 - RNA, 20 nt, Human
cuaagcacuuugauaaacug

SEQ ID NO: 408382 - RNA, 22 nt, Human
ugaggaaacugaggcacagaug

SEQ ID NO: 408383 - RNA, 22 nt, Human
gauaaacuggaaccauugccuc

SEQ ID NO: 408384 - RNA, 22 nt, Human
uacaacagacaggaauaagauu

SEQ ID NO: 408385 - RNA, 22 nt, Human
aaagggcuuuauaucagugugu

SEQ ID NO: 408386 - RNA, 22 nt, Human
gacauaaaauucaauaauuugu

SEQ ID NO: 408387 - RNA, 22 nt, Human
aaugcacauaaauauggucuua

SEQ ID NO: 408388 - RNA, 22 nt, Human
acauuuauauaacucacuagga

SEQ ID NO: 408389 - RNA, 22 nt, Human
uucagaaaucgaguuucauguc

SEQ ID NO: 408390 - RNA, 22 nt, Human
auaacaugaccugugcuucaca

SEQ ID NO: 408391 - RNA, 22 nt, Human
cauaacauugagcagcauuccu

SEQ ID NO: 408392 - RNA, 22 nt, Human
ugcacaggccuugaagggagag

SEQ ID NO: 408393 - RNA, 22 nt, Human
ugauuucuucuaauuuccauca

SEQ ID NO: 408394 - RNA, 22 nt, Human
gugcauuugugcaugcacaugu

SEQ ID NO: 408395 - RNA, 22 nt, Human
ugacauuuaaucccuaaauauu

SEQ ID NO: 408396 - RNA, 22 nt, Human
aguaaacaguaucuuuaguguc

SEQ ID NO: 408397 - RNA, 22 nt, Human
augauaacaacagcagugcugg

SEQ ID NO: 408398 - RNA, 22 nt, Human
uuuuaucauuacccagcugaaa

SEQ ID NO: 408399 - RNA, 22 nt, Human
uuucuacagaagauacacugcu

SEQ ID NO: 408400 - RNA, 21 nt, Human
ugcagauaauugaaagcugac

SEQ ID NO: 408401 - RNA, 22 nt, Human
auuuuaguaccucaaguaucca

SEQ ID NO: 408402 - RNA, 19 nt, Human
uacagugaaccaggaggag

SEQ ID NO: 408403 - RNA, 22 nt, Human
uguuuuaguucugucuugcaug

SEQ ID NO: 408404 - RNA, 23 nt, Human
cagguauugauuuuucuucuagg

SEQ ID NO: 408405 - RNA, 22 nt, Human
gcauuugaaaugcaagaaagug

SEQ ID NO: 408406 - RNA, 22 nt, Human
gagcugaacaaauugcgagugg

SEQ ID NO: 408407 - RNA, 20 nt, Human
gcaaauggaucccacaagcc

SEQ ID NO: 408408 - RNA, 22 nt, Human
cagugacguaaacugcaugugc

SEQ ID NO: 408409 - RNA, 22 nt, Human
augcuguggggagugaggguag

SEQ ID NO: 408410 - RNA, 22 nt, Human
cauuugcagagggugacacucu

SEQ ID NO: 408411 - RNA, 22 nt, Human
agaacagucguggugagagaaa

SEQ ID NO: 408412 - RNA, 22 nt, Human
auacauuagcucauaugauuaa

SEQ ID NO: 408413 - RNA, 22 nt, Human
cauuguuauagcauuacacacc

SEQ ID NO: 408414 - RNA, 22 nt, Human
aaggaaauacaacauguauuca

SEQ ID NO: 408415 - RNA, 22 nt, Human
uuucuacaacacuucugaaucu

SEQ ID NO: 408416 - RNA, 20 nt, Human
uaacaggaagcauuauuuua

SEQ ID NO: 408417 - RNA, 22 nt, Human
gacauuuguaugacacuuuaaa

SEQ ID NO: 408418 - RNA, 22 nt, Human
gugauacaaauaaacauaugcu

SEQ ID NO: 408419 - RNA, 22 nt, Human
gauaauuuaagucuugggggcu

SEQ ID NO: 408420 - RNA, 22 nt, Human
uuucuucauagaccuugucuug

SEQ ID NO: 408421 - RNA, 22 nt, Human
uaguccaggacaaucuucauau

SEQ ID NO: 408422 - RNA, 22 nt, Human
aauaacaggcucaucagaugcu

SEQ ID NO: 408423 - RNA, 22 nt, Human
agaacauuugucgaucaauuug

SEQ ID NO: 408424 - RNA, 22 nt, Human
uuucuacagcuggugcaacuuu

SEQ ID NO: 408425 - RNA, 21 nt, Human
caauuacuuuugcaccgacuu

SEQ ID NO: 408426 - RNA, 22 nt, Human
ucaaccagaguuuuucuuaaua

SEQ ID NO: 408427 - RNA, 22 nt, Human
cauuuguaggaugcuucuuguu

SEQ ID NO: 408428 - RNA, 22 nt, Human
augaacaaucuggcaagaacuu

SEQ ID NO: 408429 - RNA, 22 nt, Human
aaauuggauugggagaauguga

SEQ ID NO: 408430 - RNA, 22 nt, Human
cauccauaugaggcacauuggu

SEQ ID NO: 408431 - RNA, 22 nt, Human
gguugguaacucccugugcagu

SEQ ID NO: 408432 - RNA, 22 nt, Human
caugcugugguaaaucacugaa

SEQ ID NO: 408433 - RNA, 22 nt, Human
uuauuacacugaaagaauugcg

SEQ ID NO: 408434 - RNA, 22 nt, Human
cacaggaaugaacagggaaaga

SEQ ID NO: 408435 - RNA, 22 nt, Human
aucauacagccuuuguuagugu

SEQ ID NO: 408436 - RNA, 22 nt, Human
uagagauagcaguauugauucg

SEQ ID NO: 408437 - RNA, 22 nt, Human
ugaugauugggagacauuuggg

SEQ ID NO: 408438 - RNA, 22 nt, Human
cuuaaauuggaugaguuaaguu

SEQ ID NO: 408439 - RNA, 22 nt, Human
ucuucauucucgccuuugucgu

SEQ ID NO: 408440 - RNA, 21 nt, Human
uuucaauguguucuuuguagu

SEQ ID NO: 408441 - RNA, 22 nt, Human
aacaguacuggacaaggaguca

SEQ ID NO: 408442 - RNA, 22 nt, Human
ucauuuguucucauucucuacu

SEQ ID NO: 408443 - RNA, 22 nt, Human
aagaacuguaucaagauguagu

SEQ ID NO: 408444 - RNA, 22 nt, Human
ugcacagugaccacugagcaag

SEQ ID NO: 408445 - RNA, 22 nt, Human
acuugaauuauauuucuagaga

SEQ ID NO: 408446 - RNA, 22 nt, Human
uuuguacauccuaauucugagu

SEQ ID NO: 408447 - RNA, 22 nt, Human
acauuuguuucucuagaguagg

SEQ ID NO: 408448 - RNA, 22 nt, Human
aaggaaaugugccugacacugc

SEQ ID NO: 408449 - RNA, 22 nt, Human
ucauuuguaccauuuuuuaaga

SEQ ID NO: 408450 - RNA, 22 nt, Human
ugaaaaacugaauaguugagua

SEQ ID NO: 408451 - RNA, 22 nt, Human
uacagugauuucuacugguguu

SEQ ID NO: 408452 - RNA, 22 nt, Human
ucugugcagggaccccaagagu

SEQ ID NO: 408453 - RNA, 22 nt, Human
acauucuuucgaugucugauuu

SEQ ID NO: 408454 - RNA, 22 nt, Human
auuugucauguauguaaaguug

SEQ ID NO: 408455 - RNA, 22 nt, Human
aauuacugucuguaaagggaau

SEQ ID NO: 408456 - RNA, 21 nt, Human
uuagaguagagaacaugaucc

SEQ ID NO: 408457 - RNA, 22 nt, Human
aaucuugaguguuacucucauu

SEQ ID NO: 408458 - RNA, 22 nt, Human
uagcaguauauuuuaaggaagc

SEQ ID NO: 408459 - RNA, 20 nt, Human
gaacauuuggccauacugag

SEQ ID NO: 408460 - RNA, 22 nt, Human
cagugaugaucauuguaacauc

SEQ ID NO: 408461 - RNA, 22 nt, Human
uucauucuuauuugugaucugg

SEQ ID NO: 408462 - RNA, 22 nt, Human
agcacaaugugaaaagagcucu

SEQ ID NO: 408463 - RNA, 22 nt, Human
aagguauuggcagggcugaguu

SEQ ID NO: 408464 - RNA, 22 nt, Human
uucagcacaagacuagacaggu

SEQ ID NO: 408465 - RNA, 22 nt, Human
uuuguaaaggccugaauuucag

SEQ ID NO: 408466 - RNA, 17 nt, Human
uuagagcuacauguuga

SEQ ID NO: 408467 - RNA, 22 nt, Human
uagagaugaauucugcagucuu

SEQ ID NO: 408468 - RNA, 22 nt, Human
ggcugugcgggcagccguggga

SEQ ID NO: 408469 - RNA, 22 nt, Human
gcugugcaguaguagguacagu

SEQ ID NO: 408470 - RNA, 22 nt, Human
uuacuacugcuuuacuacuggg

SEQ ID NO: 408471 - RNA, 22 nt, Human
ugauugaauucaaaugcaaucu

SEQ ID NO: 408472 - RNA, 17 nt, Human
acaguuugucauucuaa

SEQ ID NO: 408473 - RNA, 22 nt, Human
acuauuuacucaaaugagguug

SEQ ID NO: 408474 - RNA, 22 nt, Human
caauggauauuuuaugugagaa

SEQ ID NO: 408475 - RNA, 22 nt, Human
aaacauguaaguucagaucacc

SEQ ID NO: 408476 - RNA, 22 nt, Human
aagcugaagacacagcuccagu

SEQ ID NO: 408477 - RNA, 22 nt, Human
acuuggcaaguaucuauaaagu

SEQ ID NO: 408478 - RNA, 22 nt, Human
ggagaugcuauguaguuugguu

SEQ ID NO: 408479 - RNA, 22 nt, Human
acauucuuaacaguuaaaaacu

SEQ ID NO: 408480 - RNA, 19 nt, Human
ucauaaacugggcacagug

SEQ ID NO: 408481 - RNA, 22 nt, Human
acauggauaaauuuuacuuucc

SEQ ID NO: 408482 - RNA, 22 nt, Human
aaugguuucaaacacacuaagu

SEQ ID NO: 408483 - RNA, 22 nt, Human
agagaugcccuugaaaggauua

SEQ ID NO: 408484 - RNA, 22 nt, Human
aacauuuguuuggcuucaauua

SEQ ID NO: 408485 - RNA, 22 nt, Human
acagugaucaguuacugucugu

SEQ ID NO: 408486 - RNA, 22 nt, Human
ucugugcaccagaaugauauuu

SEQ ID NO: 408487 - RNA, 22 nt, Human
uaugaauucuguucauugauga

SEQ ID NO: 408488 - RNA, 22 nt, Human
aauuuuguuuaagugaucugcu

SEQ ID NO: 408489 - RNA, 22 nt, Human
uucaucuggaauuuauguuaua

SEQ ID NO: 408490 - RNA, 22 nt, Human
auacaguagacaaucucaugaa

SEQ ID NO: 408491 - RNA, 22 nt, Human
auugcagaacaugaggucuucu

SEQ ID NO: 408492 - RNA, 22 nt, Human
caguggaagcuggcugugaaga

SEQ ID NO: 408493 - RNA, 22 nt, Human
uuagaucauuuugaacuaauuu

SEQ ID NO: 408494 - RNA, 22 nt, Human
acaugcauucucuaaaagcaaa

SEQ ID NO: 408495 - RNA, 21 nt, Human
ucacuacaauguucucuuaua

SEQ ID NO: 408496 - RNA, 22 nt, Human
cuguaaauaugaagaauauaug

SEQ ID NO: 408497 - RNA, 22 nt, Human
uuuauaucuuaugucauuucaa

SEQ ID NO: 408498 - RNA, 22 nt, Human
agugucuuuagcaaguuuaguc

SEQ ID NO: 408499 - RNA, 22 nt, Human
agaugcuauacauuguaagaca

SEQ ID NO: 408500 - RNA, 22 nt, Human
agaauaaaugcuaccuaucaca

SEQ ID NO: 408501 - RNA, 22 nt, Human
caguggcugagaguggacacug

SEQ ID NO: 408502 - RNA, 21 nt, Human
uacaacagguuuuauuucgau

SEQ ID NO: 408503 - RNA, 22 nt, Human
acacagugccaaauugcaguua

SEQ ID NO: 408504 - RNA, 22 nt, Human
ugcaaauaagcuauuauggaau

SEQ ID NO: 408505 - RNA, 22 nt, Human
cauuuguauagugcuuagacca

SEQ ID NO: 408506 - RNA, 22 nt, Human
acugugcauuugucaugggguu

SEQ ID NO: 408507 - RNA, 22 nt, Human
aagcauuucagguagagauauu

SEQ ID NO: 408508 - RNA, 22 nt, Human
uuuaucugugguaaauaacauu

SEQ ID NO: 408509 - RNA, 22 nt, Human
ugagaucugugcauguuaguua

SEQ ID NO: 408510 - RNA, 22 nt, Human
guagcugauauuagcaaugagu

SEQ ID NO: 408511 - RNA, 22 nt, Human
cuacagugacagaauuaaacag

SEQ ID NO: 408512 - RNA, 22 nt, Human
auugugauuagagaauauagag

SEQ ID NO: 408513 - RNA, 22 nt, Human
cagugcagucaaggaagaacca

SEQ ID NO: 408514 - RNA, 23 nt, Human
aaaugugagggaaaaucuuucug

SEQ ID NO: 408515 - RNA, 22 nt, Human
acugugcacaauucuaaguccu

SEQ ID NO: 408516 - RNA, 22 nt, Human
aguacaugcagaacuaacagau

SEQ ID NO: 408517 - RNA, 22 nt, Human
uuuucauuguuccucgagcauu

SEQ ID NO: 408518 - RNA, 19 nt, Human
ugcauauaucuaugaaaga

SEQ ID NO: 408519 - RNA, 22 nt, Human
uuuaauguagcgugaaaugauu

SEQ ID NO: 408520 - RNA, 22 nt, Human
auuuaucaacauguaccauugg

SEQ ID NO: 408521 - RNA, 22 nt, Human
caugauuauguguuagaguuug

SEQ ID NO: 408522 - RNA, 22 nt, Human
aaauacuguuuuauuccaugau

SEQ ID NO: 408523 - RNA, 22 nt, Human
aagcugaaacauuagccuaaac

SEQ ID NO: 408524 - RNA, 22 nt, Human
acauugauugagcacccauuau

SEQ ID NO: 408525 - RNA, 22 nt, Human
ggcugugccucaaggcuacuca

SEQ ID NO: 408526 - RNA, 22 nt, Human
uuucacauaugguuguugauug

SEQ ID NO: 408527 - RNA, 22 nt, Human
acaguaccugcucucaagcaaa

SEQ ID NO: 408528 - RNA, 22 nt, Human
uagaggcauuaaugaauaaaca

SEQ ID NO: 408529 - RNA, 22 nt, Human
cauaauuugugguaguggggga

SEQ ID NO: 408530 - RNA, 22 nt, Human
uacagugaggugguuuccuuua

SEQ ID NO: 408531 - RNA, 22 nt, Human
aacauuuauugagcaccuacug

SEQ ID NO: 408532 - RNA, 22 nt, Human
accauucugguccauacuguuc

SEQ ID NO: 408533 - RNA, 22 nt, Human
guaaacaucagccacucuauuu

SEQ ID NO: 408534 - RNA, 22 nt, Human
caauagcuauguaaccugaaga

SEQ ID NO: 408535 - RNA, 22 nt, Human
agcaccauuucucuaaagcacu

SEQ ID NO: 408536 - RNA, 22 nt, Human
aggacuuagaacauuauguacu

SEQ ID NO: 408537 - RNA, 22 nt, Human
aggucauuaaaguuaaaugagg

SEQ ID NO: 408538 - RNA, 22 nt, Human
uauaugcaauuuuuuagugcaa

SEQ ID NO: 408539 - RNA, 23 nt, Human
gagguacagcaccagugaauagg

SEQ ID NO: 408540 - RNA, 22 nt, Human
uagucuuuuuaauaaauaaugc

SEQ ID NO: 408541 - RNA, 21 nt, Human
ugaggcucaucuuauguggcu

SEQ ID NO: 408542 - RNA, 21 nt, Human
uuagaagcuaaugcagcuggu

SEQ ID NO: 408543 - RNA, 23 nt, Human
ugcucccaggugacgcugcuguu

SEQ ID NO: 408544 - RNA, 22 nt, Human
cugggcacuuuggggagccuac

SEQ ID NO: 408545 - RNA, 22 nt, Human
guagcuuauuagggauaauagu

SEQ ID NO: 408546 - RNA, 21 nt, Human
uccaaaucccauucuguaguc

SEQ ID NO: 408547 - RNA, 22 nt, Human
guggccugggguuuguucugag

SEQ ID NO: 408548 - RNA, 16 nt, Human
ggagagugucugcaaa

SEQ ID NO: 408549 - RNA, 22 nt, Human
agucaggauaugccuugugggc

SEQ ID NO: 408550 - RNA, 22 nt, Human
gagcagaugugugccaggaugc

SEQ ID NO: 408551 - RNA, 22 nt, Human
ucucuggguuuuuguccuguac

SEQ ID NO: 408552 - RNA, 22 nt, Human
uccaucaccacagaggacagag

SEQ ID NO: 408553 - RNA, 22 nt, Human
gugcagauccugauugcaguuc

SEQ ID NO: 408554 - RNA, 22 nt, Human
aggccugagccccagguuuguu

SEQ ID NO: 408555 - RNA, 22 nt, Human
gcugcccugugguccagcaggu

SEQ ID NO: 408556 - RNA, 22 nt, Human
gcacggcuaauuuuuguauuuu

SEQ ID NO: 408557 - RNA, 22 nt, Human
ggagucccagcaaagccuuccc

SEQ ID NO: 408558 - RNA, 22 nt, Human
ucugggugcccuuugcucuguu

SEQ ID NO: 408559 - RNA, 22 nt, Human
ggcagcacugcagcuuguuggg

SEQ ID NO: 408560 - RNA, 22 nt, Human
ggucccaggagaauaggugcaa

SEQ ID NO: 408561 - RNA, 20 nt, Human
cucucccagcacagcuuccu

SEQ ID NO: 408562 - RNA, 22 nt, Human
acagaauuaaugaaaauuacaa

SEQ ID NO: 408563 - RNA, 22 nt, Human
ggucaugcugugaaucagugcu

SEQ ID NO: 408564 - RNA, 22 nt, Human
uauuucugucagccagauaugg

SEQ ID NO: 408565 - RNA, 22 nt, Human
ugcccaagcagaggagugauuc

SEQ ID NO: 408566 - RNA, 22 nt, Human
ggcaggugcucugugggccugg

SEQ ID NO: 408567 - RNA, 22 nt, Human
gggcaggugccagcucccuguc

SEQ ID NO: 408568 - RNA, 22 nt, Human
gaauuguagagggaacagaagc

SEQ ID NO: 408569 - RNA, 22 nt, Human
acccaggaggcagagguugcag

SEQ ID NO: 408570 - RNA, 22 nt, Human
gcagggcugcagagggcacugu

SEQ ID NO: 408571 - RNA, 22 nt, Human
auuuggcaacauuaauugaauc

SEQ ID NO: 408572 - RNA, 22 nt, Human
cccagccucuguuugcuccucu

SEQ ID NO: 408573 - RNA, 22 nt, Human
aggcagcaauugaaaucauugu

SEQ ID NO: 408574 - RNA, 22 nt, Human
gcauuguccugcuucugagugu

SEQ ID NO: 408575 - RNA, 20 nt, Human
gggguuggcuggcacaggga

SEQ ID NO: 408576 - RNA, 22 nt, Human
ugucugguggguugacaggcag

SEQ ID NO: 408577 - RNA, 22 nt, Human
uggggcagcagaccuuucuugg

SEQ ID NO: 408578 - RNA, 22 nt, Human
caagggaguuacugagggcggg

SEQ ID NO: 408579 - RNA, 22 nt, Human
ugugcccauuacacagaggcau

SEQ ID NO: 408580 - RNA, 22 nt, Human
ccagggcaugggaagaacugaa

SEQ ID NO: 408581 - RNA, 22 nt, Human
ucugcugcugagcacacuccua

SEQ ID NO: 408582 - RNA, 22 nt, Human
ugucuguacaaauuuucugugu

SEQ ID NO: 408583 - RNA, 22 nt, Human
gcucuuccauuucucuugaacu

SEQ ID NO: 408584 - RNA, 18 nt, Human
cggcagagugcuucuagc

SEQ ID NO: 408585 - RNA, 22 nt, Human
cacagggcuaaaugaaggguug

SEQ ID NO: 408586 - RNA, 22 nt, Human
ggcagcuccucaaaaaauuaaa

SEQ ID NO: 408587 - RNA, 22 nt, Human
uagaugaccuuguguuaggcaa

SEQ ID NO: 408588 - RNA, 22 nt, Human
gaaggcugucagagaggagggc

SEQ ID NO: 408589 - RNA, 22 nt, Human
aggcagcagccacaaggccuga

SEQ ID NO: 408590 - RNA, 22 nt, Human
gcaguguuaggaauaaaaauga

SEQ ID NO: 408591 - RNA, 22 nt, Human
guggaggacaaaagaagccuuu

SEQ ID NO: 408592 - RNA, 22 nt, Human
cauuaggguaauugaacacuua

SEQ ID NO: 408593 - RNA, 22 nt, Human
ugccaggggaccuagggauguc

SEQ ID NO: 408594 - RNA, 22 nt, Human
ucacugcaaggaggcuucucaa

SEQ ID NO: 408595 - RNA, 22 nt, Human
gagcugcugguugcuggugccu

SEQ ID NO: 408596 - RNA, 22 nt, Human
ucaggggagguugaaucgucuc

SEQ ID NO: 408597 - RNA, 22 nt, Human
agcagccaaccuuacauucauc

SEQ ID NO: 408598 - RNA, 22 nt, Human
auguguacaaccaagcacuaaa

SEQ ID NO: 408599 - RNA, 22 nt, Human
cucagagauauagucccugcuu

SEQ ID NO: 408600 - RNA, 20 nt, Human
uccugguggauacugcuuaa

SEQ ID NO: 408601 - RNA, 22 nt, Human
caggcaggucagugaagaagga

SEQ ID NO: 408602 - RNA, 17 nt, Human
uggagcugcguguguuc

SEQ ID NO: 408603 - RNA, 22 nt, Human
ugaaggccagcucuuuaucagc

SEQ ID NO: 408604 - RNA, 22 nt, Human
gaacagaauuaccgaagaucug

SEQ ID NO: 408605 - RNA, 22 nt, Human
cauuucuagacaaguccuggag

SEQ ID NO: 408606 - RNA, 22 nt, Human
guuauguauugggaaauccaag

SEQ ID NO: 408607 - RNA, 22 nt, Human
cugaugcuauaagccacagugg

SEQ ID NO: 408608 - RNA, 21 nt, Human
cacugcagccuugaccugggc

SEQ ID NO: 408609 - RNA, 22 nt, Human
aggccuggccugggcggcauug

SEQ ID NO: 408610 - RNA, 22 nt, Human
uccuuugguucucuaagaugcu

SEQ ID NO: 408611 - RNA, 22 nt, Human
gccucugcucucagguagccuc

SEQ ID NO: 408612 - RNA, 22 nt, Human
caugucuggguauaugcauaug

SEQ ID NO: 408613 - RNA, 22 nt, Human
ggcugucucugugacugccacc

SEQ ID NO: 408614 - RNA, 23 nt, Human
uggcagagacccagaaucuacau

SEQ ID NO: 408615 - RNA, 22 nt, Human
gugggaugguagguagguaaua

SEQ ID NO: 408616 - RNA, 22 nt, Human
caaugugugcuuacaggccagu

SEQ ID NO: 408617 - RNA, 22 nt, Human
ugagcccuaagggucaagcagg

SEQ ID NO: 408618 - RNA, 22 nt, Human
ugaaggaaugagggaguggguc

SEQ ID NO: 408619 - RNA, 22 nt, Human
agaccugcagggccaggccugc

SEQ ID NO: 408620 - RNA, 22 nt, Human
gggcuggggcucaauaauuugu

SEQ ID NO: 408621 - RNA, 22 nt, Human
gggccucucccuucucacgcau

SEQ ID NO: 408622 - RNA, 22 nt, Human
gaggcucacgacgggacgaacu

SEQ ID NO: 408623 - RNA, 22 nt, Human
gccugagcuacuagggagucug

SEQ ID NO: 408624 - RNA, 22 nt, Human
cagugagguggauggauggccu

SEQ ID NO: 408625 - RNA, 22 nt, Human
aaaugccucugcuguacacaau

SEQ ID NO: 408626 - RNA, 22 nt, Human
gcugcucuggcucugcaguguc

SEQ ID NO: 408627 - RNA, 22 nt, Human
gggccaggucggugaaugguca

SEQ ID NO: 408628 - RNA, 22 nt, Human
ucccagccugacagugcaucaa

SEQ ID NO: 408629 - RNA, 22 nt, Human
gugccaaaagcuauaauuuggu

SEQ ID NO: 408630 - RNA, 22 nt, Human
uauguacaaucagcaguucaua

SEQ ID NO: 408631 - RNA, 22 nt, Human
caugaauauacauccugauggc

SEQ ID NO: 408632 - RNA, 22 nt, Human
aaaaauagcuucucuugucccu

SEQ ID NO: 408633 - RNA, 22 nt, Human
ccagcuuuccugcgaguugauu

SEQ ID NO: 408634 - RNA, 22 nt, Human
gcagccacuuugcaaccaagag

SEQ ID NO: 408635 - RNA, 22 nt, Human
cacagaauuaagggagaaauau

SEQ ID NO: 408636 - RNA, 22 nt, Human
acuuuauuuccuauugcaucca

SEQ ID NO: 408637 - RNA, 22 nt, Human
gucccagaaacauauugcuggu

SEQ ID NO: 408638 - RNA, 22 nt, Human
ugggccacuugaaaguggaugu

SEQ ID NO: 408639 - RNA, 22 nt, Human
ugcagggccuuguugaugugcu

SEQ ID NO: 408640 - RNA, 22 nt, Human
cccagcagaccgcugugauggc

SEQ ID NO: 408641 - RNA, 22 nt, Human
aucauaaagugcuaucugauug

SEQ ID NO: 408642 - RNA, 22 nt, Human
ccaucccuucucuggccagcag

SEQ ID NO: 408643 - RNA, 22 nt, Human
cacccagcauuggcuaagagag

SEQ ID NO: 408644 - RNA, 22 nt, Human
agagagcccgggccagggcaca

SEQ ID NO: 408645 - RNA, 22 nt, Human
agauacauauagaaaacaucaa

SEQ ID NO: 408646 - RNA, 22 nt, Human
aggccugggacgggagccguga

SEQ ID NO: 408647 - RNA, 22 nt, Human
uugacagcuauuuugcuuugau

SEQ ID NO: 408648 - RNA, 22 nt, Human
uaguaucuuucuauauuuccca

SEQ ID NO: 408649 - RNA, 22 nt, Human
uggcugagaaaaaagagcuaua

SEQ ID NO: 408650 - RNA, 22 nt, Human
gcuggccuuugaggaagcugcg

SEQ ID NO: 408651 - RNA, 22 nt, Human
uacauaguuccauuuacaggaa

SEQ ID NO: 408652 - RNA, 22 nt, Human
uaggugucugcucuuauuuaac

SEQ ID NO: 408653 - RNA, 22 nt, Human
uccuuuccaugcuucuagaggc

SEQ ID NO: 408654 - RNA, 22 nt, Human
ccaggagcauuaagagaacaua

SEQ ID NO: 408655 - RNA, 22 nt, Human
accaaggaguuugguauuuuag

SEQ ID NO: 408656 - RNA, 19 nt, Human
uuuggcacucugaaguguu

SEQ ID NO: 408657 - RNA, 22 nt, Human
gccuggagaagauggaacuagc

SEQ ID NO: 408658 - RNA, 22 nt, Human
uggaggaaguggcuggccagaa

SEQ ID NO: 408659 - RNA, 22 nt, Human
aggccuggugugccggaugcag

SEQ ID NO: 408660 - RNA, 22 nt, Human
caaaugcauaguuuauaagaag

SEQ ID NO: 408661 - RNA, 22 nt, Human
ugccucagucuaaagucucuca

SEQ ID NO: 408662 - RNA, 21 nt, Human
cugaggcagcacagcuaguca

SEQ ID NO: 408663 - RNA, 22 nt, Human
accaggcuugaugauuugcuua

SEQ ID NO: 408664 - RNA, 22 nt, Human
acccaggcugcuucucaguggc

SEQ ID NO: 408665 - RNA, 22 nt, Human
agugauggugagugagaagcuc

SEQ ID NO: 408666 - RNA, 22 nt, Human
ccaguuuuuccagugcuuucug

SEQ ID NO: 408667 - RNA, 22 nt, Human
ugcagggccgcuggaggucaug

SEQ ID NO: 408668 - RNA, 20 nt, Human
uccuucaggcagggccuagu

SEQ ID NO: 408669 - RNA, 22 nt, Human
auggggugagacuaggauuaaa

SEQ ID NO: 408670 - RNA, 17 nt, Human
cugaagauaauggcaac

SEQ ID NO: 408671 - RNA, 22 nt, Human
agcaggugggcaugaaagcuga

SEQ ID NO: 408672 - RNA, 22 nt, Human
agcagccaaaugaagauuuuac

SEQ ID NO: 408673 - RNA, 22 nt, Human
uaacagaagagcaggcagcccu

SEQ ID NO: 408674 - RNA, 21 nt, Human
gugguucuagagaaacagaau

SEQ ID NO: 408675 - RNA, 22 nt, Human
agggcagcugugagccacugug

SEQ ID NO: 408676 - RNA, 22 nt, Human
guauuugauacaugaaauggug

SEQ ID NO: 408677 - RNA, 22 nt, Human
ggcuguggucauuaggagguug

SEQ ID NO: 408678 - RNA, 20 nt, Human
uuccagagaucugcauuuua

SEQ ID NO: 408679 - RNA, 22 nt, Human
ggaggcucccacgcagcucaca

SEQ ID NO: 408680 - RNA, 22 nt, Human
ucuuuuaucuguuguguaacaa

SEQ ID NO: 408681 - RNA, 22 nt, Human
gggcugagccauuugaaccuug

SEQ ID NO: 408682 - RNA, 22 nt, Human
ccuggcugcuauagcagcaugu

SEQ ID NO: 408683 - RNA, 22 nt, Human
ugccaaggguaugggcaagaua

SEQ ID NO: 408684 - RNA, 18 nt, Human
ccucacagacuuccaugu

SEQ ID NO: 408685 - RNA, 22 nt, Human
ugagaagcugcugacuuagccu

SEQ ID NO: 408686 - RNA, 22 nt, Human
gagcuuggugaugccuccuggu

SEQ ID NO: 408687 - RNA, 22 nt, Human
aaacaugagcauuucuguuuaa

SEQ ID NO: 408688 - RNA, 22 nt, Human
uuucauuuugguuaugccauaa

SEQ ID NO: 408689 - RNA, 22 nt, Human
ggcauccaguucugaucaacaa

SEQ ID NO: 408690 - RNA, 21 nt, Human
gggaaauuaggauugcucauc

SEQ ID NO: 408691 - RNA, 23 nt, Human
auacauacagucuuacugacuuu

SEQ ID NO: 408692 - RNA, 22 nt, Human
aaggcaguaaaaucuaccuugc

SEQ ID NO: 408693 - RNA, 22 nt, Human
agaccaagaaaggaugaggauc

SEQ ID NO: 408694 - RNA, 22 nt, Human
ucaguuuucucaucugugaaau

SEQ ID NO: 408695 - RNA, 22 nt, Human
cccagccuuugcuuccugguuc

SEQ ID NO: 408696 - RNA, 20 nt, Human
gccuggaggcagagauaaag

SEQ ID NO: 408697 - RNA, 22 nt, Human
cgaugguucuggcugcuuguau

SEQ ID NO: 408698 - RNA, 22 nt, Human
ggcucagguugggucacaugac

SEQ ID NO: 408699 - RNA, 22 nt, Human
ucacauuuguucuugaaucuaa

SEQ ID NO: 408700 - RNA, 22 nt, Human
gccuccugguugcuucuccaac

SEQ ID NO: 408701 - RNA, 22 nt, Human
agcugagcugcagaugacugua

SEQ ID NO: 408702 - RNA, 23 nt, Human
ccagcugugccuggcccaggagc

SEQ ID NO: 408703 - RNA, 22 nt, Human
gccgugcgugcgcaggugcugu

SEQ ID NO: 408704 - RNA, 22 nt, Human
uuagcucagaaaauuuaaacuu

SEQ ID NO: 408705 - RNA, 22 nt, Human
gccugccugcugugugcaaguu

SEQ ID NO: 408706 - RNA, 22 nt, Human
gccugcagaggugcugcuagcu

SEQ ID NO: 408707 - RNA, 22 nt, Human
gagaagucauuugaccaccuag

SEQ ID NO: 408708 - RNA, 22 nt, Human
uaugcauaugaccccaagcuug

SEQ ID NO: 408709 - RNA, 22 nt, Human
gugccugggguugagcuaugaa

SEQ ID NO: 408710 - RNA, 22 nt, Human
ucagggcaagauugguuaauaa

SEQ ID NO: 408711 - RNA, 22 nt, Human
auaaggcauauagucacuuuuu

SEQ ID NO: 408712 - RNA, 22 nt, Human
uccagcuggggacaugggcuuc

SEQ ID NO: 408713 - RNA, 22 nt, Human
uuguggaaauacagacuccaag

SEQ ID NO: 408714 - RNA, 22 nt, Human
uuacaggggacauuggggacau

SEQ ID NO: 408715 - RNA, 18 nt, Human
aaaugcuaggcuacauga

SEQ ID NO: 408716 - RNA, 22 nt, Human
cagaggcagaggucaucucugg

SEQ ID NO: 408717 - RNA, 22 nt, Human
aauucauccaugaacaauucca

SEQ ID NO: 408718 - RNA, 22 nt, Human
auggcagaauuaggauuucaag

SEQ ID NO: 408719 - RNA, 22 nt, Human
ggccugagcagacagcaugaug

SEQ ID NO: 408720 - RNA, 22 nt, Human
uuucuuguaagauguuuauuaa

SEQ ID NO: 408721 - RNA, 22 nt, Human
ugcagggauuauguagggguug

SEQ ID NO: 408722 - RNA, 17 nt, Human
ucaugcccaacuauuac

SEQ ID NO: 408723 - RNA, 23 nt, Human
agcuuugugaaagcagacauggg

SEQ ID NO: 408724 - RNA, 21 nt, Human
aaguggagaagaaaagcugga

SEQ ID NO: 408725 - RNA, 22 nt, Human
ucugccugcuaacuccugcacc

SEQ ID NO: 408726 - RNA, 22 nt, Human
agagcugauuugauuacagugc

SEQ ID NO: 408727 - RNA, 22 nt, Human
gucccugcccuccugggacuca

SEQ ID NO: 408728 - RNA, 22 nt, Human
agggcagcuagcuguagaaaga

SEQ ID NO: 408729 - RNA, 22 nt, Human
uggcaggggaggugcuugcuua

SEQ ID NO: 408730 - RNA, 22 nt, Human
uuccagcaggcagacaggagau

SEQ ID NO: 408731 - RNA, 22 nt, Human
gccuggcccagggcucuuguug

SEQ ID NO: 408732 - RNA, 22 nt, Human
aagggcucugugugccucccca

SEQ ID NO: 408733 - RNA, 22 nt, Human
ggugucccaggccagcugugug

SEQ ID NO: 408734 - RNA, 22 nt, Human
ucuacagacagagcagguggga

SEQ ID NO: 408735 - RNA, 22 nt, Human
ccagcagaagcucccgcugggu

SEQ ID NO: 408736 - RNA, 22 nt, Human
ugaagcagagaauuugacaguc

SEQ ID NO: 408737 - RNA, 22 nt, Human
agcucacaguguccuuccucaa

SEQ ID NO: 408738 - RNA, 22 nt, Human
gccucugggcucugccccuggc

SEQ ID NO: 408739 - RNA, 22 nt, Human
ugcugccaggucuugcugucca

SEQ ID NO: 408740 - RNA, 20 nt, Human
cagaccugcacccacuucga

SEQ ID NO: 408741 - RNA, 22 nt, Human
caugcacagugauaucugaaga

SEQ ID NO: 408742 - RNA, 22 nt, Human
gugccugguuuggggaauguuc

SEQ ID NO: 408743 - RNA, 20 nt, Human
acaauagauuugagcaaagu

SEQ ID NO: 408744 - RNA, 22 nt, Human
uugaccuauguuucuucaucug

SEQ ID NO: 408745 - RNA, 22 nt, Human
uauuucccagggagcaacaagc

SEQ ID NO: 408746 - RNA, 22 nt, Human
ugcccuuggguaacuugcugau

SEQ ID NO: 408747 - RNA, 22 nt, Human
uuugcauuguuucaaaagugaa

SEQ ID NO: 408748 - RNA, 22 nt, Human
ugcuuuaucugacuuggcgcug

SEQ ID NO: 408749 - RNA, 22 nt, Human
aggggcuguggaaaccaacucu

SEQ ID NO: 408750 - RNA, 22 nt, Human
cgcauacauagaaacacacaga

SEQ ID NO: 408751 - RNA, 22 nt, Human
ggagccuguggccgucacgacu

SEQ ID NO: 408752 - RNA, 22 nt, Human
cauguuaaugaauuuuugcagu

SEQ ID NO: 408753 - RNA, 22 nt, Human
acuuaaaaagaaucuuuucacg

SEQ ID NO: 408754 - RNA, 22 nt, Human
cagcugccacaccucuuucucu

SEQ ID NO: 408755 - RNA, 22 nt, Human
uuguuuucuccacugcaucuua

SEQ ID NO: 408756 - RNA, 22 nt, Human
cccugaggggaguggugaggug

SEQ ID NO: 408757 - RNA, 23 nt, Human
cauguacacacagcuguacagug

SEQ ID NO: 408758 - RNA, 22 nt, Human
acagccuggacuggcucucugc

SEQ ID NO: 408759 - RNA, 22 nt, Human
aggagccaagcagaacuaagga

SEQ ID NO: 408760 - RNA, 22 nt, Human
uuucuauugaucuaauaaacau

SEQ ID NO: 408761 - RNA, 22 nt, Human
agagggcugcugcacagugcuc

SEQ ID NO: 408762 - RNA, 22 nt, Human
auuccaaaggcuggccuggagg

SEQ ID NO: 408763 - RNA, 19 nt, Human
ggaugagggucaggcauag

SEQ ID NO: 408764 - RNA, 22 nt, Human
cugccaggccuccgcugucccc

SEQ ID NO: 408765 - RNA, 22 nt, Human
ucaggauccauagacucccaaa

SEQ ID NO: 408766 - RNA, 22 nt, Human
gauuuccuagacauggggcaga

SEQ ID NO: 408767 - RNA, 22 nt, Human
augguguagcaugugauaugac

SEQ ID NO: 408768 - RNA, 22 nt, Human
ccagagcugaugggcccagggu

SEQ ID NO: 408769 - RNA, 22 nt, Human
ccaguggacuucucccuguggu

SEQ ID NO: 408770 - RNA, 22 nt, Human
gucaccagucccagcuccugaa

SEQ ID NO: 408771 - RNA, 22 nt, Human
agcugaggaggaaugaugggua

SEQ ID NO: 408772 - RNA, 22 nt, Human
ugggccacgugacccuuacccu

SEQ ID NO: 408773 - RNA, 19 nt, Human
ucaguuuuagucaucaguu

SEQ ID NO: 408774 - RNA, 22 nt, Human
ucaaaguagggguaagccaggc

SEQ ID NO: 408775 - RNA, 22 nt, Human
auguucuaaucccugcuaugua

SEQ ID NO: 408776 - RNA, 22 nt, Human
cagacagaccugcaagggcaca

SEQ ID NO: 408777 - RNA, 22 nt, Human
agggccagccaggcccuacaaa

SEQ ID NO: 408778 - RNA, 22 nt, Human
ggcccuguccuggcugucuccg

SEQ ID NO: 408779 - RNA, 22 nt, Human
ugggggacugcacuggcgucag

SEQ ID NO: 408780 - RNA, 22 nt, Human
uccaggcuagaagucacaggcc

SEQ ID NO: 408781 - RNA, 22 nt, Human
gcugagggcauguguggcgacu

SEQ ID NO: 408782 - RNA, 22 nt, Human
gccaggaguucagaugcauguu

SEQ ID NO: 408783 - RNA, 22 nt, Human
aguccggggucuggacaccugg

SEQ ID NO: 408784 - RNA, 22 nt, Human
uauuggugggggcagagagaga

SEQ ID NO: 408785 - RNA, 22 nt, Human
guggcugggcuccgagcggcuu

SEQ ID NO: 408786 - RNA, 22 nt, Human
ucaacagaagugauagcuauua

SEQ ID NO: 408787 - RNA, 22 nt, Human
ccugagccugaguggugcaggg

SEQ ID NO: 408788 - RNA, 22 nt, Human
agauuucagguuggggcagaag

SEQ ID NO: 408789 - RNA, 21 nt, Human
aggaaaggccagcacguaggg

SEQ ID NO: 408790 - RNA, 22 nt, Human
ccagcucuggcuucuugcuggg

SEQ ID NO: 408791 - RNA, 22 nt, Human
gagccuggacaucucaggccca

SEQ ID NO: 408792 - RNA, 22 nt, Human
caaggcaggcaguucacuugag

SEQ ID NO: 408793 - RNA, 22 nt, Human
cccaggcucccaggugggacaa

SEQ ID NO: 408794 - RNA, 22 nt, Human
gcuggcuguuggagguaccugc

SEQ ID NO: 408795 - RNA, 23 nt, Human
gggggcugguugacucucugcag

SEQ ID NO: 408796 - RNA, 22 nt, Human
aauguuuuagauuacugcuggg

SEQ ID NO: 408797 - RNA, 22 nt, Human
ugcuuuauugcaucaguguggg

SEQ ID NO: 408798 - RNA, 20 nt, Human
uguggcaggaugagggcgga

SEQ ID NO: 408799 - RNA, 22 nt, Human
gcaaaggcuucuuuuauucucc

SEQ ID NO: 408800 - RNA, 22 nt, Human
ggugaagggccuuaggagacag

SEQ ID NO: 408801 - RNA, 22 nt, Human
agagccugggaauuugcauguu

SEQ ID NO: 408802 - RNA, 22 nt, Human
cuuuucaugccagcccaucaca

SEQ ID NO: 408803 - RNA, 22 nt, Human
cuucuuuccuuccuccaguggc

SEQ ID NO: 408804 - RNA, 22 nt, Human
gcagcuggaagugacacucugu

SEQ ID NO: 408805 - RNA, 22 nt, Human
ggagauuuauagcacacuucag

SEQ ID NO: 408806 - RNA, 22 nt, Human
agagccagguguagucucggag

SEQ ID NO: 408807 - RNA, 22 nt, Human
acugcagcaaagcccgugucuu

SEQ ID NO: 408808 - RNA, 22 nt, Human
ugggcaggaugcguugauucuu

SEQ ID NO: 408809 - RNA, 21 nt, Human
ccucuggcuugugcugugccc

SEQ ID NO: 408810 - RNA, 22 nt, Human
gauggggaugagaagugagcag

SEQ ID NO: 408811 - RNA, 22 nt, Human
ucuguacaaaggcuauuuggag

SEQ ID NO: 408812 - RNA, 22 nt, Human
aacaguaacgagauguccuaac

SEQ ID NO: 408813 - RNA, 22 nt, Human
uugcucugacuggagugcagug

SEQ ID NO: 408814 - RNA, 22 nt, Human
ggucccaggauugguugcgcag

SEQ ID NO: 408815 - RNA, 23 nt, Human
acucagagaccccgggaagugac

SEQ ID NO: 408816 - RNA, 22 nt, Human
acagaaauuagcagugaguuua

SEQ ID NO: 408817 - RNA, 18 nt, Human
uuccauaauguauguaac

SEQ ID NO: 408818 - RNA, 23 nt, Human
cagaggguuccauggagcauggu

SEQ ID NO: 408819 - RNA, 22 nt, Human
agcaccaucagaugcaauaucu

SEQ ID NO: 408820 - RNA, 22 nt, Human
ccaguguucauaauuuuacacu

SEQ ID NO: 408821 - RNA, 22 nt, Human
aggggcucaguuacuuuggcag

SEQ ID NO: 408822 - RNA, 22 nt, Human
uucauucccaagaguaaacaua

SEQ ID NO: 408823 - RNA, 22 nt, Human
ugcuuaaacccugaucaugugu

SEQ ID NO: 408824 - RNA, 22 nt, Human
ugcagggaaucuguggcuggac

SEQ ID NO: 408825 - RNA, 22 nt, Human
cuguccauuuucgugccuccuu

SEQ ID NO: 408826 - RNA, 22 nt, Human
caugcacaacauacucaagagg

SEQ ID NO: 408827 - RNA, 22 nt, Human
aaacuguaaacacagcaguaca

SEQ ID NO: 408828 - RNA, 19 nt, Human
acucaagucuaaugaaauc

SEQ ID NO: 408829 - RNA, 22 nt, Human
uuuauccauaucauuaaaaucu

SEQ ID NO: 408830 - RNA, 22 nt, Human
aggcucagggacggggccccuu

SEQ ID NO: 408831 - RNA, 22 nt, Human
aaggacagaaacagauugcugg

SEQ ID NO: 408832 - RNA, 22 nt, Human
ugucaugccaggaaauaguccc

SEQ ID NO: 408833 - RNA, 20 nt, Human
gcugucuggauuagaagccu

SEQ ID NO: 408834 - RNA, 20 nt, Human
agucccuuuggucagguauu

SEQ ID NO: 408835 - RNA, 22 nt, Human
ggcucugggucuguggggagcg

SEQ ID NO: 408836 - RNA, 22 nt, Human
caggaagauuagaccaagagcu

SEQ ID NO: 408837 - RNA, 22 nt, Human
uuuuuccaccguacuuccugag

SEQ ID NO: 408838 - RNA, 22 nt, Human
guauuacauuuaguaauuaggc

SEQ ID NO: 408839 - RNA, 22 nt, Human
ccaggagucaauaaaggaagcu

SEQ ID NO: 408840 - RNA, 22 nt, Human
agugccuggaccccaugacaua

SEQ ID NO: 408841 - RNA, 22 nt, Human
ugacagaacagguugggagcaa

SEQ ID NO: 408842 - RNA, 22 nt, Human
cugauuccaaagccaaagcuau

SEQ ID NO: 408843 - RNA, 22 nt, Human
ggcucaggaugagccuucucau

SEQ ID NO: 408844 - RNA, 22 nt, Human
aaguucuacagcuucgcaggca

SEQ ID NO: 408845 - RNA, 22 nt, Human
aaagccuugggauuugugauca

SEQ ID NO: 408846 - RNA, 22 nt, Human
caucuuuguaacuuccacauaa

SEQ ID NO: 408847 - RNA, 22 nt, Human
auccuucaaggggcugacagcu

SEQ ID NO: 408848 - RNA, 22 nt, Human
uccugggaagagaccugagcau

SEQ ID NO: 408849 - RNA, 22 nt, Human
gggucuggcaugcugagaugga

SEQ ID NO: 408850 - RNA, 22 nt, Human
aaacuguaggagggaaaggaag

SEQ ID NO: 408851 - RNA, 22 nt, Human
aaugccaguguguugauuccag

SEQ ID NO: 408852 - RNA, 22 nt, Human
gaggcugguaggaaaggaaaca

SEQ ID NO: 408853 - RNA, 22 nt, Human
uagaauaugauuaauuuucuua

SEQ ID NO: 408854 - RNA, 21 nt, Human
aggugccaaggagaagcaggc

SEQ ID NO: 408855 - RNA, 22 nt, Human
uagggcagccacccaggcugcu

SEQ ID NO: 408856 - RNA, 22 nt, Human
ugcucagggacaauggagaggg

SEQ ID NO: 408857 - RNA, 22 nt, Human
ccugcagggugcugccacagau

SEQ ID NO: 408858 - RNA, 22 nt, Human
cagcaaucgggugauaugcaau

SEQ ID NO: 408859 - RNA, 22 nt, Human
cagaaauucccauuucagauuc

SEQ ID NO: 408860 - RNA, 22 nt, Human
ucagggcauguauguuucuuua

SEQ ID NO: 408861 - RNA, 22 nt, Human
ccagucccagcucugccaugcu

SEQ ID NO: 408862 - RNA, 22 nt, Human
cuggcuuuuagugugaagacuu

SEQ ID NO: 408863 - RNA, 22 nt, Human
agccaagcaccacuggcacucg

SEQ ID NO: 408864 - RNA, 22 nt, Human
uccuugaaaagaaugucuccau

SEQ ID NO: 408865 - RNA, 22 nt, Human
gaggcugccccuuccucagcug

SEQ ID NO: 408866 - RNA, 22 nt, Human
aggcugucugaccccagagccc

SEQ ID NO: 408867 - RNA, 22 nt, Human
gccuucccaagacgccugaguu

SEQ ID NO: 408868 - RNA, 22 nt, Human
gugucauggaaaauugcaaugg

SEQ ID NO: 408869 - RNA, 22 nt, Human
caccagcagaagacugagggug

SEQ ID NO: 408870 - RNA, 22 nt, Human
ggugcugguucaggguggcugu

SEQ ID NO: 408871 - RNA, 22 nt, Human
auuguaaguagaaauguuaugg

SEQ ID NO: 408872 - RNA, 22 nt, Human
acuggcucagaguuccuagaga

SEQ ID NO: 408873 - RNA, 22 nt, Human
ccuuuguucacuggagagugga

SEQ ID NO: 408874 - RNA, 22 nt, Human
guggggcaugcacgcugcuccu

SEQ ID NO: 408875 - RNA, 23 nt, Human
agggcugaugccauugcagcucu

SEQ ID NO: 408876 - RNA, 22 nt, Human
gccaggcauguccucugcagaa

SEQ ID NO: 408877 - RNA, 22 nt, Human
caggcugggcagccuccccggc

SEQ ID NO: 408878 - RNA, 22 nt, Human
uccucagacuucccuuugugua

SEQ ID NO: 408879 - RNA, 22 nt, Human
acugaaggcuuucccaagguca

SEQ ID NO: 408880 - RNA, 22 nt, Human
ucccagaggaaauggcagcuga

SEQ ID NO: 408881 - RNA, 22 nt, Human
uguggcccagaugagugugcua

SEQ ID NO: 408882 - RNA, 21 nt, Human
ccuccaggagcagagcccuga

SEQ ID NO: 408883 - RNA, 22 nt, Human
ccugugucuuccccacuggugu

SEQ ID NO: 408884 - RNA, 22 nt, Human
gggggcuggacuuucccacaca

SEQ ID NO: 408885 - RNA, 22 nt, Human
ucugcuggccuuagcaggucua

SEQ ID NO: 408886 - RNA, 22 nt, Human
ugccaggcccugcgggguccca

SEQ ID NO: 408887 - RNA, 22 nt, Human
cacagaguggaggcuuggccug

SEQ ID NO: 408888 - RNA, 18 nt, Human
aaauguacuguccauggc

SEQ ID NO: 408889 - RNA, 22 nt, Human
gcucucugguuccagucaggaa

SEQ ID NO: 408890 - RNA, 22 nt, Human
ggcucuggagcacagacgucug

SEQ ID NO: 408891 - RNA, 23 nt, Human
ggaguuggauuguacuugcugcu

SEQ ID NO: 408892 - RNA, 22 nt, Human
cagcuuguuaccgagggagggu

SEQ ID NO: 408893 - RNA, 21 nt, Human
uuugaaagcccuauguuuuca

SEQ ID NO: 408894 - RNA, 22 nt, Human
gggaaauugugugagaucuuug

SEQ ID NO: 408895 - RNA, 22 nt, Human
acagguggccccgagggagugg

SEQ ID NO: 408896 - RNA, 22 nt, Human
aggcacugaagaacucuuuuug

SEQ ID NO: 408897 - RNA, 22 nt, Human
ucagggcaggcgagcagcugcu

SEQ ID NO: 408898 - RNA, 22 nt, Human
aaagauuuaagaauaauuugug

SEQ ID NO: 408899 - RNA, 22 nt, Human
uggcagaggagaauuaagauua

SEQ ID NO: 408900 - RNA, 22 nt, Human
cccuggaguagcacugggucgc

SEQ ID NO: 408901 - RNA, 22 nt, Human
uagggcucagcucuagcuccug

SEQ ID NO: 408902 - RNA, 22 nt, Human
gggcuucuagaccagcagugag

SEQ ID NO: 408903 - RNA, 22 nt, Human
cuuauaguaugauguugagaau

SEQ ID NO: 408904 - RNA, 22 nt, Human
aacaaagucguugccuagaaga

SEQ ID NO: 408905 - RNA, 19 nt, Human
ugaagcaauaccauuuuug

SEQ ID NO: 408906 - RNA, 22 nt, Human
cugcagggugacguugcccacc

SEQ ID NO: 408907 - RNA, 22 nt, Human
uuauuuauucauucugucuguc

SEQ ID NO: 408908 - RNA, 22 nt, Human
uggagcaggugccaggugugug

SEQ ID NO: 408909 - RNA, 22 nt, Human
ucaugucaguuucuucuauaaa

SEQ ID NO: 408910 - RNA, 22 nt, Human
ucugagagagggucagaugcua

SEQ ID NO: 408911 - RNA, 22 nt, Human
cacucuccagcacaccccauuu

SEQ ID NO: 408912 - RNA, 22 nt, Human
cccaggcagaauuaguguuuca

SEQ ID NO: 408913 - RNA, 22 nt, Human
uucaagauggcugcaaauacuu

SEQ ID NO: 408914 - RNA, 22 nt, Human
uggcccuguguccugcugccag

SEQ ID NO: 408915 - RNA, 21 nt, Human
ucucugguuggaguugugcca

SEQ ID NO: 408916 - RNA, 22 nt, Human
uagcauuucccaaaugcauuug

SEQ ID NO: 408917 - RNA, 22 nt, Human
ggcuuccuaauacucccuacac

SEQ ID NO: 408918 - RNA, 22 nt, Human
gagcugccaguguaugaauucu

SEQ ID NO: 408919 - RNA, 22 nt, Human
uuugacagacauuuacuacauu

SEQ ID NO: 408920 - RNA, 22 nt, Human
acugucucucuagcaguucagg

SEQ ID NO: 408921 - RNA, 22 nt, Human
caaaauuagaaaugcagcuguu

SEQ ID NO: 408922 - RNA, 22 nt, Human
ucagagagcuggugggcagagg

SEQ ID NO: 408923 - RNA, 22 nt, Human
uguggaaaauuggaacguuccu

SEQ ID NO: 408924 - RNA, 22 nt, Human
uggccaggcagguagaacggcc

SEQ ID NO: 408925 - RNA, 22 nt, Human
agaggcugggaaggguccccgg

SEQ ID NO: 408926 - RNA, 22 nt, Human
gccaggcaauguguuagaagcg

SEQ ID NO: 408927 - RNA, 22 nt, Human
uggccucucuaccaggcagccu

SEQ ID NO: 408928 - RNA, 22 nt, Human
cagcaggguuaagugacucacc

SEQ ID NO: 408929 - RNA, 22 nt, Human
ggaaacagagggcaccugagcc

SEQ ID NO: 408930 - RNA, 22 nt, Human
agaggcuguuacacucccagau

SEQ ID NO: 408931 - RNA, 21 nt, Human
uccugcagggcagcagagugg

SEQ ID NO: 408932 - RNA, 22 nt, Human
gugcauuuggugacucucaccc

SEQ ID NO: 408933 - RNA, 22 nt, Human
caguauguacucuuaucaugua

SEQ ID NO: 408934 - RNA, 22 nt, Human
cagaugagaguggccaggguuc

SEQ ID NO: 408935 - RNA, 22 nt, Human
gacaggcuuugagucccagaac

SEQ ID NO: 408936 - RNA, 21 nt, Human
cuguccaguaauuccuggcac

SEQ ID NO: 408937 - RNA, 22 nt, Human
gccuggcacucacugaagaggc

SEQ ID NO: 408938 - RNA, 22 nt, Human
aggugccagaugcacagcugaa

SEQ ID NO: 408939 - RNA, 22 nt, Human
ucauaauacaaagaguucugca

SEQ ID NO: 408940 - RNA, 22 nt, Human
ucagucucuggggcuucuguuu

SEQ ID NO: 408941 - RNA, 22 nt, Human
gagcugugagggacacauugcu

SEQ ID NO: 408942 - RNA, 22 nt, Human
aggugaguuacaggaggagguc

SEQ ID NO: 408943 - RNA, 22 nt, Human
gcagcugaauguccauugcugc

SEQ ID NO: 408944 - RNA, 22 nt, Human
agggccagcugaugagaaugag

SEQ ID NO: 408945 - RNA, 22 nt, Human
uggcagggaauacagauguuua

SEQ ID NO: 408946 - RNA, 22 nt, Human
ugccugggccuucccaccucug

SEQ ID NO: 408947 - RNA, 22 nt, Human
gugccagggggcacugaacaga

SEQ ID NO: 408948 - RNA, 22 nt, Human
gugcaggggccuccccuugcug

SEQ ID NO: 408949 - RNA, 22 nt, Human
gccucugcaauuacauugugcc

SEQ ID NO: 408950 - RNA, 22 nt, Human
gcugucuuccuugcuccaaggg

SEQ ID NO: 408951 - RNA, 22 nt, Human
cagccagguucaaguccuuaua

SEQ ID NO: 408952 - RNA, 22 nt, Human
ggaggugaggccguagggugug

SEQ ID NO: 408953 - RNA, 22 nt, Human
auuauucaacacuugagaaauu

SEQ ID NO: 408954 - RNA, 22 nt, Human
gcacagccacugagugagaacc

SEQ ID NO: 408955 - RNA, 23 nt, Human
agccagggcacugguggagauug

SEQ ID NO: 408956 - RNA, 22 nt, Human
ccugcugugaaacuggcauaug

SEQ ID NO: 408957 - RNA, 22 nt, Human
agccacagucaaccuguccaua

SEQ ID NO: 408958 - RNA, 22 nt, Human
cagucccagacauaguaaggga

SEQ ID NO: 408959 - RNA, 22 nt, Human
uaguccauuuucacacugcuga

SEQ ID NO: 408960 - RNA, 22 nt, Human
aaagcaaugggucuaagguaaa

SEQ ID NO: 408961 - RNA, 22 nt, Human
caggaggcccaaagggcgcaga

SEQ ID NO: 408962 - RNA, 22 nt, Human
gaugcaggauagcuucacccag

SEQ ID NO: 408963 - RNA, 22 nt, Human
ucauuacaguguuuauaugucu

SEQ ID NO: 408964 - RNA, 22 nt, Human
cugaggcucccucgggucugcu

SEQ ID NO: 408965 - RNA, 22 nt, Human
gcacagguugcaaaaguucaca

SEQ ID NO: 408966 - RNA, 21 nt, Human
gccugccugcgugacccucuu

SEQ ID NO: 408967 - RNA, 19 nt, Human
uggcagcauugguaccuug

SEQ ID NO: 408968 - RNA, 22 nt, Human
agaaauguauagugaauuuuuc

SEQ ID NO: 408969 - RNA, 23 nt, Human
agagcuuucuaaaauguaaaucu

SEQ ID NO: 408970 - RNA, 22 nt, Human
gcuuuauuuugugagggauuac

SEQ ID NO: 408971 - RNA, 22 nt, Human
cuguagccagaagcagaaggcc

SEQ ID NO: 408972 - RNA, 22 nt, Human
gggcagcagaggaucccuuaau

SEQ ID NO: 408973 - RNA, 22 nt, Human
agcugucucugguauuauguga

SEQ ID NO: 408974 - RNA, 22 nt, Human
ggccagggccuggggacugucc

SEQ ID NO: 408975 - RNA, 22 nt, Human
aggagagagcugagcuuugcug

SEQ ID NO: 408976 - RNA, 22 nt, Human
cacaggcuuccaguccccagcu

SEQ ID NO: 408977 - RNA, 22 nt, Human
uuccuggugguggugacagcac

SEQ ID NO: 408978 - RNA, 22 nt, Human
ucagagaacacagaggugaugu

SEQ ID NO: 408979 - RNA, 22 nt, Human
uacauggguagguuaagucaua

SEQ ID NO: 408980 - RNA, 22 nt, Human
guggccuuuccugaagaaauga

SEQ ID NO: 408981 - RNA, 22 nt, Human
gugugccaacaaaagacagugc

SEQ ID NO: 408982 - RNA, 22 nt, Human
ccugggcaggaugggcccggug

SEQ ID NO: 408983 - RNA, 22 nt, Human
agccaggggauucaucagggac

SEQ ID NO: 408984 - RNA, 22 nt, Human
gcugucugggaggccuccacuu

SEQ ID NO: 408985 - RNA, 17 nt, Human
gggcugacaguggccuc

SEQ ID NO: 408986 - RNA, 22 nt, Human
uccuucagcuacucaguuucca

SEQ ID NO: 408987 - RNA, 22 nt, Human
ccuggccugcucggcucuuaag

SEQ ID NO: 408988 - RNA, 22 nt, Human
uccugcagccacugcaggcaga

SEQ ID NO: 408989 - RNA, 22 nt, Human
gcuggccuucugcagaguucug

SEQ ID NO: 408990 - RNA, 22 nt, Human
agggaugguggagguugcaagu

SEQ ID NO: 408991 - RNA, 22 nt, Human
gcugccugcucggcuccuggga

SEQ ID NO: 408992 - RNA, 22 nt, Human
acuaaauaguuuugacagaaca

SEQ ID NO: 408993 - RNA, 22 nt, Human
uccaggcauuggagagauaaug

SEQ ID NO: 408994 - RNA, 22 nt, Human
ucagagaaaugaaguagggauu

SEQ ID NO: 408995 - RNA, 22 nt, Human
gcugguuagaaaacagagcuca

SEQ ID NO: 408996 - RNA, 20 nt, Human
accaggagauggaggcaggg

SEQ ID NO: 408997 - RNA, 22 nt, Human
cagggcccaggccacuggguug

SEQ ID NO: 408998 - RNA, 22 nt, Human
cagaagcauuccagcaaauagu

SEQ ID NO: 408999 - RNA, 22 nt, Human
agcugagagguggcaagcugua

SEQ ID NO: 409000 - RNA, 22 nt, Human
agcagaacauuuucagggcugu

SEQ ID NO: 409001 - RNA, 22 nt, Human
gcugagagaucaaggcaggauu

SEQ ID NO: 409002 - RNA, 22 nt, Human
ccuggagcgcgggucaagcugg

SEQ ID NO: 409003 - RNA, 22 nt, Human
ccuggcagcuaagugcuuugag

SEQ ID NO: 409004 - RNA, 22 nt, Human
ucucgacagccuggcacagugg

SEQ ID NO: 409005 - RNA, 22 nt, Human
ugggcuggcugaggcauucacu

SEQ ID NO: 409006 - RNA, 22 nt, Human
cagccagugguugaagaugcag

SEQ ID NO: 409007 - RNA, 22 nt, Human
caauuucugggccucacacaag

SEQ ID NO: 409008 - RNA, 22 nt, Human
augccuguaaucccagugcuuu

SEQ ID NO: 409009 - RNA, 23 nt, Human
agggcccaagccuggacagcagg

SEQ ID NO: 409010 - RNA, 23 nt, Human
acagccaguucaccucuccuugg

SEQ ID NO: 409011 - RNA, 22 nt, Human
cugccuggcauggagaagagaa

SEQ ID NO: 409012 - RNA, 21 nt, Human
aggugcagagccagggaccag

SEQ ID NO: 409013 - RNA, 22 nt, Human
ccauggccgccgcugcucagga

SEQ ID NO: 409014 - RNA, 22 nt, Human
cucuuccucucaugcggucaua

SEQ ID NO: 409015 - RNA, 22 nt, Human
uccagccaacugccuagggagc

SEQ ID NO: 409016 - RNA, 22 nt, Human
uuacaaguauuuaagaugcugu

SEQ ID NO: 409017 - RNA, 22 nt, Human
uucugugaaucuuuuuucccac

SEQ ID NO: 409018 - RNA, 22 nt, Human
ugugccaugaggcucugauaug

SEQ ID NO: 409019 - RNA, 22 nt, Human
cuggagggggaaauguucauug

SEQ ID NO: 409020 - RNA, 22 nt, Human
cuggguggcuguccagccagcc

SEQ ID NO: 409021 - RNA, 22 nt, Human
aggccagcaccagagucaagaa

SEQ ID NO: 409022 - RNA, 22 nt, Human
ugggcucuccuggaggacaaca

SEQ ID NO: 409023 - RNA, 22 nt, Human
gagaaagggaacuuacagagug

SEQ ID NO: 409024 - RNA, 22 nt, Human
gcacacaggcaguuuccagcca

SEQ ID NO: 409025 - RNA, 22 nt, Human
gggcaggucugggucagccuga

SEQ ID NO: 409026 - RNA, 22 nt, Human
aggcagcuggcagcacccaggg

SEQ ID NO: 409027 - RNA, 22 nt, Human
ccugugugcacacgaggccaug

SEQ ID NO: 409028 - RNA, 22 nt, Human
gguggccugcccugaucccugg

SEQ ID NO: 409029 - RNA, 22 nt, Human
caggcaggugcagauuccucuu

SEQ ID NO: 409030 - RNA, 22 nt, Human
agggcuccuaugccccauggac

SEQ ID NO: 409031 - RNA, 22 nt, Human
ucauuguuucugcuuuucauga

SEQ ID NO: 409032 - RNA, 19 nt, Human
ccugcagggaugagagguu

SEQ ID NO: 409033 - RNA, 22 nt, Human
agggcagagagaugaaugggau

SEQ ID NO: 409034 - RNA, 22 nt, Human
cagugcaguugguggcaggggu

SEQ ID NO: 409035 - RNA, 22 nt, Human
gagcuguccgccccugggccga

SEQ ID NO: 409036 - RNA, 22 nt, Human
caggcagaagaaguggaaggac

SEQ ID NO: 409037 - RNA, 16 nt, Human
agaggccuugaggaag

SEQ ID NO: 409038 - RNA, 22 nt, Human
ggcucuggugggaagguuagau

SEQ ID NO: 409039 - RNA, 22 nt, Human
gccuucugugcuccuggccuuu

SEQ ID NO: 409040 - RNA, 22 nt, Human
cggcagcaaaggaagccagguc

SEQ ID NO: 409041 - RNA, 22 nt, Human
auugucgcuuauuuaggugcuu

SEQ ID NO: 409042 - RNA, 22 nt, Human
gcugcaggcgccugcggucucu

SEQ ID NO: 409043 - RNA, 22 nt, Human
cuuagaaauaaugguuucaguu

SEQ ID NO: 409044 - RNA, 22 nt, Human
uagccaggucacacuguguguu

SEQ ID NO: 409045 - RNA, 22 nt, Human
caagauggguguugugaugguu

SEQ ID NO: 409046 - RNA, 22 nt, Human
gcugucucggggcuuucuccug

SEQ ID NO: 409047 - RNA, 22 nt, Human
gacucugcuacaggccgagguu

SEQ ID NO: 409048 - RNA, 22 nt, Human
cucccuggaggugagcuggcac

SEQ ID NO: 409049 - RNA, 22 nt, Human
aguuucauauuaccaugucacc

SEQ ID NO: 409050 - RNA, 22 nt, Human
gagccucguggcggccacugcg

SEQ ID NO: 409051 - RNA, 23 nt, Human
cgcccagccucagugaccugggc

SEQ ID NO: 409052 - RNA, 22 nt, Human
ugcagccaucuuucuuggagga

SEQ ID NO: 409053 - RNA, 22 nt, Human
ucucagagauguuagggaagag

SEQ ID NO: 409054 - RNA, 22 nt, Human
uuggcauuuauucuaaggucaa

SEQ ID NO: 409055 - RNA, 22 nt, Human
gaggacagugugaucugccagc

SEQ ID NO: 409056 - RNA, 22 nt, Human
gacccggcuccaggcccagcag

SEQ ID NO: 409057 - RNA, 22 nt, Human
uccugggcugugugccacucug

SEQ ID NO: 409058 - RNA, 22 nt, Human
cuucuggggauggagcccagaa

SEQ ID NO: 409059 - RNA, 22 nt, Human
ggcccacuugaaauggagcuca

SEQ ID NO: 409060 - RNA, 22 nt, Human
aguacaaaggcccuugauuacu

SEQ ID NO: 409061 - RNA, 22 nt, Human
ggguggcuccuaugggcauagc

SEQ ID NO: 409062 - RNA, 22 nt, Human
cugggcuggcgcauccgacacg

SEQ ID NO: 409063 - RNA, 22 nt, Human
agucccagugacuuggccagaa

SEQ ID NO: 409064 - RNA, 22 nt, Human
accugccuaguugguucugccc

SEQ ID NO: 409065 - RNA, 22 nt, Human
gccacagggcagaugcgcagag

SEQ ID NO: 409066 - RNA, 22 nt, Human
ugcuuuaucaaagcuauaguga

SEQ ID NO: 409067 - RNA, 22 nt, Human
agaguguuauuugcucuguauu

SEQ ID NO: 409068 - RNA, 22 nt, Human
cagagacagaaaauggaucuag

SEQ ID NO: 409069 - RNA, 22 nt, Human
uaguacuuaucucugucauugu

SEQ ID NO: 409070 - RNA, 22 nt, Human
caaagucagccagcuaguaggu

SEQ ID NO: 409071 - RNA, 22 nt, Human
aaaaaguuucaacugccaacuc

SEQ ID NO: 409072 - RNA, 20 nt, Human
uggagccacagucagguucc

SEQ ID NO: 409073 - RNA, 22 nt, Human
ucugucauugcaauaaaauuuc

SEQ ID NO: 409074 - RNA, 22 nt, Human
ggccucuggcaggcaggcccuc

SEQ ID NO: 409075 - RNA, 22 nt, Human
uagcuuuaggcacguuugaauu

SEQ ID NO: 409076 - RNA, 22 nt, Human
ugcaagaggaauucuagaagca

SEQ ID NO: 409077 - RNA, 22 nt, Human
cauuucugugacacuuccaucu

SEQ ID NO: 409078 - RNA, 22 nt, Human
aggaccugacuggcuccugcuu

SEQ ID NO: 409079 - RNA, 22 nt, Human
aggacaguccgggguccuccac

SEQ ID NO: 409080 - RNA, 22 nt, Human
gggagggaucugcuaggcaaug

SEQ ID NO: 409081 - RNA, 22 nt, Human
gagauuucuuuugaugccuguc

SEQ ID NO: 409082 - RNA, 19 nt, Human
agagaggcugugugaggga

SEQ ID NO: 409083 - RNA, 21 nt, Human
aucacauuggcuguuauuauu

SEQ ID NO: 409084 - RNA, 22 nt, Human
agauguggauccuaggguagaa

SEQ ID NO: 409085 - RNA, 22 nt, Human
uaaauguauaggcacuaaaccu

SEQ ID NO: 409086 - RNA, 20 nt, Human
cccuggccuguuucaugccc

SEQ ID NO: 409087 - RNA, 22 nt, Human
gccuggagggauagaaugcaag

SEQ ID NO: 409088 - RNA, 22 nt, Human
ccucagaguaggucucagcugu

SEQ ID NO: 409089 - RNA, 22 nt, Human
gcagaggggaagcugaggaauu

SEQ ID NO: 409090 - RNA, 22 nt, Human
uucauguguauggaacauuuuu

SEQ ID NO: 409091 - RNA, 22 nt, Human
uaacagaauuugcuaaacuccg

SEQ ID NO: 409092 - RNA, 22 nt, Human
acccucaacaaauucacucuau

SEQ ID NO: 409093 - RNA, 22 nt, Human
agcuuuaugaggagaccuuagu

SEQ ID NO: 409094 - RNA, 19 nt, Human
uguagcaguuuaaaacaac

SEQ ID NO: 409095 - RNA, 22 nt, Human
cacagcuucuccuugauaucgc

SEQ ID NO: 409096 - RNA, 22 nt, Human
gggaagggagggaccucagucu

SEQ ID NO: 409097 - RNA, 22 nt, Human
cacagcuucccaaaguggaccu

SEQ ID NO: 409098 - RNA, 22 nt, Human
acuugcauuauauuuaucacaa

SEQ ID NO: 409099 - RNA, 22 nt, Human
gguuccacgguguuuggaggca

SEQ ID NO: 409100 - RNA, 22 nt, Human
cagaggccuuucuacagugaua

SEQ ID NO: 409101 - RNA, 18 nt, Human
aagccagagaccacugcc

SEQ ID NO: 409102 - RNA, 22 nt, Human
caggcacuguguuaggcacugu

SEQ ID NO: 409103 - RNA, 22 nt, Human
acuguguguuugucuagcacag

SEQ ID NO: 409104 - RNA, 22 nt, Human
cugggcacaggggagcagaguc

SEQ ID NO: 409105 - RNA, 22 nt, Human
uagcagggguagauagagugug

SEQ ID NO: 409106 - RNA, 22 nt, Human
agggcagaaaucgauuacaccu

SEQ ID NO: 409107 - RNA, 22 nt, Human
guuucauuaccugacccaugag

SEQ ID NO: 409108 - RNA, 22 nt, Human
aucuggcucaccuggguaaaua

SEQ ID NO: 409109 - RNA, 22 nt, Human
ugaugcugagccugggacugac

SEQ ID NO: 409110 - RNA, 22 nt, Human
ggaugcaggacggcauggaugu

SEQ ID NO: 409111 - RNA, 22 nt, Human
aaauccuaaaaguuugacuuaa

SEQ ID NO: 409112 - RNA, 22 nt, Human
guuauuagaagugaaggauugu

SEQ ID NO: 409113 - RNA, 22 nt, Human
gccucugcaugcucagcaccca

SEQ ID NO: 409114 - RNA, 22 nt, Human
caguuucuuggaugccaauuuc

SEQ ID NO: 409115 - RNA, 23 nt, Human
ugggccuggccucccaguccagc

SEQ ID NO: 409116 - RNA, 22 nt, Human
gcauccagucuuggcuccugga

SEQ ID NO: 409117 - RNA, 22 nt, Human
uggccuuguguuuuagagaaag

SEQ ID NO: 409118 - RNA, 22 nt, Human
aguggcagagugcacucaggca

SEQ ID NO: 409119 - RNA, 22 nt, Human
uagcagggccaggcugggaacc

SEQ ID NO: 409120 - RNA, 22 nt, Human
ccaggcccugcuccucacacca

SEQ ID NO: 409121 - RNA, 22 nt, Human
uucagagauggaaggcagaaug

SEQ ID NO: 409122 - RNA, 22 nt, Human
gagggccaauggauuucaacug

SEQ ID NO: 409123 - RNA, 22 nt, Human
ugccaggccaaugaaggcaggg

SEQ ID NO: 409124 - RNA, 22 nt, Human
agugaaauacugucguuuuuag

SEQ ID NO: 409125 - RNA, 22 nt, Human
ucugagggcuugaggggaagua

SEQ ID NO: 409126 - RNA, 22 nt, Human
gccuaggaguacagaaugguuu

SEQ ID NO: 409127 - RNA, 22 nt, Human
cagggccuucguaaguguccgg

SEQ ID NO: 409128 - RNA, 22 nt, Human
ccucagccuuggccccaggcag

SEQ ID NO: 409129 - RNA, 22 nt, Human
agccacgucccugucaggguca

SEQ ID NO: 409130 - RNA, 20 nt, Human
agcauuugaaauaugacuau

SEQ ID NO: 409131 - RNA, 22 nt, Human
cagagccauuauggagacuugc

SEQ ID NO: 409132 - RNA, 22 nt, Human
caguggcaaugggacagagcac

SEQ ID NO: 409133 - RNA, 22 nt, Human
cacuguacagcauuaacaaggc

SEQ ID NO: 409134 - RNA, 22 nt, Human
uugaaaggguuaaagugguaaa

SEQ ID NO: 409135 - RNA, 22 nt, Human
ucccagggucaguggugaggcc

SEQ ID NO: 409136 - RNA, 22 nt, Human
agacaucagcuugugugcaggg

SEQ ID NO: 409137 - RNA, 22 nt, Human
aguggcaggcagaagcuucuca

SEQ ID NO: 409138 - RNA, 22 nt, Human
cagggcucccaaauaucucuuc

SEQ ID NO: 409139 - RNA, 22 nt, Human
cugcugugcaggugccuaugau

SEQ ID NO: 409140 - RNA, 22 nt, Human
gcaugucaugucauguaggaau

SEQ ID NO: 409141 - RNA, 22 nt, Human
ggggagaguccuuuccaguucc

SEQ ID NO: 409142 - RNA, 22 nt, Human
agugucauaugccacugcaucc

SEQ ID NO: 409143 - RNA, 23 nt, Human
cccagcagauuguaaagugucca

SEQ ID NO: 409144 - RNA, 17 nt, Human
auacaguuuauuuuaca

SEQ ID NO: 409145 - RNA, 22 nt, Human
ugaggcagucacccccuccugc

SEQ ID NO: 409146 - RNA, 22 nt, Human
gcucaggaaauaguuuaguguu

SEQ ID NO: 409147 - RNA, 22 nt, Human
uccauuuucaucucauguauaa

SEQ ID NO: 409148 - RNA, 22 nt, Human
uuuuagaaauacugauuuagug

SEQ ID NO: 409149 - RNA, 22 nt, Human
uugugcaauuuaaaaucuuccu

SEQ ID NO: 409150 - RNA, 22 nt, Human
gcucagagggaacaaggggcug

SEQ ID NO: 409151 - RNA, 17 nt, Human
auuuccucagggcugag

SEQ ID NO: 409152 - RNA, 22 nt, Human
cuacauuucccagcugccuucc

SEQ ID NO: 409153 - RNA, 22 nt, Human
uggagauggguuaauggagaga

SEQ ID NO: 409154 - RNA, 22 nt, Human
cagaauuuagcacaauguaugg

SEQ ID NO: 409155 - RNA, 22 nt, Human
caagggcucacggucugcuggg

SEQ ID NO: 409156 - RNA, 22 nt, Human
aagccagguuccauggaggagc

SEQ ID NO: 409157 - RNA, 22 nt, Human
agggguggccugccuuacuccc

SEQ ID NO: 409158 - RNA, 22 nt, Human
cucagugguugagagccugggc

SEQ ID NO: 409159 - RNA, 22 nt, Human
auuuauguaucuguguagauca

SEQ ID NO: 409160 - RNA, 21 nt, Human
gcacagggacagaucaucaca

SEQ ID NO: 409161 - RNA, 22 nt, Human
aauucuagcauugugaaaauau

SEQ ID NO: 409162 - RNA, 22 nt, Human
cucuugaagcaggggccaguuc

SEQ ID NO: 409163 - RNA, 22 nt, Human
caagagcuagacuuugucagga

SEQ ID NO: 409164 - RNA, 22 nt, Human
uggagcagagaugguggccuuc

SEQ ID NO: 409165 - RNA, 22 nt, Human
uagggacacugcucaugaguuc

SEQ ID NO: 409166 - RNA, 22 nt, Human
agaagccaccagcugaggaaga

SEQ ID NO: 409167 - RNA, 22 nt, Human
augggaugaacuugaucugcuu

SEQ ID NO: 409168 - RNA, 22 nt, Human
cuucagaacuauaaaaaguacu

SEQ ID NO: 409169 - RNA, 22 nt, Human
ccaggggcuggugcugagcugg

SEQ ID NO: 409170 - RNA, 22 nt, Human
ugaagggcaaccccaggcccag

SEQ ID NO: 409171 - RNA, 22 nt, Human
ggccagcagucacagggucaga

SEQ ID NO: 409172 - RNA, 22 nt, Human
uggcaggagguuuucuccagga

SEQ ID NO: 409173 - RNA, 22 nt, Human
uggaggcagucaaaugacugac

SEQ ID NO: 409174 - RNA, 22 nt, Human
ucaaagucacaacucucuaauu

SEQ ID NO: 409175 - RNA, 22 nt, Human
ucagagagcagaacuuuuuuac

SEQ ID NO: 409176 - RNA, 18 nt, Human
cuuguucuucucuuggcg

SEQ ID NO: 409177 - RNA, 22 nt, Human
cauggcccucuucuggagcaau

SEQ ID NO: 409178 - RNA, 23 nt, Human
ucuggcucuaugugacagcucuc

SEQ ID NO: 409179 - RNA, 21 nt, Human
gacaaagugaagcaggcagga

SEQ ID NO: 409180 - RNA, 22 nt, Human
gaggcagcggcucacagagaaa

SEQ ID NO: 409181 - RNA, 22 nt, Human
aggcucaggucucaggucuggc

SEQ ID NO: 409182 - RNA, 22 nt, Human
uccuucagggcugaccacaggc

SEQ ID NO: 409183 - RNA, 22 nt, Human
cuggccuagcucucugcuugaa

SEQ ID NO: 409184 - RNA, 22 nt, Human
uccuggauucugcccugaaggc

SEQ ID NO: 409185 - RNA, 18 nt, Human
ucagagagaauaguaauu

SEQ ID NO: 409186 - RNA, 22 nt, Human
ugaggaaguugaucucaucagu

SEQ ID NO: 409187 - RNA, 22 nt, Human
aaggcuuucagcuaacuugauu

SEQ ID NO: 409188 - RNA, 22 nt, Human
cccaggcagagagcuggugagc

SEQ ID NO: 409189 - RNA, 22 nt, Human
uuugcagcaaggagagagcauu

SEQ ID NO: 409190 - RNA, 22 nt, Human
aaacaugcauucaagaaaaucu

SEQ ID NO: 409191 - RNA, 22 nt, Human
ucaggagacuuaugucacagug

SEQ ID NO: 409192 - RNA, 22 nt, Human
ccagcuucucucugaugcagcu

SEQ ID NO: 409193 - RNA, 22 nt, Human
aucaggaugacuauaaggcugc

SEQ ID NO: 409194 - RNA, 19 nt, Human
agacagagacugaaauaga

SEQ ID NO: 409195 - RNA, 22 nt, Human
cugugcccuggccaggccucuc

SEQ ID NO: 409196 - RNA, 22 nt, Human
uuguaaauaguaguaagaugcc

SEQ ID NO: 409197 - RNA, 22 nt, Human
gcccugugcgacucuagagguu

SEQ ID NO: 409198 - RNA, 22 nt, Human
gcugugugacugagagccuggc

SEQ ID NO: 409199 - RNA, 22 nt, Human
auuuaaaugcuuaagaggguuu

SEQ ID NO: 409200 - RNA, 22 nt, Human
cugggccaucagaggggcugga

SEQ ID NO: 409201 - RNA, 22 nt, Human
gaugcacuuucuuuucaacagu

SEQ ID NO: 409202 - RNA, 22 nt, Human
uauugacagagggucagaagag

SEQ ID NO: 409203 - RNA, 22 nt, Human
agugaaauagcauuuaugaagc

SEQ ID NO: 409204 - RNA, 22 nt, Human
ucuaggagcaugaagggaaggc

SEQ ID NO: 409205 - RNA, 22 nt, Human
agacccucuccaugcccacugc

SEQ ID NO: 409206 - RNA, 22 nt, Human
cagagcuguuacuauucaugaa

SEQ ID NO: 409207 - RNA, 23 nt, Human
uggcugagcccacuaucuuggcc

SEQ ID NO: 409208 - RNA, 22 nt, Human
uucaggauggaguaccuuuuau

SEQ ID NO: 409209 - RNA, 22 nt, Human
gaaggcuggaaggcaaguagga

SEQ ID NO: 409210 - RNA, 22 nt, Human
gagagaagaaagccaugguccu

SEQ ID NO: 409211 - RNA, 22 nt, Human
cuccagugcgcaggacagcccc

SEQ ID NO: 409212 - RNA, 22 nt, Human
uguauuagaucugagaacuucu

SEQ ID NO: 409213 - RNA, 22 nt, Human
guucauuuuacuguaaauagca

SEQ ID NO: 409214 - RNA, 22 nt, Human
uauugaggaucuccugcuaauu

SEQ ID NO: 409215 - RNA, 18 nt, Human
gucaccuggaucagauua

SEQ ID NO: 409216 - RNA, 22 nt, Human
ccacugucugcaggccucagca

SEQ ID NO: 409217 - RNA, 22 nt, Human
auuuuacauaaggaagguuuaa

SEQ ID NO: 409218 - RNA, 23 nt, Human
cagaggcaucggauucaacauca

SEQ ID NO: 409219 - RNA, 22 nt, Human
gcucccagcaauugaggcagcc

SEQ ID NO: 409220 - RNA, 19 nt, Human
uggccagguacugucugcu

SEQ ID NO: 409221 - RNA, 22 nt, Human
gcaggcagaucaccugucagga

SEQ ID NO: 409222 - RNA, 22 nt, Human
aagcagcugauuucacagcuca

SEQ ID NO: 409223 - RNA, 20 nt, Human
ugaggcucagagagguugag

SEQ ID NO: 409224 - RNA, 22 nt, Human
cuugcaggcagggccuccugga

SEQ ID NO: 409225 - RNA, 21 nt, Human
aaacugaccuugccugagaca

SEQ ID NO: 409226 - RNA, 22 nt, Human
ccaaaugcuccacugacuuugg

SEQ ID NO: 409227 - RNA, 22 nt, Human
uggcucaguuucugcccagcug

SEQ ID NO: 409228 - RNA, 22 nt, Human
ccagagcuccagggcuacagaa

SEQ ID NO: 409229 - RNA, 22 nt, Human
aaggcagccgugugacugcaug

SEQ ID NO: 409230 - RNA, 22 nt, Human
gagggaccuuuacacagacauu

SEQ ID NO: 409231 - RNA, 22 nt, Human
ccuggccugugaaucugagagc

SEQ ID NO: 409232 - RNA, 22 nt, Human
gagagugaaggcuucccagcaa

SEQ ID NO: 409233 - RNA, 22 nt, Human
agucaaagcuacaggcauuuga

SEQ ID NO: 409234 - RNA, 22 nt, Human
aucaguuugauaauaaggcuug

SEQ ID NO: 409235 - RNA, 22 nt, Human
uccagaccuagggcaccccagu

SEQ ID NO: 409236 - RNA, 21 nt, Human
aagccucaagcagaagacaga

SEQ ID NO: 409237 - RNA, 22 nt, Human
augaaggauggcuggcugcccu

SEQ ID NO: 409238 - RNA, 22 nt, Human
caaagguauaaguuaauauaca

SEQ ID NO: 409239 - RNA, 22 nt, Human
caggagccagcugucccaacca

SEQ ID NO: 409240 - RNA, 22 nt, Human
cagagccaggccugcccucuuu

SEQ ID NO: 409241 - RNA, 22 nt, Human
uuuauuaugauggacaccuucg

SEQ ID NO: 409242 - RNA, 18 nt, Human
acauuucuaugcuucugg

SEQ ID NO: 409243 - RNA, 19 nt, Human
aggacucuggaggcaugag

SEQ ID NO: 409244 - RNA, 22 nt, Human
uuugagguuagcuagcagauca

SEQ ID NO: 409245 - RNA, 22 nt, Human
uaaagguaugucuuaaucaaac

SEQ ID NO: 409246 - RNA, 22 nt, Human
uccucugcuguucugguucuuu

SEQ ID NO: 409247 - RNA, 22 nt, Human
aaaaccaggcguuuccuauuau

SEQ ID NO: 409248 - RNA, 22 nt, Human
ggaaagccaggugcucuggugu

SEQ ID NO: 409249 - RNA, 22 nt, Human
gggcucugguacuuccuggcuc

SEQ ID NO: 409250 - RNA, 22 nt, Human
uugcauugggagugaggagacc

SEQ ID NO: 409251 - RNA, 21 nt, Human
guuuucaugauagagucugua

SEQ ID NO: 409252 - RNA, 22 nt, Human
cauuuguaucugggcugcugug

SEQ ID NO: 409253 - RNA, 22 nt, Human
cagugcauaaucuaaauggggg

SEQ ID NO: 409254 - RNA, 21 nt, Human
ccaggguccagcugccauggu

SEQ ID NO: 409255 - RNA, 22 nt, Human
uacacacaugcauuugccuuau

SEQ ID NO: 409256 - RNA, 20 nt, Human
aucuggcucagauccugcag

SEQ ID NO: 409257 - RNA, 22 nt, Human
aggcagcauccagaggagaaug

SEQ ID NO: 409258 - RNA, 22 nt, Human
auggagacgcaagggaccuagg

SEQ ID NO: 409259 - RNA, 22 nt, Human
ugaagcagagugaaggugaauu

SEQ ID NO: 409260 - RNA, 22 nt, Human
gccauccucugagcacuaggca

SEQ ID NO: 409261 - RNA, 22 nt, Human
guguaaggccccagguucuuua

SEQ ID NO: 409262 - RNA, 22 nt, Human
uuggcuucuggcagucuggacg

SEQ ID NO: 409263 - RNA, 22 nt, Human
uccucaggagagcuccuaugcc

SEQ ID NO: 409264 - RNA, 22 nt, Human
ugaagccaucaggaagccagca

SEQ ID NO: 409265 - RNA, 22 nt, Human
agccuccuggaguuucugggau

SEQ ID NO: 409266 - RNA, 22 nt, Human
uggcagcuccuggggccagcac

SEQ ID NO: 409267 - RNA, 22 nt, Human
ggcuuucuagaucuagcucugu

SEQ ID NO: 409268 - RNA, 22 nt, Human
accugccucuaagcagcaggug

SEQ ID NO: 409269 - RNA, 22 nt, Human
ccagguggacggcgaguacagg

SEQ ID NO: 409270 - RNA, 22 nt, Human
gaaagguugggugaauggugga

SEQ ID NO: 409271 - RNA, 22 nt, Human
gcugucuguucgagcguguguu

SEQ ID NO: 409272 - RNA, 21 nt, Human
ggcagcccgcccucuccuggc

SEQ ID NO: 409273 - RNA, 17 nt, Human
aguggcaggcagauggg

SEQ ID NO: 409274 - RNA, 22 nt, Human
aaaaaugucauuauggaacuga

SEQ ID NO: 409275 - RNA, 22 nt, Human
cgggcuccgggucuuugcaguc

SEQ ID NO: 409276 - RNA, 22 nt, Human
cuuagaaaucgaacucagguua

SEQ ID NO: 409277 - RNA, 22 nt, Human
gcagggacaucuuugucuagua

SEQ ID NO: 409278 - RNA, 22 nt, Human
acagagauguggaugagggauu

SEQ ID NO: 409279 - RNA, 20 nt, Human
ggcacuggaagcacacagga

SEQ ID NO: 409280 - RNA, 22 nt, Human
gucagugucuuaacagagauua

SEQ ID NO: 409281 - RNA, 22 nt, Human
agugcugacucugggcacagug

SEQ ID NO: 409282 - RNA, 17 nt, Human
ucuguccagggagugug

SEQ ID NO: 409283 - RNA, 22 nt, Human
ugcagcaggcacaggacggaag

SEQ ID NO: 409284 - RNA, 22 nt, Human
gcucaaggcaggcagacaugag

SEQ ID NO: 409285 - RNA, 23 nt, Human
ggggaaguggcagugagugaggc

SEQ ID NO: 409286 - RNA, 22 nt, Human
aggugaguugguaggaaguuug

SEQ ID NO: 409287 - RNA, 22 nt, Human
uaaagccacuucauucuagucu

SEQ ID NO: 409288 - RNA, 22 nt, Human
agcuuuauagaaaggaucagug

SEQ ID NO: 409289 - RNA, 22 nt, Human
ugcccugcagugagugcgucug

SEQ ID NO: 409290 - RNA, 22 nt, Human
ugucaccaguuccaggaaauaa

SEQ ID NO: 409291 - RNA, 22 nt, Human
uccugcagagacagaggccuca

SEQ ID NO: 409292 - RNA, 22 nt, Human
aaggccugggaguacugggaca

SEQ ID NO: 409293 - RNA, 19 nt, Human
ucaguggagaaaggggaag

SEQ ID NO: 409294 - RNA, 22 nt, Human
uggcucagugacauuccuccca

SEQ ID NO: 409295 - RNA, 22 nt, Human
agugauggagcuuccucugcua

SEQ ID NO: 409296 - RNA, 20 nt, Human
uggaccugucucuuuaggga

SEQ ID NO: 409297 - RNA, 22 nt, Human
ucagagcuuaucucuugcugga

SEQ ID NO: 409298 - RNA, 20 nt, Human
uguuucuuuuaaugagcggc

SEQ ID NO: 409299 - RNA, 22 nt, Human
gcccuuccaacccagagggcaa

SEQ ID NO: 409300 - RNA, 21 nt, Human
uagagaaaagaagcuguuccu

SEQ ID NO: 409301 - RNA, 22 nt, Human
cuguccucuguccucagcagga

SEQ ID NO: 409302 - RNA, 19 nt, Human
aggucauugauagugcagg

SEQ ID NO: 409303 - RNA, 22 nt, Human
uaaugugugucaucaguagagu

SEQ ID NO: 409304 - RNA, 22 nt, Human
ggcccaucucuugcucuggguu

SEQ ID NO: 409305 - RNA, 22 nt, Human
aggcagguuucccggcugucaa

SEQ ID NO: 409306 - RNA, 22 nt, Human
uugaaagugccaaguccuagug

SEQ ID NO: 409307 - RNA, 22 nt, Human
gagauuggccuggcuugccaac

SEQ ID NO: 409308 - RNA, 22 nt, Human
uggccugccugggagcagcagg

SEQ ID NO: 409309 - RNA, 22 nt, Human
ggaccugccagaacucaggcua

SEQ ID NO: 409310 - RNA, 22 nt, Human
cugagcucuaaugucagccuug

SEQ ID NO: 409311 - RNA, 22 nt, Human
uaaggaaagugccaugauuucu

SEQ ID NO: 409312 - RNA, 22 nt, Human
ugcagggccagacuggguugga

SEQ ID NO: 409313 - RNA, 22 nt, Human
ugggggucaggaugaggccuug

SEQ ID NO: 409314 - RNA, 22 nt, Human
cagcacugcugcuguacacaca

SEQ ID NO: 409315 - RNA, 21 nt, Human
uaaagaagaugaaugugauca

SEQ ID NO: 409316 - RNA, 22 nt, Human
ucauugcagaaauaaaggugaa

SEQ ID NO: 409317 - RNA, 22 nt, Human
ucuauaaauuaugcagucucag

SEQ ID NO: 409318 - RNA, 22 nt, Human
gaagcagcaaaucugcaguauc

SEQ ID NO: 409319 - RNA, 22 nt, Human
cuacauuaaauuggcuuacuua

SEQ ID NO: 409320 - RNA, 18 nt, Human
cucucuggucuggauccc

SEQ ID NO: 409321 - RNA, 22 nt, Human
cagggagaggcaucauagggaa

SEQ ID NO: 409322 - RNA, 22 nt, Human
augcacagacccaaaggccauc

SEQ ID NO: 409323 - RNA, 22 nt, Human
gugauugcccagcaccauuguu

SEQ ID NO: 409324 - RNA, 22 nt, Human
aaaugcacaaaguaaguguaau

SEQ ID NO: 409325 - RNA, 22 nt, Human
cagggcuggauccuccagacuc

SEQ ID NO: 409326 - RNA, 22 nt, Human
gcuguucucuguaacaugcauu

SEQ ID NO: 409327 - RNA, 22 nt, Human
ccugucugcggaggaguggaag

SEQ ID NO: 409328 - RNA, 22 nt, Human
ccugccugaaggucagccaccc

SEQ ID NO: 409329 - RNA, 20 nt, Human
ucagugauuaucucugagug

SEQ ID NO: 409330 - RNA, 22 nt, Human
gauuuauugucccuguccugcu

SEQ ID NO: 409331 - RNA, 22 nt, Human
acaaaguuauucuuucagagga

SEQ ID NO: 409332 - RNA, 22 nt, Human
ggccugccucacagucagcacc

SEQ ID NO: 409333 - RNA, 22 nt, Human
acguuuucuagagaauaugcag

SEQ ID NO: 409334 - RNA, 22 nt, Human
aggggagaguuaaugugaaugu

SEQ ID NO: 409335 - RNA, 22 nt, Human
cccagggaagggcuaccugagg

SEQ ID NO: 409336 - RNA, 20 nt, Human
aggagaugauccagagucag

SEQ ID NO: 409337 - RNA, 22 nt, Human
uggcugccuuucaccucaucuc

SEQ ID NO: 409338 - RNA, 22 nt, Human
ucagaggguggcugggagcauc

SEQ ID NO: 409339 - RNA, 22 nt, Human
ucacaugcucaccuaagccaca

SEQ ID NO: 409340 - RNA, 22 nt, Human
uagggcucagaguccaguuucu

SEQ ID NO: 409341 - RNA, 22 nt, Human
gcucugcugaagccccuugcau

SEQ ID NO: 409342 - RNA, 22 nt, Human
guguccuuuuaugugacugguu

SEQ ID NO: 409343 - RNA, 21 nt, Human
uauuugcugccaucuuugagg

SEQ ID NO: 409344 - RNA, 22 nt, Human
acagguggagugguuagcaggc

SEQ ID NO: 409345 - RNA, 22 nt, Human
gccugagaaggacacagcaggu

SEQ ID NO: 409346 - RNA, 22 nt, Human
agagccaggacugugucucacu

SEQ ID NO: 409347 - RNA, 22 nt, Human
aggcugaggcgggaggaucacu

SEQ ID NO: 409348 - RNA, 22 nt, Human
auuguggcuagacagucacaau

SEQ ID NO: 409349 - RNA, 22 nt, Human
ccuggcuccugccucugcaggg

SEQ ID NO: 409350 - RNA, 22 nt, Human
gggcagguggcaaagccagagg

SEQ ID NO: 409351 - RNA, 22 nt, Human
ccagaggaggggggucuuucug

SEQ ID NO: 409352 - RNA, 22 nt, Human
uacacacagaggccaugggauu

SEQ ID NO: 409353 - RNA, 22 nt, Human
ugcugucugauucagggugauu

SEQ ID NO: 409354 - RNA, 22 nt, Human
aggccagggucccacacucgca

SEQ ID NO: 409355 - RNA, 23 nt, Human
cauggcagcaagagcucauggcc

SEQ ID NO: 409356 - RNA, 22 nt, Human
agggcuccaggggaccaucagu

SEQ ID NO: 409357 - RNA, 22 nt, Human
ccagagccucuuaugaagaucg

SEQ ID NO: 409358 - RNA, 22 nt, Human
uugcaaaagccgaggcacucca

SEQ ID NO: 409359 - RNA, 22 nt, Human
auccacccugugguggcuuucu

SEQ ID NO: 409360 - RNA, 22 nt, Human
gaacccaguccaggugcagccu

SEQ ID NO: 409361 - RNA, 22 nt, Human
gcuuuguguagaaggaggaugg

SEQ ID NO: 409362 - RNA, 19 nt, Human
uccuuugaauaucaguuga

SEQ ID NO: 409363 - RNA, 22 nt, Human
ugugcccaucccucuggagugu

SEQ ID NO: 409364 - RNA, 22 nt, Human
uggcagcaauuugugauguuga

SEQ ID NO: 409365 - RNA, 22 nt, Human
uaaguucagaguucucauuugu

SEQ ID NO: 409366 - RNA, 22 nt, Human
ggcuggaaguccaagaucaagg

SEQ ID NO: 409367 - RNA, 22 nt, Human
gacccagcuaaccaggugggga

SEQ ID NO: 409368 - RNA, 22 nt, Human
uccaggagguuuggaggaagca

SEQ ID NO: 409369 - RNA, 21 nt, Human
gcaaggcuuuuguguuuccca

SEQ ID NO: 409370 - RNA, 22 nt, Human
acagauuuuauuauucagguau

SEQ ID NO: 409371 - RNA, 22 nt, Human
gagugucugaauuagagcacaa

SEQ ID NO: 409372 - RNA, 20 nt, Human
augccucuaauuuugcaaac

SEQ ID NO: 409373 - RNA, 22 nt, Human
ugcagggcccucauuccugucc

SEQ ID NO: 409374 - RNA, 22 nt, Human
agaagccauguuuaguaggaug

SEQ ID NO: 409375 - RNA, 22 nt, Human
gauuucaaagguucugcaugcc

SEQ ID NO: 409376 - RNA, 22 nt, Human
uucauuccuucccuaagcaacu

SEQ ID NO: 409377 - RNA, 22 nt, Human
cugagagguaagcagcgcagug

SEQ ID NO: 409378 - RNA, 22 nt, Human
uugcugaaguuaaugcuugcaa

SEQ ID NO: 409379 - RNA, 22 nt, Human
caggauccuggcugcauggacg

SEQ ID NO: 409380 - RNA, 21 nt, Human
ucagaguguguuacagcaagc

SEQ ID NO: 409381 - RNA, 20 nt, Human
uugauaggcagcuugucagg

SEQ ID NO: 409382 - RNA, 22 nt, Human
uucugugcccauuuuaaaaugg

SEQ ID NO: 409383 - RNA, 22 nt, Human
ccagccaggcuggcuguggagg

SEQ ID NO: 409384 - RNA, 22 nt, Human
ccagggucucugcugccugaga

SEQ ID NO: 409385 - RNA, 22 nt, Human
cugggcugcaucaaagaggcau

SEQ ID NO: 409386 - RNA, 22 nt, Human
guguguccucaguaguggcaug

SEQ ID NO: 409387 - RNA, 22 nt, Human
augcaguggcagcuccuggugu

SEQ ID NO: 409388 - RNA, 22 nt, Human
uggaagcagugauucuugucug

SEQ ID NO: 409389 - RNA, 22 nt, Human
gaguccaguuagugaggcuggg

SEQ ID NO: 409390 - RNA, 22 nt, Human
cuggagccuucaccaggggaaa

SEQ ID NO: 409391 - RNA, 23 nt, Human
cuacaagagcaagcauggacaag

SEQ ID NO: 409392 - RNA, 22 nt, Human
ucccagagcccaaguuggagag

SEQ ID NO: 409393 - RNA, 22 nt, Human
uccuugaagcuuguaucuaaua

SEQ ID NO: 409394 - RNA, 22 nt, Human
gugggcuucuguuagggaggcu

SEQ ID NO: 409395 - RNA, 22 nt, Human
uuugcaaauauguguuucuauu

SEQ ID NO: 409396 - RNA, 22 nt, Human
aaaagguagauucuccuucuau

SEQ ID NO: 409397 - RNA, 22 nt, Human
guaggcagucucucaggugauc

SEQ ID NO: 409398 - RNA, 22 nt, Human
ccucuggggugagugggccacu

SEQ ID NO: 409399 - RNA, 22 nt, Human
caguguccucagccagcagcua

SEQ ID NO: 409400 - RNA, 22 nt, Human
cagaaauggagcccaggaaucu

SEQ ID NO: 409401 - RNA, 22 nt, Human
ggcagccauggacacuggcuag

SEQ ID NO: 409402 - RNA, 22 nt, Human
aucucagggcuggagcccugga

SEQ ID NO: 409403 - RNA, 22 nt, Human
uuaugcaacaggugagcagaca

SEQ ID NO: 409404 - RNA, 22 nt, Human
cucacugcccugaaguuggguu

SEQ ID NO: 409405 - RNA, 22 nt, Human
ugcagggaaagggcacugggcu

SEQ ID NO: 409406 - RNA, 22 nt, Human
agccugguuuaagcauuuuaua

SEQ ID NO: 409407 - RNA, 22 nt, Human
ccaggagcaccaggccugugcc

SEQ ID NO: 409408 - RNA, 18 nt, Human
uccagagguguuggagcc

SEQ ID NO: 409409 - RNA, 22 nt, Human
agccuggauccuaggcucagcu

SEQ ID NO: 409410 - RNA, 22 nt, Human
uggcugagaccaucagggugua

SEQ ID NO: 409411 - RNA, 22 nt, Human
gggcaggaugcaguuucagaga

SEQ ID NO: 409412 - RNA, 17 nt, Human
ugaagaugcauggcagc

SEQ ID NO: 409413 - RNA, 18 nt, Human
gguggccuugacuucucu

SEQ ID NO: 409414 - RNA, 22 nt, Human
ugguggccaauucacagggcuc

SEQ ID NO: 409415 - RNA, 22 nt, Human
ggagcuguucaggacugcuuca

SEQ ID NO: 409416 - RNA, 22 nt, Human
acagcuugcaauggcuuucaac

SEQ ID NO: 409417 - RNA, 22 nt, Human
cagcugagaccagaaugcaggu

SEQ ID NO: 409418 - RNA, 22 nt, Human
ccaagggcucugacuugccugc

SEQ ID NO: 409419 - RNA, 22 nt, Human
gaucauuuugaugcccuuuuag

SEQ ID NO: 409420 - RNA, 17 nt, Human
cuggagccaagagggcc

SEQ ID NO: 409421 - RNA, 22 nt, Human
ucaggggcccuucccucagcag

SEQ ID NO: 409422 - RNA, 22 nt, Human
aaugcugcaagaggugaaaaga

SEQ ID NO: 409423 - RNA, 22 nt, Human
caaagucccagcugcuuagaga

SEQ ID NO: 409424 - RNA, 22 nt, Human
gucacaggccuggaugaggggc

SEQ ID NO: 409425 - RNA, 22 nt, Human
uuagaaaggagcuuauuucuuu

SEQ ID NO: 409426 - RNA, 19 nt, Human
acuuucuccaggaccuguu

SEQ ID NO: 409427 - RNA, 22 nt, Human
aagagcuggauggaaucuggga

SEQ ID NO: 409428 - RNA, 22 nt, Human
ggucccaggcugcgggcuggug

SEQ ID NO: 409429 - RNA, 22 nt, Human
uuuagggaagaagcccauggcc

SEQ ID NO: 409430 - RNA, 22 nt, Human
acauuucucauaggagagccac

SEQ ID NO: 409431 - RNA, 22 nt, Human
gccagucugcucccacaaguuc

SEQ ID NO: 409432 - RNA, 22 nt, Human
gaagaacaagcagugcuuuccu

SEQ ID NO: 409433 - RNA, 22 nt, Human
cagcugcaugucuguggugguc

SEQ ID NO: 409434 - RNA, 22 nt, Human
gcagcuggcucagagagguggg

SEQ ID NO: 409435 - RNA, 22 nt, Human
ugaguccaauaggggccuggaa

SEQ ID NO: 409436 - RNA, 22 nt, Human
ggagauagacuuggugagccac

SEQ ID NO: 409437 - RNA, 22 nt, Human
cagcugaacauguagagcaucu

SEQ ID NO: 409438 - RNA, 22 nt, Human
uggagaagauuggucaccauuc

SEQ ID NO: 409439 - RNA, 22 nt, Human
uuauguacucugcaauguuuga

SEQ ID NO: 409440 - RNA, 22 nt, Human
ccuggcaguuuugcccaggauu

SEQ ID NO: 409441 - RNA, 22 nt, Human
ugggcugcccaagguggccaug

SEQ ID NO: 409442 - RNA, 23 nt, Human
gaggccacauuccccugcuugag

SEQ ID NO: 409443 - RNA, 22 nt, Human
ggguggaguagaaagaugaauu

SEQ ID NO: 409444 - RNA, 22 nt, Human
uccaggcaucuguauuuuuuaa

SEQ ID NO: 409445 - RNA, 22 nt, Human
aaugagcuagaccugcuuccuc

SEQ ID NO: 409446 - RNA, 22 nt, Human
agugaaaacacuaguucuugcc

SEQ ID NO: 409447 - RNA, 22 nt, Human
uggcucaggcuugaaaauagau

SEQ ID NO: 409448 - RNA, 22 nt, Human
aggugucugggcuuuggaguca

SEQ ID NO: 409449 - RNA, 22 nt, Human
ccuguacacaauuccgaggaua

SEQ ID NO: 409450 - RNA, 22 nt, Human
ugggguggauagaaagugaugu

SEQ ID NO: 409451 - RNA, 22 nt, Human
gagccugggacugggggucaug

SEQ ID NO: 409452 - RNA, 22 nt, Human
aggggcugccuggcuuggcacu

SEQ ID NO: 409453 - RNA, 22 nt, Human
gacuacucaaacuuucucuaua

SEQ ID NO: 409454 - RNA, 23 nt, Human
ucuguacacaucagcaucuccca

SEQ ID NO: 409455 - RNA, 22 nt, Human
ucgugucagaucagagguuccu

SEQ ID NO: 409456 - RNA, 22 nt, Human
gcuggagccuucugcucuguug

SEQ ID NO: 409457 - RNA, 22 nt, Human
gagggcaggggucuugcacggu

SEQ ID NO: 409458 - RNA, 22 nt, Human
gugcugcagagucucgugccgc

SEQ ID NO: 409459 - RNA, 22 nt, Human
uugaagagugccuuccagacau

SEQ ID NO: 409460 - RNA, 21 nt, Human
uuugaaagcuacaucuauagc

SEQ ID NO: 409461 - RNA, 22 nt, Human
acaggggcuccgaaggugaggg

SEQ ID NO: 409462 - RNA, 21 nt, Human
ucuggagcccuaagcugagaa

SEQ ID NO: 409463 - RNA, 19 nt, Human
uugcauuguaguuggacug

SEQ ID NO: 409464 - RNA, 22 nt, Human
aucgagggugaguacagcggac

SEQ ID NO: 409465 - RNA, 22 nt, Human
ugcauuguuugauaggugaauu

SEQ ID NO: 409466 - RNA, 22 nt, Human
agucugucuaauauuauucagg

SEQ ID NO: 409467 - RNA, 22 nt, Human
ugcugccagggcucugcccaca

SEQ ID NO: 409468 - RNA, 22 nt, Human
aaaaucugguaauuugaaugug

SEQ ID NO: 409469 - RNA, 22 nt, Human
cccaggcugaguuagagguguc

SEQ ID NO: 409470 - RNA, 22 nt, Human
cccagggcuuuucucacuagac

SEQ ID NO: 409471 - RNA, 22 nt, Human
ccagcugucugguuccagagcc

SEQ ID NO: 409472 - RNA, 22 nt, Human
ggcccagccggcgagucucgcg

SEQ ID NO: 409473 - RNA, 22 nt, Human
ucuccccaaaggacucacucuc

SEQ ID NO: 409474 - RNA, 22 nt, Human
ccagggcaaaugagaucauagc

SEQ ID NO: 409475 - RNA, 22 nt, Human
uccauuggucucugugcccagg

SEQ ID NO: 409476 - RNA, 22 nt, Human
ucagggcauccauugccuguug

SEQ ID NO: 409477 - RNA, 22 nt, Human
ucuccuccuuuuuucaacauag

SEQ ID NO: 409478 - RNA, 21 nt, Human
uuucaauguguucuuuguagu

SEQ ID NO: 409479 - RNA, 22 nt, Human
cuagggcacuaggacucaugug

SEQ ID NO: 409480 - RNA, 22 nt, Human
gcugucugcaagccaggaaaug

SEQ ID NO: 409481 - RNA, 22 nt, Human
aaaugcacaauaaaguaaaggc

SEQ ID NO: 409482 - RNA, 22 nt, Human
cucugagcagaggccguggcua

SEQ ID NO: 409483 - RNA, 22 nt, Human
agcagcuggggccugugacgau

SEQ ID NO: 409484 - RNA, 22 nt, Human
ggguccagcuacaucagggugg

SEQ ID NO: 409485 - RNA, 18 nt, Human
ucaagacaucaugaaaua

SEQ ID NO: 409486 - RNA, 22 nt, Human
uggcucaggagggaucuuugcu

SEQ ID NO: 409487 - RNA, 20 nt, Human
cccagagccauagccagaca

SEQ ID NO: 409488 - RNA, 22 nt, Human
uguggccuccccacuucugggg

SEQ ID NO: 409489 - RNA, 22 nt, Human
acuuagaacaggcagaauucca

SEQ ID NO: 409490 - RNA, 18 nt, Human
gguggcaggucagaugcc

SEQ ID NO: 409491 - RNA, 22 nt, Human
uaaauguguguagccaucugug

SEQ ID NO: 409492 - RNA, 18 nt, Human
gagguccugcucuagccc

SEQ ID NO: 409493 - RNA, 22 nt, Human
caguguuucugaguuccagcuc

SEQ ID NO: 409494 - RNA, 22 nt, Human
ucugccuucgcugcucccugaa

SEQ ID NO: 409495 - RNA, 22 nt, Human
ugucccaguuuugcagguuaga

SEQ ID NO: 409496 - RNA, 22 nt, Human
gggagagagagcucauguugaa

SEQ ID NO: 409497 - RNA, 22 nt, Human
acaugauuuuuaaagagauaau

SEQ ID NO: 409498 - RNA, 22 nt, Human
gaaacaaucaucaugugauuug

SEQ ID NO: 409499 - RNA, 22 nt, Human
aagaaauuaaugugccauuacu

SEQ ID NO: 409500 - RNA, 22 nt, Human
gcaucuuucuguccauucagca

SEQ ID NO: 409501 - RNA, 22 nt, Human
aggaagccuggcauuaaaaagc

SEQ ID NO: 409502 - RNA, 22 nt, Human
ucagccacuacccaccuuaaca

SEQ ID NO: 409503 - RNA, 22 nt, Human
ucuccuuugaaaguuaggacug

SEQ ID NO: 409504 - RNA, 22 nt, Human
cagagguaccagcagccucugg

SEQ ID NO: 409505 - RNA, 22 nt, Human
uuccgcuggggccgccuggcgg

SEQ ID NO: 409506 - RNA, 20 nt, Human
ugaagcagccuugauucugu

SEQ ID NO: 409507 - RNA, 22 nt, Human
aaaaaugaauucuucaguggca

SEQ ID NO: 409508 - RNA, 22 nt, Human
acaaagucugaaaccugaggca

SEQ ID NO: 409509 - RNA, 22 nt, Human
uuuuauuaguggcuagaugggg

SEQ ID NO: 409510 - RNA, 22 nt, Human
cugagcugguucucuugugaaa

SEQ ID NO: 409511 - RNA, 21 nt, Human
cucuggagucaagagcuucca

SEQ ID NO: 409512 - RNA, 17 nt, Human
ggugagaccucccacuc

SEQ ID NO: 409513 - RNA, 20 nt, Human
ccagacagcaccugccuggu

SEQ ID NO: 409514 - RNA, 21 nt, Human
cauugucgacauuuuccccuc

SEQ ID NO: 409515 - RNA, 22 nt, Human
aucaggaaauacuuauuuauaa

SEQ ID NO: 409516 - RNA, 22 nt, Human
ggacuggccggcgcugaggccc

SEQ ID NO: 409517 - RNA, 22 nt, Human
agcugcaguaaagcucuccagg

SEQ ID NO: 409518 - RNA, 22 nt, Human
ggaagggcaaaagagaugaacu

SEQ ID NO: 409519 - RNA, 22 nt, Human
uggaggcaucagagugcuuggc

SEQ ID NO: 409520 - RNA, 22 nt, Human
uaaggcauucucaugcugugaa

SEQ ID NO: 409521 - RNA, 22 nt, Human
ugaaggcccuaucuccauauac

SEQ ID NO: 409522 - RNA, 22 nt, Human
ggcuggagauaugucuggaaca

SEQ ID NO: 409523 - RNA, 21 nt, Human
gaaaggucuuaacuuacagag

SEQ ID NO: 409524 - RNA, 22 nt, Human
gccugcagggugaugggcugcc

SEQ ID NO: 409525 - RNA, 22 nt, Human
augaggcaguacacacaaagcc

SEQ ID NO: 409526 - RNA, 20 nt, Human
ccagcauguacacaugugga

SEQ ID NO: 409527 - RNA, 22 nt, Human
caaaggcugccacuguggcugu

SEQ ID NO: 409528 - RNA, 22 nt, Human
gggaguggauuauguggaccca

SEQ ID NO: 409529 - RNA, 22 nt, Human
aagacuuucucccaaauccuca

SEQ ID NO: 409530 - RNA, 22 nt, Human
ccauuaaaauggaauguaguga

SEQ ID NO: 409531 - RNA, 22 nt, Human
uaaggccaaggggccauagucu

SEQ ID NO: 409532 - RNA, 22 nt, Human
uguauuuaagcuuuaccuaaaa

SEQ ID NO: 409533 - RNA, 22 nt, Human
ggcagaguggagugcggccucc

SEQ ID NO: 409534 - RNA, 22 nt, Human
gccaugccugugucuccaggcc

SEQ ID NO: 409535 - RNA, 19 nt, Human
ucugaggguccagaugcau

SEQ ID NO: 409536 - RNA, 23 nt, Human
cacaccaggagccgucugggcca

SEQ ID NO: 409537 - RNA, 22 nt, Human
gagguuagaggucagugcaguc

SEQ ID NO: 409538 - RNA, 19 nt, Human
aggcagcacccaguccuug

SEQ ID NO: 409539 - RNA, 20 nt, Human
ucacaucuggcagcugauga

SEQ ID NO: 409540 - RNA, 22 nt, Human
ucucccacagccgugcuucaag

SEQ ID NO: 409541 - RNA, 22 nt, Human
acacaggggaaaguggagcuga

SEQ ID NO: 409542 - RNA, 22 nt, Human
acauuucuuuucaucucuauau

SEQ ID NO: 409543 - RNA, 22 nt, Human
acugaaaaugaauuagaaacag

SEQ ID NO: 409544 - RNA, 22 nt, Human
uccuggaguauuucuguggugu

SEQ ID NO: 409545 - RNA, 22 nt, Human
uauguacauaacaugaaaugca

SEQ ID NO: 409546 - RNA, 22 nt, Human
uuaaacagguuuuugaauggcc

SEQ ID NO: 409547 - RNA, 22 nt, Human
ugucccauggacacaacuucuu

SEQ ID NO: 409548 - RNA, 22 nt, Human
gguucaguuuacauuaaaaucu

SEQ ID NO: 409549 - RNA, 21 nt, Human
cuugaaagguagagucuacag

SEQ ID NO: 409550 - RNA, 22 nt, Human
gucaggaugacaagugcuuuca

SEQ ID NO: 409551 - RNA, 22 nt, Human
ggagaagggacagacucagcuu

SEQ ID NO: 409552 - RNA, 22 nt, Human
aaaugguaagacaacacauuau

SEQ ID NO: 409553 - RNA, 22 nt, Human
gcagaggaucaggcucuggaaa

SEQ ID NO: 409554 - RNA, 22 nt, Human
guggccugaugccagcccugug

SEQ ID NO: 409555 - RNA, 22 nt, Human
ccucccacuucuugcugagguc

SEQ ID NO: 409556 - RNA, 22 nt, Human
ucaguguagcagacuuguagcc

SEQ ID NO: 409557 - RNA, 22 nt, Human
gugcaggguagcgacggcagga

SEQ ID NO: 409558 - RNA, 22 nt, Human
uaacagaaauaguaggugaggg

SEQ ID NO: 409559 - RNA, 22 nt, Human
gaaaauguuagcuucauaguca

SEQ ID NO: 409560 - RNA, 22 nt, Human
agggcgaggagacggaggcaca

SEQ ID NO: 409561 - RNA, 22 nt, Human
agccaggccuuuucucaagguu

SEQ ID NO: 409562 - RNA, 22 nt, Human
caugggcaguuggcagggcuca

SEQ ID NO: 409563 - RNA, 22 nt, Human
auaugcauuuaccuggcauaua

SEQ ID NO: 409564 - RNA, 22 nt, Human
uuuuccuaguaggccuauuaga

SEQ ID NO: 409565 - RNA, 22 nt, Human
cugugagcuggguggccaggac

SEQ ID NO: 409566 - RNA, 22 nt, Human
gaggccagaaugagcugaaugc

SEQ ID NO: 409567 - RNA, 20 nt, Human
uaacagaaguagaagugggu

SEQ ID NO: 409568 - RNA, 22 nt, Human
agggccugcucuaucacucuca

SEQ ID NO: 409569 - RNA, 22 nt, Human
ucugggcuugguuagggcuguu

SEQ ID NO: 409570 - RNA, 22 nt, Human
acacaugcauaagccuucccuu

SEQ ID NO: 409571 - RNA, 22 nt, Human
uuugaguugcuuauuuaauagg

SEQ ID NO: 409572 - RNA, 22 nt, Human
gcaggggaguggcaggcccgga

SEQ ID NO: 409573 - RNA, 22 nt, Human
gggcucagacaucccuccugga

SEQ ID NO: 409574 - RNA, 22 nt, Human
uggcugcuagccagagcuucag

SEQ ID NO: 409575 - RNA, 22 nt, Human
caggauggucuucauuuggcuc

SEQ ID NO: 409576 - RNA, 22 nt, Human
agaaaucaugacuaagagcagu

SEQ ID NO: 409577 - RNA, 22 nt, Human
gcaggugggggucggugcaucu

SEQ ID NO: 409578 - RNA, 22 nt, Human
gugauuucaaauauagagugag

SEQ ID NO: 409579 - RNA, 22 nt, Human
agcugcugcgccucacccuggc

SEQ ID NO: 409580 - RNA, 22 nt, Human
ucucagagaaaugugucaccau

SEQ ID NO: 409581 - RNA, 22 nt, Human
uuccucaguuagugccugaggc

SEQ ID NO: 409582 - RNA, 22 nt, Human
aagaacauuuuguagaaugaca

SEQ ID NO: 409583 - RNA, 22 nt, Human
acacaaacagucuauagcacca

SEQ ID NO: 409584 - RNA, 22 nt, Human
aguuuuaugcaguguucugaua

SEQ ID NO: 409585 - RNA, 22 nt, Human
aaguucaagaucaagguuccag

SEQ ID NO: 409586 - RNA, 22 nt, Human
uggccuggccacauccagcagg

SEQ ID NO: 409587 - RNA, 22 nt, Human
aauuaacagagggcuuauuacu

SEQ ID NO: 409588 - RNA, 22 nt, Human
gcaccaggcuuagagccccagg

SEQ ID NO: 409589 - RNA, 22 nt, Human
ccagcucugcagggccuggggu

SEQ ID NO: 409590 - RNA, 21 nt, Human
aucucacagcccagagaagcc

SEQ ID NO: 409591 - RNA, 22 nt, Human
guuuuccuucucagccauugcc

SEQ ID NO: 409592 - RNA, 22 nt, Human
agaauaguggcaaugacugcac

SEQ ID NO: 409593 - RNA, 22 nt, Human
gcugccuguccugaggaguccg

SEQ ID NO: 409594 - RNA, 22 nt, Human
aagacuguacauuuuccagucu

SEQ ID NO: 409595 - RNA, 22 nt, Human
ugguaauuaauuugauagguuc

SEQ ID NO: 409596 - RNA, 22 nt, Human
uggcucaggaucuaagcagaau

SEQ ID NO: 409597 - RNA, 22 nt, Human
cugaggcucaagggcagguggg

SEQ ID NO: 409598 - RNA, 22 nt, Human
aggagucauaaaugugaacaaa

SEQ ID NO: 409599 - RNA, 22 nt, Human
auauuucaugggguuccauacu

SEQ ID NO: 409600 - RNA, 22 nt, Human
agacagcugcucgcagagcuau

SEQ ID NO: 409601 - RNA, 22 nt, Human
uuucaucucucuaaaagacagu

SEQ ID NO: 409602 - RNA, 22 nt, Human
ggcagagacuggguuggcagag

SEQ ID NO: 409603 - RNA, 22 nt, Human
uuucaugugcaauuagcaauau

SEQ ID NO: 409604 - RNA, 22 nt, Human
aaggcacuuuucuaaagaccuu

SEQ ID NO: 409605 - RNA, 22 nt, Human
ccugggcaucucaugcaccugc

SEQ ID NO: 409606 - RNA, 19 nt, Human
uagagcugcuuccuggcag

SEQ ID NO: 409607 - RNA, 22 nt, Human
cuggcucuaucuccaaggcugg

SEQ ID NO: 409608 - RNA, 22 nt, Human
accaggcaugauguggagcaca

SEQ ID NO: 409609 - RNA, 22 nt, Human
acacugcagaugaaagcauaag

SEQ ID NO: 409610 - RNA, 22 nt, Human
ggcuucagugagcugagcucac

SEQ ID NO: 409611 - RNA, 22 nt, Human
guuuagaauucuaacuuuaagg

SEQ ID NO: 409612 - RNA, 22 nt, Human
ugucuuuagaaagaagcagaca

SEQ ID NO: 409613 - RNA, 22 nt, Human
uucaaugauuuuuagggaucau

SEQ ID NO: 409614 - RNA, 19 nt, Human
cagaggcaccagguauaga

SEQ ID NO: 409615 - RNA, 20 nt, Human
ucccaaggaugccugggugu

SEQ ID NO: 409616 - RNA, 22 nt, Human
aacauaaauuugaaguggcaaa

SEQ ID NO: 409617 - RNA, 22 nt, Human
guuuucuuugaaugcuucuaga

SEQ ID NO: 409618 - RNA, 22 nt, Human
ucugucucuuuguucugugagu

SEQ ID NO: 409619 - RNA, 22 nt, Human
gaacaauagugguaacaaagcc

SEQ ID NO: 409620 - RNA, 22 nt, Human
gagcuggugugugcccgagcac

SEQ ID NO: 409621 - RNA, 20 nt, Human
gacauucauaguuauuacca

SEQ ID NO: 409622 - RNA, 22 nt, Human
guuccaggcaagugggauagga

SEQ ID NO: 409623 - RNA, 22 nt, Human
acauugaucagccucccaugca

SEQ ID NO: 409624 - RNA, 22 nt, Human
gcuuccugucccucagccauga

SEQ ID NO: 409625 - RNA, 22 nt, Human
aucacgucaugguuugaucugg

SEQ ID NO: 409626 - RNA, 20 nt, Human
gcugccagugccugaugcuu

SEQ ID NO: 409627 - RNA, 22 nt, Human
ggcuguccuuggccaaggcacu

SEQ ID NO: 409628 - RNA, 22 nt, Human
ucacaucucccuggaggacaca

SEQ ID NO: 409629 - RNA, 22 nt, Human
agcuccugcacccagccuugag

SEQ ID NO: 409630 - RNA, 22 nt, Human
uccuauugguagacauuucugu

SEQ ID NO: 409631 - RNA, 22 nt, Human
cuauuauuuccucaucuauaaa

SEQ ID NO: 409632 - RNA, 22 nt, Human
uuuucauuagaaugacugagaa

SEQ ID NO: 409633 - RNA, 22 nt, Human
uaccugcagcgggaauccauua

SEQ ID NO: 409634 - RNA, 22 nt, Human
gcagccacacuguuacagaaug

SEQ ID NO: 409635 - RNA, 22 nt, Human
cacagugcaugaugggcagaag

SEQ ID NO: 409636 - RNA, 20 nt, Human
uccaagggcagcagaaucag

SEQ ID NO: 409637 - RNA, 22 nt, Human
ugaucagucccaugaucuucca

SEQ ID NO: 409638 - RNA, 22 nt, Human
ucagaacagaagaaggaacacg

SEQ ID NO: 409639 - RNA, 22 nt, Human
cagaauaugacaagauuuuccu

SEQ ID NO: 409640 - RNA, 21 nt, Human
uuuauguacuucauagaguag

SEQ ID NO: 409641 - RNA, 22 nt, Human
uagggcucacugagaugaauau

SEQ ID NO: 409642 - RNA, 22 nt, Human
ggcucaccauuuucacucucug

SEQ ID NO: 409643 - RNA, 22 nt, Human
acaaaggugagcagaagacaca

SEQ ID NO: 409644 - RNA, 22 nt, Human
uccagcagcccgaaggcccauc

SEQ ID NO: 409645 - RNA, 22 nt, Human
guggcccaggcuuggcgcuggc

SEQ ID NO: 409646 - RNA, 22 nt, Human
uuaauuuauguccaaaccagau

SEQ ID NO: 409647 - RNA, 22 nt, Human
augcuuuuccaggagaaauaua

SEQ ID NO: 409648 - RNA, 22 nt, Human
gcaggaugggagcuucacucug

SEQ ID NO: 409649 - RNA, 20 nt, Human
aaagucuguuuaucucugga

SEQ ID NO: 409650 - RNA, 22 nt, Human
ucccacugugccuguuguaauc

SEQ ID NO: 409651 - RNA, 22 nt, Human
ccacacugaaccucagugucuu

SEQ ID NO: 409652 - RNA, 22 nt, Human
ucacugucugaaagaaauggcc

SEQ ID NO: 409653 - RNA, 22 nt, Human
ugggcaggugcuauuuuccaug

SEQ ID NO: 409654 - RNA, 22 nt, Human
agaagaaaugaggccguucugc

SEQ ID NO: 409655 - RNA, 22 nt, Human
acauuuuuuagagucccacauu

SEQ ID NO: 409656 - RNA, 22 nt, Human
uuuuuccuuagggguuacucac

SEQ ID NO: 409657 - RNA, 22 nt, Human
auaugcauaugucaaaacuuau

SEQ ID NO: 409658 - RNA, 22 nt, Human
cuccagugagugagcaggcgac

SEQ ID NO: 409659 - RNA, 17 nt, Human
ucaggcugugccuggua

SEQ ID NO: 409660 - RNA, 22 nt, Human
uugaauaguuuuggauagcaua

SEQ ID NO: 409661 - RNA, 22 nt, Human
ccugggaggcggagguugcagg

SEQ ID NO: 409662 - RNA, 22 nt, Human
cacaguggauugggugaugccc

SEQ ID NO: 409663 - RNA, 22 nt, Human
cagagggcucggcggccgcucc

SEQ ID NO: 409664 - RNA, 23 nt, Human
agucucagcuggaaacauguguc

SEQ ID NO: 409665 - RNA, 22 nt, Human
caagagcuggagaggcagucua

SEQ ID NO: 409666 - RNA, 22 nt, Human
ccagagccucgcccggagccuc

SEQ ID NO: 409667 - RNA, 21 nt, Human
uggcucaguugcugggcacag

SEQ ID NO: 409668 - RNA, 22 nt, Human
gcagaggcaaucagguaugugg

SEQ ID NO: 409669 - RNA, 22 nt, Human
cagagacauuaagugccaugau

SEQ ID NO: 409670 - RNA, 22 nt, Human
aagggcagcugacagaugcuua

SEQ ID NO: 409671 - RNA, 22 nt, Human
cagaguggcacucugcuggaug

SEQ ID NO: 409672 - RNA, 22 nt, Human
ugguggcuucugaggauggcga

SEQ ID NO: 409673 - RNA, 22 nt, Human
aaggagucugggccauucagag

SEQ ID NO: 409674 - RNA, 22 nt, Human
cugcuuugauuagaagaguaca

SEQ ID NO: 409675 - RNA, 22 nt, Human
agggaggcaggaaaguugucug

SEQ ID NO: 409676 - RNA, 22 nt, Human
gacagggcaagacucugucuaa

SEQ ID NO: 409677 - RNA, 22 nt, Human
ucugugacuugcgggaggagaa

SEQ ID NO: 409678 - RNA, 22 nt, Human
ccucucuguaagggucccuccc

SEQ ID NO: 409679 - RNA, 22 nt, Human
ucugcucuaguugcuuccugcc

SEQ ID NO: 409680 - RNA, 22 nt, Human
aaguguuaaaagauuaaaugcu

SEQ ID NO: 409681 - RNA, 22 nt, Human
ugauuuccugugcgcccuuagg

SEQ ID NO: 409682 - RNA, 22 nt, Human
agaauaaaucaaauguccugag

SEQ ID NO: 409683 - RNA, 22 nt, Human
cugcagccuccugggguacaug

SEQ ID NO: 409684 - RNA, 22 nt, Human
ccuggagcaggagcugcagagg

SEQ ID NO: 409685 - RNA, 22 nt, Human
cacugccuggaaggagagacau

SEQ ID NO: 409686 - RNA, 22 nt, Human
cacaaaauaucaagcacuuuua

SEQ ID NO: 409687 - RNA, 20 nt, Human
uacagaaacaggacuuuugg

SEQ ID NO: 409688 - RNA, 22 nt, Human
gcagcagaggcccuacucuuug

SEQ ID NO: 409689 - RNA, 22 nt, Human
ccaggcugcuuagccuuaucuu

SEQ ID NO: 409690 - RNA, 23 nt, Human
uggcuccaugaaaauuacgagga

SEQ ID NO: 409691 - RNA, 22 nt, Human
gauucuuacuucuaagcaagcu

SEQ ID NO: 409692 - RNA, 23 nt, Human
uggacgccgacuuuggaggcgcu

SEQ ID NO: 409693 - RNA, 22 nt, Human
ucagaggaaaggucagauggcu

SEQ ID NO: 409694 - RNA, 22 nt, Human
aggcaguuguagagagggcucu

SEQ ID NO: 409695 - RNA, 22 nt, Human
auucauuuagguauucacuuac

SEQ ID NO: 409696 - RNA, 23 nt, Human
gcugucugucaucucugcgggag

SEQ ID NO: 409697 - RNA, 22 nt, Human
ucucagagauuuuguuucccuu

SEQ ID NO: 409698 - RNA, 22 nt, Human
acuguggcucaucaggcuggug

SEQ ID NO: 409699 - RNA, 22 nt, Human
uacaaaguuugagaaugcuuuc

SEQ ID NO: 409700 - RNA, 22 nt, Human
uucuaguucccucuggaaugua

SEQ ID NO: 409701 - RNA, 22 nt, Human
gccuggugugcgccgcgcagcu

SEQ ID NO: 409702 - RNA, 22 nt, Human
ggagccagaggcugcugcugug

SEQ ID NO: 409703 - RNA, 22 nt, Human
ucucaggggauucacuggcacc

SEQ ID NO: 409704 - RNA, 22 nt, Human
uguacaauagcuauuaucucca

SEQ ID NO: 409705 - RNA, 22 nt, Human
ggagugggcagcacugcccugu

SEQ ID NO: 409706 - RNA, 22 nt, Human
gggagaagaaugugucaauugu

SEQ ID NO: 409707 - RNA, 22 nt, Human
cucaggaucgcuugcccuaggg

SEQ ID NO: 409708 - RNA, 19 nt, Human
ccugugacuaucuuuguaa

SEQ ID NO: 409709 - RNA, 22 nt, Human
aagagcugcaucuaagccauga

SEQ ID NO: 409710 - RNA, 22 nt, Human
ggaagccaugagggacaguucu

SEQ ID NO: 409711 - RNA, 22 nt, Human
ugcagggcaucuuugaagugug

SEQ ID NO: 409712 - RNA, 22 nt, Human
aggccuccugcagggaugagug

SEQ ID NO: 409713 - RNA, 22 nt, Human
ggggcucaguucggacagccug

SEQ ID NO: 409714 - RNA, 22 nt, Human
agccacagucugaugccugaga

SEQ ID NO: 409715 - RNA, 22 nt, Human
cccagcaucuccaggcauggcc

SEQ ID NO: 409716 - RNA, 22 nt, Human
acacaguauuacaauaggugcu

SEQ ID NO: 409717 - RNA, 22 nt, Human
cauggccugccuccuccuggug

SEQ ID NO: 409718 - RNA, 22 nt, Human
ugucucaguacacuccgauguu

SEQ ID NO: 409719 - RNA, 22 nt, Human
uauuucuugagacucgucuucc

SEQ ID NO: 409720 - RNA, 22 nt, Human
cagaggaaaugggaaggagaua

SEQ ID NO: 409721 - RNA, 21 nt, Human
cagugagguccccagccuagg

SEQ ID NO: 409722 - RNA, 18 nt, Human
uguuuauuuuucucuuac

SEQ ID NO: 409723 - RNA, 22 nt, Human
cuguauuugaaagaaaagauuu

SEQ ID NO: 409724 - RNA, 22 nt, Human
caggccuggagugcaauggcac

SEQ ID NO: 409725 - RNA, 22 nt, Human
gccagagguaucaaagauagua

SEQ ID NO: 409726 - RNA, 22 nt, Human
aucuuccuucacuuucucccac

SEQ ID NO: 409727 - RNA, 18 nt, Human
cccagcccaccauuucuc

SEQ ID NO: 409728 - RNA, 22 nt, Human
cagcugugcugauugcucagua

SEQ ID NO: 409729 - RNA, 22 nt, Human
ccucugaguccucccugguugc

SEQ ID NO: 409730 - RNA, 22 nt, Human
cagagcugggcauggugaaagg

SEQ ID NO: 409731 - RNA, 22 nt, Human
gaggagggagcuggaagcucuu

SEQ ID NO: 409732 - RNA, 22 nt, Human
agcuggggguuggauaagggua

SEQ ID NO: 409733 - RNA, 22 nt, Human
cuccugagcucugaggaagcuu

SEQ ID NO: 409734 - RNA, 22 nt, Human
gagccagguuugaaucucaguc

SEQ ID NO: 409735 - RNA, 22 nt, Human
uccaggcacgaggcccugugca

SEQ ID NO: 409736 - RNA, 22 nt, Human
aaggcugagacagcacaggucc

SEQ ID NO: 409737 - RNA, 22 nt, Human
cagaggcagaauggagauuugg

SEQ ID NO: 409738 - RNA, 21 nt, Human
ucucugggcccuccugugggg

SEQ ID NO: 409739 - RNA, 22 nt, Human
acagggucauuuuaugaucugu

SEQ ID NO: 409740 - RNA, 22 nt, Human
caguacuucuuggaaacuggau

SEQ ID NO: 409741 - RNA, 22 nt, Human
agggucagagaucggccaugug

SEQ ID NO: 409742 - RNA, 22 nt, Human
uugcaucuaccauaucaaagau

SEQ ID NO: 409743 - RNA, 22 nt, Human
ucucagagaugucaagagucua

SEQ ID NO: 409744 - RNA, 22 nt, Human
cauacauugcucauucaguauc

SEQ ID NO: 409745 - RNA, 22 nt, Human
aagccagggauuccugagggag

SEQ ID NO: 409746 - RNA, 22 nt, Human
auguccuuugcuucucuggucc

SEQ ID NO: 409747 - RNA, 22 nt, Human
uccagcuuugagauuuuaugga

SEQ ID NO: 409748 - RNA, 16 nt, Human
gggagggaguuggugg

SEQ ID NO: 409749 - RNA, 22 nt, Human
ccugggagguggagguugcagc

SEQ ID NO: 409750 - RNA, 22 nt, Human
aguguccccuacagaggcauuc

SEQ ID NO: 409751 - RNA, 22 nt, Human
gcaguggcaccgcuggcucugg

SEQ ID NO: 409752 - RNA, 21 nt, Human
ugcagcugacacugguaugcc

SEQ ID NO: 409753 - RNA, 22 nt, Human
agagaagagcaaugauaaauuu

SEQ ID NO: 409754 - RNA, 22 nt, Human
uacagaaaucacaucgcuuuga

SEQ ID NO: 409755 - RNA, 21 nt, Human
uggccaaaaccauauuauuaa

SEQ ID NO: 409756 - RNA, 19 nt, Human
cuggaaugauagagaccuc

SEQ ID NO: 409757 - RNA, 22 nt, Human
ccacccuuggguucggaggccg

SEQ ID NO: 409758 - RNA, 22 nt, Human
caccagcuacagacuacugugu

SEQ ID NO: 409759 - RNA, 22 nt, Human
gcucugagauugagccuuuggu

SEQ ID NO: 409760 - RNA, 22 nt, Human
gacuguguccaugugcuggauu

SEQ ID NO: 409761 - RNA, 17 nt, Human
agccccucagcgucacc

SEQ ID NO: 409762 - RNA, 22 nt, Human
uuucuccaauguaucagcacac

SEQ ID NO: 409763 - RNA, 22 nt, Human
guuggccugaauggucaagagg

SEQ ID NO: 409764 - RNA, 22 nt, Human
uuauuauuuuguguacagcaaa

SEQ ID NO: 409765 - RNA, 22 nt, Human
augcaguguuuggaagcuuaag

SEQ ID NO: 409766 - RNA, 22 nt, Human
auaugauuccacuauuguaugg

SEQ ID NO: 409767 - RNA, 22 nt, Human
augcacgccccacacuggugug

SEQ ID NO: 409768 - RNA, 22 nt, Human
ugaggcaggagaaucacaugaa

SEQ ID NO: 409769 - RNA, 22 nt, Human
cuuauuuuaagucaguuugggu

SEQ ID NO: 409770 - RNA, 22 nt, Human
gcgagggcacgcgguugaaggc

SEQ ID NO: 409771 - RNA, 22 nt, Human
aaggcacuacgcugcuggggcg

SEQ ID NO: 409772 - RNA, 22 nt, Human
ggggcagccuccaggaaagcug

SEQ ID NO: 409773 - RNA, 22 nt, Human
ugggagaugguucugagacuuu

SEQ ID NO: 409774 - RNA, 22 nt, Human
agccagacauggcuccugcucc

SEQ ID NO: 409775 - RNA, 22 nt, Human
gcagagcaguacucucuugacu

SEQ ID NO: 409776 - RNA, 22 nt, Human
gccuggcaggccugggccagca

SEQ ID NO: 409777 - RNA, 22 nt, Human
uaguuaggaaaguccagggagc

SEQ ID NO: 409778 - RNA, 22 nt, Human
uagaaaauagggccuguggagc

SEQ ID NO: 409779 - RNA, 22 nt, Human
uggccaggggaguuccccucca

SEQ ID NO: 409780 - RNA, 22 nt, Human
cagagugaaauaggggaucaag

SEQ ID NO: 409781 - RNA, 22 nt, Human
gagacugcauagauggccacaa

SEQ ID NO: 409782 - RNA, 22 nt, Human
guggcacagugggagagcccca

SEQ ID NO: 409783 - RNA, 22 nt, Human
caggcagagugagguggucuaa

SEQ ID NO: 409784 - RNA, 22 nt, Human
agggcuggcaagggauugaaau

SEQ ID NO: 409785 - RNA, 22 nt, Human
agggccagagucuguguagaua

SEQ ID NO: 409786 - RNA, 22 nt, Human
ggcagcaguaggagcuaaucuu

SEQ ID NO: 409787 - RNA, 22 nt, Human
aaaauggucucagcuggcacca

SEQ ID NO: 409788 - RNA, 22 nt, Human
uguugauuaguguuuagacuua

SEQ ID NO: 409789 - RNA, 22 nt, Human
gccaggugcuaucccugcgcug

SEQ ID NO: 409790 - RNA, 22 nt, Human
agaccaagacuauaaugagagg

SEQ ID NO: 409791 - RNA, 22 nt, Human
cuggagagaaaugacaaagcua

SEQ ID NO: 409792 - RNA, 17 nt, Human
gcuuccucaugcaguuc

SEQ ID NO: 409793 - RNA, 22 nt, Human
caggaaggcccaccuguccugu

SEQ ID NO: 409794 - RNA, 22 nt, Human
gcaggagcaaacugcagugugg

SEQ ID NO: 409795 - RNA, 22 nt, Human
cccuggaggagcuuagagcuug

SEQ ID NO: 409796 - RNA, 22 nt, Human
ucacuggggccuuuggucagga

SEQ ID NO: 409797 - RNA, 21 nt, Human
cugcucuggggaccggcugug

SEQ ID NO: 409798 - RNA, 22 nt, Human
uucagagaagcaaaggcagauu

SEQ ID NO: 409799 - RNA, 22 nt, Human
ggcaugggagugagcaaccuua

SEQ ID NO: 409800 - RNA, 22 nt, Human
cuggcagcgcagcaugaagucg

SEQ ID NO: 409801 - RNA, 22 nt, Human
gguuucaaauuaaagucuuaag

SEQ ID NO: 409802 - RNA, 22 nt, Human
aaauucuaugucaauguuuauu

SEQ ID NO: 409803 - RNA, 22 nt, Human
ggagccuggccuggcucugugu

SEQ ID NO: 409804 - RNA, 22 nt, Human
uuugaaaggagcuuuauccaga

SEQ ID NO: 409805 - RNA, 22 nt, Human
uuuugagauggagucuugcucu

SEQ ID NO: 409806 - RNA, 22 nt, Human
ugcuauaagaauuauauuacuc

SEQ ID NO: 409807 - RNA, 22 nt, Human
accucugccaagaugugcuccc

SEQ ID NO: 409808 - RNA, 22 nt, Human
aagugauuucugccugcauguu

SEQ ID NO: 409809 - RNA, 19 nt, Human
ggcucucuuaaagcuguuu

SEQ ID NO: 409810 - RNA, 22 nt, Human
uuacauuuugggguaaggauaa

SEQ ID NO: 409811 - RNA, 22 nt, Human
ucaguuuuuaaaugauauaauu

SEQ ID NO: 409812 - RNA, 23 nt, Human
agaccugcaucugauaggcccug

SEQ ID NO: 409813 - RNA, 22 nt, Human
ugauacagucagcucacaauug

SEQ ID NO: 409814 - RNA, 22 nt, Human
ugaugguugauuauaaaucagu

SEQ ID NO: 409815 - RNA, 22 nt, Human
ucccuggacagccuugccuggg

SEQ ID NO: 409816 - RNA, 17 nt, Human
gcugagugcagggaguc

SEQ ID NO: 409817 - RNA, 22 nt, Human
ccacagggcacaagggagguug

SEQ ID NO: 409818 - RNA, 22 nt, Human
ucugucuuagcaucuuugcuca

SEQ ID NO: 409819 - RNA, 22 nt, Human
ugucuuuucuacuguaagcaua

SEQ ID NO: 409820 - RNA, 22 nt, Human
uaaauguguuagucaugguuuu

SEQ ID NO: 409821 - RNA, 22 nt, Human
ucaggccacuucacaggugauu

SEQ ID NO: 409822 - RNA, 22 nt, Human
acuguucauuuggauuucucug

SEQ ID NO: 409823 - RNA, 22 nt, Human
aggugccaauuuucagugaaca

SEQ ID NO: 409824 - RNA, 22 nt, Human
ggaagagccuggggugucaggc

SEQ ID NO: 409825 - RNA, 20 nt, Human
cccuccagcaaccaggacuu

SEQ ID NO: 409826 - RNA, 22 nt, Human
cuagaaaaauacuuuauuguga

SEQ ID NO: 409827 - RNA, 22 nt, Human
ugggcugaaaugcuguggacua

SEQ ID NO: 409828 - RNA, 22 nt, Human
ccaggagcuggagggugcagug

SEQ ID NO: 409829 - RNA, 22 nt, Human
aggaccuguagggccugcaucc

SEQ ID NO: 409830 - RNA, 17 nt, Human
uauguaguacuuauaaa

SEQ ID NO: 409831 - RNA, 22 nt, Human
cagggcacaguuauggaggugg

SEQ ID NO: 409832 - RNA, 22 nt, Human
acucccacuccagaguagaagc

SEQ ID NO: 409833 - RNA, 22 nt, Human
gugugcagcagagacaggacuc

SEQ ID NO: 409834 - RNA, 22 nt, Human
uggacaggugagugacucaggg

SEQ ID NO: 409835 - RNA, 22 nt, Human
caggagugcagguggugaggca

SEQ ID NO: 409836 - RNA, 23 nt, Human
uccagggauuaaugaagucaguc

SEQ ID NO: 409837 - RNA, 22 nt, Human
aaaccaucagauaauucauacu

SEQ ID NO: 409838 - RNA, 22 nt, Human
cacaguggcagguguggguugu

SEQ ID NO: 409839 - RNA, 22 nt, Human
ggaggggcagccauggaacucc

SEQ ID NO: 409840 - RNA, 22 nt, Human
aacugcauucagaaagcucacu

SEQ ID NO: 409841 - RNA, 22 nt, Human
ggagaugccagaauugcaaauu

SEQ ID NO: 409842 - RNA, 22 nt, Human
aaaguuugagugauuugacaca

SEQ ID NO: 409843 - RNA, 22 nt, Human
aaagucuuuauuuuguaucuuu

SEQ ID NO: 409844 - RNA, 22 nt, Human
uauuucuguaugcauaaaagga

SEQ ID NO: 409845 - RNA, 22 nt, Human
cuggcaggcggcagagcccagg

SEQ ID NO: 409846 - RNA, 22 nt, Human
acagaggucauggagaguucuc

SEQ ID NO: 409847 - RNA, 22 nt, Human
ugcccauguuucucuguauccc

SEQ ID NO: 409848 - RNA, 20 nt, Human
cuuuggcaaugagaacaggg

SEQ ID NO: 409849 - RNA, 22 nt, Human
ucaggcagagggagaagccaag

SEQ ID NO: 409850 - RNA, 22 nt, Human
ucugagaguacgggcugcgcgc

SEQ ID NO: 409851 - RNA, 22 nt, Human
cugcugggucuaugcaagugga

SEQ ID NO: 409852 - RNA, 22 nt, Human
ugucugucugcaagccagaaag

SEQ ID NO: 409853 - RNA, 22 nt, Human
agggaucaaaaaauguacaugc

SEQ ID NO: 409854 - RNA, 22 nt, Human
cuuauguaugcuacuuuguggu

SEQ ID NO: 409855 - RNA, 22 nt, Human
uccagccaagggagguuacuag

SEQ ID NO: 409856 - RNA, 19 nt, Human
uggcuuccaucucucucau

SEQ ID NO: 409857 - RNA, 22 nt, Human
cagcacacagugacucgcaccu

SEQ ID NO: 409858 - RNA, 21 nt, Human
agcagccauggaugguaugua

SEQ ID NO: 409859 - RNA, 22 nt, Human
gagccuccuccuggugugccga

SEQ ID NO: 409860 - RNA, 22 nt, Human
cagggccauaucuugugcacca

SEQ ID NO: 409861 - RNA, 22 nt, Human
cuacauuuguucuauagcuuuu

SEQ ID NO: 409862 - RNA, 22 nt, Human
guugggaaggcaagaaguagaa

SEQ ID NO: 409863 - RNA, 22 nt, Human
aggacaguguggaagagggugc

SEQ ID NO: 409864 - RNA, 22 nt, Human
ugaagccauaggacagaggaua

SEQ ID NO: 409865 - RNA, 22 nt, Human
ugggcugcccugaugguccuca

SEQ ID NO: 409866 - RNA, 21 nt, Human
caguguggugaccagggucuc

SEQ ID NO: 409867 - RNA, 22 nt, Human
cuguggagcuuguggcaguggg

SEQ ID NO: 409868 - RNA, 22 nt, Human
aggcaggagcaagcccuacaag

SEQ ID NO: 409869 - RNA, 22 nt, Human
ccugggcauaaaucacuccaag

SEQ ID NO: 409870 - RNA, 22 nt, Human
agguggcucugacagcucuggu

SEQ ID NO: 409871 - RNA, 22 nt, Human
ugacauuuaucaaagaaauggu

SEQ ID NO: 409872 - RNA, 22 nt, Human
caggacaguauaggcuuuagga

SEQ ID NO: 409873 - RNA, 22 nt, Human
uguguuuugaacucaucuacug

SEQ ID NO: 409874 - RNA, 22 nt, Human
ccaguggaaauguggucaggau

SEQ ID NO: 409875 - RNA, 22 nt, Human
aagauuauggcagauaacaauu

SEQ ID NO: 409876 - RNA, 22 nt, Human
cagcagagacgguaagcagaac

SEQ ID NO: 409877 - RNA, 22 nt, Human
acauuugucuucuuucagauua

SEQ ID NO: 409878 - RNA, 22 nt, Human
cugcuuugaaaauaaacuuguc

SEQ ID NO: 409879 - RNA, 22 nt, Human
ugucuuccucuuggcuugagcu

SEQ ID NO: 409880 - RNA, 22 nt, Human
uggccagguugggcuuugcagc

SEQ ID NO: 409881 - RNA, 22 nt, Human
ucuggcucaggagcuguguuca

SEQ ID NO: 409882 - RNA, 22 nt, Human
gccucugcgccucagccgaccu

SEQ ID NO: 409883 - RNA, 22 nt, Human
gcugucucauacaaggcccugc

SEQ ID NO: 409884 - RNA, 17 nt, Human
uuccaguuuaguauugu

SEQ ID NO: 409885 - RNA, 22 nt, Human
uagucccauuuugagguauuug

SEQ ID NO: 409886 - RNA, 22 nt, Human
gcucugcucuugacuuaccagg

SEQ ID NO: 409887 - RNA, 22 nt, Human
guaaaucccauccuuucucugg

SEQ ID NO: 409888 - RNA, 18 nt, Human
gcucugcccaggcugccc

SEQ ID NO: 409889 - RNA, 22 nt, Human
acaggcagagaacucagccaga

SEQ ID NO: 409890 - RNA, 22 nt, Human
gggcagaggcucuggcccaucc

SEQ ID NO: 409891 - RNA, 22 nt, Human
auguguauacuugugcuuacuc

SEQ ID NO: 409892 - RNA, 22 nt, Human
gccagguggcugagugacugag

SEQ ID NO: 409893 - RNA, 22 nt, Human
acagagguguuccagaccuagg

SEQ ID NO: 409894 - RNA, 22 nt, Human
uguuucuucucacacaaacuca

SEQ ID NO: 409895 - RNA, 22 nt, Human
ccagggcaauuauuuggagggu

SEQ ID NO: 409896 - RNA, 22 nt, Human
gagccagcugagcugcacuguc

SEQ ID NO: 409897 - RNA, 21 nt, Human
gagcauggcuuacaucagcag

SEQ ID NO: 409898 - RNA, 22 nt, Human
ucaccaggcuccuguuaagaug

SEQ ID NO: 409899 - RNA, 22 nt, Human
gcucccagaaccaaggcugggg

SEQ ID NO: 409900 - RNA, 22 nt, Human
agauuuagacugccuuaaucau

SEQ ID NO: 409901 - RNA, 22 nt, Human
cucauggauauaagaacuguuu

SEQ ID NO: 409902 - RNA, 22 nt, Human
cuggcuuccaugcuguaguggc

SEQ ID NO: 409903 - RNA, 22 nt, Human
cagaggcucagauggcccuggc

SEQ ID NO: 409904 - RNA, 22 nt, Human
gcuguucugcgucccaggcugg

SEQ ID NO: 409905 - RNA, 19 nt, Human
cagaacagaggucauggcc

SEQ ID NO: 409906 - RNA, 17 nt, Human
ucauuuguugugacuag

SEQ ID NO: 409907 - RNA, 22 nt, Human
cccuggagggcagacagaugcc

SEQ ID NO: 409908 - RNA, 22 nt, Human
ucucaggaagauuagggcuaag

SEQ ID NO: 409909 - RNA, 22 nt, Human
aaucuguuuaguucugcguaug

SEQ ID NO: 409910 - RNA, 22 nt, Human
agcuguccuggcucaggcugug

SEQ ID NO: 409911 - RNA, 22 nt, Human
ucugucauguuuccauuacaug

SEQ ID NO: 409912 - RNA, 21 nt, Human
agagcugggacuugccugaga

SEQ ID NO: 409913 - RNA, 22 nt, Human
gagaagcagguuuagcagacaa

SEQ ID NO: 409914 - RNA, 22 nt, Human
cauucauuuacuuucaacagcu

SEQ ID NO: 409915 - RNA, 19 nt, Human
ggcugcugguuacagaggc

SEQ ID NO: 409916 - RNA, 22 nt, Human
auccucaguguuucugacaucu

SEQ ID NO: 409917 - RNA, 22 nt, Human
ccuccagguguuacauaugacu

SEQ ID NO: 409918 - RNA, 22 nt, Human
uuagaaaugauuucaccucuuu

SEQ ID NO: 409919 - RNA, 22 nt, Human
uggaaagagguagaggaucugg

SEQ ID NO: 409920 - RNA, 22 nt, Human
agcugccagcaucccggaaggg

SEQ ID NO: 409921 - RNA, 22 nt, Human
ccuguacagugaaugaauguga

SEQ ID NO: 409922 - RNA, 22 nt, Human
uguauuuucugaagauaaucaa

SEQ ID NO: 409923 - RNA, 22 nt, Human
caucacuguccucagcauucca

SEQ ID NO: 409924 - RNA, 22 nt, Human
uuucagaugcaauuaauuuuca

SEQ ID NO: 409925 - RNA, 22 nt, Human
cugcccugucuuuuucugauga

SEQ ID NO: 409926 - RNA, 22 nt, Human
ucccuggaacagagagacaacg

SEQ ID NO: 409927 - RNA, 22 nt, Human
ucuuccaguguagacaucugcc

SEQ ID NO: 409928 - RNA, 18 nt, Human
gugugcaguugcaggggu

SEQ ID NO: 409929 - RNA, 22 nt, Human
ggucccaguccucucccugcua

SEQ ID NO: 409930 - RNA, 22 nt, Human
ugcagagguuuccaggcaaguu

SEQ ID NO: 409931 - RNA, 22 nt, Human
aaguccaguuucauuugagguc

SEQ ID NO: 409932 - RNA, 22 nt, Human
ccucucauagucuguauccuuu

SEQ ID NO: 409933 - RNA, 22 nt, Human
uguagcucuccagccagcaagg

SEQ ID NO: 409934 - RNA, 22 nt, Human
cugugucccaguaccuugggua

SEQ ID NO: 409935 - RNA, 22 nt, Human
uccuggagcuuccuucauggua

SEQ ID NO: 409936 - RNA, 21 nt, Human
aagggagauaggaaucaggcc

SEQ ID NO: 409937 - RNA, 22 nt, Human
aucuuuaggaaccuaaccuauu

SEQ ID NO: 409938 - RNA, 21 nt, Human
ucaggcaggcgcagagggaag

SEQ ID NO: 409939 - RNA, 22 nt, Human
uggcccgaccucugcucaugca

SEQ ID NO: 409940 - RNA, 22 nt, Human
cagggccaugaggcacaggguc

SEQ ID NO: 409941 - RNA, 22 nt, Human
aaaugcagcagcuaauugaaaa

SEQ ID NO: 409942 - RNA, 22 nt, Human
caguuuuugccauuaagaguaa

SEQ ID NO: 409943 - RNA, 22 nt, Human
agugaagaggaaguggggcaca

SEQ ID NO: 409944 - RNA, 22 nt, Human
aggcacugauucuguuuuccau

SEQ ID NO: 409945 - RNA, 22 nt, Human
uggaggcaguuuaagucugaga

SEQ ID NO: 409946 - RNA, 22 nt, Human
ucucccaguccucugugcuuac

SEQ ID NO: 409947 - RNA, 22 nt, Human
uuccaguucccaugaggauuaa

SEQ ID NO: 409948 - RNA, 22 nt, Human
uguuuaaucuauaaaauggaga

SEQ ID NO: 409949 - RNA, 22 nt, Human
acugcuuuuagaaaucuauaga

SEQ ID NO: 409950 - RNA, 22 nt, Human
aaaugcagguucuugagccaag

SEQ ID NO: 409951 - RNA, 22 nt, Human
aggcuucagguuugcuuugcag

SEQ ID NO: 409952 - RNA, 22 nt, Human
uccuucagauuccugcuucugg

SEQ ID NO: 409953 - RNA, 22 nt, Human
caccugggcuaaacuaugcagg

SEQ ID NO: 409954 - RNA, 22 nt, Human
gcccagcagcugguggagaagg

SEQ ID NO: 409955 - RNA, 22 nt, Human
aaacuucagugaaugacuuaug

SEQ ID NO: 409956 - RNA, 22 nt, Human
gagaaacuuggaguuauucugg

SEQ ID NO: 409957 - RNA, 22 nt, Human
ugaggcaggaugcuugcacagg

SEQ ID NO: 409958 - RNA, 21 nt, Human
agaugcugugcuccaggagca

SEQ ID NO: 409959 - RNA, 21 nt, Human
cccuugccugcacuccucggc

SEQ ID NO: 409960 - RNA, 22 nt, Human
acuguccauucacucauauuca

SEQ ID NO: 409961 - RNA, 22 nt, Human
cucuggccugcuuccucaggua

SEQ ID NO: 409962 - RNA, 22 nt, Human
uuauuagguuauucucuguacu

SEQ ID NO: 409963 - RNA, 22 nt, Human
gaagccccaaacccucgccauc

SEQ ID NO: 409964 - RNA, 19 nt, Human
agacaaguuuccagaagcc

SEQ ID NO: 409965 - RNA, 22 nt, Human
acagccaggaauucuggagaag

SEQ ID NO: 409966 - RNA, 19 nt, Human
gcaggcacagcccugggug

SEQ ID NO: 409967 - RNA, 22 nt, Human
cuuggccucuucucaggguggg

SEQ ID NO: 409968 - RNA, 22 nt, Human
gccuccccugcaauuguccuug

SEQ ID NO: 409969 - RNA, 22 nt, Human
agaggccagggacacugcucaa

SEQ ID NO: 409970 - RNA, 22 nt, Human
cugccaggacugacgucuucag

SEQ ID NO: 409971 - RNA, 22 nt, Human
gccugcaguucugugcuaggca

SEQ ID NO: 409972 - RNA, 22 nt, Human
ucccagagguugagucacuuau

SEQ ID NO: 409973 - RNA, 22 nt, Human
gucagcaggguccccuugagug

SEQ ID NO: 409974 - RNA, 22 nt, Human
cauucugcauuuggaaggggca

SEQ ID NO: 409975 - RNA, 22 nt, Human
gaaccucagugaaacuggaggu

SEQ ID NO: 409976 - RNA, 21 nt, Human
ucugggcccaugcugccucac

SEQ ID NO: 409977 - RNA, 22 nt, Human
ggucaggggcugcucuacagag

SEQ ID NO: 409978 - RNA, 22 nt, Human
caucacagggggcuagaagucu

SEQ ID NO: 409979 - RNA, 21 nt, Human
ggacuuacauagguaaggggu

SEQ ID NO: 409980 - RNA, 17 nt, Human
ggagagugggaauggcc

SEQ ID NO: 409981 - RNA, 22 nt, Human
ccucucaucauuaucgcuuugu

SEQ ID NO: 409982 - RNA, 22 nt, Human
uuccagaaaucuuucagcucaa

SEQ ID NO: 409983 - RNA, 18 nt, Human
gguggcucagucaugggg

SEQ ID NO: 409984 - RNA, 22 nt, Human
gcagggcucugcuguaguccua

SEQ ID NO: 409985 - RNA, 22 nt, Human
gccugcagaacugugaggcaau

SEQ ID NO: 409986 - RNA, 22 nt, Human
cagagcugcucaugguggccag

SEQ ID NO: 409987 - RNA, 20 nt, Human
ucugaggcugagcucuacuu

SEQ ID NO: 409988 - RNA, 22 nt, Human
aucuucaaagcacaucguuugu

SEQ ID NO: 409989 - RNA, 22 nt, Human
cagagguagaaggcaugcagug

SEQ ID NO: 409990 - RNA, 22 nt, Human
cucuggagcaccgggcuaucca

SEQ ID NO: 409991 - RNA, 22 nt, Human
uuacaacauauuuagcuugauu

SEQ ID NO: 409992 - RNA, 22 nt, Human
ucucaguguggugcuuaggaua

SEQ ID NO: 409993 - RNA, 22 nt, Human
gcagggccagguacaagaagca

SEQ ID NO: 409994 - RNA, 22 nt, Human
accaggaggccuggagcacaaa

SEQ ID NO: 409995 - RNA, 22 nt, Human
aucuggcugcugugcuuaagcu

SEQ ID NO: 409996 - RNA, 22 nt, Human
aagggcuguaagccaaguaaag

SEQ ID NO: 409997 - RNA, 22 nt, Human
cagggcagugaagaacacacgu

SEQ ID NO: 409998 - RNA, 22 nt, Human
agaggcucugccgccucaggua

SEQ ID NO: 409999 - RNA, 22 nt, Human
gcagguggagcaguagucuggu

SEQ ID NO: 410000 - RNA, 23 nt, Human
ggcuggcccggggcugcuccuga

SEQ ID NO: 410001 - RNA, 22 nt, Human
agccuggaggccaggagacagu

SEQ ID NO: 410002 - RNA, 21 nt, Human
aauuagggugccucuuauaau

SEQ ID NO: 410003 - RNA, 22 nt, Human
agcugacugaugaagaggccuu

SEQ ID NO: 410004 - RNA, 22 nt, Human
ucagcaaugagaacuggcauuu

SEQ ID NO: 410005 - RNA, 22 nt, Human
auuuguaauuucuuaucugugu

SEQ ID NO: 410006 - RNA, 22 nt, Human
cacagggcagaggguccguggc

SEQ ID NO: 410007 - RNA, 22 nt, Human
cugcugcugcuaucuacccagg

SEQ ID NO: 410008 - RNA, 22 nt, Human
cacuuggaggcccccugugccc

SEQ ID NO: 410009 - RNA, 22 nt, Human
guuucaaaagucaggcuauucu

SEQ ID NO: 410010 - RNA, 22 nt, Human
aaagaaggaccuggaggaggau

SEQ ID NO: 410011 - RNA, 22 nt, Human
cagagcugcgcuuuuuccuggu

SEQ ID NO: 410012 - RNA, 22 nt, Human
gcugaagcugcagcaggaggaa

SEQ ID NO: 410013 - RNA, 22 nt, Human
gacagcagacagaacuaccugc

SEQ ID NO: 410014 - RNA, 22 nt, Human
cucagaauuuagggcucugagg

SEQ ID NO: 410015 - RNA, 22 nt, Human
uggggccuggucagagcugcac

SEQ ID NO: 410016 - RNA, 22 nt, Human
cucagaguccccacaucugggu

SEQ ID NO: 410017 - RNA, 22 nt, Human
aagguacaccaaaguucaaguu

SEQ ID NO: 410018 - RNA, 22 nt, Human
aauuuagauugauaaacaugga

SEQ ID NO: 410019 - RNA, 22 nt, Human
ucauugcaggcauuccccugcc

SEQ ID NO: 410020 - RNA, 22 nt, Human
ccccagccagcaggaccucuga

SEQ ID NO: 410021 - RNA, 22 nt, Human
ugggcaggauaauaucucaugu

SEQ ID NO: 410022 - RNA, 22 nt, Human
uggaggaaguggacaguugugu

SEQ ID NO: 410023 - RNA, 22 nt, Human
cuguucaugcugauucuguaug

SEQ ID NO: 410024 - RNA, 22 nt, Human
aagauuucugcuuuuggaggca

SEQ ID NO: 410025 - RNA, 22 nt, Human
uuccucuccucacaugagucac

SEQ ID NO: 410026 - RNA, 22 nt, Human
uccugccuuagagcaaggaaaa

SEQ ID NO: 410027 - RNA, 22 nt, Human
uacaagaaauuucugcauauau

SEQ ID NO: 410028 - RNA, 19 nt, Human
ggcauccacgaaugcagag

SEQ ID NO: 410029 - RNA, 22 nt, Human
aauguuaaaaccuucagugcuu

SEQ ID NO: 410030 - RNA, 22 nt, Human
gcaguggaagccucuuuaagca

SEQ ID NO: 410031 - RNA, 22 nt, Human
ggagggugcauuuuacccugug

SEQ ID NO: 410032 - RNA, 22 nt, Human
agcaggaaagaaaaaucugugu

SEQ ID NO: 410033 - RNA, 22 nt, Human
gcacccagagggcagggucucc

SEQ ID NO: 410034 - RNA, 22 nt, Human
uggaguucauccaugacagcuu

SEQ ID NO: 410035 - RNA, 22 nt, Human
ccagggcauguaacuaauggug

SEQ ID NO: 410036 - RNA, 22 nt, Human
aggcagagcuaggaagaauugu

SEQ ID NO: 410037 - RNA, 22 nt, Human
auauuauucuaguaacagugau

SEQ ID NO: 410038 - RNA, 22 nt, Human
uuugucaucccuuuugaaacug

SEQ ID NO: 410039 - RNA, 22 nt, Human
aggcucagauucacauuugguu

SEQ ID NO: 410040 - RNA, 22 nt, Human
gaguuauuggguggaaagguag

SEQ ID NO: 410041 - RNA, 22 nt, Human
ugaggccaggaucccaggcucu

SEQ ID NO: 410042 - RNA, 22 nt, Human
gugucacaagagcccaggaaac

SEQ ID NO: 410043 - RNA, 17 nt, Human
cagucgaggaggaccug

SEQ ID NO: 410044 - RNA, 22 nt, Human
ucugggggcgaccagggacugc

SEQ ID NO: 410045 - RNA, 22 nt, Human
acagaaggcggggacaaggcgg

SEQ ID NO: 410046 - RNA, 22 nt, Human
ugccucugugggccuuccuggc

SEQ ID NO: 410047 - RNA, 22 nt, Human
cugcagggaugugaggcccguu

SEQ ID NO: 410048 - RNA, 22 nt, Human
uccucagggaagaugagccuca

SEQ ID NO: 410049 - RNA, 22 nt, Human
caggugggccaugaaaaaugac

SEQ ID NO: 410050 - RNA, 22 nt, Human
ucauacauaacuuguacaguga

SEQ ID NO: 410051 - RNA, 22 nt, Human
uucaaucauuuuuacauagucc

SEQ ID NO: 410052 - RNA, 22 nt, Human
ucccagagucagagguggggcc

SEQ ID NO: 410053 - RNA, 22 nt, Human
gcccacacaccagcucaggagg

SEQ ID NO: 410054 - RNA, 22 nt, Human
aggugccagcucucaggcagga

SEQ ID NO: 410055 - RNA, 22 nt, Human
cucccaagcugugcugaacugu

SEQ ID NO: 410056 - RNA, 22 nt, Human
ggcgcuggccacgguggcucug

SEQ ID NO: 410057 - RNA, 22 nt, Human
uggcuuccuggacagaugcggu

SEQ ID NO: 410058 - RNA, 22 nt, Human
acuguacauauggauucuaaga

SEQ ID NO: 410059 - RNA, 22 nt, Human
ugucacagggauaccauggggc

SEQ ID NO: 410060 - RNA, 22 nt, Human
ucuagaaaaaaacugcugugga

SEQ ID NO: 410061 - RNA, 22 nt, Human
acauacauaugacaacuuuccu

SEQ ID NO: 410062 - RNA, 22 nt, Human
uggcucaguuaggucagaaaca

SEQ ID NO: 410063 - RNA, 22 nt, Human
gcagugacagggcugcugccuu

SEQ ID NO: 410064 - RNA, 22 nt, Human
uauuaucauugguaauaugguc

SEQ ID NO: 410065 - RNA, 22 nt, Human
gauggguggucucagacuugcc

SEQ ID NO: 410066 - RNA, 22 nt, Human
cauugucacccaaagcucauag

SEQ ID NO: 410067 - RNA, 22 nt, Human
augcuguguggucaaguuaauu

SEQ ID NO: 410068 - RNA, 22 nt, Human
ugggagcaccuugagggcagaa

SEQ ID NO: 410069 - RNA, 22 nt, Human
gcucagggaacuuuuugcaggc

SEQ ID NO: 410070 - RNA, 22 nt, Human
cucaggaugaaagucaugguga

SEQ ID NO: 410071 - RNA, 20 nt, Human
ucauccaggacaggaguggc

SEQ ID NO: 410072 - RNA, 21 nt, Human
uucaaaguuugccuaaagauu

SEQ ID NO: 410073 - RNA, 22 nt, Human
cuggggcucucuggaaugcuug

SEQ ID NO: 410074 - RNA, 22 nt, Human
cuccagcuucccucagcugugg

SEQ ID NO: 410075 - RNA, 21 nt, Human
gacaggcaaggagucacuuag

SEQ ID NO: 410076 - RNA, 23 nt, Human
caguacuuaguguagcguuaauu

SEQ ID NO: 410077 - RNA, 22 nt, Human
aagcuggagaguuaggugaaua

SEQ ID NO: 410078 - RNA, 19 nt, Human
uguguaaagucugugguca

SEQ ID NO: 410079 - RNA, 20 nt, Human
ugccaggcugcacgccugcc

SEQ ID NO: 410080 - RNA, 22 nt, Human
gagauauguuagaaagcuauug

SEQ ID NO: 410081 - RNA, 22 nt, Human
uaauuucacugauaugaaguca

SEQ ID NO: 410082 - RNA, 22 nt, Human
cugcccuguggcucugagucau

SEQ ID NO: 410083 - RNA, 22 nt, Human
auacuaagcucauuacauuuug

SEQ ID NO: 410084 - RNA, 22 nt, Human
gccuucagcccugacuggccag

SEQ ID NO: 410085 - RNA, 22 nt, Human
cauugcucaggcccagcaggaa

SEQ ID NO: 410086 - RNA, 22 nt, Human
augcucugggcaggagcccugg

SEQ ID NO: 410087 - RNA, 22 nt, Human
uaaaucccuacaucuguguuuu

SEQ ID NO: 410088 - RNA, 20 nt, Human
uccugcagucgcuagcgccc

SEQ ID NO: 410089 - RNA, 22 nt, Human
gcucuggguagccacugccugg

SEQ ID NO: 410090 - RNA, 22 nt, Human
uccuugaauauaauaacaguag

SEQ ID NO: 410091 - RNA, 22 nt, Human
ugaggcaggacuugcauaaagu

SEQ ID NO: 410092 - RNA, 22 nt, Human
gaaaccagcuagaggcagaggg

SEQ ID NO: 410093 - RNA, 22 nt, Human
guauacauagaugaugaacaag

SEQ ID NO: 410094 - RNA, 22 nt, Human
uuugucuugaggcuggggaagu

SEQ ID NO: 410095 - RNA, 22 nt, Human
gagcugaaauaugaagccaauu

SEQ ID NO: 410096 - RNA, 22 nt, Human
agugcaauagcaaagaacaaca

SEQ ID NO: 410097 - RNA, 22 nt, Human
ucagaagcaggagugugcacaa

SEQ ID NO: 410098 - RNA, 22 nt, Human
gggcagcucuggcugugggaag

SEQ ID NO: 410099 - RNA, 22 nt, Human
ccagugggugcugggcucugcc

SEQ ID NO: 410100 - RNA, 23 nt, Human
aaucuggcugauguuuuuucucu

SEQ ID NO: 410101 - RNA, 22 nt, Human
cagagccccucagcucucuccc

SEQ ID NO: 410102 - RNA, 22 nt, Human
uggccuggcugcccugucugga

SEQ ID NO: 410103 - RNA, 23 nt, Human
acagagguccaaacaguauaagc

SEQ ID NO: 410104 - RNA, 22 nt, Human
uuucauugucaauaaacuguau

SEQ ID NO: 410105 - RNA, 22 nt, Human
uauuuugagguauuuuugagcu

SEQ ID NO: 410106 - RNA, 22 nt, Human
ugucucugugagaucugacgau

SEQ ID NO: 410107 - RNA, 19 nt, Human
agacucugugugagacuuu

SEQ ID NO: 410108 - RNA, 22 nt, Human
ugggagcugggguuggacgucu

SEQ ID NO: 410109 - RNA, 20 nt, Human
ggccuuggccucuuugcagc

SEQ ID NO: 410110 - RNA, 22 nt, Human
ggcucugcccagguggacagca

SEQ ID NO: 410111 - RNA, 23 nt, Human
ugcuguccaacagacuggccaug

SEQ ID NO: 410112 - RNA, 22 nt, Human
auaugccauuagcuagaaauaa

SEQ ID NO: 410113 - RNA, 22 nt, Human
cagagccacugucugccaggca

SEQ ID NO: 410114 - RNA, 22 nt, Human
ggggauggugggaaggcaaucu

SEQ ID NO: 410115 - RNA, 22 nt, Human
gaagcagcuggugagauggagc

SEQ ID NO: 410116 - RNA, 22 nt, Human
ccugggcucuauccugacccag

SEQ ID NO: 410117 - RNA, 22 nt, Human
ccuggagcacagcccaguccca

SEQ ID NO: 410118 - RNA, 22 nt, Human
ucaucuucuauuaauagggaga

SEQ ID NO: 410119 - RNA, 22 nt, Human
ccugcagggaaucgaggcagaa

SEQ ID NO: 410120 - RNA, 22 nt, Human
gcagagcugucuaagucacuuc

SEQ ID NO: 410121 - RNA, 20 nt, Human
cuuugccuauucucugccug

SEQ ID NO: 410122 - RNA, 22 nt, Human
auacauguucguguacauguuc

SEQ ID NO: 410123 - RNA, 22 nt, Human
auguagcagaagauguuuuccu

SEQ ID NO: 410124 - RNA, 22 nt, Human
cauucauuagaauagauaugua

SEQ ID NO: 410125 - RNA, 22 nt, Human
caucauuucacuuagaugaagu

SEQ ID NO: 410126 - RNA, 22 nt, Human
gccaccagggggugcaaggucc

SEQ ID NO: 410127 - RNA, 22 nt, Human
caacaguguugcaaucugaaaa

SEQ ID NO: 410128 - RNA, 22 nt, Human
cuggcagguuuggugucuggug

SEQ ID NO: 410129 - RNA, 21 nt, Human
ucuuuccugcccaguugcccu

SEQ ID NO: 410130 - RNA, 22 nt, Human
ugccaggcccagcagggcggcc

SEQ ID NO: 410131 - RNA, 22 nt, Human
uacaguaucuucuggcaagcau

SEQ ID NO: 410132 - RNA, 22 nt, Human
aucagcaagacuaggggaauac

SEQ ID NO: 410133 - RNA, 22 nt, Human
agaccgagaaguucuccaggcc

SEQ ID NO: 410134 - RNA, 22 nt, Human
cugaggcucugggugucacugu

SEQ ID NO: 410135 - RNA, 22 nt, Human
agcuugaguuuuggaugaagug

SEQ ID NO: 410136 - RNA, 22 nt, Human
gcagcuuuguaaaguaugaagc

SEQ ID NO: 410137 - RNA, 22 nt, Human
aaaauuuugcccuauccuucau

SEQ ID NO: 410138 - RNA, 22 nt, Human
aaagagcuucauuuccauuuau

SEQ ID NO: 410139 - RNA, 21 nt, Human
acagugugcuucucucccucc

SEQ ID NO: 410140 - RNA, 22 nt, Human
agacaggcagaggcugcagagg

SEQ ID NO: 410141 - RNA, 22 nt, Human
uggaagggggaagacagcucug

SEQ ID NO: 410142 - RNA, 22 nt, Human
ggcucuggcaaggggaggcuac

SEQ ID NO: 410143 - RNA, 22 nt, Human
aggccucagugaucaucaucag

SEQ ID NO: 410144 - RNA, 22 nt, Human
gaggccugguuugcaugagaau

SEQ ID NO: 410145 - RNA, 22 nt, Human
cagggacccgcacagguagcau

SEQ ID NO: 410146 - RNA, 17 nt, Human
aagauuucauuagcuga

SEQ ID NO: 410147 - RNA, 22 nt, Human
aggccuggugaaugaaguaucu

SEQ ID NO: 410148 - RNA, 22 nt, Human
caguauuuucaggauuuggaag

SEQ ID NO: 410149 - RNA, 23 nt, Human
aguacauucgaaaaauucuguga

SEQ ID NO: 410150 - RNA, 22 nt, Human
aagauucuacaguagguacauu

SEQ ID NO: 410151 - RNA, 22 nt, Human
ggucagguuuuuaggagugacc

SEQ ID NO: 410152 - RNA, 22 nt, Human
aggcagugugggccaagcuucc

SEQ ID NO: 410153 - RNA, 22 nt, Human
cuggggugugcucagagcaggg

SEQ ID NO: 410154 - RNA, 22 nt, Human
ugcugcauuuaucuucucaaac

SEQ ID NO: 410155 - RNA, 22 nt, Human
ugagaauuacaaaugagucaca

SEQ ID NO: 410156 - RNA, 22 nt, Human
gagcccaggcagagguugcagu

SEQ ID NO: 410157 - RNA, 22 nt, Human
aggcucugguuggcaaguaaag

SEQ ID NO: 410158 - RNA, 21 nt, Human
guggcccugguguggcugcac

SEQ ID NO: 410159 - RNA, 22 nt, Human
cacaugggcguaauguccaugg

SEQ ID NO: 410160 - RNA, 22 nt, Human
ucauuguuauguuuugcugucu

SEQ ID NO: 410161 - RNA, 22 nt, Human
uucaggagaaaguucaguacuu

SEQ ID NO: 410162 - RNA, 22 nt, Human
uggacaggaucugagacugaga

SEQ ID NO: 410163 - RNA, 22 nt, Human
acagaggaaggcugagcugccc

SEQ ID NO: 410164 - RNA, 22 nt, Human
agcugagcacauucaaacaggu

SEQ ID NO: 410165 - RNA, 22 nt, Human
agggaggucuuugaggggcuua

SEQ ID NO: 410166 - RNA, 22 nt, Human
gccuggcuccuaagagcacaac

SEQ ID NO: 410167 - RNA, 20 nt, Human
uccaggagaacugggagccg

SEQ ID NO: 410168 - RNA, 22 nt, Human
cagggccugccugguuccugga

SEQ ID NO: 410169 - RNA, 22 nt, Human
agcagcugcagggagggucugc

SEQ ID NO: 410170 - RNA, 22 nt, Human
aacaggcaaacugugggauccc

SEQ ID NO: 410171 - RNA, 22 nt, Human
ugaaggaaugaguauacuguuu

SEQ ID NO: 410172 - RNA, 22 nt, Human
agugaguggacccugcaaggaa

SEQ ID NO: 410173 - RNA, 22 nt, Human
auuguacuuuuauuacauguag

SEQ ID NO: 410174 - RNA, 22 nt, Human
acugaaggucucagcaaggaug

SEQ ID NO: 410175 - RNA, 22 nt, Human
ggcugcugggaauaugccagcu

SEQ ID NO: 410176 - RNA, 17 nt, Human
ucaggcugggugcagug

SEQ ID NO: 410177 - RNA, 22 nt, Human
cauugcacuccacccuaggcaa

SEQ ID NO: 410178 - RNA, 22 nt, Human
aggcacugagaggcuguguugc

SEQ ID NO: 410179 - RNA, 22 nt, Human
agcagggcugcggccccaccac

SEQ ID NO: 410180 - RNA, 18 nt, Human
aagaggaggagcagguug

SEQ ID NO: 410181 - RNA, 22 nt, Human
gcuucccacagcuggacugggg

SEQ ID NO: 410182 - RNA, 19 nt, Human
acagggcagcaauaggaua

SEQ ID NO: 410183 - RNA, 22 nt, Human
aacaggagaguaaauauaugau

SEQ ID NO: 410184 - RNA, 22 nt, Human
gugcauguuaaugguguacaaa

SEQ ID NO: 410185 - RNA, 22 nt, Human
aggugcuuggcucgugcacaca

SEQ ID NO: 410186 - RNA, 22 nt, Human
ugcuccuuccucauccugugca

SEQ ID NO: 410187 - RNA, 22 nt, Human
caugcacuuaccugaaauucaa

SEQ ID NO: 410188 - RNA, 22 nt, Human
uuguuuuggaagaacuuacucu

SEQ ID NO: 410189 - RNA, 22 nt, Human
ugucccagggaaggcccagcac

SEQ ID NO: 410190 - RNA, 22 nt, Human
uggcucugagacacaggcucuc

SEQ ID NO: 410191 - RNA, 22 nt, Human
guauuagguuggugcaaaauug

SEQ ID NO: 410192 - RNA, 22 nt, Human
ugccugggggacuaaggccaaa

SEQ ID NO: 410193 - RNA, 20 nt, Human
ucucaggccccaguuuucuu

SEQ ID NO: 410194 - RNA, 22 nt, Human
uguuuuaaucucccauugcucu

SEQ ID NO: 410195 - RNA, 21 nt, Human
cugcucugacagugaggccag

SEQ ID NO: 410196 - RNA, 22 nt, Human
uggagccuguguuucugcccag

SEQ ID NO: 410197 - RNA, 22 nt, Human
uggcugagggcacuaugaagcc

SEQ ID NO: 410198 - RNA, 22 nt, Human
uagcccagagucccaauuccag

SEQ ID NO: 410199 - RNA, 22 nt, Human
gcucagaaaagugaggcucagu

SEQ ID NO: 410200 - RNA, 22 nt, Human
cagagcugugauaaauagauau

SEQ ID NO: 410201 - RNA, 22 nt, Human
uaaguucaaugaacucaguucu

SEQ ID NO: 410202 - RNA, 19 nt, Human
cagcucaguuugauucucu

SEQ ID NO: 410203 - RNA, 22 nt, Human
guuauguaucuugauugggugg

SEQ ID NO: 410204 - RNA, 22 nt, Human
ccuggcagcauugguagagauu

SEQ ID NO: 410205 - RNA, 22 nt, Human
uucaaugagcccggggccauag

SEQ ID NO: 410206 - RNA, 22 nt, Human
aggucaaggccaaaagaguggu

SEQ ID NO: 410207 - RNA, 22 nt, Human
uggccugggcaugaagcaucgu

SEQ ID NO: 410208 - RNA, 22 nt, Human
ucaucaaagucaaagaaugacu

SEQ ID NO: 410209 - RNA, 22 nt, Human
gaggcagugucgguggcaggau

SEQ ID NO: 410210 - RNA, 22 nt, Human
gcuggccuccugcuagauggaa

SEQ ID NO: 410211 - RNA, 22 nt, Human
gcugccacauuuucaggacuaa

SEQ ID NO: 410212 - RNA, 22 nt, Human
ucugaggcuucagacuguacug

SEQ ID NO: 410213 - RNA, 22 nt, Human
acugaguguaggacuuugaguu

SEQ ID NO: 410214 - RNA, 22 nt, Human
ucucagaggucuucagccucug

SEQ ID NO: 410215 - RNA, 22 nt, Human
aggggcuggcuuaucugagagu

SEQ ID NO: 410216 - RNA, 22 nt, Human
acaaaggcaggauugacuuagu

SEQ ID NO: 410217 - RNA, 22 nt, Human
ccugcagcuccggauuucuggg

SEQ ID NO: 410218 - RNA, 22 nt, Human
caggaugggugucggccagcac

SEQ ID NO: 410219 - RNA, 22 nt, Human
uguacacugcaggaugcauugc

SEQ ID NO: 410220 - RNA, 22 nt, Human
guccucugggagccuugagccu

SEQ ID NO: 410221 - RNA, 22 nt, Human
cugugcuggagaugggccagag

SEQ ID NO: 410222 - RNA, 22 nt, Human
aggagaaggaggccccucacac

SEQ ID NO: 410223 - RNA, 22 nt, Human
aggucaaguuuagauagaguua

SEQ ID NO: 410224 - RNA, 21 nt, Human
agggaaagaaaaugagcuaau

SEQ ID NO: 410225 - RNA, 22 nt, Human
ucauccagccucaucaggagcu

SEQ ID NO: 410226 - RNA, 22 nt, Human
ccuggcaggccccuccuggauu

SEQ ID NO: 410227 - RNA, 19 nt, Human
ccucccacggauuccuucc

SEQ ID NO: 410228 - RNA, 22 nt, Human
cugggcugucccaaccccaucc

SEQ ID NO: 410229 - RNA, 22 nt, Human
aggcacaggaaugucauccagu

SEQ ID NO: 410230 - RNA, 22 nt, Human
ugagaagcagcuuacagguguc

SEQ ID NO: 410231 - RNA, 21 nt, Human
acagauuuuauaucucugcug

SEQ ID NO: 410232 - RNA, 22 nt, Human
uuauuucauguaaaauuuaugu

SEQ ID NO: 410233 - RNA, 22 nt, Human
ugaauaugugacuuugauuuca

SEQ ID NO: 410234 - RNA, 22 nt, Human
ucuggcucauacaagccugcaa

SEQ ID NO: 410235 - RNA, 18 nt, Human
ccucaggggaccuggcag

SEQ ID NO: 410236 - RNA, 22 nt, Human
agaggccaggcugcagagggau

SEQ ID NO: 410237 - RNA, 22 nt, Human
cccugcagaccaaugccauaga

SEQ ID NO: 410238 - RNA, 22 nt, Human
ugaggaagccaaacagcuacac

SEQ ID NO: 410239 - RNA, 22 nt, Human
ggagccugggcauuaguaauuu

SEQ ID NO: 410240 - RNA, 22 nt, Human
aauuucuccaagaaugcuuaga

SEQ ID NO: 410241 - RNA, 22 nt, Human
uuuauccagaaucaggauuuuu

SEQ ID NO: 410242 - RNA, 22 nt, Human
acagggccucagcugauucugg

SEQ ID NO: 410243 - RNA, 22 nt, Human
ugaaacaaaaguauguagcuug

SEQ ID NO: 410244 - RNA, 22 nt, Human
ugccugcucuuaccacucuccc

SEQ ID NO: 410245 - RNA, 18 nt, Human
gcagcugcaguuguagcu

SEQ ID NO: 410246 - RNA, 22 nt, Human
acagcuguggccacuugcaucc

SEQ ID NO: 410247 - RNA, 22 nt, Human
ugcaggaauagcuacagagcug

SEQ ID NO: 410248 - RNA, 20 nt, Human
ucucugagcuucucuugggg

SEQ ID NO: 410249 - RNA, 22 nt, Human
ccacagccauuccagggaggcu

SEQ ID NO: 410250 - RNA, 22 nt, Human
ggcugagccaugggcacugcag

SEQ ID NO: 410251 - RNA, 22 nt, Human
agcugcccuucucuugcccuug

SEQ ID NO: 410252 - RNA, 22 nt, Human
agggaaagguagugaggucaca

SEQ ID NO: 410253 - RNA, 22 nt, Human
aaagggagcauggcugcaggga

SEQ ID NO: 410254 - RNA, 22 nt, Human
gagucugagucuaauggcccca

SEQ ID NO: 410255 - RNA, 22 nt, Human
acucucucacagcuuggcugau

SEQ ID NO: 410256 - RNA, 20 nt, Human
ucauuacagugcuaagaugu

SEQ ID NO: 410257 - RNA, 22 nt, Human
ugcuuuauggauuuguguccug

SEQ ID NO: 410258 - RNA, 22 nt, Human
aucaggaucacugggagucuug

SEQ ID NO: 410259 - RNA, 22 nt, Human
auagaacagaaacagaugcaca

SEQ ID NO: 410260 - RNA, 23 nt, Human
cagggcugguagggaagagcgug

SEQ ID NO: 410261 - RNA, 22 nt, Human
gaaggccauugcguccugggau

SEQ ID NO: 410262 - RNA, 22 nt, Human
agugauuugggugucagaaagu

SEQ ID NO: 410263 - RNA, 22 nt, Human
auaaauggcuuucauuccuagg

SEQ ID NO: 410264 - RNA, 22 nt, Human
gccuggcaggccucaugagggg

SEQ ID NO: 410265 - RNA, 22 nt, Human
acuucuggugucauacugcauu

SEQ ID NO: 410266 - RNA, 20 nt, Human
aaaaacaguaaugcugaaga

SEQ ID NO: 410267 - RNA, 22 nt, Human
ccagguggaggugugagguccu

SEQ ID NO: 410268 - RNA, 22 nt, Human
gacaggcuuccuaagugccaga

SEQ ID NO: 410269 - RNA, 22 nt, Human
ucuauuuuauacucaaaucuuc

SEQ ID NO: 410270 - RNA, 22 nt, Human
ggcugcagaaguacuuccggau

SEQ ID NO: 410271 - RNA, 22 nt, Human
ucacagacauggugagguaaca

SEQ ID NO: 410272 - RNA, 22 nt, Human
ccagaagaggacacagugugga

SEQ ID NO: 410273 - RNA, 22 nt, Human
cucaggaggugguagaggcccu

SEQ ID NO: 410274 - RNA, 22 nt, Human
uaacagcuggcguuauaggaau

SEQ ID NO: 410275 - RNA, 22 nt, Human
cuggcucagacagcugugcagu

SEQ ID NO: 410276 - RNA, 22 nt, Human
ggcacugacacuagcauggcac

SEQ ID NO: 410277 - RNA, 22 nt, Human
ugcugccagccaggccauggag

SEQ ID NO: 410278 - RNA, 22 nt, Human
gagagcugcaagguagggcggg

SEQ ID NO: 410279 - RNA, 19 nt, Human
ccagcagacacagcugccc

SEQ ID NO: 410280 - RNA, 22 nt, Human
agagccugcuguguaagucaca

SEQ ID NO: 410281 - RNA, 22 nt, Human
uuugaaagaaaccagugaguga

SEQ ID NO: 410282 - RNA, 22 nt, Human
aaguucaaguguaaucuuuauu

SEQ ID NO: 410283 - RNA, 22 nt, Human
agaugcugugaggaagcuagga

SEQ ID NO: 410284 - RNA, 22 nt, Human
cagcuccugcagcugcugccgu

SEQ ID NO: 410285 - RNA, 22 nt, Human
gcagggccuuagcagcggcugc

SEQ ID NO: 410286 - RNA, 22 nt, Human
uguccuuuaugaaaugguguuu

SEQ ID NO: 410287 - RNA, 22 nt, Human
gugaggcagagaugccaaaacu

SEQ ID NO: 410288 - RNA, 22 nt, Human
acauuucugucuuagggacugu

SEQ ID NO: 410289 - RNA, 22 nt, Human
agcuguguagggaaucagagaa

SEQ ID NO: 410290 - RNA, 22 nt, Human
augggcagacagggagcucacg

SEQ ID NO: 410291 - RNA, 22 nt, Human
ucucaggccccugaguuucucu

SEQ ID NO: 410292 - RNA, 22 nt, Human
uuugaaagacagaauauuuuug

SEQ ID NO: 410293 - RNA, 22 nt, Human
ucagaagccggaagugcuccuc

SEQ ID NO: 410294 - RNA, 22 nt, Human
aucaguuuaacugucaagagcc

SEQ ID NO: 410295 - RNA, 21 nt, Human
gugguuauuuucauuagcauc

SEQ ID NO: 410296 - RNA, 22 nt, Human
gcagggcuauuggaaggagaug

SEQ ID NO: 410297 - RNA, 22 nt, Human
aagcagaauuucccacuaguug

SEQ ID NO: 410298 - RNA, 21 nt, Human
agcagaggggacauguuugau

SEQ ID NO: 410299 - RNA, 22 nt, Human
agacucugugcuccuugcuuuc

SEQ ID NO: 410300 - RNA, 18 nt, Human
ggccugaggauuucagca

SEQ ID NO: 410301 - RNA, 22 nt, Human
auacaaguugugauaauguaaa

SEQ ID NO: 410302 - RNA, 22 nt, Human
cagcugccaugacauguccugc

SEQ ID NO: 410303 - RNA, 22 nt, Human
uccagcuggggcaguggcuggg

SEQ ID NO: 410304 - RNA, 22 nt, Human
aaagcagcagcacguggaagag

SEQ ID NO: 410305 - RNA, 22 nt, Human
gagcucuguguagccugagggu

SEQ ID NO: 410306 - RNA, 22 nt, Human
cuggcucagugccuucagaagu

SEQ ID NO: 410307 - RNA, 22 nt, Human
cagggccacacggaagggaaca

SEQ ID NO: 410308 - RNA, 22 nt, Human
gcugucaguuuuacccacagac

SEQ ID NO: 410309 - RNA, 22 nt, Human
uagcagcugugaguaaaagcca

SEQ ID NO: 410310 - RNA, 22 nt, Human
ccucucccacguggcagaggcu

SEQ ID NO: 410311 - RNA, 22 nt, Human
ggugccaggcucccagcucagg

SEQ ID NO: 410312 - RNA, 22 nt, Human
ccucuuccacugggccccaucc

SEQ ID NO: 410313 - RNA, 22 nt, Human
ucugcaucauuuuucagagccg

SEQ ID NO: 410314 - RNA, 22 nt, Human
gagagugagauccuccugggga

SEQ ID NO: 410315 - RNA, 22 nt, Human
guuccauaucacagcagacgaa

SEQ ID NO: 410316 - RNA, 22 nt, Human
ucucaggaucuaauacauggua

SEQ ID NO: 410317 - RNA, 22 nt, Human
cugagagaaucaugcugcaggu

SEQ ID NO: 410318 - RNA, 22 nt, Human
ucaagagauugaauaauaacug

SEQ ID NO: 410319 - RNA, 22 nt, Human
gcucugggauuaccagccuuag

SEQ ID NO: 410320 - RNA, 19 nt, Human
aggccugggguuuugcacu

SEQ ID NO: 410321 - RNA, 22 nt, Human
cugagagucagcuucuccuccu

SEQ ID NO: 410322 - RNA, 22 nt, Human
ucagagaggauuuuaauaagug

SEQ ID NO: 410323 - RNA, 22 nt, Human
acuguccauaauauuggugaac

SEQ ID NO: 410324 - RNA, 22 nt, Human
agauggaguuaguaccagaguc

SEQ ID NO: 410325 - RNA, 22 nt, Human
uucuggaguauuccuggcaccu

SEQ ID NO: 410326 - RNA, 23 nt, Human
acagcugcaccuggccgccuggc

SEQ ID NO: 410327 - RNA, 22 nt, Human
uggcugcugagaaggcagcugu

SEQ ID NO: 410328 - RNA, 22 nt, Human
ccagcuuuauagcuucaaagga

SEQ ID NO: 410329 - RNA, 21 nt, Human
ucagaguggaagacaguuuga

SEQ ID NO: 410330 - RNA, 22 nt, Human
aaaauccugcugacucgagaug

SEQ ID NO: 410331 - RNA, 22 nt, Human
ucacugcucucuaagcaucgcc

SEQ ID NO: 410332 - RNA, 22 nt, Human
uggcagagugcggcauccccug

SEQ ID NO: 410333 - RNA, 22 nt, Human
agccaggcuacuccuugcugac

SEQ ID NO: 410334 - RNA, 18 nt, Human
uccugccugugccccagg

SEQ ID NO: 410335 - RNA, 22 nt, Human
uguccucagauaugucuacucu

SEQ ID NO: 410336 - RNA, 22 nt, Human
cacaggagguuaggaagugguc

SEQ ID NO: 410337 - RNA, 22 nt, Human
agacuucuuugugagcauuuuc

SEQ ID NO: 410338 - RNA, 22 nt, Human
cucugggcacauuuuccaggac

SEQ ID NO: 410339 - RNA, 22 nt, Human
uauguacaucguugaauucaaa

SEQ ID NO: 410340 - RNA, 22 nt, Human
gccucugcacuguggcacacca

SEQ ID NO: 410341 - RNA, 22 nt, Human
ccuccagcgcgauccacuccgg

SEQ ID NO: 410342 - RNA, 23 nt, Human
agaauuguaaauagaauauaccu

SEQ ID NO: 410343 - RNA, 22 nt, Human
ggaugcuggggaccaaucucug

SEQ ID NO: 410344 - RNA, 22 nt, Human
cccuggaggcggagcuugcagu

SEQ ID NO: 410345 - RNA, 22 nt, Human
cuguccuccggccaccuacagu

SEQ ID NO: 410346 - RNA, 22 nt, Human
gcccagcacagcuggaagaguc

SEQ ID NO: 410347 - RNA, 22 nt, Human
auuuccaccggcucaggaaguu

SEQ ID NO: 410348 - RNA, 22 nt, Human
uacuuuggauccuuacaauagc

SEQ ID NO: 410349 - RNA, 22 nt, Human
acucucagaggguggcagcaau

SEQ ID NO: 410350 - RNA, 22 nt, Human
agaagccacaggccucgucugg

SEQ ID NO: 410351 - RNA, 22 nt, Human
uuccagcuaacucacaucccuu

SEQ ID NO: 410352 - RNA, 17 nt, Human
cgagggcuugcuggcuc

SEQ ID NO: 410353 - RNA, 22 nt, Human
uucucucauucaaauuaaagug

SEQ ID NO: 410354 - RNA, 22 nt, Human
agaagcuugaaggagcagugac

SEQ ID NO: 410355 - RNA, 22 nt, Human
ucuuugcaucccuuccauaguu

SEQ ID NO: 410356 - RNA, 22 nt, Human
gugguaauuuaauccuacacug

SEQ ID NO: 410357 - RNA, 22 nt, Human
uggcagagacaaggccgggccu

SEQ ID NO: 410358 - RNA, 22 nt, Human
caggucccgccccgggcugacc

SEQ ID NO: 410359 - RNA, 22 nt, Human
ucauuucuaucuaugcagcuuc

SEQ ID NO: 410360 - RNA, 22 nt, Human
uuguuacacauaauaacauuuu

SEQ ID NO: 410361 - RNA, 22 nt, Human
agcagggcuggauuuggcaaga

SEQ ID NO: 410362 - RNA, 22 nt, Human
acacauaagccuaaucaucucc

SEQ ID NO: 410363 - RNA, 22 nt, Human
aggucauuccagccauuccccu

SEQ ID NO: 410364 - RNA, 22 nt, Human
cagaguacugggagaacagaag

SEQ ID NO: 410365 - RNA, 22 nt, Human
agcugccacauggugucacugu

SEQ ID NO: 410366 - RNA, 22 nt, Human
cacuuagucucaccaguucagu

SEQ ID NO: 410367 - RNA, 22 nt, Human
cuggagcucuccagagccccgu

SEQ ID NO: 410368 - RNA, 22 nt, Human
agaauuagguaaguucaucuga

SEQ ID NO: 410369 - RNA, 22 nt, Human
agcagaacugaugagacuugag

SEQ ID NO: 410370 - RNA, 22 nt, Human
gugccugggcaugagcuuguug

SEQ ID NO: 410371 - RNA, 22 nt, Human
ugcagggaauccagucuagggu

SEQ ID NO: 410372 - RNA, 22 nt, Human
uuguaaaugaccuuuucuaauu

SEQ ID NO: 410373 - RNA, 22 nt, Human
ugcagaagacacaagguaacgu

SEQ ID NO: 410374 - RNA, 22 nt, Human
aaggcccuggcaggaagcagga

SEQ ID NO: 410375 - RNA, 18 nt, Human
ugugguggagcugccuuc

SEQ ID NO: 410376 - RNA, 22 nt, Human
ccuucagaccuagacaggaauc

SEQ ID NO: 410377 - RNA, 22 nt, Human
aggggccugguuggccucuguu

SEQ ID NO: 410378 - RNA, 22 nt, Human
gcugcucucagagcucaugcug

SEQ ID NO: 410379 - RNA, 22 nt, Human
cagcuauuuucucauuaaggau

SEQ ID NO: 410380 - RNA, 22 nt, Human
aguauuuccuggcuuaucugcu

SEQ ID NO: 410381 - RNA, 22 nt, Human
uagcagaaccagcagucaauuu

SEQ ID NO: 410382 - RNA, 22 nt, Human
gcuguacaguuuacuagguggg

SEQ ID NO: 410383 - RNA, 20 nt, Human
gaggaaaagcugccaggccu

SEQ ID NO: 410384 - RNA, 22 nt, Human
uaugcacgucuauuuaugaaga

SEQ ID NO: 410385 - RNA, 22 nt, Human
aacugcauuugcauaaguccau

SEQ ID NO: 410386 - RNA, 22 nt, Human
gaguaagagcuggcuuuggugu

SEQ ID NO: 410387 - RNA, 22 nt, Human
acccagagccagggucaggagc

SEQ ID NO: 410388 - RNA, 22 nt, Human
ugcugucccccgugucugggcu

SEQ ID NO: 410389 - RNA, 22 nt, Human
ugcguugcgcuccugcagcagg

SEQ ID NO: 410390 - RNA, 22 nt, Human
caguacuuguccucagguguua

SEQ ID NO: 410391 - RNA, 22 nt, Human
cgcagcagccccgugguaggug

SEQ ID NO: 410392 - RNA, 22 nt, Human
uuaagucauuucugauuauaga

SEQ ID NO: 410393 - RNA, 22 nt, Human
gcugccuuuuaaagccucgcuu

SEQ ID NO: 410394 - RNA, 22 nt, Human
ucagggacagggugcugcugcg

SEQ ID NO: 410395 - RNA, 22 nt, Human
ugaugggacugccagcugcuga

SEQ ID NO: 410396 - RNA, 22 nt, Human
agacagagauacuauguuguca

SEQ ID NO: 410397 - RNA, 21 nt, Human
uccucugcagugagguggccu

SEQ ID NO: 410398 - RNA, 22 nt, Human
cugcccagaaucacucacucga

SEQ ID NO: 410399 - RNA, 23 nt, Human
acaugggagggacauggaggcug

SEQ ID NO: 410400 - RNA, 23 nt, Human
agugcugaauugaaagcuccagg

SEQ ID NO: 410401 - RNA, 22 nt, Human
uuuccucugcugccauugcccc

SEQ ID NO: 410402 - RNA, 20 nt, Human
uugcagcagugaggugaagg

SEQ ID NO: 410403 - RNA, 22 nt, Human
uuaaacauuuauggaggcagca

SEQ ID NO: 410404 - RNA, 22 nt, Human
gggugggguguaucggauccua

SEQ ID NO: 410405 - RNA, 22 nt, Human
ugagccuggccugcagagacca

SEQ ID NO: 410406 - RNA, 22 nt, Human
ggagcagccgcgucucagggca

SEQ ID NO: 410407 - RNA, 17 nt, Human
guccugggaggagagag

SEQ ID NO: 410408 - RNA, 22 nt, Human
ugcauuauaacugaauguuguu

SEQ ID NO: 410409 - RNA, 22 nt, Human
aaagucaaugauuucuccugga

SEQ ID NO: 410410 - RNA, 22 nt, Human
uggucaacaggcagggaugaaa

SEQ ID NO: 410411 - RNA, 22 nt, Human
cacugaaggcuaggauuagaug

SEQ ID NO: 410412 - RNA, 22 nt, Human
uggggcuggcacagucucuauu

SEQ ID NO: 410413 - RNA, 18 nt, Human
aucucccauuggccaagg

SEQ ID NO: 410414 - RNA, 22 nt, Human
auucaaguucuucugucuuugc

SEQ ID NO: 410415 - RNA, 22 nt, Human
cacuggggugggccugguagag

SEQ ID NO: 410416 - RNA, 22 nt, Human
gcuggcaccugcaccaagcagg

SEQ ID NO: 410417 - RNA, 22 nt, Human
cugccugcaugcugccauagcu

SEQ ID NO: 410418 - RNA, 22 nt, Human
ugaagcagcaaaugaugggaga

SEQ ID NO: 410419 - RNA, 19 nt, Human
gagaggccugugcuugaag

SEQ ID NO: 410420 - RNA, 22 nt, Human
ggccuuggugcucuguguugca

SEQ ID NO: 410421 - RNA, 22 nt, Human
caguugcuacaguucaagugug

SEQ ID NO: 410422 - RNA, 22 nt, Human
gccuggcacauugcaguggauu

SEQ ID NO: 410423 - RNA, 22 nt, Human
cugaaggaagcagaagcgaggu

SEQ ID NO: 410424 - RNA, 19 nt, Human
ugagacagggauucaggug

SEQ ID NO: 410425 - RNA, 22 nt, Human
uagcagcucacagccucccauu

SEQ ID NO: 410426 - RNA, 22 nt, Human
gcagggcaguaagagcuagagu

SEQ ID NO: 410427 - RNA, 22 nt, Human
ugucagcagcugguuugcuguu

SEQ ID NO: 410428 - RNA, 22 nt, Human
gaaaucugaacaacagcuguca

SEQ ID NO: 410429 - RNA, 22 nt, Human
aacaugaaaguugcuaagugca

SEQ ID NO: 410430 - RNA, 22 nt, Human
ccaggauggggagcagauagaa

SEQ ID NO: 410431 - RNA, 22 nt, Human
uggcagagaauaaaucuugacu

SEQ ID NO: 410432 - RNA, 22 nt, Human
gaggcucagagaagucauggua

SEQ ID NO: 410433 - RNA, 22 nt, Human
uagaggugacacugagaccaua

SEQ ID NO: 410434 - RNA, 22 nt, Human
guuacaaaggacugggggccac

SEQ ID NO: 410435 - RNA, 22 nt, Human
uuucuguuaggcaucauuuuaa

SEQ ID NO: 410436 - RNA, 22 nt, Human
cacacaggagagugcuggaggu

SEQ ID NO: 410437 - RNA, 22 nt, Human
ucaggaugguguggaggaaaua

SEQ ID NO: 410438 - RNA, 22 nt, Human
ggcugcugguggaaugguaggc

SEQ ID NO: 410439 - RNA, 19 nt, Human
ccugugugggguagagauc

SEQ ID NO: 410440 - RNA, 22 nt, Human
guuugcauuucuugaacuauau

SEQ ID NO: 410441 - RNA, 22 nt, Human
gccccugggagcagagccacca

SEQ ID NO: 410442 - RNA, 22 nt, Human
ucaucacuguaucauugauaga

SEQ ID NO: 410443 - RNA, 22 nt, Human
agucccagugagaugagccacg

SEQ ID NO: 410444 - RNA, 22 nt, Human
aggugcagaaaaaaguccuuua

SEQ ID NO: 410445 - RNA, 22 nt, Human
uuccucaugggguuccuucaga

SEQ ID NO: 410446 - RNA, 22 nt, Human
ugggaccaagucauuucuuuag

SEQ ID NO: 410447 - RNA, 22 nt, Human
cacagcauaaugaaauauacuu

SEQ ID NO: 410448 - RNA, 22 nt, Human
ggcagcaguccauggcccaagg

SEQ ID NO: 410449 - RNA, 18 nt, Human
cccagccucuccuuucua

SEQ ID NO: 410450 - RNA, 22 nt, Human
gcagcugccccgacugugaguc

SEQ ID NO: 410451 - RNA, 22 nt, Human
aagaugauguuguguuuucacu

SEQ ID NO: 410452 - RNA, 22 nt, Human
cuguauuuucaugccuacguac

SEQ ID NO: 410453 - RNA, 22 nt, Human
ugaaaguuacaggaaaacagau

SEQ ID NO: 410454 - RNA, 22 nt, Human
ggcaggcaggagcgugcuuggg

SEQ ID NO: 410455 - RNA, 22 nt, Human
cugaaggagguagagugacaua

SEQ ID NO: 410456 - RNA, 22 nt, Human
cagaguguggcaucuuccaacu

SEQ ID NO: 410457 - RNA, 22 nt, Human
aaggaagggaaauagugauguc

SEQ ID NO: 410458 - RNA, 22 nt, Human
ccucuucugagugagacucccu

SEQ ID NO: 410459 - RNA, 22 nt, Human
cacaggaaugaacagggaaaga

SEQ ID NO: 410460 - RNA, 22 nt, Human
ggcucccacccauagggcgagu

SEQ ID NO: 410461 - RNA, 22 nt, Human
uuaacagagaacauagaaguag

SEQ ID NO: 410462 - RNA, 22 nt, Human
cauuucuauggcaaugggaaaa

SEQ ID NO: 410463 - RNA, 22 nt, Human
agcugccaaguuggaguagcaa

SEQ ID NO: 410464 - RNA, 22 nt, Human
ggccaccuuccaguugccugca

SEQ ID NO: 410465 - RNA, 22 nt, Human
uuucauaaugucacagucaaaa

SEQ ID NO: 410466 - RNA, 22 nt, Human
uagagcauuuagaggggcagga

SEQ ID NO: 410467 - RNA, 22 nt, Human
ugucccagguccuagaugacca

SEQ ID NO: 410468 - RNA, 22 nt, Human
uugaucagguugcuguggugua

SEQ ID NO: 410469 - RNA, 22 nt, Human
gugcucuccuggcugcccugac

SEQ ID NO: 410470 - RNA, 22 nt, Human
cccuggagggacagcugcucua

SEQ ID NO: 410471 - RNA, 22 nt, Human
ccugggugaaaucucuccugca

SEQ ID NO: 410472 - RNA, 21 nt, Human
aaggcagaagcauggaaugag

SEQ ID NO: 410473 - RNA, 22 nt, Human
acugaaggguaaugugggagcc

SEQ ID NO: 410474 - RNA, 22 nt, Human
uuacaaagaguguucuuuucca

SEQ ID NO: 410475 - RNA, 22 nt, Human
cagcagcccacgcgugcugucc

SEQ ID NO: 410476 - RNA, 22 nt, Human
cugcuuugaggggcucuguaua

SEQ ID NO: 410477 - RNA, 22 nt, Human
uuuguuaaauauuuauugagug

SEQ ID NO: 410478 - RNA, 22 nt, Human
ccuggaugauccaugucaugga

SEQ ID NO: 410479 - RNA, 22 nt, Human
ggaaagagcuaaaagggugaga

SEQ ID NO: 410480 - RNA, 22 nt, Human
ucagcuuugcaaguuagaaaau

SEQ ID NO: 410481 - RNA, 22 nt, Human
agcagcucugagaggccagcac

SEQ ID NO: 410482 - RNA, 22 nt, Human
gggcucuggauggagccugcag

SEQ ID NO: 410483 - RNA, 22 nt, Human
agaccagcugccucccagggcc

SEQ ID NO: 410484 - RNA, 22 nt, Human
uucacauuaucaggauuguuuc

SEQ ID NO: 410485 - RNA, 22 nt, Human
auccuucagcugcccuguuacc

SEQ ID NO: 410486 - RNA, 22 nt, Human
aaaguguugauaugugacaucc

SEQ ID NO: 410487 - RNA, 22 nt, Human
caguguggugagauuccaggug

SEQ ID NO: 410488 - RNA, 20 nt, Human
aaaguguaagcauauaauua

SEQ ID NO: 410489 - RNA, 19 nt, Human
agauggggaagagugugag

SEQ ID NO: 410490 - RNA, 22 nt, Human
guaaaguucuauuugaauuuag

SEQ ID NO: 410491 - RNA, 22 nt, Human
ugaaagaacuagcaucuucaag

SEQ ID NO: 410492 - RNA, 22 nt, Human
gacaggguacgggcuaggcaca

SEQ ID NO: 410493 - RNA, 22 nt, Human
caacagaagguguacuacugaa

SEQ ID NO: 410494 - RNA, 22 nt, Human
cuguuuaucccuuuggucagca

SEQ ID NO: 410495 - RNA, 22 nt, Human
acaaagaucuugcuuuccuacu

SEQ ID NO: 410496 - RNA, 22 nt, Human
ugacagaaugugacucucagau

SEQ ID NO: 410497 - RNA, 22 nt, Human
uggaggaaucagggcuuaggcu

SEQ ID NO: 410498 - RNA, 22 nt, Human
ccuguacuagggucucauugcc

SEQ ID NO: 410499 - RNA, 20 nt, Human
cugggcagguguuugaucuc

SEQ ID NO: 410500 - RNA, 22 nt, Human
gguggcaggcccugagcauccc

SEQ ID NO: 410501 - RNA, 20 nt, Human
caggccucugggggcccugg

SEQ ID NO: 410502 - RNA, 22 nt, Human
guuugcauuuauuagucuucug

SEQ ID NO: 410503 - RNA, 22 nt, Human
agucccagccuguaggauuggg

SEQ ID NO: 410504 - RNA, 20 nt, Human
gggaguggugguagccugug

SEQ ID NO: 410505 - RNA, 22 nt, Human
uaaggcaccuguccaggcuggg

SEQ ID NO: 410506 - RNA, 19 nt, Human
ggagccuggagcacgugcc

SEQ ID NO: 410507 - RNA, 17 nt, Human
ccucacagggaccagac

SEQ ID NO: 410508 - RNA, 22 nt, Human
gggcacagagggucuugaagaa

SEQ ID NO: 410509 - RNA, 22 nt, Human
ccugagacaugaaccaggcucc

SEQ ID NO: 410510 - RNA, 22 nt, Human
cugcuuuguggaaucacacugg

SEQ ID NO: 410511 - RNA, 22 nt, Human
gcauuuaaauuugaacuucaga

SEQ ID NO: 410512 - RNA, 22 nt, Human
acagaaagaagguguauuugag

SEQ ID NO: 410513 - RNA, 22 nt, Human
gcagagacuccacugucuugug

SEQ ID NO: 410514 - RNA, 22 nt, Human
agcaggaaggcuuuggggguuc

SEQ ID NO: 410515 - RNA, 22 nt, Human
agaggaggcagcuuaacucagu

SEQ ID NO: 410516 - RNA, 22 nt, Human
uguguacagcaggauuucucaa

SEQ ID NO: 410517 - RNA, 22 nt, Human
cugaaggauuagagagcacuua

SEQ ID NO: 410518 - RNA, 22 nt, Human
gcacccagcccagggcgugaug

SEQ ID NO: 410519 - RNA, 22 nt, Human
cagggcccauggcucagguagg

SEQ ID NO: 410520 - RNA, 22 nt, Human
cucccaggggaacuaucaagua

SEQ ID NO: 410521 - RNA, 22 nt, Human
ucugggcucuuaguguacccuc

SEQ ID NO: 410522 - RNA, 22 nt, Human
agagccugcagcugugaagaaa

SEQ ID NO: 410523 - RNA, 22 nt, Human
aaaucaguuguuauauuaaaga

SEQ ID NO: 410524 - RNA, 21 nt, Human
cagggcacacagaggauggua

SEQ ID NO: 410525 - RNA, 20 nt, Human
uguugauuggugucaucuca

SEQ ID NO: 410526 - RNA, 22 nt, Human
ugggcugaguguggaacuaguu

SEQ ID NO: 410527 - RNA, 22 nt, Human
cuuuggcaugguccucacuaua

SEQ ID NO: 410528 - RNA, 18 nt, Human
uagggcucuagggaguga

SEQ ID NO: 410529 - RNA, 22 nt, Human
uaaauguggagacucaggaguc

SEQ ID NO: 410530 - RNA, 22 nt, Human
ggccugaggccaccagcagccc

SEQ ID NO: 410531 - RNA, 22 nt, Human
aaauauguauggaguucaugaa

SEQ ID NO: 410532 - RNA, 22 nt, Human
uguauuuucuucuggaagcuua

SEQ ID NO: 410533 - RNA, 22 nt, Human
cugggcuggagugcaauggcgc

SEQ ID NO: 410534 - RNA, 22 nt, Human
aaggcugugucagaagcucccu

SEQ ID NO: 410535 - RNA, 22 nt, Human
cagaguaaggagcugucaaacg

SEQ ID NO: 410536 - RNA, 22 nt, Human
uccaucagauucccuccugaga

SEQ ID NO: 410537 - RNA, 22 nt, Human
uggagcaggcaucuuucucucu

SEQ ID NO: 410538 - RNA, 23 nt, Human
uggccuggagagaaaagaugagu

SEQ ID NO: 410539 - RNA, 22 nt, Human
gugcagugacccuggagagcug

SEQ ID NO: 410540 - RNA, 22 nt, Human
caacauauaauauuugaguucu

SEQ ID NO: 410541 - RNA, 22 nt, Human
agggcagcuggaagguggcuuc

SEQ ID NO: 410542 - RNA, 21 nt, Human
agaaaaaccagcauguuuuca

SEQ ID NO: 410543 - RNA, 22 nt, Human
uggcccugaggacccagugugg

SEQ ID NO: 410544 - RNA, 22 nt, Human
gaggacagcuuagggcuuccug

SEQ ID NO: 410545 - RNA, 22 nt, Human
uucacaggugacuggggauaac

SEQ ID NO: 410546 - RNA, 22 nt, Human
agcugggaugauaaccucaguc

SEQ ID NO: 410547 - RNA, 22 nt, Human
gucacacuagggccaaguggag

SEQ ID NO: 410548 - RNA, 22 nt, Human
gggagccagcagggcauggagc

SEQ ID NO: 410549 - RNA, 22 nt, Human
uauguguuugacacccugcaag

SEQ ID NO: 410550 - RNA, 22 nt, Human
aggcacugacaauucuggacug

SEQ ID NO: 410551 - RNA, 22 nt, Human
uggccugguccuugucaaggca

SEQ ID NO: 410552 - RNA, 21 nt, Human
uggaaagauucaaagaccagg

SEQ ID NO: 410553 - RNA, 22 nt, Human
uaucugcaucugcauguguauu

SEQ ID NO: 410554 - RNA, 22 nt, Human
gggaccugcgccacucacuguc

SEQ ID NO: 410555 - RNA, 22 nt, Human
uuuuucaucugauugauaacuc

SEQ ID NO: 410556 - RNA, 22 nt, Human
aaugcacacauuugguacugaa

SEQ ID NO: 410557 - RNA, 22 nt, Human
uccauuuuagagaugaagaaac

SEQ ID NO: 410558 - RNA, 22 nt, Human
caguggcuguuucuggaaggca

SEQ ID NO: 410559 - RNA, 22 nt, Human
ccaggagccugggccaggcugg

SEQ ID NO: 410560 - RNA, 22 nt, Human
cacugcagaucagaggcugaga

SEQ ID NO: 410561 - RNA, 22 nt, Human
cccucccaggaguggccagaga

SEQ ID NO: 410562 - RNA, 22 nt, Human
augacagaggagugcaggugau

SEQ ID NO: 410563 - RNA, 17 nt, Human
aauagcugcucagagag

SEQ ID NO: 410564 - RNA, 22 nt, Human
uguguacuugaaagggcagguc

SEQ ID NO: 410565 - RNA, 22 nt, Human
agcugguucagaaauuagaugg

SEQ ID NO: 410566 - RNA, 22 nt, Human
accaggcaaaaccacaggagca

SEQ ID NO: 410567 - RNA, 21 nt, Human
gagacagacuuucguccccug

SEQ ID NO: 410568 - RNA, 22 nt, Human
ugaagacagaccaaggagaaug

SEQ ID NO: 410569 - RNA, 21 nt, Human
aggcagaaagagcccaggcug

SEQ ID NO: 410570 - RNA, 22 nt, Human
ggggcggggcucugagaagcau

SEQ ID NO: 410571 - RNA, 22 nt, Human
ugauugacuuuagaauagcacu

SEQ ID NO: 410572 - RNA, 23 nt, Human
ggccuguguuuugucugaaguac

SEQ ID NO: 410573 - RNA, 22 nt, Human
uccugggccuguacuccauccg

SEQ ID NO: 410574 - RNA, 22 nt, Human
auuuucaugacuaccuuaaaua

SEQ ID NO: 410575 - RNA, 22 nt, Human
cccaggccagaacuugguugcu

SEQ ID NO: 410576 - RNA, 18 nt, Human
cuuuaugugcagagcuuu

SEQ ID NO: 410577 - RNA, 19 nt, Human
gcgaggaagucacuguggc

SEQ ID NO: 410578 - RNA, 22 nt, Human
guuauguaugagggaaugauua

SEQ ID NO: 410579 - RNA, 22 nt, Human
cugcaggggccucgagcacagg

SEQ ID NO: 410580 - RNA, 22 nt, Human
aggcacuggucuaccccuuagu

SEQ ID NO: 410581 - RNA, 22 nt, Human
uacaaagucccauugccaugga

SEQ ID NO: 410582 - RNA, 22 nt, Human
ugugacaugugucaucuuuucu

SEQ ID NO: 410583 - RNA, 22 nt, Human
agggcagaggcggacacggaag

SEQ ID NO: 410584 - RNA, 22 nt, Human
gcuggccauagaagccaaagag

SEQ ID NO: 410585 - RNA, 22 nt, Human
gcagguguggaguggggugagc

SEQ ID NO: 410586 - RNA, 18 nt, Human
ugcuuuaugcuuauauaa

SEQ ID NO: 410587 - RNA, 22 nt, Human
cuuagaaauuguuacucauuca

SEQ ID NO: 410588 - RNA, 22 nt, Human
gucugagaaucuugcauaucau

SEQ ID NO: 410589 - RNA, 22 nt, Human
uugcagcugcaguaaauguuca

SEQ ID NO: 410590 - RNA, 22 nt, Human
agcucucaagauaagaaagaac

SEQ ID NO: 410591 - RNA, 22 nt, Human
aagcacuuagaagagugccugc

SEQ ID NO: 410592 - RNA, 22 nt, Human
uauuaggguaaauuugacaugc

SEQ ID NO: 410593 - RNA, 22 nt, Human
cccaggacucuucacugcagcc

SEQ ID NO: 410594 - RNA, 22 nt, Human
uggcucagcagguuagaaacua

SEQ ID NO: 410595 - RNA, 23 nt, Human
uugcauguagcccaugaguaacu

SEQ ID NO: 410596 - RNA, 22 nt, Human
ucauccaguaugacuggugucu

SEQ ID NO: 410597 - RNA, 20 nt, Human
ggcagagcuaugucuguugc

SEQ ID NO: 410598 - RNA, 21 nt, Human
uaaaacuguaacuuuguccug

SEQ ID NO: 410599 - RNA, 22 nt, Human
agugcagagaccuggucaggca

SEQ ID NO: 410600 - RNA, 22 nt, Human
cccuuccuugugacuggugggg

SEQ ID NO: 410601 - RNA, 22 nt, Human
uccagggaugguaaugagcagu

SEQ ID NO: 410602 - RNA, 22 nt, Human
ccuccaaguuugacucaggaca

SEQ ID NO: 410603 - RNA, 20 nt, Human
uccugagauuuaagggguuc

SEQ ID NO: 410604 - RNA, 22 nt, Human
aaaucuguaagcaauugcucag

SEQ ID NO: 410605 - RNA, 22 nt, Human
cagaccucaguccucaguagga

SEQ ID NO: 410606 - RNA, 22 nt, Human
ugaggcaggagguugagaacug

SEQ ID NO: 410607 - RNA, 22 nt, Human
aguugaaauuagaguccuggcu

SEQ ID NO: 410608 - RNA, 21 nt, Human
ggcagaaguagcauggacggg

SEQ ID NO: 410609 - RNA, 23 nt, Human
ccuucagaagaaguaacaggggc

SEQ ID NO: 410610 - RNA, 22 nt, Human
cccaggcaggagugugguggcu

SEQ ID NO: 410611 - RNA, 22 nt, Human
gcagggacaacugugcaccuga

SEQ ID NO: 410612 - RNA, 22 nt, Human
uggcuggggagccccgacuccc

SEQ ID NO: 410613 - RNA, 22 nt, Human
gaccugccugagcugccucugc

SEQ ID NO: 410614 - RNA, 20 nt, Human
accuugaacccgccagccau

SEQ ID NO: 410615 - RNA, 22 nt, Human
caguauuuguucccuaucaaug

SEQ ID NO: 410616 - RNA, 22 nt, Human
aggccuccuggcuccaggccuu

SEQ ID NO: 410617 - RNA, 22 nt, Human
acuuccuggcugggugaccugg

SEQ ID NO: 410618 - RNA, 19 nt, Human
ucaaugcaugaaaucagcc

SEQ ID NO: 410619 - RNA, 22 nt, Human
uaaaguucuggugagagguaag

SEQ ID NO: 410620 - RNA, 22 nt, Human
uagccucucuccuccacaaccu

SEQ ID NO: 410621 - RNA, 22 nt, Human
auggaagguccuacagagcgca

SEQ ID NO: 410622 - RNA, 22 nt, Human
gggcagcugcagggauggugac

SEQ ID NO: 410623 - RNA, 22 nt, Human
gguuugcacgauauuuccaugg

SEQ ID NO: 410624 - RNA, 22 nt, Human
agcuuccucaccucagaggucu

SEQ ID NO: 410625 - RNA, 22 nt, Human
ugaagaugucagcagggguggu

SEQ ID NO: 410626 - RNA, 22 nt, Human
ggaggagacaguaaaaagcacg

SEQ ID NO: 410627 - RNA, 22 nt, Human
ccagggugggguccaggaacca

SEQ ID NO: 410628 - RNA, 22 nt, Human
ucacugcagagaccucuaguca

SEQ ID NO: 410629 - RNA, 22 nt, Human
aauaauuuuagcucagaguugu

SEQ ID NO: 410630 - RNA, 22 nt, Human
ccuuuggguucaaucucggucu

SEQ ID NO: 410631 - RNA, 22 nt, Human
auuuccuagccucucuugcagu

SEQ ID NO: 410632 - RNA, 22 nt, Human
ccugucucuguuaccacauuug

SEQ ID NO: 410633 - RNA, 22 nt, Human
cagggcaggacagauacauuac

SEQ ID NO: 410634 - RNA, 20 nt, Human
uccuggccucccuggggcuc

SEQ ID NO: 410635 - RNA, 22 nt, Human
caaggcaggaagccugucuuau

SEQ ID NO: 410636 - RNA, 22 nt, Human
cugaaggauguguggugggagu

SEQ ID NO: 410637 - RNA, 22 nt, Human
aggggcuggaguucgagguuac

SEQ ID NO: 410638 - RNA, 22 nt, Human
ucccaaggauaagagagucuga

SEQ ID NO: 410639 - RNA, 22 nt, Human
cccagcuugcaaauggguugcu

SEQ ID NO: 410640 - RNA, 22 nt, Human
ucugcagcuugcacaggcaggc

SEQ ID NO: 410641 - RNA, 22 nt, Human
acagggccagccugggaccugg

SEQ ID NO: 410642 - RNA, 22 nt, Human
gggaaggacauucugggcucag

SEQ ID NO: 410643 - RNA, 22 nt, Human
acuuccugggcaugcagagucc

SEQ ID NO: 410644 - RNA, 22 nt, Human
ucccagggcacucacccucccu

SEQ ID NO: 410645 - RNA, 21 nt, Human
acauuuucuguuuuaggaagu

SEQ ID NO: 410646 - RNA, 22 nt, Human
uguuccaucaguuuuugguuga

SEQ ID NO: 410647 - RNA, 22 nt, Human
ggcaggagcucuccaguuugcc

SEQ ID NO: 410648 - RNA, 22 nt, Human
ucucuggggauggaccugggag

SEQ ID NO: 410649 - RNA, 22 nt, Human
ugaaggaagaauaggcaguguu

SEQ ID NO: 410650 - RNA, 22 nt, Human
cucccuggcuuuguccugaggc

SEQ ID NO: 410651 - RNA, 22 nt, Human
uccuggguccauggcagccgaa

SEQ ID NO: 410652 - RNA, 22 nt, Human
agagcccuuucuccaggcaccu

SEQ ID NO: 410653 - RNA, 22 nt, Human
gcaaugauauugaagugaugaa

SEQ ID NO: 410654 - RNA, 20 nt, Human
uugcauuggaugugcaggug

SEQ ID NO: 410655 - RNA, 22 nt, Human
ggcugcaggcagaggcugucug

SEQ ID NO: 410656 - RNA, 22 nt, Human
ugcucuucggggccacugcuug

SEQ ID NO: 410657 - RNA, 22 nt, Human
aucugaaagcuaggaguucuca

SEQ ID NO: 410658 - RNA, 22 nt, Human
gcucccugcacucugcagcccu

SEQ ID NO: 410659 - RNA, 19 nt, Human
agugguagaugagcaggag

SEQ ID NO: 410660 - RNA, 22 nt, Human
gccugggagggcagcagugugg

SEQ ID NO: 410661 - RNA, 22 nt, Human
ccacaaguuucagcacccagag

SEQ ID NO: 410662 - RNA, 22 nt, Human
ucuuuacaucacaauuguaugg

SEQ ID NO: 410663 - RNA, 22 nt, Human
aggccugcagcaggagcaaacc

SEQ ID NO: 410664 - RNA, 20 nt, Human
ugcuuccuggccacugcggg

SEQ ID NO: 410665 - RNA, 22 nt, Human
caagaugggcaccccagcaccu

SEQ ID NO: 410666 - RNA, 22 nt, Human
agcaggugagcacagccaggcu

SEQ ID NO: 410667 - RNA, 22 nt, Human
ccugccaggagcuggugcugca

SEQ ID NO: 410668 - RNA, 22 nt, Human
cugugacagagcuugagugaga

SEQ ID NO: 410669 - RNA, 22 nt, Human
agagccagcaagugaauaguga

SEQ ID NO: 410670 - RNA, 22 nt, Human
gcagggacgccagggacagcaa

SEQ ID NO: 410671 - RNA, 22 nt, Human
uaaggccaaguucauauacaac

SEQ ID NO: 410672 - RNA, 22 nt, Human
ggacccugggcuugcuccuggg

SEQ ID NO: 410673 - RNA, 22 nt, Human
ucucaggaauagaguggcagca

SEQ ID NO: 410674 - RNA, 22 nt, Human
gagagucuaggaaccucauaua

SEQ ID NO: 410675 - RNA, 22 nt, Human
cccuguacagucucuguggcac

SEQ ID NO: 410676 - RNA, 22 nt, Human
uuucuaaaugguggcugcauug

SEQ ID NO: 410677 - RNA, 22 nt, Human
ucucugaguaagugacaguuca

SEQ ID NO: 410678 - RNA, 22 nt, Human
uguuucagucccuguguucaau

SEQ ID NO: 410679 - RNA, 22 nt, Human
aacaugaaaaccuccacagcaa

SEQ ID NO: 410680 - RNA, 22 nt, Human
agccucucuguuagucacuggg

SEQ ID NO: 410681 - RNA, 22 nt, Human
cagggacagccuugggguggcg

SEQ ID NO: 410682 - RNA, 22 nt, Human
gcagcugagcgugaggaagagu

SEQ ID NO: 410683 - RNA, 22 nt, Human
ugcagaagaaugagcuuggagu

SEQ ID NO: 410684 - RNA, 22 nt, Human
aaagauuuaugaaguucaauua

SEQ ID NO: 410685 - RNA, 22 nt, Human
acaaugcaccagcaucuucacc

SEQ ID NO: 410686 - RNA, 22 nt, Human
accugagcaugccaggagagug

SEQ ID NO: 410687 - RNA, 22 nt, Human
cccucuggcucuucucaggccg

SEQ ID NO: 410688 - RNA, 22 nt, Human
cuggcucaggaaaguugcugcu

SEQ ID NO: 410689 - RNA, 22 nt, Human
cucugagagagcuggugagcac

SEQ ID NO: 410690 - RNA, 22 nt, Human
caggucagaggcgcagccccca

SEQ ID NO: 410691 - RNA, 22 nt, Human
caggcauggugagaacucagcc

SEQ ID NO: 410692 - RNA, 22 nt, Human
cacagcuuguuuagugacucac

SEQ ID NO: 410693 - RNA, 22 nt, Human
uuaaaguucauuaaaugagcca

SEQ ID NO: 410694 - RNA, 22 nt, Human
aggucauugaaguuauuuucuu

SEQ ID NO: 410695 - RNA, 22 nt, Human
ccaaagucuggagcagcagagc

SEQ ID NO: 410696 - RNA, 22 nt, Human
aggagugcaaauaguccagaga

SEQ ID NO: 410697 - RNA, 22 nt, Human
ccugcagaaaggguccccagga

SEQ ID NO: 410698 - RNA, 22 nt, Human
cauguacaguuuuucuguccug

SEQ ID NO: 410699 - RNA, 22 nt, Human
caaauaucuuuggcaaagagaa

SEQ ID NO: 410700 - RNA, 19 nt, Human
gguguccuagagauaagag

SEQ ID NO: 410701 - RNA, 22 nt, Human
cagcccugccauggagccuccu

SEQ ID NO: 410702 - RNA, 22 nt, Human
agggccagaugaagccacaagc

SEQ ID NO: 410703 - RNA, 22 nt, Human
ugaaggagcugauguaaggggu

SEQ ID NO: 410704 - RNA, 20 nt, Human
agggucaguagcacagagcu

SEQ ID NO: 410705 - RNA, 22 nt, Human
ugcucagacaagcugaacagua

SEQ ID NO: 410706 - RNA, 22 nt, Human
acccagggaccccgcugacgcc

SEQ ID NO: 410707 - RNA, 22 nt, Human
aaugaacaucaaaugccuacca

SEQ ID NO: 410708 - RNA, 22 nt, Human
caugugucaaaugauguagcug

SEQ ID NO: 410709 - RNA, 19 nt, Human
uuugaaaggauuguuauuu

SEQ ID NO: 410710 - RNA, 22 nt, Human
guuuuguugcugcagagcucaa

SEQ ID NO: 410711 - RNA, 22 nt, Human
gcucugagagugggugauucug

SEQ ID NO: 410712 - RNA, 22 nt, Human
ggucauugucagagccuguacu

SEQ ID NO: 410713 - RNA, 22 nt, Human
agcaugaaagcauaggacaguc

SEQ ID NO: 410714 - RNA, 22 nt, Human
cugagaggcggagcuugcagug

SEQ ID NO: 410715 - RNA, 22 nt, Human
uuguccuuaccucaaucuggaa

SEQ ID NO: 410716 - RNA, 22 nt, Human
aagaauguggguggauaugaug

SEQ ID NO: 410717 - RNA, 22 nt, Human
agggccuggaacugugggcagg

SEQ ID NO: 410718 - RNA, 22 nt, Human
cagagagcaugggaggcccgag

SEQ ID NO: 410719 - RNA, 22 nt, Human
ucacuucacacccacuaucaug

SEQ ID NO: 410720 - RNA, 22 nt, Human
augucacagcucccauuccucc

SEQ ID NO: 410721 - RNA, 22 nt, Human
cuucaguuuaucccaucaucca

SEQ ID NO: 410722 - RNA, 22 nt, Human
gagcuggcaggaggcuccccga

SEQ ID NO: 410723 - RNA, 22 nt, Human
gcaggggaguggaugauggauu

SEQ ID NO: 410724 - RNA, 22 nt, Human
cuggcuggccggaggcaucccu

SEQ ID NO: 410725 - RNA, 22 nt, Human
ugggacagugugccuugcuccu

SEQ ID NO: 410726 - RNA, 22 nt, Human
cagugcagaacacauggaaaau

SEQ ID NO: 410727 - RNA, 22 nt, Human
ggccuucacgugaccuggcgug

SEQ ID NO: 410728 - RNA, 22 nt, Human
gcuuagucaauuauaaauaggc

SEQ ID NO: 410729 - RNA, 22 nt, Human
auuucucaguuccuacuguuua

SEQ ID NO: 410730 - RNA, 22 nt, Human
caggguggaagcuguagagugg

SEQ ID NO: 410731 - RNA, 22 nt, Human
cagcaucccucaggggccucug

SEQ ID NO: 410732 - RNA, 22 nt, Human
cugggcugagccugggcugugu

SEQ ID NO: 410733 - RNA, 22 nt, Human
agaggcugucccuugcuauucc

SEQ ID NO: 410734 - RNA, 22 nt, Human
gccugcaggcuguaguuuguga

SEQ ID NO: 410735 - RNA, 22 nt, Human
uuucauugcagagucugugugc

SEQ ID NO: 410736 - RNA, 22 nt, Human
cuggagccggaccagggacggu

SEQ ID NO: 410737 - RNA, 22 nt, Human
gccuggaggggacagucucugg

SEQ ID NO: 410738 - RNA, 22 nt, Human
uuuguaaauagcaguacucaug

SEQ ID NO: 410739 - RNA, 21 nt, Human
ccagcugucuguccuuaggca

SEQ ID NO: 410740 - RNA, 22 nt, Human
agcagggcaaagucaggcuaac

SEQ ID NO: 410741 - RNA, 22 nt, Human
caguggagagacuuuuacucuu

SEQ ID NO: 410742 - RNA, 22 nt, Human
gacacagagauaggccuguguu

SEQ ID NO: 410743 - RNA, 22 nt, Human
gaaggaaaacagaucugccuga

SEQ ID NO: 410744 - RNA, 22 nt, Human
gagaaaauagcauguguaguau

SEQ ID NO: 410745 - RNA, 20 nt, Human
aagcaauauagugcaaaugu

SEQ ID NO: 410746 - RNA, 22 nt, Human
cacucugcagcugaagggcugg

SEQ ID NO: 410747 - RNA, 17 nt, Human
gcugcagcgguaggcag

SEQ ID NO: 410748 - RNA, 21 nt, Human
acagaacuguauagugauaaa

SEQ ID NO: 410749 - RNA, 22 nt, Human
uugucuuaaauggauggacaau

SEQ ID NO: 410750 - RNA, 22 nt, Human
caggguggcccuguggucucau

SEQ ID NO: 410751 - RNA, 17 nt, Human
gcaguggagggguaguu

SEQ ID NO: 410752 - RNA, 22 nt, Human
agcugcucucacuggacgccug

SEQ ID NO: 410753 - RNA, 22 nt, Human
aaguuguauauaccgcuuuaag

SEQ ID NO: 410754 - RNA, 20 nt, Human
cugccaugauugauagagug

SEQ ID NO: 410755 - RNA, 22 nt, Human
agggcugacagugaggagucaa

SEQ ID NO: 410756 - RNA, 21 nt, Human
uagggcaggcauuggaagaga

SEQ ID NO: 410757 - RNA, 22 nt, Human
cagaggcugggaccucaggcau

SEQ ID NO: 410758 - RNA, 22 nt, Human
ccugcuucagggaugauggcac

SEQ ID NO: 410759 - RNA, 22 nt, Human
ucuuuccucugagcuccuguag

SEQ ID NO: 410760 - RNA, 21 nt, Human
aggcagcaggauccagggaca

SEQ ID NO: 410761 - RNA, 22 nt, Human
aagccaggcugcacuugcuggg

SEQ ID NO: 410762 - RNA, 22 nt, Human
aagaaugucguugguauuuuaa

SEQ ID NO: 410763 - RNA, 22 nt, Human
agcagcugagaugguaagauuc

SEQ ID NO: 410764 - RNA, 22 nt, Human
acccuggguucccgcagcacca

SEQ ID NO: 410765 - RNA, 21 nt, Human
ugggaccuagcuuugcacagg

SEQ ID NO: 410766 - RNA, 22 nt, Human
uuuagggacaagggucuggggu

SEQ ID NO: 410767 - RNA, 22 nt, Human
aagaugcaugcugaagcuggcu

SEQ ID NO: 410768 - RNA, 22 nt, Human
ucagaggauugccucagcgagc

SEQ ID NO: 410769 - RNA, 22 nt, Human
ugcugcuccugccuggcuccca

SEQ ID NO: 410770 - RNA, 22 nt, Human
accaucuuaguggccagcucuc

SEQ ID NO: 410771 - RNA, 22 nt, Human
ucuggcucggauuugucuagca

SEQ ID NO: 410772 - RNA, 22 nt, Human
gaacuguauaggagcaguguuu

SEQ ID NO: 410773 - RNA, 22 nt, Human
ccuuccaggagucucugcaggu

SEQ ID NO: 410774 - RNA, 22 nt, Human
acagcagagugugagauagcca

SEQ ID NO: 410775 - RNA, 22 nt, Human
cauggacucugguuuggggagc

SEQ ID NO: 410776 - RNA, 22 nt, Human
gccuggaggaauguagcugagg

SEQ ID NO: 410777 - RNA, 22 nt, Human
cagggccaccguguuugcugcu

SEQ ID NO: 410778 - RNA, 22 nt, Human
aaagauuugaaauuaggcauca

SEQ ID NO: 410779 - RNA, 22 nt, Human
ggggauggauuccgggucccug

SEQ ID NO: 410780 - RNA, 22 nt, Human
cuggccugugggcugucuccgg

SEQ ID NO: 410781 - RNA, 22 nt, Human
cugagcugggacucaguagcaa

SEQ ID NO: 410782 - RNA, 22 nt, Human
uucucauucugacucaguguag

SEQ ID NO: 410783 - RNA, 22 nt, Human
agugcuguccaguuucacaggu

SEQ ID NO: 410784 - RNA, 22 nt, Human
uguaugcagggcuuguaugcag

SEQ ID NO: 410785 - RNA, 22 nt, Human
cuuucaaugugccugccuuggg

SEQ ID NO: 410786 - RNA, 22 nt, Human
ggcuucccagcagagggcgcac

SEQ ID NO: 410787 - RNA, 22 nt, Human
aaguccagaacuccugugauag

SEQ ID NO: 410788 - RNA, 22 nt, Human
cuuaacagagagaaguguugcu

SEQ ID NO: 410789 - RNA, 23 nt, Human
uccugagaugagacagugcugcc

SEQ ID NO: 410790 - RNA, 22 nt, Human
gcaguggauggccagcaggggc

SEQ ID NO: 410791 - RNA, 22 nt, Human
uuagaucuuaggcaaauguguu

SEQ ID NO: 410792 - RNA, 22 nt, Human
cgggcagcggcguggccauggu

SEQ ID NO: 410793 - RNA, 19 nt, Human
cuggaaugagaacaugccc

SEQ ID NO: 410794 - RNA, 22 nt, Human
ggcacugagcgggcucugagcg

SEQ ID NO: 410795 - RNA, 22 nt, Human
ucugccagaaguucugagagua

SEQ ID NO: 410796 - RNA, 22 nt, Human
ccuggagguggagguugcagug

SEQ ID NO: 410797 - RNA, 22 nt, Human
gauaccagacagggagggagaa

SEQ ID NO: 410798 - RNA, 23 nt, Human
ccaggcaguagcuauugaaguga

SEQ ID NO: 410799 - RNA, 22 nt, Human
gagacacacacaggagguggca

SEQ ID NO: 410800 - RNA, 22 nt, Human
gccuggaggggccaggguggua

SEQ ID NO: 410801 - RNA, 22 nt, Human
cuguggcugcagccuugguccu

SEQ ID NO: 410802 - RNA, 22 nt, Human
gaguggggucugggcaucaguc

SEQ ID NO: 410803 - RNA, 23 nt, Human
agccucuuuucuccugcccugca

SEQ ID NO: 410804 - RNA, 22 nt, Human
aaaugucuuugaguauuucugc

SEQ ID NO: 410805 - RNA, 22 nt, Human
gcucagagaaucagcagacacc

SEQ ID NO: 410806 - RNA, 22 nt, Human
uuuuccuucugauacuccauuu

SEQ ID NO: 410807 - RNA, 22 nt, Human
gugcauauaugcacauaugugu

SEQ ID NO: 410808 - RNA, 22 nt, Human
aggcugaggcagguggaucacc

SEQ ID NO: 410809 - RNA, 22 nt, Human
uguaugcagcaaaacaauuagu

SEQ ID NO: 410810 - RNA, 22 nt, Human
cucaguuucuucauauuguagg

SEQ ID NO: 410811 - RNA, 22 nt, Human
cuuacaaaggagaggagauagg

SEQ ID NO: 410812 - RNA, 23 nt, Human
agggguggucaguacccgcagug

SEQ ID NO: 410813 - RNA, 22 nt, Human
cucuuuccaggguaccccaggu

SEQ ID NO: 410814 - RNA, 22 nt, Human
cacagggcaccaguuggccauc

SEQ ID NO: 410815 - RNA, 20 nt, Human
auguccagugacuggaccau

SEQ ID NO: 410816 - RNA, 22 nt, Human
auuucagcccaguaugagcccc

SEQ ID NO: 410817 - RNA, 22 nt, Human
uauucacauucucaggccuggu

SEQ ID NO: 410818 - RNA, 23 nt, Human
agcccagcagagaaccuaggucc

SEQ ID NO: 410819 - RNA, 23 nt, Human
agaagcagcuucuggaguaucgg

SEQ ID NO: 410820 - RNA, 22 nt, Human
ucucuucuuguguuuuccugcc

SEQ ID NO: 410821 - RNA, 22 nt, Human
caucugccuaaguggcccuguu

SEQ ID NO: 410822 - RNA, 22 nt, Human
ugacagcauaacacuggucuug

SEQ ID NO: 410823 - RNA, 22 nt, Human
agggacacugaugagaaauucu

SEQ ID NO: 410824 - RNA, 22 nt, Human
ccugagagcauuccacacugaa

SEQ ID NO: 410825 - RNA, 22 nt, Human
ucacugaagacugggcucuaaa

SEQ ID NO: 410826 - RNA, 23 nt, Human
uggaccugaaccagugccucugu

SEQ ID NO: 410827 - RNA, 22 nt, Human
gaaggccauuagagccugugcc

SEQ ID NO: 410828 - RNA, 22 nt, Human
ucagagaguccuggucauuugc

SEQ ID NO: 410829 - RNA, 22 nt, Human
gagggcucacugagaaagcagu

SEQ ID NO: 410830 - RNA, 22 nt, Human
aacaaucaaguuucuaaaugac

SEQ ID NO: 410831 - RNA, 22 nt, Human
aaggccagaguacuagaggcug

SEQ ID NO: 410832 - RNA, 18 nt, Human
cccagugcucacugccuc

SEQ ID NO: 410833 - RNA, 23 nt, Human
gagugcagaauagacaugcagug

SEQ ID NO: 410834 - RNA, 22 nt, Human
uaaggcacgcauaagagggggc

SEQ ID NO: 410835 - RNA, 23 nt, Human
ggccucagcgcacagaaacugcu

SEQ ID NO: 410836 - RNA, 22 nt, Human
gcucugggcugcccucuggaca

SEQ ID NO: 410837 - RNA, 22 nt, Human
ccugcagguugcagaggcggaa

SEQ ID NO: 410838 - RNA, 22 nt, Human
ucuggcucuguguccccaccca

SEQ ID NO: 410839 - RNA, 22 nt, Human
ggcagugaaugaaacagaggcu

SEQ ID NO: 410840 - RNA, 22 nt, Human
gcugucccgcugacuuccagcu

SEQ ID NO: 410841 - RNA, 22 nt, Human
aaguuauuuccucgugacugaa

SEQ ID NO: 410842 - RNA, 22 nt, Human
gccaccagguuagauccagccu

SEQ ID NO: 410843 - RNA, 20 nt, Human
ucagaggcugccagcugggg

SEQ ID NO: 410844 - RNA, 22 nt, Human
agagugaagguugacacuucac

SEQ ID NO: 410845 - RNA, 22 nt, Human
ugucauguguucuuaaauacau

SEQ ID NO: 410846 - RNA, 22 nt, Human
gcugccucccccauggcuggaa

SEQ ID NO: 410847 - RNA, 22 nt, Human
uacaaacucuuuauauuucaua

SEQ ID NO: 410848 - RNA, 22 nt, Human
gcagcuuuuuggaugucaguua

SEQ ID NO: 410849 - RNA, 22 nt, Human
agaauucuguucuucgggugug

SEQ ID NO: 410850 - RNA, 22 nt, Human
cauguuaaaauauacauucuga

SEQ ID NO: 410851 - RNA, 22 nt, Human
agggcagaaguacagacacuua

SEQ ID NO: 410852 - RNA, 17 nt, Human
gcuuuggaaggguagac

SEQ ID NO: 410853 - RNA, 22 nt, Human
cuuucacaguccugacugagcg

SEQ ID NO: 410854 - RNA, 22 nt, Human
ccucaguguuaggauaagagaa

SEQ ID NO: 410855 - RNA, 22 nt, Human
aaaaaucuaugacugcuucucc

SEQ ID NO: 410856 - RNA, 22 nt, Human
gagggcucugucuggaagggaa

SEQ ID NO: 410857 - RNA, 22 nt, Human
uggagaauucuauguugagggg

SEQ ID NO: 410858 - RNA, 22 nt, Human
agccuggagguaaugaggaaac

SEQ ID NO: 410859 - RNA, 22 nt, Human
gccaggcaugggcuucugggcg

SEQ ID NO: 410860 - RNA, 22 nt, Human
ccagcuggugacauccccaacc

SEQ ID NO: 410861 - RNA, 22 nt, Human
uggcugcaguucacaggagcaa

SEQ ID NO: 410862 - RNA, 22 nt, Human
cagagagcuuagugugcugcau

SEQ ID NO: 410863 - RNA, 22 nt, Human
ccugucugagccagggugggca

SEQ ID NO: 410864 - RNA, 22 nt, Human
ccucugcucccuggugucugag

SEQ ID NO: 410865 - RNA, 22 nt, Human
uauauguaagcuauguaagagu

SEQ ID NO: 410866 - RNA, 22 nt, Human
gggaccuggcaccuuugcucug

SEQ ID NO: 410867 - RNA, 22 nt, Human
aaggcagucugguuucaaagca

SEQ ID NO: 410868 - RNA, 22 nt, Human
ugauuaacugucuauuaaucau

SEQ ID NO: 410869 - RNA, 22 nt, Human
ccugggaguggcacucacagca

SEQ ID NO: 410870 - RNA, 22 nt, Human
caggcacugugcaagggucucg

SEQ ID NO: 410871 - RNA, 22 nt, Human
cuggagugaggucugggagccu

SEQ ID NO: 410872 - RNA, 22 nt, Human
gccugcagugagugcagaaggu

SEQ ID NO: 410873 - RNA, 22 nt, Human
guacaaaguggaccugauagua

SEQ ID NO: 410874 - RNA, 22 nt, Human
cagggccuuauccugccauuga

SEQ ID NO: 410875 - RNA, 22 nt, Human
cuccagggaggucugcaggacu

SEQ ID NO: 410876 - RNA, 20 nt, Human
acuggagccaucucagccua

SEQ ID NO: 410877 - RNA, 22 nt, Human
uacuuuuuagcacagugugugc

SEQ ID NO: 410878 - RNA, 22 nt, Human
ccaggcaucacgggcauguggc

SEQ ID NO: 410879 - RNA, 20 nt, Human
ucucagcauaagaacccuuc

SEQ ID NO: 410880 - RNA, 18 nt, Human
ugaggcagucagugaugg

SEQ ID NO: 410881 - RNA, 22 nt, Human
cuuccuggccauugccauggca

SEQ ID NO: 410882 - RNA, 22 nt, Human
caggggaagaugccaagggaga

SEQ ID NO: 410883 - RNA, 22 nt, Human
gcagaggaggacccaggaauua

SEQ ID NO: 410884 - RNA, 22 nt, Human
ccucacaguuuggcuaacugug

SEQ ID NO: 410885 - RNA, 22 nt, Human
accugccucagugcagcuggau

SEQ ID NO: 410886 - RNA, 22 nt, Human
guuagaaagugucugcuugggu

SEQ ID NO: 410887 - RNA, 22 nt, Human
auguuauuuuggaaaauacaaa

SEQ ID NO: 410888 - RNA, 22 nt, Human
guggcauuaggccaggugcaua

SEQ ID NO: 410889 - RNA, 22 nt, Human
uuucacaaugcaauccuacuuc

SEQ ID NO: 410890 - RNA, 22 nt, Human
acaguggagcucagaugaaaau

SEQ ID NO: 410891 - RNA, 22 nt, Human
ucucaagcuuguugguauguuu

SEQ ID NO: 410892 - RNA, 22 nt, Human
ucagcugagcuccagcucauag

SEQ ID NO: 410893 - RNA, 23 nt, Human
ugccucugccucccuagucugca

SEQ ID NO: 410894 - RNA, 22 nt, Human
aggacuuagaacauuauguacu

SEQ ID NO: 410895 - RNA, 22 nt, Human
uucuuccucagcagggcugccu

SEQ ID NO: 410896 - RNA, 22 nt, Human
ucuuuccacauucucuguuuag

SEQ ID NO: 410897 - RNA, 20 nt, Human
gcuuccuucccagcccccac

SEQ ID NO: 410898 - RNA, 22 nt, Human
ucaggcugcccguucagggcuc

SEQ ID NO: 410899 - RNA, 22 nt, Human
auaauuuaauuuucacaguggu

SEQ ID NO: 410900 - RNA, 22 nt, Human
uuguuaaaaugcauauucuggu

SEQ ID NO: 410901 - RNA, 22 nt, Human
aggguauguuuuuaucuacugu

SEQ ID NO: 410902 - RNA, 20 nt, Human
aggagcugaauuagaggguu

SEQ ID NO: 410903 - RNA, 22 nt, Human
ggcccucccugagccagguggg

SEQ ID NO: 410904 - RNA, 22 nt, Human
caaggccaugagcagcgagugu

SEQ ID NO: 410905 - RNA, 22 nt, Human
ccugcagguaaggcuaacugcc

SEQ ID NO: 410906 - RNA, 22 nt, Human
gugaaggacuagcauggagggc

SEQ ID NO: 410907 - RNA, 22 nt, Human
ugucagaggcucagggucucag

SEQ ID NO: 410908 - RNA, 22 nt, Human
augcacaagaggcuagaaaaga

SEQ ID NO: 410909 - RNA, 21 nt, Human
ccccugggagcccugucagua

SEQ ID NO: 410910 - RNA, 22 nt, Human
aggagcugggcugcugcuggga

SEQ ID NO: 410911 - RNA, 22 nt, Human
uuccucagacccucauugugag

SEQ ID NO: 410912 - RNA, 22 nt, Human
ugccagccagguucugaggcua

SEQ ID NO: 410913 - RNA, 22 nt, Human
cuuucauucuuagauauuagug

SEQ ID NO: 410914 - RNA, 22 nt, Human
uuagaaaauuugcuucuuugga

SEQ ID NO: 410915 - RNA, 22 nt, Human
cagcccugagagaaccaucuau

SEQ ID NO: 410916 - RNA, 22 nt, Human
cccagcauggagugaggacuca

SEQ ID NO: 410917 - RNA, 22 nt, Human
aaagaaaccuaucagccacaug

SEQ ID NO: 410918 - RNA, 22 nt, Human
cucagggcuggaaagccaggaa

SEQ ID NO: 410919 - RNA, 22 nt, Human
ugcugguggagaaaguggaggu

SEQ ID NO: 410920 - RNA, 22 nt, Human
ccacuguuuuucaguuaacuuu

SEQ ID NO: 410921 - RNA, 22 nt, Human
cagccaggccuggugaccaaag

SEQ ID NO: 410922 - RNA, 22 nt, Human
ugcaguggcgccaucucagcuc

SEQ ID NO: 410923 - RNA, 22 nt, Human
ugaaggaaagagggaacauccc

SEQ ID NO: 410924 - RNA, 22 nt, Human
ucagcuuuuuacaugugaaaua

SEQ ID NO: 410925 - RNA, 22 nt, Human
aggcuuguggauuggagcgagu

SEQ ID NO: 410926 - RNA, 22 nt, Human
cagugaggaguccagggcagag

SEQ ID NO: 410927 - RNA, 21 nt, Human
gguugguguguccaguggcca

SEQ ID NO: 410928 - RNA, 22 nt, Human
acaacacagcaaaaccccaucu

SEQ ID NO: 410929 - RNA, 19 nt, Human
agggaaggauucugucauu

SEQ ID NO: 410930 - RNA, 22 nt, Human
gcucuggacuggggccugagaa

SEQ ID NO: 410931 - RNA, 22 nt, Human
cucuuaaagcuuccaguuucaa

SEQ ID NO: 410932 - RNA, 22 nt, Human
ucugccuuuucacugccacuaa

SEQ ID NO: 410933 - RNA, 22 nt, Human
uaaggccaccguuauagaacca

SEQ ID NO: 410934 - RNA, 22 nt, Human
aucuggcucuuccuggaguucc

SEQ ID NO: 410935 - RNA, 21 nt, Human
guggcucugccaggacugaaa

SEQ ID NO: 410936 - RNA, 22 nt, Human
cuggccuggucuggccucucca

SEQ ID NO: 410937 - RNA, 22 nt, Human
uguuugugcugccuggugggca

SEQ ID NO: 410938 - RNA, 22 nt, Human
aggcacugaagugguaaaugua

SEQ ID NO: 410939 - RNA, 22 nt, Human
agcagaaccugcagaccugucu

SEQ ID NO: 410940 - RNA, 22 nt, Human
uuccugagggacuuuugagauu

SEQ ID NO: 410941 - RNA, 22 nt, Human
acccagcuguuucccgugucau

SEQ ID NO: 410942 - RNA, 22 nt, Human
agggcucccgugaggugacugc

SEQ ID NO: 410943 - RNA, 22 nt, Human
aggucauuggggacuaucuccg

SEQ ID NO: 410944 - RNA, 22 nt, Human
agggccaggaacaccugaaggg

SEQ ID NO: 410945 - RNA, 22 nt, Human
cccagaggugcuucagaggugc

SEQ ID NO: 410946 - RNA, 22 nt, Human
ucccaggcaaaggcagcucauu

SEQ ID NO: 410947 - RNA, 22 nt, Human
caugaagcuugaagcaguccac

SEQ ID NO: 410948 - RNA, 22 nt, Human
ucccagauucuucugugugggc

SEQ ID NO: 410949 - RNA, 19 nt, Human
agugaaauggaguauucaa

SEQ ID NO: 410950 - RNA, 22 nt, Human
ucaccuuagcuagaggaagaga

SEQ ID NO: 410951 - RNA, 22 nt, Human
cuggccugagcacagcggcugc

SEQ ID NO: 410952 - RNA, 22 nt, Human
ccaaagugcugggguuacaggc

SEQ ID NO: 410953 - RNA, 22 nt, Human
uugaccauaccuccaggcaguu

SEQ ID NO: 410954 - RNA, 19 nt, Human
aaaaggaauauucuuuggg

SEQ ID NO: 410955 - RNA, 19 nt, Human
uguuggugcggauguggag

SEQ ID NO: 410956 - RNA, 22 nt, Human
aggcuggggaauugaauuugcu

SEQ ID NO: 410957 - RNA, 22 nt, Human
gcuggcagggacagcugcgugu

SEQ ID NO: 410958 - RNA, 22 nt, Human
ugggaaugugagcauucauuca

SEQ ID NO: 410959 - RNA, 22 nt, Human
agaauccugaugaaaaggagag

SEQ ID NO: 410960 - RNA, 22 nt, Human
ucacacgugagguucuauccug

SEQ ID NO: 410961 - RNA, 22 nt, Human
cccagcuucugagggggccuug

SEQ ID NO: 410962 - RNA, 23 nt, Human
gccagccuugcucuccugcagcc

SEQ ID NO: 410963 - RNA, 22 nt, Human
ucacaggaaccaucagagaaau

SEQ ID NO: 410964 - RNA, 22 nt, Human
uggaaggcaugggaacuguucu

SEQ ID NO: 410965 - RNA, 22 nt, Human
gagcuggugaucagcuggagga

SEQ ID NO: 410966 - RNA, 20 nt, Human
cccucugcacauggcugugg

SEQ ID NO: 410967 - RNA, 22 nt, Human
gggcucugggaugcucuuagag

SEQ ID NO: 410968 - RNA, 22 nt, Human
aaguguguauuguuuaugcugc

SEQ ID NO: 410969 - RNA, 22 nt, Human
ucaaaugcugccuuugugugcc

SEQ ID NO: 410970 - RNA, 22 nt, Human
agccagccgggggaccacagug

SEQ ID NO: 410971 - RNA, 22 nt, Human
auuaaaagcuucccaagaguua

SEQ ID NO: 410972 - RNA, 22 nt, Human
agagaugucgccuugcccaggg

SEQ ID NO: 410973 - RNA, 22 nt, Human
augaggcucucaggggagcugu

SEQ ID NO: 410974 - RNA, 21 nt, Human
aggcacuguuugugguuuggg

SEQ ID NO: 410975 - RNA, 22 nt, Human
ggcugggcaggucugcacaggg

SEQ ID NO: 410976 - RNA, 22 nt, Human
auaguuguguggggauucuggu

SEQ ID NO: 410977 - RNA, 22 nt, Human
uccuucagaaaaccucagucuu

SEQ ID NO: 410978 - RNA, 22 nt, Human
cuggcucauccagguguugcuc

SEQ ID NO: 410979 - RNA, 23 nt, Human
ugggaccuguuugcccacagaug

SEQ ID NO: 410980 - RNA, 22 nt, Human
uagggcaggugaagaaaagcua

SEQ ID NO: 410981 - RNA, 22 nt, Human
cucccaggguagggagagacua

SEQ ID NO: 410982 - RNA, 22 nt, Human
ugggcacaggggaauggaugaa

SEQ ID NO: 410983 - RNA, 22 nt, Human
uaaggccaauuaacaaccaggg

SEQ ID NO: 410984 - RNA, 22 nt, Human
ccugggagagucuguggucucc

SEQ ID NO: 410985 - RNA, 22 nt, Human
cagcauggugccagugagucca

SEQ ID NO: 410986 - RNA, 22 nt, Human
acagcugggugcugcucagagc

SEQ ID NO: 410987 - RNA, 22 nt, Human
cacugcagcaccaugcagggcu

SEQ ID NO: 410988 - RNA, 22 nt, Human
gcaaggaccuuugagcgugcca

SEQ ID NO: 410989 - RNA, 22 nt, Human
uacagaagcugagacacugaga

SEQ ID NO: 410990 - RNA, 22 nt, Human
ugaggccugggcacauaaccuc

SEQ ID NO: 410991 - RNA, 22 nt, Human
aggccuagaggaauggccaggg

SEQ ID NO: 410992 - RNA, 22 nt, Human
acacaaugugcaggacaccugu

SEQ ID NO: 410993 - RNA, 22 nt, Human
uugauacaggcucuauuucauc

SEQ ID NO: 410994 - RNA, 22 nt, Human
caggugccucaggaugagacaa

SEQ ID NO: 410995 - RNA, 22 nt, Human
ccuguacaagagccaucuggau

SEQ ID NO: 410996 - RNA, 22 nt, Human
gccugucaauuuuguguacaau

SEQ ID NO: 410997 - RNA, 22 nt, Human
auguguccacaggugugagaga

SEQ ID NO: 410998 - RNA, 22 nt, Human
gcagccacucucauuccacgug

SEQ ID NO: 410999 - RNA, 22 nt, Human
cagcugccacuugcucucggcu

SEQ ID NO: 411000 - RNA, 22 nt, Human
agcuggaggauaacucacuucu

SEQ ID NO: 411001 - RNA, 22 nt, Human
gacccaggguauccagagcugc

SEQ ID NO: 411002 - RNA, 22 nt, Human
gcaggagcagucaggggcagcu

SEQ ID NO: 411003 - RNA, 22 nt, Human
caggcagggagcuggaaaggau

SEQ ID NO: 411004 - RNA, 22 nt, Human
ccagcccuccuccaucagagga

SEQ ID NO: 411005 - RNA, 22 nt, Human
auacauguuguaccauauguuu

SEQ ID NO: 411006 - RNA, 22 nt, Human
ugcucuguaaggucagaaaagg

SEQ ID NO: 411007 - RNA, 22 nt, Human
cccagcuugucugauucagccu

SEQ ID NO: 411008 - RNA, 20 nt, Human
ucacuaguaaccaucugcuu

SEQ ID NO: 411009 - RNA, 22 nt, Human
uucucuucuguucagugcccaa

SEQ ID NO: 411010 - RNA, 22 nt, Human
aacacaaagaagcugcaggauc

SEQ ID NO: 411011 - RNA, 22 nt, Human
uuuguucacugagcaaugauua

SEQ ID NO: 411012 - RNA, 22 nt, Human
acacagccaggguaguaaggcu

SEQ ID NO: 411013 - RNA, 20 nt, Human
gaguuccccauuucuccugg

SEQ ID NO: 411014 - RNA, 22 nt, Human
cugcuucugggaugauggagua

SEQ ID NO: 411015 - RNA, 22 nt, Human
caggcugaucagggcugggaug

SEQ ID NO: 411016 - RNA, 22 nt, Human
ugccaggcugaacagggucuua

SEQ ID NO: 411017 - RNA, 20 nt, Human
ucugucucugagcuagacuu

SEQ ID NO: 411018 - RNA, 22 nt, Human
aggcucugaucagguggcugug

SEQ ID NO: 411019 - RNA, 22 nt, Human
aaauccuaauaaugcacuagug

SEQ ID NO: 411020 - RNA, 22 nt, Human
cagagguauugcaaaagccuag

SEQ ID NO: 411021 - RNA, 22 nt, Human
cuggggcccaucgagggcugag

SEQ ID NO: 411022 - RNA, 22 nt, Human
ggcugcaggcaggguauccacu

SEQ ID NO: 411023 - RNA, 17 nt, Human
uuauuuuuugggcugag

SEQ ID NO: 411024 - RNA, 22 nt, Human
ugugcagcuaguccuggacuug

SEQ ID NO: 411025 - RNA, 22 nt, Human
aaguauauuuuuugaagcauau

SEQ ID NO: 411026 - RNA, 22 nt, Human
auuacaguaacagcuacaaugc

SEQ ID NO: 411027 - RNA, 22 nt, Human
auggggcuguucucugcccugc

SEQ ID NO: 411028 - RNA, 22 nt, Human
uccuuuuugguccaaggugacc

SEQ ID NO: 411029 - RNA, 22 nt, Human
uuauuaggaaaaggucagaugu

SEQ ID NO: 411030 - RNA, 20 nt, Human
gccuggaggcaaugggaaga

SEQ ID NO: 411031 - RNA, 22 nt, Human
cauggcagaaaccugagcugcu

SEQ ID NO: 411032 - RNA, 22 nt, Human
aggcacagagaaugcccuccau

SEQ ID NO: 411033 - RNA, 20 nt, Human
uuucagugguuugugccuag

SEQ ID NO: 411034 - RNA, 22 nt, Human
uccagaccauggauggcugcaa

SEQ ID NO: 411035 - RNA, 22 nt, Human
gugccaggcccagggagcgggg

SEQ ID NO: 411036 - RNA, 19 nt, Human
ggucacagggguuacaagg

SEQ ID NO: 411037 - RNA, 23 nt, Human
aguguuccaguugguugagagug

SEQ ID NO: 411038 - RNA, 22 nt, Human
acagaguaucuaucaggaguau

SEQ ID NO: 411039 - RNA, 22 nt, Human
ucacuguauuugcugaugcaua

SEQ ID NO: 411040 - RNA, 22 nt, Human
cuguuuuugugcugugucuccc

SEQ ID NO: 411041 - RNA, 22 nt, Human
cuauuaaacacuacugugcacu

SEQ ID NO: 411042 - RNA, 22 nt, Human
cuggcagcuuccuuugcaucug

SEQ ID NO: 411043 - RNA, 22 nt, Human
gcuucucuggccugcagggcau

SEQ ID NO: 411044 - RNA, 22 nt, Human
guuagggagucagguggcucuu

SEQ ID NO: 411045 - RNA, 22 nt, Human
cagagcugagucuucaagguug

SEQ ID NO: 411046 - RNA, 22 nt, Human
gccagcaguccugcugugugcc

SEQ ID NO: 411047 - RNA, 22 nt, Human
aauuuuauuagaaggcaagggg

SEQ ID NO: 411048 - RNA, 22 nt, Human
aagcagcacaguaauauuggug

SEQ ID NO: 411049 - RNA, 22 nt, Human
aguguuugucccguuagaaaug

SEQ ID NO: 411050 - RNA, 22 nt, Human
uucuguuuugcacagacuugaa

SEQ ID NO: 411051 - RNA, 22 nt, Human
ucaaaguuuuugagaauuacau

SEQ ID NO: 411052 - RNA, 22 nt, Human
accugcaggcacaggugugcgc

SEQ ID NO: 411053 - RNA, 22 nt, Human
ggccucugccucaucugggcac

SEQ ID NO: 411054 - RNA, 22 nt, Human
acucaagauagggaaaguacaa

SEQ ID NO: 411055 - RNA, 22 nt, Human
gaagcccaggcuuccuuggcuu

SEQ ID NO: 411056 - RNA, 22 nt, Human
cagcugccuguauuguccucau

SEQ ID NO: 411057 - RNA, 22 nt, Human
uuuugauaucaugaugaacaga

SEQ ID NO: 411058 - RNA, 22 nt, Human
cugcugcugagagcucagccug

SEQ ID NO: 411059 - RNA, 22 nt, Human
cagcugccccgcuggcugacca

SEQ ID NO: 411060 - RNA, 22 nt, Human
acagagcucccagccaucuccu

SEQ ID NO: 411061 - RNA, 22 nt, Human
guccucagagugggcagguccu

SEQ ID NO: 411062 - RNA, 22 nt, Human
cuggcagcagcuucuggaucga

SEQ ID NO: 411063 - RNA, 22 nt, Human
cauugacaucaggcuuggccaa

SEQ ID NO: 411064 - RNA, 22 nt, Human
cuggcucacuagcccugcccug

SEQ ID NO: 411065 - RNA, 22 nt, Human
caguagcaggcaggugcuuuug

SEQ ID NO: 411066 - RNA, 22 nt, Human
cacaguccagacuccuggaguu

SEQ ID NO: 411067 - RNA, 22 nt, Human
cccucaggagaugucagcugga

SEQ ID NO: 411068 - RNA, 23 nt, Human
uucaaagcuuaagcucuuuccac

SEQ ID NO: 411069 - RNA, 22 nt, Human
aggcagagcugauguucuguga

SEQ ID NO: 411070 - RNA, 22 nt, Human
caaagccauagaguagauaaga

SEQ ID NO: 411071 - RNA, 22 nt, Human
uuggaaggcccugccuagcagg

SEQ ID NO: 411072 - RNA, 22 nt, Human
ggggcuggcucacuaagagacu

SEQ ID NO: 411073 - RNA, 22 nt, Human
cuuguggcccauggcuuccugc

SEQ ID NO: 411074 - RNA, 22 nt, Human
ccaggagccacucaggcccaca

SEQ ID NO: 411075 - RNA, 22 nt, Human
gggaccugccaaggccacccag

SEQ ID NO: 411076 - RNA, 22 nt, Human
aauuucaauuacuuuugcacca

SEQ ID NO: 411077 - RNA, 22 nt, Human
agccuccaucccaugcacaaag

SEQ ID NO: 411078 - RNA, 22 nt, Human
gagacugcauuguccaaggguu

SEQ ID NO: 411079 - RNA, 22 nt, Human
uggcucagccuggcccuuucau

SEQ ID NO: 411080 - RNA, 22 nt, Human
uuuccuucaucaucugagagcu

SEQ ID NO: 411081 - RNA, 22 nt, Human
ccucuggguaucuguggaagua

SEQ ID NO: 411082 - RNA, 22 nt, Human
ccacacagucaguuuccaagaa

SEQ ID NO: 411083 - RNA, 22 nt, Human
auaagguaugaaaaguaaaugg

SEQ ID NO: 411084 - RNA, 22 nt, Human
agggcagcauugccuuucucca

SEQ ID NO: 411085 - RNA, 22 nt, Human
uuauuuacaacucuucucuucc

SEQ ID NO: 411086 - RNA, 18 nt, Human
acccucuggcuucugagc

SEQ ID NO: 411087 - RNA, 22 nt, Human
ugcaggcugggaagagggacaa

SEQ ID NO: 411088 - RNA, 22 nt, Human
cauuagaagaacaguuauauua

SEQ ID NO: 411089 - RNA, 19 nt, Human
aguguguacugaaagcacu

SEQ ID NO: 411090 - RNA, 22 nt, Human
gggcagugguccaggcuacagc

SEQ ID NO: 411091 - RNA, 22 nt, Human
ucauugcacuccagccugggca

SEQ ID NO: 411092 - RNA, 22 nt, Human
ccugccaggacauugcuugaag

SEQ ID NO: 411093 - RNA, 22 nt, Human
aacaaacaaacauuuugucauc

SEQ ID NO: 411094 - RNA, 22 nt, Human
ucaaacuguuuacagugagaua

SEQ ID NO: 411095 - RNA, 22 nt, Human
gagcagcugagcuggaaugaga

SEQ ID NO: 411096 - RNA, 22 nt, Human
cauaauuucuguaucagcacca

SEQ ID NO: 411097 - RNA, 22 nt, Human
cauugacaguucuuuaaguugc

SEQ ID NO: 411098 - RNA, 20 nt, Human
uccucagaagacauuugggg

SEQ ID NO: 411099 - RNA, 22 nt, Human
ugugaccucaucuuaacuggaa

SEQ ID NO: 411100 - RNA, 20 nt, Human
gaaauucucguauuaguuua

SEQ ID NO: 411101 - RNA, 22 nt, Human
ggaggaccccagcagcucccca

SEQ ID NO: 411102 - RNA, 22 nt, Human
uuucacauuuaggcgugaauug

SEQ ID NO: 411103 - RNA, 22 nt, Human
ggucucagcaguugcuuugacu

SEQ ID NO: 411104 - RNA, 22 nt, Human
ucauuuauaaggaugcaauuaa

SEQ ID NO: 411105 - RNA, 22 nt, Human
uagaaacugauagucuugugcu

SEQ ID NO: 411106 - RNA, 22 nt, Human
uuagaaauacaagugagguuga

SEQ ID NO: 411107 - RNA, 22 nt, Human
gccugcagacguguuuuccuca

SEQ ID NO: 411108 - RNA, 22 nt, Human
gacauaauaaucugaccuagau

SEQ ID NO: 411109 - RNA, 22 nt, Human
aggcccugaagucggccccuca

SEQ ID NO: 411110 - RNA, 19 nt, Human
uccucaggggcucacagac

SEQ ID NO: 411111 - RNA, 22 nt, Human
agccagggacgcugcaggcuac

SEQ ID NO: 411112 - RNA, 23 nt, Human
ccucccaccuauuucacuuucuu

SEQ ID NO: 411113 - RNA, 22 nt, Human
agagcuuauaucuuggccaucc

SEQ ID NO: 411114 - RNA, 19 nt, Human
caaggguugggucugucau

SEQ ID NO: 411115 - RNA, 22 nt, Human
ccagagcugcauccagcagguu

SEQ ID NO: 411116 - RNA, 22 nt, Human
agcagcuguggaaaaguaacua

SEQ ID NO: 411117 - RNA, 22 nt, Human
ccagcuccuucugucuguggag

SEQ ID NO: 411118 - RNA, 22 nt, Human
uaaaugcagauuccugagccua

SEQ ID NO: 411119 - RNA, 22 nt, Human
uggccuggaaaaaugcagaugg

SEQ ID NO: 411120 - RNA, 22 nt, Human
auuuugaaaagcauuugaguaa

SEQ ID NO: 411121 - RNA, 22 nt, Human
cagaagaauggugucugagcuc

SEQ ID NO: 411122 - RNA, 21 nt, Human
aauuacagauggaauuacaga

SEQ ID NO: 411123 - RNA, 22 nt, Human
caggacugauguuccuccagcc

SEQ ID NO: 411124 - RNA, 22 nt, Human
ucacauuuucuacuacuguacg

SEQ ID NO: 411125 - RNA, 22 nt, Human
aaaggugacugcagcagcuauu

SEQ ID NO: 411126 - RNA, 19 nt, Human
ccagagagcuagguacaga

SEQ ID NO: 411127 - RNA, 22 nt, Human
caagauggaguccgggaaugug

SEQ ID NO: 411128 - RNA, 22 nt, Human
cucacugugccuuuucccaaac

SEQ ID NO: 411129 - RNA, 22 nt, Human
uuggcuuccaggaucucagcag

SEQ ID NO: 411130 - RNA, 22 nt, Human
agccugcaggaugggcagcacc

SEQ ID NO: 411131 - RNA, 22 nt, Human
aaauaauugaguuggucaauau

SEQ ID NO: 411132 - RNA, 22 nt, Human
ccugucugcaugaucccugcca

SEQ ID NO: 411133 - RNA, 22 nt, Human
cagggcugucuccaaaggcccc

SEQ ID NO: 411134 - RNA, 22 nt, Human
uuguugucauuguagaggauuu

SEQ ID NO: 411135 - RNA, 21 nt, Human
acacugugucauaaugcuuaa

SEQ ID NO: 411136 - RNA, 22 nt, Human
gaggaaccaaaucagcuugcac

SEQ ID NO: 411137 - RNA, 22 nt, Human
ggcacugaaccaggacacaagc

SEQ ID NO: 411138 - RNA, 22 nt, Human
aaaugcacagaggccagagagg

SEQ ID NO: 411139 - RNA, 22 nt, Human
cugagggcccugaagcuuggca

SEQ ID NO: 411140 - RNA, 22 nt, Human
caguccaggccuggaggagcca

SEQ ID NO: 411141 - RNA, 22 nt, Human
uucacagggccacuggcaggag

SEQ ID NO: 411142 - RNA, 22 nt, Human
cuguggcauugugaggacugca

SEQ ID NO: 411143 - RNA, 22 nt, Human
cuuuauguucaguacaaugcuu

SEQ ID NO: 411144 - RNA, 22 nt, Human
gggcugugagaguggggcugcu

SEQ ID NO: 411145 - RNA, 18 nt, Human
ucagcuuuugaaaaccaa

SEQ ID NO: 411146 - RNA, 22 nt, Human
cuggagugauacucagaaugug

SEQ ID NO: 411147 - RNA, 22 nt, Human
auggcagggcagccucucagag

SEQ ID NO: 411148 - RNA, 22 nt, Human
uggcucaguggcagccgcagcu

SEQ ID NO: 411149 - RNA, 22 nt, Human
ggugcagcugcagccugggagc

SEQ ID NO: 411150 - RNA, 22 nt, Human
ggccucuggucaagacaagcau

SEQ ID NO: 411151 - RNA, 22 nt, Human
ucaucacucauuggacaacaga

SEQ ID NO: 411152 - RNA, 18 nt, Human
gcuuuauuucuuggggaa

SEQ ID NO: 411153 - RNA, 22 nt, Human
uccaguggagugugggggugaa

SEQ ID NO: 411154 - RNA, 22 nt, Human
uuuacacaaaagauagcacacc

SEQ ID NO: 411155 - RNA, 22 nt, Human
gagcagcuccagccgcaugacu

SEQ ID NO: 411156 - RNA, 22 nt, Human
uauuuccaagcugaauccaaug

SEQ ID NO: 411157 - RNA, 22 nt, Human
aaaagaggagugguuuaugaca

SEQ ID NO: 411158 - RNA, 22 nt, Human
gaggccaggguaccaucaacau

SEQ ID NO: 411159 - RNA, 22 nt, Human
uuuuccucaggaaugcuaagcu

SEQ ID NO: 411160 - RNA, 22 nt, Human
uuccuguaguugugcaauguac

SEQ ID NO: 411161 - RNA, 22 nt, Human
aguaaugucccuuaaauguggu

SEQ ID NO: 411162 - RNA, 22 nt, Human
aagccaguguuuuugagaguug

SEQ ID NO: 411163 - RNA, 22 nt, Human
agggccugggauguccuccuag

SEQ ID NO: 411164 - RNA, 22 nt, Human
ccaaaggccaagcucagguaaa

SEQ ID NO: 411165 - RNA, 22 nt, Human
ucaauucugguccucaggaacu

SEQ ID NO: 411166 - RNA, 22 nt, Human
uacugugaauacaaaauaaauu

SEQ ID NO: 411167 - RNA, 22 nt, Human
aaauuguugaucuacaguaagg

SEQ ID NO: 411168 - RNA, 22 nt, Human
aaaaacugcaauuacuuuuguc

SEQ ID NO: 411169 - RNA, 22 nt, Human
gccugguguccagaggcgagug

SEQ ID NO: 411170 - RNA, 22 nt, Human
aaagcaaucagauucagauguc

SEQ ID NO: 411171 - RNA, 22 nt, Human
cagauggccagaggcagcugca

SEQ ID NO: 411172 - RNA, 22 nt, Human
ccuucugcuggucaucccagug

SEQ ID NO: 411173 - RNA, 22 nt, Human
ugaaaucuccucuuuauauauc

SEQ ID NO: 411174 - RNA, 18 nt, Human
ggcagcaagaagggaggg

SEQ ID NO: 411175 - RNA, 22 nt, Human
ugcaggugccucuugagcuugu

SEQ ID NO: 411176 - RNA, 22 nt, Human
uagcauuucacugaucuucacu

SEQ ID NO: 411177 - RNA, 22 nt, Human
auguccuucuccucuuaccugc

SEQ ID NO: 411178 - RNA, 22 nt, Human
caggguagacaguaggugucug

SEQ ID NO: 411179 - RNA, 22 nt, Human
acacaggagauauguaauggcu

SEQ ID NO: 411180 - RNA, 22 nt, Human
gagcucagcccaaagagcagug

SEQ ID NO: 411181 - RNA, 22 nt, Human
gaagcccauuuguacagcacau

SEQ ID NO: 411182 - RNA, 22 nt, Human
cagacagaaggcuccuugaggu

SEQ ID NO: 411183 - RNA, 23 nt, Human
uucauuugucuacuucacuuguu

SEQ ID NO: 411184 - RNA, 22 nt, Human
ccaagggaaaccgagaggcugg

SEQ ID NO: 411185 - RNA, 22 nt, Human
gcuguggcuguacagagaccau

SEQ ID NO: 411186 - RNA, 22 nt, Human
cuuguccuuuacuugagacuca

SEQ ID NO: 411187 - RNA, 22 nt, Human
gacagagugcagggcuagaaga

SEQ ID NO: 411188 - RNA, 22 nt, Human
ugugaaggagaugaagggagug

SEQ ID NO: 411189 - RNA, 22 nt, Human
cauuugaugacucaacucauaa

SEQ ID NO: 411190 - RNA, 22 nt, Human
cagggcagccaggccccguggg

SEQ ID NO: 411191 - RNA, 22 nt, Human
cuccauugaacauccucucaga

SEQ ID NO: 411192 - RNA, 22 nt, Human
caaggagaguaauugaaugaga

SEQ ID NO: 411193 - RNA, 22 nt, Human
gcacugaaugccaaaguguagg

SEQ ID NO: 411194 - RNA, 20 nt, Human
aggcugaguucuaugcacuu

SEQ ID NO: 411195 - RNA, 22 nt, Human
ucugccuugagguccucagcuc

SEQ ID NO: 411196 - RNA, 18 nt, Human
augggaggggccaagaga

SEQ ID NO: 411197 - RNA, 22 nt, Human
aauagcuuuggucaccaucugg

SEQ ID NO: 411198 - RNA, 22 nt, Human
augaaacaugagaaauggagag

SEQ ID NO: 411199 - RNA, 22 nt, Human
agggccugacacccuugccagc

SEQ ID NO: 411200 - RNA, 22 nt, Human
acuguacaaccucugccccugu

SEQ ID NO: 411201 - RNA, 22 nt, Human
agggacacaugugauuauuuau

SEQ ID NO: 411202 - RNA, 22 nt, Human
uucauauaaauggaaucagaau

SEQ ID NO: 411203 - RNA, 21 nt, Human
gcccagcaaggugagaaggcc

SEQ ID NO: 411204 - RNA, 22 nt, Human
cauuuguaguuaaaaaugucuc

SEQ ID NO: 411205 - RNA, 22 nt, Human
uugugguuaaccgcacauuuuu

SEQ ID NO: 411206 - RNA, 22 nt, Human
caggaaugacugcagauggggc

SEQ ID NO: 411207 - RNA, 22 nt, Human
caaggccaguuucuccuaguca

SEQ ID NO: 411208 - RNA, 22 nt, Human
gcauaauauacaugcuugaucc

SEQ ID NO: 411209 - RNA, 22 nt, Human
gcagugugaccgagcuugcuuc

SEQ ID NO: 411210 - RNA, 22 nt, Human
aagggcugagcacagugagcca

SEQ ID NO: 411211 - RNA, 22 nt, Human
aucaggaucacagaaacuuuua

SEQ ID NO: 411212 - RNA, 22 nt, Human
gcuuccuucuaccacaucaugc

SEQ ID NO: 411213 - RNA, 23 nt, Human
ucugucacuuucugcuguggagu

SEQ ID NO: 411214 - RNA, 22 nt, Human
uuucaguggguuuauuucaugu

SEQ ID NO: 411215 - RNA, 22 nt, Human
gacuuucucuccucccaggugu

SEQ ID NO: 411216 - RNA, 22 nt, Human
gggcuucucccuaaggacucug

SEQ ID NO: 411217 - RNA, 22 nt, Human
gcagggugugucucauacaguu

SEQ ID NO: 411218 - RNA, 22 nt, Human
ucaguuuucucauuuaugagau

SEQ ID NO: 411219 - RNA, 21 nt, Human
ugagagccuccaaccggcuac

SEQ ID NO: 411220 - RNA, 22 nt, Human
agaaaagggcaggagggauaca

SEQ ID NO: 411221 - RNA, 22 nt, Human
agccagcaggugagugcagccu

SEQ ID NO: 411222 - RNA, 22 nt, Human
ugggaccugaagcagguuggca

SEQ ID NO: 411223 - RNA, 22 nt, Human
aaaguguugggauuacaggugu

SEQ ID NO: 411224 - RNA, 22 nt, Human
aagggaggaggauuuauuguac

SEQ ID NO: 411225 - RNA, 23 nt, Human
agucagagagugugagacaacug

SEQ ID NO: 411226 - RNA, 22 nt, Human
gccugcagccagggaguucucu

SEQ ID NO: 411227 - RNA, 22 nt, Human
ccuggccacucagguguggggc

SEQ ID NO: 411228 - RNA, 22 nt, Human
uugcauguuauuuaaucuguau

SEQ ID NO: 411229 - RNA, 22 nt, Human
gguagcacauugcauuaggaga

SEQ ID NO: 411230 - RNA, 22 nt, Human
ucagaacaauugggaaccauua

SEQ ID NO: 411231 - RNA, 22 nt, Human
ugccaggcauauggccucuuug

SEQ ID NO: 411232 - RNA, 22 nt, Human
aagagcuguaugccauaugauu

SEQ ID NO: 411233 - RNA, 22 nt, Human
gcaaggcuuugugaauuuuaaa

SEQ ID NO: 411234 - RNA, 22 nt, Human
caagcugguaucagcuagagcg

SEQ ID NO: 411235 - RNA, 22 nt, Human
ucucacugauuugagaccaagg

SEQ ID NO: 411236 - RNA, 22 nt, Human
acagcuguauccccagagcuca

SEQ ID NO: 411237 - RNA, 22 nt, Human
ggcucuggucagugaggggccu

SEQ ID NO: 411238 - RNA, 22 nt, Human
ccugcagacacuuguccagcaa

SEQ ID NO: 411239 - RNA, 22 nt, Human
uccuugaaugaauguucucucc

SEQ ID NO: 411240 - RNA, 22 nt, Human
ucuucuuccuccacagggccca

SEQ ID NO: 411241 - RNA, 22 nt, Human
uggcagagcccagaacugagca

SEQ ID NO: 411242 - RNA, 22 nt, Human
aggaguggaauuacuggguucu

SEQ ID NO: 411243 - RNA, 22 nt, Human
gugggcagugguuugcgcgguc

SEQ ID NO: 411244 - RNA, 22 nt, Human
guggggggacguuggucacuuu

SEQ ID NO: 411245 - RNA, 22 nt, Human
augaauacgcggucauacacau

SEQ ID NO: 411246 - RNA, 22 nt, Human
uaugaguacaaggacucugucu

SEQ ID NO: 411247 - RNA, 22 nt, Human
gcagggcagagggagaaucucu

SEQ ID NO: 411248 - RNA, 22 nt, Human
augauuucuauauaaacuuaaa

SEQ ID NO: 411249 - RNA, 22 nt, Human
cucuggaauguuuacaugcccu

SEQ ID NO: 411250 - RNA, 22 nt, Human
aagcuuuaaggaauuuuaugga

SEQ ID NO: 411251 - RNA, 22 nt, Human
ccaucuccacugucccugucaa

SEQ ID NO: 411252 - RNA, 22 nt, Human
ugauuuccucuacuagcaauua

SEQ ID NO: 411253 - RNA, 21 nt, Human
uuuauuuauauaggacacaug

SEQ ID NO: 411254 - RNA, 18 nt, Human
uggcaggaaaugcacuuu

SEQ ID NO: 411255 - RNA, 22 nt, Human
cauggcagugauucagccuuug

SEQ ID NO: 411256 - RNA, 22 nt, Human
gaggagaaauuauccuuggugu

SEQ ID NO: 411257 - RNA, 21 nt, Human
gagugcaggucugaugccauc

SEQ ID NO: 411258 - RNA, 23 nt, Human
auguuauuauuagcagucuugcc

SEQ ID NO: 411259 - RNA, 22 nt, Human
caaagguaguauauauauuguu

SEQ ID NO: 411260 - RNA, 22 nt, Human
agaaaucauucccaaacccaua

SEQ ID NO: 411261 - RNA, 22 nt, Human
aaauuucuguuguuuugagcca

SEQ ID NO: 411262 - RNA, 22 nt, Human
uggcucugcugaaccuagugca

SEQ ID NO: 411263 - RNA, 20 nt, Human
ugcuugucaugcacucaggc

SEQ ID NO: 411264 - RNA, 22 nt, Human
uugcauaaagauuuuauugcau

SEQ ID NO: 411265 - RNA, 21 nt, Human
ccugagggugguugugaagau

SEQ ID NO: 411266 - RNA, 22 nt, Human
uccugcaggcuugaguccucag

SEQ ID NO: 411267 - RNA, 23 nt, Human
cuggcucauccugguugcagugg

SEQ ID NO: 411268 - RNA, 22 nt, Human
ccagggcagcagaauuggggca

SEQ ID NO: 411269 - RNA, 22 nt, Human
aggcuccuaucgcuuucagcaa

SEQ ID NO: 411270 - RNA, 23 nt, Human
uacauuguggauggaguccuggg

SEQ ID NO: 411271 - RNA, 22 nt, Human
uuuucuuauggugaagcacaaa

SEQ ID NO: 411272 - RNA, 22 nt, Human
ccagagucuaugaguccucauu

SEQ ID NO: 411273 - RNA, 22 nt, Human
gaggcagcagaacauggaagag

SEQ ID NO: 411274 - RNA, 22 nt, Human
ucugaggccccugggcaggaug

SEQ ID NO: 411275 - RNA, 22 nt, Human
cuaaaauuaccuaccaguuuag

SEQ ID NO: 411276 - RNA, 22 nt, Human
uaggaaaagcacaggauguucu

SEQ ID NO: 411277 - RNA, 22 nt, Human
ugaaaguugcacauaagagaau

SEQ ID NO: 411278 - RNA, 22 nt, Human
uccucacagucaacacuuugag

SEQ ID NO: 411279 - RNA, 22 nt, Human
gcacugaacuuuaaucauuucu

SEQ ID NO: 411280 - RNA, 22 nt, Human
ggcucuggugcccuggcuccca

SEQ ID NO: 411281 - RNA, 22 nt, Human
cucccuggaggcccagaccugg

SEQ ID NO: 411282 - RNA, 22 nt, Human
caggcugagcucuggccugggc

SEQ ID NO: 411283 - RNA, 22 nt, Human
aaugccucuuggaagaagacuu

SEQ ID NO: 411284 - RNA, 21 nt, Human
ugccagggauuuacagagccu

SEQ ID NO: 411285 - RNA, 22 nt, Human
ccucccacauugaggacaugcu

SEQ ID NO: 411286 - RNA, 22 nt, Human
ggcacugagcugccuuggggca

SEQ ID NO: 411287 - RNA, 22 nt, Human
ugggcagggagcuggaaccaca

SEQ ID NO: 411288 - RNA, 22 nt, Human
gugagggcagcuuggucagugu

SEQ ID NO: 411289 - RNA, 22 nt, Human
aacagcaauagcacuauucauu

SEQ ID NO: 411290 - RNA, 22 nt, Human
cucugagcccgcugcagcccca

SEQ ID NO: 411291 - RNA, 22 nt, Human
auacagaagaacuauagccacu

SEQ ID NO: 411292 - RNA, 22 nt, Human
cucaggagacaguguccacaug

SEQ ID NO: 411293 - RNA, 22 nt, Human
ccagaggaaaaauaucucccua

SEQ ID NO: 411294 - RNA, 22 nt, Human
aguccagggcucucugugggau

SEQ ID NO: 411295 - RNA, 22 nt, Human
ucaggaggccaccaggaccugu

SEQ ID NO: 411296 - RNA, 22 nt, Human
gccagcuggagugagagugggc

SEQ ID NO: 411297 - RNA, 22 nt, Human
ccagcucuuggugcacuuacau

SEQ ID NO: 411298 - RNA, 22 nt, Human
gccuguuggugacuuucuguug

SEQ ID NO: 411299 - RNA, 22 nt, Human
guuuccauggcucuguuaaugg

SEQ ID NO: 411300 - RNA, 22 nt, Human
ugaggaugacgauggcaauggc

SEQ ID NO: 411301 - RNA, 22 nt, Human
ugaagaauguugcagugagcau

SEQ ID NO: 411302 - RNA, 22 nt, Human
aguuacaaccaugacacaagca

SEQ ID NO: 411303 - RNA, 22 nt, Human
cagggugcgccacucagaugua

SEQ ID NO: 411304 - RNA, 22 nt, Human
uggcucagccauucguguugcc

SEQ ID NO: 411305 - RNA, 22 nt, Human
guggcuucuggcugggccucag

SEQ ID NO: 411306 - RNA, 22 nt, Human
caggaagagaacauggaggcug

SEQ ID NO: 411307 - RNA, 22 nt, Human
uuguggcucgugagauguuagg

SEQ ID NO: 411308 - RNA, 19 nt, Human
aggcugcaagguggugggc

SEQ ID NO: 411309 - RNA, 22 nt, Human
ggcuuuaugcacagcagauggu

SEQ ID NO: 411310 - RNA, 22 nt, Human
cccuggaggucagaggccuggg

SEQ ID NO: 411311 - RNA, 22 nt, Human
gaggaaugucagcacaggccuc

SEQ ID NO: 411312 - RNA, 22 nt, Human
guguccagagaaacucacagcu

SEQ ID NO: 411313 - RNA, 22 nt, Human
gccuggagagcacugugcgcuu

SEQ ID NO: 411314 - RNA, 22 nt, Human
cccagcaggucggugcugccug

SEQ ID NO: 411315 - RNA, 22 nt, Human
aagccagggucaggggccuccu

SEQ ID NO: 411316 - RNA, 20 nt, Human
uccugggguaagccaugguc

SEQ ID NO: 411317 - RNA, 22 nt, Human
ccaaagugcugagauuacaggu

SEQ ID NO: 411318 - RNA, 22 nt, Human
uggcagaggaaaaagucacugg

SEQ ID NO: 411319 - RNA, 22 nt, Human
cggagcugccugccaagccugc

SEQ ID NO: 411320 - RNA, 22 nt, Human
aggcuucagaaagaguaauugg

SEQ ID NO: 411321 - RNA, 22 nt, Human
gucccauaaguagugcaacuug

SEQ ID NO: 411322 - RNA, 22 nt, Human
auuguacaugcagugagucauc

SEQ ID NO: 411323 - RNA, 22 nt, Human
cuuaauuuuuguaguagaugga

SEQ ID NO: 411324 - RNA, 22 nt, Human
guagggacaugccauuaucuca

SEQ ID NO: 411325 - RNA, 22 nt, Human
cacauggaagagauacagugag

SEQ ID NO: 411326 - RNA, 22 nt, Human
ucagaagcugguguccuuugaa

SEQ ID NO: 411327 - RNA, 22 nt, Human
ggagccaguuuagaccucaguu

SEQ ID NO: 411328 - RNA, 18 nt, Human
acagggagggcgcugggg

SEQ ID NO: 411329 - RNA, 22 nt, Human
uguaacaguaagccugugagcu

SEQ ID NO: 411330 - RNA, 22 nt, Human
gcaggagcccuggcauguucuu

SEQ ID NO: 411331 - RNA, 22 nt, Human
gccaaaucuggauuuagcaaga

SEQ ID NO: 411332 - RNA, 22 nt, Human
ccagcuccugggucuuagucag

SEQ ID NO: 411333 - RNA, 22 nt, Human
gccauuuucugucuuguuuauu

SEQ ID NO: 411334 - RNA, 22 nt, Human
gcugucuggaggcucugaggga

SEQ ID NO: 411335 - RNA, 22 nt, Human
uuagugucuucuucauccucug

SEQ ID NO: 411336 - RNA, 22 nt, Human
acugcuuuucagagucugccug

SEQ ID NO: 411337 - RNA, 22 nt, Human
caagcuggcugggagaggcacg

SEQ ID NO: 411338 - RNA, 22 nt, Human
auguggaggaaaugaguguaca

SEQ ID NO: 411339 - RNA, 22 nt, Human
aaucuuucccuauuaaaugugg

SEQ ID NO: 411340 - RNA, 22 nt, Human
aggccagguggucaugcuugcu

SEQ ID NO: 411341 - RNA, 22 nt, Human
gaaggccauuuuuagguagaau

SEQ ID NO: 411342 - RNA, 22 nt, Human
ugaaugaugcaguauaaugaua

SEQ ID NO: 411343 - RNA, 22 nt, Human
aaggucauuguugcauguucuc

SEQ ID NO: 411344 - RNA, 22 nt, Human
gucccaggcuuauguggagcuu

SEQ ID NO: 411345 - RNA, 22 nt, Human
uuccucuccucccaccagguga

SEQ ID NO: 411346 - RNA, 22 nt, Human
uaccacuacauuugcuaauggc

SEQ ID NO: 411347 - RNA, 22 nt, Human
ccuggcugugcauugccggccc

SEQ ID NO: 411348 - RNA, 22 nt, Human
cccugcagcuuuugcauaguca

SEQ ID NO: 411349 - RNA, 22 nt, Human
aggcccagggcugcucucugaa

SEQ ID NO: 411350 - RNA, 20 nt, Human
cgcccaggagggcccaugug

SEQ ID NO: 411351 - RNA, 22 nt, Human
uuucagugcuucuguuuaccgg

SEQ ID NO: 411352 - RNA, 22 nt, Human
aaggccaucuacuuacggaauu

SEQ ID NO: 411353 - RNA, 18 nt, Human
cagaaguccuucaaggcc

SEQ ID NO: 411354 - RNA, 22 nt, Human
cuggcagcucugagucccuucu

SEQ ID NO: 411355 - RNA, 22 nt, Human
auggcccaggccuccuguggcu

SEQ ID NO: 411356 - RNA, 22 nt, Human
gcagggaagacccggagcagcg

SEQ ID NO: 411357 - RNA, 21 nt, Human
uugcaccaugauaaauucaga

SEQ ID NO: 411358 - RNA, 22 nt, Human
guagaagugaugucauguuaua

SEQ ID NO: 411359 - RNA, 22 nt, Human
ugaggcucaagaaagauuuguu

SEQ ID NO: 411360 - RNA, 22 nt, Human
cugucuccuccacugcauggga

SEQ ID NO: 411361 - RNA, 22 nt, Human
ugaggccucauuuagggagagg

SEQ ID NO: 411362 - RNA, 22 nt, Human
cucaggaugucggugacuauug

SEQ ID NO: 411363 - RNA, 22 nt, Human
uauuucuggcuuugagggugau

SEQ ID NO: 411364 - RNA, 23 nt, Human
cuggcucuguagguggcauccuu

SEQ ID NO: 411365 - RNA, 22 nt, Human
gcagugaaaaagugcacccugu

SEQ ID NO: 411366 - RNA, 22 nt, Human
caucagcaggcaacacucuugg

SEQ ID NO: 411367 - RNA, 23 nt, Human
ucccuggaggcagguccagggcc

SEQ ID NO: 411368 - RNA, 22 nt, Human
gaaggucaccuccccucucugg

SEQ ID NO: 411369 - RNA, 22 nt, Human
gggcccuggacguggcggcaga

SEQ ID NO: 411370 - RNA, 22 nt, Human
acuuugaaacuaaaauucauua

SEQ ID NO: 411371 - RNA, 22 nt, Human
cugggccuagcaacagaggagu

SEQ ID NO: 411372 - RNA, 22 nt, Human
ugaaggccagggauuugcagcc

SEQ ID NO: 411373 - RNA, 22 nt, Human
accaaggaagagauucucaguu

SEQ ID NO: 411374 - RNA, 22 nt, Human
uucacaaaaaugcugaacaguu

SEQ ID NO: 411375 - RNA, 18 nt, Human
caugggugacagguggau

SEQ ID NO: 411376 - RNA, 21 nt, Human
gcugcaucaaucuacccaggg

SEQ ID NO: 411377 - RNA, 22 nt, Human
auuauaaaccuuugaggguggg

SEQ ID NO: 411378 - RNA, 22 nt, Human
uucacagacuuuccauagauug

SEQ ID NO: 411379 - RNA, 22 nt, Human
gaaaugcauggaucuuggcaga

SEQ ID NO: 411380 - RNA, 22 nt, Human
cagucucucagcuuucagcugu

SEQ ID NO: 411381 - RNA, 22 nt, Human
agcagagucugugugcacuuua

SEQ ID NO: 411382 - RNA, 22 nt, Human
aaugcacauguuguaauaaaua

SEQ ID NO: 411383 - RNA, 22 nt, Human
uccucagaugcucuuggacgcc

SEQ ID NO: 411384 - RNA, 22 nt, Human
cugguuuagcuguaagguuccc

SEQ ID NO: 411385 - RNA, 23 nt, Human
cagggcugggcuugguguuaggc

SEQ ID NO: 411386 - RNA, 22 nt, Human
uguaggaguccaaucaggagac

SEQ ID NO: 411387 - RNA, 22 nt, Human
uggcucagauaauucaaggggc

SEQ ID NO: 411388 - RNA, 22 nt, Human
acagccuggccugaguuaaggc

SEQ ID NO: 411389 - RNA, 22 nt, Human
cucagaaucugccaaguucagg

SEQ ID NO: 411390 - RNA, 22 nt, Human
cacugaaggaaggacuacugca

SEQ ID NO: 411391 - RNA, 22 nt, Human
ggaggaccugcuggcccugcaa

SEQ ID NO: 411392 - RNA, 22 nt, Human
ugcagcuguuacggacccuguc

SEQ ID NO: 411393 - RNA, 18 nt, Human
agcagagcccaugcauuc

SEQ ID NO: 411394 - RNA, 22 nt, Human
uagauuucucauucauagauug

SEQ ID NO: 411395 - RNA, 22 nt, Human
agaggcuccuagccacuggcuu

SEQ ID NO: 411396 - RNA, 22 nt, Human
uccagagcagguggucagaagg

SEQ ID NO: 411397 - RNA, 22 nt, Human
caggccugugaguugaggcccc

SEQ ID NO: 411398 - RNA, 22 nt, Human
ggcuuucuaugaacucaaaggc

SEQ ID NO: 411399 - RNA, 22 nt, Human
acugaaauacugcucuuggauu

SEQ ID NO: 411400 - RNA, 22 nt, Human
auuacacauagacauucguuca

SEQ ID NO: 411401 - RNA, 22 nt, Human
aggagaguucacacuggucaga

SEQ ID NO: 411402 - RNA, 22 nt, Human
ugccugugucacagugauguuu

SEQ ID NO: 411403 - RNA, 22 nt, Human
ugggagcccaagggagcugccg

SEQ ID NO: 411404 - RNA, 22 nt, Human
caaggcugcugcgggucgcacc

SEQ ID NO: 411405 - RNA, 20 nt, Human
uucuuucaucuacacguugu

SEQ ID NO: 411406 - RNA, 21 nt, Human
auucagaaagggaauaaacuc

SEQ ID NO: 411407 - RNA, 22 nt, Human
ugcugccuccaacuccugggcu

SEQ ID NO: 411408 - RNA, 22 nt, Human
gagcuuuaagggauaaaaugau

SEQ ID NO: 411409 - RNA, 22 nt, Human
auggacagugugaagcagauag

SEQ ID NO: 411410 - RNA, 17 nt, Human
gcugagaggcagcacag

SEQ ID NO: 411411 - RNA, 21 nt, Human
ggcagugaugugaagugcauc

SEQ ID NO: 411412 - RNA, 22 nt, Human
gcuaggagauugagcucugaag

SEQ ID NO: 411413 - RNA, 22 nt, Human
cagggagggacaauugucaccu

SEQ ID NO: 411414 - RNA, 22 nt, Human
ugaugcuucacgcugaauaugc

SEQ ID NO: 411415 - RNA, 22 nt, Human
caggcagagucagauuagacuu

SEQ ID NO: 411416 - RNA, 22 nt, Human
cugugcaagacuuacuuuaaua

SEQ ID NO: 411417 - RNA, 22 nt, Human
uuucugaagggcagcagacucu

SEQ ID NO: 411418 - RNA, 22 nt, Human
cccugccuucuuggccuuuaaa

SEQ ID NO: 411419 - RNA, 22 nt, Human
ucccagagugagccaggggcag

SEQ ID NO: 411420 - RNA, 22 nt, Human
cugcucugcaaggcacagugau

SEQ ID NO: 411421 - RNA, 22 nt, Human
gcagccacccucaaggcugaau

SEQ ID NO: 411422 - RNA, 22 nt, Human
gguggccuccagggcauaggug

SEQ ID NO: 411423 - RNA, 21 nt, Human
cacucaggguaugugccaggc

SEQ ID NO: 411424 - RNA, 22 nt, Human
aagggcuccaagagguagcugg

SEQ ID NO: 411425 - RNA, 19 nt, Human
agggccugcagcucaagcu

SEQ ID NO: 411426 - RNA, 22 nt, Human
aucuacagcugucugcacagua

SEQ ID NO: 411427 - RNA, 22 nt, Human
aaaggccaugguuggaguguuu

SEQ ID NO: 411428 - RNA, 23 nt, Human
ugucacauuuaguuggcauuguu

SEQ ID NO: 411429 - RNA, 22 nt, Human
ggcuucucgugccgaagcaaga

SEQ ID NO: 411430 - RNA, 22 nt, Human
cagcacuggggggauucggagc

SEQ ID NO: 411431 - RNA, 22 nt, Human
ucuuccucuagaucugaggccc

SEQ ID NO: 411432 - RNA, 22 nt, Human
ccuggaguuuuuugguugacuc

SEQ ID NO: 411433 - RNA, 22 nt, Human
auuucacucauucauguuacuu

SEQ ID NO: 411434 - RNA, 22 nt, Human
cgagaguggacagggcgcagcu

SEQ ID NO: 411435 - RNA, 22 nt, Human
ugggcuccaauuuguccuuuca

SEQ ID NO: 411436 - RNA, 22 nt, Human
aaguuuaacuugaauucuuucu

SEQ ID NO: 411437 - RNA, 22 nt, Human
ugucucaggcccaagccaguaa

SEQ ID NO: 411438 - RNA, 20 nt, Human
cagggcucugggccuggccu

SEQ ID NO: 411439 - RNA, 20 nt, Human
acaggagaucugaggaaagg

SEQ ID NO: 411440 - RNA, 22 nt, Human
uggaaagaaaaacaggccauga

SEQ ID NO: 411441 - RNA, 22 nt, Human
ccuuggaggacugcugcuucuu

SEQ ID NO: 411442 - RNA, 20 nt, Human
agcaggaaugaugcuuucau

SEQ ID NO: 411443 - RNA, 22 nt, Human
aaacuucauggauaauauaaag

SEQ ID NO: 411444 - RNA, 22 nt, Human
agauacauuaguaguuacuugu

SEQ ID NO: 411445 - RNA, 22 nt, Human
augaggcauucacagaaggcac

SEQ ID NO: 411446 - RNA, 22 nt, Human
acacuguaaauugagugcguga

SEQ ID NO: 411447 - RNA, 22 nt, Human
cacacuagucuauccauuagcu

SEQ ID NO: 411448 - RNA, 22 nt, Human
uuugcauuuguucaaguauuga

SEQ ID NO: 411449 - RNA, 22 nt, Human
acuguacacauucgucaagacu

SEQ ID NO: 411450 - RNA, 22 nt, Human
aaaucaaaagacauguguuuua

SEQ ID NO: 411451 - RNA, 22 nt, Human
uaaggaaaguacauguuuugac

SEQ ID NO: 411452 - RNA, 22 nt, Human
ucuggagcuggagggcaaggca

SEQ ID NO: 411453 - RNA, 22 nt, Human
auguagcaucuauccugauaaa

SEQ ID NO: 411454 - RNA, 22 nt, Human
ucuggagcuuguuucagauggu

SEQ ID NO: 411455 - RNA, 22 nt, Human
ugcuuccagcucucuguaaggu

SEQ ID NO: 411456 - RNA, 22 nt, Human
aagcugccuugcugaggagaaa

SEQ ID NO: 411457 - RNA, 22 nt, Human
aggcuucacgaugggugaggug

SEQ ID NO: 411458 - RNA, 22 nt, Human
uguguauuaccauuuuacagcu

SEQ ID NO: 411459 - RNA, 22 nt, Human
ucuguaucacccguucccagaa

SEQ ID NO: 411460 - RNA, 22 nt, Human
ucccaaggugcucggcaacagg

SEQ ID NO: 411461 - RNA, 22 nt, Human
uguacaaagaguauagcuuuga

SEQ ID NO: 411462 - RNA, 23 nt, Human
gccucugcagccuaguuaguguc

SEQ ID NO: 411463 - RNA, 22 nt, Human
accauuuuggguauuuucagag

SEQ ID NO: 411464 - RNA, 22 nt, Human
gagggcugcuggaaaaaugcag

SEQ ID NO: 411465 - RNA, 19 nt, Human
aggugaugugacucuagaa

SEQ ID NO: 411466 - RNA, 22 nt, Human
agguggggccaaaugcuacagu

SEQ ID NO: 411467 - RNA, 23 nt, Human
ggccuccuggucuaggcuagacu

SEQ ID NO: 411468 - RNA, 22 nt, Human
gggcugaggcuaccacuggucu

SEQ ID NO: 411469 - RNA, 22 nt, Human
gccuucagcggccgcucgcugc

SEQ ID NO: 411470 - RNA, 22 nt, Human
gaagcccagggcguggccgggc

SEQ ID NO: 411471 - RNA, 22 nt, Human
cugagcugaaacuugagaggcu

SEQ ID NO: 411472 - RNA, 20 nt, Human
gacaggagaguuagguaggu

SEQ ID NO: 411473 - RNA, 22 nt, Human
uggggugccgacagggagggca

SEQ ID NO: 411474 - RNA, 22 nt, Human
ccugcccuagagaugacacaau

SEQ ID NO: 411475 - RNA, 22 nt, Human
gaaaagcuaggccaguucagcu

SEQ ID NO: 411476 - RNA, 22 nt, Human
agaacuguccuuggaggagagu

SEQ ID NO: 411477 - RNA, 22 nt, Human
cuggcucaauaaauauuagcug

SEQ ID NO: 411478 - RNA, 21 nt, Human
guagggacagagaguugguga

SEQ ID NO: 411479 - RNA, 22 nt, Human
aguggcaggcggagauguagga

SEQ ID NO: 411480 - RNA, 22 nt, Human
auuccaaagcacaucagaacua

SEQ ID NO: 411481 - RNA, 22 nt, Human
caggaaugaggucguaaguguc

SEQ ID NO: 411482 - RNA, 22 nt, Human
aggcucccaagcacugacccca

SEQ ID NO: 411483 - RNA, 20 nt, Human
cuuagaaauuuuuacccugg

SEQ ID NO: 411484 - RNA, 22 nt, Human
uacaaagucagaauaacaggug

SEQ ID NO: 411485 - RNA, 22 nt, Human
ggugaggggagagugaaagaaa

SEQ ID NO: 411486 - RNA, 22 nt, Human
uaacagaagaaaacauauugga

SEQ ID NO: 411487 - RNA, 22 nt, Human
ugcccaggauugugaggucagg

SEQ ID NO: 411488 - RNA, 22 nt, Human
uccagggagagccgcugcucca

SEQ ID NO: 411489 - RNA, 23 nt, Human
gcugucaguuguuuuugucucua

SEQ ID NO: 411490 - RNA, 22 nt, Human
ucagugaucuaaggguauggcc

SEQ ID NO: 411491 - RNA, 22 nt, Human
aggcuccuuguucaucauccau

SEQ ID NO: 411492 - RNA, 22 nt, Human
ccaggcauccauugcuuccucu

SEQ ID NO: 411493 - RNA, 22 nt, Human
ccagccucacuggcaucaccua

SEQ ID NO: 411494 - RNA, 22 nt, Human
ggaggccaaagugugggcggcu

SEQ ID NO: 411495 - RNA, 22 nt, Human
acauuuaaugauccuacuguga

SEQ ID NO: 411496 - RNA, 22 nt, Human
aggugucuucagggugagacag

SEQ ID NO: 411497 - RNA, 21 nt, Human
acagucuccccagaucucucc

SEQ ID NO: 411498 - RNA, 22 nt, Human
agguacaguagacagacaguua

SEQ ID NO: 411499 - RNA, 22 nt, Human
caggauggucagaugcauuguc

SEQ ID NO: 411500 - RNA, 22 nt, Human
aucugccucuucuucauugcga

SEQ ID NO: 411501 - RNA, 22 nt, Human
gcacacagccagcugagggcua

SEQ ID NO: 411502 - RNA, 22 nt, Human
cuggagccagccagggcccucu

SEQ ID NO: 411503 - RNA, 22 nt, Human
ucacaugcuacugagccagacc

SEQ ID NO: 411504 - RNA, 22 nt, Human
cuguguggccucaagccagccu

SEQ ID NO: 411505 - RNA, 22 nt, Human
uggacagguuugggugccuguu

SEQ ID NO: 411506 - RNA, 22 nt, Human
uuucugcugugcuuucuugcgu

SEQ ID NO: 411507 - RNA, 22 nt, Human
gugggacucuucuuuggcagug

SEQ ID NO: 411508 - RNA, 22 nt, Human
caggccuggggcuggcuuccag

SEQ ID NO: 411509 - RNA, 22 nt, Human
cagccucuuuccacaucaggca

SEQ ID NO: 411510 - RNA, 23 nt, Human
gcucagagguuuuucucuggaug

SEQ ID NO: 411511 - RNA, 22 nt, Human
agggggugcuacuuccagaguu

SEQ ID NO: 411512 - RNA, 22 nt, Human
acaguguucacuuaacaaugga

SEQ ID NO: 411513 - RNA, 22 nt, Human
ucaguuuugaaaacauugaaug

SEQ ID NO: 411514 - RNA, 22 nt, Human
gcugggaggaauuuggggaaua

SEQ ID NO: 411515 - RNA, 22 nt, Human
ccagcuccgggaguugcugcug

SEQ ID NO: 411516 - RNA, 22 nt, Human
gggaggcuggcucuggccacag

SEQ ID NO: 411517 - RNA, 22 nt, Human
gcugggagccguaccugucacg

SEQ ID NO: 411518 - RNA, 22 nt, Human
agugaaaugauaguguaaauac

SEQ ID NO: 411519 - RNA, 22 nt, Human
agcagccaauuggaggaugaag

SEQ ID NO: 411520 - RNA, 22 nt, Human
agagugaaaagcuagagcagua

SEQ ID NO: 411521 - RNA, 22 nt, Human
gcucaggaccgaggggugggaa

SEQ ID NO: 411522 - RNA, 22 nt, Human
agugcacaccuuaguacaaagu

SEQ ID NO: 411523 - RNA, 22 nt, Human
cagaguguugaccauaagccca

SEQ ID NO: 411524 - RNA, 22 nt, Human
aggaaacuccccuacaucucaa

SEQ ID NO: 411525 - RNA, 22 nt, Human
gggaggaaagagaaguggucca

SEQ ID NO: 411526 - RNA, 22 nt, Human
uaugaagacaaugauagcauga

SEQ ID NO: 411527 - RNA, 19 nt, Human
gucacauuugucucccagg

SEQ ID NO: 411528 - RNA, 22 nt, Human
aacagacaacuccuguggcuca

SEQ ID NO: 411529 - RNA, 22 nt, Human
cccaggucugccagccuguggg

SEQ ID NO: 411530 - RNA, 22 nt, Human
ggccucucuccuuggcuugcag

SEQ ID NO: 411531 - RNA, 22 nt, Human
accaggcagcacuuuccuugca

SEQ ID NO: 411532 - RNA, 19 nt, Human
gagguggguccccgcagcc

SEQ ID NO: 411533 - RNA, 22 nt, Human
aaagauuucacaucccaagccu

SEQ ID NO: 411534 - RNA, 22 nt, Human
cuggcuggucaucagcaguacg

SEQ ID NO: 411535 - RNA, 22 nt, Human
ccugcaggcugcaggccaguuc

SEQ ID NO: 411536 - RNA, 22 nt, Human
gugugcagaagacacaagacau

SEQ ID NO: 411537 - RNA, 22 nt, Human
uaggaaaagucuagauugauga

SEQ ID NO: 411538 - RNA, 22 nt, Human
cagcuucuggcguggagccuga

SEQ ID NO: 411539 - RNA, 22 nt, Human
aguacuuugcacuuugcucaga

SEQ ID NO: 411540 - RNA, 22 nt, Human
ucagaacauuuaaaaagugguu

SEQ ID NO: 411541 - RNA, 22 nt, Human
ucagggcacauucugcaguggc

SEQ ID NO: 411542 - RNA, 21 nt, Human
gccacguuucagucuucucag

SEQ ID NO: 411543 - RNA, 22 nt, Human
aaguugaagcaugaaccaaggu

SEQ ID NO: 411544 - RNA, 22 nt, Human
auucuucugccuacuuucaucc

SEQ ID NO: 411545 - RNA, 19 nt, Human
acccagagcccuuugcagg

SEQ ID NO: 411546 - RNA, 22 nt, Human
uuaucauugucgcagucuaauu

SEQ ID NO: 411547 - RNA, 20 nt, Human
cuggguggcaagcaaggggg

SEQ ID NO: 411548 - RNA, 22 nt, Human
cccagacauaacagcagagagg

SEQ ID NO: 411549 - RNA, 22 nt, Human
ccucacugcuauguguuugcuc

SEQ ID NO: 411550 - RNA, 22 nt, Human
gccugccuuuuggaggcacauu

SEQ ID NO: 411551 - RNA, 20 nt, Human
cauuaugguugggcacagug

SEQ ID NO: 411552 - RNA, 22 nt, Human
aaaaucaguacacuuuauuuug

SEQ ID NO: 411553 - RNA, 22 nt, Human
agauuucccucuuguauuugca

SEQ ID NO: 411554 - RNA, 22 nt, Human
aggacucaucccugcuugucag

SEQ ID NO: 411555 - RNA, 22 nt, Human
agcuuuguggcuuugcaagacu

SEQ ID NO: 411556 - RNA, 22 nt, Human
uauucacauguacauaugcuca

SEQ ID NO: 411557 - RNA, 23 nt, Human
ucugucaccuauggcugcucuuc

SEQ ID NO: 411558 - RNA, 22 nt, Human
uucaauucuaaacuaauauucu

SEQ ID NO: 411559 - RNA, 22 nt, Human
ucuguaaucaagauauuugaga

SEQ ID NO: 411560 - RNA, 22 nt, Human
ggcagagcuuguuccuucuguu

SEQ ID NO: 411561 - RNA, 23 nt, Human
ccugcucaggcgugugcccugcu

SEQ ID NO: 411562 - RNA, 18 nt, Human
gcagcugacacuggaguu

SEQ ID NO: 411563 - RNA, 22 nt, Human
ggcugcuggaagacugaacaag

SEQ ID NO: 411564 - RNA, 22 nt, Human
aaugagcugcugcuguuccacc

SEQ ID NO: 411565 - RNA, 22 nt, Human
uugaaagaggcaaaguuugauc

SEQ ID NO: 411566 - RNA, 22 nt, Human
ccugggcaacauagggagaccc

SEQ ID NO: 411567 - RNA, 22 nt, Human
cagagcggccacuagagggcgc

SEQ ID NO: 411568 - RNA, 22 nt, Human
cugcuuccaugcaauggcaguc

SEQ ID NO: 411569 - RNA, 22 nt, Human
aucagaagaaauggaugugacu

SEQ ID NO: 411570 - RNA, 22 nt, Human
cagagcagaaaccugggugauu

SEQ ID NO: 411571 - RNA, 22 nt, Human
gccugcagcugcuuccacacac

SEQ ID NO: 411572 - RNA, 22 nt, Human
gcagggcacacaagaaugauaa

SEQ ID NO: 411573 - RNA, 22 nt, Human
gcuccaggagagggaagcagau

SEQ ID NO: 411574 - RNA, 22 nt, Human
gccuggcuccuaaggacuggcu

SEQ ID NO: 411575 - RNA, 22 nt, Human
gaagccacaacuuuuucuuagc

SEQ ID NO: 411576 - RNA, 18 nt, Human
ggacaucaucaggugcuu

SEQ ID NO: 411577 - RNA, 22 nt, Human
uaaggccagccagcaaaucugu

SEQ ID NO: 411578 - RNA, 22 nt, Human
cuggcagggugggcuuugcuuu

SEQ ID NO: 411579 - RNA, 22 nt, Human
uaugcacaguuacaagaauauc

SEQ ID NO: 411580 - RNA, 22 nt, Human
aagaagaugguuaacuuucagu

SEQ ID NO: 411581 - RNA, 22 nt, Human
cacacaugagucuccccauugg

SEQ ID NO: 411582 - RNA, 19 nt, Human
caggaaugagguaauggcu

SEQ ID NO: 411583 - RNA, 22 nt, Human
ugacagggcuagaggcaaugca

SEQ ID NO: 411584 - RNA, 22 nt, Human
aggagcugacuuguaaagcauu

SEQ ID NO: 411585 - RNA, 22 nt, Human
gagcucccuggagguucagaua

SEQ ID NO: 411586 - RNA, 22 nt, Human
ugaggcagggagaguggauaug

SEQ ID NO: 411587 - RNA, 22 nt, Human
ggugaaggaggaagcugaugga

SEQ ID NO: 411588 - RNA, 22 nt, Human
auugaaagcauggauuuggauu

SEQ ID NO: 411589 - RNA, 22 nt, Human
uagcaggguaaauguagaugga

SEQ ID NO: 411590 - RNA, 17 nt, Human
acaggccugcuugcacu

SEQ ID NO: 411591 - RNA, 22 nt, Human
ucaagagagugcugcuuggggu

SEQ ID NO: 411592 - RNA, 22 nt, Human
gcugagaggcacuaucuccgga

SEQ ID NO: 411593 - RNA, 22 nt, Human
agagugucugguagcugcucug

SEQ ID NO: 411594 - RNA, 22 nt, Human
gcacagcaauuucuauaagcuc

SEQ ID NO: 411595 - RNA, 22 nt, Human
uguggccuugcagccuggaggu

SEQ ID NO: 411596 - RNA, 23 nt, Human
agagccugaaagacuucuggcac

SEQ ID NO: 411597 - RNA, 22 nt, Human
uaguggaguagaaaccaaagaa

SEQ ID NO: 411598 - RNA, 22 nt, Human
acucugugugaguagagccugu

SEQ ID NO: 411599 - RNA, 22 nt, Human
ccaggcagcaaauuuucugaau

SEQ ID NO: 411600 - RNA, 22 nt, Human
cugagaaaggaccucaaacagg

SEQ ID NO: 411601 - RNA, 22 nt, Human
ccauuuguucgcccagcuccaa

SEQ ID NO: 411602 - RNA, 22 nt, Human
uggcucaguuccaucaucugga

SEQ ID NO: 411603 - RNA, 17 nt, Human
agggacagcaguuuagg

SEQ ID NO: 411604 - RNA, 23 nt, Human
caggcaggaugaggacuacacuc

SEQ ID NO: 411605 - RNA, 22 nt, Human
caggcagaugcugacaagaguu

SEQ ID NO: 411606 - RNA, 22 nt, Human
cagugguauuugagagaaugga

SEQ ID NO: 411607 - RNA, 22 nt, Human
cucagaguccauaguuuacagu

SEQ ID NO: 411608 - RNA, 22 nt, Human
augggaggaaggaggcccuuga

SEQ ID NO: 411609 - RNA, 22 nt, Human
ccucuggcaacuucacagccca

SEQ ID NO: 411610 - RNA, 22 nt, Human
cucuggagcauuucaccuacau

SEQ ID NO: 411611 - RNA, 21 nt, Human
gcagcagaggcuugacagaca

SEQ ID NO: 411612 - RNA, 22 nt, Human
ugaaggcccagccacagaaugg

SEQ ID NO: 411613 - RNA, 22 nt, Human
cagggcucuuccggagcaggga

SEQ ID NO: 411614 - RNA, 17 nt, Human
gcuggcugacccaugcc

SEQ ID NO: 411615 - RNA, 22 nt, Human
uggcacugccuggcagggcccc

SEQ ID NO: 411616 - RNA, 22 nt, Human
cugccagguuggcgcucgcucu

SEQ ID NO: 411617 - RNA, 22 nt, Human
uuuauacuccacucugcaagcg

SEQ ID NO: 411618 - RNA, 22 nt, Human
ucaaguguaguggugucagguc

SEQ ID NO: 411619 - RNA, 17 nt, Human
ugcugccaagucccaac

SEQ ID NO: 411620 - RNA, 17 nt, Human
agagagagcaugccacc

SEQ ID NO: 411621 - RNA, 22 nt, Human
ggugccagccuagugcaguggu

SEQ ID NO: 411622 - RNA, 22 nt, Human
aggagagucuugagucacuggu

SEQ ID NO: 411623 - RNA, 22 nt, Human
uacuuuagaaggaaauaaguuc

SEQ ID NO: 411624 - RNA, 22 nt, Human
ucucugggaaugggccugggua

SEQ ID NO: 411625 - RNA, 22 nt, Human
aggccuggcaugagaccugaga

SEQ ID NO: 411626 - RNA, 22 nt, Human
aagagcauggaauggagaucca

SEQ ID NO: 411627 - RNA, 22 nt, Human
aggucaccauggcaugcuccac

SEQ ID NO: 411628 - RNA, 22 nt, Human
cagaagcagugagagaugugca

SEQ ID NO: 411629 - RNA, 22 nt, Human
ucagcaguggcucucaugcagu

SEQ ID NO: 411630 - RNA, 22 nt, Human
cuggaaggcucugcugccuguc

SEQ ID NO: 411631 - RNA, 22 nt, Human
ucaggcaggcagagggcaaaug

SEQ ID NO: 411632 - RNA, 22 nt, Human
auucuguauuucuaauaagauc

SEQ ID NO: 411633 - RNA, 22 nt, Human
ucauucagguugggcaaguguc

SEQ ID NO: 411634 - RNA, 22 nt, Human
uacaaagccugguagauaucug

SEQ ID NO: 411635 - RNA, 22 nt, Human
gaaagaagcuuuagauggcuau

SEQ ID NO: 411636 - RNA, 21 nt, Human
acaugcauagagagauuucug

SEQ ID NO: 411637 - RNA, 23 nt, Human
ucacagggcacuggcugggguug

SEQ ID NO: 411638 - RNA, 22 nt, Human
acccaggguagaaccucagagc

SEQ ID NO: 411639 - RNA, 22 nt, Human
agggagaaaauuggaugcacaa

SEQ ID NO: 411640 - RNA, 22 nt, Human
auggccuggccagagcucugcu

SEQ ID NO: 411641 - RNA, 22 nt, Human
gggcagggguagcauuccaagu

SEQ ID NO: 411642 - RNA, 22 nt, Human
uggcgugcccuccagacuuggc

SEQ ID NO: 411643 - RNA, 22 nt, Human
gggcugcugcugccagcgacac

SEQ ID NO: 411644 - RNA, 22 nt, Human
agcugucuuucugccuccugau

SEQ ID NO: 411645 - RNA, 22 nt, Human
cagcaauauacacagucuaugg

SEQ ID NO: 411646 - RNA, 21 nt, Human
ggacaccagucacacuggauu

SEQ ID NO: 411647 - RNA, 22 nt, Human
guacuuccguggacuaauuguu

SEQ ID NO: 411648 - RNA, 22 nt, Human
ccacagagagugucagccuuug

SEQ ID NO: 411649 - RNA, 22 nt, Human
cugcagagcaaguaacauccuc

SEQ ID NO: 411650 - RNA, 22 nt, Human
ucuucagagugaaagucuguga

SEQ ID NO: 411651 - RNA, 22 nt, Human
caggcagccaggggaccugucc

SEQ ID NO: 411652 - RNA, 21 nt, Human
uucuuuccccagaggacuaaa

SEQ ID NO: 411653 - RNA, 22 nt, Human
cccagcagccagaaugaggagc

SEQ ID NO: 411654 - RNA, 22 nt, Human
uguaugugcuugagaagguggg

SEQ ID NO: 411655 - RNA, 22 nt, Human
caguucaggccggcugacucag

SEQ ID NO: 411656 - RNA, 22 nt, Human
uggcagcuguguccagguagaa

SEQ ID NO: 411657 - RNA, 22 nt, Human
uuuguuaauucuuauguuagag

SEQ ID NO: 411658 - RNA, 22 nt, Human
gagccugaugaaacaggcagac

SEQ ID NO: 411659 - RNA, 22 nt, Human
uccaggagguagugcuuaauuu

SEQ ID NO: 411660 - RNA, 20 nt, Human
aauguauuguuuuguuucag

SEQ ID NO: 411661 - RNA, 23 nt, Human
cacugcagcguggucuggcagga

SEQ ID NO: 411662 - RNA, 22 nt, Human
cccuucucuuucacucacuauu

SEQ ID NO: 411663 - RNA, 21 nt, Human
agaugaggauacugaggccua

SEQ ID NO: 411664 - RNA, 22 nt, Human
acaguuugcccugacauucucc

SEQ ID NO: 411665 - RNA, 21 nt, Human
aaauuucugcaagccucaacu

SEQ ID NO: 411666 - RNA, 22 nt, Human
cagccuccugggacacucaccg

SEQ ID NO: 411667 - RNA, 22 nt, Human
gcagcugagagaagaacagggc

SEQ ID NO: 411668 - RNA, 22 nt, Human
caguuaaaggcccaauaucugg

SEQ ID NO: 411669 - RNA, 22 nt, Human
agggggcaggagagaccugcug

SEQ ID NO: 411670 - RNA, 22 nt, Human
cacucaggcugugucaggagga

SEQ ID NO: 411671 - RNA, 22 nt, Human
ugcuucuggaaacaguggcugu

SEQ ID NO: 411672 - RNA, 22 nt, Human
ccugccugcuuucugcuuugca

SEQ ID NO: 411673 - RNA, 22 nt, Human
ucugagcuacgaugccugucac

SEQ ID NO: 411674 - RNA, 22 nt, Human
gcauuccuacaggcugcuauga

SEQ ID NO: 411675 - RNA, 19 nt, Human
ucucuggggacacuuucac

SEQ ID NO: 411676 - RNA, 17 nt, Human
acaagcaguggccaugg

SEQ ID NO: 411677 - RNA, 22 nt, Human
cuggcagcauggagccugugcu

SEQ ID NO: 411678 - RNA, 22 nt, Human
caggcugaggcaguaggguuug

SEQ ID NO: 411679 - RNA, 22 nt, Human
auaguauuuaauaguuagcuca

SEQ ID NO: 411680 - RNA, 22 nt, Human
acuguguggaaauuugugaggg

SEQ ID NO: 411681 - RNA, 22 nt, Human
auucuggauuaucaguccacca

SEQ ID NO: 411682 - RNA, 22 nt, Human
gagcagcugguaggugaaccca

SEQ ID NO: 411683 - RNA, 22 nt, Human
ccuggcaguggugaagaagagg

SEQ ID NO: 411684 - RNA, 22 nt, Human
agucccagacuccaguuuucug

SEQ ID NO: 411685 - RNA, 22 nt, Human
gcagagcagugcuugcccagcg

SEQ ID NO: 411686 - RNA, 18 nt, Human
gacccagcagaugggcuu

SEQ ID NO: 411687 - RNA, 22 nt, Human
cagucucuaaaucaaucugaau

SEQ ID NO: 411688 - RNA, 22 nt, Human
gccuccugaaaggaagagcucc

SEQ ID NO: 411689 - RNA, 22 nt, Human
cuccaggccauggcugcggagg

SEQ ID NO: 411690 - RNA, 22 nt, Human
gugggcagacagugcuuugcag

SEQ ID NO: 411691 - RNA, 22 nt, Human
ccugagggaaggaugcuaccca

SEQ ID NO: 411692 - RNA, 22 nt, Human
ucaggugguccuaagugccauc

SEQ ID NO: 411693 - RNA, 22 nt, Human
ggccagagaauaugccuuacgu

SEQ ID NO: 411694 - RNA, 22 nt, Human
gggcuggagccagcuguggcug

SEQ ID NO: 411695 - RNA, 22 nt, Human
gcaggcaggagcccaacugccu

SEQ ID NO: 411696 - RNA, 22 nt, Human
gacacagcacuguacaaggaau

SEQ ID NO: 411697 - RNA, 22 nt, Human
aaauagcacagcagcugaggcu

SEQ ID NO: 411698 - RNA, 22 nt, Human
uccacagaauguaagauccaca

SEQ ID NO: 411699 - RNA, 22 nt, Human
acccagcuggaugcauggaggc

SEQ ID NO: 411700 - RNA, 22 nt, Human
gggcugaccaaugccuugcuuu

SEQ ID NO: 411701 - RNA, 22 nt, Human
uggcuuccgccgcgggccucgg

SEQ ID NO: 411702 - RNA, 20 nt, Human
ugaaggccagcagcauaggg

SEQ ID NO: 411703 - RNA, 22 nt, Human
ugggccugacucaccugccucc

SEQ ID NO: 411704 - RNA, 22 nt, Human
ugauuuccuggcuuuggaguuc

SEQ ID NO: 411705 - RNA, 22 nt, Human
ucucugguuauuaacuaacucc

SEQ ID NO: 411706 - RNA, 22 nt, Human
cuuauguauaauguuccacaua

SEQ ID NO: 411707 - RNA, 22 nt, Human
uggcugagcugcagcguggcuu

SEQ ID NO: 411708 - RNA, 22 nt, Human
ccuggugcuuaccagagcuuuu

SEQ ID NO: 411709 - RNA, 22 nt, Human
uguguacaagaguguuuacugu

SEQ ID NO: 411710 - RNA, 22 nt, Human
gguguccaucaggcugugcuuc

SEQ ID NO: 411711 - RNA, 22 nt, Human
guccucugggcagcugccccac

SEQ ID NO: 411712 - RNA, 22 nt, Human
accucaggauguggacacagaa

SEQ ID NO: 411713 - RNA, 22 nt, Human
ggcacagggaggcccuggugug

SEQ ID NO: 411714 - RNA, 22 nt, Human
cagucacuggaauagcugagga

SEQ ID NO: 411715 - RNA, 22 nt, Human
ucaggcugaaucauccuagcuu

SEQ ID NO: 411716 - RNA, 22 nt, Human
aauuuagaauucgcuagcuaau

SEQ ID NO: 411717 - RNA, 22 nt, Human
ggcuggcuggcugguagacaag

SEQ ID NO: 411718 - RNA, 22 nt, Human
uucuuucccagaagauauguuu

SEQ ID NO: 411719 - RNA, 18 nt, Human
uaaaugcauguuaauaac

SEQ ID NO: 411720 - RNA, 22 nt, Human
gaguccaguaguuaggacagag

SEQ ID NO: 411721 - RNA, 22 nt, Human
aggagucaggaccaaauggaaa

SEQ ID NO: 411722 - RNA, 21 nt, Human
ugggagagggcucagcuaccc

SEQ ID NO: 411723 - RNA, 22 nt, Human
acaaagucacaauaauuaaccu

SEQ ID NO: 411724 - RNA, 22 nt, Human
cagagccagcccacuguucccg

SEQ ID NO: 411725 - RNA, 22 nt, Human
auaauacaugguugaucuuuuc

SEQ ID NO: 411726 - RNA, 22 nt, Human
ucccaggauguuggcggcaggu

SEQ ID NO: 411727 - RNA, 22 nt, Human
cuccaggggccagaagccuggc

SEQ ID NO: 411728 - RNA, 22 nt, Human
gaggccuggaauuccagccugg

SEQ ID NO: 411729 - RNA, 22 nt, Human
aggcaccuugagagcaggagcu

SEQ ID NO: 411730 - RNA, 22 nt, Human
gaggcaguuugccaugccagga

SEQ ID NO: 411731 - RNA, 22 nt, Human
agcaugcacaugacuggcuuaa

SEQ ID NO: 411732 - RNA, 22 nt, Human
augcuauacucaaagaaauuca

SEQ ID NO: 411733 - RNA, 19 nt, Human
agacucugccacucuucuc

SEQ ID NO: 411734 - RNA, 22 nt, Human
gccacccugagcugggccaggg

SEQ ID NO: 411735 - RNA, 22 nt, Human
ccagggaggguccuguggcuuc

SEQ ID NO: 411736 - RNA, 19 nt, Human
ugcagccacgugagagacu

SEQ ID NO: 411737 - RNA, 22 nt, Human
cuuauguauauuuggaacguac

SEQ ID NO: 411738 - RNA, 22 nt, Human
gcugagcugggacaguccuggg

SEQ ID NO: 411739 - RNA, 22 nt, Human
acugggccuugccauggcagcc

SEQ ID NO: 411740 - RNA, 22 nt, Human
gcauccagagguagccacugug

SEQ ID NO: 411741 - RNA, 22 nt, Human
uaagcugugggagauuggcaua

SEQ ID NO: 411742 - RNA, 22 nt, Human
agugaguggguuacagauggga

SEQ ID NO: 411743 - RNA, 22 nt, Human
ugaggccugcuuggaauugaau

SEQ ID NO: 411744 - RNA, 22 nt, Human
agugcaaaauucagaagcaauu

SEQ ID NO: 411745 - RNA, 23 nt, Human
ucugagagaacaaugccuccuau

SEQ ID NO: 411746 - RNA, 18 nt, Human
cagaugagaugcaaucuc

SEQ ID NO: 411747 - RNA, 23 nt, Human
cccuggagcuagucugagcagag

SEQ ID NO: 411748 - RNA, 20 nt, Human
agcccuguuuccuggagaga

SEQ ID NO: 411749 - RNA, 22 nt, Human
gacccuggaguuaguccugugu

SEQ ID NO: 411750 - RNA, 22 nt, Human
caauuucuuguuaauucucagg

SEQ ID NO: 411751 - RNA, 22 nt, Human
uguagaaagaauauguuucaua

SEQ ID NO: 411752 - RNA, 22 nt, Human
cagugccucuuaagugucaccc

SEQ ID NO: 411753 - RNA, 22 nt, Human
ugcagugugaccuguagcgagc

SEQ ID NO: 411754 - RNA, 22 nt, Human
ugccucugugugcaggugagca

SEQ ID NO: 411755 - RNA, 22 nt, Human
aggcagaugguaacugugauau

SEQ ID NO: 411756 - RNA, 22 nt, Human
uaguaacagauuuauacagucu

SEQ ID NO: 411757 - RNA, 22 nt, Human
auguuuaaaggguugagaaaua

SEQ ID NO: 411758 - RNA, 20 nt, Human
accucugcaucaauccuuug

SEQ ID NO: 411759 - RNA, 22 nt, Human
gcuguggcuugcagcuggggcu

SEQ ID NO: 411760 - RNA, 22 nt, Human
uucuguguggguagcuccuguu

SEQ ID NO: 411761 - RNA, 22 nt, Human
ggggaaggauugaguugaccca

SEQ ID NO: 411762 - RNA, 18 nt, Human
gucauugcaacauacugu

SEQ ID NO: 411763 - RNA, 22 nt, Human
ccagggcauccucacaucgcag

SEQ ID NO: 411764 - RNA, 22 nt, Human
cugccucucagccugaccgcca

SEQ ID NO: 411765 - RNA, 22 nt, Human
cagaaguaagauuacugugagu

SEQ ID NO: 411766 - RNA, 22 nt, Human
caccagcuuugcccacugccca

SEQ ID NO: 411767 - RNA, 22 nt, Human
caggaguggugugagggacucc

SEQ ID NO: 411768 - RNA, 22 nt, Human
ugccugucucugacugccauua

SEQ ID NO: 411769 - RNA, 22 nt, Human
uugaaagggauauaucuuucug

SEQ ID NO: 411770 - RNA, 22 nt, Human
ggcaccuggagguuuacuggau

SEQ ID NO: 411771 - RNA, 22 nt, Human
agggccaguaccaggugggugg

SEQ ID NO: 411772 - RNA, 22 nt, Human
uagcugucagcaaucaaguggu

SEQ ID NO: 411773 - RNA, 22 nt, Human
acaguuucuccauuuacaccuu

SEQ ID NO: 411774 - RNA, 22 nt, Human
uguguuuuacaaauucucuuaa

SEQ ID NO: 411775 - RNA, 22 nt, Human
gaggccuggguuggaggugcau

SEQ ID NO: 411776 - RNA, 22 nt, Human
ugccaaggagcuggaucagggc

SEQ ID NO: 411777 - RNA, 22 nt, Human
caggccugggcuucggggcuga

SEQ ID NO: 411778 - RNA, 22 nt, Human
cacuuggaggaaggccuauuca

SEQ ID NO: 411779 - RNA, 23 nt, Human
uggcucugagagguucagaugcu

SEQ ID NO: 411780 - RNA, 22 nt, Human
caguguggcugagacagaggcu

SEQ ID NO: 411781 - RNA, 22 nt, Human
gucaaguuaagauaaggucaug

SEQ ID NO: 411782 - RNA, 22 nt, Human
ugcacagagagaugagacacgu

SEQ ID NO: 411783 - RNA, 22 nt, Human
uuuuugcaccaaccuaauagaa

SEQ ID NO: 411784 - RNA, 22 nt, Human
guggcucucgccagccugcggg

SEQ ID NO: 411785 - RNA, 22 nt, Human
uucuuacagcccuauuacuaaa

SEQ ID NO: 411786 - RNA, 22 nt, Human
uacauguuauuucacuauuggu

SEQ ID NO: 411787 - RNA, 19 nt, Human
gcuuuuuguugucaaaggu

SEQ ID NO: 411788 - RNA, 22 nt, Human
uguuuauaccuugguauaacca

SEQ ID NO: 411789 - RNA, 22 nt, Human
ucauuuguggaagugauugugg

SEQ ID NO: 411790 - RNA, 22 nt, Human
gagguucacaggcuaucacagu

SEQ ID NO: 411791 - RNA, 19 nt, Human
uggggcuguguuuugaccc

SEQ ID NO: 411792 - RNA, 22 nt, Human
cagccuucugaaugaacguacu

SEQ ID NO: 411793 - RNA, 22 nt, Human
guggccuggaugagcuucgaca

SEQ ID NO: 411794 - RNA, 22 nt, Human
ccagucccaucucugucgcuua

SEQ ID NO: 411795 - RNA, 22 nt, Human
cacaccagagguuaccugcaaa

SEQ ID NO: 411796 - RNA, 22 nt, Human
aaugcacagcuaaagugguucc

SEQ ID NO: 411797 - RNA, 22 nt, Human
agggucugacugaauggaaaag

SEQ ID NO: 411798 - RNA, 22 nt, Human
cugucauuuaagacauucugga

SEQ ID NO: 411799 - RNA, 22 nt, Human
aauguguauacuggcaauuaag

SEQ ID NO: 411800 - RNA, 22 nt, Human
ucucacugcaaauauuauguau

SEQ ID NO: 411801 - RNA, 22 nt, Human
gaggccugcagcguggucccug

SEQ ID NO: 411802 - RNA, 20 nt, Human
ccuccaggcacacccaugug

SEQ ID NO: 411803 - RNA, 22 nt, Human
ugccaggcuuuggucaaaggcu

SEQ ID NO: 411804 - RNA, 21 nt, Human
gcagccacugccuucaacaau

SEQ ID NO: 411805 - RNA, 22 nt, Human
ccuuagagaguacugggcugcc

SEQ ID NO: 411806 - RNA, 22 nt, Human
aucuggcuuuuacugaauugcu

SEQ ID NO: 411807 - RNA, 22 nt, Human
ggcugaaacagauuucaagaca

SEQ ID NO: 411808 - RNA, 22 nt, Human
cucucuggcuuggcacggagau

SEQ ID NO: 411809 - RNA, 22 nt, Human
ggagcugugcagugacuacaga

SEQ ID NO: 411810 - RNA, 22 nt, Human
gaggcugaauggccagaagcca

SEQ ID NO: 411811 - RNA, 22 nt, Human
uggcaggaaaguaacagagcac

SEQ ID NO: 411812 - RNA, 22 nt, Human
ucugccugaaauucacauguaa

SEQ ID NO: 411813 - RNA, 22 nt, Human
cugaggcugaagagggccuacg

SEQ ID NO: 411814 - RNA, 22 nt, Human
gcuguacauuuguguacacuug

SEQ ID NO: 411815 - RNA, 22 nt, Human
cugcagccucaaccuccugagc

SEQ ID NO: 411816 - RNA, 22 nt, Human
agcugguaugaacaggauagga

SEQ ID NO: 411817 - RNA, 22 nt, Human
guuaauuugcagcuuucgagcu

SEQ ID NO: 411818 - RNA, 23 nt, Human
cuggaagugcuuuuauagcuuug

SEQ ID NO: 411819 - RNA, 22 nt, Human
ugcugccauggucgcugguguc

SEQ ID NO: 411820 - RNA, 22 nt, Human
auuauguaacugugguucagca

SEQ ID NO: 411821 - RNA, 19 nt, Human
agaggcagucuccaacagg

SEQ ID NO: 411822 - RNA, 22 nt, Human
gugcucacugugagacguccug

SEQ ID NO: 411823 - RNA, 22 nt, Human
aggacaggauugagcugaacug

SEQ ID NO: 411824 - RNA, 22 nt, Human
uuugaaaguguuuacuugggaa

SEQ ID NO: 411825 - RNA, 22 nt, Human
ugagcuuacgugggaacagacu

SEQ ID NO: 411826 - RNA, 22 nt, Human
cggcagagcccugagucagccu

SEQ ID NO: 411827 - RNA, 22 nt, Human
uauuugaaaguguacaaaaacu

SEQ ID NO: 411828 - RNA, 22 nt, Human
ugaagcaguuacuggguguuaa

SEQ ID NO: 411829 - RNA, 22 nt, Human
acacacacaagcagguugugga

SEQ ID NO: 411830 - RNA, 22 nt, Human
ccagcuuucauaucaugaggua

SEQ ID NO: 411831 - RNA, 22 nt, Human
cagugcagucaaggaagaacca

SEQ ID NO: 411832 - RNA, 22 nt, Human
ggggaugguagaccggugacgu

SEQ ID NO: 411833 - RNA, 22 nt, Human
caggccagugugcuucccaggc

SEQ ID NO: 411834 - RNA, 22 nt, Human
gaggaggaggaaguggaaccca

SEQ ID NO: 411835 - RNA, 22 nt, Human
gcagggcugggugggagacaga

SEQ ID NO: 411836 - RNA, 22 nt, Human
guggcccucugauagggucagg

SEQ ID NO: 411837 - RNA, 22 nt, Human
gucccagaggacagggucacau

SEQ ID NO: 411838 - RNA, 22 nt, Human
cugggcacaaguggcccuggau

SEQ ID NO: 411839 - RNA, 22 nt, Human
uccuucagcucucuauuuagau

SEQ ID NO: 411840 - RNA, 22 nt, Human
uuugacaguaauaaagcacaag

SEQ ID NO: 411841 - RNA, 22 nt, Human
ccagggcuggguuugucggugu

SEQ ID NO: 411842 - RNA, 22 nt, Human
gggauggggucaacauguaccu

SEQ ID NO: 411843 - RNA, 19 nt, Human
ugagcaugcgagcugagaa

SEQ ID NO: 411844 - RNA, 22 nt, Human
ggguacaaagauuucauaagau

SEQ ID NO: 411845 - RNA, 22 nt, Human
agaucacaguggcaacucccuu

SEQ ID NO: 411846 - RNA, 22 nt, Human
auguuacagaaagcaaagauga

SEQ ID NO: 411847 - RNA, 22 nt, Human
ugggcugccagcucuccagaug

SEQ ID NO: 411848 - RNA, 22 nt, Human
guguaaggugaaaucaacaaau

SEQ ID NO: 411849 - RNA, 22 nt, Human
aaaguuucaauagaggaagugg

SEQ ID NO: 411850 - RNA, 22 nt, Human
uccugagauaaaucucauguga

SEQ ID NO: 411851 - RNA, 22 nt, Human
aggcagcagagguugaggaaag

SEQ ID NO: 411852 - RNA, 22 nt, Human
acagagcaugcucaguguguga

SEQ ID NO: 411853 - RNA, 22 nt, Human
gguggccucgguggugcacagg

SEQ ID NO: 411854 - RNA, 22 nt, Human
cccaggcugauguucagcgggu

SEQ ID NO: 411855 - RNA, 22 nt, Human
cagggccagccauccugcuggg

SEQ ID NO: 411856 - RNA, 23 nt, Human
cagcuuucagggcuuuagggaag

SEQ ID NO: 411857 - RNA, 22 nt, Human
ugugccuggcauucugggcuuc

SEQ ID NO: 411858 - RNA, 22 nt, Human
uggcucucaggccugcugcguu

SEQ ID NO: 411859 - RNA, 23 nt, Human
cugcagccgcguggggacgugga

SEQ ID NO: 411860 - RNA, 22 nt, Human
gccuggagggucccucucugga

SEQ ID NO: 411861 - RNA, 22 nt, Human
aggagcugcuuaaaugguuggu

SEQ ID NO: 411862 - RNA, 22 nt, Human
aggaagccaugguggacgucua

SEQ ID NO: 411863 - RNA, 22 nt, Human
cugagauggaguuuugcucuug

SEQ ID NO: 411864 - RNA, 22 nt, Human
cuccucugucuaccacgagggu

SEQ ID NO: 411865 - RNA, 22 nt, Human
caaaggcuuugcuaugaugcau

SEQ ID NO: 411866 - RNA, 22 nt, Human
gccaggcuggcaaaaggaaacc

SEQ ID NO: 411867 - RNA, 19 nt, Human
ccagagcccgccagauggg

SEQ ID NO: 411868 - RNA, 22 nt, Human
cccuggaguccuggcaguugau

SEQ ID NO: 411869 - RNA, 22 nt, Human
caaaguccuagaacagugcuug

SEQ ID NO: 411870 - RNA, 22 nt, Human
auccaaaucaugucagaagaac

SEQ ID NO: 411871 - RNA, 22 nt, Human
uuaaugcuugucuagaucuucu

SEQ ID NO: 411872 - RNA, 22 nt, Human
cugagggcaugaacauuccaua

SEQ ID NO: 411873 - RNA, 22 nt, Human
ugucacauugaauaugauuuau

SEQ ID NO: 411874 - RNA, 22 nt, Human
gggaaccagccgcuuccgccuc

SEQ ID NO: 411875 - RNA, 22 nt, Human
accagagcagacuacuggaggu

SEQ ID NO: 411876 - RNA, 22 nt, Human
caggaaagggaugggcugccac

SEQ ID NO: 411877 - RNA, 22 nt, Human
uggcagggccugcucaucaucc

SEQ ID NO: 411878 - RNA, 22 nt, Human
aaaggccaagcaugagguggac

SEQ ID NO: 411879 - RNA, 22 nt, Human
ggugugccuggggcuuagcugc

SEQ ID NO: 411880 - RNA, 22 nt, Human
gggcugagagcuggaaucugag

SEQ ID NO: 411881 - RNA, 22 nt, Human
caggauagaaaggccauggagu

SEQ ID NO: 411882 - RNA, 19 nt, Human
cuccucagucccagagguc

SEQ ID NO: 411883 - RNA, 22 nt, Human
ccuagaugggauggcggccggg

SEQ ID NO: 411884 - RNA, 22 nt, Human
gccuguguggaugcgccggugc

SEQ ID NO: 411885 - RNA, 21 nt, Human
uaaaugugagcagggcugggc

SEQ ID NO: 411886 - RNA, 22 nt, Human
cugcccugucugcagccuggcu

SEQ ID NO: 411887 - RNA, 22 nt, Human
uaaucacaucaggguaaauggg

SEQ ID NO: 411888 - RNA, 22 nt, Human
aagugacaccucuucccuuucc

SEQ ID NO: 411889 - RNA, 22 nt, Human
gcagagugagccgaggcugcuc

SEQ ID NO: 411890 - RNA, 22 nt, Human
ucaguauccacaaaugcucaaa

SEQ ID NO: 411891 - RNA, 21 nt, Human
ccuucucuugcuucagcuuca

SEQ ID NO: 411892 - RNA, 22 nt, Human
uggaaagaauuccuaugguuca

SEQ ID NO: 411893 - RNA, 22 nt, Human
ccucugagagaaggccuucagc

SEQ ID NO: 411894 - RNA, 22 nt, Human
uugcugaagugaagguauguuu

SEQ ID NO: 411895 - RNA, 21 nt, Human
cagcuucuucugugaccuggu

SEQ ID NO: 411896 - RNA, 22 nt, Human
ccagugcaggugagcaccaggu

SEQ ID NO: 411897 - RNA, 22 nt, Human
uggcaggguuggccaccuuacc

SEQ ID NO: 411898 - RNA, 20 nt, Human
aggaaaaauggaaacuggag

SEQ ID NO: 411899 - RNA, 22 nt, Human
ugaaaucuuuaguuucuguccc

SEQ ID NO: 411900 - RNA, 22 nt, Human
ggcagcugugaagugccucaca

SEQ ID NO: 411901 - RNA, 22 nt, Human
cugaaggagaaggccacuguuc

SEQ ID NO: 411902 - RNA, 22 nt, Human
cuccagggagcuguggagguuu

SEQ ID NO: 411903 - RNA, 22 nt, Human
ccaguggccaugcacgagcagc

SEQ ID NO: 411904 - RNA, 22 nt, Human
ccucugggugggaggccgggcg

SEQ ID NO: 411905 - RNA, 22 nt, Human
ucaggagcuugguagugugauu

SEQ ID NO: 411906 - RNA, 22 nt, Human
agagggcauuaacucugucuug

SEQ ID NO: 411907 - RNA, 20 nt, Human
uggggccuguuucugugguu

SEQ ID NO: 411908 - RNA, 22 nt, Human
aggcagcauuugaauccagguc

SEQ ID NO: 411909 - RNA, 22 nt, Human
ccuguguguaggccaggggagu

SEQ ID NO: 411910 - RNA, 22 nt, Human
gggugaagcuccugcaggggcc

SEQ ID NO: 411911 - RNA, 22 nt, Human
uagggcagauucgguggaguuu

SEQ ID NO: 411912 - RNA, 22 nt, Human
uguauagaguuggaagaugacu

SEQ ID NO: 411913 - RNA, 22 nt, Human
cugaaaauguuacacaggaaga

SEQ ID NO: 411914 - RNA, 22 nt, Human
gccaagagaaugugagagaaau

SEQ ID NO: 411915 - RNA, 22 nt, Human
aguguuccuugcuuucccagag

SEQ ID NO: 411916 - RNA, 22 nt, Human
aagggcuccacuugaaucacac

SEQ ID NO: 411917 - RNA, 22 nt, Human
uccagccuaauguucuucccac

SEQ ID NO: 411918 - RNA, 22 nt, Human
auucuccacacauccagaccuu

SEQ ID NO: 411919 - RNA, 23 nt, Human
uggcccugugcaugcugcuuccc

SEQ ID NO: 411920 - RNA, 22 nt, Human
ugaagcagcuucuuucugucaa

SEQ ID NO: 411921 - RNA, 22 nt, Human
uauuuguauuucaugcaguaaa

SEQ ID NO: 411922 - RNA, 22 nt, Human
cuggcagcgugagcagcaucca

SEQ ID NO: 411923 - RNA, 22 nt, Human
cuggcccagucucagaguguca

SEQ ID NO: 411924 - RNA, 22 nt, Human
uugauacagcagccugugaucc

SEQ ID NO: 411925 - RNA, 22 nt, Human
agggcugacaguaaaaguauga

SEQ ID NO: 411926 - RNA, 22 nt, Human
uggaggagggcuggugucugua

SEQ ID NO: 411927 - RNA, 22 nt, Human
uuuccucuucuucccaugucau

SEQ ID NO: 411928 - RNA, 22 nt, Human
cuggcagcugcccgagaugccc

SEQ ID NO: 411929 - RNA, 23 nt, Human
gccaggcuccggucuguggccac

SEQ ID NO: 411930 - RNA, 22 nt, Human
aggaggaggcuggaguacaccc

SEQ ID NO: 411931 - RNA, 22 nt, Human
auuuaaauuuucugauggagag

SEQ ID NO: 411932 - RNA, 22 nt, Human
ugggcagauuaaugcaguggcu

SEQ ID NO: 411933 - RNA, 22 nt, Human
uauguacaguccuuaacuuaaa

SEQ ID NO: 411934 - RNA, 22 nt, Human
ugucucugccagcuagcagaau

SEQ ID NO: 411935 - RNA, 23 nt, Human
aaguucaagucacagccugucuu

SEQ ID NO: 411936 - RNA, 19 nt, Human
ugugaaagcuaguguucuu

SEQ ID NO: 411937 - RNA, 22 nt, Human
gagaggccauggcugugcagug

SEQ ID NO: 411938 - RNA, 22 nt, Human
ugcgcaggagcucugccaggag

SEQ ID NO: 411939 - RNA, 22 nt, Human
uccuucagggggccgccugcac

SEQ ID NO: 411940 - RNA, 22 nt, Human
caggcuugggagcagagccacu

SEQ ID NO: 411941 - RNA, 22 nt, Human
aggcagcagugauaagauagga

SEQ ID NO: 411942 - RNA, 22 nt, Human
agccuggaagaaccugaagucu

SEQ ID NO: 411943 - RNA, 22 nt, Human
acaaaggcagagaauucaacau

SEQ ID NO: 411944 - RNA, 22 nt, Human
uuuaauuuguauuucuagaggg

SEQ ID NO: 411945 - RNA, 22 nt, Human
agaagccaaaugccagugaccu

SEQ ID NO: 411946 - RNA, 22 nt, Human
caguggggaggccaggauagaa

SEQ ID NO: 411947 - RNA, 19 nt, Human
gccugcagaaaaggcaggg

SEQ ID NO: 411948 - RNA, 22 nt, Human
gcagccagguuugaggaccacu

SEQ ID NO: 411949 - RNA, 22 nt, Human
aggggcugggacagagccaagc

SEQ ID NO: 411950 - RNA, 18 nt, Human
auggucucauacugggag

SEQ ID NO: 411951 - RNA, 22 nt, Human
accaucagucacauguagagaa

SEQ ID NO: 411952 - RNA, 22 nt, Human
aauagguagccagauauauaaa

SEQ ID NO: 411953 - RNA, 22 nt, Human
cuuaauuuaagccuagaaugca

SEQ ID NO: 411954 - RNA, 22 nt, Human
agagcaucuaacacauaagccu

SEQ ID NO: 411955 - RNA, 22 nt, Human
aggcagccagauggcagccugc

SEQ ID NO: 411956 - RNA, 22 nt, Human
uccucuggcucuuucccuagga

SEQ ID NO: 411957 - RNA, 22 nt, Human
ugcuuuauuaagagagaaauuu

SEQ ID NO: 411958 - RNA, 22 nt, Human
agggcugacaguggcguggcgu

SEQ ID NO: 411959 - RNA, 22 nt, Human
agggcugcaccggggcuucgcg

SEQ ID NO: 411960 - RNA, 19 nt, Human
uggcuccugccugccuucu

SEQ ID NO: 411961 - RNA, 22 nt, Human
cauucacagagggggaagcauc

SEQ ID NO: 411962 - RNA, 20 nt, Human
uggagcugugguaaggagca

SEQ ID NO: 411963 - RNA, 21 nt, Human
uuuguucaggggcaaaguuaa

SEQ ID NO: 411964 - RNA, 22 nt, Human
agcagggcuccugaaagccgcg

SEQ ID NO: 411965 - RNA, 22 nt, Human
ggugccaggcuguagucagggu

SEQ ID NO: 411966 - RNA, 22 nt, Human
gcucugugggugaguagaaucu

SEQ ID NO: 411967 - RNA, 22 nt, Human
ggccucugguucguggugaccu

SEQ ID NO: 411968 - RNA, 22 nt, Human
agacagcaugauacaugaugcu

SEQ ID NO: 411969 - RNA, 22 nt, Human
cucugaccauucccuugauuuu

SEQ ID NO: 411970 - RNA, 22 nt, Human
uggcuggcccugggagugcaga

SEQ ID NO: 411971 - RNA, 21 nt, Human
acaggcuuuagaaaaugacuc

SEQ ID NO: 411972 - RNA, 22 nt, Human
acaaagugcacaagaugagaac

SEQ ID NO: 411973 - RNA, 22 nt, Human
aaacucuuccuuucuuuaaagu

SEQ ID NO: 411974 - RNA, 22 nt, Human
ccaggacccugcaaacccuguu

SEQ ID NO: 411975 - RNA, 22 nt, Human
cagggcuggguuaaaagcaggg

SEQ ID NO: 411976 - RNA, 22 nt, Human
ugccugaugcaggaguaucaga

SEQ ID NO: 411977 - RNA, 22 nt, Human
gucuccugagccuugacugcaa

SEQ ID NO: 411978 - RNA, 22 nt, Human
gagcuguccuaccaggaguccu

SEQ ID NO: 411979 - RNA, 22 nt, Human
ucauuuguucaucugcucuucu

SEQ ID NO: 411980 - RNA, 22 nt, Human
ggcugcuuuaucggcugcugaa

SEQ ID NO: 411981 - RNA, 22 nt, Human
cagcuuuaccaauauuuggaaa

SEQ ID NO: 411982 - RNA, 22 nt, Human
agacaucaaugaucagagguag

SEQ ID NO: 411983 - RNA, 22 nt, Human
ucugagagucucugaggcagau

SEQ ID NO: 411984 - RNA, 22 nt, Human
aggacagaccuaggacuggagc

SEQ ID NO: 411985 - RNA, 22 nt, Human
aggcaggccccugagaauagac

SEQ ID NO: 411986 - RNA, 22 nt, Human
gggaagccaugcucagagguac

SEQ ID NO: 411987 - RNA, 22 nt, Human
aguacuucagaggcugcccagg

SEQ ID NO: 411988 - RNA, 22 nt, Human
cugcagaggccucgccuccucu

SEQ ID NO: 411989 - RNA, 22 nt, Human
aggcacugaaggaagcuugcgc

SEQ ID NO: 411990 - RNA, 22 nt, Human
aucagagacaaaaccagcacuu

SEQ ID NO: 411991 - RNA, 22 nt, Human
uuaacagacauauauauuugua

SEQ ID NO: 411992 - RNA, 22 nt, Human
uaggcagauguuaacaggaaaa

SEQ ID NO: 411993 - RNA, 17 nt, Human
uccaggcauaucuccua

SEQ ID NO: 411994 - RNA, 22 nt, Human
acagcuuuaguguggguggugc

SEQ ID NO: 411995 - RNA, 22 nt, Human
auauguguauuugguuagccua

SEQ ID NO: 411996 - RNA, 22 nt, Human
ggcugaaggaugaaagcugcag

SEQ ID NO: 411997 - RNA, 22 nt, Human
aggcagugagugugacuucaca

SEQ ID NO: 411998 - RNA, 22 nt, Human
ucaggaucaggggccuuuccuu

SEQ ID NO: 411999 - RNA, 22 nt, Human
agcccugggaggccagcuugua

SEQ ID NO: 412000 - RNA, 22 nt, Human
ugagaggccccagcucuuggcc

SEQ ID NO: 412001 - RNA, 22 nt, Human
gaggcagcgggucaggaccgug

SEQ ID NO: 412002 - RNA, 20 nt, Human
aacagggggcugcagagggc

SEQ ID NO: 412003 - RNA, 22 nt, Human
ugucccuggaacuauggcucca

SEQ ID NO: 412004 - RNA, 22 nt, Human
cuucauuaaccaaaaugcaaua

SEQ ID NO: 412005 - RNA, 22 nt, Human
caaggccaaagggccacuguca

SEQ ID NO: 412006 - RNA, 22 nt, Human
uaggccauucuuggagcuuacu

SEQ ID NO: 412007 - RNA, 22 nt, Human
aggagucagauaugggaaaguu

SEQ ID NO: 412008 - RNA, 22 nt, Human
ggcucugcugguaagaugccuc

SEQ ID NO: 412009 - RNA, 22 nt, Human
aaaagggacuacucucagcucc

SEQ ID NO: 412010 - RNA, 22 nt, Human
ggcgaggccgggacaggcugga

SEQ ID NO: 412011 - RNA, 22 nt, Human
cuguuuaucuaggaguugcagg

SEQ ID NO: 412012 - RNA, 22 nt, Human
aaauggaucuguggaauacauu

SEQ ID NO: 412013 - RNA, 19 nt, Human
gccucugcuggggacaggc

SEQ ID NO: 412014 - RNA, 22 nt, Human
uuccauauguauauagcuguua

SEQ ID NO: 412015 - RNA, 22 nt, Human
agagccagcauuugacacuggc

SEQ ID NO: 412016 - RNA, 22 nt, Human
cccuccccacaaagcuucacac

SEQ ID NO: 412017 - RNA, 22 nt, Human
uggcagaggcucugugauguug

SEQ ID NO: 412018 - RNA, 22 nt, Human
gccagagccacuuuugggugau

SEQ ID NO: 412019 - RNA, 20 nt, Human
aggcucagauacccagggaa

SEQ ID NO: 412020 - RNA, 22 nt, Human
cuuguacaggaauccaugguau

SEQ ID NO: 412021 - RNA, 17 nt, Human
agccgggcauggaccag

SEQ ID NO: 412022 - RNA, 22 nt, Human
cuggcccuucucuugcuuccug

SEQ ID NO: 412023 - RNA, 22 nt, Human
uggcauuuccucagugcucaga

SEQ ID NO: 412024 - RNA, 22 nt, Human
cacagcagagggagccauugaa

SEQ ID NO: 412025 - RNA, 22 nt, Human
cagggcagaaggcacucuacuc

SEQ ID NO: 412026 - RNA, 22 nt, Human
ugucucagauacgccaucaagg

SEQ ID NO: 412027 - RNA, 22 nt, Human
ggcagggagagcaugcugauaa

SEQ ID NO: 412028 - RNA, 22 nt, Human
acacaucagaaauaugaaugag

SEQ ID NO: 412029 - RNA, 22 nt, Human
ugcagugguugagagcccagac

SEQ ID NO: 412030 - RNA, 22 nt, Human
gagaaggcuggucuuaagucga

SEQ ID NO: 412031 - RNA, 20 nt, Human
ggcagccaaucagcgugccg

SEQ ID NO: 412032 - RNA, 22 nt, Human
ugauuuccuaggucuggagaag

SEQ ID NO: 412033 - RNA, 19 nt, Human
ucugcuggcagaauucccu

SEQ ID NO: 412034 - RNA, 22 nt, Human
aaguguagauuauggagugucu

SEQ ID NO: 412035 - RNA, 22 nt, Human
auuuacagaugaugcuauuuga

SEQ ID NO: 412036 - RNA, 22 nt, Human
agaagccauaguaucucagggu

SEQ ID NO: 412037 - RNA, 22 nt, Human
gacagggaggagcagagcuucu

SEQ ID NO: 412038 - RNA, 22 nt, Human
augcagguugggcaaguguggg

SEQ ID NO: 412039 - RNA, 22 nt, Human
acagaccaaaaaaggauauugg

SEQ ID NO: 412040 - RNA, 22 nt, Human
gcagcguggggacaggagcuca

SEQ ID NO: 412041 - RNA, 22 nt, Human
uuucucaaggugucauguauuu

SEQ ID NO: 412042 - RNA, 22 nt, Human
aggaugaauaacugaaauggug

SEQ ID NO: 412043 - RNA, 22 nt, Human
gaacagaagaggcuggugccac

SEQ ID NO: 412044 - RNA, 22 nt, Human
aggcacugcagauuacaggcgc

SEQ ID NO: 412045 - RNA, 21 nt, Human
gaaggagaaagcaagugcugc

SEQ ID NO: 412046 - RNA, 22 nt, Human
agaguccauaugugggaggagu

SEQ ID NO: 412047 - RNA, 22 nt, Human
uugggguguuggauggagcaag

SEQ ID NO: 412048 - RNA, 22 nt, Human
gucacuguauccagguuccagc

SEQ ID NO: 412049 - RNA, 22 nt, Human
uggugaagucagcggagcccgg

SEQ ID NO: 412050 - RNA, 22 nt, Human
gccagggggucagcaggcacuu

SEQ ID NO: 412051 - RNA, 22 nt, Human
aggcugggaaauguagucuucc

SEQ ID NO: 412052 - RNA, 21 nt, Human
acagcaagccuuccuuucagg

SEQ ID NO: 412053 - RNA, 22 nt, Human
agcugccagggacugggcaugg

SEQ ID NO: 412054 - RNA, 22 nt, Human
aaagcagguugcaauuacagug

SEQ ID NO: 412055 - RNA, 22 nt, Human
acauuucuaguuguucaucucc

SEQ ID NO: 412056 - RNA, 19 nt, Human
ugaaggagggggauggcca

SEQ ID NO: 412057 - RNA, 19 nt, Human
aggguccagggagcggcuc

SEQ ID NO: 412058 - RNA, 22 nt, Human
aaucaguuaaauauugaguaca

SEQ ID NO: 412059 - RNA, 22 nt, Human
gcugcccucccagggcaagcuu

SEQ ID NO: 412060 - RNA, 22 nt, Human
uguccucaaggagcuucagucu

SEQ ID NO: 412061 - RNA, 22 nt, Human
caaggccagagccagcgauaag

SEQ ID NO: 412062 - RNA, 22 nt, Human
agagccugugauugucaucacc

SEQ ID NO: 412063 - RNA, 22 nt, Human
ugagcccagagaucugagcuau

SEQ ID NO: 412064 - RNA, 17 nt, Human
agaugcuggccacaugu

SEQ ID NO: 412065 - RNA, 22 nt, Human
acuuucuauucccacagagaua

SEQ ID NO: 412066 - RNA, 20 nt, Human
gaaaugugaccucuucugug

SEQ ID NO: 412067 - RNA, 22 nt, Human
ggcugcagggcagcuggugugg

SEQ ID NO: 412068 - RNA, 22 nt, Human
uccagggcuggguuggcucagc

SEQ ID NO: 412069 - RNA, 19 nt, Human
cucagagaggggcagugcc

SEQ ID NO: 412070 - RNA, 19 nt, Human
gcagcugugggaagagcca

SEQ ID NO: 412071 - RNA, 22 nt, Human
ggcuucugagugcucugcuguu

SEQ ID NO: 412072 - RNA, 22 nt, Human
gcagggcagaccuccagccuau

SEQ ID NO: 412073 - RNA, 20 nt, Human
agugcaagaaagcacagcug

SEQ ID NO: 412074 - RNA, 22 nt, Human
gcugucacaucaaggcacuaaa

SEQ ID NO: 412075 - RNA, 22 nt, Human
gugggagcuuuggcaucaggcu

SEQ ID NO: 412076 - RNA, 22 nt, Human
ccagagagaaaauggagggcca

SEQ ID NO: 412077 - RNA, 22 nt, Human
agguggagacccagagaaggcg

SEQ ID NO: 412078 - RNA, 22 nt, Human
ucaccaggauugggcuguaggc

SEQ ID NO: 412079 - RNA, 22 nt, Human
ggagccaggggaccuucacaga

SEQ ID NO: 412080 - RNA, 22 nt, Human
uguggugagaaacugguagauu

SEQ ID NO: 412081 - RNA, 22 nt, Human
cccagcuccagagccagaaaca

SEQ ID NO: 412082 - RNA, 22 nt, Human
ucagaggagaaguugggaaaau

SEQ ID NO: 412083 - RNA, 22 nt, Human
cugagcugcucccgcugcagcg

SEQ ID NO: 412084 - RNA, 22 nt, Human
cagaggaggcgguauacacugc

SEQ ID NO: 412085 - RNA, 22 nt, Human
ucuuugcaaauguuauuaucuu

SEQ ID NO: 412086 - RNA, 20 nt, Human
uuucacaucugucccuuuaa

SEQ ID NO: 412087 - RNA, 22 nt, Human
cacugaaggacaguaggaaggg

SEQ ID NO: 412088 - RNA, 22 nt, Human
uggagaaggccggccaggagug

SEQ ID NO: 412089 - RNA, 18 nt, Human
gcaggugccacugcuguu

SEQ ID NO: 412090 - RNA, 20 nt, Human
cauauauaccuagaagugga

SEQ ID NO: 412091 - RNA, 22 nt, Human
gcugggcagccccuacagagag

SEQ ID NO: 412092 - RNA, 22 nt, Human
cccccaaggccaggcugagacc

SEQ ID NO: 412093 - RNA, 22 nt, Human
uaggcuggaacuuaggcagagg

SEQ ID NO: 412094 - RNA, 22 nt, Human
agaagaaaugugaaggccacug

SEQ ID NO: 412095 - RNA, 18 nt, Human
uuaagagcugaaagggga

SEQ ID NO: 412096 - RNA, 22 nt, Human
agaggcaacauggggaacagau

SEQ ID NO: 412097 - RNA, 22 nt, Human
cauauaaauacaacauguguua

SEQ ID NO: 412098 - RNA, 22 nt, Human
gcaguccaaaguggcucucacc

SEQ ID NO: 412099 - RNA, 22 nt, Human
uaugcacauuaucuaauccauu

SEQ ID NO: 412100 - RNA, 22 nt, Human
cagcugugaauugucuuaucua

SEQ ID NO: 412101 - RNA, 22 nt, Human
gccaggcauuuauugauugaau

SEQ ID NO: 412102 - RNA, 22 nt, Human
ugauuuccaaaaggcuucuaag

SEQ ID NO: 412103 - RNA, 20 nt, Human
uauuuacaacuuagagccuc

SEQ ID NO: 412104 - RNA, 23 nt, Human
aggagccaggaaccagcuucccc

SEQ ID NO: 412105 - RNA, 22 nt, Human
uucucuuaucuggcauuauugg

SEQ ID NO: 412106 - RNA, 23 nt, Human
gccuggccaccccagggcugcuu

SEQ ID NO: 412107 - RNA, 22 nt, Human
cagggguggcugcagcagaggu

SEQ ID NO: 412108 - RNA, 22 nt, Human
cagggugccucccgcucgccgg

SEQ ID NO: 412109 - RNA, 22 nt, Human
gaggcucagagggagcaugguc

SEQ ID NO: 412110 - RNA, 22 nt, Human
ccaccagcagugugcaaggauu

SEQ ID NO: 412111 - RNA, 22 nt, Human
cugcaggcugagcgccugccgg

SEQ ID NO: 412112 - RNA, 22 nt, Human
caggcugcagaggccuuucaug

SEQ ID NO: 412113 - RNA, 22 nt, Human
agugaccaacaaugcugagaag

SEQ ID NO: 412114 - RNA, 22 nt, Human
gggcagguggcagggucucugg

SEQ ID NO: 412115 - RNA, 22 nt, Human
agucucagcaagcauggcuagu

SEQ ID NO: 412116 - RNA, 22 nt, Human
aaggaguuuggguagucauaca

SEQ ID NO: 412117 - RNA, 22 nt, Human
gaggcccaggucaagcagccac

SEQ ID NO: 412118 - RNA, 22 nt, Human
accaaaaauuguggggcugaau

SEQ ID NO: 412119 - RNA, 22 nt, Human
uguagaaauuaguaagaucaac

SEQ ID NO: 412120 - RNA, 22 nt, Human
uaucuuuauuaugucuaucugc

SEQ ID NO: 412121 - RNA, 22 nt, Human
acccagcucuuugauggucuug

SEQ ID NO: 412122 - RNA, 22 nt, Human
caguccuguguuaaacaagagc

SEQ ID NO: 412123 - RNA, 22 nt, Human
gcacaugguaggcauuugaugu

SEQ ID NO: 412124 - RNA, 22 nt, Human
ccugccugcaaaaugggacaag

SEQ ID NO: 412125 - RNA, 22 nt, Human
aagaauuauugcaauacuagau

SEQ ID NO: 412126 - RNA, 22 nt, Human
cugggguggaggagcuccccug

SEQ ID NO: 412127 - RNA, 22 nt, Human
ccugagguggcugcagcacugc

SEQ ID NO: 412128 - RNA, 21 nt, Human
ccuuuacaauuuugcauuccu

SEQ ID NO: 412129 - RNA, 22 nt, Human
uguggcagcuggagguggagaa

SEQ ID NO: 412130 - RNA, 22 nt, Human
aaguccuuggagaauagaaagg

SEQ ID NO: 412131 - RNA, 22 nt, Human
gcucccagcauugcugcugaau

SEQ ID NO: 412132 - RNA, 22 nt, Human
gaagagcuuaguuguccuagaa

SEQ ID NO: 412133 - RNA, 22 nt, Human
ugccuuggugcuucuucaugug

SEQ ID NO: 412134 - RNA, 22 nt, Human
gccucccuguagaggccagccu

SEQ ID NO: 412135 - RNA, 22 nt, Human
cagucccuaguggagcucacag

SEQ ID NO: 412136 - RNA, 22 nt, Human
agcucccagagcucgagaguaa

SEQ ID NO: 412137 - RNA, 22 nt, Human
cggcuggggcuguccccaugac

SEQ ID NO: 412138 - RNA, 20 nt, Human
aggcucaggguguuuaggaa

SEQ ID NO: 412139 - RNA, 22 nt, Human
ugggcagcagcaaagccagacu

SEQ ID NO: 412140 - RNA, 22 nt, Human
acaggggaauuuacugucauua

SEQ ID NO: 412141 - RNA, 22 nt, Human
gcuguggaaaugccuaacauga

SEQ ID NO: 412142 - RNA, 22 nt, Human
uuagcuaaacuguaacuagaau

SEQ ID NO: 412143 - RNA, 22 nt, Human
uggcagggugccaguugcgagu

SEQ ID NO: 412144 - RNA, 22 nt, Human
acacacagguaaaggagccugg

SEQ ID NO: 412145 - RNA, 22 nt, Human
auguaagguucagaguauguga

SEQ ID NO: 412146 - RNA, 22 nt, Human
gaguguucccacaccccaguug

SEQ ID NO: 412147 - RNA, 22 nt, Human
cugcagaggucuugcugauggu

SEQ ID NO: 412148 - RNA, 22 nt, Human
cuucuggaggacacuggcccca

SEQ ID NO: 412149 - RNA, 22 nt, Human
acucugggccccagguggagcu

SEQ ID NO: 412150 - RNA, 22 nt, Human
gagauggggucagcugggacau

SEQ ID NO: 412151 - RNA, 22 nt, Human
uguccucaggaccuggcacagu

SEQ ID NO: 412152 - RNA, 22 nt, Human
cugagccagggccacacaugga

SEQ ID NO: 412153 - RNA, 22 nt, Human
gggucuccauguuaacaucacu

SEQ ID NO: 412154 - RNA, 23 nt, Human
ugugaagguggguccaagggcug

SEQ ID NO: 412155 - RNA, 22 nt, Human
gggaggagugaagauucaccug

SEQ ID NO: 412156 - RNA, 22 nt, Human
cacugcuuaguugguaaaugug

SEQ ID NO: 412157 - RNA, 22 nt, Human
auggggugaccaugagcauuua

SEQ ID NO: 412158 - RNA, 22 nt, Human
uuuauuagugcuuguaucacug

SEQ ID NO: 412159 - RNA, 20 nt, Human
ggagagcagggaagacagua

SEQ ID NO: 412160 - RNA, 22 nt, Human
ccaaggcuucccagagaugcuc

SEQ ID NO: 412161 - RNA, 18 nt, Human
uguuccaaggaaggaauc

SEQ ID NO: 412162 - RNA, 22 nt, Human
ugccugccaugcagaaagcuga

SEQ ID NO: 412163 - RNA, 22 nt, Human
ugauuuccccagucuugcugcu

SEQ ID NO: 412164 - RNA, 22 nt, Human
aggcucagcaucugauucauau

SEQ ID NO: 412165 - RNA, 22 nt, Human
uugaaggacaucuuguuucuag

SEQ ID NO: 412166 - RNA, 23 nt, Human
aggcugcagaagaauagggucau

SEQ ID NO: 412167 - RNA, 22 nt, Human
cucuccagccacagaagcugcu

SEQ ID NO: 412168 - RNA, 22 nt, Human
uggcaguguauagguggcuccu

SEQ ID NO: 412169 - RNA, 22 nt, Human
aggcucuguuauucuagagggc

SEQ ID NO: 412170 - RNA, 22 nt, Human
ggcuggcucagggcuugagaga

SEQ ID NO: 412171 - RNA, 22 nt, Human
agggaagagcuugcaagaaacc

SEQ ID NO: 412172 - RNA, 22 nt, Human
ucaaaauuuuauuucucaagga

SEQ ID NO: 412173 - RNA, 22 nt, Human
ugcugggcuugaaagcugcuaa

SEQ ID NO: 412174 - RNA, 22 nt, Human
cugggccuggcguuccaggcug

SEQ ID NO: 412175 - RNA, 22 nt, Human
gcagcuuuaaaggaggcucuga

SEQ ID NO: 412176 - RNA, 22 nt, Human
uaacacugauuuguucucaggg

SEQ ID NO: 412177 - RNA, 22 nt, Human
caggcuugcugcuagagcacuu

SEQ ID NO: 412178 - RNA, 22 nt, Human
agauuucaauggauauugcaag

SEQ ID NO: 412179 - RNA, 22 nt, Human
uccugcagccuugggcuggagc

SEQ ID NO: 412180 - RNA, 22 nt, Human
cugucucugucuuaacucccag

SEQ ID NO: 412181 - RNA, 22 nt, Human
uggagacugugcuaagggaguu

SEQ ID NO: 412182 - RNA, 22 nt, Human
uuuaguagaaugauacagggca

SEQ ID NO: 412183 - RNA, 22 nt, Human
caggagacaauggcuguggggc

SEQ ID NO: 412184 - RNA, 22 nt, Human
guggcugcagcccagcggcacg

SEQ ID NO: 412185 - RNA, 22 nt, Human
ucaaugaugcugaagguagcgu

SEQ ID NO: 412186 - RNA, 22 nt, Human
ugggagagugcucaaugugcaa

SEQ ID NO: 412187 - RNA, 22 nt, Human
auucagaaauagaaaauuugau

SEQ ID NO: 412188 - RNA, 23 nt, Human
cagaagcaccuguugacugcugc

SEQ ID NO: 412189 - RNA, 22 nt, Human
cucaggaggccauucucaaggu

SEQ ID NO: 412190 - RNA, 19 nt, Human
ucuuucauuucuagcucug

SEQ ID NO: 412191 - RNA, 22 nt, Human
gcacugaaauuauaugcauuug

SEQ ID NO: 412192 - RNA, 22 nt, Human
ggcuuuauguuuuucauguggu

SEQ ID NO: 412193 - RNA, 22 nt, Human
uccuucaguucaauuaguccgu

SEQ ID NO: 412194 - RNA, 22 nt, Human
gcaggagccaggccgagcuggu

SEQ ID NO: 412195 - RNA, 22 nt, Human
gcucugucaacagcuagcugug

SEQ ID NO: 412196 - RNA, 22 nt, Human
aagaggaagucuccauggagag

SEQ ID NO: 412197 - RNA, 22 nt, Human
auguccaggaucuauccccaga

SEQ ID NO: 412198 - RNA, 22 nt, Human
uagcuuuccuuguugccugugc

SEQ ID NO: 412199 - RNA, 22 nt, Human
gguggggcccuggcacugguau

SEQ ID NO: 412200 - RNA, 22 nt, Human
uccagucaucucccuucacauu

SEQ ID NO: 412201 - RNA, 22 nt, Human
ugcagggaagcaaggguggcuc

SEQ ID NO: 412202 - RNA, 22 nt, Human
uaccuuggguugaguucauucu

SEQ ID NO: 412203 - RNA, 22 nt, Human
uccagcuugccuggucuuuugg

SEQ ID NO: 412204 - RNA, 22 nt, Human
gaaaauguuuccuguuauuugc

SEQ ID NO: 412205 - RNA, 22 nt, Human
augaacacauguacacauuucu

SEQ ID NO: 412206 - RNA, 22 nt, Human
ugaaaaaccucaguccgcuuua

SEQ ID NO: 412207 - RNA, 22 nt, Human
ugcagggaggccccgcagcccu

SEQ ID NO: 412208 - RNA, 22 nt, Human
uacauaauaaggggcauggugu

SEQ ID NO: 412209 - RNA, 22 nt, Human
agcugaaggcuagaacagcugg

SEQ ID NO: 412210 - RNA, 22 nt, Human
aucuggguucaccaugcuccug

SEQ ID NO: 412211 - RNA, 22 nt, Human
agauuuagugguggaauuuugg

SEQ ID NO: 412212 - RNA, 19 nt, Human
cccagcuugaccaccugcu

SEQ ID NO: 412213 - RNA, 20 nt, Human
caggaggcaaggucaagguc

SEQ ID NO: 412214 - RNA, 22 nt, Human
agucaauucuuuucaacucaag

SEQ ID NO: 412215 - RNA, 22 nt, Human
uccuugaauccuagcauccuau

SEQ ID NO: 412216 - RNA, 22 nt, Human
uucucuucaucucaguaaaugu

SEQ ID NO: 412217 - RNA, 22 nt, Human
uagaucugauacaauucaucug

SEQ ID NO: 412218 - RNA, 22 nt, Human
ucuggcucauaggaaggccauu

SEQ ID NO: 412219 - RNA, 22 nt, Human
uguuauugagguuacuuauaag

SEQ ID NO: 412220 - RNA, 22 nt, Human
acuggagcccguggaggcgcag

SEQ ID NO: 412221 - RNA, 22 nt, Human
ucacagaauagcacuguaagcg

SEQ ID NO: 412222 - RNA, 22 nt, Human
cuguccucaacccauccuucuc

SEQ ID NO: 412223 - RNA, 22 nt, Human
ccaggccucccuuuuccagcca

SEQ ID NO: 412224 - RNA, 22 nt, Human
cucaccacagagccuguccagc

SEQ ID NO: 412225 - RNA, 22 nt, Human
uagagcugaguugacuccauuu

SEQ ID NO: 412226 - RNA, 22 nt, Human
gcagagccugacgggauuuuuc

SEQ ID NO: 412227 - RNA, 22 nt, Human
guauuugauagauuucaaagga

SEQ ID NO: 412228 - RNA, 22 nt, Human
uuuucauuguuacuaugagcua

SEQ ID NO: 412229 - RNA, 22 nt, Human
uccauggguagcccugguugag

SEQ ID NO: 412230 - RNA, 22 nt, Human
gaaugcacacgugugugcaugc

SEQ ID NO: 412231 - RNA, 22 nt, Human
agcuuccuacaaccaucucaga

SEQ ID NO: 412232 - RNA, 22 nt, Human
ccagcugguguuccuuaggacc

SEQ ID NO: 412233 - RNA, 22 nt, Human
cuauuucugccuaaugaccugu

SEQ ID NO: 412234 - RNA, 22 nt, Human
uaaaucucacuggguauauugg

SEQ ID NO: 412235 - RNA, 22 nt, Human
cuuucaaaacgcucuguaugca

SEQ ID NO: 412236 - RNA, 22 nt, Human
uuuccucuccaccaggaggucu

SEQ ID NO: 412237 - RNA, 19 nt, Human
cagagcugcuggccucguc

SEQ ID NO: 412238 - RNA, 23 nt, Human
gcagacagagcagacuaagacaa

SEQ ID NO: 412239 - RNA, 22 nt, Human
aagggcucccugccugaggugg

SEQ ID NO: 412240 - RNA, 19 nt, Human
ccaggccaucccaguuccc

SEQ ID NO: 412241 - RNA, 21 nt, Human
cucuugugucagagccagagg

SEQ ID NO: 412242 - RNA, 22 nt, Human
aaaguuugaaugauauauuagu

SEQ ID NO: 412243 - RNA, 22 nt, Human
agccugguguggggcugcagag

SEQ ID NO: 412244 - RNA, 20 nt, Human
uaagaacaagacuaggaagc

SEQ ID NO: 412245 - RNA, 22 nt, Human
aggggcagccucacaauccucu

SEQ ID NO: 412246 - RNA, 22 nt, Human
cuggaguguaaagagcauagaa

SEQ ID NO: 412247 - RNA, 22 nt, Human
aacaaccaaaaagaugaaugua

SEQ ID NO: 412248 - RNA, 21 nt, Human
agcagcugcaguuucuaucug

SEQ ID NO: 412249 - RNA, 22 nt, Human
caggguacagaguuuucuaaac

SEQ ID NO: 412250 - RNA, 21 nt, Human
gauugaaaccauggcagugag

SEQ ID NO: 412251 - RNA, 22 nt, Human
aggugcuagguguguaguggag

SEQ ID NO: 412252 - RNA, 22 nt, Human
acagccagggcauugucgccga

SEQ ID NO: 412253 - RNA, 22 nt, Human
uaaguuuucuggaauaacuugg

SEQ ID NO: 412254 - RNA, 22 nt, Human
gggcaugguggugcacaccugu

SEQ ID NO: 412255 - RNA, 22 nt, Human
uccugggcccaggcugccaggg

SEQ ID NO: 412256 - RNA, 22 nt, Human
ugcuggaggggccugaccagga

SEQ ID NO: 412257 - RNA, 22 nt, Human
ggaggcuccacugcucuuccug

SEQ ID NO: 412258 - RNA, 22 nt, Human
gaaggccaguuuugagauaggu

SEQ ID NO: 412259 - RNA, 22 nt, Human
gaaggcugcugggaaguguggu

SEQ ID NO: 412260 - RNA, 22 nt, Human
ugcagccauuuucugccaaugc

SEQ ID NO: 412261 - RNA, 22 nt, Human
gagccaggcaccuucuguguug

SEQ ID NO: 412262 - RNA, 22 nt, Human
aagcaucucuauguggagagug

SEQ ID NO: 412263 - RNA, 22 nt, Human
ccagcagcuguggcuuugccuc

SEQ ID NO: 412264 - RNA, 22 nt, Human
uuaggaaaaucaugagagauga

SEQ ID NO: 412265 - RNA, 22 nt, Human
gcacccagaggucagcagugcu

SEQ ID NO: 412266 - RNA, 22 nt, Human
gcaggggcuacucugagcuucc

SEQ ID NO: 412267 - RNA, 22 nt, Human
aggcuccaugcaaaggcuguuu

SEQ ID NO: 412268 - RNA, 20 nt, Human
uuuuauauguaggguauaug

SEQ ID NO: 412269 - RNA, 22 nt, Human
uaacagaaauagaaaugagagu

SEQ ID NO: 412270 - RNA, 22 nt, Human
agucucuuuaaucacagugucu

SEQ ID NO: 412271 - RNA, 22 nt, Human
aaaagagguuaaccaggugugu

SEQ ID NO: 412272 - RNA, 20 nt, Human
uaugaagauaugugaacagc

SEQ ID NO: 412273 - RNA, 22 nt, Human
agcugggaggugggcagugaga

SEQ ID NO: 412274 - RNA, 22 nt, Human
ccagcuuuccaggguugacugg

SEQ ID NO: 412275 - RNA, 23 nt, Human
gacacaggagcacccagcugagc

SEQ ID NO: 412276 - RNA, 22 nt, Human
acugagcugcuugaagugaacu

SEQ ID NO: 412277 - RNA, 22 nt, Human
ugcugucuuccaggauggugaa

SEQ ID NO: 412278 - RNA, 21 nt, Human
cuggacugaggagacagucgc

SEQ ID NO: 412279 - RNA, 22 nt, Human
aggaaaugcugaugcuccugga

SEQ ID NO: 412280 - RNA, 22 nt, Human
uguagaaagcucuucugaaauc

SEQ ID NO: 412281 - RNA, 17 nt, Human
cuggagccuccaacucc

SEQ ID NO: 412282 - RNA, 22 nt, Human
caaaggcaguuacugaaugaag

SEQ ID NO: 412283 - RNA, 22 nt, Human
cuggaagguucuuugugugccu

SEQ ID NO: 412284 - RNA, 22 nt, Human
gcaguguuuacauauuagaaac

SEQ ID NO: 412285 - RNA, 22 nt, Human
ugcacacaaguuggagaaugaa

SEQ ID NO: 412286 - RNA, 16 nt, Human
uguuagcugugcauua

SEQ ID NO: 412287 - RNA, 22 nt, Human
aguggcaguuugggagcuacag

SEQ ID NO: 412288 - RNA, 22 nt, Human
aggaccuguaccucagcaucua

SEQ ID NO: 412289 - RNA, 21 nt, Human
ccugggccaaauucccuggac

SEQ ID NO: 412290 - RNA, 22 nt, Human
cugugccuggggggcagagcug

SEQ ID NO: 412291 - RNA, 21 nt, Human
agggucaggaaccaggguacc

SEQ ID NO: 412292 - RNA, 22 nt, Human
uccuggcccggccgggccugcu

SEQ ID NO: 412293 - RNA, 22 nt, Human
gaugcugagagguggagggaac

SEQ ID NO: 412294 - RNA, 22 nt, Human
cugagcauggccgguccauggu

SEQ ID NO: 412295 - RNA, 22 nt, Human
cugcugagcccuggcacaggug

SEQ ID NO: 412296 - RNA, 22 nt, Human
auccugugcaaugacugcaucu

SEQ ID NO: 412297 - RNA, 22 nt, Human
aggcccaguuauccuacuuguu

SEQ ID NO: 412298 - RNA, 22 nt, Human
cagggcagcuuccuuuguuagg

SEQ ID NO: 412299 - RNA, 19 nt, Human
gaucuuugccaauuuaagc

SEQ ID NO: 412300 - RNA, 22 nt, Human
agggucaggagacacuggcaac

SEQ ID NO: 412301 - RNA, 22 nt, Human
gcagacaauuuauuagcagauu

SEQ ID NO: 412302 - RNA, 22 nt, Human
aaauuuaagaagugugugcgug

SEQ ID NO: 412303 - RNA, 22 nt, Human
gaguggggcccacugcugggug

SEQ ID NO: 412304 - RNA, 23 nt, Human
cccagaccuugugcugcccuugg

SEQ ID NO: 412305 - RNA, 22 nt, Human
agaaaucucaguaucucaggga

SEQ ID NO: 412306 - RNA, 22 nt, Human
ccagugcccagucucccugguc

SEQ ID NO: 412307 - RNA, 22 nt, Human
uggcagccacaucucguggauu

SEQ ID NO: 412308 - RNA, 22 nt, Human
cugagucucccggcaguggagg

SEQ ID NO: 412309 - RNA, 22 nt, Human
aaggugucggcagagccgcuuc

SEQ ID NO: 412310 - RNA, 22 nt, Human
ugagcagagucgcuccagagug

SEQ ID NO: 412311 - RNA, 22 nt, Human
aauuagggaaaacauuugcuuu

SEQ ID NO: 412312 - RNA, 22 nt, Human
gccucugcggagcuguacauca

SEQ ID NO: 412313 - RNA, 22 nt, Human
aaagacuagcauuuauauguac

SEQ ID NO: 412314 - RNA, 22 nt, Human
guaucuuucccaccaaucacaa

SEQ ID NO: 412315 - RNA, 22 nt, Human
gcagagcauguccucaggacag

SEQ ID NO: 412316 - RNA, 22 nt, Human
gaacauuuaugaugcaauaccu

SEQ ID NO: 412317 - RNA, 22 nt, Human
ucuacuguagugaugcugcagu

SEQ ID NO: 412318 - RNA, 22 nt, Human
ugaagacacauacaagggaaug

SEQ ID NO: 412319 - RNA, 22 nt, Human
gcugccacuuggucaugucaug

SEQ ID NO: 412320 - RNA, 22 nt, Human
aagcugccagauucagucugcu

SEQ ID NO: 412321 - RNA, 22 nt, Human
aaacagacugaagaguugaagc

SEQ ID NO: 412322 - RNA, 22 nt, Human
gaauacaaauaauaccaaggug

SEQ ID NO: 412323 - RNA, 22 nt, Human
cucagagaagucuuugcuaaac

SEQ ID NO: 412324 - RNA, 22 nt, Human
ugcagggaaugcuugcagcaug

SEQ ID NO: 412325 - RNA, 22 nt, Human
ugugccaggcacuugcccaggc

SEQ ID NO: 412326 - RNA, 22 nt, Human
ugcagauucaaaugaaaugcaa

SEQ ID NO: 412327 - RNA, 22 nt, Human
ugaaaucuucacuaagucucuu

SEQ ID NO: 412328 - RNA, 23 nt, Human
accaugaugggagugcaaauaag

SEQ ID NO: 412329 - RNA, 22 nt, Human
aaagaacuuauccuagaauuug

SEQ ID NO: 412330 - RNA, 22 nt, Human
uacccagcccaugccuaccuca

SEQ ID NO: 412331 - RNA, 22 nt, Human
caguaugagaguugaaucaagg

SEQ ID NO: 412332 - RNA, 18 nt, Human
gcugcugguggagggagc

SEQ ID NO: 412333 - RNA, 22 nt, Human
cuuacauugugugcaugagggg

SEQ ID NO: 412334 - RNA, 22 nt, Human
uucaggauggcggauguugggg

SEQ ID NO: 412335 - RNA, 22 nt, Human
uggcuccuaucaaggagugggu

SEQ ID NO: 412336 - RNA, 20 nt, Human
aagggagaauaaugauugua

SEQ ID NO: 412337 - RNA, 22 nt, Human
caugggcucuucuggacugcac

SEQ ID NO: 412338 - RNA, 22 nt, Human
cagugggaagggcagaggcuuu

SEQ ID NO: 412339 - RNA, 22 nt, Human
cuggcucauuuuagcaucaggu

SEQ ID NO: 412340 - RNA, 22 nt, Human
cucccagagaccaagcugagaa

SEQ ID NO: 412341 - RNA, 22 nt, Human
uucuuuggggaauauucugguu

SEQ ID NO: 412342 - RNA, 22 nt, Human
gaagagcugcaguuuccugggc

SEQ ID NO: 412343 - RNA, 22 nt, Human
ggagccugugcccaagcccaga

SEQ ID NO: 412344 - RNA, 22 nt, Human
caguacuuuucuggcuuucuac

SEQ ID NO: 412345 - RNA, 22 nt, Human
uggccucaagucugagggccuu

SEQ ID NO: 412346 - RNA, 22 nt, Human
cggcagagacggcgcuuugaac

SEQ ID NO: 412347 - RNA, 22 nt, Human
ucucaggaagugauauugagac

SEQ ID NO: 412348 - RNA, 22 nt, Human
uccugcagucugcacucugccu

SEQ ID NO: 412349 - RNA, 22 nt, Human
ggccaggcuggucucagacuuc

SEQ ID NO: 412350 - RNA, 22 nt, Human
ucagaggaaagggaacauaguc

SEQ ID NO: 412351 - RNA, 22 nt, Human
uugaaaggaauacagaggccua

SEQ ID NO: 412352 - RNA, 22 nt, Human
uguacaguauauuucaaagcca

SEQ ID NO: 412353 - RNA, 22 nt, Human
gcugucccaugguugcaagaug

SEQ ID NO: 412354 - RNA, 22 nt, Human
cuggggggagcugcguccagca

SEQ ID NO: 412355 - RNA, 22 nt, Human
gccagcagcccagaaggacuuu

SEQ ID NO: 412356 - RNA, 18 nt, Human
ucagagguacagaaaagu

SEQ ID NO: 412357 - RNA, 22 nt, Human
gggcaugguggcaggcaccugu

SEQ ID NO: 412358 - RNA, 22 nt, Human
aagauguaucaguuaagucuuc

SEQ ID NO: 412359 - RNA, 22 nt, Human
uccucaggcugccuggaagacu

SEQ ID NO: 412360 - RNA, 22 nt, Human
caggccucagagaguggcgggg

SEQ ID NO: 412361 - RNA, 19 nt, Human
uaaggccaaaaguaagugu

SEQ ID NO: 412362 - RNA, 22 nt, Human
caaaugcaaaauauaacccugu

SEQ ID NO: 412363 - RNA, 22 nt, Human
ucucauugguauauacaugugu

SEQ ID NO: 412364 - RNA, 22 nt, Human
gagaugaauguaaacaaaggca

SEQ ID NO: 412365 - RNA, 22 nt, Human
ugaggcaggagaauggcgggaa

SEQ ID NO: 412366 - RNA, 22 nt, Human
cacaggagaacccacagauucu

SEQ ID NO: 412367 - RNA, 22 nt, Human
caaagaugcugauguuggauca

SEQ ID NO: 412368 - RNA, 22 nt, Human
ggcagcaggcgacuucccuauu

SEQ ID NO: 412369 - RNA, 22 nt, Human
cagcccugagaaggaggaucuc

SEQ ID NO: 412370 - RNA, 22 nt, Human
ugagcuucaaaauaugugaauc

SEQ ID NO: 412371 - RNA, 22 nt, Human
aagaaucauccugcaagagucu

SEQ ID NO: 412372 - RNA, 22 nt, Human
agccuguggaucccugcacugg

SEQ ID NO: 412373 - RNA, 22 nt, Human
gaggccagaagucugagaucag

SEQ ID NO: 412374 - RNA, 21 nt, Human
agcuggugucagagcucuggg

SEQ ID NO: 412375 - RNA, 19 nt, Human
ugggaguggggaagguccu

SEQ ID NO: 412376 - RNA, 22 nt, Human
agcuguggcagcagccguggca

SEQ ID NO: 412377 - RNA, 22 nt, Human
ccgggcgggggcucucgucacc

SEQ ID NO: 412378 - RNA, 22 nt, Human
aagaggcagcccgcugaggcug

SEQ ID NO: 412379 - RNA, 22 nt, Human
uggcuaggcuccaagagcugga

SEQ ID NO: 412380 - RNA, 22 nt, Human
uuucagauggagguuuaggaca

SEQ ID NO: 412381 - RNA, 22 nt, Human
gaagcucucaaacucuccccuu

SEQ ID NO: 412382 - RNA, 19 nt, Human
cagaaauagcgaaguguaa

SEQ ID NO: 412383 - RNA, 21 nt, Human
ugggcacugagggugcugcuc

SEQ ID NO: 412384 - RNA, 22 nt, Human
cugggcaguuuauucaguucug

SEQ ID NO: 412385 - RNA, 22 nt, Human
ccagcuuuagguugccugccag

SEQ ID NO: 412386 - RNA, 23 nt, Human
ggucccaguggagaggccucacc

SEQ ID NO: 412387 - RNA, 22 nt, Human
cauuuacauuuaagguuaauau

SEQ ID NO: 412388 - RNA, 22 nt, Human
gggcugggauugcuugcuguga

SEQ ID NO: 412389 - RNA, 22 nt, Human
cucacugacgaggaagcugaga

SEQ ID NO: 412390 - RNA, 22 nt, Human
uugauuaaacaggcauauucaa

SEQ ID NO: 412391 - RNA, 22 nt, Human
gcugucacaagcaucuggggca

SEQ ID NO: 412392 - RNA, 22 nt, Human
ccagccuucugagcugccugga

SEQ ID NO: 412393 - RNA, 22 nt, Human
acaggcugccuaccaaguauca

SEQ ID NO: 412394 - RNA, 22 nt, Human
guaaaugugcuucuuuuaacuu

SEQ ID NO: 412395 - RNA, 17 nt, Human
ugccagccugucccagg

SEQ ID NO: 412396 - RNA, 22 nt, Human
aucagcaagcaugguuaggugu

SEQ ID NO: 412397 - RNA, 17 nt, Human
agguggcugcugcgccu

SEQ ID NO: 412398 - RNA, 22 nt, Human
cagcuguguagaugcaggguca

SEQ ID NO: 412399 - RNA, 22 nt, Human
ugcuuaaacauacuauuuauau

SEQ ID NO: 412400 - RNA, 22 nt, Human
uccugggguccugacugcuucc

SEQ ID NO: 412401 - RNA, 22 nt, Human
uaaacauggauucugaucacag

SEQ ID NO: 412402 - RNA, 22 nt, Human
gacagcauggugucuguucagg

SEQ ID NO: 412403 - RNA, 23 nt, Human
auggagcugguacuagcuaccuc

SEQ ID NO: 412404 - RNA, 23 nt, Human
aggcagagccaaggucaaaaccc

SEQ ID NO: 412405 - RNA, 22 nt, Human
gccaggcagcagcgaggauggu

SEQ ID NO: 412406 - RNA, 22 nt, Human
acagcagcgucaacuuaaaauu

SEQ ID NO: 412407 - RNA, 22 nt, Human
gagagugauucccucccauaga

SEQ ID NO: 412408 - RNA, 22 nt, Human
cauuuguaggaugcuucuuguu

SEQ ID NO: 412409 - RNA, 22 nt, Human
ggugaagggugucauggcauuu

SEQ ID NO: 412410 - RNA, 22 nt, Human
uaggcagggauuaggguugauu

SEQ ID NO: 412411 - RNA, 22 nt, Human
caaaggagguaaugggugugag

SEQ ID NO: 412412 - RNA, 23 nt, Human
gugcucugcggucugcuagucug

SEQ ID NO: 412413 - RNA, 22 nt, Human
uauugaugcuuggauugggcca

SEQ ID NO: 412414 - RNA, 22 nt, Human
ugcacccucaucagucaaaugg

SEQ ID NO: 412415 - RNA, 19 nt, Human
cucuggccucuggaugcug

SEQ ID NO: 412416 - RNA, 22 nt, Human
ucugagagccucuagccuaagu

SEQ ID NO: 412417 - RNA, 21 nt, Human
ccauaauuuuguuucagaagu

SEQ ID NO: 412418 - RNA, 20 nt, Human
gccuguccugagugucaugg

SEQ ID NO: 412419 - RNA, 22 nt, Human
gacaucauagggugggaggaaa

SEQ ID NO: 412420 - RNA, 22 nt, Human
ccagggucuuggagaggagugc

SEQ ID NO: 412421 - RNA, 22 nt, Human
gcugggagcaaagccaugcaua

SEQ ID NO: 412422 - RNA, 22 nt, Human
aaaaauaggucaaccguguaug

SEQ ID NO: 412423 - RNA, 18 nt, Human
agucuucugauccauuuu

SEQ ID NO: 412424 - RNA, 22 nt, Human
acacaggggcucggcugggugc

SEQ ID NO: 412425 - RNA, 22 nt, Human
uuguccuuggaugaagcuggga

SEQ ID NO: 412426 - RNA, 22 nt, Human
aucaaaaugcuccagugauggu

SEQ ID NO: 412427 - RNA, 22 nt, Human
uaaacaagcugucugauauucu

SEQ ID NO: 412428 - RNA, 23 nt, Human
auuugagaaaguauuuuuaagac

SEQ ID NO: 412429 - RNA, 22 nt, Human
ggcagaggugaaguucacaagg

SEQ ID NO: 412430 - RNA, 20 nt, Human
guggccucucacauucugag

SEQ ID NO: 412431 - RNA, 22 nt, Human
gggcuguaggagcuggaauggg

SEQ ID NO: 412432 - RNA, 22 nt, Human
aagggcucacccaacucacuuc

SEQ ID NO: 412433 - RNA, 22 nt, Human
gaggcucacugggcaaagacuc

SEQ ID NO: 412434 - RNA, 22 nt, Human
agcccggcuuccccgguugcua

SEQ ID NO: 412435 - RNA, 22 nt, Human
uaaucacagaaacagacuguuu

SEQ ID NO: 412436 - RNA, 22 nt, Human
agccauccucccaccucagccu

SEQ ID NO: 412437 - RNA, 22 nt, Human
gauggcaggcaggugaguagag

SEQ ID NO: 412438 - RNA, 17 nt, Human
gcugccaccuuuggagc

SEQ ID NO: 412439 - RNA, 22 nt, Human
ucaggagggugacaggcccugg

SEQ ID NO: 412440 - RNA, 22 nt, Human
aggcccaguccucugccgucug

SEQ ID NO: 412441 - RNA, 22 nt, Human
uauagaaguaagcauugugaug

SEQ ID NO: 412442 - RNA, 22 nt, Human
ugagccagccuugcagcugugc

SEQ ID NO: 412443 - RNA, 22 nt, Human
ccucccacauccuagcucugcu

SEQ ID NO: 412444 - RNA, 22 nt, Human
gcacuaaaccaacauguaauaa

SEQ ID NO: 412445 - RNA, 23 nt, Human
aacaccaaggcucagagagauaa

SEQ ID NO: 412446 - RNA, 22 nt, Human
augaguaaaaccacuauuuaca

SEQ ID NO: 412447 - RNA, 22 nt, Human
ucuucaaauccuacagugucug

SEQ ID NO: 412448 - RNA, 22 nt, Human
caggcagagaggagcauuuaau

SEQ ID NO: 412449 - RNA, 22 nt, Human
aaaucacuaaguuauagugugg

SEQ ID NO: 412450 - RNA, 22 nt, Human
uaacagaaaggcucaggugcuc

SEQ ID NO: 412451 - RNA, 21 nt, Human
ccaaaggcuauguaucuucug

SEQ ID NO: 412452 - RNA, 22 nt, Human
aagccaggccauucucugguuc

SEQ ID NO: 412453 - RNA, 22 nt, Human
uccagggaucuuuagagucuuu

SEQ ID NO: 412454 - RNA, 22 nt, Human
uugcagagccaugaggcuggcu

SEQ ID NO: 412455 - RNA, 22 nt, Human
ccuguacaucugcucucauugc

SEQ ID NO: 412456 - RNA, 22 nt, Human
uggcugaguuucaugcaucaug

SEQ ID NO: 412457 - RNA, 22 nt, Human
cacugcaguuccccagugcgca

SEQ ID NO: 412458 - RNA, 22 nt, Human
aagauacugaugauguaggcua

SEQ ID NO: 412459 - RNA, 22 nt, Human
ucaaaugcuguauuguaguaau

SEQ ID NO: 412460 - RNA, 22 nt, Human
cugcugcauuacucuucucaag

SEQ ID NO: 412461 - RNA, 22 nt, Human
guguuuuaucagacaaaguaua

SEQ ID NO: 412462 - RNA, 22 nt, Human
gugaggcagcaggagccucugu

SEQ ID NO: 412463 - RNA, 22 nt, Human
gaugaggcucaugcacccugcg

SEQ ID NO: 412464 - RNA, 22 nt, Human
uuuuuccuuggaugugucucuc

SEQ ID NO: 412465 - RNA, 22 nt, Human
gggcuccaccuagggacacugg

SEQ ID NO: 412466 - RNA, 22 nt, Human
cacucaggguacaauggagggc

SEQ ID NO: 412467 - RNA, 22 nt, Human
uauuucuuguucccuccaaguu

SEQ ID NO: 412468 - RNA, 22 nt, Human
gaggggaagacuucuggacagu

SEQ ID NO: 412469 - RNA, 22 nt, Human
ccagcccugccucucagggccc

SEQ ID NO: 412470 - RNA, 22 nt, Human
ccccagcucagugcagggacau

SEQ ID NO: 412471 - RNA, 22 nt, Human
gccagcucccaagugagccccu

SEQ ID NO: 412472 - RNA, 22 nt, Human
ccugugugcugaugacgacaga

SEQ ID NO: 412473 - RNA, 22 nt, Human
uccagggacagcgcuggagcua

SEQ ID NO: 412474 - RNA, 22 nt, Human
cagugcauagauccugaggccu

SEQ ID NO: 412475 - RNA, 22 nt, Human
ugggcagaggacagggaagauc

SEQ ID NO: 412476 - RNA, 22 nt, Human
cacaggcucuucucacuugauu

SEQ ID NO: 412477 - RNA, 22 nt, Human
gucaggaugagggaugaggagu

SEQ ID NO: 412478 - RNA, 22 nt, Human
ucagaggauuggacuuuuaugu

SEQ ID NO: 412479 - RNA, 22 nt, Human
acugccaggauggcacuagagg

SEQ ID NO: 412480 - RNA, 22 nt, Human
cugcaguguucuggaaugcauu

SEQ ID NO: 412481 - RNA, 22 nt, Human
gccugcagcaugcuaggucuug

SEQ ID NO: 412482 - RNA, 22 nt, Human
ggcucugcagugacuugagggg

SEQ ID NO: 412483 - RNA, 22 nt, Human
ucagaguggugguuuugccuuc

SEQ ID NO: 412484 - RNA, 22 nt, Human
aaggccaugcacauccuaggca

SEQ ID NO: 412485 - RNA, 22 nt, Human
caggggcuguuugccucaggcc

SEQ ID NO: 412486 - RNA, 22 nt, Human
cagagcugagaauguugaugcu

SEQ ID NO: 412487 - RNA, 22 nt, Human
aaaguguacuaugucaugaaca

SEQ ID NO: 412488 - RNA, 22 nt, Human
aagaguuuucuauaaucuuggc

SEQ ID NO: 412489 - RNA, 21 nt, Human
aacaaagggaugcucaucuuu

SEQ ID NO: 412490 - RNA, 22 nt, Human
gcuggagccaagcugcucuugg

SEQ ID NO: 412491 - RNA, 22 nt, Human
ggaaaaggccauuguuucucug

SEQ ID NO: 412492 - RNA, 22 nt, Human
gccaccucuuugucucugccgc

SEQ ID NO: 412493 - RNA, 22 nt, Human
agagcagugcugaagaguaggg

SEQ ID NO: 412494 - RNA, 22 nt, Human
ugcucuguaacaaauugacaug

SEQ ID NO: 412495 - RNA, 22 nt, Human
gccccucccagucaggagcacu

SEQ ID NO: 412496 - RNA, 22 nt, Human
uagcagggucucaggagucagg

SEQ ID NO: 412497 - RNA, 21 nt, Human
ugcagccauucagcccuaugc

SEQ ID NO: 412498 - RNA, 21 nt, Human
ugcauaaagaaauacaaauac

SEQ ID NO: 412499 - RNA, 22 nt, Human
ccugagugaauucccucacugu

SEQ ID NO: 412500 - RNA, 22 nt, Human
uuaugacaggaaaaucacagaa

SEQ ID NO: 412501 - RNA, 22 nt, Human
cuacacaguucugccuaauggc

SEQ ID NO: 412502 - RNA, 22 nt, Human
uguuccuaaauaugaauggaga

SEQ ID NO: 412503 - RNA, 22 nt, Human
uuagccauuuuauacaagugua

SEQ ID NO: 412504 - RNA, 22 nt, Human
ggucagccuuggauuugguagc

SEQ ID NO: 412505 - RNA, 22 nt, Human
gcuccacuugcagcuaggcuug

SEQ ID NO: 412506 - RNA, 22 nt, Human
auaucacaguaguuguuuaguu

SEQ ID NO: 412507 - RNA, 22 nt, Human
uugcagagugguugugaggauu

SEQ ID NO: 412508 - RNA, 22 nt, Human
acauucaugucccacuucuagc

SEQ ID NO: 412509 - RNA, 22 nt, Human
ucccagggcagcuguccagaag

SEQ ID NO: 412510 - RNA, 22 nt, Human
cccucagcuucucccugcagcu

SEQ ID NO: 412511 - RNA, 22 nt, Human
uugacaaaaaccucauuucacc

SEQ ID NO: 412512 - RNA, 22 nt, Human
cugcugugcaacauugcaccua

SEQ ID NO: 412513 - RNA, 22 nt, Human
agaggagcugggaggcccucgu

SEQ ID NO: 412514 - RNA, 22 nt, Human
cucuggagguggagguugcagu

SEQ ID NO: 412515 - RNA, 22 nt, Human
aucaaaguggaaguuuacuagg

SEQ ID NO: 412516 - RNA, 20 nt, Human
cugccuggaggccucuaccu

SEQ ID NO: 412517 - RNA, 22 nt, Human
ccagcuuuugcacuggacuggg

SEQ ID NO: 412518 - RNA, 22 nt, Human
aggagucauugagagggguccu

SEQ ID NO: 412519 - RNA, 22 nt, Human
aggcacuguacuagguacaggg

SEQ ID NO: 412520 - RNA, 22 nt, Human
agccugagccccauccagcuga

SEQ ID NO: 412521 - RNA, 22 nt, Human
caggaaugacccaacaguuuca

SEQ ID NO: 412522 - RNA, 22 nt, Human
caugaauauuuaguauuuacuu

SEQ ID NO: 412523 - RNA, 22 nt, Human
acucaguacaucuggaguuggc

SEQ ID NO: 412524 - RNA, 22 nt, Human
aggaagugaaagggaaggaguu

SEQ ID NO: 412525 - RNA, 22 nt, Human
ccaggaggcggaagguacagug

SEQ ID NO: 412526 - RNA, 22 nt, Human
uuacuuuguucucaagauaugu

SEQ ID NO: 412527 - RNA, 20 nt, Human
uccuggccuucucgggcagu

SEQ ID NO: 412528 - RNA, 22 nt, Human
agagugauggguugugcugacc

SEQ ID NO: 412529 - RNA, 22 nt, Human
auucucugugcagauuuaagac

SEQ ID NO: 412530 - RNA, 22 nt, Human
cuggcugccacuucagggucuu

SEQ ID NO: 412531 - RNA, 22 nt, Human
cucuggagcgcugcuucccgcg

SEQ ID NO: 412532 - RNA, 22 nt, Human
acagcuuugggcaaugcuauga

SEQ ID NO: 412533 - RNA, 22 nt, Human
ugggcaagucacuucugucuuu

SEQ ID NO: 412534 - RNA, 22 nt, Human
gagggcucuaccaaguaacucu

SEQ ID NO: 412535 - RNA, 21 nt, Human
uaagaacauuaucuucuuccu

SEQ ID NO: 412536 - RNA, 22 nt, Human
gcucacagccggcuggcagggg

SEQ ID NO: 412537 - RNA, 20 nt, Human
agugucugggccucaggccc

SEQ ID NO: 412538 - RNA, 22 nt, Human
agggcugaguggugcagucaaa

SEQ ID NO: 412539 - RNA, 22 nt, Human
aagggcugggucugguuaaccc

SEQ ID NO: 412540 - RNA, 22 nt, Human
ggggcagcucccgagggcagga

SEQ ID NO: 412541 - RNA, 22 nt, Human
ugguggacaccgcagccaugaa

SEQ ID NO: 412542 - RNA, 20 nt, Human
uggagcuccagcguccaugu

SEQ ID NO: 412543 - RNA, 22 nt, Human
ugugaaagauacuaggcagagg

SEQ ID NO: 412544 - RNA, 22 nt, Human
agggaguuagaaauccaggaua

SEQ ID NO: 412545 - RNA, 22 nt, Human
caaggaaaacagaugaucaaca

SEQ ID NO: 412546 - RNA, 22 nt, Human
uggcugggggugcuauagcugc

SEQ ID NO: 412547 - RNA, 22 nt, Human
gcuuccuagaucugugguacuc

SEQ ID NO: 412548 - RNA, 22 nt, Human
ugccacccagccaggaguggga

SEQ ID NO: 412549 - RNA, 22 nt, Human
ggagugggaacaaugacauggu

SEQ ID NO: 412550 - RNA, 22 nt, Human
cugggagaugacucagagcagg

SEQ ID NO: 412551 - RNA, 19 nt, Human
ugguggcaaugucagcuaa

SEQ ID NO: 412552 - RNA, 22 nt, Human
gugccaggugcuaagcugugcu

SEQ ID NO: 412553 - RNA, 20 nt, Human
agagaauucccuuuggagau

SEQ ID NO: 412554 - RNA, 22 nt, Human
agucagugaaggcauugcucaa

SEQ ID NO: 412555 - RNA, 22 nt, Human
cucucaggcuugggucguggca

SEQ ID NO: 412556 - RNA, 22 nt, Human
gaggagaaagcagugauuugug

SEQ ID NO: 412557 - RNA, 20 nt, Human
caucagugccugacaggucc

SEQ ID NO: 412558 - RNA, 22 nt, Human
acaggccacaguggagucucug

SEQ ID NO: 412559 - RNA, 22 nt, Human
aggccuggccuuuauguucaag

SEQ ID NO: 412560 - RNA, 22 nt, Human
acuuugaaggggaacauuuuaa

SEQ ID NO: 412561 - RNA, 22 nt, Human
caaaagauacuugcaucuaacu

SEQ ID NO: 412562 - RNA, 22 nt, Human
aacaguaaaaaucauuuaguug

SEQ ID NO: 412563 - RNA, 22 nt, Human
gcugguccacucccuggaggcu

SEQ ID NO: 412564 - RNA, 22 nt, Human
uuugcauugcagugguuuacag

SEQ ID NO: 412565 - RNA, 22 nt, Human
agcugcccuuaauaggcauuca

SEQ ID NO: 412566 - RNA, 22 nt, Human
gcuccucucccagagcugcagg

SEQ ID NO: 412567 - RNA, 22 nt, Human
cgugagcaaaauggacacuccc

SEQ ID NO: 412568 - RNA, 22 nt, Human
gucccacaccuugaggggucuu

SEQ ID NO: 412569 - RNA, 22 nt, Human
gggcucugggauucagagcaag

SEQ ID NO: 412570 - RNA, 22 nt, Human
uggcauuuuguucaguauaugg

SEQ ID NO: 412571 - RNA, 22 nt, Human
agcagguguagggcucuuugua

SEQ ID NO: 412572 - RNA, 22 nt, Human
uccugagaugagacagugcugc

SEQ ID NO: 412573 - RNA, 22 nt, Human
gcugugcagauguagggagugg

SEQ ID NO: 412574 - RNA, 22 nt, Human
acagaccaaguuuccagcaggu

SEQ ID NO: 412575 - RNA, 22 nt, Human
acaggccucaagacacccaggu

SEQ ID NO: 412576 - RNA, 18 nt, Human
uggagccauugccaccau

SEQ ID NO: 412577 - RNA, 22 nt, Human
uugaaaggccuguuuauccagc

SEQ ID NO: 412578 - RNA, 22 nt, Human
uggcugagaaaaugguuuuagg

SEQ ID NO: 412579 - RNA, 19 nt, Human
ucaaaggcuuuuaggagac

SEQ ID NO: 412580 - RNA, 22 nt, Human
guggcagggugcucaucaugca

SEQ ID NO: 412581 - RNA, 22 nt, Human
caggccugacccugagcuucac

SEQ ID NO: 412582 - RNA, 22 nt, Human
accgaaggaaacuggaaccguu

SEQ ID NO: 412583 - RNA, 22 nt, Human
ugucuagggagcugcucaggcu

SEQ ID NO: 412584 - RNA, 22 nt, Human
cagagagagugggguguggauu

SEQ ID NO: 412585 - RNA, 22 nt, Human
ucucugaagauauuuauuauua

SEQ ID NO: 412586 - RNA, 22 nt, Human
agccaggcucaaggccugcucc

SEQ ID NO: 412587 - RNA, 22 nt, Human
uaagacaugguugaucuagugu

SEQ ID NO: 412588 - RNA, 22 nt, Human
cagggcuccaugcagggacucc

SEQ ID NO: 412589 - RNA, 22 nt, Human
agagccuggacuuuucugagcc

SEQ ID NO: 412590 - RNA, 22 nt, Human
cugcagagcauaaaucugaaua

SEQ ID NO: 412591 - RNA, 22 nt, Human
auggauaagucaaagaguaucc

SEQ ID NO: 412592 - RNA, 22 nt, Human
ccugccuggcuuccagaagaga

SEQ ID NO: 412593 - RNA, 22 nt, Human
caggcagcguccugcuuccugu

SEQ ID NO: 412594 - RNA, 22 nt, Human
uacaggcaugaaugaaaucugu

SEQ ID NO: 412595 - RNA, 17 nt, Human
agcacuaaaaugcuucc

SEQ ID NO: 412596 - RNA, 22 nt, Human
gguuucaacuucaaccucucca

SEQ ID NO: 412597 - RNA, 22 nt, Human
uaaaucaguuucucuuauuggu

SEQ ID NO: 412598 - RNA, 22 nt, Human
cucagagaggcaguggaaguca

SEQ ID NO: 412599 - RNA, 22 nt, Human
uuggauccaucucaggcauagg

SEQ ID NO: 412600 - RNA, 19 nt, Human
gggcuucugggaucaagag

SEQ ID NO: 412601 - RNA, 20 nt, Human
uccagcugucuuucagagac

SEQ ID NO: 412602 - RNA, 22 nt, Human
cugagagcagggacuugagcca

SEQ ID NO: 412603 - RNA, 22 nt, Human
ccugucaguugcugucagggau

SEQ ID NO: 412604 - RNA, 22 nt, Human
uggccuuggcagugagaagagu

SEQ ID NO: 412605 - RNA, 22 nt, Human
uccauuuuguagguaugcuaca

SEQ ID NO: 412606 - RNA, 19 nt, Human
caguggagauuggaggagg

SEQ ID NO: 412607 - RNA, 22 nt, Human
uugaacauuaacuucagucuau

SEQ ID NO: 412608 - RNA, 22 nt, Human
ucucagggcgcagugaggcagu

SEQ ID NO: 412609 - RNA, 22 nt, Human
gcccagaaguugaggcugcagu

SEQ ID NO: 412610 - RNA, 22 nt, Human
uggcucucagcucccagcagcc

SEQ ID NO: 412611 - RNA, 22 nt, Human
uggccugggugcugcugacauc

SEQ ID NO: 412612 - RNA, 22 nt, Human
augggaggaugcucgggugcuc

SEQ ID NO: 412613 - RNA, 23 nt, Human
agcuucauugaccuccgcagggg

SEQ ID NO: 412614 - RNA, 22 nt, Human
acccugggcuuggccugcucag

SEQ ID NO: 412615 - RNA, 22 nt, Human
ugggccuggcccuguggaggag

SEQ ID NO: 412616 - RNA, 22 nt, Human
uggcagaguggaccauacucaa

SEQ ID NO: 412617 - RNA, 22 nt, Human
gcuguccucugaucucuggagg

SEQ ID NO: 412618 - RNA, 22 nt, Human
agggcugcugcuccgggcccag

SEQ ID NO: 412619 - RNA, 20 nt, Human
cuuccacacaagaagcacag

SEQ ID NO: 412620 - RNA, 22 nt, Human
gagagcugauagaugagcuacu

SEQ ID NO: 412621 - RNA, 22 nt, Human
ucagaguguggugagaugugca

SEQ ID NO: 412622 - RNA, 22 nt, Human
gugggugauguacuggaggcca

SEQ ID NO: 412623 - RNA, 22 nt, Human
gcauggcagugaggauggugcu

SEQ ID NO: 412624 - RNA, 22 nt, Human
cagcccuggaacagcugacuca

SEQ ID NO: 412625 - RNA, 22 nt, Human
auuucucagcacuuccuaucuc

SEQ ID NO: 412626 - RNA, 22 nt, Human
gugcucuggcuggucucccggu

SEQ ID NO: 412627 - RNA, 22 nt, Human
ccaggcuggagugcaauggugc

SEQ ID NO: 412628 - RNA, 22 nt, Human
agugcacagcgugauguauugg

SEQ ID NO: 412629 - RNA, 22 nt, Human
uuuauguaguuacggacuauca

SEQ ID NO: 412630 - RNA, 22 nt, Human
cuuauauuugucaacuuuacaa

SEQ ID NO: 412631 - RNA, 22 nt, Human
aggccucaggaagguaaagaag

SEQ ID NO: 412632 - RNA, 18 nt, Human
guuaauuuugaaguucau

SEQ ID NO: 412633 - RNA, 22 nt, Human
aggccugaaggaagaugagcug

SEQ ID NO: 412634 - RNA, 22 nt, Human
auuugcagagcucugaauuuug

SEQ ID NO: 412635 - RNA, 22 nt, Human
auacaugucaucauauguuugu

SEQ ID NO: 412636 - RNA, 22 nt, Human
cugcccugccuggccagugugg

SEQ ID NO: 412637 - RNA, 22 nt, Human
uggagcugauacagcuggcuuu

SEQ ID NO: 412638 - RNA, 22 nt, Human
ggaggccagggacccagucagc

SEQ ID NO: 412639 - RNA, 22 nt, Human
ggucagggggaucugugaggua

SEQ ID NO: 412640 - RNA, 22 nt, Human
ugaauaaacuaugaggaggaau

SEQ ID NO: 412641 - RNA, 22 nt, Human
cccagcccaucucaaaggucua

SEQ ID NO: 412642 - RNA, 21 nt, Human
gggcuggacaugguggcucau

SEQ ID NO: 412643 - RNA, 22 nt, Human
cccugcagugugaccucaccua

SEQ ID NO: 412644 - RNA, 22 nt, Human
acuguacaacugcugagcagaa

SEQ ID NO: 412645 - RNA, 22 nt, Human
cagggcugguuugucgaagaaa

SEQ ID NO: 412646 - RNA, 22 nt, Human
uggcuucuuagaccaguggccu

SEQ ID NO: 412647 - RNA, 22 nt, Human
ucugcaggacugaggccuguuu

SEQ ID NO: 412648 - RNA, 22 nt, Human
agcuggcauacuuugcuaggaa

SEQ ID NO: 412649 - RNA, 22 nt, Human
caguccugagccaaucaugaug

SEQ ID NO: 412650 - RNA, 22 nt, Human
aggcucaguuugguuuccauug

SEQ ID NO: 412651 - RNA, 22 nt, Human
uuuucauuuacauuagggaaga

SEQ ID NO: 412652 - RNA, 22 nt, Human
aaauccuaagcagaggaauuua

SEQ ID NO: 412653 - RNA, 22 nt, Human
cagcugugggccugacguggca

SEQ ID NO: 412654 - RNA, 19 nt, Human
gcauuucucuuuacagcca

SEQ ID NO: 412655 - RNA, 22 nt, Human
agcaggaguuugaugcuuuuau

SEQ ID NO: 412656 - RNA, 22 nt, Human
acagccagaggagccaggcugg

SEQ ID NO: 412657 - RNA, 22 nt, Human
gggugcaggcagcccaggcagg

SEQ ID NO: 412658 - RNA, 18 nt, Human
uccgaggcaccauaaaaa

SEQ ID NO: 412659 - RNA, 22 nt, Human
augaaauaucuugaagaaauuc

SEQ ID NO: 412660 - RNA, 22 nt, Human
aucaguuuguauaugaaacacu

SEQ ID NO: 412661 - RNA, 22 nt, Human
uguuacaauauuaucaacugag

SEQ ID NO: 412662 - RNA, 22 nt, Human
uacccaggggcugagcagaggu

SEQ ID NO: 412663 - RNA, 22 nt, Human
aaagaauuuguacacccuacua

SEQ ID NO: 412664 - RNA, 19 nt, Human
uggcaucuguaaaauggug

SEQ ID NO: 412665 - RNA, 22 nt, Human
auacaaagcuuucugucuggua

SEQ ID NO: 412666 - RNA, 21 nt, Human
uagcacuucgcuguaauuggg

SEQ ID NO: 412667 - RNA, 22 nt, Human
ccaggcugccgaggaaagaaag

SEQ ID NO: 412668 - RNA, 22 nt, Human
acccaggagguggaggcugcag

SEQ ID NO: 412669 - RNA, 22 nt, Human
ggggccagguccagcuuccaaa

SEQ ID NO: 412670 - RNA, 20 nt, Human
ugcuccaucuaaagugauua

SEQ ID NO: 412671 - RNA, 22 nt, Human
auugaaagguuuugagcagaua

SEQ ID NO: 412672 - RNA, 22 nt, Human
uguuucaggaccuaucuuuuag

SEQ ID NO: 412673 - RNA, 22 nt, Human
ugcccagcacugugccagucac

SEQ ID NO: 412674 - RNA, 22 nt, Human
aagccacugagauuucacugca

SEQ ID NO: 412675 - RNA, 22 nt, Human
gccugguggacacugggcauca

SEQ ID NO: 412676 - RNA, 22 nt, Human
cccuggagcaucucugcugucu

SEQ ID NO: 412677 - RNA, 21 nt, Human
ucuuguccuugcucucccacu

SEQ ID NO: 412678 - RNA, 22 nt, Human
ccuggcagaauauuaaagugca

SEQ ID NO: 412679 - RNA, 22 nt, Human
ccugaagagcacucuagaguug

SEQ ID NO: 412680 - RNA, 22 nt, Human
gguuccaccuggcgagggguau

SEQ ID NO: 412681 - RNA, 22 nt, Human
acauuucuuucuauucaguagc

SEQ ID NO: 412682 - RNA, 22 nt, Human
ucagcugccuuucccaugcuag

SEQ ID NO: 412683 - RNA, 22 nt, Human
guuacaaagcacuucaagugaa

SEQ ID NO: 412684 - RNA, 22 nt, Human
agccaggaagaaggucacacca

SEQ ID NO: 412685 - RNA, 22 nt, Human
gcagaggagaugaagauacuuu

SEQ ID NO: 412686 - RNA, 22 nt, Human
agggaggaucugcuccuugucu

SEQ ID NO: 412687 - RNA, 22 nt, Human
gaugcacuugccccuccucaga

SEQ ID NO: 412688 - RNA, 20 nt, Human
uggcccuguuuucuccaggc

SEQ ID NO: 412689 - RNA, 22 nt, Human
caggaaaaaugccaggagucag

SEQ ID NO: 412690 - RNA, 18 nt, Human
cagggcuguggggucacu

SEQ ID NO: 412691 - RNA, 22 nt, Human
aggcagcagacuguuaaucaga

SEQ ID NO: 412692 - RNA, 22 nt, Human
agagccugucaauuguaaagag

SEQ ID NO: 412693 - RNA, 22 nt, Human
gccacccccaaguagguggucu

SEQ ID NO: 412694 - RNA, 17 nt, Human
aaucuguuuacagucag

SEQ ID NO: 412695 - RNA, 22 nt, Human
cucuggaguucucaugaggaac

SEQ ID NO: 412696 - RNA, 22 nt, Human
uuucacaugguacugccuguuu

SEQ ID NO: 412697 - RNA, 22 nt, Human
aggaccuguguuuuccuugaau

SEQ ID NO: 412698 - RNA, 22 nt, Human
aagcagcagaccugauuuugaa

SEQ ID NO: 412699 - RNA, 22 nt, Human
caggugucaaaauacuaagugg

SEQ ID NO: 412700 - RNA, 22 nt, Human
cagggugccaaagaacaaauau

SEQ ID NO: 412701 - RNA, 22 nt, Human
ggcagaccucuccagccccaca

SEQ ID NO: 412702 - RNA, 22 nt, Human
cagagcagagugauuguucugg

SEQ ID NO: 412703 - RNA, 22 nt, Human
agcugagcauuugauccaccuc

SEQ ID NO: 412704 - RNA, 22 nt, Human
aggaggaggugggacacaguga

SEQ ID NO: 412705 - RNA, 22 nt, Human
gaagagcuaaaggcacaggcuu

SEQ ID NO: 412706 - RNA, 21 nt, Human
cccagggaagccgcagucacc

SEQ ID NO: 412707 - RNA, 22 nt, Human
uucaggaugcagagguuguagu

SEQ ID NO: 412708 - RNA, 22 nt, Human
uuguuacagcagugauuucaga

SEQ ID NO: 412709 - RNA, 22 nt, Human
guuuuccacuggauuguuugga

SEQ ID NO: 412710 - RNA, 19 nt, Human
guggccucggagcgcgcgg

SEQ ID NO: 412711 - RNA, 22 nt, Human
gauccucuuuuccuaggaaggu

SEQ ID NO: 412712 - RNA, 22 nt, Human
uccuucagcuuauuucuuagga

SEQ ID NO: 412713 - RNA, 18 nt, Human
cugagggcagccccuggg

SEQ ID NO: 412714 - RNA, 22 nt, Human
uuaauuuuaaccuguuuguguc

SEQ ID NO: 412715 - RNA, 19 nt, Human
agggccaggauucuggaac

SEQ ID NO: 412716 - RNA, 22 nt, Human
ucaaaguuuguggcaauuuauu

SEQ ID NO: 412717 - RNA, 22 nt, Human
uucacagauguauuggaacucc

SEQ ID NO: 412718 - RNA, 22 nt, Human
uggagaagcuguagguggacuc

SEQ ID NO: 412719 - RNA, 22 nt, Human
ccuccugggccuugcucuguga

SEQ ID NO: 412720 - RNA, 22 nt, Human
uuuauguacauauccacaagga

SEQ ID NO: 412721 - RNA, 22 nt, Human
aggcacugugcagucccaagca

SEQ ID NO: 412722 - RNA, 22 nt, Human
uuuuaucaaucauuaagacauu

SEQ ID NO: 412723 - RNA, 22 nt, Human
gaggcugcggggaggagccugc

SEQ ID NO: 412724 - RNA, 22 nt, Human
cugcagugaaaucaggaagcaa

SEQ ID NO: 412725 - RNA, 22 nt, Human
gggcaugagaggcaggcaagug

SEQ ID NO: 412726 - RNA, 18 nt, Human
gcccugguggagcuggug

SEQ ID NO: 412727 - RNA, 22 nt, Human
agggcugagacuaaggccagau

SEQ ID NO: 412728 - RNA, 22 nt, Human
uggcugagaaguucugguggga

SEQ ID NO: 412729 - RNA, 22 nt, Human
ucagguguuagaagaaauuuca

SEQ ID NO: 412730 - RNA, 22 nt, Human
cuuuauuccuacaagauuuucu

SEQ ID NO: 412731 - RNA, 22 nt, Human
guaugcaucgacucaagucuga

SEQ ID NO: 412732 - RNA, 22 nt, Human
uugaaaguccuucuugaguuac

SEQ ID NO: 412733 - RNA, 22 nt, Human
ucuauuugcugguugcuucugu

SEQ ID NO: 412734 - RNA, 22 nt, Human
ucuuagaaaugaaguucuuucu

SEQ ID NO: 412735 - RNA, 22 nt, Human
ugagggcugcuuccagagcuag

SEQ ID NO: 412736 - RNA, 22 nt, Human
ggccagaggccauccuccugcu

SEQ ID NO: 412737 - RNA, 22 nt, Human
uuuaucacagaauaagaaguca

SEQ ID NO: 412738 - RNA, 22 nt, Human
agggucagggagugaguauuua

SEQ ID NO: 412739 - RNA, 21 nt, Human
aacuuuagaaagacugggaag

SEQ ID NO: 412740 - RNA, 22 nt, Human
gaggcucaguuauuuuagccug

SEQ ID NO: 412741 - RNA, 22 nt, Human
uaccuuuugcuuauuaugacac

SEQ ID NO: 412742 - RNA, 22 nt, Human
ucaggaaagaagaugcucagug

SEQ ID NO: 412743 - RNA, 22 nt, Human
caagauggagaagcagcaaggg

SEQ ID NO: 412744 - RNA, 22 nt, Human
gcaggcucuucuuucugcccag

SEQ ID NO: 412745 - RNA, 22 nt, Human
gcuguccugggaacaggcacua

SEQ ID NO: 412746 - RNA, 22 nt, Human
auaaaaguuuccaaucaugccu

SEQ ID NO: 412747 - RNA, 22 nt, Human
auuguaucuugucauuaugcau

SEQ ID NO: 412748 - RNA, 22 nt, Human
cugaggcugggcugaggguaua

SEQ ID NO: 412749 - RNA, 22 nt, Human
agcugucagugcugugccugua

SEQ ID NO: 412750 - RNA, 22 nt, Human
uggcccugugugcaggcugcac

SEQ ID NO: 412751 - RNA, 22 nt, Human
cuggccuggcaggggaccucua

SEQ ID NO: 412752 - RNA, 22 nt, Human
uauuucugggaguucagaaauu

SEQ ID NO: 412753 - RNA, 23 nt, Human
gccugggacugguagugugaccu

SEQ ID NO: 412754 - RNA, 22 nt, Human
guuauugcaguauagaggucua

SEQ ID NO: 412755 - RNA, 22 nt, Human
cagcuggaucccugcagaacuu

SEQ ID NO: 412756 - RNA, 21 nt, Human
ggugggcacaggagagcagag

SEQ ID NO: 412757 - RNA, 22 nt, Human
aguccagugucaaggugccauu

SEQ ID NO: 412758 - RNA, 20 nt, Human
gcucccagccugcagucccc

SEQ ID NO: 412759 - RNA, 22 nt, Human
aagcgccacgagaagcuggacc

SEQ ID NO: 412760 - RNA, 22 nt, Human
cagagugaaaacugagcucaaa

SEQ ID NO: 412761 - RNA, 21 nt, Human
agccugcaauguagguaccgg

SEQ ID NO: 412762 - RNA, 22 nt, Human
acuuugugcccaacagaaagaa

SEQ ID NO: 412763 - RNA, 22 nt, Human
guuaaauucgaugauggauaaa

SEQ ID NO: 412764 - RNA, 22 nt, Human
aaucagaaaauucaguggaauu

SEQ ID NO: 412765 - RNA, 22 nt, Human
gaaggccugugguagugagacg

SEQ ID NO: 412766 - RNA, 22 nt, Human
acuaaagaagccaaaguuuucu

SEQ ID NO: 412767 - RNA, 22 nt, Human
agugcccuggcccagcuggacc

SEQ ID NO: 412768 - RNA, 22 nt, Human
gugcagcugugugagagcucca

SEQ ID NO: 412769 - RNA, 22 nt, Human
ucugccugccagucugguccuc

SEQ ID NO: 412770 - RNA, 22 nt, Human
ggcucagguuaccagucccucc

SEQ ID NO: 412771 - RNA, 22 nt, Human
ugggcagagucauacaggagac

SEQ ID NO: 412772 - RNA, 22 nt, Human
acagagaugcaaguguguauuu

SEQ ID NO: 412773 - RNA, 22 nt, Human
cugaggcaguuuaauuuuugaa

SEQ ID NO: 412774 - RNA, 22 nt, Human
ugacccugcuucuuggugcagg

SEQ ID NO: 412775 - RNA, 23 nt, Human
ccugucugugcuggguggacaca

SEQ ID NO: 412776 - RNA, 22 nt, Human
agggcuggaggguacuaguuua

SEQ ID NO: 412777 - RNA, 22 nt, Human
agagcuguucagcagccagguu

SEQ ID NO: 412778 - RNA, 20 nt, Human
ggucccugcccucugucauc

SEQ ID NO: 412779 - RNA, 22 nt, Human
aaguucaagcucugccuaaaau

SEQ ID NO: 412780 - RNA, 22 nt, Human
gcguggugcugcccugcacaca

SEQ ID NO: 412781 - RNA, 22 nt, Human
aggagucagauuguuugaaugu

SEQ ID NO: 412782 - RNA, 22 nt, Human
agaacagcagcacgucaagcug

SEQ ID NO: 412783 - RNA, 22 nt, Human
gggcaggaggcuaauucugcau

SEQ ID NO: 412784 - RNA, 21 nt, Human
auuuccaaggguaccuaagau

SEQ ID NO: 412785 - RNA, 22 nt, Human
uaaacaucugucauguguuuau

SEQ ID NO: 412786 - RNA, 22 nt, Human
uccuugaauggacauuacacug

SEQ ID NO: 412787 - RNA, 22 nt, Human
uuugaaaauuagacacaggcua

SEQ ID NO: 412788 - RNA, 22 nt, Human
ggaaccaggaguuacacgaguu

SEQ ID NO: 412789 - RNA, 23 nt, Human
uccagcagccaagaaggguagaa

SEQ ID NO: 412790 - RNA, 22 nt, Human
agaccauagggaccucagguug

SEQ ID NO: 412791 - RNA, 22 nt, Human
ccugccuguacuagagacccag

SEQ ID NO: 412792 - RNA, 22 nt, Human
gagccuggauugucaccgacuu

SEQ ID NO: 412793 - RNA, 22 nt, Human
uauaguacauggaaucuucaua

SEQ ID NO: 412794 - RNA, 22 nt, Human
uucagagagaccaaguggcgug

SEQ ID NO: 412795 - RNA, 22 nt, Human
ucuacugcacuggugucucauc

SEQ ID NO: 412796 - RNA, 19 nt, Human
ggcccaaguacugagugcc

SEQ ID NO: 412797 - RNA, 22 nt, Human
uccuucagccaugggcucucca

SEQ ID NO: 412798 - RNA, 22 nt, Human
uaccugcaaaguuccuuuugcc

SEQ ID NO: 412799 - RNA, 22 nt, Human
uggcugccuagucccucagccu

SEQ ID NO: 412800 - RNA, 19 nt, Human
gggaccugacuaauuggca

SEQ ID NO: 412801 - RNA, 22 nt, Human
agcuggccuuagugagcaccug

SEQ ID NO: 412802 - RNA, 22 nt, Human
uuuaucuuuggaucuucagaaa

SEQ ID NO: 412803 - RNA, 22 nt, Human
auucaaguggcugcuauguuaa

SEQ ID NO: 412804 - RNA, 22 nt, Human
cugaggccagcugcagagcucu

SEQ ID NO: 412805 - RNA, 22 nt, Human
gguccccguggaggcuggagcg

SEQ ID NO: 412806 - RNA, 17 nt, Human
agcugagcuggccaggg

SEQ ID NO: 412807 - RNA, 22 nt, Human
ugccaggccacguagcuucaag

SEQ ID NO: 412808 - RNA, 22 nt, Human
gcuuuccuggcccugucccugc

SEQ ID NO: 412809 - RNA, 22 nt, Human
uggcugagagcaauugacucug

SEQ ID NO: 412810 - RNA, 22 nt, Human
uaggagaggugaauggcacacu

SEQ ID NO: 412811 - RNA, 18 nt, Human
cauaauuuucuuucuuua

SEQ ID NO: 412812 - RNA, 22 nt, Human
ugccuggcaagaggggcuggcu

SEQ ID NO: 412813 - RNA, 19 nt, Human
caaguucuggagauuaggg

SEQ ID NO: 412814 - RNA, 22 nt, Human
uucaggaugacaccauguccag

SEQ ID NO: 412815 - RNA, 22 nt, Human
cccagggacagaugggcagcua

SEQ ID NO: 412816 - RNA, 21 nt, Human
agcucagccgggcacaguggc

SEQ ID NO: 412817 - RNA, 22 nt, Human
caguuucugggcguucacaggu

SEQ ID NO: 412818 - RNA, 22 nt, Human
gaggucaggcuugcagcagggu

SEQ ID NO: 412819 - RNA, 22 nt, Human
ucccugggccuccugcuaugca

SEQ ID NO: 412820 - RNA, 22 nt, Human
ucagaggacgcacuaggguugu

SEQ ID NO: 412821 - RNA, 22 nt, Human
ugaagguggcauaggagagaug

SEQ ID NO: 412822 - RNA, 22 nt, Human
ugaagcaggcauugacugauga

SEQ ID NO: 412823 - RNA, 22 nt, Human
cucacugugaccucagcagaca

SEQ ID NO: 412824 - RNA, 22 nt, Human
uccaggcauuccagccauucca

SEQ ID NO: 412825 - RNA, 22 nt, Human
ucucucagcuuugagaccugcu

SEQ ID NO: 412826 - RNA, 22 nt, Human
uuugaaagaauuuauguacuuu

SEQ ID NO: 412827 - RNA, 22 nt, Human
uuuauuauguacaggcacuaua

SEQ ID NO: 412828 - RNA, 22 nt, Human
uucuugauuucaugcaguuaag

SEQ ID NO: 412829 - RNA, 22 nt, Human
acuuuggaucugauguaaucag

SEQ ID NO: 412830 - RNA, 22 nt, Human
cacaggaggaggccagagcgua

SEQ ID NO: 412831 - RNA, 22 nt, Human
gggcacagcugcuacccagugc

SEQ ID NO: 412832 - RNA, 22 nt, Human
acaugcauucucuaaaagcaaa

SEQ ID NO: 412833 - RNA, 22 nt, Human
uauauagaaaagcagauguugg

SEQ ID NO: 412834 - RNA, 22 nt, Human
auccaaagauggaaagaacuuu

SEQ ID NO: 412835 - RNA, 22 nt, Human
agagaagacuuacagccacagu

SEQ ID NO: 412836 - RNA, 22 nt, Human
gcuguacaggguuauccuuucc

SEQ ID NO: 412837 - RNA, 22 nt, Human
aacauuucagcaaauaagaaca

SEQ ID NO: 412838 - RNA, 22 nt, Human
acacuaauuaagcugcuuuacu

SEQ ID NO: 412839 - RNA, 22 nt, Human
acagggccaggugagaggugcu

SEQ ID NO: 412840 - RNA, 22 nt, Human
uuuuccucuguuauuaguguga

SEQ ID NO: 412841 - RNA, 22 nt, Human
ugcagaagcagagccgguggcc

SEQ ID NO: 412842 - RNA, 22 nt, Human
acucaggaaaaauguagugaua

SEQ ID NO: 412843 - RNA, 22 nt, Human
gcucaggaucccaggggugugc

SEQ ID NO: 412844 - RNA, 22 nt, Human
cuuagggaaucuuagagcugga

SEQ ID NO: 412845 - RNA, 22 nt, Human
uggcagagaugaagaguuguuu

SEQ ID NO: 412846 - RNA, 22 nt, Human
gcugagagugagcacuggauau

SEQ ID NO: 412847 - RNA, 22 nt, Human
uggcugggugcuauccaguacu

SEQ ID NO: 412848 - RNA, 22 nt, Human
agaaaauauucauugagaggcu

SEQ ID NO: 412849 - RNA, 22 nt, Human
gccucaggacuggcauacucau

SEQ ID NO: 412850 - RNA, 22 nt, Human
cuucccugauaagagccucaga

SEQ ID NO: 412851 - RNA, 21 nt, Human
ugauccuuucccccauguugc

SEQ ID NO: 412852 - RNA, 22 nt, Human
aagcugcagacccccugucuca

SEQ ID NO: 412853 - RNA, 22 nt, Human
ggcaguggguuccccaaggcac

SEQ ID NO: 412854 - RNA, 22 nt, Human
acaccagggccuagccagggcg

SEQ ID NO: 412855 - RNA, 22 nt, Human
ccaagaugaucuuuacaguguu

SEQ ID NO: 412856 - RNA, 22 nt, Human
caauuucucuuuauaucucaca

SEQ ID NO: 412857 - RNA, 22 nt, Human
gacuuuggcaucuagacauugu

SEQ ID NO: 412858 - RNA, 19 nt, Human
uggcagaggcaguuuguac

SEQ ID NO: 412859 - RNA, 19 nt, Human
uccuucagucagaucuggg

SEQ ID NO: 412860 - RNA, 22 nt, Human
cauccagggcagccauggccug

SEQ ID NO: 412861 - RNA, 22 nt, Human
aucaggaagccagucuaaugga

SEQ ID NO: 412862 - RNA, 22 nt, Human
agcuggugcucaggggcaugga

SEQ ID NO: 412863 - RNA, 21 nt, Human
aagccagcccacagugguuug

SEQ ID NO: 412864 - RNA, 22 nt, Human
uaucuacaggugucagguaaga

SEQ ID NO: 412865 - RNA, 22 nt, Human
aagaacuuccuaauauauuuuc

SEQ ID NO: 412866 - RNA, 22 nt, Human
caaaguccauaguuuacaauag

SEQ ID NO: 412867 - RNA, 22 nt, Human
gccuguccuggaugcucugcaa

SEQ ID NO: 412868 - RNA, 22 nt, Human
ggaagccaggcugggggaucug

SEQ ID NO: 412869 - RNA, 22 nt, Human
cugaggagagaucacguggugu

SEQ ID NO: 412870 - RNA, 22 nt, Human
agaauuguugggguaauaaaag

SEQ ID NO: 412871 - RNA, 22 nt, Human
ccucagggaaugggaggcuggg

SEQ ID NO: 412872 - RNA, 22 nt, Human
gucugucucucuccagagugca

SEQ ID NO: 412873 - RNA, 22 nt, Human
cuuggcagcuuuuggaggagcc

SEQ ID NO: 412874 - RNA, 22 nt, Human
ucucccaggcugcccuguggac

SEQ ID NO: 412875 - RNA, 22 nt, Human
uucaggaucacuaaacccucca

SEQ ID NO: 412876 - RNA, 22 nt, Human
ugaggccugucauugucuuguu

SEQ ID NO: 412877 - RNA, 19 nt, Human
ggcagacacaguugacaug

SEQ ID NO: 412878 - RNA, 22 nt, Human
aaagcucacaguaauacaaggc

SEQ ID NO: 412879 - RNA, 22 nt, Human
ccugggcuggaguacagcagug

SEQ ID NO: 412880 - RNA, 22 nt, Human
ggucucagcuggaguccuuggu

SEQ ID NO: 412881 - RNA, 22 nt, Human
ugucucaguucccuucucugga

SEQ ID NO: 412882 - RNA, 22 nt, Human
ggcagugagcuggagggaagga

SEQ ID NO: 412883 - RNA, 22 nt, Human
uaccuugggguuuuguugcucu

SEQ ID NO: 412884 - RNA, 22 nt, Human
gcaggggaguccacucuaugca

SEQ ID NO: 412885 - RNA, 22 nt, Human
gaaugcuaagcaugugggaguu

SEQ ID NO: 412886 - RNA, 18 nt, Human
ggcuguggacaagauuag

SEQ ID NO: 412887 - RNA, 18 nt, Human
aaagaaggauuggagagc

SEQ ID NO: 412888 - RNA, 22 nt, Human
ggggccagcacugugccuuugu

SEQ ID NO: 412889 - RNA, 22 nt, Human
aaggcugaguaaaacagagaac

SEQ ID NO: 412890 - RNA, 22 nt, Human
agaaugcaagauaaacuuuauu

SEQ ID NO: 412891 - RNA, 22 nt, Human
aggcaggucacaugcuuggcga

SEQ ID NO: 412892 - RNA, 22 nt, Human
aaaggucaagcuggacucaggu

SEQ ID NO: 412893 - RNA, 22 nt, Human
cagagcagacguugagauuaag

SEQ ID NO: 412894 - RNA, 22 nt, Human
cagacuugacggcagcugcuuu

SEQ ID NO: 412895 - RNA, 22 nt, Human
ccagagcccgggaccuggacuu

SEQ ID NO: 412896 - RNA, 22 nt, Human
agcagggcuugccgcuuguccu

SEQ ID NO: 412897 - RNA, 22 nt, Human
gagcugccaagauuacaaucag

SEQ ID NO: 412898 - RNA, 22 nt, Human
uccugaggaaaguucaugaaug

SEQ ID NO: 412899 - RNA, 20 nt, Human
uccagcugggaacagcugau

SEQ ID NO: 412900 - RNA, 22 nt, Human
ugucccagucaaggcugucauc

SEQ ID NO: 412901 - RNA, 22 nt, Human
aucagagaaguuucacuggcau

SEQ ID NO: 412902 - RNA, 22 nt, Human
cugucugucaccaaaacagacu

SEQ ID NO: 412903 - RNA, 21 nt, Human
ucccagggccaggugccauca

SEQ ID NO: 412904 - RNA, 22 nt, Human
uguauuuugugaggaucacucu

SEQ ID NO: 412905 - RNA, 22 nt, Human
gcugugugcucacguaguggaa

SEQ ID NO: 412906 - RNA, 22 nt, Human
gggugggguucaggaaucuuca

SEQ ID NO: 412907 - RNA, 22 nt, Human
ucagcuuuuuggauugcccaag

SEQ ID NO: 412908 - RNA, 22 nt, Human
aaugagacacgugaagcagaug

SEQ ID NO: 412909 - RNA, 22 nt, Human
agauaacuuuuggguauucaug

SEQ ID NO: 412910 - RNA, 22 nt, Human
gaguggggcguggauccagcgu

SEQ ID NO: 412911 - RNA, 18 nt, Human
gaggauggaaggagaugc

SEQ ID NO: 412912 - RNA, 22 nt, Human
gccagcucagaugcaggaagga

SEQ ID NO: 412913 - RNA, 22 nt, Human
cagucacauugcccugcauuua

SEQ ID NO: 412914 - RNA, 22 nt, Human
uaaggccaggcuguggucggca

SEQ ID NO: 412915 - RNA, 22 nt, Human
gcuggaccaggugugcacaggc

SEQ ID NO: 412916 - RNA, 22 nt, Human
aacccuggggcagcugcuaggg

SEQ ID NO: 412917 - RNA, 22 nt, Human
aggcacugacucaagggagcca

SEQ ID NO: 412918 - RNA, 22 nt, Human
aagauggagcacgagcagaagc

SEQ ID NO: 412919 - RNA, 22 nt, Human
agggccugggucuguacuccuc

SEQ ID NO: 412920 - RNA, 22 nt, Human
agucuucucauuucacaugcuu

SEQ ID NO: 412921 - RNA, 22 nt, Human
agccuucacugggaccuuggau

SEQ ID NO: 412922 - RNA, 22 nt, Human
aaaugcacagagccuuagagau

SEQ ID NO: 412923 - RNA, 22 nt, Human
uugggcaaaguguuucuggagc

SEQ ID NO: 412924 - RNA, 22 nt, Human
cacucacuuauuucuaacagaa

SEQ ID NO: 412925 - RNA, 22 nt, Human
uuugaaagagcugauacaugaa

SEQ ID NO: 412926 - RNA, 22 nt, Human
aaaguuacuaucacaaugaaau

SEQ ID NO: 412927 - RNA, 22 nt, Human
ccaggcaggcuagaauguaaau

SEQ ID NO: 412928 - RNA, 17 nt, Human
uccagagcacagagcuc

SEQ ID NO: 412929 - RNA, 22 nt, Human
cagcaauaagccagguuagaca

SEQ ID NO: 412930 - RNA, 22 nt, Human
aguggcaggaaaguggaagaga

SEQ ID NO: 412931 - RNA, 22 nt, Human
gagcaggcuugcagagaagggg

SEQ ID NO: 412932 - RNA, 22 nt, Human
uggcucagucauggaugaguaa

SEQ ID NO: 412933 - RNA, 22 nt, Human
ugccugcugcuaagcucuuugu

SEQ ID NO: 412934 - RNA, 22 nt, Human
uaaguuuuaagcaaucugauaa

SEQ ID NO: 412935 - RNA, 22 nt, Human
aaguguuuauuuauaacgaucu

SEQ ID NO: 412936 - RNA, 22 nt, Human
acucugccaucccaggugcugu

SEQ ID NO: 412937 - RNA, 15 nt, Human
aggcacugugggacc

SEQ ID NO: 412938 - RNA, 22 nt, Human
cagcuugugcaaagguccuggg

SEQ ID NO: 412939 - RNA, 22 nt, Human
cauguuuuguguacagaauauu

SEQ ID NO: 412940 - RNA, 22 nt, Human
cugcucuggggaagccagaugu

SEQ ID NO: 412941 - RNA, 22 nt, Human
cuggcaggcagacuucugcaag

SEQ ID NO: 412942 - RNA, 22 nt, Human
gagugcaggccugagcaccauc

SEQ ID NO: 412943 - RNA, 22 nt, Human
acaaaguuugugguauuccaag

SEQ ID NO: 412944 - RNA, 22 nt, Human
aggagguggccugagcgugccc

SEQ ID NO: 412945 - RNA, 22 nt, Human
cugugaauuaaguauuguuauc

SEQ ID NO: 412946 - RNA, 22 nt, Human
auaaaaguaggaccaacuuaca

SEQ ID NO: 412947 - RNA, 22 nt, Human
cagcagcaacaacggaagccuu

SEQ ID NO: 412948 - RNA, 22 nt, Human
gcaguggauccaaugguaucuu

SEQ ID NO: 412949 - RNA, 22 nt, Human
ucuggcucuccagugcucuuag

SEQ ID NO: 412950 - RNA, 22 nt, Human
ccaggacuuauuacaguauaac

SEQ ID NO: 412951 - RNA, 22 nt, Human
uuugcauuacuugacuuuaguu

SEQ ID NO: 412952 - RNA, 22 nt, Human
agcagcaugaugacagagucuc

SEQ ID NO: 412953 - RNA, 20 nt, Human
agaggcuuccuugggaggag

SEQ ID NO: 412954 - RNA, 22 nt, Human
uuaaacagagucugaaauguaa

SEQ ID NO: 412955 - RNA, 22 nt, Human
ucagguggcuucggggaguggc

SEQ ID NO: 412956 - RNA, 22 nt, Human
ugguccagacauuucugaggua

SEQ ID NO: 412957 - RNA, 22 nt, Human
ccacaggcugcugcaggucccg

SEQ ID NO: 412958 - RNA, 22 nt, Human
accuggcaugaagcaugccuua

SEQ ID NO: 412959 - RNA, 22 nt, Human
ucuuugucugaacagggacauu

SEQ ID NO: 412960 - RNA, 22 nt, Human
auugaaaauauaauucuaggag

SEQ ID NO: 412961 - RNA, 22 nt, Human
auacaaauuuauagaugcauuu

SEQ ID NO: 412962 - RNA, 19 nt, Human
agucucaguguacagaggc

SEQ ID NO: 412963 - RNA, 22 nt, Human
acagugucugacacauuguagc

SEQ ID NO: 412964 - RNA, 22 nt, Human
ugggccuggguuccuccugggc

SEQ ID NO: 412965 - RNA, 19 nt, Human
ugcagaagacacaguggug

SEQ ID NO: 412966 - RNA, 22 nt, Human
aaugauugcaaacauugagaac

SEQ ID NO: 412967 - RNA, 22 nt, Human
gguccagggaacuuugaaggau

SEQ ID NO: 412968 - RNA, 22 nt, Human
augaggcaggagugcaguggca

SEQ ID NO: 412969 - RNA, 22 nt, Human
aaacaguauuaucaauauauuu

SEQ ID NO: 412970 - RNA, 22 nt, Human
uccugccucaggcucuggagua

SEQ ID NO: 412971 - RNA, 22 nt, Human
cuggagguaauguuauuuuugu

SEQ ID NO: 412972 - RNA, 22 nt, Human
gcuggccaggugcuuugguucu

SEQ ID NO: 412973 - RNA, 22 nt, Human
acagaauucucucugcagaggc

SEQ ID NO: 412974 - RNA, 22 nt, Human
gccugagccgccugagcggcgg

SEQ ID NO: 412975 - RNA, 22 nt, Human
cauguuaauaugcauugaguac

SEQ ID NO: 412976 - RNA, 22 nt, Human
gugucccaaagauuagaaauca

SEQ ID NO: 412977 - RNA, 22 nt, Human
aguggcagagaccccagccagc

SEQ ID NO: 412978 - RNA, 22 nt, Human
caggugcucccagagaagugcu

SEQ ID NO: 412979 - RNA, 22 nt, Human
uuucuuaggcucuaaaaugacu

SEQ ID NO: 412980 - RNA, 22 nt, Human
gagcaggcucugccuguguguc

SEQ ID NO: 412981 - RNA, 17 nt, Human
ucucuuucccuuucugc

SEQ ID NO: 412982 - RNA, 22 nt, Human
aagggugggcaccgccagguca

SEQ ID NO: 412983 - RNA, 22 nt, Human
cccuggagucagguuggccugg

SEQ ID NO: 412984 - RNA, 21 nt, Human
agcagcugggcaacauggagg

SEQ ID NO: 412985 - RNA, 22 nt, Human
cagcugaagaaagagugguuag

SEQ ID NO: 412986 - RNA, 22 nt, Human
ucucagaggcccgacguucucc

SEQ ID NO: 412987 - RNA, 22 nt, Human
ucucagagaacaguuggugcuu

SEQ ID NO: 412988 - RNA, 22 nt, Human
cuggugguucaggagaauggcu

SEQ ID NO: 412989 - RNA, 22 nt, Human
uuaugcuaguauaguccuuaga

SEQ ID NO: 412990 - RNA, 22 nt, Human
gcaggaagaggcucgaagcccc

SEQ ID NO: 412991 - RNA, 22 nt, Human
caggaacagcaccaggagcuag

SEQ ID NO: 412992 - RNA, 22 nt, Human
uccaggaggaggaaggcugcca

SEQ ID NO: 412993 - RNA, 22 nt, Human
cauagcaacagcaucaagucaa

SEQ ID NO: 412994 - RNA, 22 nt, Human
ugaggcagcaauugauuauuca

SEQ ID NO: 412995 - RNA, 22 nt, Human
aggugcugccccgagaaggaug

SEQ ID NO: 412996 - RNA, 20 nt, Human
agauggugaaggccagggag

SEQ ID NO: 412997 - RNA, 21 nt, Human
acccuggguucuccauacccu

SEQ ID NO: 412998 - RNA, 22 nt, Human
ggcuucucucuucacauggcuu

SEQ ID NO: 412999 - RNA, 22 nt, Human
aaacaacuucugcacuaugggu

SEQ ID NO: 413000 - RNA, 22 nt, Human
cuauuacaauucugcaaggagu

SEQ ID NO: 413001 - RNA, 20 nt, Human
ugacucugcaaccgucucuc

SEQ ID NO: 413002 - RNA, 22 nt, Human
aguggagaagaggauggucucc

SEQ ID NO: 413003 - RNA, 22 nt, Human
gguuucaaugagaagugcuugu

SEQ ID NO: 413004 - RNA, 22 nt, Human
ccaccaggacagcccugagggg

SEQ ID NO: 413005 - RNA, 22 nt, Human
acagagcuuaggaugacuccca

SEQ ID NO: 413006 - RNA, 17 nt, Human
gcauccaguaacaugcc

SEQ ID NO: 413007 - RNA, 22 nt, Human
cuugaaagucacaugcagcccu

SEQ ID NO: 413008 - RNA, 22 nt, Human
cuuccucaugugcaaugcaagc

SEQ ID NO: 413009 - RNA, 22 nt, Human
cuccuuccugccccagugauaa

SEQ ID NO: 413010 - RNA, 22 nt, Human
gccuugcuuugcuucuggacag

SEQ ID NO: 413011 - RNA, 22 nt, Human
ugaauaaucuuggguauuaaua

SEQ ID NO: 413012 - RNA, 22 nt, Human
ccugugcccucagccuggcucu

SEQ ID NO: 413013 - RNA, 22 nt, Human
gcuuccuaaaugcacagggcag

SEQ ID NO: 413014 - RNA, 22 nt, Human
ugagagugguucagcucagaag

SEQ ID NO: 413015 - RNA, 22 nt, Human
gcagcugaagcugcaguuccag

SEQ ID NO: 413016 - RNA, 20 nt, Human
cuaucuccuggcgugccuuc

SEQ ID NO: 413017 - RNA, 22 nt, Human
gccugggaacucugaucuccug

SEQ ID NO: 413018 - RNA, 22 nt, Human
agggcaugcuggaggagagaca

SEQ ID NO: 413019 - RNA, 22 nt, Human
guggcucuaggugagcauggag

SEQ ID NO: 413020 - RNA, 22 nt, Human
cagggccacccucugcugggug

SEQ ID NO: 413021 - RNA, 22 nt, Human
ugccagggugucaggagagcua

SEQ ID NO: 413022 - RNA, 22 nt, Human
cauacuuugggauaagagugga

SEQ ID NO: 413023 - RNA, 22 nt, Human
auugaaaaaugacuauugcuua

SEQ ID NO: 413024 - RNA, 22 nt, Human
cacaggcagccuuguagaagaa

SEQ ID NO: 413025 - RNA, 22 nt, Human
cuggagugaagcuuauuuuuca

SEQ ID NO: 413026 - RNA, 22 nt, Human
uuccucagccaaggcugggauc

SEQ ID NO: 413027 - RNA, 22 nt, Human
gucaugccuggcuucuuagaca

SEQ ID NO: 413028 - RNA, 22 nt, Human
cagcccagcacuaaguagauuu

SEQ ID NO: 413029 - RNA, 17 nt, Human
gggcagggacuccuggg

SEQ ID NO: 413030 - RNA, 22 nt, Human
acagaaauugggcaaauggaag

SEQ ID NO: 413031 - RNA, 22 nt, Human
auaaacugaagggaacacugag

SEQ ID NO: 413032 - RNA, 22 nt, Human
uaucaacauuaauauuuucugg

SEQ ID NO: 413033 - RNA, 22 nt, Human
agccucucugaugugacagcua

SEQ ID NO: 413034 - RNA, 22 nt, Human
aagauuuaccacuuuauucaag

SEQ ID NO: 413035 - RNA, 19 nt, Human
ccuggcccugcugcgcggg

SEQ ID NO: 413036 - RNA, 22 nt, Human
ugaaagguguccaauauuucuc

SEQ ID NO: 413037 - RNA, 22 nt, Human
acugcuuuagaccuagagcucu

SEQ ID NO: 413038 - RNA, 22 nt, Human
aaggacuccaauucuuucaucu

SEQ ID NO: 413039 - RNA, 22 nt, Human
ggugcucaagagggcauccucu

SEQ ID NO: 413040 - RNA, 22 nt, Human
gcagcugcuguggcaucaagcu

SEQ ID NO: 413041 - RNA, 22 nt, Human
uggcaggauuugcccggaagga

SEQ ID NO: 413042 - RNA, 21 nt, Human
gcagagccugagguucuugag

SEQ ID NO: 413043 - RNA, 23 nt, Human
uccuuccuuugagaggcuccauc

SEQ ID NO: 413044 - RNA, 22 nt, Human
ugagagugaaaugucacauguc

SEQ ID NO: 413045 - RNA, 23 nt, Human
ccugaagggucaggguccucagc

SEQ ID NO: 413046 - RNA, 22 nt, Human
aggggagccccugguccuggug

SEQ ID NO: 413047 - RNA, 22 nt, Human
cagugcugggcagaggagagcg

SEQ ID NO: 413048 - RNA, 22 nt, Human
uaccaaauguaaucauucuaau

SEQ ID NO: 413049 - RNA, 22 nt, Human
ucucaggagccacagcgggagu

SEQ ID NO: 413050 - RNA, 22 nt, Human
guggcagagguuccucagugug

SEQ ID NO: 413051 - RNA, 22 nt, Human
ucuguaucuaauuuuacaguag

SEQ ID NO: 413052 - RNA, 22 nt, Human
ggcugccaggagaagcucagug

SEQ ID NO: 413053 - RNA, 22 nt, Human
cucagagcccaggguacacccg

SEQ ID NO: 413054 - RNA, 22 nt, Human
gugccuuccccgguggucuguu

SEQ ID NO: 413055 - RNA, 22 nt, Human
uggggcuggcuauugucucccu

SEQ ID NO: 413056 - RNA, 20 nt, Human
cagaaggucuaagcuuuaga

SEQ ID NO: 413057 - RNA, 22 nt, Human
ugaggcuguucuaccagggcca

SEQ ID NO: 413058 - RNA, 22 nt, Human
ucugccuguugcuagaauguca

SEQ ID NO: 413059 - RNA, 22 nt, Human
ccagggcaggagaaagacucac

SEQ ID NO: 413060 - RNA, 22 nt, Human
gaggcugcuuugaugacaggag

SEQ ID NO: 413061 - RNA, 22 nt, Human
accaugaugggaagcucagggc

SEQ ID NO: 413062 - RNA, 22 nt, Human
uaaauucuacaacuucaaagau

SEQ ID NO: 413063 - RNA, 22 nt, Human
agucacaguuccuacccaguaa

SEQ ID NO: 413064 - RNA, 22 nt, Human
gaguggagcaaaagagguagau

SEQ ID NO: 413065 - RNA, 22 nt, Human
uccuugaauugugccacuuacc

SEQ ID NO: 413066 - RNA, 22 nt, Human
auuugucuagugguauucacgu

SEQ ID NO: 413067 - RNA, 22 nt, Human
acuuucauuuguaauaaacuuc

SEQ ID NO: 413068 - RNA, 22 nt, Human
cacaggcuugucagcaugaggc

SEQ ID NO: 413069 - RNA, 22 nt, Human
cagcagggcccccgggugcgcc

SEQ ID NO: 413070 - RNA, 22 nt, Human
cuggcucuucagugcuugguuc

SEQ ID NO: 413071 - RNA, 22 nt, Human
ugccucagaguugucccuacca

SEQ ID NO: 413072 - RNA, 22 nt, Human
gggacuggaguagaggccggug

SEQ ID NO: 413073 - RNA, 20 nt, Human
acagaauaugcugguugugg

SEQ ID NO: 413074 - RNA, 22 nt, Human
ugccagucucacccuggguccu

SEQ ID NO: 413075 - RNA, 22 nt, Human
cacagccugcugcacucaagaa

SEQ ID NO: 413076 - RNA, 22 nt, Human
caugggcaccuuaaaaugaggc

SEQ ID NO: 413077 - RNA, 22 nt, Human
ugugcccauuccacuugaguac

SEQ ID NO: 413078 - RNA, 22 nt, Human
ugagcuuacuucuguacacaga

SEQ ID NO: 413079 - RNA, 22 nt, Human
gcugucacucuccggccuuccc

SEQ ID NO: 413080 - RNA, 22 nt, Human
ucaagagaagugcuccacagua

SEQ ID NO: 413081 - RNA, 22 nt, Human
uccugcaggggcugaggaacca

SEQ ID NO: 413082 - RNA, 23 nt, Human
ggcagagagcauggcuggggccc

SEQ ID NO: 413083 - RNA, 22 nt, Human
uguacaguaggaacuuguuauu

SEQ ID NO: 413084 - RNA, 22 nt, Human
ucucuucuagcuucuugugguu

SEQ ID NO: 413085 - RNA, 22 nt, Human
agggcccaggacagcaucaggg

SEQ ID NO: 413086 - RNA, 22 nt, Human
ucuucacaugaccuucaugucu

SEQ ID NO: 413087 - RNA, 22 nt, Human
gggcugagccacagcuuuuguu

SEQ ID NO: 413088 - RNA, 22 nt, Human
ggcugccuggaccuccucuuuc

SEQ ID NO: 413089 - RNA, 22 nt, Human
uaaggccagcaugaaugcagca

SEQ ID NO: 413090 - RNA, 22 nt, Human
cagccccucacagagcuguccu

SEQ ID NO: 413091 - RNA, 22 nt, Human
ucucagugagcuuuucuauguu

SEQ ID NO: 413092 - RNA, 22 nt, Human
aggcuguccucucuugcucagu

SEQ ID NO: 413093 - RNA, 22 nt, Human
agggacagucuacuguucacug

SEQ ID NO: 413094 - RNA, 22 nt, Human
uaagaacagauaaaguuucccc

SEQ ID NO: 413095 - RNA, 22 nt, Human
gggcagugguuacacagcugag

SEQ ID NO: 413096 - RNA, 22 nt, Human
gacaagacugguuuauuuaagg

SEQ ID NO: 413097 - RNA, 22 nt, Human
aaacacuagcaggaagcacuga

SEQ ID NO: 413098 - RNA, 22 nt, Human
acucuugucucaacuuuuguau

SEQ ID NO: 413099 - RNA, 20 nt, Human
gaggcucugggcauggcgcc

SEQ ID NO: 413100 - RNA, 22 nt, Human
agggcugccugcucugcauuga

SEQ ID NO: 413101 - RNA, 22 nt, Human
aaggcagaaauucaacuacugg

SEQ ID NO: 413102 - RNA, 22 nt, Human
cguguggucccggcaaggcaag

SEQ ID NO: 413103 - RNA, 23 nt, Human
uggcucagcuaguuuuccauuuc

SEQ ID NO: 413104 - RNA, 22 nt, Human
agcucauggugcuaucucaggg

SEQ ID NO: 413105 - RNA, 22 nt, Human
ucuggcuccacucugugcaugc

SEQ ID NO: 413106 - RNA, 22 nt, Human
gucccaggugggcuccaccucu

SEQ ID NO: 413107 - RNA, 22 nt, Human
uuccuguauucuaaagggaaag

SEQ ID NO: 413108 - RNA, 22 nt, Human
caggggcucuaaugcaugauca

SEQ ID NO: 413109 - RNA, 22 nt, Human
agggccagggaagcuguauuuu

SEQ ID NO: 413110 - RNA, 23 nt, Human
cuggcuccgaagacuccaggauc

SEQ ID NO: 413111 - RNA, 22 nt, Human
cagguggggcgcccucaggcag

SEQ ID NO: 413112 - RNA, 22 nt, Human
ggcaggcaguguggugugaaac

SEQ ID NO: 413113 - RNA, 21 nt, Human
ugucagaaauaagcaugugau

SEQ ID NO: 413114 - RNA, 22 nt, Human
uggugcuguggaggggcagaag

SEQ ID NO: 413115 - RNA, 22 nt, Human
gaacuguaguuaauacuacaca

SEQ ID NO: 413116 - RNA, 22 nt, Human
ucauguuauugacucauaauau

SEQ ID NO: 413117 - RNA, 22 nt, Human
cuguaaaacacuguaguaucug

SEQ ID NO: 413118 - RNA, 22 nt, Human
uuuuuccuaagcaguggagcug

SEQ ID NO: 413119 - RNA, 22 nt, Human
gccugccuuuguaugacccuga

SEQ ID NO: 413120 - RNA, 22 nt, Human
uuagggaaggcugcugucagcu

SEQ ID NO: 413121 - RNA, 22 nt, Human
ugaggggagaagcagcagccug

SEQ ID NO: 413122 - RNA, 22 nt, Human
ggccucugguucacagggagga

SEQ ID NO: 413123 - RNA, 22 nt, Human
gagggcugauaaaugcgcaugg

SEQ ID NO: 413124 - RNA, 17 nt, Human
agcugccagggagugug

SEQ ID NO: 413125 - RNA, 22 nt, Human
ucucagagcucacaccuccugg

SEQ ID NO: 413126 - RNA, 22 nt, Human
cagcucuguaaauuccuucauc

SEQ ID NO: 413127 - RNA, 22 nt, Human
ucagugcagaauagugaugcau

SEQ ID NO: 413128 - RNA, 22 nt, Human
gcagagugggagcccagggcug

SEQ ID NO: 413129 - RNA, 22 nt, Human
cuggccuggggccucagcugcu

SEQ ID NO: 413130 - RNA, 22 nt, Human
uucccaggcugugcuaccagag

SEQ ID NO: 413131 - RNA, 22 nt, Human
uggccacccagcugacgccuuc

SEQ ID NO: 413132 - RNA, 22 nt, Human
gggcaggagagaacagucaugg

SEQ ID NO: 413133 - RNA, 22 nt, Human
uggagggcaucuguggucaggc

SEQ ID NO: 413134 - RNA, 22 nt, Human
cuauuauuagauaaucuacuug

SEQ ID NO: 413135 - RNA, 22 nt, Human
guccucuggaagaugaguucuu

SEQ ID NO: 413136 - RNA, 22 nt, Human
guuauuuucauuggcucagacu

SEQ ID NO: 413137 - RNA, 22 nt, Human
cuucagggugacgcaggcugca

SEQ ID NO: 413138 - RNA, 22 nt, Human
gagguggccucaagcagucuuc

SEQ ID NO: 413139 - RNA, 22 nt, Human
gcccauggacacccaagugcca

SEQ ID NO: 413140 - RNA, 22 nt, Human
cuggagccggcgagccccagcc

SEQ ID NO: 413141 - RNA, 22 nt, Human
gaggcucauugcauugugcauu

SEQ ID NO: 413142 - RNA, 22 nt, Human
augugcauuaaaugucaauguu

SEQ ID NO: 413143 - RNA, 22 nt, Human
agagcauccaucggccaggacc

SEQ ID NO: 413144 - RNA, 22 nt, Human
auguguaaaaagugcuuaauau

SEQ ID NO: 413145 - RNA, 22 nt, Human
acaucuguuugagaaaaagaag

SEQ ID NO: 413146 - RNA, 22 nt, Human
uuccacuuaguggaagggcaug

SEQ ID NO: 413147 - RNA, 22 nt, Human
ucccagaggucucugcugguuc

SEQ ID NO: 413148 - RNA, 22 nt, Human
ggguuggggcccagcagucugc

SEQ ID NO: 413149 - RNA, 22 nt, Human
aaaaguaauugcaauuuuguag

SEQ ID NO: 413150 - RNA, 22 nt, Human
gaccauuuguugaaaagauuau

SEQ ID NO: 413151 - RNA, 22 nt, Human
caggcuggagugaguguagugg

SEQ ID NO: 413152 - RNA, 22 nt, Human
ucucagggccccaaaggcuagu

SEQ ID NO: 413153 - RNA, 22 nt, Human
uaauccaaaacugaaucugugg

SEQ ID NO: 413154 - RNA, 22 nt, Human
cagguggcuucucccuaggcca

SEQ ID NO: 413155 - RNA, 22 nt, Human
gaggaggcuggcgccgccugcc

SEQ ID NO: 413156 - RNA, 22 nt, Human
uuaugcuaaaugaaucaaguca

SEQ ID NO: 413157 - RNA, 22 nt, Human
cugcacagagcagggcagacac

SEQ ID NO: 413158 - RNA, 22 nt, Human
aggagcagaacuguuguggagg

SEQ ID NO: 413159 - RNA, 22 nt, Human
uacauguaagacaugagacucu

SEQ ID NO: 413160 - RNA, 22 nt, Human
gcccugucccuuggcuucuagg

SEQ ID NO: 413161 - RNA, 22 nt, Human
gcugauuauuacaugucugugg

SEQ ID NO: 413162 - RNA, 22 nt, Human
caggcacuucugcugcuugucu

SEQ ID NO: 413163 - RNA, 22 nt, Human
cagucucagaggugggaguggg

SEQ ID NO: 413164 - RNA, 22 nt, Human
uucaaugagcccaagaacguga

SEQ ID NO: 413165 - RNA, 22 nt, Human
aaguucuacuguggguaaaaug

SEQ ID NO: 413166 - RNA, 22 nt, Human
gcagcaggcuuuucauaccuug

SEQ ID NO: 413167 - RNA, 22 nt, Human
uccuggaggggacagcaugggc

SEQ ID NO: 413168 - RNA, 22 nt, Human
caggggcuuuuccucuauaagg

SEQ ID NO: 413169 - RNA, 22 nt, Human
caaagguauucucauuuuggaa

SEQ ID NO: 413170 - RNA, 22 nt, Human
agaugagggguagaaaggacuu

SEQ ID NO: 413171 - RNA, 22 nt, Human
cuccagggcagcauggcagugg

SEQ ID NO: 413172 - RNA, 22 nt, Human
cagcagguauguuuguucagca

SEQ ID NO: 413173 - RNA, 21 nt, Human
aagcuucccugcucuccaggg

SEQ ID NO: 413174 - RNA, 22 nt, Human
ugcuucugggcaaaugugugug

SEQ ID NO: 413175 - RNA, 22 nt, Human
ucagaguguuuuacuaaacaag

SEQ ID NO: 413176 - RNA, 22 nt, Human
guugaaagaugucuugguuccc

SEQ ID NO: 413177 - RNA, 22 nt, Human
cuuuggaagugaccacaauccu

SEQ ID NO: 413178 - RNA, 22 nt, Human
agagccugaggccaggaaaaug

SEQ ID NO: 413179 - RNA, 21 nt, Human
ucacacacguuuccaagggca

SEQ ID NO: 413180 - RNA, 22 nt, Human
auacuguuucucuucuacauga

SEQ ID NO: 413181 - RNA, 22 nt, Human
gaggaaaauauucagggagguu

SEQ ID NO: 413182 - RNA, 22 nt, Human
uugggugcugucauggggcacg

SEQ ID NO: 413183 - RNA, 22 nt, Human
cuuaaauuuucaucuacaagaa

SEQ ID NO: 413184 - RNA, 22 nt, Human
uuuguucauuuugagcucauca

SEQ ID NO: 413185 - RNA, 22 nt, Human
ggcuccacccugcuuccagaag

SEQ ID NO: 413186 - RNA, 22 nt, Human
uagcagagcagggaucagagcc

SEQ ID NO: 413187 - RNA, 22 nt, Human
aggucauuguuaagucaccaua

SEQ ID NO: 413188 - RNA, 22 nt, Human
auaaggcagugacuucaucuau

SEQ ID NO: 413189 - RNA, 21 nt, Human
ucacaucuauguuaagcaaac

SEQ ID NO: 413190 - RNA, 22 nt, Human
gaggcaggguguugauuacaga

SEQ ID NO: 413191 - RNA, 23 nt, Human
ugggggugcacgggccacaucuu

SEQ ID NO: 413192 - RNA, 22 nt, Human
aagggcucuguugccauuucag

SEQ ID NO: 413193 - RNA, 22 nt, Human
ucucccuggagcccugaagcau

SEQ ID NO: 413194 - RNA, 17 nt, Human
aggcuggcucacaggga

SEQ ID NO: 413195 - RNA, 22 nt, Human
gucaccagcaccaaugccacau

SEQ ID NO: 413196 - RNA, 22 nt, Human
cagaaggcuuuguggaguagac

SEQ ID NO: 413197 - RNA, 22 nt, Human
cagcagcuucuguugaucagaa

SEQ ID NO: 413198 - RNA, 22 nt, Human
ugucuuuagagucacaaaacca

SEQ ID NO: 413199 - RNA, 22 nt, Human
uuuaucuuuaggacuuugcaga

SEQ ID NO: 413200 - RNA, 22 nt, Human
cagagggagcccuccaggagca

SEQ ID NO: 413201 - RNA, 22 nt, Human
aagggcugccagggggugccag

SEQ ID NO: 413202 - RNA, 22 nt, Human
auaguggugagcugcauuuaug

SEQ ID NO: 413203 - RNA, 22 nt, Human
uagcagggaagaugaucagaau

SEQ ID NO: 413204 - RNA, 22 nt, Human
uggaggcaacugaagauguagu

SEQ ID NO: 413205 - RNA, 22 nt, Human
uggccugucuuguugugcuaga

SEQ ID NO: 413206 - RNA, 19 nt, Human
cagaguccuugaccagucc

SEQ ID NO: 413207 - RNA, 22 nt, Human
gacagaggcaagaccagaagcc

SEQ ID NO: 413208 - RNA, 22 nt, Human
gaggcucugugaugugccaggc

SEQ ID NO: 413209 - RNA, 22 nt, Human
aggcacuguggaagacaugguu

SEQ ID NO: 413210 - RNA, 22 nt, Human
gcacagggccuggcacauaaga

SEQ ID NO: 413211 - RNA, 22 nt, Human
aagaggaaaugauugacuauau

SEQ ID NO: 413212 - RNA, 22 nt, Human
gcagagaaaguuuuguccucag

SEQ ID NO: 413213 - RNA, 22 nt, Human
aaggagagguuguccguguugu

SEQ ID NO: 413214 - RNA, 22 nt, Human
uguguuccuucgucuucccuuc

SEQ ID NO: 413215 - RNA, 20 nt, Human
aguaggggaaugcaagagca

SEQ ID NO: 413216 - RNA, 22 nt, Human
agguuacagugauuauagguuu

SEQ ID NO: 413217 - RNA, 22 nt, Human
gucccuaguggaaagacaugau

SEQ ID NO: 413218 - RNA, 19 nt, Human
ugagaaggcaguggggagc

SEQ ID NO: 413219 - RNA, 19 nt, Human
uagcugccuguuaccucca

SEQ ID NO: 413220 - RNA, 22 nt, Human
gccuguuggguaacagaguuca

SEQ ID NO: 413221 - RNA, 18 nt, Human
gcugccugcauuccucac

SEQ ID NO: 413222 - RNA, 22 nt, Human
aacaucuuuuuguuugcugaaa

SEQ ID NO: 413223 - RNA, 22 nt, Human
ucagcugaguucuagagcacuc

SEQ ID NO: 413224 - RNA, 22 nt, Human
uaaaaguggauaagcuguagga

SEQ ID NO: 413225 - RNA, 22 nt, Human
uccuugaaugaagagaggugac

SEQ ID NO: 413226 - RNA, 22 nt, Human
agcugccauccgaggugucaga

SEQ ID NO: 413227 - RNA, 22 nt, Human
aguguggcugcguagggcucuc

SEQ ID NO: 413228 - RNA, 22 nt, Human
acaggcagguaauuuacauauu

SEQ ID NO: 413229 - RNA, 21 nt, Human
aggccucuucauggccaugau

SEQ ID NO: 413230 - RNA, 22 nt, Human
cccaggaguuugaguucagcau

SEQ ID NO: 413231 - RNA, 22 nt, Human
cagcuggcagaaccugcaucca

SEQ ID NO: 413232 - RNA, 22 nt, Human
uugaaaggugacauuguuagag

SEQ ID NO: 413233 - RNA, 22 nt, Human
ccuguccuccaagagcacaucu

SEQ ID NO: 413234 - RNA, 22 nt, Human
uugaaaaaauugguagaggaug

SEQ ID NO: 413235 - RNA, 22 nt, Human
ucaaaauuucagcacuagcccu

SEQ ID NO: 413236 - RNA, 22 nt, Human
ucuccuggucaccucagaaguc

SEQ ID NO: 413237 - RNA, 22 nt, Human
uccacauucucuguuacagaua

SEQ ID NO: 413238 - RNA, 22 nt, Human
gcucaggauuucauccaugugu

SEQ ID NO: 413239 - RNA, 22 nt, Human
uauuuuagguaauauccauugu

SEQ ID NO: 413240 - RNA, 22 nt, Human
uucugucuucccacugaggagc

SEQ ID NO: 413241 - RNA, 22 nt, Human
ugagaagcugcuugugcuguau

SEQ ID NO: 413242 - RNA, 22 nt, Human
agccucugcuuaugcaaaggua

SEQ ID NO: 413243 - RNA, 22 nt, Human
uccugggcuguggccccgggca

SEQ ID NO: 413244 - RNA, 22 nt, Human
ugaagccuuguguggccucucu

SEQ ID NO: 413245 - RNA, 18 nt, Human
aguggucuguuauaucau

SEQ ID NO: 413246 - RNA, 22 nt, Human
agauggggcugaaaguuccaau

SEQ ID NO: 413247 - RNA, 22 nt, Human
uggcagggccuaccccaauauc

SEQ ID NO: 413248 - RNA, 22 nt, Human
aaggccagacaggaccacaucu

SEQ ID NO: 413249 - RNA, 22 nt, Human
gcucagagcacucagacucagc

SEQ ID NO: 413250 - RNA, 22 nt, Human
cagguacacucccuugugcuga

SEQ ID NO: 413251 - RNA, 22 nt, Human
uaggaaaaauacagaauuauau

SEQ ID NO: 413252 - RNA, 22 nt, Human
acagagcauauaaagugcuuug

SEQ ID NO: 413253 - RNA, 22 nt, Human
ccagccacugggccacugccag

SEQ ID NO: 413254 - RNA, 22 nt, Human
aagaaacugaaaguggcuucau

SEQ ID NO: 413255 - RNA, 22 nt, Human
uuuaaaauuuagaccucuccac

SEQ ID NO: 413256 - RNA, 22 nt, Human
augggcaguuaggaggccagga

SEQ ID NO: 413257 - RNA, 22 nt, Human
ugcccaggaucuggcgaugcuc

SEQ ID NO: 413258 - RNA, 22 nt, Human
aguuuucuguucuacaauuuga

SEQ ID NO: 413259 - RNA, 22 nt, Human
uccaagaagucaucuaaacugu

SEQ ID NO: 413260 - RNA, 22 nt, Human
uaugcauagguaucuauacuca

SEQ ID NO: 413261 - RNA, 22 nt, Human
cccugcagagagugcuuuugug

SEQ ID NO: 413262 - RNA, 19 nt, Human
ucaaaugccaaugucacag

SEQ ID NO: 413263 - RNA, 22 nt, Human
uccauauuaacuaaaacuagaa

SEQ ID NO: 413264 - RNA, 22 nt, Human
gaagagcugcucagaacaugau

SEQ ID NO: 413265 - RNA, 22 nt, Human
ggcugccuucccugagccccgg

SEQ ID NO: 413266 - RNA, 22 nt, Human
cagagacuggagugcaguggcg

SEQ ID NO: 413267 - RNA, 22 nt, Human
cacaagagagugcgcguugcaa

SEQ ID NO: 413268 - RNA, 19 nt, Human
ugcagcucagggcaggggc

SEQ ID NO: 413269 - RNA, 22 nt, Human
ugggcucugugccagguuggug

SEQ ID NO: 413270 - RNA, 22 nt, Human
aucuggcuugacuuugcgacuu

SEQ ID NO: 413271 - RNA, 22 nt, Human
aggcugcagugcagguaggauu

SEQ ID NO: 413272 - RNA, 22 nt, Human
agagcagauggagcuggaagag

SEQ ID NO: 413273 - RNA, 22 nt, Human
cccuucccuucugggagaucca

SEQ ID NO: 413274 - RNA, 20 nt, Human
uauuugaaauggccaagugu

SEQ ID NO: 413275 - RNA, 18 nt, Human
aguaguggguuuagcuuc

SEQ ID NO: 413276 - RNA, 22 nt, Human
gugaagagcuguugcagagauu

SEQ ID NO: 413277 - RNA, 22 nt, Human
auucagcaaugagcuuggauuu

SEQ ID NO: 413278 - RNA, 20 nt, Human
uguauauuuucugguguaaa

SEQ ID NO: 413279 - RNA, 22 nt, Human
agcuuuaugcuuccuacaagcu

SEQ ID NO: 413280 - RNA, 22 nt, Human
ucaaggagcccacagucuaaug

SEQ ID NO: 413281 - RNA, 22 nt, Human
cagagccaugguaugggcuugu

SEQ ID NO: 413282 - RNA, 22 nt, Human
acugucaccaucagagcgggaa

SEQ ID NO: 413283 - RNA, 22 nt, Human
ccucaugguacuuacuguagcu

SEQ ID NO: 413284 - RNA, 22 nt, Human
gguugccggggcaggacuggaa

SEQ ID NO: 413285 - RNA, 20 nt, Human
accccagccccucuaucuga

SEQ ID NO: 413286 - RNA, 22 nt, Human
uggcccugcuuaugucucucuu

SEQ ID NO: 413287 - RNA, 22 nt, Human
gcuguacauucuguggguuugg

SEQ ID NO: 413288 - RNA, 22 nt, Human
ucuguggauuuuaguguucaug

SEQ ID NO: 413289 - RNA, 22 nt, Human
cuggccugaggccgccuucaga

SEQ ID NO: 413290 - RNA, 22 nt, Human
cuuccucugcggcgccgggcgc

SEQ ID NO: 413291 - RNA, 22 nt, Human
uaguggagaaguggagucugug

SEQ ID NO: 413292 - RNA, 22 nt, Human
gugggaugcaguggugaguggc

SEQ ID NO: 413293 - RNA, 22 nt, Human
cagccuguagaauacaguaaau

SEQ ID NO: 413294 - RNA, 22 nt, Human
ucugggagguaaccaugcugau

SEQ ID NO: 413295 - RNA, 22 nt, Human
aggcuggcuggcaggggacaca

SEQ ID NO: 413296 - RNA, 22 nt, Human
gccuccuggauuuuagugccau

SEQ ID NO: 413297 - RNA, 22 nt, Human
gggcagguguugucaaucuaau

SEQ ID NO: 413298 - RNA, 22 nt, Human
agggcugcugaggaagccuugc

SEQ ID NO: 413299 - RNA, 21 nt, Human
ggugucaguuuuggucauuag

SEQ ID NO: 413300 - RNA, 22 nt, Human
aucuuaaucgaguccaugaaaa

SEQ ID NO: 413301 - RNA, 22 nt, Human
gcaugguggccuuaggguagcc

SEQ ID NO: 413302 - RNA, 21 nt, Human
uaucuacuggugucuuucaga

SEQ ID NO: 413303 - RNA, 22 nt, Human
ggccucacccaucggugccuuu

SEQ ID NO: 413304 - RNA, 22 nt, Human
gacagccaugcacuucugcugu

SEQ ID NO: 413305 - RNA, 22 nt, Human
ugagccuguccugugcauguga

SEQ ID NO: 413306 - RNA, 22 nt, Human
agccacaccuguccugccagcu

SEQ ID NO: 413307 - RNA, 22 nt, Human
aucaggauucaccccagagcug

SEQ ID NO: 413308 - RNA, 23 nt, Human
uccucccaaauuucagccucauu

SEQ ID NO: 413309 - RNA, 22 nt, Human
cucuuaguuuaucuuugacaaa

SEQ ID NO: 413310 - RNA, 21 nt, Human
cagagcugaaggguguagugu

SEQ ID NO: 413311 - RNA, 22 nt, Human
ugcuuuauucaggguuuacccc

SEQ ID NO: 413312 - RNA, 21 nt, Human
ugcucaugcaaugcaugucca

SEQ ID NO: 413313 - RNA, 22 nt, Human
uggcucugggcaccguguccac

SEQ ID NO: 413314 - RNA, 22 nt, Human
gagucacauuaauuuaauuuua

SEQ ID NO: 413315 - RNA, 22 nt, Human
gcuugcuggugccugcaggcuc

SEQ ID NO: 413316 - RNA, 22 nt, Human
cuuugcauacaauuuuuagaaa

SEQ ID NO: 413317 - RNA, 22 nt, Human
auuucugauaaacguaagcugc

SEQ ID NO: 413318 - RNA, 22 nt, Human
aaauuaguacauugcaaagucc

SEQ ID NO: 413319 - RNA, 22 nt, Human
gugcugucguggaacugggcug

SEQ ID NO: 413320 - RNA, 22 nt, Human
cuauugaauuaacuauuaaagu

SEQ ID NO: 413321 - RNA, 22 nt, Human
uacugccuggagcauuggugcu

SEQ ID NO: 413322 - RNA, 22 nt, Human
gucucccacuuucuggccucuu

SEQ ID NO: 413323 - RNA, 22 nt, Human
aaaugcagauuuugaugcagca

SEQ ID NO: 413324 - RNA, 22 nt, Human
cagagcugacccaaggauugaa

SEQ ID NO: 413325 - RNA, 22 nt, Human
aaaugcaggaaauuaugcuuuu

SEQ ID NO: 413326 - RNA, 22 nt, Human
ucagaggaucaugucccuacuc

SEQ ID NO: 413327 - RNA, 19 nt, Human
ggcugucucggcccagcca

SEQ ID NO: 413328 - RNA, 22 nt, Human
uacaagagguauauagaaacag

SEQ ID NO: 413329 - RNA, 22 nt, Human
cagaacauucacucauaugugg

SEQ ID NO: 413330 - RNA, 22 nt, Human
gcaugcugcaccagagccucuc

SEQ ID NO: 413331 - RNA, 22 nt, Human
ucagagugugagacauauugga

SEQ ID NO: 413332 - RNA, 22 nt, Human
ucaaaggcauugccaauaagua

SEQ ID NO: 413333 - RNA, 22 nt, Human
gcugcucuccauggccgugagu

SEQ ID NO: 413334 - RNA, 22 nt, Human
gcagggcagcuuagucccuguc

SEQ ID NO: 413335 - RNA, 22 nt, Human
gcagagccugugucugagcaaa

SEQ ID NO: 413336 - RNA, 22 nt, Human
gcugcccuaauaucacauguua

SEQ ID NO: 413337 - RNA, 22 nt, Human
acaggacauguaccaggugguc

SEQ ID NO: 413338 - RNA, 22 nt, Human
gggagagguuacccgagcaacu

SEQ ID NO: 413339 - RNA, 22 nt, Human
ccauaaucuggcuuugagagag

SEQ ID NO: 413340 - RNA, 22 nt, Human
acagcuggcaggggggcaugaa

SEQ ID NO: 413341 - RNA, 22 nt, Human
gucucaguaagaaaggcuccug

SEQ ID NO: 413342 - RNA, 22 nt, Human
aaaggucagacuuaggcugggc

SEQ ID NO: 413343 - RNA, 22 nt, Human
cuguuuauaaauagaggggagu

SEQ ID NO: 413344 - RNA, 22 nt, Human
gaggagagaagcuaacggugcu

SEQ ID NO: 413345 - RNA, 22 nt, Human
gucccacugggcaacuagaaaa

SEQ ID NO: 413346 - RNA, 20 nt, Human
cugaacacagaauaagcaca

SEQ ID NO: 413347 - RNA, 22 nt, Human
gaguuauucuagguccuuugua

SEQ ID NO: 413348 - RNA, 22 nt, Human
ggcuucuccagguacugagcau

SEQ ID NO: 413349 - RNA, 22 nt, Human
uccccagccgugaaggagagga

SEQ ID NO: 413350 - RNA, 22 nt, Human
acagccuguuugaucuggugcu

SEQ ID NO: 413351 - RNA, 23 nt, Human
ugucccagagggagggauaggcu

SEQ ID NO: 413352 - RNA, 21 nt, Human
gaacauuuggguuguuucuac

SEQ ID NO: 413353 - RNA, 22 nt, Human
ugccaggaggaggugggacaga

SEQ ID NO: 413354 - RNA, 22 nt, Human
gggagcuguaagggacagguag

SEQ ID NO: 413355 - RNA, 20 nt, Human
gcauccagacacccagcugc

SEQ ID NO: 413356 - RNA, 22 nt, Human
aggcacugugcuucuuauaugu

SEQ ID NO: 413357 - RNA, 22 nt, Human
cugccuggaaugccagcuucuc

SEQ ID NO: 413358 - RNA, 22 nt, Human
aucugccuggcuccaggugagc

SEQ ID NO: 413359 - RNA, 22 nt, Human
ugaagcagaggggucuugagcu

SEQ ID NO: 413360 - RNA, 22 nt, Human
cugcuucuccaaaguaggacuu

SEQ ID NO: 413361 - RNA, 22 nt, Human
gcucccuccaugaggcagaccg

SEQ ID NO: 413362 - RNA, 22 nt, Human
cugggugguuuugaugugaauu

SEQ ID NO: 413363 - RNA, 22 nt, Human
cgaggcaggcaggcggaggaua

SEQ ID NO: 413364 - RNA, 22 nt, Human
auugacaaggaaacuauaccag

SEQ ID NO: 413365 - RNA, 22 nt, Human
ggaagggcaauaaaaucucagg

SEQ ID NO: 413366 - RNA, 22 nt, Human
acaagaauguagauuaguuaag

SEQ ID NO: 413367 - RNA, 21 nt, Human
ggcagccugacccccagagag

SEQ ID NO: 413368 - RNA, 22 nt, Human
ccucagagguuuucauucugua

SEQ ID NO: 413369 - RNA, 22 nt, Human
cuggagcuggcuuccuuccacu

SEQ ID NO: 413370 - RNA, 22 nt, Human
ucccacugugaauccaaggccu

SEQ ID NO: 413371 - RNA, 22 nt, Human
ugaaggaaaugacggcagaaga

SEQ ID NO: 413372 - RNA, 22 nt, Human
aucuacagugcacaggacagcc

SEQ ID NO: 413373 - RNA, 22 nt, Human
aaggagagagcuuugcuggaac

SEQ ID NO: 413374 - RNA, 22 nt, Human
cauuaucucuucuauaugcuag

SEQ ID NO: 413375 - RNA, 22 nt, Human
gggcagguguuuccaaggugag

SEQ ID NO: 413376 - RNA, 22 nt, Human
aaguucaagucugcaucuuuuu

SEQ ID NO: 413377 - RNA, 19 nt, Human
ugcuuccucaccaucuccc

SEQ ID NO: 413378 - RNA, 22 nt, Human
gaggcacauauauacagagccc

SEQ ID NO: 413379 - RNA, 22 nt, Human
uaaagguaguuuuaaaggugcu

SEQ ID NO: 413380 - RNA, 22 nt, Human
aguggcaguagaugagcugguu

SEQ ID NO: 413381 - RNA, 22 nt, Human
aggagugagcuuuggggucaga

SEQ ID NO: 413382 - RNA, 20 nt, Human
uuggucagugguucaguuug

SEQ ID NO: 413383 - RNA, 20 nt, Human
ccucaagcagacugacagcu

SEQ ID NO: 413384 - RNA, 22 nt, Human
gggcagcucucacagcagccaa

SEQ ID NO: 413385 - RNA, 22 nt, Human
ccaggagucuggaugagguguc

SEQ ID NO: 413386 - RNA, 19 nt, Human
ucagaggauuuggcuauga

SEQ ID NO: 413387 - RNA, 22 nt, Human
cuuauguaaacuacagauaaua

SEQ ID NO: 413388 - RNA, 22 nt, Human
cuuucucugugugguaaagggc

SEQ ID NO: 413389 - RNA, 22 nt, Human
gagggugguggcuuaaggugcu

SEQ ID NO: 413390 - RNA, 22 nt, Human
acauuucucuuagaguuggacu

SEQ ID NO: 413391 - RNA, 22 nt, Human
uggcugggccgggccuugugcc

SEQ ID NO: 413392 - RNA, 22 nt, Human
ggucucugacuuagagauggau

SEQ ID NO: 413393 - RNA, 22 nt, Human
ugaggccugaagccuggagccu

SEQ ID NO: 413394 - RNA, 22 nt, Human
aguaacuaugcuugagaaucag

SEQ ID NO: 413395 - RNA, 22 nt, Human
cuggcaggaaguuagaugguaa

SEQ ID NO: 413396 - RNA, 22 nt, Human
caggugcugcguggcggagcug

SEQ ID NO: 413397 - RNA, 22 nt, Human
ucuggcuccuggcuccacugcc

SEQ ID NO: 413398 - RNA, 22 nt, Human
ggagagaauuccauggacaugu

SEQ ID NO: 413399 - RNA, 23 nt, Human
ucagggacaugaugugucauauc

SEQ ID NO: 413400 - RNA, 22 nt, Human
ugcuuuauuuauaaaauagcaa

SEQ ID NO: 413401 - RNA, 22 nt, Human
uagagcuagcuucaaaaugcga

SEQ ID NO: 413402 - RNA, 22 nt, Human
auaaacacuucuagggcacaca

SEQ ID NO: 413403 - RNA, 22 nt, Human
cuggcuggcaaguagaacacaa

SEQ ID NO: 413404 - RNA, 19 nt, Human
auacacauacguaaacuga

SEQ ID NO: 413405 - RNA, 22 nt, Human
ggugaguugggguucacagguc

SEQ ID NO: 413406 - RNA, 19 nt, Human
ugggccugcaucugggucu

SEQ ID NO: 413407 - RNA, 22 nt, Human
cuccugguucagagagcugaga

SEQ ID NO: 413408 - RNA, 22 nt, Human
ggcugcagaggcgaucugaggu

SEQ ID NO: 413409 - RNA, 22 nt, Human
acauuucuuccuaauuaucccu

SEQ ID NO: 413410 - RNA, 20 nt, Human
agcugaggcaccugagguua

SEQ ID NO: 413411 - RNA, 22 nt, Human
cauuucuguacauguuuuggug

SEQ ID NO: 413412 - RNA, 22 nt, Human
gcuggcucagggacuagaguuu

SEQ ID NO: 413413 - RNA, 22 nt, Human
uugcugaaaacaguggguauug

SEQ ID NO: 413414 - RNA, 22 nt, Human
aaagucauguaaugauaugauu

SEQ ID NO: 413415 - RNA, 22 nt, Human
gcacagggagacagccguggcc

SEQ ID NO: 413416 - RNA, 18 nt, Human
uauauuucacacauauuc

SEQ ID NO: 413417 - RNA, 22 nt, Human
gaugauuuuaugucuugucauu

SEQ ID NO: 413418 - RNA, 22 nt, Human
cagagggcucuuggcugccugc

SEQ ID NO: 413419 - RNA, 22 nt, Human
caguagacacauuaauauggaa

SEQ ID NO: 413420 - RNA, 22 nt, Human
uccugaggcacaauccuagaau

SEQ ID NO: 413421 - RNA, 22 nt, Human
accugagggcccaaacuuggua

SEQ ID NO: 413422 - RNA, 22 nt, Human
cuauuuuaacuugauuaccucu

SEQ ID NO: 413423 - RNA, 20 nt, Human
gccugcagguuggaugggau

SEQ ID NO: 413424 - RNA, 22 nt, Human
gggaccugaggagggguuucag

SEQ ID NO: 413425 - RNA, 22 nt, Human
ccuggccucagccuagggcuga

SEQ ID NO: 413426 - RNA, 22 nt, Human
uaaaggcucguauuguugugug

SEQ ID NO: 413427 - RNA, 19 nt, Human
ggcagaagguguaggggga

SEQ ID NO: 413428 - RNA, 22 nt, Human
cagccaggcccccgagucguug

SEQ ID NO: 413429 - RNA, 22 nt, Human
agggccugggguagcuuacugc

SEQ ID NO: 413430 - RNA, 22 nt, Human
guggccuggcgagcuggcgcgg

SEQ ID NO: 413431 - RNA, 22 nt, Human
cugggguggugcaggccucaug

SEQ ID NO: 413432 - RNA, 22 nt, Human
aucaggaugaagcuguagcgaa

SEQ ID NO: 413433 - RNA, 21 nt, Human
gcucuuggaaggggcucagcu

SEQ ID NO: 413434 - RNA, 22 nt, Human
agaugcagaaaaacuaagugau

SEQ ID NO: 413435 - RNA, 22 nt, Human
uguugauuugugggcugcaaaa

SEQ ID NO: 413436 - RNA, 22 nt, Human
uuuaauuuuccucuuccuggag

SEQ ID NO: 413437 - RNA, 22 nt, Human
uaaaggcuuuuacaggagugca

SEQ ID NO: 413438 - RNA, 23 nt, Human
gugagcagcccacuaggaaugcc

SEQ ID NO: 413439 - RNA, 22 nt, Human
cuugaaagcuuugcgucuucua

SEQ ID NO: 413440 - RNA, 22 nt, Human
aggcugagccacggggcuggcu

SEQ ID NO: 413441 - RNA, 22 nt, Human
gcagcguggggcugagucagcu

SEQ ID NO: 413442 - RNA, 22 nt, Human
ugagcuuccucccugcauccau

SEQ ID NO: 413443 - RNA, 22 nt, Human
ccaggguggggcaggcccacug

SEQ ID NO: 413444 - RNA, 22 nt, Human
ucaagucuggagaucuggaacu

SEQ ID NO: 413445 - RNA, 22 nt, Human
gcugcuucucugauggagucca

SEQ ID NO: 413446 - RNA, 22 nt, Human
auugaauagaugcauuauacua

SEQ ID NO: 413447 - RNA, 22 nt, Human
ugcagcucugaacagucaugaa

SEQ ID NO: 413448 - RNA, 22 nt, Human
aguuaaagucugaaauagagaa

SEQ ID NO: 413449 - RNA, 18 nt, Human
gggcucacacaggucauc

SEQ ID NO: 413450 - RNA, 22 nt, Human
agcaggugaauuccuggaugug

SEQ ID NO: 413451 - RNA, 22 nt, Human
auugacaauguauuuguaucug

SEQ ID NO: 413452 - RNA, 22 nt, Human
gacagcagggacauguaggaag

SEQ ID NO: 413453 - RNA, 22 nt, Human
aguaacaagugccaacguuaga

SEQ ID NO: 413454 - RNA, 22 nt, Human
ugcagaaggaggaggaaaucca

SEQ ID NO: 413455 - RNA, 23 nt, Human
auauuagggagauuagcccucua

SEQ ID NO: 413456 - RNA, 22 nt, Human
cacagaaucugugacuccaaga

SEQ ID NO: 413457 - RNA, 22 nt, Human
uaaaucuccuguuuuucaucua

SEQ ID NO: 413458 - RNA, 22 nt, Human
caguguguggauccucccagga

SEQ ID NO: 413459 - RNA, 22 nt, Human
ccuggagccccucuggccagcc

SEQ ID NO: 413460 - RNA, 22 nt, Human
ccaggcucugagccucacucuu

SEQ ID NO: 413461 - RNA, 22 nt, Human
gcccaggcuagcguagagugca

SEQ ID NO: 413462 - RNA, 21 nt, Human
cagcaaaucauugggcagacu

SEQ ID NO: 413463 - RNA, 22 nt, Human
gcaggagagucugugccagguu

SEQ ID NO: 413464 - RNA, 18 nt, Human
ucagagagcagcuuuauu

SEQ ID NO: 413465 - RNA, 22 nt, Human
gcucaagggaugggagugggug

SEQ ID NO: 413466 - RNA, 22 nt, Human
aagccagguguugugguaagag

SEQ ID NO: 413467 - RNA, 22 nt, Human
gggagccacaguuuauagugau

SEQ ID NO: 413468 - RNA, 22 nt, Human
auacaucuugucagauucaugu

SEQ ID NO: 413469 - RNA, 22 nt, Human
cuggcagcguguuuaugaacau

SEQ ID NO: 413470 - RNA, 22 nt, Human
cucuccuggggagcacacacac

SEQ ID NO: 413471 - RNA, 22 nt, Human
cugcuggagguuggagcaugca

SEQ ID NO: 413472 - RNA, 21 nt, Human
uccauuguuuucccaggguuu

SEQ ID NO: 413473 - RNA, 22 nt, Human
aaauguucuacuuugauaauua

SEQ ID NO: 413474 - RNA, 22 nt, Human
auaguaacuggcauguuuauga

SEQ ID NO: 413475 - RNA, 22 nt, Human
gaagaaggugccagaggcuuac

SEQ ID NO: 413476 - RNA, 22 nt, Human
ugcagaagaccuuccagggcug

SEQ ID NO: 413477 - RNA, 22 nt, Human
uuugagaaaugggcucugugcu

SEQ ID NO: 413478 - RNA, 22 nt, Human
auggaguucugccagcgcugcu

SEQ ID NO: 413479 - RNA, 22 nt, Human
accagagcgcucaagccuuccc

SEQ ID NO: 413480 - RNA, 22 nt, Human
gugaccaucagagaauaacaaa

SEQ ID NO: 413481 - RNA, 22 nt, Human
agccagaguugaaugugagucu

SEQ ID NO: 413482 - RNA, 22 nt, Human
ucucuuucuauugcaccaugcu

SEQ ID NO: 413483 - RNA, 22 nt, Human
uuucuaguccucaugcaucauu

SEQ ID NO: 413484 - RNA, 22 nt, Human
ccuggaaggugaugguacagca

SEQ ID NO: 413485 - RNA, 22 nt, Human
augcagaaggagccaugcuugc

SEQ ID NO: 413486 - RNA, 22 nt, Human
augcagagacagauguggcaug

SEQ ID NO: 413487 - RNA, 22 nt, Human
gcugcuuccuuuccugcugacc

SEQ ID NO: 413488 - RNA, 22 nt, Human
acauuucugcaucucagagcua

SEQ ID NO: 413489 - RNA, 22 nt, Human
ggaucauuaacacauccaucac

SEQ ID NO: 413490 - RNA, 22 nt, Human
ggaggaugccaagcugugcaca

SEQ ID NO: 413491 - RNA, 22 nt, Human
aucaguuucugugaagaacaca

SEQ ID NO: 413492 - RNA, 17 nt, Human
ugguggcuggagucagg

SEQ ID NO: 413493 - RNA, 22 nt, Human
guccucuggugaaagcauuccc

SEQ ID NO: 413494 - RNA, 22 nt, Human
ugcacacaguucucaggaaaga

SEQ ID NO: 413495 - RNA, 22 nt, Human
aggggaaggccagccuguagag

SEQ ID NO: 413496 - RNA, 22 nt, Human
aggauccugcgcuuugggggag

SEQ ID NO: 413497 - RNA, 22 nt, Human
ugucaccaugccagcuucugcc

SEQ ID NO: 413498 - RNA, 22 nt, Human
ggcugcagcggauuggggauug

SEQ ID NO: 413499 - RNA, 22 nt, Human
ucucucagaggaagaggcagug

SEQ ID NO: 413500 - RNA, 22 nt, Human
auggauaauggugauaguugca

SEQ ID NO: 413501 - RNA, 22 nt, Human
uacagaauguguaucauuacca

SEQ ID NO: 413502 - RNA, 22 nt, Human
uaccucaugcuguacagcacgu

SEQ ID NO: 413503 - RNA, 22 nt, Human
acaaaggcauagugaauguuuu

SEQ ID NO: 413504 - RNA, 23 nt, Human
ugaagugaaauuucacaagggac

SEQ ID NO: 413505 - RNA, 22 nt, Human
aaauacagaguugcuuaaaagc

SEQ ID NO: 413506 - RNA, 22 nt, Human
uacauagcaaggaaaugacaga

SEQ ID NO: 413507 - RNA, 22 nt, Human
gugcuuccccaagccacagccu

SEQ ID NO: 413508 - RNA, 22 nt, Human
cucaggaguaguucagcagcug

SEQ ID NO: 413509 - RNA, 22 nt, Human
gcuugggauaugcugauguaaa

SEQ ID NO: 413510 - RNA, 22 nt, Human
aaauuauuacaagcuaguuggc

SEQ ID NO: 413511 - RNA, 23 nt, Human
uucaagauacgguuuccaggcug

SEQ ID NO: 413512 - RNA, 20 nt, Human
gggagucuggaugaaagaug

SEQ ID NO: 413513 - RNA, 22 nt, Human
uggcagcugaggggaggcuuug

SEQ ID NO: 413514 - RNA, 22 nt, Human
ugcaggcuggaggagggacuaa

SEQ ID NO: 413515 - RNA, 22 nt, Human
agggcagcaaugcagcugcugc

SEQ ID NO: 413516 - RNA, 22 nt, Human
ggaccagagaagugagcaccug

SEQ ID NO: 413517 - RNA, 22 nt, Human
gcagugaacauaacacagaagg

SEQ ID NO: 413518 - RNA, 20 nt, Human
uguucacaguaguugcugcu

SEQ ID NO: 413519 - RNA, 22 nt, Human
ugccuggcaacuguggugggcu

SEQ ID NO: 413520 - RNA, 22 nt, Human
agggcagccucucagccuaggu

SEQ ID NO: 413521 - RNA, 22 nt, Human
aauuucaaugcacucaugguug

SEQ ID NO: 413522 - RNA, 22 nt, Human
caagugucuauaucagugcuug

SEQ ID NO: 413523 - RNA, 22 nt, Human
ugugggaggaauuagaauggga

SEQ ID NO: 413524 - RNA, 22 nt, Human
uugaaagaagaagcugcgaugu

SEQ ID NO: 413525 - RNA, 22 nt, Human
cuguacucaagguaaaccagga

SEQ ID NO: 413526 - RNA, 22 nt, Human
cuagcaucagaugagaagcugu

SEQ ID NO: 413527 - RNA, 22 nt, Human
ccugggcauucuuugaguucuc

SEQ ID NO: 413528 - RNA, 22 nt, Human
cugcccugaccugccucagagu

SEQ ID NO: 413529 - RNA, 22 nt, Human
ggcucaggagaggggcuaaaag

SEQ ID NO: 413530 - RNA, 22 nt, Human
uggcccugcagaacuagccugg

SEQ ID NO: 413531 - RNA, 22 nt, Human
gggcuggcaucgguugcugaga

SEQ ID NO: 413532 - RNA, 22 nt, Human
aggcaggcuagucgcuugagcc

SEQ ID NO: 413533 - RNA, 22 nt, Human
gaggaagaagggauuagaacuc

SEQ ID NO: 413534 - RNA, 22 nt, Human
ugggccugaaggagcugcgccc

SEQ ID NO: 413535 - RNA, 22 nt, Human
gaguuauuucagaaggaaagau

SEQ ID NO: 413536 - RNA, 22 nt, Human
ggcuuuauuaacucauccguaa

SEQ ID NO: 413537 - RNA, 22 nt, Human
gccagcccagcuccaggggaaa

SEQ ID NO: 413538 - RNA, 22 nt, Human
uucaugugaucacagauuguaa

SEQ ID NO: 413539 - RNA, 22 nt, Human
uuccucagagggcgcuggggaa

SEQ ID NO: 413540 - RNA, 22 nt, Human
gaaguucaggugggaauugagc

SEQ ID NO: 413541 - RNA, 22 nt, Human
aaauugugcucacacugauauu

SEQ ID NO: 413542 - RNA, 22 nt, Human
cuggccaacuugcuuguuggca

SEQ ID NO: 413543 - RNA, 22 nt, Human
cugggaugucuauagaacacuu

SEQ ID NO: 413544 - RNA, 22 nt, Human
aaauugcaaaaguacuuuuagg

SEQ ID NO: 413545 - RNA, 22 nt, Human
uccugcagguggaugauucucu

SEQ ID NO: 413546 - RNA, 22 nt, Human
gccagagcugagugagguucuu

SEQ ID NO: 413547 - RNA, 22 nt, Human
ugcacacacaugaaguagcaug

SEQ ID NO: 413548 - RNA, 20 nt, Human
acuuuggggucuuucucaga

SEQ ID NO: 413549 - RNA, 22 nt, Human
aggcugggaaauguauuccagc

SEQ ID NO: 413550 - RNA, 21 nt, Human
ucucuggaauuagaccauguu

SEQ ID NO: 413551 - RNA, 22 nt, Human
uagaaaucagcaggcauaugua

SEQ ID NO: 413552 - RNA, 22 nt, Human
ugggcagccaucccagccucuc

SEQ ID NO: 413553 - RNA, 22 nt, Human
aaauuucuugaggcucucuagc

SEQ ID NO: 413554 - RNA, 22 nt, Human
ucagagucucccccaguuuggg

SEQ ID NO: 413555 - RNA, 22 nt, Human
uugacaagaaucguugccuugg

SEQ ID NO: 413556 - RNA, 22 nt, Human
aucuuuaguagaggaauauauu

SEQ ID NO: 413557 - RNA, 22 nt, Human
ugaagcaggaucguuugcuuca

SEQ ID NO: 413558 - RNA, 22 nt, Human
gaggggcugggguugacuccaa

SEQ ID NO: 413559 - RNA, 22 nt, Human
gcuggccugcugggcaccaccg

SEQ ID NO: 413560 - RNA, 22 nt, Human
gggaugucacugugccuggcac

SEQ ID NO: 413561 - RNA, 22 nt, Human
ggucccagaauugguuagcaca

SEQ ID NO: 413562 - RNA, 19 nt, Human
agaggccucagcagcuggc

SEQ ID NO: 413563 - RNA, 22 nt, Human
uggcucagcugucacagccugg

SEQ ID NO: 413564 - RNA, 22 nt, Human
auacuuacuuuucuucagacua

SEQ ID NO: 413565 - RNA, 22 nt, Human
aggucauuacaauuaucauuuu

SEQ ID NO: 413566 - RNA, 22 nt, Human
uccuuuggagcuugacugguag

SEQ ID NO: 413567 - RNA, 22 nt, Human
cuguuauuuagaacauggaauc

SEQ ID NO: 413568 - RNA, 23 nt, Human
caguggagacucaugcuuccuua

SEQ ID NO: 413569 - RNA, 22 nt, Human
gagggcugcaaugagacagaga

SEQ ID NO: 413570 - RNA, 22 nt, Human
cuggagaggccccaagauauuu

SEQ ID NO: 413571 - RNA, 19 nt, Human
cuuauuagagugagagcuu

SEQ ID NO: 413572 - RNA, 22 nt, Human
uccaggcaagggaggagcaugg

SEQ ID NO: 413573 - RNA, 22 nt, Human
cuucuuaaugacagauuaaaau

SEQ ID NO: 413574 - RNA, 22 nt, Human
aaguggaggccgaguucacgca

SEQ ID NO: 413575 - RNA, 22 nt, Human
ugggaggagcccucugggaagg

SEQ ID NO: 413576 - RNA, 22 nt, Human
cacagaauaaauugguaucaga

SEQ ID NO: 413577 - RNA, 22 nt, Human
agcagccacagucugggacagg

SEQ ID NO: 413578 - RNA, 22 nt, Human
cugaggcagagggcagaccaga

SEQ ID NO: 413579 - RNA, 22 nt, Human
uggcagaaguucacuaguagcu

SEQ ID NO: 413580 - RNA, 22 nt, Human
ccagggcacuuaggcccagccc

SEQ ID NO: 413581 - RNA, 22 nt, Human
agccugugugcuuuggacaggg

SEQ ID NO: 413582 - RNA, 22 nt, Human
cuuucucaaugccggaaggcac

SEQ ID NO: 413583 - RNA, 22 nt, Human
cugggaggcggagguuguagug

SEQ ID NO: 413584 - RNA, 22 nt, Human
gccuggaguucagccaaguccc

SEQ ID NO: 413585 - RNA, 22 nt, Human
guuacaaacucaggugccaaaa

SEQ ID NO: 413586 - RNA, 22 nt, Human
uuagaaagaacuuuagauauca

SEQ ID NO: 413587 - RNA, 22 nt, Human
uggguaggccaggaagcagugu

SEQ ID NO: 413588 - RNA, 17 nt, Human
agccugcugaucucaca

SEQ ID NO: 413589 - RNA, 22 nt, Human
ucuggccuacuggaguccauga

SEQ ID NO: 413590 - RNA, 22 nt, Human
cccaggcacacugaagugacau

SEQ ID NO: 413591 - RNA, 22 nt, Human
uuguuaaaaauagauuuccagg

SEQ ID NO: 413592 - RNA, 22 nt, Human
accaugggucagccaccucagc

SEQ ID NO: 413593 - RNA, 23 nt, Human
uuacuuuugcaccaaccuaauau

SEQ ID NO: 413594 - RNA, 18 nt, Human
cguuuuuccgggauugca

SEQ ID NO: 413595 - RNA, 22 nt, Human
acagcagcauaaacugacuaag

SEQ ID NO: 413596 - RNA, 22 nt, Human
auguaucaauuaucugucugca

SEQ ID NO: 413597 - RNA, 22 nt, Human
agccaggacguugcucagcucc

SEQ ID NO: 413598 - RNA, 22 nt, Human
aggcugugcaauuaggguaaga

SEQ ID NO: 413599 - RNA, 22 nt, Human
uccuucaaagcuccuagugagc

SEQ ID NO: 413600 - RNA, 22 nt, Human
ugggcagaauugugguaguuaa

SEQ ID NO: 413601 - RNA, 22 nt, Human
gcuggcugaggucuagcucuuu

SEQ ID NO: 413602 - RNA, 22 nt, Human
gucucagggacugcuucugggg

SEQ ID NO: 413603 - RNA, 22 nt, Human
agcucccagucuccucuccaug

SEQ ID NO: 413604 - RNA, 22 nt, Human
guauuuuacugcucaaagcucu

SEQ ID NO: 413605 - RNA, 22 nt, Human
gacauaaaccuugagauauuaa

SEQ ID NO: 413606 - RNA, 22 nt, Human
uccugagaaggcacagcuugca

SEQ ID NO: 413607 - RNA, 22 nt, Human
cagaauggcuuuuauggcucag

SEQ ID NO: 413608 - RNA, 17 nt, Human
agcagcuggcacaggag

SEQ ID NO: 413609 - RNA, 22 nt, Human
gcagcuuggauuucuguaguuu

SEQ ID NO: 413610 - RNA, 22 nt, Human
uagagaaaagcagggaucagga

SEQ ID NO: 413611 - RNA, 22 nt, Human
acagcagcacuauugacauuuu

SEQ ID NO: 413612 - RNA, 22 nt, Human
ucuggcucaggucagacaggga

SEQ ID NO: 413613 - RNA, 21 nt, Human
gccaccccuggcacaggugcu

SEQ ID NO: 413614 - RNA, 22 nt, Human
gaggcaguggucugaugcaagg

SEQ ID NO: 413615 - RNA, 23 nt, Human
uugaaggagaaagcuuucuuggu

SEQ ID NO: 413616 - RNA, 22 nt, Human
aguuucuaccgguacauucagg

SEQ ID NO: 413617 - RNA, 22 nt, Human
cugaggccggagcacugaagag

SEQ ID NO: 413618 - RNA, 22 nt, Human
ugcagcuucuccaucuccuugu

SEQ ID NO: 413619 - RNA, 22 nt, Human
uguauuuuuaggaaugcgcuau

SEQ ID NO: 413620 - RNA, 22 nt, Human
aagcagccacuggccaguuaua

SEQ ID NO: 413621 - RNA, 22 nt, Human
aaaacuguaucuucuugggacu

SEQ ID NO: 413622 - RNA, 22 nt, Human
gccagguggcugagcagcugca

SEQ ID NO: 413623 - RNA, 22 nt, Human
aaguguuuggggaucauuuuaa

SEQ ID NO: 413624 - RNA, 22 nt, Human
ggagcugcucagagccaguccc

SEQ ID NO: 413625 - RNA, 22 nt, Human
gacuucaaaggucaaacaucgc

SEQ ID NO: 413626 - RNA, 22 nt, Human
aaaguuuccugcuaagugcuau

SEQ ID NO: 413627 - RNA, 22 nt, Human
agacccugcaccucucgugggc

SEQ ID NO: 413628 - RNA, 22 nt, Human
agcagcaacuuauuuuucuuau

SEQ ID NO: 413629 - RNA, 22 nt, Human
gaaggccaagaggcuccaagau

SEQ ID NO: 413630 - RNA, 22 nt, Human
ugccagggcugcuacuggcuga

SEQ ID NO: 413631 - RNA, 22 nt, Human
augaggcagguggaggcugcca

SEQ ID NO: 413632 - RNA, 22 nt, Human
gguuucaacucagcuaguaagg

SEQ ID NO: 413633 - RNA, 22 nt, Human
cugcagggaacugaggcccaga

SEQ ID NO: 413634 - RNA, 22 nt, Human
cagcaguggcugcaggcagcug

SEQ ID NO: 413635 - RNA, 22 nt, Human
uacuuccuguuuccaugucugu

SEQ ID NO: 413636 - RNA, 22 nt, Human
ugccugagugauguggcagcca

SEQ ID NO: 413637 - RNA, 22 nt, Human
gcacccagaauaaggacaggac

SEQ ID NO: 413638 - RNA, 22 nt, Human
gcuggccucuggagaagggcuu

SEQ ID NO: 413639 - RNA, 22 nt, Human
ucagcugaaguggagaagcaga

SEQ ID NO: 413640 - RNA, 22 nt, Human
acaguaccugcucucaagcaaa

SEQ ID NO: 413641 - RNA, 22 nt, Human
caguagcagggauuauuuuagg

SEQ ID NO: 413642 - RNA, 22 nt, Human
ggcacugggcaccggcugaggg

SEQ ID NO: 413643 - RNA, 22 nt, Human
auuguggugucaguuauaggca

SEQ ID NO: 413644 - RNA, 22 nt, Human
ccacagagacaggguccuugcu

SEQ ID NO: 413645 - RNA, 22 nt, Human
aguuuauguagaauuggcaaua

SEQ ID NO: 413646 - RNA, 22 nt, Human
agagugguacuucuuuuucuuc

SEQ ID NO: 413647 - RNA, 22 nt, Human
ccuggcaggcuggggacagugc

SEQ ID NO: 413648 - RNA, 22 nt, Human
augcucuggaguacgugaaauu

SEQ ID NO: 413649 - RNA, 22 nt, Human
gaacaguaucaguagugccagu

SEQ ID NO: 413650 - RNA, 22 nt, Human
aucuacaggcugaggugggagg

SEQ ID NO: 413651 - RNA, 22 nt, Human
guacuucccugggaggcaagca

SEQ ID NO: 413652 - RNA, 22 nt, Human
guccugggaaggaagccaggga

SEQ ID NO: 413653 - RNA, 22 nt, Human
auuaagacugcccauguuuuua

SEQ ID NO: 413654 - RNA, 22 nt, Human
aggcugaggcagguggaucauu

SEQ ID NO: 413655 - RNA, 22 nt, Human
cccugcagagaccacugaccuu

SEQ ID NO: 413656 - RNA, 22 nt, Human
cuaguccacuguccugccucca

SEQ ID NO: 413657 - RNA, 22 nt, Human
aagagcugauuaagucaugagg

SEQ ID NO: 413658 - RNA, 22 nt, Human
uggaagugcucuucugaccaac

SEQ ID NO: 413659 - RNA, 22 nt, Human
cagccaucccagccugugguuc

SEQ ID NO: 413660 - RNA, 21 nt, Human
gcucccugcucagcuccuggg

SEQ ID NO: 413661 - RNA, 22 nt, Human
cagcaugcaaguccagaugugg

SEQ ID NO: 413662 - RNA, 22 nt, Human
cagagggcacaugguuuccuca

SEQ ID NO: 413663 - RNA, 22 nt, Human
acaguaaugauucugagucucu

SEQ ID NO: 413664 - RNA, 22 nt, Human
auucacaaagaagggaaguaca

SEQ ID NO: 413665 - RNA, 22 nt, Human
cugcugugcuuguggccacccg

SEQ ID NO: 413666 - RNA, 22 nt, Human
gccugccacgcaugcagaguca

SEQ ID NO: 413667 - RNA, 22 nt, Human
cuuguacauagagaagaagccu

SEQ ID NO: 413668 - RNA, 22 nt, Human
uguccucacaggaaugaacuuu

SEQ ID NO: 413669 - RNA, 22 nt, Human
gguuugcauucugaaaggcuca

SEQ ID NO: 413670 - RNA, 22 nt, Human
uggagccaggagccugggaguc

SEQ ID NO: 413671 - RNA, 22 nt, Human
gagcacagcuggagguagcauu

SEQ ID NO: 413672 - RNA, 22 nt, Human
agucucagcuacuugggaggcu

SEQ ID NO: 413673 - RNA, 22 nt, Human
aaggcacugcuuugcugcgccc

SEQ ID NO: 413674 - RNA, 22 nt, Human
gggaccuggacaugugugugcu

SEQ ID NO: 413675 - RNA, 22 nt, Human
uaaauuaugucacaugacucug

SEQ ID NO: 413676 - RNA, 22 nt, Human
cuuauuagaaagaaaagacaug

SEQ ID NO: 413677 - RNA, 22 nt, Human
ccagcuuuuccucucauugcuu

SEQ ID NO: 413678 - RNA, 22 nt, Human
ugaguccauugauggauaguga

SEQ ID NO: 413679 - RNA, 22 nt, Human
acaugauuggacuccuuccccu

SEQ ID NO: 413680 - RNA, 22 nt, Human
aaggagaaaugguagaugugca

SEQ ID NO: 413681 - RNA, 22 nt, Human
guaacagaggguuugcagauau

SEQ ID NO: 413682 - RNA, 22 nt, Human
gucugcugcagagcauggcuuu

SEQ ID NO: 413683 - RNA, 22 nt, Human
gugcccugaguggguaggagag

SEQ ID NO: 413684 - RNA, 22 nt, Human
ucagagagccucaggcacugcc

SEQ ID NO: 413685 - RNA, 23 nt, Human
uuugcaaauuggacacaaccaca

SEQ ID NO: 413686 - RNA, 20 nt, Human
ucagagagagggugccacuu

SEQ ID NO: 413687 - RNA, 22 nt, Human
aauguguagcauuuaaugcagu

SEQ ID NO: 413688 - RNA, 22 nt, Human
acaugauauuaaugucuuauuu

SEQ ID NO: 413689 - RNA, 22 nt, Human
gccugcagccucagagaauuuu

SEQ ID NO: 413690 - RNA, 22 nt, Human
uacaguucacaguaucauaaau

SEQ ID NO: 413691 - RNA, 22 nt, Human
acaggcagcgucauugcugcuc

SEQ ID NO: 413692 - RNA, 22 nt, Human
caaaauguucuggcaccuuuaa

SEQ ID NO: 413693 - RNA, 22 nt, Human
cgcugccaggauccccugccgg

SEQ ID NO: 413694 - RNA, 22 nt, Human
aaaugcacugaacacauguugu

SEQ ID NO: 413695 - RNA, 22 nt, Human
ucuggcaggcaaucggcucugg

SEQ ID NO: 413696 - RNA, 22 nt, Human
aaaggucaaaaucgugacauug

SEQ ID NO: 413697 - RNA, 22 nt, Human
ggugacugguuuaucuggcagu

SEQ ID NO: 413698 - RNA, 22 nt, Human
cuuugcaauagaggcacacaug

SEQ ID NO: 413699 - RNA, 22 nt, Human
ucucucagaggccaggguccug

SEQ ID NO: 413700 - RNA, 22 nt, Human
ccagagaggccuuggcaagaca

SEQ ID NO: 413701 - RNA, 22 nt, Human
uaguggagaguuguuuugugca

SEQ ID NO: 413702 - RNA, 22 nt, Human
ucaguuuucaauuucaucagag

SEQ ID NO: 413703 - RNA, 22 nt, Human
ucugucaccauucagcuugaau

SEQ ID NO: 413704 - RNA, 22 nt, Human
cuguacaucccgagagccagua

SEQ ID NO: 413705 - RNA, 22 nt, Human
gugugcagggcugccugugccg

SEQ ID NO: 413706 - RNA, 20 nt, Human
ugccagggccagcagaggcu

SEQ ID NO: 413707 - RNA, 22 nt, Human
ggguccagcgacagcaggcuca

SEQ ID NO: 413708 - RNA, 22 nt, Human
uggcagcagccauggaaggccc

SEQ ID NO: 413709 - RNA, 23 nt, Human
ccuggcagcaaacgaggagguua

SEQ ID NO: 413710 - RNA, 22 nt, Human
ucaaaugcaggucuggucuugg

SEQ ID NO: 413711 - RNA, 22 nt, Human
caucaucaaaacaaauggaguc

SEQ ID NO: 413712 - RNA, 22 nt, Human
acaaaaagcuccauuacugucc

SEQ ID NO: 413713 - RNA, 22 nt, Human
ggcagggguccugguguugacu

SEQ ID NO: 413714 - RNA, 22 nt, Human
ggcagggcccugauuccugggg

SEQ ID NO: 413715 - RNA, 22 nt, Human
uuggcagggccaggcucucucu

SEQ ID NO: 413716 - RNA, 22 nt, Human
agggcuccaaggaaguguagcu

SEQ ID NO: 413717 - RNA, 22 nt, Human
agaauaaacugcuuuagggcag

SEQ ID NO: 413718 - RNA, 22 nt, Human
cagggcccagucccugcuguca

SEQ ID NO: 413719 - RNA, 22 nt, Human
gcagcaggcacggucucgacau

SEQ ID NO: 413720 - RNA, 22 nt, Human
agucucugccagcuuguccucu

SEQ ID NO: 413721 - RNA, 22 nt, Human
gccccagccaaggugacacgaa

SEQ ID NO: 413722 - RNA, 22 nt, Human
aggcccugcccagugccacaag

SEQ ID NO: 413723 - RNA, 22 nt, Human
agauaauuugaguaaauuaauu

SEQ ID NO: 413724 - RNA, 22 nt, Human
gagauguacaauguguauuaau

SEQ ID NO: 413725 - RNA, 23 nt, Human
ccuggaguacuaaggggauggaa

SEQ ID NO: 413726 - RNA, 22 nt, Human
gccucugcggggcccgagcccg

SEQ ID NO: 413727 - RNA, 22 nt, Human
gcugugcacuaccuauacaucc

SEQ ID NO: 413728 - RNA, 22 nt, Human
uguuaggguccugugcaggggc

SEQ ID NO: 413729 - RNA, 22 nt, Human
aggaaaaagaguugcugccuuc

SEQ ID NO: 413730 - RNA, 22 nt, Human
uuuuucugccauucaaagagga

SEQ ID NO: 413731 - RNA, 22 nt, Human
uaacagaaauuuuaguuagggg

SEQ ID NO: 413732 - RNA, 22 nt, Human
uuugaaagccuggcuuuucucu

SEQ ID NO: 413733 - RNA, 22 nt, Human
uucuaccauugggaaaacagcc

SEQ ID NO: 413734 - RNA, 22 nt, Human
agagcugggugaagugccauca

SEQ ID NO: 413735 - RNA, 22 nt, Human
gagaagcaauuuccaacugugc

SEQ ID NO: 413736 - RNA, 22 nt, Human
gccuggccugaacuaggaggug

SEQ ID NO: 413737 - RNA, 22 nt, Human
aaguuacaggagaaagagauca

SEQ ID NO: 413738 - RNA, 22 nt, Human
guccaagagucaagaagggggc

SEQ ID NO: 413739 - RNA, 22 nt, Human
ggcuucccuuuccgagaggaga

SEQ ID NO: 413740 - RNA, 22 nt, Human
gcagcuuuguggagaggcccau

SEQ ID NO: 413741 - RNA, 22 nt, Human
cuuggucauuucuuguccuguu

SEQ ID NO: 413742 - RNA, 22 nt, Human
uucauugugauucuuggcuagc

SEQ ID NO: 413743 - RNA, 22 nt, Human
ugggcagggaucucuuuugcaa

SEQ ID NO: 413744 - RNA, 22 nt, Human
cuggacagaaagggcugcugug

SEQ ID NO: 413745 - RNA, 22 nt, Human
cacauaaucaccaaguccuuuc

SEQ ID NO: 413746 - RNA, 22 nt, Human
acaugauuaaaagauuuuaaag

SEQ ID NO: 413747 - RNA, 22 nt, Human
uggccucuuaggacauccucua

SEQ ID NO: 413748 - RNA, 19 nt, Human
ugcucaggccaaggagccc

SEQ ID NO: 413749 - RNA, 21 nt, Human
guauugcagaguuaugugcuc

SEQ ID NO: 413750 - RNA, 22 nt, Human
aaaguuagaaugauaucaacga

SEQ ID NO: 413751 - RNA, 22 nt, Human
agaggaggccaggcccacaccu

SEQ ID NO: 413752 - RNA, 17 nt, Human
gacaggcucagugacga

SEQ ID NO: 413753 - RNA, 22 nt, Human
augcugugucaggaauuugaua

SEQ ID NO: 413754 - RNA, 22 nt, Human
ggcuagaauaauugacuucauu

SEQ ID NO: 413755 - RNA, 22 nt, Human
ggcuguggacacugagcucaga

SEQ ID NO: 413756 - RNA, 22 nt, Human
gcucccagcuggagccucaaca

SEQ ID NO: 413757 - RNA, 22 nt, Human
auguacaaaaugccacugaauu

SEQ ID NO: 413758 - RNA, 22 nt, Human
cccagccucuggguucugccgg

SEQ ID NO: 413759 - RNA, 22 nt, Human
gaggggaaagugugaggcugcg

SEQ ID NO: 413760 - RNA, 22 nt, Human
ggauaagaaaauuguaauaacu

SEQ ID NO: 413761 - RNA, 22 nt, Human
gggagggacacaaagaguuccc

SEQ ID NO: 413762 - RNA, 22 nt, Human
ggggcagaaguagugccccuga

SEQ ID NO: 413763 - RNA, 22 nt, Human
uuugcauuucucguaaggaaac

SEQ ID NO: 413764 - RNA, 22 nt, Human
aaggcaguuugggccaccaucu

SEQ ID NO: 413765 - RNA, 22 nt, Human
cucugcugcccaggccugcuag

SEQ ID NO: 413766 - RNA, 22 nt, Human
gacaggaggcagagcucaggug

SEQ ID NO: 413767 - RNA, 23 nt, Human
uccuucagagccucccuccaagc

SEQ ID NO: 413768 - RNA, 22 nt, Human
agauuucagaugcucggcaguu

SEQ ID NO: 413769 - RNA, 22 nt, Human
ccagccuggagggcaguggugg

SEQ ID NO: 413770 - RNA, 22 nt, Human
cagaccaucuugaagcaaacug

SEQ ID NO: 413771 - RNA, 22 nt, Human
gcuccucuucucccacugaaug

SEQ ID NO: 413772 - RNA, 22 nt, Human
acacuguguggucucucucgga

SEQ ID NO: 413773 - RNA, 22 nt, Human
aucacauuguuagcauagacug

SEQ ID NO: 413774 - RNA, 22 nt, Human
cagccagggucaggcagcuucu

SEQ ID NO: 413775 - RNA, 22 nt, Human
agagauucauguuuacuguagg

SEQ ID NO: 413776 - RNA, 22 nt, Human
agcccagcaaagggagguucag

SEQ ID NO: 413777 - RNA, 22 nt, Human
aggagccccucuucaguccugg

SEQ ID NO: 413778 - RNA, 22 nt, Human
ugacacagauuagagacauacc

SEQ ID NO: 413779 - RNA, 22 nt, Human
ccagagcccagcacacggugcu

SEQ ID NO: 413780 - RNA, 22 nt, Human
aggaaccagagguugagcaacu

SEQ ID NO: 413781 - RNA, 22 nt, Human
gccuaggaguggggauggcggu

SEQ ID NO: 413782 - RNA, 22 nt, Human
gaguccagacaccauaccugau

SEQ ID NO: 413783 - RNA, 22 nt, Human
ucucagaguuuacggggcugaa

SEQ ID NO: 413784 - RNA, 22 nt, Human
agggagccagaguugggagcuc

SEQ ID NO: 413785 - RNA, 22 nt, Human
cacucugcgcugggcgccagcg

SEQ ID NO: 413786 - RNA, 22 nt, Human
auggcaggcccagguguucauu

SEQ ID NO: 413787 - RNA, 22 nt, Human
ucuggcucucaacaaauauuua

SEQ ID NO: 413788 - RNA, 22 nt, Human
uuucucugaggcuggccucccu

SEQ ID NO: 413789 - RNA, 22 nt, Human
auuucucacucacaguccaugu

SEQ ID NO: 413790 - RNA, 22 nt, Human
gggauuugugggauggccagug

SEQ ID NO: 413791 - RNA, 22 nt, Human
ggccuggcauggggacuaaggg

SEQ ID NO: 413792 - RNA, 22 nt, Human
agcuggcuccagaaggagucgu

SEQ ID NO: 413793 - RNA, 17 nt, Human
uuagcaaaauagcacuu

SEQ ID NO: 413794 - RNA, 22 nt, Human
uggcaggaaaaacauuggagau

SEQ ID NO: 413795 - RNA, 22 nt, Human
cugccuuggaaaaugugguaau

SEQ ID NO: 413796 - RNA, 22 nt, Human
ucaaaugcggucauggcuuuua

SEQ ID NO: 413797 - RNA, 22 nt, Human
ggcagcaugagccuggugaauu

SEQ ID NO: 413798 - RNA, 22 nt, Human
ccaggguggaggcuggauggag

SEQ ID NO: 413799 - RNA, 22 nt, Human
aaaaacugguaacuauucccca

SEQ ID NO: 413800 - RNA, 22 nt, Human
guaaaguucuacuagaaucaac

SEQ ID NO: 413801 - RNA, 22 nt, Human
ggggcccagcaccccuccucgc

SEQ ID NO: 413802 - RNA, 22 nt, Human
ucuucucaguuucucuaggaug

SEQ ID NO: 413803 - RNA, 22 nt, Human
gccuggcaggccuguuggggcu

SEQ ID NO: 413804 - RNA, 22 nt, Human
acaguaauauugaugcucguca

SEQ ID NO: 413805 - RNA, 22 nt, Human
aagccagauagaagaacucauu

SEQ ID NO: 413806 - RNA, 21 nt, Human
uggcacugcuuagcagguucc

SEQ ID NO: 413807 - RNA, 22 nt, Human
ugccuaggaaaccucaugcuuc

SEQ ID NO: 413808 - RNA, 22 nt, Human
ucagcagauggguuguguuggc

SEQ ID NO: 413809 - RNA, 22 nt, Human
agggcugaagggaggugcucau

SEQ ID NO: 413810 - RNA, 22 nt, Human
ucccagccggugccuggguccc

SEQ ID NO: 413811 - RNA, 22 nt, Human
ccuguggcugccacuuggguga

SEQ ID NO: 413812 - RNA, 22 nt, Human
ucaaguauaucuagucauuagg

SEQ ID NO: 413813 - RNA, 22 nt, Human
ucucccacgguacaggauaaac

SEQ ID NO: 413814 - RNA, 22 nt, Human
ugccugaggagucagggcaggu

SEQ ID NO: 413815 - RNA, 22 nt, Human
augggaggaagagaagaugucu

SEQ ID NO: 413816 - RNA, 22 nt, Human
ucacacagguuugcaaugauuu

SEQ ID NO: 413817 - RNA, 22 nt, Human
acaaaauuguguuaaacuuuau

SEQ ID NO: 413818 - RNA, 23 nt, Human
aguuccagaaaaaugcucaagca

SEQ ID NO: 413819 - RNA, 22 nt, Human
gaguucaguaguuauagucuag

SEQ ID NO: 413820 - RNA, 22 nt, Human
agccuguccagaggacagggcu

SEQ ID NO: 413821 - RNA, 22 nt, Human
uugagggucuggaucugcugcu

SEQ ID NO: 413822 - RNA, 22 nt, Human
cagaggcuguguaggcagacug

SEQ ID NO: 413823 - RNA, 22 nt, Human
uggagaugcacgagcaggugga

SEQ ID NO: 413824 - RNA, 22 nt, Human
uguucccaagauaagauuauga

SEQ ID NO: 413825 - RNA, 22 nt, Human
augcugcacaagccacauguag

SEQ ID NO: 413826 - RNA, 22 nt, Human
uugcagaggcaaaaaugaacuc

SEQ ID NO: 413827 - RNA, 22 nt, Human
ugcugccacauuuaaagagggg

SEQ ID NO: 413828 - RNA, 22 nt, Human
acauuugaggauguuaagaaug

SEQ ID NO: 413829 - RNA, 21 nt, Human
ugggaccuauuucaacuggau

SEQ ID NO: 413830 - RNA, 22 nt, Human
gcucugggugaacuuggagcaa

SEQ ID NO: 413831 - RNA, 19 nt, Human
ucagggcaguccggucccc

SEQ ID NO: 413832 - RNA, 19 nt, Human
gguagaagggaaguguuuu

SEQ ID NO: 413833 - RNA, 22 nt, Human
agaggcuggauugagcauagac

SEQ ID NO: 413834 - RNA, 22 nt, Human
gcucaggaaacagcagggcuug

SEQ ID NO: 413835 - RNA, 22 nt, Human
ucagcuuucucagaggccuaac

SEQ ID NO: 413836 - RNA, 22 nt, Human
accugcaguggccacuccuaau

SEQ ID NO: 413837 - RNA, 16 nt, Human
gagaagagcccggcag

SEQ ID NO: 413838 - RNA, 19 nt, Human
uuuacucuccaaggugagu

SEQ ID NO: 413839 - RNA, 22 nt, Human
gagguacaugaggauacacagg

SEQ ID NO: 413840 - RNA, 22 nt, Human
aagcuggaacaucuugaggaag

SEQ ID NO: 413841 - RNA, 22 nt, Human
agcugguuagcaaucuaaguga

SEQ ID NO: 413842 - RNA, 22 nt, Human
agacaaagaaaccguagaagca

SEQ ID NO: 413843 - RNA, 22 nt, Human
ugucccagcagcuggguucucu

SEQ ID NO: 413844 - RNA, 19 nt, Human
uaguggagugacaaguucu

SEQ ID NO: 413845 - RNA, 22 nt, Human
uucaggauccccaccgcguuua

SEQ ID NO: 413846 - RNA, 22 nt, Human
agggcaguguggugggacugac

SEQ ID NO: 413847 - RNA, 22 nt, Human
agaacugguggugaucaguuau

SEQ ID NO: 413848 - RNA, 22 nt, Human
ggcucaggaccugggauugcca

SEQ ID NO: 413849 - RNA, 22 nt, Human
aaagccagcaaggugaguuuca

SEQ ID NO: 413850 - RNA, 23 nt, Human
uccuccuuuugcuugugcuuccc

SEQ ID NO: 413851 - RNA, 22 nt, Human
aauggcugggaguguauuuugg

SEQ ID NO: 413852 - RNA, 22 nt, Human
agccauugaauuuagugccuuu

SEQ ID NO: 413853 - RNA, 22 nt, Human
ugucacauaauuuaucuguagg

SEQ ID NO: 413854 - RNA, 22 nt, Human
aauuaugauuggucuaaaccag

SEQ ID NO: 413855 - RNA, 22 nt, Human
gggcuggcgggaaaggcaauuc

SEQ ID NO: 413856 - RNA, 19 nt, Human
cucugccucuggcuguggc

SEQ ID NO: 413857 - RNA, 22 nt, Human
gcuguccagagcaugggagcaa

SEQ ID NO: 413858 - RNA, 22 nt, Human
acacugugcagauucccuguga

SEQ ID NO: 413859 - RNA, 21 nt, Human
guccucagcugaugggagcug

SEQ ID NO: 413860 - RNA, 22 nt, Human
auggacaggaacucccuuggca

SEQ ID NO: 413861 - RNA, 20 nt, Human
acccagcucugugcccuggg

SEQ ID NO: 413862 - RNA, 22 nt, Human
gcucccagggaccgcagggcag

SEQ ID NO: 413863 - RNA, 22 nt, Human
ugggagcacccugaggagcuuc

SEQ ID NO: 413864 - RNA, 22 nt, Human
guaucacuuuugagagugagaa

SEQ ID NO: 413865 - RNA, 22 nt, Human
cuucucucccuggcacucagac

SEQ ID NO: 413866 - RNA, 22 nt, Human
cacccagcuuuugcauccuccg

SEQ ID NO: 413867 - RNA, 22 nt, Human
ugcugcacaauuggaaaguauc

SEQ ID NO: 413868 - RNA, 22 nt, Human
uaggccagcccuuaguccuguc

SEQ ID NO: 413869 - RNA, 22 nt, Human
ugagcauggugggugcagagca

SEQ ID NO: 413870 - RNA, 22 nt, Human
gugagcaggauaggggcucccu

SEQ ID NO: 413871 - RNA, 22 nt, Human
ccagcugcugugaggaccacag

SEQ ID NO: 413872 - RNA, 22 nt, Human
uuuagggaauagaagaucugaa

SEQ ID NO: 413873 - RNA, 21 nt, Human
aucuggaagaacugguaagug

SEQ ID NO: 413874 - RNA, 22 nt, Human
ccagagcagauguggccuuggu

SEQ ID NO: 413875 - RNA, 22 nt, Human
agaaacugaauuauuucugagg

SEQ ID NO: 413876 - RNA, 22 nt, Human
cuuacaaauacacuuaggagag

SEQ ID NO: 413877 - RNA, 22 nt, Human
uugcauugaaugcacauuuuua

SEQ ID NO: 413878 - RNA, 22 nt, Human
cugugucucuccuuacaagacu

SEQ ID NO: 413879 - RNA, 22 nt, Human
cacagggcuucucauggggugc

SEQ ID NO: 413880 - RNA, 22 nt, Human
uuacuuugaugaucaaugagcg

SEQ ID NO: 413881 - RNA, 22 nt, Human
cugggaggugaacagaaaaacu

SEQ ID NO: 413882 - RNA, 21 nt, Human
gcugcugccccuagugaggcc

SEQ ID NO: 413883 - RNA, 22 nt, Human
ucucccagugucuggcagucag

SEQ ID NO: 413884 - RNA, 22 nt, Human
ggcuggaaaagacaaagcuauu

SEQ ID NO: 413885 - RNA, 22 nt, Human
acauuucucauucuccccuaac

SEQ ID NO: 413886 - RNA, 22 nt, Human
uacauguauugauuucucuucu

SEQ ID NO: 413887 - RNA, 22 nt, Human
uauaacaguuuaggugguguca

SEQ ID NO: 413888 - RNA, 22 nt, Human
aaggcaguagguguuucaaacu

SEQ ID NO: 413889 - RNA, 22 nt, Human
uagcuuuaccauagaagaguau

SEQ ID NO: 413890 - RNA, 22 nt, Human
cguuggagacacuugaggacuu

SEQ ID NO: 413891 - RNA, 22 nt, Human
ccaggguguagggauuccagau

SEQ ID NO: 413892 - RNA, 22 nt, Human
aucagcugaaaaacaggcagca

SEQ ID NO: 413893 - RNA, 22 nt, Human
ggagaagccacacauugggugu

SEQ ID NO: 413894 - RNA, 19 nt, Human
uccauaagcuuguguucau

SEQ ID NO: 413895 - RNA, 22 nt, Human
ggcagcuggguuggccagaaac

SEQ ID NO: 413896 - RNA, 21 nt, Human
ccugugugucugacugggcua

SEQ ID NO: 413897 - RNA, 22 nt, Human
ccacugaaggucaacauagagc

SEQ ID NO: 413898 - RNA, 22 nt, Human
uccugucugcucacagagcugg

SEQ ID NO: 413899 - RNA, 22 nt, Human
uuggcugagagaggaaaagggc

SEQ ID NO: 413900 - RNA, 22 nt, Human
agcaggguuuggggauuggcac

SEQ ID NO: 413901 - RNA, 22 nt, Human
gaggcucaccuagggagcacug

SEQ ID NO: 413902 - RNA, 22 nt, Human
ugccuguccugaggaugagggu

SEQ ID NO: 413903 - RNA, 18 nt, Human
agccuggaggguugaagu

SEQ ID NO: 413904 - RNA, 22 nt, Human
agcacccucagccuuauccaga

SEQ ID NO: 413905 - RNA, 22 nt, Human
gggcuugcugauuugggcagga

SEQ ID NO: 413906 - RNA, 22 nt, Human
ugacaugcuuguuuuccuugaa

SEQ ID NO: 413907 - RNA, 18 nt, Human
aggaagcaggaggaaggc

SEQ ID NO: 413908 - RNA, 22 nt, Human
caguacuugggggguucuaagu

SEQ ID NO: 413909 - RNA, 22 nt, Human
gccaggcuggccagcaccuucu

SEQ ID NO: 413910 - RNA, 22 nt, Human
ucccacugcuuugcucugcuca

SEQ ID NO: 413911 - RNA, 22 nt, Human
ucacuuagauggggaucaucac

SEQ ID NO: 413912 - RNA, 22 nt, Human
caggaggaacaagagguucugg

SEQ ID NO: 413913 - RNA, 22 nt, Human
agucccagcuacucaagaggcu

SEQ ID NO: 413914 - RNA, 22 nt, Human
gguggcuggaggagcugaugga

SEQ ID NO: 413915 - RNA, 22 nt, Human
gcucccugacucaguuccugag

SEQ ID NO: 413916 - RNA, 22 nt, Human
gcaggcuggucugaccaucccu

SEQ ID NO: 413917 - RNA, 22 nt, Human
auggaaaggcuguggaaacuua

SEQ ID NO: 413918 - RNA, 22 nt, Human
uaaggucauggugaauaauaag

SEQ ID NO: 413919 - RNA, 21 nt, Human
gcagacugcccugcugucccc

SEQ ID NO: 413920 - RNA, 22 nt, Human
aaggaaccauuugugugcaugg

SEQ ID NO: 413921 - RNA, 20 nt, Human
ccugggguacacuggcaugu

SEQ ID NO: 413922 - RNA, 22 nt, Human
gcauggaauucccuuaugggcc

SEQ ID NO: 413923 - RNA, 22 nt, Human
ccagcucucagcgggagacuca

SEQ ID NO: 413924 - RNA, 22 nt, Human
gagcagcuguccccaaagcuuc

SEQ ID NO: 413925 - RNA, 22 nt, Human
agccagagagccccagguucua

SEQ ID NO: 413926 - RNA, 21 nt, Human
aaggccugcuuacugcuaguu

SEQ ID NO: 413927 - RNA, 22 nt, Human
ugggccuguugccugaguccau

SEQ ID NO: 413928 - RNA, 22 nt, Human
ucaaaggcgguccaggaauaaa

SEQ ID NO: 413929 - RNA, 22 nt, Human
ggccugaggcaauagucagaca

SEQ ID NO: 413930 - RNA, 22 nt, Human
ggcagugguuagaaacaugagc

SEQ ID NO: 413931 - RNA, 22 nt, Human
agcugccaccucugccuuuggg

SEQ ID NO: 413932 - RNA, 22 nt, Human
ggcaggguggcccuccagugag

SEQ ID NO: 413933 - RNA, 22 nt, Human
cagcagcugauggggaagugau

SEQ ID NO: 413934 - RNA, 22 nt, Human
uguuacuuaucucacgugaugc

SEQ ID NO: 413935 - RNA, 22 nt, Human
ucagaccauccugcuguuagug

SEQ ID NO: 413936 - RNA, 22 nt, Human
gguggagcuguggacaggaagg

SEQ ID NO: 413937 - RNA, 22 nt, Human
gucucagaguccuacuuauucc

SEQ ID NO: 413938 - RNA, 22 nt, Human
ggaaaguggugguggaaagagg

SEQ ID NO: 413939 - RNA, 22 nt, Human
acagagguguguguaggacagu

SEQ ID NO: 413940 - RNA, 22 nt, Human
caaaacugucuagagagagaag

SEQ ID NO: 413941 - RNA, 22 nt, Human
agcaucuggugagggccuaguu

SEQ ID NO: 413942 - RNA, 22 nt, Human
acucugcuuauugcugcaggca

SEQ ID NO: 413943 - RNA, 22 nt, Human
acauuucuucccuuuagcagaa

SEQ ID NO: 413944 - RNA, 22 nt, Human
aaucuggcucagaagaagauga

SEQ ID NO: 413945 - RNA, 22 nt, Human
gcuggccugcgagggcaggcug

SEQ ID NO: 413946 - RNA, 20 nt, Human
ggcagcucacuacuuucugu

SEQ ID NO: 413947 - RNA, 22 nt, Human
caccaggcugaaccagagggga

SEQ ID NO: 413948 - RNA, 22 nt, Human
cacagggccuggggcagcugcu

SEQ ID NO: 413949 - RNA, 22 nt, Human
gacauaaaauucaauaauuugu

SEQ ID NO: 413950 - RNA, 22 nt, Human
cucugggcuuguugaccugcac

SEQ ID NO: 413951 - RNA, 20 nt, Human
uuugagaccagucugcccaa

SEQ ID NO: 413952 - RNA, 22 nt, Human
cucagggacguuagaggacagg

SEQ ID NO: 413953 - RNA, 22 nt, Human
aauuauauuguggugugaaugu

SEQ ID NO: 413954 - RNA, 22 nt, Human
cacaggagugcugcuauuguug

SEQ ID NO: 413955 - RNA, 22 nt, Human
cugagcccaggcgggagcugag

SEQ ID NO: 413956 - RNA, 22 nt, Human
ggcucugcuggauugaggccag

SEQ ID NO: 413957 - RNA, 22 nt, Human
uccuccuucgggacugcuugac

SEQ ID NO: 413958 - RNA, 22 nt, Human
ucucagaguuccucuggagucc

SEQ ID NO: 413959 - RNA, 23 nt, Human
ugaaggccuggaggacgcguugu

SEQ ID NO: 413960 - RNA, 22 nt, Human
uucaagauccagcacaacagug

SEQ ID NO: 413961 - RNA, 22 nt, Human
agcagggccaacaguaaacacc

SEQ ID NO: 413962 - RNA, 22 nt, Human
uaacagaagaugaaacuucuuu

SEQ ID NO: 413963 - RNA, 22 nt, Human
cuucuccucugaguccugggag

SEQ ID NO: 413964 - RNA, 21 nt, Human
aggaaguggccagauugggaa

SEQ ID NO: 413965 - RNA, 22 nt, Human
cagguggcaugacugccuacaa

SEQ ID NO: 413966 - RNA, 22 nt, Human
aagagguaaccauagcaaccac

SEQ ID NO: 413967 - RNA, 22 nt, Human
acagacauuuucuguauugccu

SEQ ID NO: 413968 - RNA, 21 nt, Human
uggcugccuacaugcugcagg

SEQ ID NO: 413969 - RNA, 22 nt, Human
ucugucuuugagaucucagccu

SEQ ID NO: 413970 - RNA, 22 nt, Human
aaacaugagcaucucuucaagc

SEQ ID NO: 413971 - RNA, 22 nt, Human
aguggcagacacaaugugggca

SEQ ID NO: 413972 - RNA, 23 nt, Human
ucuggcuccauccuuggggaucc

SEQ ID NO: 413973 - RNA, 22 nt, Human
aauuuggcagugucuugaagua

SEQ ID NO: 413974 - RNA, 22 nt, Human
aagcaguguucccagcuggccc

SEQ ID NO: 413975 - RNA, 22 nt, Human
ccuucugcucccuggccagggc

SEQ ID NO: 413976 - RNA, 22 nt, Human
ugcauuguuuagaacucuuugg

SEQ ID NO: 413977 - RNA, 22 nt, Human
caguuuauagcucuagcagcuu

SEQ ID NO: 413978 - RNA, 22 nt, Human
auugcaccuuggguuuugaaag

SEQ ID NO: 413979 - RNA, 22 nt, Human
ggagaccagaaggaagcuucga

SEQ ID NO: 413980 - RNA, 22 nt, Human
agggccuggcgcguggccgccg

SEQ ID NO: 413981 - RNA, 22 nt, Human
gcagcaugagcuauacaaagua

SEQ ID NO: 413982 - RNA, 22 nt, Human
uggacucaaguccaaguucacg

SEQ ID NO: 413983 - RNA, 22 nt, Human
caggggcuguggcacauggugu

SEQ ID NO: 413984 - RNA, 20 nt, Human
ccuaggcaugcugagucucc

SEQ ID NO: 413985 - RNA, 22 nt, Human
cuguaugaggaucagacuggac

SEQ ID NO: 413986 - RNA, 22 nt, Human
aaacaguagaaguguauuuuau

SEQ ID NO: 413987 - RNA, 22 nt, Human
uguggccuccuguuccugggua

SEQ ID NO: 413988 - RNA, 22 nt, Human
gggcugagcuguucugaguuua

SEQ ID NO: 413989 - RNA, 19 nt, Human
gcugcuggcucuggcugga

SEQ ID NO: 413990 - RNA, 22 nt, Human
agcagccagagaaugaugcagu

SEQ ID NO: 413991 - RNA, 22 nt, Human
ccugagggaggguauaggcugu

SEQ ID NO: 413992 - RNA, 22 nt, Human
ucuucuuccucauuuauacaua

SEQ ID NO: 413993 - RNA, 22 nt, Human
uggaccugggguggccuccucu

SEQ ID NO: 413994 - RNA, 22 nt, Human
accugagaaugggggcaugugu

SEQ ID NO: 413995 - RNA, 22 nt, Human
cccuuucccuucuggcucaggg

SEQ ID NO: 413996 - RNA, 22 nt, Human
gggcguggauggucagugcagg

SEQ ID NO: 413997 - RNA, 19 nt, Human
aggagaaguagcagaaauu

SEQ ID NO: 413998 - RNA, 22 nt, Human
ugcucuggaguggcuugugcac

SEQ ID NO: 413999 - RNA, 22 nt, Human
cccaggcacagauuaucccaau

SEQ ID NO: 414000 - RNA, 22 nt, Human
uuuucucaggugcuuaucuaag

SEQ ID NO: 414001 - RNA, 16 nt, Human
ccaccugcagcucuca

SEQ ID NO: 414002 - RNA, 21 nt, Human
ugcucacagaugugcucagug

SEQ ID NO: 414003 - RNA, 22 nt, Human
gcaggggcuaaggacacagaga

SEQ ID NO: 414004 - RNA, 22 nt, Human
agaggcccucucucuccugaug

SEQ ID NO: 414005 - RNA, 23 nt, Human
cugucuccugggcuagguggaau

SEQ ID NO: 414006 - RNA, 22 nt, Human
cacagcugccauggcugcacuu

SEQ ID NO: 414007 - RNA, 22 nt, Human
uagcaggguccaaugugaggca

SEQ ID NO: 414008 - RNA, 22 nt, Human
ccugccugcggcccgcggggag

SEQ ID NO: 414009 - RNA, 22 nt, Human
ccucagggacuccaugcugcag

SEQ ID NO: 414010 - RNA, 19 nt, Human
gcucugugaugcugagggg

SEQ ID NO: 414011 - RNA, 22 nt, Human
cccagcucaagcagagagcuaa

SEQ ID NO: 414012 - RNA, 23 nt, Human
agucaguguaaguuuggaaugca

SEQ ID NO: 414013 - RNA, 22 nt, Human
guacauuucucuuguucuuauu

SEQ ID NO: 414014 - RNA, 22 nt, Human
uuuucuuacugucugugauccu

SEQ ID NO: 414015 - RNA, 17 nt, Human
ggcaccagacggagagu

SEQ ID NO: 414016 - RNA, 22 nt, Human
cugaggcaugaaugugggcuuu

SEQ ID NO: 414017 - RNA, 22 nt, Human
aucucagucagguugaauuugg

SEQ ID NO: 414018 - RNA, 22 nt, Human
uccucuggauauaagccucacc

SEQ ID NO: 414019 - RNA, 22 nt, Human
uuccugaugcacacagucauuu

SEQ ID NO: 414020 - RNA, 22 nt, Human
agcucccugagaugccacagca

SEQ ID NO: 414021 - RNA, 22 nt, Human
ggagggcugccagguggagcgg

SEQ ID NO: 414022 - RNA, 22 nt, Human
ugaaaucuuagccauucugccu

SEQ ID NO: 414023 - RNA, 22 nt, Human
uauucauaguaaacaaaagugg

SEQ ID NO: 414024 - RNA, 22 nt, Human
gggauggcuuuguggcugacuc

SEQ ID NO: 414025 - RNA, 22 nt, Human
gccagaaacauacacaucacuu

SEQ ID NO: 414026 - RNA, 22 nt, Human
ccagguguaggacaccaaggga

SEQ ID NO: 414027 - RNA, 22 nt, Human
ccagccuccauguagauagcug

SEQ ID NO: 414028 - RNA, 22 nt, Human
agcagggcccacuaggggagau

SEQ ID NO: 414029 - RNA, 22 nt, Human
ugggcaggagagaagcuaaaga

SEQ ID NO: 414030 - RNA, 22 nt, Human
cccaggcagccugcagggaagg

SEQ ID NO: 414031 - RNA, 22 nt, Human
aucuggaagccagauacucagu

SEQ ID NO: 414032 - RNA, 22 nt, Human
cagcuugaaauauuaggagaug

SEQ ID NO: 414033 - RNA, 22 nt, Human
gaaauucaggacaaagacucuu

SEQ ID NO: 414034 - RNA, 22 nt, Human
gcaguguuguuaaaagauuaga

SEQ ID NO: 414035 - RNA, 22 nt, Human
uuugaacaagagcuucacauua

SEQ ID NO: 414036 - RNA, 22 nt, Human
auuuuaucugcuuacuuucagg

SEQ ID NO: 414037 - RNA, 22 nt, Human
cuccugggcucaagugauccuc

SEQ ID NO: 414038 - RNA, 22 nt, Human
gccugcagauauauaggauggu

SEQ ID NO: 414039 - RNA, 22 nt, Human
caccuggcuggaagugcuccgg

SEQ ID NO: 414040 - RNA, 22 nt, Human
ucugucugacaggguaugaacu

SEQ ID NO: 414041 - RNA, 22 nt, Human
agggccaccagagcagggcagu

SEQ ID NO: 414042 - RNA, 22 nt, Human
uggccuggugcucaggcaguag

SEQ ID NO: 414043 - RNA, 22 nt, Human
aggccuuaccauagcuguagca

SEQ ID NO: 414044 - RNA, 22 nt, Human
ucuuccucucuaauugaucaga

SEQ ID NO: 414045 - RNA, 22 nt, Human
ccauuguaguaucuguuuuagu

SEQ ID NO: 414046 - RNA, 22 nt, Human
uaggccagaggagcagcuuugg

SEQ ID NO: 414047 - RNA, 22 nt, Human
agcagacaacccagaugaccca

SEQ ID NO: 414048 - RNA, 22 nt, Human
acugucugcccugagaugccag

SEQ ID NO: 414049 - RNA, 22 nt, Human
aagggcaggugggcauuucugg

SEQ ID NO: 414050 - RNA, 22 nt, Human
gggcugugggacccggcacuuu

SEQ ID NO: 414051 - RNA, 22 nt, Human
cagagagaggccacugcuauua

SEQ ID NO: 414052 - RNA, 22 nt, Human
gccaggcaguucaaguacacca

SEQ ID NO: 414053 - RNA, 21 nt, Human
agagccugagaucuuccagca

SEQ ID NO: 414054 - RNA, 22 nt, Human
aaggguggauuucugagcucua

SEQ ID NO: 414055 - RNA, 22 nt, Human
agccuggccugggcaggcacau

SEQ ID NO: 414056 - RNA, 22 nt, Human
ggaggaggggugacugaaugcu

SEQ ID NO: 414057 - RNA, 23 nt, Human
cuuuucauugccuuagcgcagag

SEQ ID NO: 414058 - RNA, 22 nt, Human
caagaaaugggauuugacugcc

SEQ ID NO: 414059 - RNA, 22 nt, Human
uguauguguauguacauaugca

SEQ ID NO: 414060 - RNA, 22 nt, Human
auguuaaaugguuuauuauuaa

SEQ ID NO: 414061 - RNA, 22 nt, Human
aggcaguuucugggacagcaua

SEQ ID NO: 414062 - RNA, 22 nt, Human
accugagccuagggagguugag

SEQ ID NO: 414063 - RNA, 22 nt, Human
gagcugcagcggcugacgcaac

SEQ ID NO: 414064 - RNA, 22 nt, Human
cacauuugaaggaauuagcauu

SEQ ID NO: 414065 - RNA, 22 nt, Human
cagcaauaagguaagcuucucc

SEQ ID NO: 414066 - RNA, 21 nt, Human
cccaggucguggucuucccag

SEQ ID NO: 414067 - RNA, 22 nt, Human
gggcuccagcccgggaccaggu

SEQ ID NO: 414068 - RNA, 22 nt, Human
cagccagggagggcaaaugaga

SEQ ID NO: 414069 - RNA, 22 nt, Human
gccuggagacagcagaggcggc

SEQ ID NO: 414070 - RNA, 18 nt, Human
ucugggcuucccgaggcu

SEQ ID NO: 414071 - RNA, 22 nt, Human
ucccagccuuucuuuucugcug

SEQ ID NO: 414072 - RNA, 22 nt, Human
ugcuggagaucauuaauguuca

SEQ ID NO: 414073 - RNA, 22 nt, Human
acaaaaauuagcugggcauggu

SEQ ID NO: 414074 - RNA, 20 nt, Human
caggcaguuugugguuaggg

SEQ ID NO: 414075 - RNA, 21 nt, Human
ccagaggccucucuuggccac

SEQ ID NO: 414076 - RNA, 22 nt, Human
uuuauccauucaccaguugaac

SEQ ID NO: 414077 - RNA, 22 nt, Human
ucccagaguauuagcaauugcu

SEQ ID NO: 414078 - RNA, 22 nt, Human
cuggcucaugugaugagggcaa

SEQ ID NO: 414079 - RNA, 22 nt, Human
cuggggcugcgguggaggagcc

SEQ ID NO: 414080 - RNA, 22 nt, Human
guacaugucaaaaaaugcauaa

SEQ ID NO: 414081 - RNA, 22 nt, Human
cauuuguaauacugacuugcag

SEQ ID NO: 414082 - RNA, 22 nt, Human
agggagaacaguugcagcagac

SEQ ID NO: 414083 - RNA, 22 nt, Human
gagugcaguaucuucugugucc

SEQ ID NO: 414084 - RNA, 22 nt, Human
acugauacaucuguggaagugg

SEQ ID NO: 414085 - RNA, 22 nt, Human
ugaggcaggaaguuauauaaug

SEQ ID NO: 414086 - RNA, 22 nt, Human
ggaagccaggccaaugagaaca

SEQ ID NO: 414087 - RNA, 22 nt, Human
agaagccaauccuugucucucu

SEQ ID NO: 414088 - RNA, 22 nt, Human
cagagcugcacauucuaugaug

SEQ ID NO: 414089 - RNA, 22 nt, Human
ugcauguuaagaaaauauugag

SEQ ID NO: 414090 - RNA, 22 nt, Human
agccagcugccuuucacaucug

SEQ ID NO: 414091 - RNA, 22 nt, Human
gugagcagaacagguggcuucu

SEQ ID NO: 414092 - RNA, 22 nt, Human
aggcucagggacucccucccuc

SEQ ID NO: 414093 - RNA, 22 nt, Human
ugggcuccguugccuggggcag

SEQ ID NO: 414094 - RNA, 22 nt, Human
gccucucucuacccaguaugau

SEQ ID NO: 414095 - RNA, 22 nt, Human
gcagugggagcuuaggcagugc

SEQ ID NO: 414096 - RNA, 22 nt, Human
uguacacaauucuuaacauaca

SEQ ID NO: 414097 - RNA, 22 nt, Human
gcugagagcaaagcaugucuag

SEQ ID NO: 414098 - RNA, 22 nt, Human
aauaauguugacgauagucuua

SEQ ID NO: 414099 - RNA, 20 nt, Human
ccagcugagccaaggggaga

SEQ ID NO: 414100 - RNA, 22 nt, Human
ccaggugucuguggccagcccu

SEQ ID NO: 414101 - RNA, 22 nt, Human
ccaaggaggccccaggucagcu

SEQ ID NO: 414102 - RNA, 22 nt, Human
gaggaaacauuguagaagcagu

SEQ ID NO: 414103 - RNA, 22 nt, Human
cucccugguguccccuccagga

SEQ ID NO: 414104 - RNA, 22 nt, Human
gccagggaaacugcagaccagc

SEQ ID NO: 414105 - RNA, 22 nt, Human
agccucugacugucagcaaggu

SEQ ID NO: 414106 - RNA, 22 nt, Human
cugaggcugcccagggccaggu

SEQ ID NO: 414107 - RNA, 22 nt, Human
ucccagagucuucuccuguaau

SEQ ID NO: 414108 - RNA, 22 nt, Human
ccucugccugcacaucauccug

SEQ ID NO: 414109 - RNA, 22 nt, Human
ugguaaagaaggcuagaucuga

SEQ ID NO: 414110 - RNA, 22 nt, Human
ugcauaaacuucucugguguga

SEQ ID NO: 414111 - RNA, 22 nt, Human
ucuuuggauaucgcuagaccgu

SEQ ID NO: 414112 - RNA, 22 nt, Human
cucuggaguuagugaucugggc

SEQ ID NO: 414113 - RNA, 22 nt, Human
cucuggaggccuaaggaagugg

SEQ ID NO: 414114 - RNA, 22 nt, Human
gcagggacaucuucagaucacu

SEQ ID NO: 414115 - RNA, 22 nt, Human
uuagggacagcucuguagguga

SEQ ID NO: 414116 - RNA, 23 nt, Human
ggguccagagacaggcaugggug

SEQ ID NO: 414117 - RNA, 22 nt, Human
gcagggacaaggcagguguucu

SEQ ID NO: 414118 - RNA, 22 nt, Human
agguggccggugccagccgggc

SEQ ID NO: 414119 - RNA, 22 nt, Human
ggcucugcccagaugaagagga

SEQ ID NO: 414120 - RNA, 22 nt, Human
ucucagaguuuuuuuccaggac

SEQ ID NO: 414121 - RNA, 22 nt, Human
cauggcaggugcagauucugug

SEQ ID NO: 414122 - RNA, 22 nt, Human
aaaugcuguaacugauauucug

SEQ ID NO: 414123 - RNA, 22 nt, Human
gagagcugucagcguagcaccg

SEQ ID NO: 414124 - RNA, 21 nt, Human
ccuggcagaagccugauaugc

SEQ ID NO: 414125 - RNA, 22 nt, Human
gaggcucacuuucauccucuuc

SEQ ID NO: 414126 - RNA, 22 nt, Human
cagcuuugugcaaugcagucuc

SEQ ID NO: 414127 - RNA, 22 nt, Human
ugcaguggaaagacucagacuu

SEQ ID NO: 414128 - RNA, 22 nt, Human
agagccccugguggagugagaa

SEQ ID NO: 414129 - RNA, 22 nt, Human
ucagggcagguuaacuugggug

SEQ ID NO: 414130 - RNA, 22 nt, Human
ggguaauuggggccuugcagug

SEQ ID NO: 414131 - RNA, 22 nt, Human
aaauguguuuagaugguuuauu

SEQ ID NO: 414132 - RNA, 22 nt, Human
ggccgggcaggucucagccagc

SEQ ID NO: 414133 - RNA, 22 nt, Human
agagcuggccagggaucacucu

SEQ ID NO: 414134 - RNA, 22 nt, Human
gcagggccagugcagagaggaa

SEQ ID NO: 414135 - RNA, 22 nt, Human
ccaggcucaggugcgagagaca

SEQ ID NO: 414136 - RNA, 22 nt, Human
gaaauucugugucccagagugc

SEQ ID NO: 414137 - RNA, 22 nt, Human
aaaauccucuaauucuagaaua

SEQ ID NO: 414138 - RNA, 22 nt, Human
cugaagcaaaugaaacagcucu

SEQ ID NO: 414139 - RNA, 22 nt, Human
aguuauauaacuaucuagaugc

SEQ ID NO: 414140 - RNA, 19 nt, Human
uggcauugguccagauaaa

SEQ ID NO: 414141 - RNA, 22 nt, Human
agcucccagaguccucugccca

SEQ ID NO: 414142 - RNA, 23 nt, Human
uggcucagggucucuuaugaagu

SEQ ID NO: 414143 - RNA, 22 nt, Human
agaaaugacacacaugagacau

SEQ ID NO: 414144 - RNA, 22 nt, Human
ugggccacacacagaagaauca

SEQ ID NO: 414145 - RNA, 22 nt, Human
auguuucaaauauauagaguug

SEQ ID NO: 414146 - RNA, 18 nt, Human
gcuccuggaccaggucac

SEQ ID NO: 414147 - RNA, 22 nt, Human
guauuuauaggggaaugagagu

SEQ ID NO: 414148 - RNA, 22 nt, Human
caggauggucucgaucuccuga

SEQ ID NO: 414149 - RNA, 22 nt, Human
uaaaugcaaugugcuuuaccag

SEQ ID NO: 414150 - RNA, 22 nt, Human
accucugcaguagggcugugcc

SEQ ID NO: 414151 - RNA, 22 nt, Human
aauguguagggugccuguuuuu

SEQ ID NO: 414152 - RNA, 22 nt, Human
aaguaaaagcuuuaccaugcgc

SEQ ID NO: 414153 - RNA, 22 nt, Human
gccagagcagaauagaguggcc

SEQ ID NO: 414154 - RNA, 22 nt, Human
ucaaauguucccuguacuggcc

SEQ ID NO: 414155 - RNA, 22 nt, Human
acaaguggguccuacauaaagc

SEQ ID NO: 414156 - RNA, 22 nt, Human
ccuuggcccuagccucaggcaa

SEQ ID NO: 414157 - RNA, 22 nt, Human
aaauguauccuacuuccugagu

SEQ ID NO: 414158 - RNA, 22 nt, Human
aaagagcucacaguccacugga

SEQ ID NO: 414159 - RNA, 22 nt, Human
ugcagaagaaaacagcugugug

SEQ ID NO: 414160 - RNA, 22 nt, Human
ugcagcugguuuagaacuagau

SEQ ID NO: 414161 - RNA, 22 nt, Human
ccccaccagcacccucucuauc

SEQ ID NO: 414162 - RNA, 22 nt, Human
cgcagaagagguugucuagucc

SEQ ID NO: 414163 - RNA, 22 nt, Human
auaaggcaucucucaguuagca

SEQ ID NO: 414164 - RNA, 22 nt, Human
gcagagugauggaaugugggug

SEQ ID NO: 414165 - RNA, 22 nt, Human
gcugccuucaguucugauucau

SEQ ID NO: 414166 - RNA, 22 nt, Human
ugacagggugauuaugagagcu

SEQ ID NO: 414167 - RNA, 19 nt, Human
gcugugccucucuccugcu

SEQ ID NO: 414168 - RNA, 22 nt, Human
ccaaaauuaagccucuuauguu

SEQ ID NO: 414169 - RNA, 22 nt, Human
ugcugucaguuggcaggaugag

SEQ ID NO: 414170 - RNA, 22 nt, Human
cccaggagguagagguugcagu

SEQ ID NO: 414171 - RNA, 22 nt, Human
aucaggaucaugcuggguggga

SEQ ID NO: 414172 - RNA, 22 nt, Human
ugggaguggggcauagaaggua

SEQ ID NO: 414173 - RNA, 22 nt, Human
auuaaauuaaguggcuaauuua

SEQ ID NO: 414174 - RNA, 22 nt, Human
ucagagugguagccuauuuucu

SEQ ID NO: 414175 - RNA, 22 nt, Human
cuggccacuggagguggcaccc

SEQ ID NO: 414176 - RNA, 22 nt, Human
gaggaagaauugguuauuggag

SEQ ID NO: 414177 - RNA, 22 nt, Human
aggccugaggaccagauaaaug

SEQ ID NO: 414178 - RNA, 22 nt, Human
ucaggggacagccagcuggagg

SEQ ID NO: 414179 - RNA, 22 nt, Human
ugcagggauuguuggcauccau

SEQ ID NO: 414180 - RNA, 21 nt, Human
acagcagacaggcuuaggacc

SEQ ID NO: 414181 - RNA, 22 nt, Human
cagcuuuaguaacccacugcuc

SEQ ID NO: 414182 - RNA, 22 nt, Human
agagacaggauaucugcucaug

SEQ ID NO: 414183 - RNA, 22 nt, Human
uggagcaagcuggagagaacau

SEQ ID NO: 414184 - RNA, 22 nt, Human
ccagcccugaacccugcugcau

SEQ ID NO: 414185 - RNA, 22 nt, Human
aggagagagaacacuugggucc

SEQ ID NO: 414186 - RNA, 20 nt, Human
ccaggcacugucccaugcag

SEQ ID NO: 414187 - RNA, 23 nt, Human
ggcagcucucaucugaugacuga

SEQ ID NO: 414188 - RNA, 22 nt, Human
uccagggaccucccugagagcu

SEQ ID NO: 414189 - RNA, 22 nt, Human
gaagaggaugacaggagccggu

SEQ ID NO: 414190 - RNA, 22 nt, Human
ucaggcugguggucagauggcu

SEQ ID NO: 414191 - RNA, 22 nt, Human
gccaccuggacagcugugcccu

SEQ ID NO: 414192 - RNA, 22 nt, Human
ucuucagagacucugagccccu

SEQ ID NO: 414193 - RNA, 22 nt, Human
acaguaaaucaacagaauaucu

SEQ ID NO: 414194 - RNA, 22 nt, Human
uacagaaaaacuggcauugaag

SEQ ID NO: 414195 - RNA, 22 nt, Human
guccuggcuuaguucgcuguaa

SEQ ID NO: 414196 - RNA, 22 nt, Human
gaauguaauagucaguagaaca

SEQ ID NO: 414197 - RNA, 22 nt, Human
aauaacaggcucaucagaugcu

SEQ ID NO: 414198 - RNA, 22 nt, Human
agauacaaaagauaagauuuag

SEQ ID NO: 414199 - RNA, 22 nt, Human
uuugcauuuccagaguagcaga

SEQ ID NO: 414200 - RNA, 22 nt, Human
aucaguuuggugcuuucaguga

SEQ ID NO: 414201 - RNA, 22 nt, Human
cagggcagggauguugcggcag

SEQ ID NO: 414202 - RNA, 22 nt, Human
gggccagagcuuggcagcuggg

SEQ ID NO: 414203 - RNA, 22 nt, Human
guggcgcagaggguggcagaga

SEQ ID NO: 414204 - RNA, 22 nt, Human
aaaaguuaccucuguaauauaa

SEQ ID NO: 414205 - RNA, 21 nt, Human
cagaggcaggcucugugugug

SEQ ID NO: 414206 - RNA, 22 nt, Human
gugcauuggugcgccacuucac

SEQ ID NO: 414207 - RNA, 22 nt, Human
agacuucucaguuuuauuagua

SEQ ID NO: 414208 - RNA, 22 nt, Human
uccauuuuucaugacuccucaa

SEQ ID NO: 414209 - RNA, 22 nt, Human
uuauuuauuguguaccuacugu

SEQ ID NO: 414210 - RNA, 20 nt, Human
agagccuugaggaagaugau

SEQ ID NO: 414211 - RNA, 22 nt, Human
ccaggagcaggagcuggacaga

SEQ ID NO: 414212 - RNA, 22 nt, Human
cccuggagggauuucucaauca

SEQ ID NO: 414213 - RNA, 22 nt, Human
aaggccugggaggccucucuuc

SEQ ID NO: 414214 - RNA, 22 nt, Human
gagcagggagacaacucuggug

SEQ ID NO: 414215 - RNA, 23 nt, Human
cagugcagggcaacucagacucc

SEQ ID NO: 414216 - RNA, 22 nt, Human
agccuggagaggcgccauacac

SEQ ID NO: 414217 - RNA, 22 nt, Human
aaauacagauuccagggucuua

SEQ ID NO: 414218 - RNA, 22 nt, Human
gagagggcugccuggugugagg

SEQ ID NO: 414219 - RNA, 22 nt, Human
cugucuguuuuaccuucuccag

SEQ ID NO: 414220 - RNA, 22 nt, Human
gaggcagcagggcugguuccuu

SEQ ID NO: 414221 - RNA, 22 nt, Human
uauguguaggaggaggacaggg

SEQ ID NO: 414222 - RNA, 22 nt, Human
uggcucagauuuuuguaggcuu

SEQ ID NO: 414223 - RNA, 22 nt, Human
uuugcauuguaauauuuaguuc

SEQ ID NO: 414224 - RNA, 22 nt, Human
ucuguacaacaaagggaugaga

SEQ ID NO: 414225 - RNA, 22 nt, Human
cuggcucccguuguccuugaag

SEQ ID NO: 414226 - RNA, 22 nt, Human
cgcugccaggucaccaggggua

SEQ ID NO: 414227 - RNA, 22 nt, Human
uggcuuucucccccagcuucuc

SEQ ID NO: 414228 - RNA, 22 nt, Human
gccagggcugugcagguuuguu

SEQ ID NO: 414229 - RNA, 22 nt, Human
ccaggugguucaggucaccaua

SEQ ID NO: 414230 - RNA, 22 nt, Human
ucccagccacagguguagcccu

SEQ ID NO: 414231 - RNA, 23 nt, Human
ucuccagugucucuucauugagu

SEQ ID NO: 414232 - RNA, 22 nt, Human
ggcuuuaugcagggauagaaau

SEQ ID NO: 414233 - RNA, 22 nt, Human
aaguucuaauuuugcauucagg

SEQ ID NO: 414234 - RNA, 22 nt, Human
uuggccuuguuaaggaggcccu

SEQ ID NO: 414235 - RNA, 22 nt, Human
aucaggaugacaacugcugggu

SEQ ID NO: 414236 - RNA, 22 nt, Human
agagaauuacagaagaauguca

SEQ ID NO: 414237 - RNA, 19 nt, Human
uguggccaugguucagcug

SEQ ID NO: 414238 - RNA, 22 nt, Human
caggaagagguaucaccgagca

SEQ ID NO: 414239 - RNA, 22 nt, Human
cuggcagguccagcuggacuca

SEQ ID NO: 414240 - RNA, 22 nt, Human
cagugagggaagaucucagcac

SEQ ID NO: 414241 - RNA, 22 nt, Human
cugccagcucgccacaaugaca

SEQ ID NO: 414242 - RNA, 22 nt, Human
auuucacucuuaauugcuuccu

SEQ ID NO: 414243 - RNA, 19 nt, Human
cugggagguguucagagaa

SEQ ID NO: 414244 - RNA, 22 nt, Human
cugucaguaggcucccaucauu

SEQ ID NO: 414245 - RNA, 22 nt, Human
ugggcuggcccaccacaccucg

SEQ ID NO: 414246 - RNA, 22 nt, Human
gccuggcaggggccugggagug

SEQ ID NO: 414247 - RNA, 22 nt, Human
ugcagggcuccuggcuccaauc

SEQ ID NO: 414248 - RNA, 22 nt, Human
uaguaaaaguuuaguugaaagu

SEQ ID NO: 414249 - RNA, 18 nt, Human
ucuggcucaggacugaac

SEQ ID NO: 414250 - RNA, 22 nt, Human
gucccuggggaaucagcuggag

SEQ ID NO: 414251 - RNA, 18 nt, Human
gggaagaggaucuggccc

SEQ ID NO: 414252 - RNA, 22 nt, Human
ucauugcaagcucauuuaucug

SEQ ID NO: 414253 - RNA, 22 nt, Human
ggagacagugguagggccuaag

SEQ ID NO: 414254 - RNA, 22 nt, Human
guggcugcagagggcacagcau

SEQ ID NO: 414255 - RNA, 22 nt, Human
ggagcuggucagccuugagcau

SEQ ID NO: 414256 - RNA, 22 nt, Human
cgccuggaaccucuaggaccag

SEQ ID NO: 414257 - RNA, 22 nt, Human
uggcagugggaagcuggaaguc

SEQ ID NO: 414258 - RNA, 22 nt, Human
aaaugguguuucuaaugcuaga

SEQ ID NO: 414259 - RNA, 22 nt, Human
gacaagacaugugaugacauca

SEQ ID NO: 414260 - RNA, 22 nt, Human
uuucucaaguucagauauuuga

SEQ ID NO: 414261 - RNA, 22 nt, Human
ucauccaguaccauggaaggca

SEQ ID NO: 414262 - RNA, 21 nt, Human
auauuucucauaagguuaugg

SEQ ID NO: 414263 - RNA, 22 nt, Human
acucagaggcagcugcucaccc

SEQ ID NO: 414264 - RNA, 20 nt, Human
gcugcucuccacggucugca

SEQ ID NO: 414265 - RNA, 23 nt, Human
gcucugagggcuuaucccuccca

SEQ ID NO: 414266 - RNA, 22 nt, Human
ccuggccucuccgaguaaccug

SEQ ID NO: 414267 - RNA, 22 nt, Human
gucucaguuuuccaaacuguca

SEQ ID NO: 414268 - RNA, 22 nt, Human
gaaucauuuagcucugcaugga

SEQ ID NO: 414269 - RNA, 22 nt, Human
ggcagcagggcugucucccuac

SEQ ID NO: 414270 - RNA, 18 nt, Human
gagacacaagggccugga

SEQ ID NO: 414271 - RNA, 23 nt, Human
acaguuauagcugugaauaacau

SEQ ID NO: 414272 - RNA, 22 nt, Human
agcugccagaugacagugcuau

SEQ ID NO: 414273 - RNA, 22 nt, Human
guggcauucucggcaccaucug

SEQ ID NO: 414274 - RNA, 22 nt, Human
cagggccaggcugauggccugg

SEQ ID NO: 414275 - RNA, 22 nt, Human
uggccugaggcucggcaugggu

SEQ ID NO: 414276 - RNA, 22 nt, Human
cauuuucucaaugaacccucuu

SEQ ID NO: 414277 - RNA, 22 nt, Human
uggcccugacagguccugggca

SEQ ID NO: 414278 - RNA, 22 nt, Human
gggagcugagggaccucugugg

SEQ ID NO: 414279 - RNA, 22 nt, Human
uucuacaugguugcucagaggg

SEQ ID NO: 414280 - RNA, 22 nt, Human
agcugccacagagccuggccag

SEQ ID NO: 414281 - RNA, 22 nt, Human
aggaaaaauaaggcagcagggc

SEQ ID NO: 414282 - RNA, 22 nt, Human
cugccagcagaggccagcgcug

SEQ ID NO: 414283 - RNA, 22 nt, Human
caagagagaugcagcucacuca

SEQ ID NO: 414284 - RNA, 22 nt, Human
ggccuugguaaagggaugcaug

SEQ ID NO: 414285 - RNA, 22 nt, Human
uucacauuucauaccacagcuu

SEQ ID NO: 414286 - RNA, 22 nt, Human
uguccugggaaugggaugcagu

SEQ ID NO: 414287 - RNA, 22 nt, Human
caugcacaaagguaagaugcgu

SEQ ID NO: 414288 - RNA, 22 nt, Human
cgacccuacagacagugcugag

SEQ ID NO: 414289 - RNA, 22 nt, Human
gcccaggauucuuucuuccuua

SEQ ID NO: 414290 - RNA, 22 nt, Human
agcuuuaccugccuuggggcac

SEQ ID NO: 414291 - RNA, 22 nt, Human
uugcaccaaaugaguuaaaauu

SEQ ID NO: 414292 - RNA, 22 nt, Human
aaagaacaauguggaaucuccu

SEQ ID NO: 414293 - RNA, 22 nt, Human
ugggggagauugugcaucucua

SEQ ID NO: 414294 - RNA, 22 nt, Human
uauuucaucuggaacaagguaa

SEQ ID NO: 414295 - RNA, 22 nt, Human
ugcucugugguccaagauggcu

SEQ ID NO: 414296 - RNA, 22 nt, Human
gcagaaggucuggcacuucagg

SEQ ID NO: 414297 - RNA, 22 nt, Human
aaggaccuauauugucagagga

SEQ ID NO: 414298 - RNA, 22 nt, Human
aagaugcagcuuccacuuuugc

SEQ ID NO: 414299 - RNA, 22 nt, Human
auaaacaguaaaugugagcagu

SEQ ID NO: 414300 - RNA, 22 nt, Human
uacaaagucaccagcuucuugc

SEQ ID NO: 414301 - RNA, 22 nt, Human
gugucccagcagcacauuggcu

SEQ ID NO: 414302 - RNA, 22 nt, Human
gaggcuggaggucaaagaugaa

SEQ ID NO: 414303 - RNA, 22 nt, Human
gcuaucuucauggaaauacagg

SEQ ID NO: 414304 - RNA, 22 nt, Human
aggcaauccccugaggauacuu

SEQ ID NO: 414305 - RNA, 22 nt, Human
aucuaggauuugaaugcacagu

SEQ ID NO: 414306 - RNA, 22 nt, Human
acuuugcagggcuugauaucca

SEQ ID NO: 414307 - RNA, 22 nt, Human
aaauggauggaauugacauuua

SEQ ID NO: 414308 - RNA, 22 nt, Human
cugagccauaagggaggcuggg

SEQ ID NO: 414309 - RNA, 22 nt, Human
agcaggggcaggguuuugugcu

SEQ ID NO: 414310 - RNA, 22 nt, Human
gagguacagaguguuccaaugu

SEQ ID NO: 414311 - RNA, 22 nt, Human
ucaggcugcuguacugugaaug

SEQ ID NO: 414312 - RNA, 22 nt, Human
ggcucuggugaggguaggagau

SEQ ID NO: 414313 - RNA, 22 nt, Human
uguacauacauagauauacaca

SEQ ID NO: 414314 - RNA, 19 nt, Human
ugagugggccccugcagac

SEQ ID NO: 414315 - RNA, 22 nt, Human
caguccuggggaccaggcugag

SEQ ID NO: 414316 - RNA, 22 nt, Human
gcucugcuggagggaaagagaa

SEQ ID NO: 414317 - RNA, 22 nt, Human
gugugcaggccacaggccaggg

SEQ ID NO: 414318 - RNA, 22 nt, Human
uucacagacauugcagacugaa

SEQ ID NO: 414319 - RNA, 22 nt, Human
cuggccagaguuggagggugug

SEQ ID NO: 414320 - RNA, 22 nt, Human
uggcacugggaugcuacuguua

SEQ ID NO: 414321 - RNA, 22 nt, Human
aaaaucugcuuccuuuuacaga

SEQ ID NO: 414322 - RNA, 19 nt, Human
cucugccucccuccugggu

SEQ ID NO: 414323 - RNA, 22 nt, Human
ccaggaguuugaggcugcagug

SEQ ID NO: 414324 - RNA, 22 nt, Human
uccaggcuggacaugaggcggg

SEQ ID NO: 414325 - RNA, 22 nt, Human
uuuccauauucugcgucugcca

SEQ ID NO: 414326 - RNA, 22 nt, Human
aauguguagauguugcauuccu

SEQ ID NO: 414327 - RNA, 18 nt, Human
ccugcagcccaggaggcc

SEQ ID NO: 414328 - RNA, 22 nt, Human
uccugggagagugggacuguau

SEQ ID NO: 414329 - RNA, 23 nt, Human
uuacaguaggaguuggaaaacca

SEQ ID NO: 414330 - RNA, 22 nt, Human
gaggcagcugaaggagugacag

SEQ ID NO: 414331 - RNA, 22 nt, Human
uuugcauugccucugacuuaug

SEQ ID NO: 414332 - RNA, 22 nt, Human
cugccuggaccggcagcccucc

SEQ ID NO: 414333 - RNA, 22 nt, Human
uauuuugucuucugcucaucac

SEQ ID NO: 414334 - RNA, 22 nt, Human
uggcucagucuggguugacuga

SEQ ID NO: 414335 - RNA, 22 nt, Human
aggcaguguauugcuagcggcu

SEQ ID NO: 414336 - RNA, 22 nt, Human
acacaccaugauuuauuuaccc

SEQ ID NO: 414337 - RNA, 22 nt, Human
acauuucucagguaagucauuu

SEQ ID NO: 414338 - RNA, 23 nt, Human
uuugaaaguaucaacucgccuga

SEQ ID NO: 414339 - RNA, 18 nt, Human
cauuaugugguuauagaa

SEQ ID NO: 414340 - RNA, 22 nt, Human
gucuuuauuugagauugucauu

SEQ ID NO: 414341 - RNA, 22 nt, Human
cuuagaaaugcagauucucagg

SEQ ID NO: 414342 - RNA, 23 nt, Human
acuuuauugaccccaggucaguu

SEQ ID NO: 414343 - RNA, 22 nt, Human
gugcauuugugcaugcacaugu

SEQ ID NO: 414344 - RNA, 22 nt, Human
gagccaccuucaacucaggaau

SEQ ID NO: 414345 - RNA, 22 nt, Human
ucuggcuccacuuucuucauuu

SEQ ID NO: 414346 - RNA, 22 nt, Human
uuugcauugcauuaaguauucu

SEQ ID NO: 414347 - RNA, 22 nt, Human
gagauuggauuuaauggccaaa

SEQ ID NO: 414348 - RNA, 22 nt, Human
caggccuggcccccggcacacc

SEQ ID NO: 414349 - RNA, 22 nt, Human
gacagguggggaaacuaaggua

SEQ ID NO: 414350 - RNA, 17 nt, Human
acagagcacaucaagau

SEQ ID NO: 414351 - RNA, 22 nt, Human
gaggccuggcucugcccuccug

SEQ ID NO: 414352 - RNA, 22 nt, Human
acagguccuuauaagagcacuc

SEQ ID NO: 414353 - RNA, 22 nt, Human
agccuggaggaggaguugagca

SEQ ID NO: 414354 - RNA, 22 nt, Human
auacaaagacaaaucucaaucu

SEQ ID NO: 414355 - RNA, 22 nt, Human
gccuggaggguugagguuuugu

SEQ ID NO: 414356 - RNA, 22 nt, Human
cccuguccuggaugggagcacu

SEQ ID NO: 414357 - RNA, 22 nt, Human
uggcagagacuccuccugggag

SEQ ID NO: 414358 - RNA, 17 nt, Human
cugaggcccagggccca

SEQ ID NO: 414359 - RNA, 22 nt, Human
gcaggcugaugacuggaguugg

SEQ ID NO: 414360 - RNA, 22 nt, Human
gagcagaacaggccggguggga

SEQ ID NO: 414361 - RNA, 22 nt, Human
cagggcuccccgcaccgcagcc

SEQ ID NO: 414362 - RNA, 22 nt, Human
gacagaguuguugauguaugcu

SEQ ID NO: 414363 - RNA, 22 nt, Human
cagcugagaaauggggaaaggg

SEQ ID NO: 414364 - RNA, 22 nt, Human
cuuuauguccuugaagaguugu

SEQ ID NO: 414365 - RNA, 22 nt, Human
cuagucacucagcacugacaaa

SEQ ID NO: 414366 - RNA, 22 nt, Human
acauagcuuaaaugagaagaua

SEQ ID NO: 414367 - RNA, 22 nt, Human
uucaaauuaccacauuugcuua

SEQ ID NO: 414368 - RNA, 22 nt, Human
acagagccacuuuggugccuac

SEQ ID NO: 414369 - RNA, 22 nt, Human
gggucaggcucagcagggcagc

SEQ ID NO: 414370 - RNA, 22 nt, Human
aguccaaggagagacagcauuu

SEQ ID NO: 414371 - RNA, 22 nt, Human
uacauucuggaaaggcacagac

SEQ ID NO: 414372 - RNA, 22 nt, Human
ucuuucaaugagcauucuuucc

SEQ ID NO: 414373 - RNA, 22 nt, Human
ccuggcugcauuuugcuggaug

SEQ ID NO: 414374 - RNA, 22 nt, Human
aggcugaggcuggcagcuccag

SEQ ID NO: 414375 - RNA, 22 nt, Human
accagacacugugaagacaggc

SEQ ID NO: 414376 - RNA, 22 nt, Human
aaggagucucagcugggccuga

SEQ ID NO: 414377 - RNA, 22 nt, Human
cucagagaaaaggagcaagggu

SEQ ID NO: 414378 - RNA, 21 nt, Human
augacagaugcugcagaucgu

SEQ ID NO: 414379 - RNA, 22 nt, Human
gcugcugcgcuugucuacuguu

SEQ ID NO: 414380 - RNA, 22 nt, Human
auucaguuucauggcacagcua

SEQ ID NO: 414381 - RNA, 22 nt, Human
agagccugcuaccucauuccag

SEQ ID NO: 414382 - RNA, 19 nt, Human
gccacuccugaugcugccc

SEQ ID NO: 414383 - RNA, 22 nt, Human
cucagagaaccuaagcggagga

SEQ ID NO: 414384 - RNA, 19 nt, Human
aaggcagaaguuggauaug

SEQ ID NO: 414385 - RNA, 22 nt, Human
ugccaggcucagccccuaucuu

SEQ ID NO: 414386 - RNA, 22 nt, Human
caggccucuccuuagucuggca

SEQ ID NO: 414387 - RNA, 22 nt, Human
ggaggccacgguuuagcaccga

SEQ ID NO: 414388 - RNA, 22 nt, Human
ugcagcauuauucacaguagcc

SEQ ID NO: 414389 - RNA, 20 nt, Human
cugcugugugugccucagcc

SEQ ID NO: 414390 - RNA, 22 nt, Human
cagucccaggguugguucagcu

SEQ ID NO: 414391 - RNA, 22 nt, Human
aguuuuucugggaggcacugcu

SEQ ID NO: 414392 - RNA, 22 nt, Human
gaggccugcuuuggcacucugg

SEQ ID NO: 414393 - RNA, 22 nt, Human
gaggcugguucugaaguacugu

SEQ ID NO: 414394 - RNA, 21 nt, Human
cugugcuucuuccuaagccag

SEQ ID NO: 414395 - RNA, 22 nt, Human
agauaugacuagaagcucauuu

SEQ ID NO: 414396 - RNA, 22 nt, Human
agcugccugggcuuguacaccu

SEQ ID NO: 414397 - RNA, 22 nt, Human
uaaacaugugagugugcauaua

SEQ ID NO: 414398 - RNA, 22 nt, Human
ucucagaguuugaaucuggagu

SEQ ID NO: 414399 - RNA, 22 nt, Human
ucccaagugucuuggaccaggg

SEQ ID NO: 414400 - RNA, 22 nt, Human
guucaaagcuccugguacagua

SEQ ID NO: 414401 - RNA, 22 nt, Human
cccauuuaaacacaagcuuuca

SEQ ID NO: 414402 - RNA, 22 nt, Human
gagcugagccuggguggaccgc

SEQ ID NO: 414403 - RNA, 22 nt, Human
cagucccagaagagccugggag

SEQ ID NO: 414404 - RNA, 22 nt, Human
ggcuucaccaggugcaugcaug

SEQ ID NO: 414405 - RNA, 22 nt, Human
uccuucaggccucauucucaua

SEQ ID NO: 414406 - RNA, 22 nt, Human
agcccagaggcugggcgugcau

SEQ ID NO: 414407 - RNA, 22 nt, Human
aagcugccagcugagcugaggc

SEQ ID NO: 414408 - RNA, 22 nt, Human
uaugcacacauguaugcaugug

SEQ ID NO: 414409 - RNA, 17 nt, Human
ucuuuccugccaugcuc

SEQ ID NO: 414410 - RNA, 22 nt, Human
ucaggcugccuaucagacugug

SEQ ID NO: 414411 - RNA, 22 nt, Human
uccauuuacuauucucauaucg

SEQ ID NO: 414412 - RNA, 22 nt, Human
ggccauggaccccgagcugacc

SEQ ID NO: 414413 - RNA, 22 nt, Human
accaggggugucaacagcauuu

SEQ ID NO: 414414 - RNA, 22 nt, Human
acacugaauguuuaagaacuug

SEQ ID NO: 414415 - RNA, 22 nt, Human
cagguccugcagggagaguaaa

SEQ ID NO: 414416 - RNA, 22 nt, Human
gaccagagaaaggcacuggaag

SEQ ID NO: 414417 - RNA, 22 nt, Human
gcucugcucuaacauuccugac

SEQ ID NO: 414418 - RNA, 22 nt, Human
agauuucccacuccauguauug

SEQ ID NO: 414419 - RNA, 22 nt, Human
cggcugaggaucuccaggccug

SEQ ID NO: 414420 - RNA, 22 nt, Human
aguuccagcugugaccagaaaa

SEQ ID NO: 414421 - RNA, 22 nt, Human
ccagcugggauuaagggaaaau

SEQ ID NO: 414422 - RNA, 22 nt, Human
gaacaguaaauuuaugcagcac

SEQ ID NO: 414423 - RNA, 23 nt, Human
uucuuucaagaaguucacagugc

SEQ ID NO: 414424 - RNA, 22 nt, Human
uccagucucuacucugagauaa

SEQ ID NO: 414425 - RNA, 22 nt, Human
uggaaagacauucagccgcugg

SEQ ID NO: 414426 - RNA, 21 nt, Human
agaauucuuaaguauucuaau

SEQ ID NO: 414427 - RNA, 22 nt, Human
ugaggcaguauucuccauucca

SEQ ID NO: 414428 - RNA, 22 nt, Human
ugugugacccccagugaagccu

SEQ ID NO: 414429 - RNA, 22 nt, Human
cuccuucccuucaaguguuccu

SEQ ID NO: 414430 - RNA, 22 nt, Human
aguguuccugcucucaggaagc

SEQ ID NO: 414431 - RNA, 22 nt, Human
gaggagagagggacugucugca

SEQ ID NO: 414432 - RNA, 22 nt, Human
aagaacagguucuagaaccauu

SEQ ID NO: 414433 - RNA, 22 nt, Human
uucuaguugagggagacaaaua

SEQ ID NO: 414434 - RNA, 22 nt, Human
aguacagaccugucucuuccug

SEQ ID NO: 414435 - RNA, 22 nt, Human
ccaggccauucccagaguugcu

SEQ ID NO: 414436 - RNA, 21 nt, Human
acagaguaguugaaacagaga

SEQ ID NO: 414437 - RNA, 22 nt, Human
acugcaggagacacagcugcug

SEQ ID NO: 414438 - RNA, 22 nt, Human
uuuauugacccaaagcgagagu

SEQ ID NO: 414439 - RNA, 22 nt, Human
cagcuggcauaccugggcccgg

SEQ ID NO: 414440 - RNA, 22 nt, Human
gagccugaauuugaccugcuua

SEQ ID NO: 414441 - RNA, 22 nt, Human
ugagaaccaugaaaagcuguca

SEQ ID NO: 414442 - RNA, 19 nt, Human
ggugugaagugaggaguua

SEQ ID NO: 414443 - RNA, 22 nt, Human
ucugaaaugcaggcaauuugcu

SEQ ID NO: 414444 - RNA, 22 nt, Human
cagagccugccaccuuucuccc

SEQ ID NO: 414445 - RNA, 22 nt, Human
cucuggacagcaggugcugugg

SEQ ID NO: 414446 - RNA, 22 nt, Human
auguuacaauucaaaaugcugc

SEQ ID NO: 414447 - RNA, 22 nt, Human
uggcucuggugcgggcuccugc

SEQ ID NO: 414448 - RNA, 22 nt, Human
agcucugacauugauucucagc

SEQ ID NO: 414449 - RNA, 22 nt, Human
ucugugaacaucacauugacag

SEQ ID NO: 414450 - RNA, 22 nt, Human
gccugcagccccucugcaguag

SEQ ID NO: 414451 - RNA, 22 nt, Human
cuggugccauucuguggccuag

SEQ ID NO: 414452 - RNA, 22 nt, Human
cugacccauauaagaguggagg

SEQ ID NO: 414453 - RNA, 22 nt, Human
agacaggcuuugcuguauauca

SEQ ID NO: 414454 - RNA, 20 nt, Human
aggcucagcugagcucuugg

SEQ ID NO: 414455 - RNA, 22 nt, Human
ugagcccagucugucugacaug

SEQ ID NO: 414456 - RNA, 22 nt, Human
cugcucuguucccccaucaucu

SEQ ID NO: 414457 - RNA, 22 nt, Human
cagaggcacagcuucuuuuaau

SEQ ID NO: 414458 - RNA, 22 nt, Human
ucaaggugcugugcugugcuag

SEQ ID NO: 414459 - RNA, 22 nt, Human
aguggcagcugucaugcccuag

SEQ ID NO: 414460 - RNA, 22 nt, Human
accucugccacuuucuaacucu

SEQ ID NO: 414461 - RNA, 22 nt, Human
ugcauuguugaugaguugaaua

SEQ ID NO: 414462 - RNA, 22 nt, Human
gcucagccgaacuucagagcag

SEQ ID NO: 414463 - RNA, 22 nt, Human
uuuguuuagaaagagauuggug

SEQ ID NO: 414464 - RNA, 22 nt, Human
gaggguccccaugcagagcuca

SEQ ID NO: 414465 - RNA, 20 nt, Human
ugcucaggauggagaggugu

SEQ ID NO: 414466 - RNA, 22 nt, Human
agggaagugaaugacagauauc

SEQ ID NO: 414467 - RNA, 22 nt, Human
gaggggcuggguagggcaaccc

SEQ ID NO: 414468 - RNA, 22 nt, Human
agaaagcuuaugaaugggcaag

SEQ ID NO: 414469 - RNA, 19 nt, Human
cccaaggcccugggcaggc

SEQ ID NO: 414470 - RNA, 22 nt, Human
cuggaugcuuccucucugcuag

SEQ ID NO: 414471 - RNA, 22 nt, Human
agcagagcccuuccauggccuu

SEQ ID NO: 414472 - RNA, 22 nt, Human
ugcagggccuugggucuuucuu

SEQ ID NO: 414473 - RNA, 22 nt, Human
gaaaccucuuagccucucuuug

SEQ ID NO: 414474 - RNA, 22 nt, Human
agaaaucacaggaggcagaagg

SEQ ID NO: 414475 - RNA, 22 nt, Human
ucccaggccauaaaacucagag

SEQ ID NO: 414476 - RNA, 22 nt, Human
uguuuauugagugccuacuaua

SEQ ID NO: 414477 - RNA, 22 nt, Human
ggcagugacuguucagacgucc

SEQ ID NO: 414478 - RNA, 22 nt, Human
ccuuccuggcuguccgccugau

SEQ ID NO: 414479 - RNA, 22 nt, Human
ccagcugagaaguguaaaguga

SEQ ID NO: 414480 - RNA, 22 nt, Human
ccugggaagagcugacaggagg

SEQ ID NO: 414481 - RNA, 20 nt, Human
agcccaggccugugugaguc

SEQ ID NO: 414482 - RNA, 22 nt, Human
caagagcucaccggagagcauu

SEQ ID NO: 414483 - RNA, 22 nt, Human
ggcagcagcaagguuggagcug

SEQ ID NO: 414484 - RNA, 22 nt, Human
uggggcuggggaucuugagccu

SEQ ID NO: 414485 - RNA, 22 nt, Human
guuuuccauggaggucugaccu

SEQ ID NO: 414486 - RNA, 22 nt, Human
ggcagcagggucuagauugaug

SEQ ID NO: 414487 - RNA, 22 nt, Human
gcuccagguauuugcccuuuua

SEQ ID NO: 414488 - RNA, 22 nt, Human
ggccccuggcaccaggcugauu

SEQ ID NO: 414489 - RNA, 22 nt, Human
agggaggagaauggacuccuuc

SEQ ID NO: 414490 - RNA, 22 nt, Human
auacaagacucagcacagacgg

SEQ ID NO: 414491 - RNA, 22 nt, Human
uuguucaugguuguaaguuuga

SEQ ID NO: 414492 - RNA, 21 nt, Human
agguggggcugcaccucugcu

SEQ ID NO: 414493 - RNA, 22 nt, Human
uuaacagauguuuauggagcau

SEQ ID NO: 414494 - RNA, 22 nt, Human
uucucuggaacugaaacaagau

SEQ ID NO: 414495 - RNA, 23 nt, Human
aggcuuccuaucuuagagcuggg

SEQ ID NO: 414496 - RNA, 21 nt, Human
uuacuuuugcaccaaccuaau

SEQ ID NO: 414497 - RNA, 16 nt, Human
aggcagagauuuaccc

SEQ ID NO: 414498 - RNA, 22 nt, Human
gagguggguguaucacagguca

SEQ ID NO: 414499 - RNA, 22 nt, Human
ucagaaauagucuuuaaaauga

SEQ ID NO: 414500 - RNA, 22 nt, Human
uggcucagcauucacuggucuu

SEQ ID NO: 414501 - RNA, 17 nt, Human
ucagcaaagacaaagga

SEQ ID NO: 414502 - RNA, 22 nt, Human
uggcagguuuccuccucauagu

SEQ ID NO: 414503 - RNA, 22 nt, Human
uccucuggggucagggcacuac

SEQ ID NO: 414504 - RNA, 22 nt, Human
uuuaaaaucagaugggaguugg

SEQ ID NO: 414505 - RNA, 22 nt, Human
gggcuacauugugagagaaguu

SEQ ID NO: 414506 - RNA, 22 nt, Human
ucucagagcuucaguuauuuuc

SEQ ID NO: 414507 - RNA, 22 nt, Human
guccucugaaguugugcaaugc

SEQ ID NO: 414508 - RNA, 22 nt, Human
agggcuggcaucucuaaugcug

SEQ ID NO: 414509 - RNA, 22 nt, Human
gaggugggaugugugugcuacu

SEQ ID NO: 414510 - RNA, 22 nt, Human
gcaggaguuaggcgucguggau

SEQ ID NO: 414511 - RNA, 22 nt, Human
aaauauaauuucugccucaaua

SEQ ID NO: 414512 - RNA, 22 nt, Human
aaagacugggacugcagcaggc

SEQ ID NO: 414513 - RNA, 22 nt, Human
acagcaggauuuggcgauguug

SEQ ID NO: 414514 - RNA, 22 nt, Human
caaggccugccucuggcagaaa

SEQ ID NO: 414515 - RNA, 22 nt, Human
ucuuuccuaggugauaugcaau

SEQ ID NO: 414516 - RNA, 22 nt, Human
cagccagcuggcacugugagua

SEQ ID NO: 414517 - RNA, 22 nt, Human
aggggccuggacauggacgcgc

SEQ ID NO: 414518 - RNA, 21 nt, Human
ugcaugcuauguuuuuauuuc

SEQ ID NO: 414519 - RNA, 22 nt, Human
ucacacacauggauaguauuuu

SEQ ID NO: 414520 - RNA, 22 nt, Human
gagcuuugcuggaagccugggg

SEQ ID NO: 414521 - RNA, 22 nt, Human
cccuccagagcuugaccugcug

SEQ ID NO: 414522 - RNA, 18 nt, Human
uccucucuuuccccaggg

SEQ ID NO: 414523 - RNA, 23 nt, Human
gccauggcugccccacaggccuc

SEQ ID NO: 414524 - RNA, 22 nt, Human
gggcugagauuggugcccuguc

SEQ ID NO: 414525 - RNA, 22 nt, Human
ugagugaggaagcgguggagga

SEQ ID NO: 414526 - RNA, 22 nt, Human
aucagcaaguccuguuaauucu

SEQ ID NO: 414527 - RNA, 22 nt, Human
ucucagagaccugaacucccug

SEQ ID NO: 414528 - RNA, 19 nt, Human
agcagagcccugaagaucc

SEQ ID NO: 414529 - RNA, 22 nt, Human
guguacauauugagucugcuga

SEQ ID NO: 414530 - RNA, 22 nt, Human
cauggaaggcaaaagacacaga

SEQ ID NO: 414531 - RNA, 22 nt, Human
uccaauaacaucuaaaaacuua

SEQ ID NO: 414532 - RNA, 22 nt, Human
ggcucccaggagggccuggagg

SEQ ID NO: 414533 - RNA, 22 nt, Human
guggcuucacauggcauuuggc

SEQ ID NO: 414534 - RNA, 22 nt, Human
acacacuguugcucauccaggc

SEQ ID NO: 414535 - RNA, 22 nt, Human
auuuucaucgcuagguuggccu

SEQ ID NO: 414536 - RNA, 20 nt, Human
acugagcugcauggagagga

SEQ ID NO: 414537 - RNA, 22 nt, Human
cugagggccuuggcuccugccc

SEQ ID NO: 414538 - RNA, 22 nt, Human
guggcaggucccauuggagcag

SEQ ID NO: 414539 - RNA, 22 nt, Human
uugcauugcuuggucuucaaga

SEQ ID NO: 414540 - RNA, 22 nt, Human
cccaggcagugugugcaugcgu

SEQ ID NO: 414541 - RNA, 22 nt, Human
uaagcaaauagcuagaucagag

SEQ ID NO: 414542 - RNA, 18 nt, Human
acucaggaaaugaugaca

SEQ ID NO: 414543 - RNA, 22 nt, Human
uuuuuaguagagguggguuuca

SEQ ID NO: 414544 - RNA, 22 nt, Human
auaaggcagaaauagggaaagu

SEQ ID NO: 414545 - RNA, 22 nt, Human
uuacauuuuaguuaaccuguga

SEQ ID NO: 414546 - RNA, 22 nt, Human
ucacagugagccaugucagaga

SEQ ID NO: 414547 - RNA, 22 nt, Human
gccugagagacccauggggcaa

SEQ ID NO: 414548 - RNA, 22 nt, Human
uuugaaaguccuaggagagucc

SEQ ID NO: 414549 - RNA, 22 nt, Human
cagaaguaagauuacugugaga

SEQ ID NO: 414550 - RNA, 22 nt, Human
ggcucagguuuccuucccagcu

SEQ ID NO: 414551 - RNA, 22 nt, Human
ucucauucauacccuacaugcu

SEQ ID NO: 414552 - RNA, 22 nt, Human
gggaggaaaugugcagcgaauu

SEQ ID NO: 414553 - RNA, 22 nt, Human
ucugagaguccaucuccaagcc

SEQ ID NO: 414554 - RNA, 22 nt, Human
ugucaacacaccuaucucaauu

SEQ ID NO: 414555 - RNA, 22 nt, Human
cugucucuguugccuguaggug

SEQ ID NO: 414556 - RNA, 22 nt, Human
uggaggugagugugguacagca

SEQ ID NO: 414557 - RNA, 22 nt, Human
gcaggcuggaggcuguucuggg

SEQ ID NO: 414558 - RNA, 22 nt, Human
agauuuccugcacugccuuuga

SEQ ID NO: 414559 - RNA, 22 nt, Human
agucaauuaucucuaggucauc

SEQ ID NO: 414560 - RNA, 22 nt, Human
uuuauuguuguuagucauaagu

SEQ ID NO: 414561 - RNA, 21 nt, Human
uggcugaguggaugcaugaau

SEQ ID NO: 414562 - RNA, 22 nt, Human
ucagggcacaggccuguggguu

SEQ ID NO: 414563 - RNA, 22 nt, Human
cagcugagcucccaggccauca

SEQ ID NO: 414564 - RNA, 22 nt, Human
gaagcagcgaaguggaagggac

SEQ ID NO: 414565 - RNA, 22 nt, Human
cccagcucaucaggagccgccc

SEQ ID NO: 414566 - RNA, 22 nt, Human
aaggugucggguuagcucagcc

SEQ ID NO: 414567 - RNA, 22 nt, Human
uuaugcaaaggggccucuuccu

SEQ ID NO: 414568 - RNA, 22 nt, Human
cagcauggagacaaagugggca

SEQ ID NO: 414569 - RNA, 22 nt, Human
acugcccuguaacugccaggua

SEQ ID NO: 414570 - RNA, 22 nt, Human
ugguuugcccacucgagugauu

SEQ ID NO: 414571 - RNA, 22 nt, Human
aggcccagcccguccucgugcu

SEQ ID NO: 414572 - RNA, 22 nt, Human
acuggacagaggaaauauggag

SEQ ID NO: 414573 - RNA, 22 nt, Human
cagcauggggcuuggagucagc

SEQ ID NO: 414574 - RNA, 22 nt, Human
ucaguggauuggaugagaucug

SEQ ID NO: 414575 - RNA, 22 nt, Human
ccagucacagguguguuuauau

SEQ ID NO: 414576 - RNA, 22 nt, Human
ucuggaguccagauccauuugg

SEQ ID NO: 414577 - RNA, 22 nt, Human
ucaguggauuguagaaggcuua

SEQ ID NO: 414578 - RNA, 22 nt, Human
caggagaagucucuagggggug

SEQ ID NO: 414579 - RNA, 22 nt, Human
ccacagggacuguuaaaacccu

SEQ ID NO: 414580 - RNA, 22 nt, Human
agaaagaacguugguuaucuua

SEQ ID NO: 414581 - RNA, 22 nt, Human
aggucacccguuugacuaucca

SEQ ID NO: 414582 - RNA, 22 nt, Human
cauuuguacagaacagcuuuau

SEQ ID NO: 414583 - RNA, 22 nt, Human
uuccucuuucucugugcuaugu

SEQ ID NO: 414584 - RNA, 22 nt, Human
auucaguuaaaaacuguacuuc

SEQ ID NO: 414585 - RNA, 22 nt, Human
ugaggcuccagccaggccagca

SEQ ID NO: 414586 - RNA, 22 nt, Human
gccuggagccucagcaaggagg

SEQ ID NO: 414587 - RNA, 22 nt, Human
caaggaaaaagcgagcucgggg

SEQ ID NO: 414588 - RNA, 22 nt, Human
aaaucuaggcucauccuggucc

SEQ ID NO: 414589 - RNA, 22 nt, Human
ucccaggaaaacacucgaggac

SEQ ID NO: 414590 - RNA, 22 nt, Human
gcacagggcaacaggucuguua

SEQ ID NO: 414591 - RNA, 21 nt, Human
ccuucuccacagggucuccgg

SEQ ID NO: 414592 - RNA, 22 nt, Human
cugagaggcacaaggcauuucg

SEQ ID NO: 414593 - RNA, 22 nt, Human
ugacagcugagccccaggcaag

SEQ ID NO: 414594 - RNA, 22 nt, Human
uccuuugacuucuugcagucca

SEQ ID NO: 414595 - RNA, 22 nt, Human
auucauuccaggucagucagac

SEQ ID NO: 414596 - RNA, 22 nt, Human
agaaauacuaggaauauucaua

SEQ ID NO: 414597 - RNA, 22 nt, Human
uuagcaucugcuguaagcuuau

SEQ ID NO: 414598 - RNA, 22 nt, Human
uccaggcauguugggaagauga

SEQ ID NO: 414599 - RNA, 22 nt, Human
aaugaucuggcucaggauauca

SEQ ID NO: 414600 - RNA, 22 nt, Human
aucuggcucgcuaggcucuggg

SEQ ID NO: 414601 - RNA, 22 nt, Human
aaaggucauugaaaaggaggaa

SEQ ID NO: 414602 - RNA, 22 nt, Human
gacagggcgagacucagucuca

SEQ ID NO: 414603 - RNA, 23 nt, Human
uccagcagagccuuccaggaggg

SEQ ID NO: 414604 - RNA, 22 nt, Human
aggaaaaaagucugugauuaua

SEQ ID NO: 414605 - RNA, 20 nt, Human
gaagcagcuucauguagaca

SEQ ID NO: 414606 - RNA, 22 nt, Human
gcaggcagagaaggaacauuua

SEQ ID NO: 414607 - RNA, 22 nt, Human
acauguggucaaucuguguagg

SEQ ID NO: 414608 - RNA, 22 nt, Human
aagagcuggagcugcuacagga

SEQ ID NO: 414609 - RNA, 22 nt, Human
accagagcuuacaugcuagaaa

SEQ ID NO: 414610 - RNA, 22 nt, Human
cuguccuguggaccugaggacg

SEQ ID NO: 414611 - RNA, 22 nt, Human
ccuccuuuccuguuuuccugag

SEQ ID NO: 414612 - RNA, 22 nt, Human
ucuacuuuucccuauacaguuu

SEQ ID NO: 414613 - RNA, 22 nt, Human
gcugcaggagcuggagcugugg

SEQ ID NO: 414614 - RNA, 22 nt, Human
gaagcagcagcuggggacaguu

SEQ ID NO: 414615 - RNA, 22 nt, Human
agagccacggcaggccuaggaa

SEQ ID NO: 414616 - RNA, 23 nt, Human
ugcucugugaauaguuggugacu

SEQ ID NO: 414617 - RNA, 22 nt, Human
ucauuuaauaauuuuugaguag

SEQ ID NO: 414618 - RNA, 22 nt, Human
ugcagaguaaaagcagaugcua

SEQ ID NO: 414619 - RNA, 22 nt, Human
gcagugccuugcuucucugucu

SEQ ID NO: 414620 - RNA, 22 nt, Human
uuguuucugaguuuucauguau

SEQ ID NO: 414621 - RNA, 22 nt, Human
auucauuugcuauuguguaugg

SEQ ID NO: 414622 - RNA, 22 nt, Human
cauuuguaucauauguaucuua

SEQ ID NO: 414623 - RNA, 22 nt, Human
uuacaucuaaacugugaacaau

SEQ ID NO: 414624 - RNA, 22 nt, Human
ucucuggccgagagucccuggg

SEQ ID NO: 414625 - RNA, 22 nt, Human
guccuggcccacuggcaggcug

SEQ ID NO: 414626 - RNA, 22 nt, Human
ccucccaccguaucucaguggc

SEQ ID NO: 414627 - RNA, 22 nt, Human
aagauuuccuggauguaauucc

SEQ ID NO: 414628 - RNA, 22 nt, Human
cugagaggugacagcgugcugg

SEQ ID NO: 414629 - RNA, 22 nt, Human
cauguacacucauguaacuaua

SEQ ID NO: 414630 - RNA, 23 nt, Human
uccaggcaugagcucuggaugga

SEQ ID NO: 414631 - RNA, 22 nt, Human
auuuauuauugugguuacuucu

SEQ ID NO: 414632 - RNA, 22 nt, Human
ccuuucucuuugcugaucaugu

SEQ ID NO: 414633 - RNA, 22 nt, Human
ucuuuacaaucuaagcauaguu

SEQ ID NO: 414634 - RNA, 22 nt, Human
ggggugggcgugcagggacacc

SEQ ID NO: 414635 - RNA, 22 nt, Human
caggcagauuugcugcccucca

SEQ ID NO: 414636 - RNA, 22 nt, Human
agugcugucccgacaacugagg

SEQ ID NO: 414637 - RNA, 22 nt, Human
gaggagcaugggaaggcucugg

SEQ ID NO: 414638 - RNA, 22 nt, Human
cauaauuuuuuuaagucagaac

SEQ ID NO: 414639 - RNA, 22 nt, Human
caccugcagggggagucaagag

SEQ ID NO: 414640 - RNA, 22 nt, Human
ccagaaggcggagauugcagug

SEQ ID NO: 414641 - RNA, 22 nt, Human
ugauuuccaugaagcugaaggc

SEQ ID NO: 414642 - RNA, 22 nt, Human
agguacagggugaaaguuuaug

SEQ ID NO: 414643 - RNA, 22 nt, Human
gccuucugauugcuggacugac

SEQ ID NO: 414644 - RNA, 22 nt, Human
acaugcaugucuaugggcaggu

SEQ ID NO: 414645 - RNA, 22 nt, Human
agggaccuugauggguuuggga

SEQ ID NO: 414646 - RNA, 22 nt, Human
ucaggaugagcucauaacuaug

SEQ ID NO: 414647 - RNA, 23 nt, Human
aggagacagggaagugccuggcu

SEQ ID NO: 414648 - RNA, 22 nt, Human
gaggcaggcccugaaugaguca

SEQ ID NO: 414649 - RNA, 22 nt, Human
uagggaggcuacuucuuguagg

SEQ ID NO: 414650 - RNA, 22 nt, Human
guuugcauaaaguggaugcagg

SEQ ID NO: 414651 - RNA, 23 nt, Human
ucagagaaguuguaggcugggga

SEQ ID NO: 414652 - RNA, 22 nt, Human
gcugcagugagccaagaucgug

SEQ ID NO: 414653 - RNA, 22 nt, Human
uaugagaaaauaaauaucuguu

SEQ ID NO: 414654 - RNA, 22 nt, Human
ucucagagugacaaugagaauu

SEQ ID NO: 414655 - RNA, 22 nt, Human
ugcaguggaggccgugagacag

SEQ ID NO: 414656 - RNA, 22 nt, Human
caggugggccgggguuuguucu

SEQ ID NO: 414657 - RNA, 22 nt, Human
acuuugcaaugggcagaaccca

SEQ ID NO: 414658 - RNA, 22 nt, Human
gccacucaugggaggugugcaa

SEQ ID NO: 414659 - RNA, 22 nt, Human
uuucacaaucaaauggugaaau

SEQ ID NO: 414660 - RNA, 22 nt, Human
uucauugucucuguuugccuuc

SEQ ID NO: 414661 - RNA, 22 nt, Human
agauuaugcuggcugcuacaag

SEQ ID NO: 414662 - RNA, 19 nt, Human
gcuguacaguaaggagaca

SEQ ID NO: 414663 - RNA, 22 nt, Human
uaagacacaugcguacaagaua

SEQ ID NO: 414664 - RNA, 22 nt, Human
ucagagugaggcccagcaaucu

SEQ ID NO: 414665 - RNA, 22 nt, Human
auaauaacaccugaauaggaaa

SEQ ID NO: 414666 - RNA, 22 nt, Human
uccguauuugacuauugcaccg

SEQ ID NO: 414667 - RNA, 23 nt, Human
ucuugaaaagccuacagcaguuc

SEQ ID NO: 414668 - RNA, 20 nt, Human
gcacugaagguuccagggga

SEQ ID NO: 414669 - RNA, 22 nt, Human
acguuuucagugacugugcuuc

SEQ ID NO: 414670 - RNA, 22 nt, Human
augaaaacggaccagagcuauu

SEQ ID NO: 414671 - RNA, 17 nt, Human
gguggccugcaguggcu

SEQ ID NO: 414672 - RNA, 19 nt, Human
ucugccucuggucaggcuc

SEQ ID NO: 414673 - RNA, 22 nt, Human
ugaaggccucugguacaugcca

SEQ ID NO: 414674 - RNA, 22 nt, Human
aggccuggccccaguugcuagg

SEQ ID NO: 414675 - RNA, 22 nt, Human
cugcucuguuaauuaaacuuug

SEQ ID NO: 414676 - RNA, 22 nt, Human
cagugcagguuuagggcugggg

SEQ ID NO: 414677 - RNA, 22 nt, Human
gcaaaugcucuccuuggucagg

SEQ ID NO: 414678 - RNA, 22 nt, Human
cuguccuaugaguacucacuag

SEQ ID NO: 414679 - RNA, 20 nt, Human
ggcagagggccugggagaag

SEQ ID NO: 414680 - RNA, 22 nt, Human
ggcucaggacacagugguuuag

SEQ ID NO: 414681 - RNA, 22 nt, Human
cguggccuuugagugagcuccc

SEQ ID NO: 414682 - RNA, 22 nt, Human
cacagcuggggaagcugaggcc

SEQ ID NO: 414683 - RNA, 22 nt, Human
ugauugaacugagcuucaagau

SEQ ID NO: 414684 - RNA, 22 nt, Human
ggccagagaagucagacccuug

SEQ ID NO: 414685 - RNA, 22 nt, Human
ucagcagcagcucagcauguuu

SEQ ID NO: 414686 - RNA, 22 nt, Human
guagggacuuguuuuacuagua

SEQ ID NO: 414687 - RNA, 22 nt, Human
caggagcugggucuggaagcag

SEQ ID NO: 414688 - RNA, 22 nt, Human
uggagagcaagucgcagacaug

SEQ ID NO: 414689 - RNA, 22 nt, Human
augauugaccaucugcugggcu

SEQ ID NO: 414690 - RNA, 22 nt, Human
uccagcucuaacaugcugggcc

SEQ ID NO: 414691 - RNA, 22 nt, Human
agccaguguuaagugacugguu

SEQ ID NO: 414692 - RNA, 22 nt, Human
cugggagggguagccaauccua

SEQ ID NO: 414693 - RNA, 22 nt, Human
gcuggcauuacaggagagaacc

SEQ ID NO: 414694 - RNA, 22 nt, Human
aggcaucugaguuugcaagcuu

SEQ ID NO: 414695 - RNA, 22 nt, Human
ccaggugucaugcgugugaccc

SEQ ID NO: 414696 - RNA, 19 nt, Human
ugggcuuccccagggcaga

SEQ ID NO: 414697 - RNA, 22 nt, Human
uaugagcuuccaguguugcaug

SEQ ID NO: 414698 - RNA, 17 nt, Human
gcagcagagagacccuc

SEQ ID NO: 414699 - RNA, 22 nt, Human
ugucucagaguaucccugaacu

SEQ ID NO: 414700 - RNA, 22 nt, Human
cccagcuccgagcuccgagccg

SEQ ID NO: 414701 - RNA, 22 nt, Human
ucacauuuuuuacuggacuuaa

SEQ ID NO: 414702 - RNA, 22 nt, Human
ucuuugcaugcauuuucccuua

SEQ ID NO: 414703 - RNA, 17 nt, Human
caggcagacauguaagc

SEQ ID NO: 414704 - RNA, 22 nt, Human
ugcuggccaauggcagaggcgg

SEQ ID NO: 414705 - RNA, 22 nt, Human
aggaggccgggauucuggagau

SEQ ID NO: 414706 - RNA, 22 nt, Human
accacugggcgggcagccugcu

SEQ ID NO: 414707 - RNA, 22 nt, Human
gccagggcaggggagcaucugc

SEQ ID NO: 414708 - RNA, 21 nt, Human
aggcccagcuuuccucuugcu

SEQ ID NO: 414709 - RNA, 22 nt, Human
gggcacuggaggccaaggagcu

SEQ ID NO: 414710 - RNA, 22 nt, Human
uccaggaggugaggggaccaaa

SEQ ID NO: 414711 - RNA, 22 nt, Human
aggcagaggaaggguggauuug

SEQ ID NO: 414712 - RNA, 22 nt, Human
cauuuacuguugaaucccuagc

SEQ ID NO: 414713 - RNA, 22 nt, Human
ugcugucugcaacaguacuaca

SEQ ID NO: 414714 - RNA, 22 nt, Human
agcuucuggaaggcaaggcuug

SEQ ID NO: 414715 - RNA, 22 nt, Human
guggccaggacauugccaggca

SEQ ID NO: 414716 - RNA, 22 nt, Human
uuuuuauaugaaggauagugcg

SEQ ID NO: 414717 - RNA, 22 nt, Human
ggcagaggaggggugaauuugc

SEQ ID NO: 414718 - RNA, 22 nt, Human
uggagggcucuuucaccuggua

SEQ ID NO: 414719 - RNA, 22 nt, Human
ucauggauggccgggaggugau

SEQ ID NO: 414720 - RNA, 22 nt, Human
ugccucugguuaucugguaccu

SEQ ID NO: 414721 - RNA, 22 nt, Human
gccuuggccuuccuaggccuga

SEQ ID NO: 414722 - RNA, 22 nt, Human
cuccagggaaaggggcguccgc

SEQ ID NO: 414723 - RNA, 22 nt, Human
cagagcugucauuugccaguga

SEQ ID NO: 414724 - RNA, 21 nt, Human
ugcagcagaguaagcagggga

SEQ ID NO: 414725 - RNA, 22 nt, Human
uacauaauugucuuuguccuca

SEQ ID NO: 414726 - RNA, 22 nt, Human
gggcugcuguagagaacauguu

SEQ ID NO: 414727 - RNA, 22 nt, Human
ggacuccucuagaaguugaggc

SEQ ID NO: 414728 - RNA, 19 nt, Human
agcauccagucaugggauc

SEQ ID NO: 414729 - RNA, 22 nt, Human
gggucagcugcugggggcugac

SEQ ID NO: 414730 - RNA, 22 nt, Human
agucccagcucugccacuuacu

SEQ ID NO: 414731 - RNA, 22 nt, Human
uuaauuuuuauguauagugugu

SEQ ID NO: 414732 - RNA, 22 nt, Human
auucuucacuguuucagaauga

SEQ ID NO: 414733 - RNA, 22 nt, Human
cagggcuguuagcugcugcucu

SEQ ID NO: 414734 - RNA, 22 nt, Human
uuauuagggugguuuauguucu

SEQ ID NO: 414735 - RNA, 22 nt, Human
cuggcccagagagcagagcuua

SEQ ID NO: 414736 - RNA, 22 nt, Human
uuucacauaugguuguugauug

SEQ ID NO: 414737 - RNA, 22 nt, Human
ccauaaggagccagacauucca

SEQ ID NO: 414738 - RNA, 21 nt, Human
ccaccaggucuucugcucggg

SEQ ID NO: 414739 - RNA, 22 nt, Human
ccuggugccacuagagaauguc

SEQ ID NO: 414740 - RNA, 22 nt, Human
aacacuguacuggaagauggac

SEQ ID NO: 414741 - RNA, 22 nt, Human
ccaggacuucgaggcuacagug

SEQ ID NO: 414742 - RNA, 18 nt, Human
cagaaaucacaccagcac

SEQ ID NO: 414743 - RNA, 22 nt, Human
aaacaucaauugcaucucccaa

SEQ ID NO: 414744 - RNA, 20 nt, Human
acaaaugcauucugugacau

SEQ ID NO: 414745 - RNA, 22 nt, Human
aggggugugcauccuggaggau

SEQ ID NO: 414746 - RNA, 22 nt, Human
acaggccugugugcacacgagg

SEQ ID NO: 414747 - RNA, 22 nt, Human
ggccucucucccuggcuugcag

SEQ ID NO: 414748 - RNA, 22 nt, Human
caggccuggguucaaaucccuu

SEQ ID NO: 414749 - RNA, 22 nt, Human
ccuucauugcaucuuuaagaga

SEQ ID NO: 414750 - RNA, 22 nt, Human
ugucagugguagacccagaggu

SEQ ID NO: 414751 - RNA, 22 nt, Human
caguggcugugaccagggaccu

SEQ ID NO: 414752 - RNA, 17 nt, Human
cucagaguugcuuuguc

SEQ ID NO: 414753 - RNA, 22 nt, Human
aagucagagcaacugagacauu

SEQ ID NO: 414754 - RNA, 22 nt, Human
ggugaggaauuggggacugacc

SEQ ID NO: 414755 - RNA, 22 nt, Human
gcucugagucucagcuaccaca

SEQ ID NO: 414756 - RNA, 22 nt, Human
uuugaaagcaccauuugaguag

SEQ ID NO: 414757 - RNA, 22 nt, Human
cagucucuugcuucauuaguug

SEQ ID NO: 414758 - RNA, 22 nt, Human
uggcuggggccugaauccugca

SEQ ID NO: 414759 - RNA, 22 nt, Human
aggcccagagcaggaaaggguu

SEQ ID NO: 414760 - RNA, 22 nt, Human
aaggagugcaugacucagagua

SEQ ID NO: 414761 - RNA, 22 nt, Human
ugaggcucacaaaucugcauuu

SEQ ID NO: 414762 - RNA, 22 nt, Human
agggcagcccuucugggagggc

SEQ ID NO: 414763 - RNA, 22 nt, Human
gccugagacagugugguccaau

SEQ ID NO: 414764 - RNA, 22 nt, Human
augaaggcaguuaaacgucauc

SEQ ID NO: 414765 - RNA, 22 nt, Human
gaaaggaaauauucuaagcacu

SEQ ID NO: 414766 - RNA, 22 nt, Human
agcuuuaugggagcuuagauaa

SEQ ID NO: 414767 - RNA, 22 nt, Human
ucauugcauuuauucacuggca

SEQ ID NO: 414768 - RNA, 22 nt, Human
gcucagaggaugcuccuuuaug

SEQ ID NO: 414769 - RNA, 21 nt, Human
uucuucaugaugauuaauggc

SEQ ID NO: 414770 - RNA, 22 nt, Human
aaauguaguauguugcauguau

SEQ ID NO: 414771 - RNA, 22 nt, Human
uuggaggcaaugggaaggaggc

SEQ ID NO: 414772 - RNA, 22 nt, Human
acagugugaugggccugccuga

SEQ ID NO: 414773 - RNA, 22 nt, Human
aguggggagguccaggccaccc

SEQ ID NO: 414774 - RNA, 22 nt, Human
ugucucugaacagcuuacuaaa

SEQ ID NO: 414775 - RNA, 22 nt, Human
agggcuggcuaggugcguuccc

SEQ ID NO: 414776 - RNA, 22 nt, Human
agcuuuauucaugauuucaggg

SEQ ID NO: 414777 - RNA, 22 nt, Human
agcuuuauggugccucacuuga

SEQ ID NO: 414778 - RNA, 22 nt, Human
aauuugcaugaugagaacaaua

SEQ ID NO: 414779 - RNA, 22 nt, Human
uggagcugguaaacagugacau

SEQ ID NO: 414780 - RNA, 22 nt, Human
gcagauggugggggaggaguac

SEQ ID NO: 414781 - RNA, 22 nt, Human
ccauccugcauugcuauucaga

SEQ ID NO: 414782 - RNA, 22 nt, Human
agcaccuggucuccuggcgcug

SEQ ID NO: 414783 - RNA, 22 nt, Human
gcccugucggaacugcgaccuc

SEQ ID NO: 414784 - RNA, 22 nt, Human
gggcucuggaaggugcaccaug

SEQ ID NO: 414785 - RNA, 22 nt, Human
ccagagagcuacaaggcauaaa

SEQ ID NO: 414786 - RNA, 22 nt, Human
agcaggcuuguuaugucugaga

SEQ ID NO: 414787 - RNA, 22 nt, Human
gcugcccaggguggagccggcu

SEQ ID NO: 414788 - RNA, 22 nt, Human
uuggaaggugagucccuggguu

SEQ ID NO: 414789 - RNA, 22 nt, Human
gugacucacacaggccugggcu

SEQ ID NO: 414790 - RNA, 22 nt, Human
ucaucaaagcgcuuggaguagg

SEQ ID NO: 414791 - RNA, 22 nt, Human
gcagggacgcagcacucuccgu

SEQ ID NO: 414792 - RNA, 22 nt, Human
gccaggugcauggcugagucuc

SEQ ID NO: 414793 - RNA, 22 nt, Human
ucacaggguguacaucaccuau

SEQ ID NO: 414794 - RNA, 22 nt, Human
gcagggugccgacuucagggau

SEQ ID NO: 414795 - RNA, 22 nt, Human
ucagcuuuugucagaaauugua

SEQ ID NO: 414796 - RNA, 22 nt, Human
ccucugaggucauggacuuggc

SEQ ID NO: 414797 - RNA, 22 nt, Human
gcaccaggcagcugagcaggcc

SEQ ID NO: 414798 - RNA, 22 nt, Human
ccaggcugugguuuagauagag

SEQ ID NO: 414799 - RNA, 17 nt, Human
aggcaggagauuggaga

SEQ ID NO: 414800 - RNA, 22 nt, Human
cauuuguaguaucuguuuauau

SEQ ID NO: 414801 - RNA, 22 nt, Human
ggcccugagcugaaguacugug

SEQ ID NO: 414802 - RNA, 22 nt, Human
agugcauugcaucucugcuuca

SEQ ID NO: 414803 - RNA, 22 nt, Human
aaggaagguucauagucaaaga

SEQ ID NO: 414804 - RNA, 22 nt, Human
ucagggacgugagcucagaguc

SEQ ID NO: 414805 - RNA, 22 nt, Human
ugcugccuuagcagccaggcaa

SEQ ID NO: 414806 - RNA, 22 nt, Human
ucugccuuccccauaaucugau

SEQ ID NO: 414807 - RNA, 22 nt, Human
cugagccuuauucaccagcccu

SEQ ID NO: 414808 - RNA, 20 nt, Human
cuucaggacccauccucccc

SEQ ID NO: 414809 - RNA, 23 nt, Human
gagggcucugagugcuugggcca

SEQ ID NO: 414810 - RNA, 22 nt, Human
aaauuuucucucuaagacuuaa

SEQ ID NO: 414811 - RNA, 22 nt, Human
agagcagauggccagggggccu

SEQ ID NO: 414812 - RNA, 22 nt, Human
gaggcucaacccacagggguug

SEQ ID NO: 414813 - RNA, 22 nt, Human
aaggcuuuugggaauuuucaac

SEQ ID NO: 414814 - RNA, 22 nt, Human
ucagaggaggcauuuaaacaga

SEQ ID NO: 414815 - RNA, 22 nt, Human
ucucagagugguggucccucug

SEQ ID NO: 414816 - RNA, 22 nt, Human
cagucccaucucccagguggcu

SEQ ID NO: 414817 - RNA, 22 nt, Human
uggcucuguugugcugagccag

SEQ ID NO: 414818 - RNA, 22 nt, Human
acuuccuggcguagcugacauu

SEQ ID NO: 414819 - RNA, 22 nt, Human
uacccagcuucaagucaggacu

SEQ ID NO: 414820 - RNA, 22 nt, Human
gcagagcuguuaauggagcuga

SEQ ID NO: 414821 - RNA, 22 nt, Human
uccaugagacagauacuguaag

SEQ ID NO: 414822 - RNA, 22 nt, Human
cugacucuccucaagcauaaau

SEQ ID NO: 414823 - RNA, 22 nt, Human
gcugagcugcuguucauccugc

SEQ ID NO: 414824 - RNA, 21 nt, Human
uccagaccucccucuccuagc

SEQ ID NO: 414825 - RNA, 22 nt, Human
acagugugguuugagcacuggg

SEQ ID NO: 414826 - RNA, 22 nt, Human
gaggaagcugcguggcauuuca

SEQ ID NO: 414827 - RNA, 22 nt, Human
uagggcugccuauggcuagaua

SEQ ID NO: 414828 - RNA, 22 nt, Human
uuaugaaagacauuucuguugg

SEQ ID NO: 414829 - RNA, 22 nt, Human
ccaaguacagauuccuccacug

SEQ ID NO: 414830 - RNA, 22 nt, Human
cccucccagaugggcuugaggu

SEQ ID NO: 414831 - RNA, 19 nt, Human
ucucacaucagcuccuagc

SEQ ID NO: 414832 - RNA, 22 nt, Human
aaggaaaggaugagcaugcauu

SEQ ID NO: 414833 - RNA, 22 nt, Human
agaaaagguugaaaguaggauu

SEQ ID NO: 414834 - RNA, 22 nt, Human
gcugagugauugauauuuuagu

SEQ ID NO: 414835 - RNA, 22 nt, Human
agggcccuuacgcaggcccuuc

SEQ ID NO: 414836 - RNA, 22 nt, Human
aaggucauugguucugaauucu

SEQ ID NO: 414837 - RNA, 22 nt, Human
accucuggccuucaggcaucau

SEQ ID NO: 414838 - RNA, 22 nt, Human
cagaggaagcagacacaucuug

SEQ ID NO: 414839 - RNA, 22 nt, Human
ccaguugguuucaaugggacag

SEQ ID NO: 414840 - RNA, 22 nt, Human
auuugucuuuggaccugugaga

SEQ ID NO: 414841 - RNA, 20 nt, Human
ccucaguguccuggacuggg

SEQ ID NO: 414842 - RNA, 22 nt, Human
gacagaagaggaacuuggacag

SEQ ID NO: 414843 - RNA, 17 nt, Human
uggcuucccugggccac

SEQ ID NO: 414844 - RNA, 22 nt, Human
uucuaguucauauucucaaaga

SEQ ID NO: 414845 - RNA, 22 nt, Human
ugucagggcaugcgguccagcc

SEQ ID NO: 414846 - RNA, 22 nt, Human
cugggugaguugaugaaggaga

SEQ ID NO: 414847 - RNA, 22 nt, Human
gaaaggccauuucugaggguuu

SEQ ID NO: 414848 - RNA, 22 nt, Human
ccagcugacgaugccuggucuc

SEQ ID NO: 414849 - RNA, 23 nt, Human
cccauuuucauguuaacuccugg

SEQ ID NO: 414850 - RNA, 22 nt, Human
cagagcuggguuugggaaaccu

SEQ ID NO: 414851 - RNA, 22 nt, Human
ucugagccguauggcuuggcua

SEQ ID NO: 414852 - RNA, 22 nt, Human
gggagggaggugcugguucacg

SEQ ID NO: 414853 - RNA, 22 nt, Human
gcucaaagaauauucagaauga

SEQ ID NO: 414854 - RNA, 22 nt, Human
agggaggauaguagucaguuua

SEQ ID NO: 414855 - RNA, 22 nt, Human
caggaacauuuaaccacagggu

SEQ ID NO: 414856 - RNA, 22 nt, Human
ccugcccagcuucaccucaggc

SEQ ID NO: 414857 - RNA, 22 nt, Human
ugcagcagacugaguaugagaa

SEQ ID NO: 414858 - RNA, 19 nt, Human
cagaccuguccagccugug

SEQ ID NO: 414859 - RNA, 22 nt, Human
uauggaaaguguuuucuucugu

SEQ ID NO: 414860 - RNA, 22 nt, Human
uauccaaaggaacaaucacagc

SEQ ID NO: 414861 - RNA, 19 nt, Human
ggcugucuggcguguggau

SEQ ID NO: 414862 - RNA, 22 nt, Human
ugucucagaauggcucauaaua

SEQ ID NO: 414863 - RNA, 22 nt, Human
uuguaacaaucugucauaaaug

SEQ ID NO: 414864 - RNA, 22 nt, Human
ugcaagagguaaaaugaaagga

SEQ ID NO: 414865 - RNA, 22 nt, Human
aaugguuuaacauaugcuugag

SEQ ID NO: 414866 - RNA, 22 nt, Human
ugaaggccagcagagugaaggc

SEQ ID NO: 414867 - RNA, 22 nt, Human
aaaggcaggcuuucacaucuca

SEQ ID NO: 414868 - RNA, 22 nt, Human
ggaggcuccuaagcugacuuga

SEQ ID NO: 414869 - RNA, 22 nt, Human
caggagugaaaugaggcccagg

SEQ ID NO: 414870 - RNA, 22 nt, Human
ucacacagauugguagagcuga

SEQ ID NO: 414871 - RNA, 23 nt, Human
cccagcuuucccacugccgagag

SEQ ID NO: 414872 - RNA, 22 nt, Human
acaggcagguccugucccagcu

SEQ ID NO: 414873 - RNA, 22 nt, Human
ucagagccaaucauggugcauu

SEQ ID NO: 414874 - RNA, 23 nt, Human
gcugagguacauuuacaggaaga

SEQ ID NO: 414875 - RNA, 22 nt, Human
caggggaaggagccuugaaacu

SEQ ID NO: 414876 - RNA, 22 nt, Human
aggaggccgauuucagaggucg

SEQ ID NO: 414877 - RNA, 22 nt, Human
cagccagaaccuaggaugagcu

SEQ ID NO: 414878 - RNA, 22 nt, Human
ucuugacauuguuguuagcagg

SEQ ID NO: 414879 - RNA, 22 nt, Human
gggagccaaggagagaggccuu

SEQ ID NO: 414880 - RNA, 19 nt, Human
ccugucugucuucagcuag

SEQ ID NO: 414881 - RNA, 22 nt, Human
acagauuuuaaaugacacuccc

SEQ ID NO: 414882 - RNA, 18 nt, Human
gucacuguguuucugagc

SEQ ID NO: 414883 - RNA, 22 nt, Human
gaggaccacagaugagccugca

SEQ ID NO: 414884 - RNA, 19 nt, Human
uugaggggccaggggagau

SEQ ID NO: 414885 - RNA, 22 nt, Human
ucucaguguguuuucucucaga

SEQ ID NO: 414886 - RNA, 22 nt, Human
ggcucuggaaaguguccuugau

SEQ ID NO: 414887 - RNA, 22 nt, Human
guuacaaaggucauaaaagugu

SEQ ID NO: 414888 - RNA, 22 nt, Human
gcaaggcugcugccacccaucu

SEQ ID NO: 414889 - RNA, 22 nt, Human
cuccagugcacccagaggauuu

SEQ ID NO: 414890 - RNA, 22 nt, Human
uucuuacuaguauguuucagca

SEQ ID NO: 414891 - RNA, 22 nt, Human
acauuuaaauaugccuuauauu

SEQ ID NO: 414892 - RNA, 22 nt, Human
caagaaauuucuuaagaacuaa

SEQ ID NO: 414893 - RNA, 22 nt, Human
caaaugcuaacuucuuuccaaa

SEQ ID NO: 414894 - RNA, 22 nt, Human
guuagggaagcgcuguguucuu

SEQ ID NO: 414895 - RNA, 22 nt, Human
uaugcauaauuggauaaguaga

SEQ ID NO: 414896 - RNA, 22 nt, Human
cagacagcugcuuucuugcugu

SEQ ID NO: 414897 - RNA, 22 nt, Human
cagaguguuagcgcugguuggg

SEQ ID NO: 414898 - RNA, 22 nt, Human
acacagggaggaggugcugugc

SEQ ID NO: 414899 - RNA, 22 nt, Human
gucaugccagcggagcucggga

SEQ ID NO: 414900 - RNA, 22 nt, Human
ugcugccuugaccuccugggcu

SEQ ID NO: 414901 - RNA, 22 nt, Human
acucacuuuccauucaagcacc

SEQ ID NO: 414902 - RNA, 22 nt, Human
gccuggaguggacuuggccccu

SEQ ID NO: 414903 - RNA, 22 nt, Human
aagauuucagaguuugggggaa

SEQ ID NO: 414904 - RNA, 22 nt, Human
ucugggagggagccucagaauc

SEQ ID NO: 414905 - RNA, 23 nt, Human
agggccacugggaaggauuacug

SEQ ID NO: 414906 - RNA, 22 nt, Human
agaaaucagaacccugaaguuc

SEQ ID NO: 414907 - RNA, 18 nt, Human
acagaggcagacauguau

SEQ ID NO: 414908 - RNA, 22 nt, Human
gguuucaaaguggacaguuagu

SEQ ID NO: 414909 - RNA, 22 nt, Human
caaaugaagggagcugaagucu

SEQ ID NO: 414910 - RNA, 20 nt, Human
ggcucuggaaucuggugggc

SEQ ID NO: 414911 - RNA, 22 nt, Human
gguuugcaugugauguugggca

SEQ ID NO: 414912 - RNA, 22 nt, Human
uaaaguauccaguuauucuucu

SEQ ID NO: 414913 - RNA, 22 nt, Human
acuguacacgugucauuuacag

SEQ ID NO: 414914 - RNA, 22 nt, Human
ucacugggagaugugggaaggg

SEQ ID NO: 414915 - RNA, 22 nt, Human
auuuucaucauggguuuaacau

SEQ ID NO: 414916 - RNA, 22 nt, Human
uccugcagacauuuacaccuuu

SEQ ID NO: 414917 - RNA, 22 nt, Human
augucuuucuuauggucuguug

SEQ ID NO: 414918 - RNA, 22 nt, Human
guuacacaggaaaacauuagca

SEQ ID NO: 414919 - RNA, 22 nt, Human
uuccuauuuccaugaaacacaa

SEQ ID NO: 414920 - RNA, 22 nt, Human
cauugcuguuaauugucucuag

SEQ ID NO: 414921 - RNA, 20 nt, Human
uccagggcuagggagcucau

SEQ ID NO: 414922 - RNA, 22 nt, Human
uguaagauauucagcuuauuga

SEQ ID NO: 414923 - RNA, 22 nt, Human
cagagagagucaaaucuuugcu

SEQ ID NO: 414924 - RNA, 17 nt, Human
gauuuccugaaguucuu

SEQ ID NO: 414925 - RNA, 21 nt, Human
agcugcuccagggagcucagg

SEQ ID NO: 414926 - RNA, 22 nt, Human
uucagugucaauuuuuaaauau

SEQ ID NO: 414927 - RNA, 20 nt, Human
gccugccucagcuagcugag

SEQ ID NO: 414928 - RNA, 22 nt, Human
ccuggcagcuguuuggcuuggc

SEQ ID NO: 414929 - RNA, 22 nt, Human
ucauccaguucacauggugagu

SEQ ID NO: 414930 - RNA, 22 nt, Human
ggaggccaccugaccugcuguu

SEQ ID NO: 414931 - RNA, 22 nt, Human
ccccagccuuccaugggaauug

SEQ ID NO: 414932 - RNA, 22 nt, Human
uuauuuucuccucagaaagugg

SEQ ID NO: 414933 - RNA, 22 nt, Human
caggcacuggccagucagcaca

SEQ ID NO: 414934 - RNA, 22 nt, Human
agagccagcauuugggcccugc

SEQ ID NO: 414935 - RNA, 22 nt, Human
gggcugaguuccugccucacuc

SEQ ID NO: 414936 - RNA, 22 nt, Human
uccagccacucagcagggauug

SEQ ID NO: 414937 - RNA, 22 nt, Human
gagccaaggguugccauggaga

SEQ ID NO: 414938 - RNA, 22 nt, Human
uauaguaaaauuuucauuuaug

SEQ ID NO: 414939 - RNA, 22 nt, Human
caaggagauaaaauguugagcu

SEQ ID NO: 414940 - RNA, 22 nt, Human
agcaugaaaggcgugccaacuu

SEQ ID NO: 414941 - RNA, 22 nt, Human
ggaugcaggggcagcagagccu

SEQ ID NO: 414942 - RNA, 22 nt, Human
gggcuggcaucaguugccgaga

SEQ ID NO: 414943 - RNA, 22 nt, Human
uuguaacagcuguuuauauagu

SEQ ID NO: 414944 - RNA, 22 nt, Human
uuucuacagguugauggguuug

SEQ ID NO: 414945 - RNA, 22 nt, Human
cagaggcacaagaaagcaaggc

SEQ ID NO: 414946 - RNA, 22 nt, Human
cacagcuugggcucugacaaua

SEQ ID NO: 414947 - RNA, 22 nt, Human
auguaacaaaugguauacaugu

SEQ ID NO: 414948 - RNA, 21 nt, Human
ggccucugucauccugggaag

SEQ ID NO: 414949 - RNA, 22 nt, Human
acuauacauugaauguuaaggu

SEQ ID NO: 414950 - RNA, 22 nt, Human
agacaucauguuacagauuaag

SEQ ID NO: 414951 - RNA, 22 nt, Human
gugcagcagggggaagacagug

SEQ ID NO: 414952 - RNA, 22 nt, Human
cuggccgguauuugccucuggg

SEQ ID NO: 414953 - RNA, 22 nt, Human
ggugggcacccgagacuggauc

SEQ ID NO: 414954 - RNA, 23 nt, Human
acugagccagggccugggucagc

SEQ ID NO: 414955 - RNA, 22 nt, Human
ccugggagcuguggaaaggcug

SEQ ID NO: 414956 - RNA, 22 nt, Human
acuguucauuuguccuguaucu

SEQ ID NO: 414957 - RNA, 22 nt, Human
gggaagguauuuagcugcugaa

SEQ ID NO: 414958 - RNA, 22 nt, Human
ggggugggguuacucauugugc

SEQ ID NO: 414959 - RNA, 22 nt, Human
ugucuuuaaaauuaaacacauc

SEQ ID NO: 414960 - RNA, 22 nt, Human
cuuggucauuuggggcugcuau

SEQ ID NO: 414961 - RNA, 22 nt, Human
aaguguauauaugacuuauaaa

SEQ ID NO: 414962 - RNA, 22 nt, Human
augggaggguggaaaggcucug

SEQ ID NO: 414963 - RNA, 22 nt, Human
ccugggagugugccaucucugu

SEQ ID NO: 414964 - RNA, 22 nt, Human
ucuccucugcgcggcagugccc

SEQ ID NO: 414965 - RNA, 22 nt, Human
cagaggccaccuguggccacug

SEQ ID NO: 414966 - RNA, 22 nt, Human
ccagggugaggaggcucccacg

SEQ ID NO: 414967 - RNA, 22 nt, Human
auguaacuucugugaaucugac

SEQ ID NO: 414968 - RNA, 22 nt, Human
uggagaaggggcagggucucca

SEQ ID NO: 414969 - RNA, 22 nt, Human
gcuggcagagacaagaagacua

SEQ ID NO: 414970 - RNA, 22 nt, Human
gcagcaaucuucacagugucau

SEQ ID NO: 414971 - RNA, 22 nt, Human
auuaaauuggacgcugggggaa

SEQ ID NO: 414972 - RNA, 22 nt, Human
gugcaggagguaacauagcaaa

SEQ ID NO: 414973 - RNA, 18 nt, Human
gcagcuuuugauucaccc

SEQ ID NO: 414974 - RNA, 22 nt, Human
cagggccacuguagaugaggag

SEQ ID NO: 414975 - RNA, 22 nt, Human
aaauuauuaugccccucuauaa

SEQ ID NO: 414976 - RNA, 22 nt, Human
cagcugggagcuccauuagaua

SEQ ID NO: 414977 - RNA, 22 nt, Human
gccagccccuuagggcucuccc

SEQ ID NO: 414978 - RNA, 22 nt, Human
gaaaugcagaaccugagaccau

SEQ ID NO: 414979 - RNA, 22 nt, Human
ucuggagccuuggaugggaaag

SEQ ID NO: 414980 - RNA, 22 nt, Human
cucagggcuugaguguccagga

SEQ ID NO: 414981 - RNA, 22 nt, Human
uuucaguguaagguuuccagga

SEQ ID NO: 414982 - RNA, 22 nt, Human
acaguaaaaagccuuagaauuu

SEQ ID NO: 414983 - RNA, 22 nt, Human
aagcugcccucauucccagugc

SEQ ID NO: 414984 - RNA, 22 nt, Human
uaaugcuucaauuuccuugauu

SEQ ID NO: 414985 - RNA, 22 nt, Human
aaacucuggagauguuuaugca

SEQ ID NO: 414986 - RNA, 22 nt, Human
ucacaacucuuuccauuuaaua

SEQ ID NO: 414987 - RNA, 22 nt, Human
uccagagggcgauggcuggggg

SEQ ID NO: 414988 - RNA, 22 nt, Human
acauuuaaccaaacuguuuaau

SEQ ID NO: 414989 - RNA, 22 nt, Human
acacagggauauuucagguggu

SEQ ID NO: 414990 - RNA, 22 nt, Human
gccugucucuuggaacuuggua

SEQ ID NO: 414991 - RNA, 22 nt, Human
ugaguucucacccauucuucuu

SEQ ID NO: 414992 - RNA, 22 nt, Human
auucuuggcaaggagauuuaaa

SEQ ID NO: 414993 - RNA, 22 nt, Human
ggggcagaaagcccacagagug

SEQ ID NO: 414994 - RNA, 21 nt, Human
cugugcuuuuuaagugugaug

SEQ ID NO: 414995 - RNA, 22 nt, Human
acauuuuuauucaucaaagcag

SEQ ID NO: 414996 - RNA, 22 nt, Human
ggacaggaugcugaagaugaag

SEQ ID NO: 414997 - RNA, 22 nt, Human
accaugaucugcucugguguuu

SEQ ID NO: 414998 - RNA, 22 nt, Human
acugugcaaugaguaauaaacu

SEQ ID NO: 414999 - RNA, 22 nt, Human
cccugagagugagugccaccuu

SEQ ID NO: 415000 - RNA, 22 nt, Human
agccccaggcccggacgccucu

SEQ ID NO: 415001 - RNA, 22 nt, Human
caagaugaaacuacagggagga

SEQ ID NO: 415002 - RNA, 19 nt, Human
gccugagccagccaugcaa

SEQ ID NO: 415003 - RNA, 22 nt, Human
uggcucugccacuaacuuggua

SEQ ID NO: 415004 - RNA, 22 nt, Human
agggguggagaguguugccagu

SEQ ID NO: 415005 - RNA, 22 nt, Human
uuugucagucaugucugcuuuu

SEQ ID NO: 415006 - RNA, 22 nt, Human
gaggccugucgcuaggccucug

SEQ ID NO: 415007 - RNA, 22 nt, Human
cauuucuaagaaggcugcacau

SEQ ID NO: 415008 - RNA, 22 nt, Human
cuggccacaacuagcccaggac

SEQ ID NO: 415009 - RNA, 22 nt, Human
cugggggcaauggucagagugu

SEQ ID NO: 415010 - RNA, 22 nt, Human
uagcugucaccagaaauggcca

SEQ ID NO: 415011 - RNA, 22 nt, Human
aaagauuugaguucugcuuaua

SEQ ID NO: 415012 - RNA, 22 nt, Human
gcuguacaaggccucugccauc

SEQ ID NO: 415013 - RNA, 22 nt, Human
ugcagaagauggucugagcacc

SEQ ID NO: 415014 - RNA, 22 nt, Human
gucccagggaagaaggcagcac

SEQ ID NO: 415015 - RNA, 22 nt, Human
cuggcuccaucacugggugaug

SEQ ID NO: 415016 - RNA, 22 nt, Human
guauuuuauggccuggggccua

SEQ ID NO: 415017 - RNA, 22 nt, Human
ggcagggucuggacugaaagcu

SEQ ID NO: 415018 - RNA, 22 nt, Human
ggaggccaggaaggcucggaga

SEQ ID NO: 415019 - RNA, 22 nt, Human
cugucaguucuuccagauagag

SEQ ID NO: 415020 - RNA, 22 nt, Human
ucaugccacuuacaaaauaaug

SEQ ID NO: 415021 - RNA, 22 nt, Human
gagaaagcuucuuucccacagg

SEQ ID NO: 415022 - RNA, 22 nt, Human
ugccuggaugugcuggccucac

SEQ ID NO: 415023 - RNA, 22 nt, Human
ggcauccaaauaccaagaugua

SEQ ID NO: 415024 - RNA, 22 nt, Human
aaacaucaccauuuuaccuaau

SEQ ID NO: 415025 - RNA, 22 nt, Human
uggaagaaggcagagaggcauu

SEQ ID NO: 415026 - RNA, 22 nt, Human
gagccuggggacccuccugagu

SEQ ID NO: 415027 - RNA, 22 nt, Human
agagggagcccagucauagcug

SEQ ID NO: 415028 - RNA, 22 nt, Human
agcccuggcccggcugugcuuu

SEQ ID NO: 415029 - RNA, 22 nt, Human
gcagcagaugcuuucauggaca

SEQ ID NO: 415030 - RNA, 22 nt, Human
ggcagugaaaaaguauguuucc

SEQ ID NO: 415031 - RNA, 22 nt, Human
ucucagggugaggaaagaauuu

SEQ ID NO: 415032 - RNA, 22 nt, Human
aggaggcuguggagcacuccau

SEQ ID NO: 415033 - RNA, 22 nt, Human
caggagcaaggagcagugggau

SEQ ID NO: 415034 - RNA, 22 nt, Human
cccaggcagugcugaucccuca

SEQ ID NO: 415035 - RNA, 22 nt, Human
guggcucuccauugacauggaa

SEQ ID NO: 415036 - RNA, 22 nt, Human
ccagucccgcaugguccagaau

SEQ ID NO: 415037 - RNA, 22 nt, Human
auuuuuccaugauacuuaucug

SEQ ID NO: 415038 - RNA, 22 nt, Human
gggcucagccccauugaaccag

SEQ ID NO: 415039 - RNA, 22 nt, Human
uuaaacagacaguaaaugaaac

SEQ ID NO: 415040 - RNA, 22 nt, Human
ucaguggauauuucuguggcug

SEQ ID NO: 415041 - RNA, 22 nt, Human
acugaaagauaaaucaguuagc

SEQ ID NO: 415042 - RNA, 20 nt, Human
ccugucucacguuccgcccc

SEQ ID NO: 415043 - RNA, 22 nt, Human
agguggggugagcugcagacua

SEQ ID NO: 415044 - RNA, 22 nt, Human
gcucccagauuucagccuugug

SEQ ID NO: 415045 - RNA, 22 nt, Human
ccagccacagcuuccagcuccu

SEQ ID NO: 415046 - RNA, 22 nt, Human
cucagagcaaugaacaugcaaa

SEQ ID NO: 415047 - RNA, 22 nt, Human
agggaagaaaauccaucgcugc

SEQ ID NO: 415048 - RNA, 22 nt, Human
ucaaauaugugauagaagcuaa

SEQ ID NO: 415049 - RNA, 22 nt, Human
aggcacugcuucuaaguaggaa

SEQ ID NO: 415050 - RNA, 21 nt, Human
ggccugagcaccuguccaccu

SEQ ID NO: 415051 - RNA, 22 nt, Human
aacagaaaagguagguggcuuu

SEQ ID NO: 415052 - RNA, 22 nt, Human
ccuggcagacugugagggcagg

SEQ ID NO: 415053 - RNA, 22 nt, Human
augcuucagugcuaccuucaaa

SEQ ID NO: 415054 - RNA, 22 nt, Human
cagagcauuuggaagccacgug

SEQ ID NO: 415055 - RNA, 22 nt, Human
aggcagaaaauagucauccaaa

SEQ ID NO: 415056 - RNA, 22 nt, Human
ugaggcucagagcaccugcucc

SEQ ID NO: 415057 - RNA, 22 nt, Human
agagcugaggauccagcugagc

SEQ ID NO: 415058 - RNA, 22 nt, Human
gggccucugugcagaggggccu

SEQ ID NO: 415059 - RNA, 22 nt, Human
uuucaaauaccauaaaccuaau

SEQ ID NO: 415060 - RNA, 22 nt, Human
ucaaaggcugcuugucuucugg

SEQ ID NO: 415061 - RNA, 22 nt, Human
ggcugcagguugguuggcagcu

SEQ ID NO: 415062 - RNA, 22 nt, Human
agacaacaccaaaugcuagugu

SEQ ID NO: 415063 - RNA, 22 nt, Human
accaggagccacaggaggagcc

SEQ ID NO: 415064 - RNA, 22 nt, Human
cuucuuuacuuucuagaaauaa

SEQ ID NO: 415065 - RNA, 22 nt, Human
aacaguaucuuuuaucagaaau

SEQ ID NO: 415066 - RNA, 22 nt, Human
ggcagugaaucugagagccugg

SEQ ID NO: 415067 - RNA, 22 nt, Human
gaggagagggcugcgggcccac

SEQ ID NO: 415068 - RNA, 22 nt, Human
uccagagguauguagagaguau

SEQ ID NO: 415069 - RNA, 22 nt, Human
uccaggcagagcaacaaaauau

SEQ ID NO: 415070 - RNA, 22 nt, Human
ccgggccucgggacaccgggua

SEQ ID NO: 415071 - RNA, 22 nt, Human
uuaucacuuaugagcuuuuugc

SEQ ID NO: 415072 - RNA, 22 nt, Human
auaauuuacaacugcuuuuaau

SEQ ID NO: 415073 - RNA, 22 nt, Human
cuguacaucucugaggacagua

SEQ ID NO: 415074 - RNA, 22 nt, Human
agaggccagguccagaguuugu

SEQ ID NO: 415075 - RNA, 22 nt, Human
ucuguuccaguagaaaggugca

SEQ ID NO: 415076 - RNA, 22 nt, Human
gggguugguuuaaaugcuugag

SEQ ID NO: 415077 - RNA, 22 nt, Human
auuuccacauaagggaaauaag

SEQ ID NO: 415078 - RNA, 22 nt, Human
cucugagcugaaacaugagcau

SEQ ID NO: 415079 - RNA, 22 nt, Human
gcucccuguucucagccaugau

SEQ ID NO: 415080 - RNA, 22 nt, Human
uguaacaaaauaccuuggauug

SEQ ID NO: 415081 - RNA, 22 nt, Human
uuccauaaugagauucccagcc

SEQ ID NO: 415082 - RNA, 22 nt, Human
ggcagggaagcuggcaucacgg

SEQ ID NO: 415083 - RNA, 22 nt, Human
caggcagccuucucgucucaca

SEQ ID NO: 415084 - RNA, 22 nt, Human
uccuggccugucuggaguagcu

SEQ ID NO: 415085 - RNA, 22 nt, Human
uggcagcuacagacagagguga

SEQ ID NO: 415086 - RNA, 22 nt, Human
acagcaaaggacgaacacucug

SEQ ID NO: 415087 - RNA, 22 nt, Human
gaccucagugaauggucaugua

SEQ ID NO: 415088 - RNA, 22 nt, Human
uuuucaucucugcuuuguaccu

SEQ ID NO: 415089 - RNA, 22 nt, Human
aagauggaguaguguaaugguu

SEQ ID NO: 415090 - RNA, 20 nt, Human
cacguuuuuccacuagcaaa

SEQ ID NO: 415091 - RNA, 22 nt, Human
auugagaauccauuugagauga

SEQ ID NO: 415092 - RNA, 22 nt, Human
ggagcuggcuacagagaacucc

SEQ ID NO: 415093 - RNA, 18 nt, Human
uguggcaggggugggaga

SEQ ID NO: 415094 - RNA, 22 nt, Human
ucucugaaggggagcuguuuaa

SEQ ID NO: 415095 - RNA, 22 nt, Human
cccuggagugccggaaucaaga

SEQ ID NO: 415096 - RNA, 22 nt, Human
gccaggcugaggcucuggaaga

SEQ ID NO: 415097 - RNA, 22 nt, Human
auaacagaugugaagugcuaau

SEQ ID NO: 415098 - RNA, 22 nt, Human
agggcugcuccuccuucaggcc

SEQ ID NO: 415099 - RNA, 22 nt, Human
cuggccuucagacucggacuga

SEQ ID NO: 415100 - RNA, 18 nt, Human
agggaucaucacugcagc

SEQ ID NO: 415101 - RNA, 22 nt, Human
ggaagccagagugcugggcagg

SEQ ID NO: 415102 - RNA, 22 nt, Human
gaugcugaagugaagugaucuu

SEQ ID NO: 415103 - RNA, 22 nt, Human
gcagaagcccggucagcgcacg

SEQ ID NO: 415104 - RNA, 22 nt, Human
acagaauuaaaguguuugugga

SEQ ID NO: 415105 - RNA, 22 nt, Human
ggagcauguggggugagcaggg

SEQ ID NO: 415106 - RNA, 22 nt, Human
agagccuggcucccagcuaccg

SEQ ID NO: 415107 - RNA, 22 nt, Human
ggcauuugagccauuggccugu

SEQ ID NO: 415108 - RNA, 22 nt, Human
cagagcugauuggauccagaga

SEQ ID NO: 415109 - RNA, 22 nt, Human
aggggcaggugcugcacuuaga

SEQ ID NO: 415110 - RNA, 22 nt, Human
cugccugggccggccacccucu

SEQ ID NO: 415111 - RNA, 22 nt, Human
ccucagaggugaacaucagugc

SEQ ID NO: 415112 - RNA, 22 nt, Human
aagguuaaauagguauuuucca

SEQ ID NO: 415113 - RNA, 22 nt, Human
ucuauauuccagauacagauua

SEQ ID NO: 415114 - RNA, 22 nt, Human
ugcacuggggucccagcgcacg

SEQ ID NO: 415115 - RNA, 22 nt, Human
aacaacuugcguucagagaugu

SEQ ID NO: 415116 - RNA, 20 nt, Human
gggcaguggcgcuaucucag

SEQ ID NO: 415117 - RNA, 22 nt, Human
agagcugcaauuucauguggug

SEQ ID NO: 415118 - RNA, 22 nt, Human
aaaucaguuggaacacaagcag

SEQ ID NO: 415119 - RNA, 19 nt, Human
uacuuuuucaggacagagu

SEQ ID NO: 415120 - RNA, 22 nt, Human
uucauuccugagcccauauuua

SEQ ID NO: 415121 - RNA, 22 nt, Human
agcugccuggagucauuuccug

SEQ ID NO: 415122 - RNA, 22 nt, Human
agcagggggaguuagacuagau

SEQ ID NO: 415123 - RNA, 22 nt, Human
uuuucaagggcagggaaaucau

SEQ ID NO: 415124 - RNA, 22 nt, Human
ccagcucugccaagcgucagcu

SEQ ID NO: 415125 - RNA, 22 nt, Human
ugaaauuccaggagaguuaaaa

SEQ ID NO: 415126 - RNA, 22 nt, Human
gucauuguguggacauggagaa

SEQ ID NO: 415127 - RNA, 22 nt, Human
cagggccugagggcugcucugc

SEQ ID NO: 415128 - RNA, 22 nt, Human
cauagagugauguaagguaugu

SEQ ID NO: 415129 - RNA, 22 nt, Human
gggcauggugaugugcaccugu

SEQ ID NO: 415130 - RNA, 22 nt, Human
ccacugcccaccccgacgucua

SEQ ID NO: 415131 - RNA, 20 nt, Human
cccucugcuacacugggagc

SEQ ID NO: 415132 - RNA, 22 nt, Human
aguuucuauguaagcuacguga

SEQ ID NO: 415133 - RNA, 20 nt, Human
acuuucucgguuucucaccu

SEQ ID NO: 415134 - RNA, 22 nt, Human
uggcugaguuccuggcacacgg

SEQ ID NO: 415135 - RNA, 22 nt, Human
agacaaaggauuaaugaugaug

SEQ ID NO: 415136 - RNA, 22 nt, Human
auucucaaacaagugguuugau

SEQ ID NO: 415137 - RNA, 22 nt, Human
cucagggucugguccuuagauu

SEQ ID NO: 415138 - RNA, 16 nt, Human
ucagggcagaauggca

SEQ ID NO: 415139 - RNA, 22 nt, Human
auuugagaugguaaauaacuuu

SEQ ID NO: 415140 - RNA, 22 nt, Human
agucccuucucaaagugugcgg

SEQ ID NO: 415141 - RNA, 22 nt, Human
uggauaaacucacuguaaguug

SEQ ID NO: 415142 - RNA, 18 nt, Human
aggcuucccaggcaggcc

SEQ ID NO: 415143 - RNA, 23 nt, Human
gcaguggaaugucucuguuugga

SEQ ID NO: 415144 - RNA, 22 nt, Human
acacagggcaaugcuuugaccu

SEQ ID NO: 415145 - RNA, 22 nt, Human
ucagcaauaugauaggcuuugu

SEQ ID NO: 415146 - RNA, 22 nt, Human
caaaugcuggcccugcuacuua

SEQ ID NO: 415147 - RNA, 22 nt, Human
uauuucuucgggauucaagcua

SEQ ID NO: 415148 - RNA, 22 nt, Human
ccuggagggcgccgcacagucc

SEQ ID NO: 415149 - RNA, 22 nt, Human
auuugucuucaguagguucuuc

SEQ ID NO: 415150 - RNA, 22 nt, Human
ugaggaggucagagucuggcug

SEQ ID NO: 415151 - RNA, 22 nt, Human
agcagcucaaagccugcaagga

SEQ ID NO: 415152 - RNA, 22 nt, Human
uccucugccccagaugaaauuu

SEQ ID NO: 415153 - RNA, 22 nt, Human
cuucaagaagacagcagagcau

SEQ ID NO: 415154 - RNA, 22 nt, Human
uaaagaacacagggaauagcac

SEQ ID NO: 415155 - RNA, 22 nt, Human
ucucagugauggcccauuugga

SEQ ID NO: 415156 - RNA, 19 nt, Human
gagcacagcggcauuuggu

SEQ ID NO: 415157 - RNA, 22 nt, Human
ccaaaguccuuucuccaccugc

SEQ ID NO: 415158 - RNA, 21 nt, Human
cccugcaggccagggcugagc

SEQ ID NO: 415159 - RNA, 22 nt, Human
uccaggcuagguuuacaggaca

SEQ ID NO: 415160 - RNA, 20 nt, Human
ccugucugcaauggagguca

SEQ ID NO: 415161 - RNA, 22 nt, Human
aggaaaaaccuguuaaugguag

SEQ ID NO: 415162 - RNA, 22 nt, Human
agcagggggccacagucacagc

SEQ ID NO: 415163 - RNA, 22 nt, Human
aagagcauauuaauaguggaga

SEQ ID NO: 415164 - RNA, 22 nt, Human
cugaggcuuggaggggucuggu

SEQ ID NO: 415165 - RNA, 22 nt, Human
cggcagagugugugcgugcaug

SEQ ID NO: 415166 - RNA, 17 nt, Human
aucuggaagcuagcuga

SEQ ID NO: 415167 - RNA, 22 nt, Human
agagucagcuuaugacacaguc

SEQ ID NO: 415168 - RNA, 20 nt, Human
ugagugauggaggcggguca

SEQ ID NO: 415169 - RNA, 22 nt, Human
cucaggauugugccuagggaga

SEQ ID NO: 415170 - RNA, 22 nt, Human
ugggcugcacccucagccucug

SEQ ID NO: 415171 - RNA, 22 nt, Human
ucagggcaccaaaaaagaugcc

SEQ ID NO: 415172 - RNA, 22 nt, Human
acacugcucacuucuucccuug

SEQ ID NO: 415173 - RNA, 21 nt, Human
uagcuuuaauauucccacauu

SEQ ID NO: 415174 - RNA, 22 nt, Human
agggcacaucugcugggaaugg

SEQ ID NO: 415175 - RNA, 22 nt, Human
agccaggaauuggacaacacau

SEQ ID NO: 415176 - RNA, 22 nt, Human
uagcuuuaauaagcugcugaau

SEQ ID NO: 415177 - RNA, 21 nt, Human
ccagagagagggaaguggguu

SEQ ID NO: 415178 - RNA, 22 nt, Human
uggaggcaccacuggcugcccg

SEQ ID NO: 415179 - RNA, 22 nt, Human
ucagagaguuacacaaauuguu

SEQ ID NO: 415180 - RNA, 22 nt, Human
augcugaagagugcacaggcua

SEQ ID NO: 415181 - RNA, 22 nt, Human
cagagcaggcccacugcccucc

SEQ ID NO: 415182 - RNA, 22 nt, Human
agucaggagcugcugcauugua

SEQ ID NO: 415183 - RNA, 22 nt, Human
cuuucacauaauugaccuugaa

SEQ ID NO: 415184 - RNA, 22 nt, Human
gaggcucagagggacuuucaag

SEQ ID NO: 415185 - RNA, 22 nt, Human
cuucuuaacuguauauacuaug

SEQ ID NO: 415186 - RNA, 22 nt, Human
cugaagccaugugcucacuggu

SEQ ID NO: 415187 - RNA, 22 nt, Human
acagugucaugucguguucccc

SEQ ID NO: 415188 - RNA, 22 nt, Human
ucacgagaggcacagaauagag

SEQ ID NO: 415189 - RNA, 22 nt, Human
ucacagacacagggagaagcau

SEQ ID NO: 415190 - RNA, 22 nt, Human
gggugaggagcugccagucaug

SEQ ID NO: 415191 - RNA, 22 nt, Human
auaugcaagcacauagaauacu

SEQ ID NO: 415192 - RNA, 22 nt, Human
ugagccugcaauaagcacagcc

SEQ ID NO: 415193 - RNA, 22 nt, Human
uugguuuacuaggauucaaauu

SEQ ID NO: 415194 - RNA, 22 nt, Human
ggaccugcucucccaguucucu

SEQ ID NO: 415195 - RNA, 18 nt, Human
aggugcagccucugaggc

SEQ ID NO: 415196 - RNA, 22 nt, Human
caguagcacucugucagugaag

SEQ ID NO: 415197 - RNA, 19 nt, Human
ccagagacauuggcaucuu

SEQ ID NO: 415198 - RNA, 22 nt, Human
augacacaauuuuagagcugaa

SEQ ID NO: 415199 - RNA, 22 nt, Human
agccagggauggcagugcccag

SEQ ID NO: 415200 - RNA, 22 nt, Human
agucccuguacuuuccacugcc

SEQ ID NO: 415201 - RNA, 22 nt, Human
caauaauauccugugcuguuug

SEQ ID NO: 415202 - RNA, 22 nt, Human
ugcauauugugaaaauguagau

SEQ ID NO: 415203 - RNA, 22 nt, Human
ggcugcugcccaccccugcaug

SEQ ID NO: 415204 - RNA, 22 nt, Human
cacugcuucuggaggaauuugg

SEQ ID NO: 415205 - RNA, 22 nt, Human
acccugggucauauacagugug

SEQ ID NO: 415206 - RNA, 22 nt, Human
gcagggcagggcaagaacuggg

SEQ ID NO: 415207 - RNA, 22 nt, Human
acagacaaguaguucagacaag

SEQ ID NO: 415208 - RNA, 22 nt, Human
gcuggagcuugagaggacaggg

SEQ ID NO: 415209 - RNA, 22 nt, Human
gguucacauauugagaguauuc

SEQ ID NO: 415210 - RNA, 18 nt, Human
auuuugaacaaugcugua

SEQ ID NO: 415211 - RNA, 22 nt, Human
gcgaaaaauguguaaauauguu

SEQ ID NO: 415212 - RNA, 19 nt, Human
gaggaggcuucagcuuucu

SEQ ID NO: 415213 - RNA, 20 nt, Human
aagggcagagggaacagacu

SEQ ID NO: 415214 - RNA, 22 nt, Human
ugcagcauucuuggccacuacu

SEQ ID NO: 415215 - RNA, 22 nt, Human
cauuaagauuuuuuucuacugg

SEQ ID NO: 415216 - RNA, 22 nt, Human
cagaccugagguugaguaccag

SEQ ID NO: 415217 - RNA, 22 nt, Human
aaagccuucaaguagauguaag

SEQ ID NO: 415218 - RNA, 19 nt, Human
cagcaauaaugccagaugg

SEQ ID NO: 415219 - RNA, 22 nt, Human
gaauuaguguugaaaucagggc

SEQ ID NO: 415220 - RNA, 22 nt, Human
ucccagagccucugccacucug

SEQ ID NO: 415221 - RNA, 22 nt, Human
gggcugagggccaauuccuacu

SEQ ID NO: 415222 - RNA, 22 nt, Human
uacaaaaaauugauacugacga

SEQ ID NO: 415223 - RNA, 22 nt, Human
ugucucugugacuccuuccgcc

SEQ ID NO: 415224 - RNA, 22 nt, Human
ggcaggucagguccaugaccaa

SEQ ID NO: 415225 - RNA, 22 nt, Human
uuggccuuaaccucucugugcc

SEQ ID NO: 415226 - RNA, 22 nt, Human
uggcugggagcuggaacugggc

SEQ ID NO: 415227 - RNA, 17 nt, Human
ccuuucucuuucaucuc

SEQ ID NO: 415228 - RNA, 22 nt, Human
ugccaggcccugugcuggaugc

SEQ ID NO: 415229 - RNA, 22 nt, Human
agcuguggcagcacuuuggagu

SEQ ID NO: 415230 - RNA, 22 nt, Human
uccugaaaauaauuucacaaga

SEQ ID NO: 415231 - RNA, 22 nt, Human
augaagucuagcaagcauugaa

SEQ ID NO: 415232 - RNA, 22 nt, Human
gaaguggaagccaucggcaguc

SEQ ID NO: 415233 - RNA, 22 nt, Human
cagauuuagaguggggcuugga

SEQ ID NO: 415234 - RNA, 22 nt, Human
uucauuccuucuguaccuugcc

SEQ ID NO: 415235 - RNA, 22 nt, Human
agcagcauagaagcugggagga

SEQ ID NO: 415236 - RNA, 22 nt, Human
cagguggagcugacugagggca

SEQ ID NO: 415237 - RNA, 22 nt, Human
uucaggauaugugauaucugaa

SEQ ID NO: 415238 - RNA, 22 nt, Human
cugcuguggguuaagacacugu

SEQ ID NO: 415239 - RNA, 22 nt, Human
aguuauauuccauagauucaga

SEQ ID NO: 415240 - RNA, 22 nt, Human
gagucacaaaagaugcccaggg

SEQ ID NO: 415241 - RNA, 22 nt, Human
cacauuuaaagguugaagcuga

SEQ ID NO: 415242 - RNA, 22 nt, Human
gucuggagccacccuaagcauu

SEQ ID NO: 415243 - RNA, 21 nt, Human
cucaggaucuuauauauuagu

SEQ ID NO: 415244 - RNA, 21 nt, Human
ugccagcauguaggcuaguug

SEQ ID NO: 415245 - RNA, 22 nt, Human
caggaaauaucuccuggcagag

SEQ ID NO: 415246 - RNA, 22 nt, Human
uucuuaaaacuuauggacaggu

SEQ ID NO: 415247 - RNA, 22 nt, Human
augcuuuauuauuuugcaggga

SEQ ID NO: 415248 - RNA, 22 nt, Human
ucaucaguuuagaaaaaauaug

SEQ ID NO: 415249 - RNA, 22 nt, Human
aucccaugagaccacguuggcu

SEQ ID NO: 415250 - RNA, 22 nt, Human
caagagcugaggcuggagaggu

SEQ ID NO: 415251 - RNA, 20 nt, Human
aacacagauaccaaagguug

SEQ ID NO: 415252 - RNA, 20 nt, Human
agucucuguagugccugaga

SEQ ID NO: 415253 - RNA, 22 nt, Human
cugucuguucagauucauuacu

SEQ ID NO: 415254 - RNA, 22 nt, Human
acuguacauguaaacauuguca

SEQ ID NO: 415255 - RNA, 22 nt, Human
ucucccagaggaucccagugga

SEQ ID NO: 415256 - RNA, 20 nt, Human
aaucagaaagugugagcucu

SEQ ID NO: 415257 - RNA, 22 nt, Human
caggcugccgugaagcaggccu

SEQ ID NO: 415258 - RNA, 22 nt, Human
ugggaggcagguaggugaugau

SEQ ID NO: 415259 - RNA, 22 nt, Human
ugggccugaguuugggaacugg

SEQ ID NO: 415260 - RNA, 22 nt, Human
caccuagggcaucccugcccca

SEQ ID NO: 415261 - RNA, 22 nt, Human
auacauuagcucauaugauuaa

SEQ ID NO: 415262 - RNA, 22 nt, Human
ucaguuuucauuucaugagcag

SEQ ID NO: 415263 - RNA, 17 nt, Human
caaggccagcaucuuca

SEQ ID NO: 415264 - RNA, 22 nt, Human
ucuggagcuggcagggcccugg

SEQ ID NO: 415265 - RNA, 22 nt, Human
cucccagggccaucgagucacu

SEQ ID NO: 415266 - RNA, 22 nt, Human
uccagggaugccagccauguug

SEQ ID NO: 415267 - RNA, 22 nt, Human
guccagcugaucuugacccagc

SEQ ID NO: 415268 - RNA, 22 nt, Human
cagcaauaacucaaagccauuu

SEQ ID NO: 415269 - RNA, 22 nt, Human
ucucagagauuuauggaaaacu

SEQ ID NO: 415270 - RNA, 22 nt, Human
cccuggguucuggcugggcugc

SEQ ID NO: 415271 - RNA, 22 nt, Human
agugaaaugauucugagcaaga

SEQ ID NO: 415272 - RNA, 22 nt, Human
aggaaucccgcaccagcugcug

SEQ ID NO: 415273 - RNA, 22 nt, Human
cucuggagugcagccugguggc

SEQ ID NO: 415274 - RNA, 22 nt, Human
auucuaggcuugaaacaugaag

SEQ ID NO: 415275 - RNA, 22 nt, Human
ucugucacuuauuaagauggau

SEQ ID NO: 415276 - RNA, 22 nt, Human
ucugucacugagcucaggauuc

SEQ ID NO: 415277 - RNA, 22 nt, Human
gcugcucucucccuaaguuggg

SEQ ID NO: 415278 - RNA, 22 nt, Human
gccuggagcagacgugucccgg

SEQ ID NO: 415279 - RNA, 19 nt, Human
cuguggcugaccucuggcc

SEQ ID NO: 415280 - RNA, 22 nt, Human
caguaggaaggaugcagaaaaa

SEQ ID NO: 415281 - RNA, 22 nt, Human
aggcucaggaggagcugccgga

SEQ ID NO: 415282 - RNA, 22 nt, Human
ccucacuggccagccaggggug

SEQ ID NO: 415283 - RNA, 22 nt, Human
caaaugugguuucucagcauuc

SEQ ID NO: 415284 - RNA, 22 nt, Human
ggcuucuuccugugaacauguu

SEQ ID NO: 415285 - RNA, 22 nt, Human
ggugaaggucagagcaggaaaa

SEQ ID NO: 415286 - RNA, 22 nt, Human
gcaggaugccagggcagcagcg

SEQ ID NO: 415287 - RNA, 20 nt, Human
acauguacuaaugaauacag

SEQ ID NO: 415288 - RNA, 20 nt, Human
ugcagcugcaggaggguggg

SEQ ID NO: 415289 - RNA, 22 nt, Human
ugcaaacuauugguagagaugg

SEQ ID NO: 415290 - RNA, 22 nt, Human
cugccugcugccuguggagggu

SEQ ID NO: 415291 - RNA, 18 nt, Human
cucaccauucugcccaau

SEQ ID NO: 415292 - RNA, 22 nt, Human
ggcaguggaggacccugugucu

SEQ ID NO: 415293 - RNA, 22 nt, Human
auggcagcaaaugucuggcugg

SEQ ID NO: 415294 - RNA, 22 nt, Human
gcucugcugagauaucugggag

SEQ ID NO: 415295 - RNA, 22 nt, Human
ucacaggguaucugggauggau

SEQ ID NO: 415296 - RNA, 22 nt, Human
ugaacgcagguccacauggcuc

SEQ ID NO: 415297 - RNA, 17 nt, Human
uguggccuucugagcuu

SEQ ID NO: 415298 - RNA, 22 nt, Human
uugagaagaauguguugaguuu

SEQ ID NO: 415299 - RNA, 20 nt, Human
aggcucagagcaguaguaca

SEQ ID NO: 415300 - RNA, 22 nt, Human
uugugaguagugccgcaauaaa

SEQ ID NO: 415301 - RNA, 22 nt, Human
ugcagaagaauguaggcauaag

SEQ ID NO: 415302 - RNA, 22 nt, Human
acugcagccuuugggcucauaa

SEQ ID NO: 415303 - RNA, 22 nt, Human
agaggagguggugaugcuuuaa

SEQ ID NO: 415304 - RNA, 22 nt, Human
uggggcugucccgguuuggcga

SEQ ID NO: 415305 - RNA, 22 nt, Human
gccucuggggcagcugagucau

SEQ ID NO: 415306 - RNA, 21 nt, Human
cugcaucucauagaacauguc

SEQ ID NO: 415307 - RNA, 22 nt, Human
aggcugaggaucguacuuucca

SEQ ID NO: 415308 - RNA, 22 nt, Human
agcugggucuugggccaggaga

SEQ ID NO: 415309 - RNA, 22 nt, Human
gcaguggggaaugcuggggaga

SEQ ID NO: 415310 - RNA, 22 nt, Human
auuaauuuuucugacagccaca

SEQ ID NO: 415311 - RNA, 21 nt, Human
uucaaagagugggcauuguca

SEQ ID NO: 415312 - RNA, 22 nt, Human
acaaaauuaugaagaggccuug

SEQ ID NO: 415313 - RNA, 22 nt, Human
agcaaggcagucagcuggcugg

SEQ ID NO: 415314 - RNA, 22 nt, Human
agacuguaauuuguggccuccu

SEQ ID NO: 415315 - RNA, 22 nt, Human
gaaaugugcagaauguguuaga

SEQ ID NO: 415316 - RNA, 22 nt, Human
cuguugucuccucucagauuau

SEQ ID NO: 415317 - RNA, 22 nt, Human
agggccagcuagagcccucgcc

SEQ ID NO: 415318 - RNA, 22 nt, Human
cccuggcagaaugucucugggc

SEQ ID NO: 415319 - RNA, 22 nt, Human
uguguccuucugggagucccag

SEQ ID NO: 415320 - RNA, 22 nt, Human
aggagugggggcgagaaguuaa

SEQ ID NO: 415321 - RNA, 20 nt, Human
agcuggagaagggcccuucc

SEQ ID NO: 415322 - RNA, 22 nt, Human
uauuuuaucugccagaguggag

SEQ ID NO: 415323 - RNA, 22 nt, Human
uguuucuuuguagauauucuuu

SEQ ID NO: 415324 - RNA, 22 nt, Human
aaggugucacugggacaggaaa

SEQ ID NO: 415325 - RNA, 22 nt, Human
cuuucauuugauaagaaugcca

SEQ ID NO: 415326 - RNA, 19 nt, Human
ccaggccuggcgucuccgc

SEQ ID NO: 415327 - RNA, 22 nt, Human
ugccaggcagugucagauugag

SEQ ID NO: 415328 - RNA, 22 nt, Human
ccuuucucuggcagcaggacag

SEQ ID NO: 415329 - RNA, 22 nt, Human
gagucgagcagaaagccgucgg

SEQ ID NO: 415330 - RNA, 22 nt, Human
aaagacugguguguuacauaua

SEQ ID NO: 415331 - RNA, 19 nt, Human
uuugaaagaguuuuauugg

SEQ ID NO: 415332 - RNA, 20 nt, Human
ggaagccagggugcagggga

SEQ ID NO: 415333 - RNA, 22 nt, Human
cuggacagaaaccaguccuggg

SEQ ID NO: 415334 - RNA, 22 nt, Human
agcagggcugcagugugucuuu

SEQ ID NO: 415335 - RNA, 22 nt, Human
agagcuggaaucagaccucagg

SEQ ID NO: 415336 - RNA, 22 nt, Human
aacagaacccgagugugaaucu

SEQ ID NO: 415337 - RNA, 22 nt, Human
uggcugccuagugucugagcag

SEQ ID NO: 415338 - RNA, 22 nt, Human
gagcagugacuggagcaugaga

SEQ ID NO: 415339 - RNA, 21 nt, Human
agcuggcagauauggugucug

SEQ ID NO: 415340 - RNA, 22 nt, Human
cuguccagucuuuagcaagcug

SEQ ID NO: 415341 - RNA, 18 nt, Human
ggagagugagaucaaaca

SEQ ID NO: 415342 - RNA, 22 nt, Human
ugcuggaggcaguggaggugcc

SEQ ID NO: 415343 - RNA, 22 nt, Human
ucugucacaauuugcuuacucu

SEQ ID NO: 415344 - RNA, 23 nt, Human
uuuuccagaaucgacucuguaga

SEQ ID NO: 415345 - RNA, 22 nt, Human
agaaugcuccagagcugaaaga

SEQ ID NO: 415346 - RNA, 22 nt, Human
ccaagggcugcugaggugucca

SEQ ID NO: 415347 - RNA, 22 nt, Human
gagggcuccauuccccgugccc

SEQ ID NO: 415348 - RNA, 22 nt, Human
uuccaaaggaauggggagcuau

SEQ ID NO: 415349 - RNA, 22 nt, Human
auucugucuuuuuaaaauaaua

SEQ ID NO: 415350 - RNA, 22 nt, Human
uucacuuaacaucauaucauga

SEQ ID NO: 415351 - RNA, 22 nt, Human
ucuggcucccuggagcuccaca

SEQ ID NO: 415352 - RNA, 22 nt, Human
caacagagagaccagaaacagg

SEQ ID NO: 415353 - RNA, 22 nt, Human
agccagcuggugggucagcugg

SEQ ID NO: 415354 - RNA, 22 nt, Human
uaauacuuaccuugcagagucu

SEQ ID NO: 415355 - RNA, 18 nt, Human
uggagccagcucuaggau

SEQ ID NO: 415356 - RNA, 22 nt, Human
uccugccugcaaucccagcacu

SEQ ID NO: 415357 - RNA, 22 nt, Human
gguggguauaguuagggccucu

SEQ ID NO: 415358 - RNA, 22 nt, Human
uuuccaaauaaggucacauucu

SEQ ID NO: 415359 - RNA, 22 nt, Human
uaugugcaguuugcucuuaaca

SEQ ID NO: 415360 - RNA, 22 nt, Human
ucagaagaagagacuccacagc

SEQ ID NO: 415361 - RNA, 22 nt, Human
ccugucucuuucaaucugagag

SEQ ID NO: 415362 - RNA, 21 nt, Human
cagaggccucaugcucugugc

SEQ ID NO: 415363 - RNA, 22 nt, Human
agguagagcuccaguagaaaau

SEQ ID NO: 415364 - RNA, 22 nt, Human
agaggccggccgagcccauggg

SEQ ID NO: 415365 - RNA, 22 nt, Human
cuguggcuuucucugccuccuu

SEQ ID NO: 415366 - RNA, 22 nt, Human
cuggaauguagagacagcuuag

SEQ ID NO: 415367 - RNA, 22 nt, Human
acagacuguuugguucaugucu

SEQ ID NO: 415368 - RNA, 22 nt, Human
gcaggagucacugacuuggucc

SEQ ID NO: 415369 - RNA, 22 nt, Human
agaccaagugcaggugccacua

SEQ ID NO: 415370 - RNA, 20 nt, Human
uccaagcccuccuuccauuc

SEQ ID NO: 415371 - RNA, 22 nt, Human
cagaggugcauacaggucauua

SEQ ID NO: 415372 - RNA, 16 nt, Human
agcagggcgggaagga

SEQ ID NO: 415373 - RNA, 22 nt, Human
uggccucuggcugaggacuaac

SEQ ID NO: 415374 - RNA, 22 nt, Human
uaacagaauagcagaaacagaa

SEQ ID NO: 415375 - RNA, 22 nt, Human
cuggaggcacccuuagagaggc

SEQ ID NO: 415376 - RNA, 22 nt, Human
gagaaggcugauccuuggaguu

SEQ ID NO: 415377 - RNA, 22 nt, Human
auuuaugacuggugaauagaac

SEQ ID NO: 415378 - RNA, 20 nt, Human
agugccagggcaggugagag

SEQ ID NO: 415379 - RNA, 22 nt, Human
aagcuggcaauuaucaaaacug

SEQ ID NO: 415380 - RNA, 22 nt, Human
gguccuggaaauugacggaaag

SEQ ID NO: 415381 - RNA, 22 nt, Human
ucagccuuguggcccugcucca

SEQ ID NO: 415382 - RNA, 22 nt, Human
ucuaggagaaccaucagggagg

SEQ ID NO: 415383 - RNA, 22 nt, Human
acagccugcagccccaggucgc

SEQ ID NO: 415384 - RNA, 22 nt, Human
guggccugucagaagccguggg

SEQ ID NO: 415385 - RNA, 19 nt, Human
ugaaauggcaguugcuaaa

SEQ ID NO: 415386 - RNA, 22 nt, Human
ugaagcccugugucagcuucca

SEQ ID NO: 415387 - RNA, 22 nt, Human
ccagagccggcucccucagcuu

SEQ ID NO: 415388 - RNA, 22 nt, Human
uggggcuccuccuggcaggagg

SEQ ID NO: 415389 - RNA, 22 nt, Human
uauguacaccggggaagguggg

SEQ ID NO: 415390 - RNA, 22 nt, Human
uuuccuaagguagugauaauuu

SEQ ID NO: 415391 - RNA, 22 nt, Human
gaaauguguuguucauuucuaa

SEQ ID NO: 415392 - RNA, 23 nt, Human
uuucacaaugagcauuacagaau

SEQ ID NO: 415393 - RNA, 22 nt, Human
caaagccucugauuucacuugu

SEQ ID NO: 415394 - RNA, 22 nt, Human
cagaggcauauaauugcugggg

SEQ ID NO: 415395 - RNA, 18 nt, Human
acagaacucaggggcacc

SEQ ID NO: 415396 - RNA, 22 nt, Human
accagagcuggcagaguaucaa

SEQ ID NO: 415397 - RNA, 22 nt, Human
cugagccagcuggcaugugcua

SEQ ID NO: 415398 - RNA, 22 nt, Human
guucaaggaagggaggaaagcc

SEQ ID NO: 415399 - RNA, 22 nt, Human
uguaaaaccaaaucaaucuagu

SEQ ID NO: 415400 - RNA, 22 nt, Human
cagagugaacagugggaugugc

SEQ ID NO: 415401 - RNA, 22 nt, Human
ucugccugagggagcugaggaa

SEQ ID NO: 415402 - RNA, 22 nt, Human
accagagaaaacacagcaggcu

SEQ ID NO: 415403 - RNA, 22 nt, Human
cagcagugaugugugaggguuc

SEQ ID NO: 415404 - RNA, 22 nt, Human
gggcuggaggagauccagaggc

SEQ ID NO: 415405 - RNA, 22 nt, Human
caccaucagcagcaggugucaa

SEQ ID NO: 415406 - RNA, 22 nt, Human
guccuggggauacagaagugaa

SEQ ID NO: 415407 - RNA, 22 nt, Human
cugccagcaaugugaccaugcu

SEQ ID NO: 415408 - RNA, 17 nt, Human
ccagguggaaucgugga

SEQ ID NO: 415409 - RNA, 22 nt, Human
uuucacaauuuuaaggagcaaa

SEQ ID NO: 415410 - RNA, 22 nt, Human
gccuggagcucggcugagggcg

SEQ ID NO: 415411 - RNA, 22 nt, Human
uggcugagaaugggaugaugcc

SEQ ID NO: 415412 - RNA, 22 nt, Human
agaggcuccuucacucuggcac

SEQ ID NO: 415413 - RNA, 22 nt, Human
ugccucagagugggcuugcuau

SEQ ID NO: 415414 - RNA, 22 nt, Human
cugccuggcuaaacucaagucg

SEQ ID NO: 415415 - RNA, 22 nt, Human
cagggcucccucuggcucccag

SEQ ID NO: 415416 - RNA, 22 nt, Human
ucacacguccuugcuacuccuc

SEQ ID NO: 415417 - RNA, 22 nt, Human
uggcucagcaagacauugaccu

SEQ ID NO: 415418 - RNA, 22 nt, Human
ucagaggaccuuacugagaacc

SEQ ID NO: 415419 - RNA, 22 nt, Human
gguggccaggccagcucuggcc

SEQ ID NO: 415420 - RNA, 22 nt, Human
cagggcagggccacacccccug

SEQ ID NO: 415421 - RNA, 22 nt, Human
aagggugggcccuggcagccau

SEQ ID NO: 415422 - RNA, 22 nt, Human
ccucugcaccauagccuucagc

SEQ ID NO: 415423 - RNA, 22 nt, Human
uucuaccuacccucugcauaca

SEQ ID NO: 415424 - RNA, 22 nt, Human
uucuguuugccauauauaguag

SEQ ID NO: 415425 - RNA, 22 nt, Human
gcugagcugaggcagggcuggg

SEQ ID NO: 415426 - RNA, 22 nt, Human
acugggaguucuccaugucccu

SEQ ID NO: 415427 - RNA, 22 nt, Human
ggcagcuguggacgucgucauu

SEQ ID NO: 415428 - RNA, 22 nt, Human
uaugcacacaggcuuaauucau

SEQ ID NO: 415429 - RNA, 22 nt, Human
acaguguuuuagaaaagcuuga

SEQ ID NO: 415430 - RNA, 22 nt, Human
cugugccuaagaugcaugucuc

SEQ ID NO: 415431 - RNA, 22 nt, Human
gaggcagagguuguugcaguga

SEQ ID NO: 415432 - RNA, 22 nt, Human
cuggacagaaaaggccacugga

SEQ ID NO: 415433 - RNA, 22 nt, Human
uucuuuccccauggaguucgga

SEQ ID NO: 415434 - RNA, 22 nt, Human
gggcugacgaaggccaugugug

SEQ ID NO: 415435 - RNA, 22 nt, Human
uagacagauuuaaaggaaugga

SEQ ID NO: 415436 - RNA, 21 nt, Human
ggagucagggucuggcugggg

SEQ ID NO: 415437 - RNA, 22 nt, Human
aggccuguuccaggccccuuuu

SEQ ID NO: 415438 - RNA, 22 nt, Human
aggcucagacaggaaaaguaac

SEQ ID NO: 415439 - RNA, 22 nt, Human
gccagcagguugucaaggagcu

SEQ ID NO: 415440 - RNA, 22 nt, Human
cagggcucgcugccagcuucag

SEQ ID NO: 415441 - RNA, 22 nt, Human
aggcucuggcaacagcuggugu

SEQ ID NO: 415442 - RNA, 22 nt, Human
ccucaggggcuuuucguuguug

SEQ ID NO: 415443 - RNA, 22 nt, Human
acaggcauauuucuagauuaca

SEQ ID NO: 415444 - RNA, 22 nt, Human
gcauugucaaaagugguaugac

SEQ ID NO: 415445 - RNA, 22 nt, Human
ggcuucuguccucuggaucugu

SEQ ID NO: 415446 - RNA, 22 nt, Human
cagcugccugucuggaggcaau

SEQ ID NO: 415447 - RNA, 22 nt, Human
ggccugcuccgggggcugagcu

SEQ ID NO: 415448 - RNA, 22 nt, Human
agggcagagauuaauuaagaca

SEQ ID NO: 415449 - RNA, 22 nt, Human
cagccaucaguaaagacagcuu

SEQ ID NO: 415450 - RNA, 22 nt, Human
gaagucugcugcucaggaguuu

SEQ ID NO: 415451 - RNA, 22 nt, Human
ggcccagaauacuuuguaaaau

SEQ ID NO: 415452 - RNA, 22 nt, Human
acagcuggaggccccauugucc

SEQ ID NO: 415453 - RNA, 22 nt, Human
gaggugggagggcagucccuaa

SEQ ID NO: 415454 - RNA, 22 nt, Human
uagccucuggaauccuuucucu

SEQ ID NO: 415455 - RNA, 22 nt, Human
ggcugccauaacugauaccaua

SEQ ID NO: 415456 - RNA, 22 nt, Human
gcucucuggaggccauggacag

SEQ ID NO: 415457 - RNA, 22 nt, Human
cuguccuuacugcuucuggcuu

SEQ ID NO: 415458 - RNA, 22 nt, Human
ugucccagcacuuugggagucu

SEQ ID NO: 415459 - RNA, 22 nt, Human
ucuggagcuuccucauuuacag

SEQ ID NO: 415460 - RNA, 22 nt, Human
auuagggaaacugacuugucuc

SEQ ID NO: 415461 - RNA, 22 nt, Human
gagccugcccagcccuguccac

SEQ ID NO: 415462 - RNA, 22 nt, Human
gcaggggcaggagaucucaggc

SEQ ID NO: 415463 - RNA, 21 nt, Human
uuuauuaacaacuguggacgu

SEQ ID NO: 415464 - RNA, 22 nt, Human
uugagucaguaauuccauuucu

SEQ ID NO: 415465 - RNA, 22 nt, Human
cccugagcccauaguugacauu

SEQ ID NO: 415466 - RNA, 22 nt, Human
gaaggcuaaaggggcagagguu

SEQ ID NO: 415467 - RNA, 22 nt, Human
aaucaguuagaaggaagagaau

SEQ ID NO: 415468 - RNA, 22 nt, Human
ccagcuggagccaagguggacu

SEQ ID NO: 415469 - RNA, 22 nt, Human
augaggcaaggcuggccguguu

SEQ ID NO: 415470 - RNA, 22 nt, Human
gcuggccacacugcugauggag

SEQ ID NO: 415471 - RNA, 22 nt, Human
ggggaggcugaugugggcaaag

SEQ ID NO: 415472 - RNA, 22 nt, Human
gcgguagcucaagcuuguaauc

SEQ ID NO: 415473 - RNA, 22 nt, Human
uccugguggugccagcugcagg

SEQ ID NO: 415474 - RNA, 22 nt, Human
gcccuuccuuagacagcaggau

SEQ ID NO: 415475 - RNA, 22 nt, Human
caaggaaacaugaaaugcauug

SEQ ID NO: 415476 - RNA, 22 nt, Human
gcuuccugauauucauacuguu

SEQ ID NO: 415477 - RNA, 22 nt, Human
agccuggauucgugcauccaca

SEQ ID NO: 415478 - RNA, 22 nt, Human
cucuccuccaacagcccugccg

SEQ ID NO: 415479 - RNA, 22 nt, Human
cccaggcagggacgugcucugg

SEQ ID NO: 415480 - RNA, 22 nt, Human
uccugguggcuuucccugccuu

SEQ ID NO: 415481 - RNA, 22 nt, Human
gguguagcucugugucccacug

SEQ ID NO: 415482 - RNA, 22 nt, Human
ucagaagagcuggugcugccug

SEQ ID NO: 415483 - RNA, 22 nt, Human
gaggccugguagccgagcccca

SEQ ID NO: 415484 - RNA, 22 nt, Human
acaauucuggguauuuauauag

SEQ ID NO: 415485 - RNA, 22 nt, Human
agggaggucuggcugcccugag

SEQ ID NO: 415486 - RNA, 22 nt, Human
gggcagagaaauggacaguugg

SEQ ID NO: 415487 - RNA, 19 nt, Human
gcaucagagcagaaggggu

SEQ ID NO: 415488 - RNA, 22 nt, Human
augaggcagauguugcaugagg

SEQ ID NO: 415489 - RNA, 22 nt, Human
gcauuucugugcauacacauga

SEQ ID NO: 415490 - RNA, 22 nt, Human
aaaguguggagauugaacuaaa

SEQ ID NO: 415491 - RNA, 22 nt, Human
ggaggccaaggaggagcuugcc

SEQ ID NO: 415492 - RNA, 22 nt, Human
ggacagcccauacacaugucug

SEQ ID NO: 415493 - RNA, 22 nt, Human
uuguacuugccauagaacaaca

SEQ ID NO: 415494 - RNA, 20 nt, Human
cugggcugcccagcuauggg

SEQ ID NO: 415495 - RNA, 22 nt, Human
aggcaguuguugcugagcagcu

SEQ ID NO: 415496 - RNA, 22 nt, Human
cuccagggagcuuggaaagacc

SEQ ID NO: 415497 - RNA, 22 nt, Human
uuauuuaaaagugguaagauuc

SEQ ID NO: 415498 - RNA, 23 nt, Human
ugggccuggaaagccuuagagag

SEQ ID NO: 415499 - RNA, 22 nt, Human
ggccugcugacccaaguccugu

SEQ ID NO: 415500 - RNA, 22 nt, Human
gccugcagggccugggccuacc

SEQ ID NO: 415501 - RNA, 23 nt, Human
ugggucagcugccuccaggacaa

SEQ ID NO: 415502 - RNA, 22 nt, Human
agaggcugcacuugcucaugau

SEQ ID NO: 415503 - RNA, 22 nt, Human
aauguacaaaccuucuuuguag

SEQ ID NO: 415504 - RNA, 22 nt, Human
augauugaaaaugacauugcca

SEQ ID NO: 415505 - RNA, 22 nt, Human
agucucugcaugaugcagcaca

SEQ ID NO: 415506 - RNA, 22 nt, Human
cagcuggcccuuugguagccuu

SEQ ID NO: 415507 - RNA, 21 nt, Human
uccucagggccccagagcacu

SEQ ID NO: 415508 - RNA, 22 nt, Human
gaggggcuugaggcccugaugg

SEQ ID NO: 415509 - RNA, 22 nt, Human
auuucucucauuguuagcuagg

SEQ ID NO: 415510 - RNA, 22 nt, Human
caaagcaaggcucaguuugaac

SEQ ID NO: 415511 - RNA, 22 nt, Human
auaccuuuuagacauguaguug

SEQ ID NO: 415512 - RNA, 22 nt, Human
cuuccccaaccccgacugugug

SEQ ID NO: 415513 - RNA, 22 nt, Human
uggcucaggugugagcugaaga

SEQ ID NO: 415514 - RNA, 22 nt, Human
cacagggcuuugauggcugagu

SEQ ID NO: 415515 - RNA, 22 nt, Human
aaaugcaucagcucauaagaga

SEQ ID NO: 415516 - RNA, 22 nt, Human
ucuggagccacaaaccucagcu

SEQ ID NO: 415517 - RNA, 22 nt, Human
cuggagggugagccucaucucu

SEQ ID NO: 415518 - RNA, 22 nt, Human
acucaggaaaugaagacugguu

SEQ ID NO: 415519 - RNA, 22 nt, Human
ucaucaguguccuuaucacuua

SEQ ID NO: 415520 - RNA, 22 nt, Human
cugcaggggcuggaguuggcuu

SEQ ID NO: 415521 - RNA, 22 nt, Human
ugccaggcauuugacagacacu

SEQ ID NO: 415522 - RNA, 22 nt, Human
ucaaagcuuagauaauuucuuu

SEQ ID NO: 415523 - RNA, 22 nt, Human
uagcuaucuguguccagaucca

SEQ ID NO: 415524 - RNA, 22 nt, Human
ccuuucucuuggauaccgauug

SEQ ID NO: 415525 - RNA, 22 nt, Human
gcuucuggaggagcugggcuga

SEQ ID NO: 415526 - RNA, 22 nt, Human
ugcugugguucccagaguggau

SEQ ID NO: 415527 - RNA, 22 nt, Human
uuaacauuucuuuuccacucau

SEQ ID NO: 415528 - RNA, 21 nt, Human
aggcucagagagaaacucuug

SEQ ID NO: 415529 - RNA, 22 nt, Human
uuuccaaagcugaguugagcaa

SEQ ID NO: 415530 - RNA, 22 nt, Human
uuucacauuuguuuuaagaagu

SEQ ID NO: 415531 - RNA, 21 nt, Human
agcagaacagucgagcacugc

SEQ ID NO: 415532 - RNA, 22 nt, Human
uaguaugggaagaacuuuguag

SEQ ID NO: 415533 - RNA, 22 nt, Human
uuguauauauucuuaaagaugu

SEQ ID NO: 415534 - RNA, 22 nt, Human
ucaaaauuaaaccaacguccag

SEQ ID NO: 415535 - RNA, 22 nt, Human
ccugggugucaugggcagcugg

SEQ ID NO: 415536 - RNA, 18 nt, Human
aagaacugagguccuaga

SEQ ID NO: 415537 - RNA, 22 nt, Human
cagagcugggaucccaugggcg

SEQ ID NO: 415538 - RNA, 22 nt, Human
uggguggcggccugguucugag

SEQ ID NO: 415539 - RNA, 22 nt, Human
gcaggggcugcugggaacucgg

SEQ ID NO: 415540 - RNA, 22 nt, Human
cuccaggagcugugucuuucuu

SEQ ID NO: 415541 - RNA, 22 nt, Human
caugucuguguacacaugcaca

SEQ ID NO: 415542 - RNA, 23 nt, Human
ucucugaguuguacuuucccuug

SEQ ID NO: 415543 - RNA, 22 nt, Human
guggccuggaaaggcuggucug

SEQ ID NO: 415544 - RNA, 23 nt, Human
agggcuccuuguugauuagcauu

SEQ ID NO: 415545 - RNA, 22 nt, Human
cauuucugggagacaugcuaga

SEQ ID NO: 415546 - RNA, 18 nt, Human
cugucuuuuuucucucca

SEQ ID NO: 415547 - RNA, 22 nt, Human
ucauuugugugagugauuugac

SEQ ID NO: 415548 - RNA, 22 nt, Human
agauguaaacucucaugucauu

SEQ ID NO: 415549 - RNA, 22 nt, Human
ccagggcugguggcugcagagg

SEQ ID NO: 415550 - RNA, 22 nt, Human
ggaugcaggaguugaagaagga

SEQ ID NO: 415551 - RNA, 22 nt, Human
uugacaauguccuuugaauuuc

SEQ ID NO: 415552 - RNA, 22 nt, Human
cugggccugguagggcuugaaa

SEQ ID NO: 415553 - RNA, 22 nt, Human
guauuuucaugauuucagacca

SEQ ID NO: 415554 - RNA, 22 nt, Human
ucugucacucccugaugaugaa

SEQ ID NO: 415555 - RNA, 22 nt, Human
aaagccagaguguguuagagac

SEQ ID NO: 415556 - RNA, 22 nt, Human
gggcagagguucaacuucaaca

SEQ ID NO: 415557 - RNA, 21 nt, Human
gccauuguuuucuaccuggag

SEQ ID NO: 415558 - RNA, 22 nt, Human
gcucagaggcacgaccucuugg

SEQ ID NO: 415559 - RNA, 22 nt, Human
gaguccaguuguucacagaggc

SEQ ID NO: 415560 - RNA, 22 nt, Human
ugagguguguccccagggaggu

SEQ ID NO: 415561 - RNA, 22 nt, Human
ccagaaaaugcagaacauagaa

SEQ ID NO: 415562 - RNA, 23 nt, Human
ccugcagcugcuggggcuccacc

SEQ ID NO: 415563 - RNA, 22 nt, Human
ggagcagagcucuucaucugca

SEQ ID NO: 415564 - RNA, 22 nt, Human
uucuacuuuggacauaaaggac

SEQ ID NO: 415565 - RNA, 22 nt, Human
caguagcaggcacucagcacgu

SEQ ID NO: 415566 - RNA, 22 nt, Human
gcucaggagcugacagccucaa

SEQ ID NO: 415567 - RNA, 22 nt, Human
uuuuaaguuaauauaauugagg

SEQ ID NO: 415568 - RNA, 21 nt, Human
caggaaaagcggaagucuagc

SEQ ID NO: 415569 - RNA, 22 nt, Human
ugauuucuuccuugucauuaga

SEQ ID NO: 415570 - RNA, 22 nt, Human
cccagccugucuuucccaauga

SEQ ID NO: 415571 - RNA, 22 nt, Human
ugacagaaagaauaugucaauc

SEQ ID NO: 415572 - RNA, 22 nt, Human
cuggagcuaggaaguccaagau

SEQ ID NO: 415573 - RNA, 22 nt, Human
ucugggagagcacguggcugac

SEQ ID NO: 415574 - RNA, 22 nt, Human
ucccugggcaucacguugcuuc

SEQ ID NO: 415575 - RNA, 22 nt, Human
auggccugggcccgcuucagau

SEQ ID NO: 415576 - RNA, 22 nt, Human
ucauuuaauugguuuugcucgu

SEQ ID NO: 415577 - RNA, 22 nt, Human
aagcagaaaaacugagcuccaa

SEQ ID NO: 415578 - RNA, 22 nt, Human
acugucugcaaaacucauacuc

SEQ ID NO: 415579 - RNA, 22 nt, Human
aacaugauuuaguauaaugcag

SEQ ID NO: 415580 - RNA, 22 nt, Human
ggcagaggaaggaugaauucac

SEQ ID NO: 415581 - RNA, 22 nt, Human
aaauguuccuuuggauuaaacu

SEQ ID NO: 415582 - RNA, 22 nt, Human
aguuucuagccucacuguuuag

SEQ ID NO: 415583 - RNA, 22 nt, Human
ugugugccugagccgugccugg

SEQ ID NO: 415584 - RNA, 19 nt, Human
acacagggcuagaguuaca

SEQ ID NO: 415585 - RNA, 22 nt, Human
agcugcuguccuaggcacugua

SEQ ID NO: 415586 - RNA, 21 nt, Human
gggagcuggaaacugggugac

SEQ ID NO: 415587 - RNA, 19 nt, Human
agucccaggcccgaaagag

SEQ ID NO: 415588 - RNA, 22 nt, Human
cuguaauucacuagggucagcg

SEQ ID NO: 415589 - RNA, 19 nt, Human
gcuguauuaaagauacaug

SEQ ID NO: 415590 - RNA, 22 nt, Human
caggugggcguggcgagaaggc

SEQ ID NO: 415591 - RNA, 22 nt, Human
ucagguggcuuggagggggacg

SEQ ID NO: 415592 - RNA, 22 nt, Human
aggccugaaguguggagugggg

SEQ ID NO: 415593 - RNA, 22 nt, Human
ccagagaccagaacauggggau

SEQ ID NO: 415594 - RNA, 20 nt, Human
agaauucuuacccuuugaug

SEQ ID NO: 415595 - RNA, 22 nt, Human
ggggccagcaauguugaggaau

SEQ ID NO: 415596 - RNA, 22 nt, Human
cugcaggcaucuaacugugggc

SEQ ID NO: 415597 - RNA, 22 nt, Human
gagcgggaggaacggcucgggc

SEQ ID NO: 415598 - RNA, 22 nt, Human
gcagcuuucuacuuccuacagc

SEQ ID NO: 415599 - RNA, 22 nt, Human
ggcagauguuauaugaucugag

SEQ ID NO: 415600 - RNA, 22 nt, Human
agagcagcuggggcagagacca

SEQ ID NO: 415601 - RNA, 22 nt, Human
ugucucaguauacgaaacacuu

SEQ ID NO: 415602 - RNA, 22 nt, Human
gagcugggcacacgccacuuga

SEQ ID NO: 415603 - RNA, 22 nt, Human
ugucucagggcagcagcagggg

SEQ ID NO: 415604 - RNA, 17 nt, Human
acucaggaucugggagu

SEQ ID NO: 415605 - RNA, 22 nt, Human
gugugccaggaacuggcugcug

SEQ ID NO: 415606 - RNA, 18 nt, Human
cugccuguugcugagagg

SEQ ID NO: 415607 - RNA, 22 nt, Human
cagcuuuauuucacguguuugu

SEQ ID NO: 415608 - RNA, 21 nt, Human
gggccacaccuucugcagacc

SEQ ID NO: 415609 - RNA, 22 nt, Human
ugcuugggaauguggagucaga

SEQ ID NO: 415610 - RNA, 22 nt, Human
gcugggcuugguuucccugcuu

SEQ ID NO: 415611 - RNA, 20 nt, Human
ucauugcacauaauggaagc

SEQ ID NO: 415612 - RNA, 22 nt, Human
ugaaggugaaugucuaugggga

SEQ ID NO: 415613 - RNA, 22 nt, Human
gaaugcacuuccaacaucuauu

SEQ ID NO: 415614 - RNA, 22 nt, Human
agguuuauguuuggugcaggag

SEQ ID NO: 415615 - RNA, 22 nt, Human
ugaggaaguuguuucucuucua

SEQ ID NO: 415616 - RNA, 22 nt, Human
aggcccugcuuuccagagcuca

SEQ ID NO: 415617 - RNA, 22 nt, Human
gcucacugccauucucuagaug

SEQ ID NO: 415618 - RNA, 18 nt, Human
ucagcuggggcugcagcc

SEQ ID NO: 415619 - RNA, 18 nt, Human
ugcucuggucucacuugg

SEQ ID NO: 415620 - RNA, 22 nt, Human
ccagcccugucaccaacuggag

SEQ ID NO: 415621 - RNA, 22 nt, Human
ugaaggccuaacuuccagugcu

SEQ ID NO: 415622 - RNA, 22 nt, Human
ucucugggugauggcagggcac

SEQ ID NO: 415623 - RNA, 22 nt, Human
agcugagccagcagcaacagga

SEQ ID NO: 415624 - RNA, 22 nt, Human
uggaggaauaacagcaaccuua

SEQ ID NO: 415625 - RNA, 22 nt, Human
cuguguggacugguugaggccc

SEQ ID NO: 415626 - RNA, 22 nt, Human
ccuggagauuauuugguccaau

SEQ ID NO: 415627 - RNA, 22 nt, Human
aggccugagguuccugugcuca

SEQ ID NO: 415628 - RNA, 22 nt, Human
ugaagcaggaaacuucuuguuu

SEQ ID NO: 415629 - RNA, 22 nt, Human
ggcucuggagacauguggagag

SEQ ID NO: 415630 - RNA, 22 nt, Human
agcagcucuguuuaccuggagg

SEQ ID NO: 415631 - RNA, 22 nt, Human
cuuccuguugucacagucugcg

SEQ ID NO: 415632 - RNA, 22 nt, Human
agccuucauaaucuugggcuuu

SEQ ID NO: 415633 - RNA, 22 nt, Human
acugcuuacaaaaggaaagaau

SEQ ID NO: 415634 - RNA, 22 nt, Human
ucuugccucuuccccuuuccau

SEQ ID NO: 415635 - RNA, 22 nt, Human
auacaaagcuaaauaugguuuc

SEQ ID NO: 415636 - RNA, 22 nt, Human
gcagguggauuaucagaagugc

SEQ ID NO: 415637 - RNA, 22 nt, Human
ugauuucauaguauauacauga

SEQ ID NO: 415638 - RNA, 22 nt, Human
ccacugucuuuuccaggcugaa

SEQ ID NO: 415639 - RNA, 22 nt, Human
aaacucuguagcuaaacauaau

SEQ ID NO: 415640 - RNA, 22 nt, Human
aggugucugugaugggagcgau

SEQ ID NO: 415641 - RNA, 22 nt, Human
uuuuuccuagcgauuugucagc

SEQ ID NO: 415642 - RNA, 20 nt, Human
cugagcgucuaagaggugag

SEQ ID NO: 415643 - RNA, 22 nt, Human
agauacauuguucuaagcauug

SEQ ID NO: 415644 - RNA, 22 nt, Human
ugucaaauuuuuauugcaguau

SEQ ID NO: 415645 - RNA, 22 nt, Human
cugggccagggaggugucugua

SEQ ID NO: 415646 - RNA, 22 nt, Human
ugaagccaucccucagauggcc

SEQ ID NO: 415647 - RNA, 22 nt, Human
aagcagcuuaaauuagagccug

SEQ ID NO: 415648 - RNA, 22 nt, Human
cuggcuccacucccugccugac

SEQ ID NO: 415649 - RNA, 20 nt, Human
agucccagaucaaauuucug

SEQ ID NO: 415650 - RNA, 22 nt, Human
aacaaauggaacacaaaucuuu

SEQ ID NO: 415651 - RNA, 18 nt, Human
acugugguuuauguguag

SEQ ID NO: 415652 - RNA, 22 nt, Human
agguaacacuacuuaguauacu

SEQ ID NO: 415653 - RNA, 19 nt, Human
aucagcaagguaggaugug

SEQ ID NO: 415654 - RNA, 20 nt, Human
cuguagggugcagcaggcuc

SEQ ID NO: 415655 - RNA, 22 nt, Human
gagagcuguguucauucuacca

SEQ ID NO: 415656 - RNA, 22 nt, Human
aaauuucuggaagugucagagu

SEQ ID NO: 415657 - RNA, 22 nt, Human
gccugccuguuggcugaggugc

SEQ ID NO: 415658 - RNA, 22 nt, Human
cacaaugcguacauauaucaaa

SEQ ID NO: 415659 - RNA, 22 nt, Human
gagaagguggaccugaaggagc

SEQ ID NO: 415660 - RNA, 22 nt, Human
aaaguucagugccuucuauaca

SEQ ID NO: 415661 - RNA, 22 nt, Human
aguguacauguuuacagcaucu

SEQ ID NO: 415662 - RNA, 22 nt, Human
cagagccaggucuaggagucuc

SEQ ID NO: 415663 - RNA, 22 nt, Human
ugggcugcagggguugagagcu

SEQ ID NO: 415664 - RNA, 22 nt, Human
gcacaugagcugcugggauggg

SEQ ID NO: 415665 - RNA, 21 nt, Human
ccagcuccaggaccuuggauc

SEQ ID NO: 415666 - RNA, 22 nt, Human
cuggagcccugaaugggcagga

SEQ ID NO: 415667 - RNA, 22 nt, Human
uggcucagugcauucacaguaa

SEQ ID NO: 415668 - RNA, 22 nt, Human
ugccugggccucugaggaaggc

SEQ ID NO: 415669 - RNA, 22 nt, Human
cacaagucuguggucuccaaca

SEQ ID NO: 415670 - RNA, 20 nt, Human
agcaagaguaaggacagcga

SEQ ID NO: 415671 - RNA, 22 nt, Human
aggcaguuuaggcagcgauuua

SEQ ID NO: 415672 - RNA, 23 nt, Human
agaaaaguucauaccuuuuuaac

SEQ ID NO: 415673 - RNA, 22 nt, Human
aguuuguaucaauuugcuuuau

SEQ ID NO: 415674 - RNA, 22 nt, Human
agcaugcugguguucauggcag

SEQ ID NO: 415675 - RNA, 21 nt, Human
ucccacucuaaauggacugaa

SEQ ID NO: 415676 - RNA, 22 nt, Human
ugucacauguguggcauuuuuc

SEQ ID NO: 415677 - RNA, 22 nt, Human
gcagauggcagcccaggcuggg

SEQ ID NO: 415678 - RNA, 22 nt, Human
ucauuuguucucauucucuacu

SEQ ID NO: 415679 - RNA, 22 nt, Human
gggccugugcacaguucuguua

SEQ ID NO: 415680 - RNA, 21 nt, Human
cacaagacacauaggguguuu

SEQ ID NO: 415681 - RNA, 22 nt, Human
cugcagugcaagcccagaugga

SEQ ID NO: 415682 - RNA, 22 nt, Human
ucucugguggcuccaucaguag

SEQ ID NO: 415683 - RNA, 22 nt, Human
uggccgggccgggcgccuccac

SEQ ID NO: 415684 - RNA, 22 nt, Human
aaggcaguacuuuauguccaua

SEQ ID NO: 415685 - RNA, 22 nt, Human
ugcagggcacacgcacgggugu

SEQ ID NO: 415686 - RNA, 22 nt, Human
auuucucagugaaaugacaggc

SEQ ID NO: 415687 - RNA, 22 nt, Human
gcagccagccccucugaccucu

SEQ ID NO: 415688 - RNA, 22 nt, Human
aagggcugaaagaccuugggca

SEQ ID NO: 415689 - RNA, 22 nt, Human
cauuucugucacguucuuuuau

SEQ ID NO: 415690 - RNA, 22 nt, Human
ugagcuggucuugaguguagcu

SEQ ID NO: 415691 - RNA, 19 nt, Human
uucuaccuuacuguaggcu

SEQ ID NO: 415692 - RNA, 22 nt, Human
agccugagagccaagcugugca

SEQ ID NO: 415693 - RNA, 20 nt, Human
gucucaaguaucucacaguc

SEQ ID NO: 415694 - RNA, 22 nt, Human
aaaugucuguuagucauaucau

SEQ ID NO: 415695 - RNA, 23 nt, Human
aacaauagguuuuggcagaauag

SEQ ID NO: 415696 - RNA, 22 nt, Human
caaggccagggaauuuuucugg

SEQ ID NO: 415697 - RNA, 22 nt, Human
uggcagagaaccugggcuuugu

SEQ ID NO: 415698 - RNA, 22 nt, Human
acaggugaccugcucauaugaa

SEQ ID NO: 415699 - RNA, 22 nt, Human
uaucuacuccucuuucagaugc

SEQ ID NO: 415700 - RNA, 22 nt, Human
caagacaagaucuaagcaugcu

SEQ ID NO: 415701 - RNA, 22 nt, Human
gugugcagggggccagcgcagc

SEQ ID NO: 415702 - RNA, 22 nt, Human
aaggugaaacuggaagcuggcc

SEQ ID NO: 415703 - RNA, 22 nt, Human
cagcccuguccagcagagggug

SEQ ID NO: 415704 - RNA, 22 nt, Human
cucccagguuacaucugagccu

SEQ ID NO: 415705 - RNA, 22 nt, Human
ggcuucuccccuuugagucuuc

SEQ ID NO: 415706 - RNA, 22 nt, Human
uuuccuuugcccaauacauguc

SEQ ID NO: 415707 - RNA, 22 nt, Human
ggcagagcuugcagugagccga

SEQ ID NO: 415708 - RNA, 22 nt, Human
ccucagagccuccagaaggaau

SEQ ID NO: 415709 - RNA, 22 nt, Human
gcuguacauucugcacaggccc

SEQ ID NO: 415710 - RNA, 22 nt, Human
uugaagcauuugcuauagcauu

SEQ ID NO: 415711 - RNA, 22 nt, Human
agggcucccgcgguguccggga

SEQ ID NO: 415712 - RNA, 22 nt, Human
uggcagagcuggcugcggauga

SEQ ID NO: 415713 - RNA, 22 nt, Human
gugcugucaauugcuuucagua

SEQ ID NO: 415714 - RNA, 18 nt, Human
uuuuacucauagcaggcc

SEQ ID NO: 415715 - RNA, 23 nt, Human
agaugagccaacaccuccaugcc

SEQ ID NO: 415716 - RNA, 22 nt, Human
uguggcucucagauccuccaau

SEQ ID NO: 415717 - RNA, 22 nt, Human
cuggcagcuggaggcuagaggc

SEQ ID NO: 415718 - RNA, 22 nt, Human
uuaagucacuuaucuaaagaca

SEQ ID NO: 415719 - RNA, 22 nt, Human
uuucacauuuuauacuuaagcc

SEQ ID NO: 415720 - RNA, 21 nt, Human
uguggcagauguugggaggca

SEQ ID NO: 415721 - RNA, 22 nt, Human
agugcugucuccuucccccggg

SEQ ID NO: 415722 - RNA, 22 nt, Human
cuggcugcuuguagacucgacu

SEQ ID NO: 415723 - RNA, 22 nt, Human
aggcucaguauagcuggcaagu

SEQ ID NO: 415724 - RNA, 22 nt, Human
uuucaaagguggaagagugaau

SEQ ID NO: 415725 - RNA, 22 nt, Human
ccugccugacagagaagguuca

SEQ ID NO: 415726 - RNA, 22 nt, Human
ccuggcagcgccgaagcuggcc

SEQ ID NO: 415727 - RNA, 22 nt, Human
aaugcuuuaauugcauguagug

SEQ ID NO: 415728 - RNA, 22 nt, Human
agccaacuaggagauuaaggua

SEQ ID NO: 415729 - RNA, 22 nt, Human
ugcaauaaguuguguuaucacu

SEQ ID NO: 415730 - RNA, 22 nt, Human
aaggucauuuuuuccucuguug

SEQ ID NO: 415731 - RNA, 22 nt, Human
cagggcucaggcucugggauuc

SEQ ID NO: 415732 - RNA, 23 nt, Human
caugggagugagaaugccagcuc

SEQ ID NO: 415733 - RNA, 22 nt, Human
cggggcaggagucccuguagag

SEQ ID NO: 415734 - RNA, 22 nt, Human
gcagggacagggcagggccuuu

SEQ ID NO: 415735 - RNA, 22 nt, Human
gguccccagcaguggcugcuuc

SEQ ID NO: 415736 - RNA, 22 nt, Human
augugaaagagguguucagugg

SEQ ID NO: 415737 - RNA, 22 nt, Human
cucccaagggguaagggagcug

SEQ ID NO: 415738 - RNA, 23 nt, Human
uggagcugggcucagacccuggg

SEQ ID NO: 415739 - RNA, 22 nt, Human
ugggcugcagagcccggccuuc

SEQ ID NO: 415740 - RNA, 18 nt, Human
ugucauugccagggaagc

SEQ ID NO: 415741 - RNA, 22 nt, Human
aucaggaugcugucaguuacca

SEQ ID NO: 415742 - RNA, 22 nt, Human
aaugcacaugccacauguggua

SEQ ID NO: 415743 - RNA, 22 nt, Human
ggucagcagugcagggcagagc

SEQ ID NO: 415744 - RNA, 22 nt, Human
uugaggaguguuuagggugagg

SEQ ID NO: 415745 - RNA, 23 nt, Human
cacacccaucacuaagagcuccu

SEQ ID NO: 415746 - RNA, 20 nt, Human
cugagcccccagccugcagg

SEQ ID NO: 415747 - RNA, 22 nt, Human
uucaggauucugugucugacaa

SEQ ID NO: 415748 - RNA, 23 nt, Human
ugcagcugccucuggcgggccgg

SEQ ID NO: 415749 - RNA, 22 nt, Human
aguguggguuuuauggagcccu

SEQ ID NO: 415750 - RNA, 22 nt, Human
acugagcucuugacugggaguu

SEQ ID NO: 415751 - RNA, 22 nt, Human
uagaaacagaaaacuguaauag

SEQ ID NO: 415752 - RNA, 22 nt, Human
uuaacauuguccuuagcagauu

SEQ ID NO: 415753 - RNA, 22 nt, Human
guggggaaaggaguggggcuca

SEQ ID NO: 415754 - RNA, 20 nt, Human
ggggcccaagcccucuugcc

SEQ ID NO: 415755 - RNA, 22 nt, Human
uuucaaauagaaucuuuccaaa

SEQ ID NO: 415756 - RNA, 22 nt, Human
ccugucugcaugagugagcaua

SEQ ID NO: 415757 - RNA, 22 nt, Human
ccagcccugccagagagagcug

SEQ ID NO: 415758 - RNA, 22 nt, Human
cacugaagaugcgacuagugcu

SEQ ID NO: 415759 - RNA, 22 nt, Human
uggccucugggaaagcagauuc

SEQ ID NO: 415760 - RNA, 22 nt, Human
ugaagcagauggucuggucauu

SEQ ID NO: 415761 - RNA, 22 nt, Human
uggcagaguaggauggcccugu

SEQ ID NO: 415762 - RNA, 22 nt, Human
agcagagaagacacaggcuuca

SEQ ID NO: 415763 - RNA, 22 nt, Human
aggagcugucagagugccagag

SEQ ID NO: 415764 - RNA, 22 nt, Human
gguggguuuggaagagcaggcu

SEQ ID NO: 415765 - RNA, 22 nt, Human
ccacagcugaccgcaggugagc

SEQ ID NO: 415766 - RNA, 22 nt, Human
gcuccuggcuccaggcagccaa

SEQ ID NO: 415767 - RNA, 22 nt, Human
cagggcucugccuugagggaug

SEQ ID NO: 415768 - RNA, 22 nt, Human
ugcuucucccaaccagggccug

SEQ ID NO: 415769 - RNA, 20 nt, Human
gcagagcuguucugugggga

SEQ ID NO: 415770 - RNA, 22 nt, Human
uccugcaguuacaucccagcca

SEQ ID NO: 415771 - RNA, 20 nt, Human
uauuuguauuugggaaaguu

SEQ ID NO: 415772 - RNA, 22 nt, Human
gcuguccucuuggacucagggc

SEQ ID NO: 415773 - RNA, 22 nt, Human
caggaugagaggcccagggaag

SEQ ID NO: 415774 - RNA, 22 nt, Human
uuugcauuuugauaagaucacu

SEQ ID NO: 415775 - RNA, 22 nt, Human
agcuuuauauuuaaugaauucu

SEQ ID NO: 415776 - RNA, 22 nt, Human
ugggaccugcuccuggaaugag

SEQ ID NO: 415777 - RNA, 22 nt, Human
gguuucaacuuuugugaggaau

SEQ ID NO: 415778 - RNA, 22 nt, Human
gaauucugguuuugaaaugaau

SEQ ID NO: 415779 - RNA, 22 nt, Human
cugcagcuguagaggacagugg

SEQ ID NO: 415780 - RNA, 22 nt, Human
gcugcagcagaaguucucagag

SEQ ID NO: 415781 - RNA, 22 nt, Human
uugaacagcuguuacauuguua

SEQ ID NO: 415782 - RNA, 17 nt, Human
ggcugcugugcuggugc

SEQ ID NO: 415783 - RNA, 22 nt, Human
caaggccacuccagagacuggu

SEQ ID NO: 415784 - RNA, 22 nt, Human
acaguggaagaagcacugaacu

SEQ ID NO: 415785 - RNA, 22 nt, Human
agcugcuguggggcucggccug

SEQ ID NO: 415786 - RNA, 23 nt, Human
uggcccugaaucuguccuggagg

SEQ ID NO: 415787 - RNA, 23 nt, Human
cagaccuggcagucauccucaac

SEQ ID NO: 415788 - RNA, 22 nt, Human
aaagcagcagcaccugcauuuc

SEQ ID NO: 415789 - RNA, 22 nt, Human
ccagaagagaucacaguucuug

SEQ ID NO: 415790 - RNA, 22 nt, Human
guccucuguagggcugggccac

SEQ ID NO: 415791 - RNA, 21 nt, Human
uagggcucuauuuuuauuuca

SEQ ID NO: 415792 - RNA, 22 nt, Human
ucagcaguguaguuuaucauuc

SEQ ID NO: 415793 - RNA, 19 nt, Human
uuucaauggcuuagagaaa

SEQ ID NO: 415794 - RNA, 18 nt, Human
aggccugggaagcugagg

SEQ ID NO: 415795 - RNA, 22 nt, Human
agucccagaugacccagcuacu

SEQ ID NO: 415796 - RNA, 22 nt, Human
aggugaaguugaggaggcagaa

SEQ ID NO: 415797 - RNA, 18 nt, Human
cgaggcaggcggaucacg

SEQ ID NO: 415798 - RNA, 22 nt, Human
guggccugccgugugguauggg

SEQ ID NO: 415799 - RNA, 19 nt, Human
ccuggaggugaagguucuc

SEQ ID NO: 415800 - RNA, 22 nt, Human
gggggcuggaauauccaucaac

SEQ ID NO: 415801 - RNA, 22 nt, Human
cuccuguauguugggcuucaca

SEQ ID NO: 415802 - RNA, 21 nt, Human
aggcucagcagguguauaaag

SEQ ID NO: 415803 - RNA, 22 nt, Human
ccacccagaccagggaucuggg

SEQ ID NO: 415804 - RNA, 22 nt, Human
cacaugggugugccuggaggaa

SEQ ID NO: 415805 - RNA, 22 nt, Human
aaggcugaggagggccugcagg

SEQ ID NO: 415806 - RNA, 22 nt, Human
agcugucuccagauacaggauu

SEQ ID NO: 415807 - RNA, 22 nt, Human
gaggcacaguguuuggucagug

SEQ ID NO: 415808 - RNA, 22 nt, Human
ggggaccuucccagagcaguug

SEQ ID NO: 415809 - RNA, 22 nt, Human
uuuuucauauuccccucucugg

SEQ ID NO: 415810 - RNA, 22 nt, Human
ucaccagggagcuuguccucug

SEQ ID NO: 415811 - RNA, 22 nt, Human
cucugggcaggaccaguggacc

SEQ ID NO: 415812 - RNA, 22 nt, Human
ucugaacauccagcaaugcaca

SEQ ID NO: 415813 - RNA, 22 nt, Human
acccacgaagaugagcggcaug

SEQ ID NO: 415814 - RNA, 22 nt, Human
uuguaacagcugcuuaauagag

SEQ ID NO: 415815 - RNA, 22 nt, Human
aacacagcuaauuucugucaau

SEQ ID NO: 415816 - RNA, 22 nt, Human
uggcucagaggggaagugguuu

SEQ ID NO: 415817 - RNA, 20 nt, Human
ucagaugggagugagccauc

SEQ ID NO: 415818 - RNA, 22 nt, Human
guuauaaaugacugcaaaaguu

SEQ ID NO: 415819 - RNA, 20 nt, Human
ugcucugucuaaaacuuccc

SEQ ID NO: 415820 - RNA, 22 nt, Human
ucaagagacaggacguguuuca

SEQ ID NO: 415821 - RNA, 22 nt, Human
ugaggcaggaggauugcaggau

SEQ ID NO: 415822 - RNA, 22 nt, Human
agccaggauuggcugagccuua

SEQ ID NO: 415823 - RNA, 22 nt, Human
acagccuguguaccagcuggga

SEQ ID NO: 415824 - RNA, 22 nt, Human
uuccucagccagcacuuagggg

SEQ ID NO: 415825 - RNA, 22 nt, Human
uaaagcaggccacauaugugau

SEQ ID NO: 415826 - RNA, 20 nt, Human
cuguggcucaugcaucugcc

SEQ ID NO: 415827 - RNA, 21 nt, Human
gcagggacaaagcuucaggag

SEQ ID NO: 415828 - RNA, 22 nt, Human
ugggcagagucguggggaauag

SEQ ID NO: 415829 - RNA, 18 nt, Human
aggcacagagcauacaua

SEQ ID NO: 415830 - RNA, 22 nt, Human
cuggccucaccucagacuuacu

SEQ ID NO: 415831 - RNA, 22 nt, Human
caggccugagacaucugagaua

SEQ ID NO: 415832 - RNA, 22 nt, Human
ccagagcccagggucaugcagg

SEQ ID NO: 415833 - RNA, 22 nt, Human
aauaccuuuccugccauucacu

SEQ ID NO: 415834 - RNA, 22 nt, Human
gugggcaaggucccugccagcu

SEQ ID NO: 415835 - RNA, 22 nt, Human
gcugccaguaguuggagcucca

SEQ ID NO: 415836 - RNA, 22 nt, Human
cagugaggaagcugucuggacc

SEQ ID NO: 415837 - RNA, 22 nt, Human
caguacuuggucaaggaagcag

SEQ ID NO: 415838 - RNA, 22 nt, Human
ggagcugucuguagggcacagg

SEQ ID NO: 415839 - RNA, 22 nt, Human
uuggagcccugaggaucuggau

SEQ ID NO: 415840 - RNA, 22 nt, Human
ggccucaguuucuccauggguu

SEQ ID NO: 415841 - RNA, 22 nt, Human
gaggcucagagagguccacaua

SEQ ID NO: 415842 - RNA, 22 nt, Human
gggggacuaacuggauccugga

SEQ ID NO: 415843 - RNA, 22 nt, Human
aagcccagcugaaagcauuuuu

SEQ ID NO: 415844 - RNA, 22 nt, Human
uuuguuuagaugguaaaucagu

SEQ ID NO: 415845 - RNA, 22 nt, Human
gcugagcuagcuaucucagucu

SEQ ID NO: 415846 - RNA, 22 nt, Human
cgucccaguuccagccgcgcug

SEQ ID NO: 415847 - RNA, 22 nt, Human
gagcucagauucuggugucaga

SEQ ID NO: 415848 - RNA, 19 nt, Human
ugucucagugucccuuccu

SEQ ID NO: 415849 - RNA, 22 nt, Human
cagcuggcaaguggagcagggu

SEQ ID NO: 415850 - RNA, 22 nt, Human
auaauuuacuaagcucuaccuu

SEQ ID NO: 415851 - RNA, 22 nt, Human
uggcccuguggaggucagugag

SEQ ID NO: 415852 - RNA, 22 nt, Human
aaagaaauagauggcauuuaaa

SEQ ID NO: 415853 - RNA, 22 nt, Human
gggaggaaggcuugggugagua

SEQ ID NO: 415854 - RNA, 22 nt, Human
acagaauuaucaggaaauguua

SEQ ID NO: 415855 - RNA, 22 nt, Human
ccaaggaguagagcaggaagcu

SEQ ID NO: 415856 - RNA, 22 nt, Human
gugggccucuugaggguggcua

SEQ ID NO: 415857 - RNA, 22 nt, Human
agguggcuccucccauggcugg

SEQ ID NO: 415858 - RNA, 15 nt, Human
uucaggauaugacuc

SEQ ID NO: 415859 - RNA, 22 nt, Human
gagccuguguuuccuguagcca

SEQ ID NO: 415860 - RNA, 22 nt, Human
acagucauagcagccuuuguua

SEQ ID NO: 415861 - RNA, 22 nt, Human
agcagcauucucugguaugggg

SEQ ID NO: 415862 - RNA, 22 nt, Human
ugggauggagccugaguauagu

SEQ ID NO: 415863 - RNA, 22 nt, Human
ggcacugaaguggguguugggu

SEQ ID NO: 415864 - RNA, 22 nt, Human
agcugguggauuaugcuguaca

SEQ ID NO: 415865 - RNA, 22 nt, Human
ccagcugcagguguuccagaug

SEQ ID NO: 415866 - RNA, 22 nt, Human
ucuggcucccagccugcucuca

SEQ ID NO: 415867 - RNA, 17 nt, Human
ccucccacaccgcccug

SEQ ID NO: 415868 - RNA, 22 nt, Human
aguccuucaagaaaucuggaaa

SEQ ID NO: 415869 - RNA, 22 nt, Human
ccucccucuguuagagcugucu

SEQ ID NO: 415870 - RNA, 22 nt, Human
guccuuugaaggcaaaaggaga

SEQ ID NO: 415871 - RNA, 22 nt, Human
ugacauuuaagccucugauuuc

SEQ ID NO: 415872 - RNA, 22 nt, Human
ccugggugacccgugagcgucc

SEQ ID NO: 415873 - RNA, 22 nt, Human
auguccagccaaccacuggauu

SEQ ID NO: 415874 - RNA, 22 nt, Human
guguauaacuaucuaucuagua

SEQ ID NO: 415875 - RNA, 22 nt, Human
ugaggcagcauucuucaagaca

SEQ ID NO: 415876 - RNA, 22 nt, Human
ggcuuuauuugcagccauuguu

SEQ ID NO: 415877 - RNA, 22 nt, Human
gaaaguuugccucucucuugag

SEQ ID NO: 415878 - RNA, 22 nt, Human
uuuguuuucaaugugucauuca

SEQ ID NO: 415879 - RNA, 22 nt, Human
uuagggacaaauuugcagaacc

SEQ ID NO: 415880 - RNA, 22 nt, Human
guaucuuuuacaccaggaaauu

SEQ ID NO: 415881 - RNA, 22 nt, Human
acaguggagaagcaaaugcagu

SEQ ID NO: 415882 - RNA, 22 nt, Human
aggguagggcccggagacagac

SEQ ID NO: 415883 - RNA, 22 nt, Human
agggacccugaugacugaggag

SEQ ID NO: 415884 - RNA, 22 nt, Human
acagaacugggaaaugcacaua

SEQ ID NO: 415885 - RNA, 22 nt, Human
aggcgcaggguuuggacccagg

SEQ ID NO: 415886 - RNA, 22 nt, Human
guucagggagggacagaugaag

SEQ ID NO: 415887 - RNA, 22 nt, Human
ucucugucccuaggagccuugc

SEQ ID NO: 415888 - RNA, 22 nt, Human
uucaggaugaaagugugcaaca

SEQ ID NO: 415889 - RNA, 22 nt, Human
agggugucagccacggaauggg

SEQ ID NO: 415890 - RNA, 22 nt, Human
ccugggagggcaagugcugaug

SEQ ID NO: 415891 - RNA, 22 nt, Human
ccagggccaguaagauuggcau

SEQ ID NO: 415892 - RNA, 22 nt, Human
cuuauguaaaacggaaagggaa

SEQ ID NO: 415893 - RNA, 22 nt, Human
aaaugcauguagaauaauagag

SEQ ID NO: 415894 - RNA, 22 nt, Human
gauaugaaguggcauugugaag

SEQ ID NO: 415895 - RNA, 22 nt, Human
ucccugcagacguccugcgggu

SEQ ID NO: 415896 - RNA, 22 nt, Human
cccuggcauaaaacuucuccag

SEQ ID NO: 415897 - RNA, 22 nt, Human
uuaauaaacaggugcagcugaa

SEQ ID NO: 415898 - RNA, 22 nt, Human
guggguggaggcgucgagggca

SEQ ID NO: 415899 - RNA, 20 nt, Human
aggcugagggugauuguguc

SEQ ID NO: 415900 - RNA, 22 nt, Human
uaaggccauuauggugggcccg

SEQ ID NO: 415901 - RNA, 22 nt, Human
ucauaacagcuaagucccuuuc

SEQ ID NO: 415902 - RNA, 22 nt, Human
ugcuucaggagaugucaccaug

SEQ ID NO: 415903 - RNA, 22 nt, Human
guuaauuuaguagaguccagau

SEQ ID NO: 415904 - RNA, 22 nt, Human
gggagcuggagcuggaagacuc

SEQ ID NO: 415905 - RNA, 22 nt, Human
ucagaggacaagcucccuggug

SEQ ID NO: 415906 - RNA, 22 nt, Human
cagggcucagggacugcagaaa

SEQ ID NO: 415907 - RNA, 22 nt, Human
agcagggcuuuggcuggcuuuc

SEQ ID NO: 415908 - RNA, 22 nt, Human
cugggcugucaauggcccucug

SEQ ID NO: 415909 - RNA, 22 nt, Human
ccucccaccauuuagagagagc

SEQ ID NO: 415910 - RNA, 22 nt, Human
caaagugcugagauuacaggua

SEQ ID NO: 415911 - RNA, 22 nt, Human
gcagcuguguaaugagcccaca

SEQ ID NO: 415912 - RNA, 22 nt, Human
uguguauucagcaagcgaaaca

SEQ ID NO: 415913 - RNA, 22 nt, Human
acaaacuaccuacagauguuca

SEQ ID NO: 415914 - RNA, 17 nt, Human
ccagagcuacugagacu

SEQ ID NO: 415915 - RNA, 22 nt, Human
agucucugcacaguaagaagca

SEQ ID NO: 415916 - RNA, 23 nt, Human
uaagaacagacaagcauuuacau

SEQ ID NO: 415917 - RNA, 22 nt, Human
agcuugccucuuaaucaccuca

SEQ ID NO: 415918 - RNA, 22 nt, Human
acagggcagagugaaaugcuau

SEQ ID NO: 415919 - RNA, 22 nt, Human
agccagccaguucacuaggaaa

SEQ ID NO: 415920 - RNA, 22 nt, Human
cagggagaucuuggcuccuggu

SEQ ID NO: 415921 - RNA, 22 nt, Human
ugaauccagagcuauuucgucc

SEQ ID NO: 415922 - RNA, 22 nt, Human
cugccuggccugaucuccacgc

SEQ ID NO: 415923 - RNA, 22 nt, Human
uaaaguucagugcaugaaugug

SEQ ID NO: 415924 - RNA, 22 nt, Human
agcaaagucaguggaaccaucc

SEQ ID NO: 415925 - RNA, 22 nt, Human
acuuucuccagaaaaccaagga

SEQ ID NO: 415926 - RNA, 19 nt, Human
aggcagaggcuuggcuagc

SEQ ID NO: 415927 - RNA, 23 nt, Human
ccagcccuccaccagcucuaggc

SEQ ID NO: 415928 - RNA, 22 nt, Human
uucuggaaguguuagaaucugg

SEQ ID NO: 415929 - RNA, 22 nt, Human
aagugguaggaagagagcacug

SEQ ID NO: 415930 - RNA, 23 nt, Human
ugggaguguugggaucucugcuc

SEQ ID NO: 415931 - RNA, 20 nt, Human
agaggccaguuaggagucua

SEQ ID NO: 415932 - RNA, 22 nt, Human
aaggcaggaugggaaaagauuu

SEQ ID NO: 415933 - RNA, 22 nt, Human
auguccagggcacacagcagug

SEQ ID NO: 415934 - RNA, 18 nt, Human
guucaaggucaagagaga

SEQ ID NO: 415935 - RNA, 22 nt, Human
cuggcucaguucuugguuuuca

SEQ ID NO: 415936 - RNA, 22 nt, Human
aucuggcucucucauuuacaaa

SEQ ID NO: 415937 - RNA, 20 nt, Human
ugcagaagaacguucugguu

SEQ ID NO: 415938 - RNA, 22 nt, Human
ccagaggcauguucaaagcaau

SEQ ID NO: 415939 - RNA, 22 nt, Human
aaaauaacuucuacuauuugca

SEQ ID NO: 415940 - RNA, 23 nt, Human
uggcugagguccagguaguuuca

SEQ ID NO: 415941 - RNA, 22 nt, Human
cacauaauugaacgugaugagu

SEQ ID NO: 415942 - RNA, 22 nt, Human
caguuucucucauacauauuug

SEQ ID NO: 415943 - RNA, 22 nt, Human
uggugugggcguggcaggcaag

SEQ ID NO: 415944 - RNA, 22 nt, Human
agaggaggcucugggaucgucc

SEQ ID NO: 415945 - RNA, 22 nt, Human
cugagccaaccacagcaggagc

SEQ ID NO: 415946 - RNA, 22 nt, Human
uggaagcacuuggguuuuguug

SEQ ID NO: 415947 - RNA, 22 nt, Human
aucaggaucugcaucauaagaa

SEQ ID NO: 415948 - RNA, 22 nt, Human
acagggccauuaucuguucuag

SEQ ID NO: 415949 - RNA, 22 nt, Human
gccagccugugcuuggccaggc

SEQ ID NO: 415950 - RNA, 20 nt, Human
ugcugcaguuucaugggacu

SEQ ID NO: 415951 - RNA, 22 nt, Human
aaaggccaauaaagacaagcug

SEQ ID NO: 415952 - RNA, 21 nt, Human
agggagcuauuuauaguaagc

SEQ ID NO: 415953 - RNA, 22 nt, Human
ggcugugggaugcauaggagcu

SEQ ID NO: 415954 - RNA, 22 nt, Human
uuucacauguggaaugccaggu

SEQ ID NO: 415955 - RNA, 22 nt, Human
uauuucugauugcucaugaggc

SEQ ID NO: 415956 - RNA, 22 nt, Human
uuuauuauagugguggggacug

SEQ ID NO: 415957 - RNA, 22 nt, Human
uagaaacucaggauacucuucc

SEQ ID NO: 415958 - RNA, 22 nt, Human
auaucuuuuagagcaagcuugu

SEQ ID NO: 415959 - RNA, 22 nt, Human
uuccucucucuugccagaaugu

SEQ ID NO: 415960 - RNA, 22 nt, Human
agacaaguucugugggucaccu

SEQ ID NO: 415961 - RNA, 22 nt, Human
cagaauuugaaguaauauucca

SEQ ID NO: 415962 - RNA, 22 nt, Human
ugccagcacuucuggcugucug

SEQ ID NO: 415963 - RNA, 17 nt, Human
ggaaaaggaugauacag

SEQ ID NO: 415964 - RNA, 22 nt, Human
gggcuggaucuccugcaggcag

SEQ ID NO: 415965 - RNA, 22 nt, Human
ucccagaggacuguuggugcua

SEQ ID NO: 415966 - RNA, 22 nt, Human
gccugagagucugcauuucuaa

SEQ ID NO: 415967 - RNA, 22 nt, Human
uccugagauucugcauuucuaa

SEQ ID NO: 415968 - RNA, 22 nt, Human
aaugaacacagcccucuacuuu

SEQ ID NO: 415969 - RNA, 22 nt, Human
ugggcacuggaagccugcugug

SEQ ID NO: 415970 - RNA, 22 nt, Human
gcaggcaggcuuccuugaacug

SEQ ID NO: 415971 - RNA, 22 nt, Human
caggcagcugcgacaagagagc

SEQ ID NO: 415972 - RNA, 22 nt, Human
ucauauuuaggccuuuaauuca

SEQ ID NO: 415973 - RNA, 22 nt, Human
ugcacaucuuucagcaucauac

SEQ ID NO: 415974 - RNA, 22 nt, Human
aagaagagaaaugugcugcugg

SEQ ID NO: 415975 - RNA, 22 nt, Human
acagagcauuugggacagagag

SEQ ID NO: 415976 - RNA, 22 nt, Human
acauacuuaacauuaaagucau

SEQ ID NO: 415977 - RNA, 22 nt, Human
ccugccugauuccaggauggcu

SEQ ID NO: 415978 - RNA, 22 nt, Human
caagagcugugaccucauucac

SEQ ID NO: 415979 - RNA, 22 nt, Human
gccuggcaaggcccuguugacu

SEQ ID NO: 415980 - RNA, 22 nt, Human
gcccuggccuucaucucagaca

SEQ ID NO: 415981 - RNA, 22 nt, Human
uccagccaugacucggacagug

SEQ ID NO: 415982 - RNA, 22 nt, Human
gcagcugcuggaaguuccugcc

SEQ ID NO: 415983 - RNA, 22 nt, Human
gaaacccaaacuaagacaguag

SEQ ID NO: 415984 - RNA, 22 nt, Human
ccugguguugugaaguagccgu

SEQ ID NO: 415985 - RNA, 22 nt, Human
gcugucuggguugagggcccug

SEQ ID NO: 415986 - RNA, 22 nt, Human
auguaacacccacuuuuauagc

SEQ ID NO: 415987 - RNA, 22 nt, Human
acugcagacucuacaguuauaa

SEQ ID NO: 415988 - RNA, 22 nt, Human
guccaggucuggacccugagcc

SEQ ID NO: 415989 - RNA, 22 nt, Human
ucccuggggauguuggccugcc

SEQ ID NO: 415990 - RNA, 22 nt, Human
agagcuggacgucugagcccua

SEQ ID NO: 415991 - RNA, 22 nt, Human
cagagcauugagggucugccaa

SEQ ID NO: 415992 - RNA, 19 nt, Human
uggcagaggacaaggacuu

SEQ ID NO: 415993 - RNA, 22 nt, Human
gcagccucagggcacucagaug

SEQ ID NO: 415994 - RNA, 22 nt, Human
uguggcugucuguucuccuagg

SEQ ID NO: 415995 - RNA, 22 nt, Human
gcuggccucuacaggccggcca

SEQ ID NO: 415996 - RNA, 22 nt, Human
ugcauuaugcuacccagaagcu

SEQ ID NO: 415997 - RNA, 22 nt, Human
auuccaguucuccucucuaaag

SEQ ID NO: 415998 - RNA, 22 nt, Human
gcugccucugcgacucugggcg

SEQ ID NO: 415999 - RNA, 22 nt, Human
cucccuggcacagcgagagguu

SEQ ID NO: 416000 - RNA, 22 nt, Human
uugcucuguaauaaucuggggu

SEQ ID NO: 416001 - RNA, 20 nt, Human
gugccuggagaagaggcugu

SEQ ID NO: 416002 - RNA, 22 nt, Human
gugccuggcacacagaaggcaa

SEQ ID NO: 416003 - RNA, 22 nt, Human
uggagaugaauauguguaccug

SEQ ID NO: 416004 - RNA, 22 nt, Human
cagagaaagggugaauuccuuc

SEQ ID NO: 416005 - RNA, 22 nt, Human
cuggcugggagcgagcugcuca

SEQ ID NO: 416006 - RNA, 22 nt, Human
cagggugacugcccuggccacu

SEQ ID NO: 416007 - RNA, 22 nt, Human
cuggaagguuccucccagcucc

SEQ ID NO: 416008 - RNA, 22 nt, Human
gucacuguuuccuauuauauuu

SEQ ID NO: 416009 - RNA, 22 nt, Human
ggauuucuuccuuccucagaag

SEQ ID NO: 416010 - RNA, 22 nt, Human
cagcagaggaaagcaaaucuaa

SEQ ID NO: 416011 - RNA, 22 nt, Human
gacaugcaugaaugcaggucuc

SEQ ID NO: 416012 - RNA, 22 nt, Human
uauuaguagcuugaaauuggug

SEQ ID NO: 416013 - RNA, 22 nt, Human
uggacaacauagugagaccuca

SEQ ID NO: 416014 - RNA, 22 nt, Human
uguguacucaauugagccauuu

SEQ ID NO: 416015 - RNA, 23 nt, Human
ggacagggcccugcccuauggcc

SEQ ID NO: 416016 - RNA, 22 nt, Human
cuggccugagaaugcuacccuu

SEQ ID NO: 416017 - RNA, 22 nt, Human
augggcagcugcagcaguggug

SEQ ID NO: 416018 - RNA, 22 nt, Human
ugaggcagguaagcaaguuuug

SEQ ID NO: 416019 - RNA, 22 nt, Human
ccugcacuaccuggggcugcug

SEQ ID NO: 416020 - RNA, 22 nt, Human
ucaggagucugugcaguuccac

SEQ ID NO: 416021 - RNA, 22 nt, Human
augauuuccaguuguugcuaag

SEQ ID NO: 416022 - RNA, 22 nt, Human
gccucugcccauccaccaucag

SEQ ID NO: 416023 - RNA, 17 nt, Human
gcacugaacaauccugu

SEQ ID NO: 416024 - RNA, 22 nt, Human
ugagaggcagaauggugccugc

SEQ ID NO: 416025 - RNA, 22 nt, Human
gccaggcuccaggcccuccuga

SEQ ID NO: 416026 - RNA, 22 nt, Human
acagcuuuugaaaaauuacugg

SEQ ID NO: 416027 - RNA, 22 nt, Human
uccaggcaaggauaauaaacau

SEQ ID NO: 416028 - RNA, 22 nt, Human
agggaccugucaaugacaguua

SEQ ID NO: 416029 - RNA, 22 nt, Human
aaggaagaagacucuuuacucc

SEQ ID NO: 416030 - RNA, 22 nt, Human
gagggacagcuaaagagaaauu

SEQ ID NO: 416031 - RNA, 20 nt, Human
aucaggauucuugcuuuguu

SEQ ID NO: 416032 - RNA, 22 nt, Human
cagggcucccugcagccucugu

SEQ ID NO: 416033 - RNA, 22 nt, Human
cacauaaguggguuccauugca

SEQ ID NO: 416034 - RNA, 23 nt, Human
uggggcugauggagacggaccag

SEQ ID NO: 416035 - RNA, 22 nt, Human
ggguccaggucuucaggcagag

SEQ ID NO: 416036 - RNA, 22 nt, Human
aagacagaccacgugacagggc

SEQ ID NO: 416037 - RNA, 22 nt, Human
agacaaagacagcaucucaggu

SEQ ID NO: 416038 - RNA, 22 nt, Human
aggaaggagggcagauauuaag

SEQ ID NO: 416039 - RNA, 22 nt, Human
ugcagcagguuccaaaggguua

SEQ ID NO: 416040 - RNA, 22 nt, Human
uuuucauugagcaccugaguaa

SEQ ID NO: 416041 - RNA, 22 nt, Human
guucuccauucagcuuccugug

SEQ ID NO: 416042 - RNA, 22 nt, Human
auccuuggaugugucuuuuugu

SEQ ID NO: 416043 - RNA, 22 nt, Human
gagcaggcauucuaguggcuga

SEQ ID NO: 416044 - RNA, 22 nt, Human
agagcagaggcauggccguggg

SEQ ID NO: 416045 - RNA, 22 nt, Human
cugugcauugucuugucuguag

SEQ ID NO: 416046 - RNA, 22 nt, Human
ccuccaggauaagucagggccu

SEQ ID NO: 416047 - RNA, 22 nt, Human
uggcagagccuugccaaacucc

SEQ ID NO: 416048 - RNA, 22 nt, Human
guuuacaacaucuuguccuuca

SEQ ID NO: 416049 - RNA, 22 nt, Human
ucacauacacuaggauauuuuu

SEQ ID NO: 416050 - RNA, 22 nt, Human
cuuuggaaaaauaccuggcaua

SEQ ID NO: 416051 - RNA, 22 nt, Human
ugggcagacugagcccuguccc

SEQ ID NO: 416052 - RNA, 22 nt, Human
cccagguggcagaagcugcagu

SEQ ID NO: 416053 - RNA, 22 nt, Human
cacagggcagguacucucagag

SEQ ID NO: 416054 - RNA, 22 nt, Human
guuuuacacaccuaugaaagac

SEQ ID NO: 416055 - RNA, 22 nt, Human
auucaagagcccauguuuccug

SEQ ID NO: 416056 - RNA, 22 nt, Human
cccuggaggcggauguugcagu

SEQ ID NO: 416057 - RNA, 22 nt, Human
cccuggaagguucucuggcuca

SEQ ID NO: 416058 - RNA, 22 nt, Human
aagagcaucaaugacucgcagu

SEQ ID NO: 416059 - RNA, 19 nt, Human
agugucaucagcuacucag

SEQ ID NO: 416060 - RNA, 22 nt, Human
gacagcaggagaucaugauaga

SEQ ID NO: 416061 - RNA, 22 nt, Human
cggcagagcggcgagccccucc

SEQ ID NO: 416062 - RNA, 22 nt, Human
cugccaaggcuggggaggacaa

SEQ ID NO: 416063 - RNA, 22 nt, Human
uagcugccuuugggcuccugcu

SEQ ID NO: 416064 - RNA, 22 nt, Human
gggaccuggggacuccuuguuc

SEQ ID NO: 416065 - RNA, 22 nt, Human
ggcucaggccagaccacgacuc

SEQ ID NO: 416066 - RNA, 22 nt, Human
agggucccgaaggagacagcaa

SEQ ID NO: 416067 - RNA, 22 nt, Human
ucaguuuucucaucuguaauuu

SEQ ID NO: 416068 - RNA, 22 nt, Human
ggcaguggcuccucucuacucc

SEQ ID NO: 416069 - RNA, 22 nt, Human
gcugccaccguggagaugagug

SEQ ID NO: 416070 - RNA, 22 nt, Human
ggcagcaguggcugcuauuguc

SEQ ID NO: 416071 - RNA, 22 nt, Human
cagagcuggggacuguuggaug

SEQ ID NO: 416072 - RNA, 22 nt, Human
gaaggaaaucugugauuuaugc

SEQ ID NO: 416073 - RNA, 22 nt, Human
cuccccagguucaggagguggg

SEQ ID NO: 416074 - RNA, 22 nt, Human
ggucauuguucuuuucugugau

SEQ ID NO: 416075 - RNA, 22 nt, Human
cagggugggcacccagccucca

SEQ ID NO: 416076 - RNA, 22 nt, Human
agaaaguuuugugcuauauaug

SEQ ID NO: 416077 - RNA, 22 nt, Human
uccauguggccagacacuggca

SEQ ID NO: 416078 - RNA, 22 nt, Human
aaaugcagguaguauuuauuuu

SEQ ID NO: 416079 - RNA, 22 nt, Human
aagucaaucacaugcacacuga

SEQ ID NO: 416080 - RNA, 22 nt, Human
ggcaugggccgaggugccuccu

SEQ ID NO: 416081 - RNA, 22 nt, Human
gcaggagagccagcaggcuucc

SEQ ID NO: 416082 - RNA, 22 nt, Human
ccuggcugcuuucacuauggag

SEQ ID NO: 416083 - RNA, 22 nt, Human
aaguuacuggcaagggcugcag

SEQ ID NO: 416084 - RNA, 22 nt, Human
cugggcagccucacacaauguu

SEQ ID NO: 416085 - RNA, 21 nt, Human
agcugcuuucagcuccuagag

SEQ ID NO: 416086 - RNA, 22 nt, Human
agaggucagaacaggaaagugu

SEQ ID NO: 416087 - RNA, 22 nt, Human
aaaagagucuuaggcagucaua

SEQ ID NO: 416088 - RNA, 22 nt, Human
aaggcacuguacuaguuaguua

SEQ ID NO: 416089 - RNA, 22 nt, Human
ucagcuuucuauguugcuaaac

SEQ ID NO: 416090 - RNA, 22 nt, Human
auaagaaacauuauucuuucca

SEQ ID NO: 416091 - RNA, 22 nt, Human
aggaggaauacaauccagcagc

SEQ ID NO: 416092 - RNA, 22 nt, Human
cugaggccuggugaggugguga

SEQ ID NO: 416093 - RNA, 22 nt, Human
aggcagggucuugcuauguugc

SEQ ID NO: 416094 - RNA, 22 nt, Human
gcugcugguccucagagcucau

SEQ ID NO: 416095 - RNA, 23 nt, Human
acuuuagauaaauuaugugcaca

SEQ ID NO: 416096 - RNA, 22 nt, Human
cagucccaaggaggaagcaguc

SEQ ID NO: 416097 - RNA, 22 nt, Human
uguguauuucuggaacagacua

SEQ ID NO: 416098 - RNA, 17 nt, Human
aggccagaugaggcaag

SEQ ID NO: 416099 - RNA, 22 nt, Human
aaguuaugaaauuuggacagcu

SEQ ID NO: 416100 - RNA, 19 nt, Human
guagggacagugguucuga

SEQ ID NO: 416101 - RNA, 22 nt, Human
ccucagagguguggcaucucug

SEQ ID NO: 416102 - RNA, 22 nt, Human
augcaguacagauaauucuaca

SEQ ID NO: 416103 - RNA, 22 nt, Human
aagacaugcaauuagcaaggaa

SEQ ID NO: 416104 - RNA, 22 nt, Human
uguaccuuuuucugugcaugcu

SEQ ID NO: 416105 - RNA, 22 nt, Human
cagggcaguaccgcccucuggc

SEQ ID NO: 416106 - RNA, 22 nt, Human
uccucagucguuugagccaaaa

SEQ ID NO: 416107 - RNA, 22 nt, Human
gcuggagccauuggcuuggccu

SEQ ID NO: 416108 - RNA, 20 nt, Human
gccagcccugacacaggagc

SEQ ID NO: 416109 - RNA, 22 nt, Human
cuguccucaccuuggcaggggg

SEQ ID NO: 416110 - RNA, 22 nt, Human
gggaccugccauugcucacagg

SEQ ID NO: 416111 - RNA, 22 nt, Human
cuguacauaaaggaauaggugu

SEQ ID NO: 416112 - RNA, 22 nt, Human
aggaggccgcugaugggcuccc

SEQ ID NO: 416113 - RNA, 22 nt, Human
ucaaaaguuucacauagagaua

SEQ ID NO: 416114 - RNA, 22 nt, Human
ccuggccaggcauggagucaca

SEQ ID NO: 416115 - RNA, 22 nt, Human
ggcagccagagggcagcuggau

SEQ ID NO: 416116 - RNA, 22 nt, Human
acagggcauuuccucuaugugu

SEQ ID NO: 416117 - RNA, 22 nt, Human
uaagaacauaaauucauacggg

SEQ ID NO: 416118 - RNA, 21 nt, Human
uguucacauggagcagaaugu

SEQ ID NO: 416119 - RNA, 22 nt, Human
uuaaauuccagccucauaauag

SEQ ID NO: 416120 - RNA, 22 nt, Human
cacagcagaaaguguaggagga

SEQ ID NO: 416121 - RNA, 22 nt, Human
acaaauuuauugaagggcauau

SEQ ID NO: 416122 - RNA, 22 nt, Human
aggugucuggauggguguccuu

SEQ ID NO: 416123 - RNA, 22 nt, Human
aggggcaguuccaaguuuugug

SEQ ID NO: 416124 - RNA, 22 nt, Human
cucuuaaaaacuugauauauuu

SEQ ID NO: 416125 - RNA, 22 nt, Human
ccaguucugacacaagcacagu

SEQ ID NO: 416126 - RNA, 17 nt, Human
uuccucucacauuuuuu

SEQ ID NO: 416127 - RNA, 22 nt, Human
uucucagauccaucagaagucc

SEQ ID NO: 416128 - RNA, 22 nt, Human
gccugccugaaggcuguaccag

SEQ ID NO: 416129 - RNA, 21 nt, Human
ucacaugcccauuacuggagc

SEQ ID NO: 416130 - RNA, 20 nt, Human
auauguguacguguauacau

SEQ ID NO: 416131 - RNA, 23 nt, Human
ggccauggagacuuagaaugggc

SEQ ID NO: 416132 - RNA, 22 nt, Human
ccucacagggccaggccccuca

SEQ ID NO: 416133 - RNA, 22 nt, Human
uaauuuauuucaacugccaagg

SEQ ID NO: 416134 - RNA, 22 nt, Human
guuauuaguaagacucgcacau

SEQ ID NO: 416135 - RNA, 22 nt, Human
cucuggcuucuaccuugcaguu

SEQ ID NO: 416136 - RNA, 22 nt, Human
uacauacacaaauauacuguuu

SEQ ID NO: 416137 - RNA, 22 nt, Human
acuccuggggauccauuccuuu

SEQ ID NO: 416138 - RNA, 22 nt, Human
agcagcucacaggauuccugaa

SEQ ID NO: 416139 - RNA, 22 nt, Human
ggcagcuuuuaucccugacaga

SEQ ID NO: 416140 - RNA, 22 nt, Human
cccugccugugggcaucaacau

SEQ ID NO: 416141 - RNA, 22 nt, Human
agcagggcuccauuucacugcc

SEQ ID NO: 416142 - RNA, 22 nt, Human
uaagaauuguguugaauagagu

SEQ ID NO: 416143 - RNA, 22 nt, Human
uauguuuuucaagugcacacua

SEQ ID NO: 416144 - RNA, 22 nt, Human
cccagacuccucuggcuggugg

SEQ ID NO: 416145 - RNA, 22 nt, Human
auaugugugaugcauggacuaa

SEQ ID NO: 416146 - RNA, 22 nt, Human
aauaauuuccagccaacuggaa

SEQ ID NO: 416147 - RNA, 22 nt, Human
gcuguguccucacacagccuuu

SEQ ID NO: 416148 - RNA, 22 nt, Human
cagaguggcgacccccucagcu

SEQ ID NO: 416149 - RNA, 22 nt, Human
ucugggcacugcugagccugua

SEQ ID NO: 416150 - RNA, 22 nt, Human
caggaaccuaaugaaggcucac

SEQ ID NO: 416151 - RNA, 22 nt, Human
cccugcagaaccacagacaaac

SEQ ID NO: 416152 - RNA, 22 nt, Human
cugggcagguauacaaaaaaug

SEQ ID NO: 416153 - RNA, 22 nt, Human
gggcacagaagucuaagacauc

SEQ ID NO: 416154 - RNA, 22 nt, Human
ucucagagagcuguguuuuccu

SEQ ID NO: 416155 - RNA, 22 nt, Human
agguggcaggaggucagagaaa

SEQ ID NO: 416156 - RNA, 22 nt, Human
gccucugcaucuucgccgcacu

SEQ ID NO: 416157 - RNA, 22 nt, Human
guauuaggugguggaauuguag

SEQ ID NO: 416158 - RNA, 18 nt, Human
ucuuggaguaaugaucaa

SEQ ID NO: 416159 - RNA, 22 nt, Human
aaggcugauuagacugauagcu

SEQ ID NO: 416160 - RNA, 22 nt, Human
uugaagcagagaaauacuugaa

SEQ ID NO: 416161 - RNA, 22 nt, Human
gggccuccggggugagcugugg

SEQ ID NO: 416162 - RNA, 22 nt, Human
cccagccaaggugcugguguug

SEQ ID NO: 416163 - RNA, 23 nt, Human
cucugcaggagagugggcagggc

SEQ ID NO: 416164 - RNA, 22 nt, Human
cacagcuuaugccacugauugg

SEQ ID NO: 416165 - RNA, 22 nt, Human
cagaggccuauccaguguccau

SEQ ID NO: 416166 - RNA, 19 nt, Human
guugaaaguaggugagggu

SEQ ID NO: 416167 - RNA, 22 nt, Human
aggcccuguccauggugcugaa

SEQ ID NO: 416168 - RNA, 22 nt, Human
cugccaggggccucacaggcca

SEQ ID NO: 416169 - RNA, 22 nt, Human
agaauguagucuuggagauuua

SEQ ID NO: 416170 - RNA, 22 nt, Human
guggcugcuaagucuccuuccu

SEQ ID NO: 416171 - RNA, 22 nt, Human
ccuggcugucguuuugugaaau

SEQ ID NO: 416172 - RNA, 22 nt, Human
ggggggugcugaucaguggagc

SEQ ID NO: 416173 - RNA, 22 nt, Human
gaagggugugugugagggacac

SEQ ID NO: 416174 - RNA, 22 nt, Human
ucauuuguugcuguuaccugag

SEQ ID NO: 416175 - RNA, 22 nt, Human
auacuguuuugugacuuaucuu

SEQ ID NO: 416176 - RNA, 22 nt, Human
uguuccaugucuuuguaggacu

SEQ ID NO: 416177 - RNA, 22 nt, Human
augugcaaauccaaugugaaug

SEQ ID NO: 416178 - RNA, 22 nt, Human
auccaaagcccuaaguuaacug

SEQ ID NO: 416179 - RNA, 22 nt, Human
ucaugcacaugugucaccauca

SEQ ID NO: 416180 - RNA, 22 nt, Human
uccuuccugcaggccaaguccu

SEQ ID NO: 416181 - RNA, 22 nt, Human
augagcuguaagguggcuuccu

SEQ ID NO: 416182 - RNA, 19 nt, Human
cgcaggagccgaggugacc

SEQ ID NO: 416183 - RNA, 16 nt, Human
aggcucagaggcugga

SEQ ID NO: 416184 - RNA, 22 nt, Human
uaggcuggaggaagcagugccu

SEQ ID NO: 416185 - RNA, 23 nt, Human
ugauuuccagugagucaguggga

SEQ ID NO: 416186 - RNA, 21 nt, Human
ucuugaaaauuguagcaguuu

SEQ ID NO: 416187 - RNA, 22 nt, Human
uccugggcugcagggaagagca

SEQ ID NO: 416188 - RNA, 22 nt, Human
accagggcccgggagagcucuc

SEQ ID NO: 416189 - RNA, 22 nt, Human
auagaauuacaguguguuugga

SEQ ID NO: 416190 - RNA, 21 nt, Human
cacuauuuauauaugccagcu

SEQ ID NO: 416191 - RNA, 22 nt, Human
uuagggcuuuucugaauaggcc

SEQ ID NO: 416192 - RNA, 22 nt, Human
augucuaaaagauaaaguuuaa

SEQ ID NO: 416193 - RNA, 18 nt, Human
ucagaggagauaccuaaa

SEQ ID NO: 416194 - RNA, 22 nt, Human
ggagucaggagcaggcugggcu

SEQ ID NO: 416195 - RNA, 19 nt, Human
acaagggcaggcaagguga

SEQ ID NO: 416196 - RNA, 22 nt, Human
ggacacagauaaucacacagau

SEQ ID NO: 416197 - RNA, 22 nt, Human
uggcucugucacugugagcuau

SEQ ID NO: 416198 - RNA, 22 nt, Human
uggcucaggccacuucuuuuau

SEQ ID NO: 416199 - RNA, 22 nt, Human
gggcaagcacagcgagcgugcg

SEQ ID NO: 416200 - RNA, 22 nt, Human
aaggggaauagaguggguugug

SEQ ID NO: 416201 - RNA, 22 nt, Human
aaggaagacuugagaagguucc

SEQ ID NO: 416202 - RNA, 22 nt, Human
aaaggaagauugagcuuuucca

SEQ ID NO: 416203 - RNA, 22 nt, Human
gcaucuucacacaaagccagug

SEQ ID NO: 416204 - RNA, 22 nt, Human
ugcacuccaggcugggugacag

SEQ ID NO: 416205 - RNA, 22 nt, Human
uccugccuucauacugcuguau

SEQ ID NO: 416206 - RNA, 18 nt, Human
gggcccuggcguccgccc

SEQ ID NO: 416207 - RNA, 22 nt, Human
cacagaaaaaggcuugaaaauc

SEQ ID NO: 416208 - RNA, 22 nt, Human
gccagggagucugggccacaga

SEQ ID NO: 416209 - RNA, 22 nt, Human
gggccuggggugacguaccccu

SEQ ID NO: 416210 - RNA, 22 nt, Human
cuuagaugaagucacagaaccc

SEQ ID NO: 416211 - RNA, 22 nt, Human
gcuggccaguguggugaccacc

SEQ ID NO: 416212 - RNA, 22 nt, Human
cagugcagaggccagggaggau

SEQ ID NO: 416213 - RNA, 22 nt, Human
acauuucuugaugccucuguga

SEQ ID NO: 416214 - RNA, 22 nt, Human
caaauguguagagcuuuugggg

SEQ ID NO: 416215 - RNA, 22 nt, Human
ucucuggagcugcagauccagg

SEQ ID NO: 416216 - RNA, 19 nt, Human
agcuguggggccuagcacc

SEQ ID NO: 416217 - RNA, 22 nt, Human
agggacagaugaaugacugagu

SEQ ID NO: 416218 - RNA, 22 nt, Human
gcugugcagccaagugccucug

SEQ ID NO: 416219 - RNA, 19 nt, Human
agccuggagggcuggucac

SEQ ID NO: 416220 - RNA, 22 nt, Human
cccuggcaaaacacucucuuga

SEQ ID NO: 416221 - RNA, 22 nt, Human
guacaaaaguuauugcgguuuu

SEQ ID NO: 416222 - RNA, 22 nt, Human
cuguauuucccacauucucuau

SEQ ID NO: 416223 - RNA, 22 nt, Human
gagggcugauaacaggaauaca

SEQ ID NO: 416224 - RNA, 22 nt, Human
cagcccuggugccaagguuccc

SEQ ID NO: 416225 - RNA, 22 nt, Human
ugcugcucucagccaccaggaa

SEQ ID NO: 416226 - RNA, 22 nt, Human
acuuucucaaaucagacuuuaa

SEQ ID NO: 416227 - RNA, 22 nt, Human
ugcagcugauuaaagggcagac

SEQ ID NO: 416228 - RNA, 22 nt, Human
ugcuggcccaguauggacugca

SEQ ID NO: 416229 - RNA, 22 nt, Human
cacugccuccccaggcuccaca

SEQ ID NO: 416230 - RNA, 22 nt, Human
gcagagcuucuguccuucagga

SEQ ID NO: 416231 - RNA, 22 nt, Human
gcagagguggcaucugggcucu

SEQ ID NO: 416232 - RNA, 21 nt, Human
uggcagggguaguaguacagc

SEQ ID NO: 416233 - RNA, 22 nt, Human
uuucacagguacaaacacuccu

SEQ ID NO: 416234 - RNA, 22 nt, Human
gggagggaagguaccuguguga

SEQ ID NO: 416235 - RNA, 22 nt, Human
ccugcucagagcgucuugugug

SEQ ID NO: 416236 - RNA, 22 nt, Human
aggagccaggaaaccugcucug

SEQ ID NO: 416237 - RNA, 22 nt, Human
gcagugauuggaucagagaugg

SEQ ID NO: 416238 - RNA, 22 nt, Human
gcaaagucugcaucuggaucag

SEQ ID NO: 416239 - RNA, 22 nt, Human
agcagggccucuggcacugguc

SEQ ID NO: 416240 - RNA, 20 nt, Human
gugcaauggcgcaaucucgg

SEQ ID NO: 416241 - RNA, 22 nt, Human
uucuuuugggaauuacguaugc

SEQ ID NO: 416242 - RNA, 22 nt, Human
gagaagcaaucaguggccaccc

SEQ ID NO: 416243 - RNA, 22 nt, Human
auuuguagugaagugaaaauaa

SEQ ID NO: 416244 - RNA, 22 nt, Human
auuauuagauucuuaauuguaa

SEQ ID NO: 416245 - RNA, 22 nt, Human
uuauuagguuuacauaaagguu

SEQ ID NO: 416246 - RNA, 22 nt, Human
aggccagcuguuacuagagcca

SEQ ID NO: 416247 - RNA, 22 nt, Human
caguucagcuagaagaaacaaa

SEQ ID NO: 416248 - RNA, 22 nt, Human
gcagugcuaaguagcuggccca

SEQ ID NO: 416249 - RNA, 22 nt, Human
gcagaugaggaagcuaaugcug

SEQ ID NO: 416250 - RNA, 22 nt, Human
cugugacuguguuggaugcaca

SEQ ID NO: 416251 - RNA, 22 nt, Human
gcaugagggggguuaggaaguu

SEQ ID NO: 416252 - RNA, 22 nt, Human
ucugugcaggaagucauuauga

SEQ ID NO: 416253 - RNA, 20 nt, Human
gagggcucguggauggauaa

SEQ ID NO: 416254 - RNA, 22 nt, Human
cacagagagcuacgugcagcgu

SEQ ID NO: 416255 - RNA, 22 nt, Human
caggaaaauggaaucaccugua

SEQ ID NO: 416256 - RNA, 21 nt, Human
cagagguggccugaccucuga

SEQ ID NO: 416257 - RNA, 22 nt, Human
uccucaggaucuaggagugcuu

SEQ ID NO: 416258 - RNA, 22 nt, Human
auauuagggucucuaaauucua

SEQ ID NO: 416259 - RNA, 22 nt, Human
uggggcagcuccaucuauucca

SEQ ID NO: 416260 - RNA, 22 nt, Human
accgggaaguccugcacugggc

SEQ ID NO: 416261 - RNA, 22 nt, Human
ugaggcucagagaagugcuguu

SEQ ID NO: 416262 - RNA, 22 nt, Human
ccccuuccuuccucagacagcc

SEQ ID NO: 416263 - RNA, 22 nt, Human
aucuggcuuucuuaaugacuua

SEQ ID NO: 416264 - RNA, 22 nt, Human
uucaggauaguggugaguggca

SEQ ID NO: 416265 - RNA, 22 nt, Human
uaugcacacauuagcacagggu

SEQ ID NO: 416266 - RNA, 22 nt, Human
uaaaacugaauacauacugagg

SEQ ID NO: 416267 - RNA, 22 nt, Human
cuaaaugccuuuccuaccuaac

SEQ ID NO: 416268 - RNA, 22 nt, Human
uucugaggcacuggcucuccca

SEQ ID NO: 416269 - RNA, 22 nt, Human
gcugugcuauaucucugagugu

SEQ ID NO: 416270 - RNA, 22 nt, Human
ccagggcagggaccacgugucu

SEQ ID NO: 416271 - RNA, 22 nt, Human
uauuuaaaaagaggccagcugg

SEQ ID NO: 416272 - RNA, 20 nt, Human
gucucagaauggauuugcau

SEQ ID NO: 416273 - RNA, 22 nt, Human
agguggguccuggcucugccau

SEQ ID NO: 416274 - RNA, 22 nt, Human
agggcuccgggccaccggccug

SEQ ID NO: 416275 - RNA, 22 nt, Human
ugcugcucuguaaagugaugag

SEQ ID NO: 416276 - RNA, 22 nt, Human
aggggcugacuggaaagugcca

SEQ ID NO: 416277 - RNA, 22 nt, Human
cagagaaagaagcccauucauu

SEQ ID NO: 416278 - RNA, 22 nt, Human
gucccuggucuaccguggcuuc

SEQ ID NO: 416279 - RNA, 22 nt, Human
ugggcugcuuccucagcugaga

SEQ ID NO: 416280 - RNA, 22 nt, Human
caggaggaaaugugacccugcu

SEQ ID NO: 416281 - RNA, 22 nt, Human
cagcaaaagccagcauaagcuc

SEQ ID NO: 416282 - RNA, 22 nt, Human
augaggcagucuggccugaggg

SEQ ID NO: 416283 - RNA, 22 nt, Human
gucuuguuugggauguggaugg

SEQ ID NO: 416284 - RNA, 22 nt, Human
guccuggggauuauagaguguu

SEQ ID NO: 416285 - RNA, 22 nt, Human
gagcucagcacuaaaaucaugu

SEQ ID NO: 416286 - RNA, 22 nt, Human
cuguggaccugcucuuagagac

SEQ ID NO: 416287 - RNA, 22 nt, Human
augauucagcaauuuuauaucu

SEQ ID NO: 416288 - RNA, 22 nt, Human
gagcaugguuccauagguuggu

SEQ ID NO: 416289 - RNA, 22 nt, Human
cuggccuuuuguuucuggagaa

SEQ ID NO: 416290 - RNA, 22 nt, Human
uggccugcagcucucagggaag

SEQ ID NO: 416291 - RNA, 22 nt, Human
cuggcagccaagugggauacuc

SEQ ID NO: 416292 - RNA, 22 nt, Human
ccagccaggcauugcaaacuga

SEQ ID NO: 416293 - RNA, 22 nt, Human
ucacuccucauugcugcccauu

SEQ ID NO: 416294 - RNA, 22 nt, Human
uugugcauuucucugagugugu

SEQ ID NO: 416295 - RNA, 22 nt, Human
ggcuucugccacgagagggaag

SEQ ID NO: 416296 - RNA, 22 nt, Human
uggacucagugcugccauuccc

SEQ ID NO: 416297 - RNA, 23 nt, Human
cuuuccuuucuuugacacccagc

SEQ ID NO: 416298 - RNA, 22 nt, Human
cagcugccagcuucucuccauc

SEQ ID NO: 416299 - RNA, 22 nt, Human
caggggcuuaagugacagaagg

SEQ ID NO: 416300 - RNA, 22 nt, Human
uugcagcuucgagucuaucugu

SEQ ID NO: 416301 - RNA, 22 nt, Human
aaggaagagaauccuucucaga

SEQ ID NO: 416302 - RNA, 22 nt, Human
ugcaagggcuuagggggcugug

SEQ ID NO: 416303 - RNA, 22 nt, Human
gagaggaguaggcugauggugc

SEQ ID NO: 416304 - RNA, 22 nt, Human
gaagcagcuaggaucuucauuu

SEQ ID NO: 416305 - RNA, 22 nt, Human
ggaggcagaacuucccgucagu

SEQ ID NO: 416306 - RNA, 22 nt, Human
aggcucagugcaaaucauucug

SEQ ID NO: 416307 - RNA, 22 nt, Human
caguggcaugguugacugcagu

SEQ ID NO: 416308 - RNA, 22 nt, Human
ugucucugauaaguaguucagu

SEQ ID NO: 416309 - RNA, 22 nt, Human
ucugccuggaugauggcagggc

SEQ ID NO: 416310 - RNA, 22 nt, Human
cagagcagggugcaccuugggc

SEQ ID NO: 416311 - RNA, 19 nt, Human
uggaccugugcccauggcu

SEQ ID NO: 416312 - RNA, 22 nt, Human
cuguccuguagcuccaucaguc

SEQ ID NO: 416313 - RNA, 22 nt, Human
ggccugcuuuccgagccugcag

SEQ ID NO: 416314 - RNA, 22 nt, Human
ucucagagagaugaaacuucca

SEQ ID NO: 416315 - RNA, 22 nt, Human
uggcccugaggggcugugcccc

SEQ ID NO: 416316 - RNA, 22 nt, Human
aaggcacuuaacgugggaggau

SEQ ID NO: 416317 - RNA, 22 nt, Human
cagucacacaaguggacuuggg

SEQ ID NO: 416318 - RNA, 22 nt, Human
ucauuuguacuugugugcuugu

SEQ ID NO: 416319 - RNA, 22 nt, Human
gcagacaggcccaguggaggga

SEQ ID NO: 416320 - RNA, 22 nt, Human
gaugugagugguagcugggauu

SEQ ID NO: 416321 - RNA, 22 nt, Human
ccagcagcucccucaggguccg

SEQ ID NO: 416322 - RNA, 22 nt, Human
uuucuuuguuguuaucacauca

SEQ ID NO: 416323 - RNA, 22 nt, Human
uuguaacagguacuaaauaacu

SEQ ID NO: 416324 - RNA, 22 nt, Human
uuacaaaguucugaguucaaac

SEQ ID NO: 416325 - RNA, 19 nt, Human
ggagaggcuggagggaugc

SEQ ID NO: 416326 - RNA, 22 nt, Human
uaauacaauggaguugggcccc

SEQ ID NO: 416327 - RNA, 22 nt, Human
aaaagacauaugugggcauucu

SEQ ID NO: 416328 - RNA, 22 nt, Human
ugcugcucaaugagaugccauc

SEQ ID NO: 416329 - RNA, 21 nt, Human
guggccugauuaugaaugggu

SEQ ID NO: 416330 - RNA, 22 nt, Human
auacauacauguacacauaaau

SEQ ID NO: 416331 - RNA, 22 nt, Human
gagggggagaugugcacacacu

SEQ ID NO: 416332 - RNA, 22 nt, Human
uagaaacauauaggauggcagg

SEQ ID NO: 416333 - RNA, 22 nt, Human
gugcccaggcccaaggcaccac

SEQ ID NO: 416334 - RNA, 22 nt, Human
ugucaugcuuauguuacauacu

SEQ ID NO: 416335 - RNA, 22 nt, Human
agaaaacauuacauaggugugu

SEQ ID NO: 416336 - RNA, 21 nt, Human
uugaagcaaggguggcucuga

SEQ ID NO: 416337 - RNA, 22 nt, Human
acugcagccuugaacucugggc

SEQ ID NO: 416338 - RNA, 22 nt, Human
cagugaggcucugcugagcggu

SEQ ID NO: 416339 - RNA, 22 nt, Human
ugucacaguuuguacuuuauag

SEQ ID NO: 416340 - RNA, 22 nt, Human
ugucaccucuuuggcugcagcu

SEQ ID NO: 416341 - RNA, 22 nt, Human
agugguaacuaaguccugcuua

SEQ ID NO: 416342 - RNA, 22 nt, Human
gcccuggaaucucuccauggga

SEQ ID NO: 416343 - RNA, 22 nt, Human
cugagguguugaugaccuaugc

SEQ ID NO: 416344 - RNA, 22 nt, Human
cagccagcugaauguaccauga

SEQ ID NO: 416345 - RNA, 22 nt, Human
ccacugagaccuuuuggaggag

SEQ ID NO: 416346 - RNA, 22 nt, Human
uuggccuucccuaccugggcca

SEQ ID NO: 416347 - RNA, 22 nt, Human
gagggagagugauggaccauug

SEQ ID NO: 416348 - RNA, 22 nt, Human
gccucugcaggugcgguuaucc

SEQ ID NO: 416349 - RNA, 22 nt, Human
uaaaugugagugaugcggugaa

SEQ ID NO: 416350 - RNA, 22 nt, Human
ugaagccacuuuccagaaucac

SEQ ID NO: 416351 - RNA, 22 nt, Human
uucaaaggcaggauagcagcug

SEQ ID NO: 416352 - RNA, 22 nt, Human
gccagcagguggagagaucaag

SEQ ID NO: 416353 - RNA, 22 nt, Human
uauccaaaguggcauauuauag

SEQ ID NO: 416354 - RNA, 22 nt, Human
cagcagugucuccagcaucaca

SEQ ID NO: 416355 - RNA, 22 nt, Human
caaagacugcauaacacaugaa

SEQ ID NO: 416356 - RNA, 22 nt, Human
gaggccugaggcugccuggagc

SEQ ID NO: 416357 - RNA, 22 nt, Human
gugagaguguuuggaaauagaa

SEQ ID NO: 416358 - RNA, 22 nt, Human
gauucugagcugguguuuuacg

SEQ ID NO: 416359 - RNA, 22 nt, Human
cucacuguuuaauagcuggauc

SEQ ID NO: 416360 - RNA, 22 nt, Human
aaccauuugccauuaucuuaag

SEQ ID NO: 416361 - RNA, 22 nt, Human
uacccagcuccucagaagacca

SEQ ID NO: 416362 - RNA, 22 nt, Human
agaaauguauucuguauguuuu

SEQ ID NO: 416363 - RNA, 22 nt, Human
acaaaaguguaggaauuccuua

SEQ ID NO: 416364 - RNA, 21 nt, Human
cagaggggcuagccuggcugc

SEQ ID NO: 416365 - RNA, 22 nt, Human
guguuaaccagcuaaacuuugc

SEQ ID NO: 416366 - RNA, 22 nt, Human
ggcccugggcagaggagugggc

SEQ ID NO: 416367 - RNA, 22 nt, Human
aaggccuggauuuagguuguga

SEQ ID NO: 416368 - RNA, 22 nt, Human
agcaggaggguuuuguagaguc

SEQ ID NO: 416369 - RNA, 21 nt, Human
cagacccucuagaggccaccu

SEQ ID NO: 416370 - RNA, 22 nt, Human
caggaugggauguagugggccc

SEQ ID NO: 416371 - RNA, 22 nt, Human
cagcacugcuucgcagccaggg

SEQ ID NO: 416372 - RNA, 22 nt, Human
ggagcugcuuugaucugaagaa

SEQ ID NO: 416373 - RNA, 22 nt, Human
aagggagacaguugugugagga

SEQ ID NO: 416374 - RNA, 22 nt, Human
aaguggacuaauacaaggacua

SEQ ID NO: 416375 - RNA, 22 nt, Human
uuuauauccaucuuugaaguaa

SEQ ID NO: 416376 - RNA, 22 nt, Human
aaauuugauaagccauuguuac

SEQ ID NO: 416377 - RNA, 22 nt, Human
uagccggguguugugucaugca

SEQ ID NO: 416378 - RNA, 22 nt, Human
cuacaggucaguaagaccuaga

SEQ ID NO: 416379 - RNA, 22 nt, Human
agugacugggcagggcagggcc

SEQ ID NO: 416380 - RNA, 22 nt, Human
cugagggagggacuuugagacu

SEQ ID NO: 416381 - RNA, 22 nt, Human
gccuggagcucaugugggcauu

SEQ ID NO: 416382 - RNA, 22 nt, Human
accauguguuuuacacauggua

SEQ ID NO: 416383 - RNA, 22 nt, Human
uggcugaggagagggcggaagu

SEQ ID NO: 416384 - RNA, 22 nt, Human
cauggccuugagugacugcacu

SEQ ID NO: 416385 - RNA, 22 nt, Human
gaagaagcaggaguguguagca

SEQ ID NO: 416386 - RNA, 22 nt, Human
gaggcucacuaggcauccuggg

SEQ ID NO: 416387 - RNA, 22 nt, Human
auugucuguacuuuaaaaaugu

SEQ ID NO: 416388 - RNA, 22 nt, Human
acaguggaaagaaacgaauuag

SEQ ID NO: 416389 - RNA, 22 nt, Human
ucauuucaaguucugacagcua

SEQ ID NO: 416390 - RNA, 20 nt, Human
aggaacuggaagggaggaaa

SEQ ID NO: 416391 - RNA, 22 nt, Human
gugaaggcuacaagagaucaag

SEQ ID NO: 416392 - RNA, 22 nt, Human
ucucacucauuuccuaggucuu

SEQ ID NO: 416393 - RNA, 22 nt, Human
cuguccagcuuggcuccugggg

SEQ ID NO: 416394 - RNA, 23 nt, Human
cagggcccugcucaauuucucca

SEQ ID NO: 416395 - RNA, 22 nt, Human
gcuggugcauuagcugcaguuc

SEQ ID NO: 416396 - RNA, 22 nt, Human
gccuucccacccugcgaggcug

SEQ ID NO: 416397 - RNA, 22 nt, Human
cacagaagaaucaugcuguguu

SEQ ID NO: 416398 - RNA, 22 nt, Human
guggccagaagacugcaaugcu

SEQ ID NO: 416399 - RNA, 20 nt, Human
ugcuuuaugcuauacuuugu

SEQ ID NO: 416400 - RNA, 22 nt, Human
uuuguaaagucuguucugaguu

SEQ ID NO: 416401 - RNA, 22 nt, Human
cagcugcccauccugggaaaug

SEQ ID NO: 416402 - RNA, 22 nt, Human
agcuuuuaguacguuaaaauug

SEQ ID NO: 416403 - RNA, 22 nt, Human
aucaguuuuuauuaauguagcu

SEQ ID NO: 416404 - RNA, 22 nt, Human
ucagcagaggggaaggcaucug

SEQ ID NO: 416405 - RNA, 22 nt, Human
gaggaggaaacccuguuccucu

SEQ ID NO: 416406 - RNA, 22 nt, Human
gcugugcagucuuuggugugcc

SEQ ID NO: 416407 - RNA, 22 nt, Human
agaaaugcucuuccugaccaga

SEQ ID NO: 416408 - RNA, 17 nt, Human
agauggcaggaggcaga

SEQ ID NO: 416409 - RNA, 22 nt, Human
agacagaacagaauaauuguug

SEQ ID NO: 416410 - RNA, 22 nt, Human
uggcugagugauauuugcaaag

SEQ ID NO: 416411 - RNA, 22 nt, Human
ugggcugcugcggugcucuugg

SEQ ID NO: 416412 - RNA, 20 nt, Human
agaguaacuggcacauaggg

SEQ ID NO: 416413 - RNA, 22 nt, Human
gcucugcugcuuacuagauggu

SEQ ID NO: 416414 - RNA, 22 nt, Human
caggcccauucuaggcuugcua

SEQ ID NO: 416415 - RNA, 22 nt, Human
gagugcagaugaacagaagauu

SEQ ID NO: 416416 - RNA, 19 nt, Human
ucauucaggaccaguggau

SEQ ID NO: 416417 - RNA, 22 nt, Human
gcuugcucaacccccgucucuc

SEQ ID NO: 416418 - RNA, 22 nt, Human
gcagcuggucuggccuagagua

SEQ ID NO: 416419 - RNA, 20 nt, Human
aguguuccggaagacuggca

SEQ ID NO: 416420 - RNA, 22 nt, Human
ugcagccaucgcagagucugua

SEQ ID NO: 416421 - RNA, 23 nt, Human
ucagagaggcccccugcagagau

SEQ ID NO: 416422 - RNA, 22 nt, Human
uaaaauguagcuucuaggcugg

SEQ ID NO: 416423 - RNA, 23 nt, Human
ucucagaggauuccugggccuug

SEQ ID NO: 416424 - RNA, 22 nt, Human
aaugcuguaaagaugcuaucug

SEQ ID NO: 416425 - RNA, 22 nt, Human
caggcagcuagauuuauaacaa

SEQ ID NO: 416426 - RNA, 22 nt, Human
acauuuuaauaugcuuagugug

SEQ ID NO: 416427 - RNA, 22 nt, Human
agggccagcugcagaauuagca

SEQ ID NO: 416428 - RNA, 22 nt, Human
uccaucaccauuucugcgagcu

SEQ ID NO: 416429 - RNA, 22 nt, Human
cuggggcugcagcgaucuucau

SEQ ID NO: 416430 - RNA, 22 nt, Human
uauaauccugcuucacauugaa

SEQ ID NO: 416431 - RNA, 22 nt, Human
cagggacccuacuagcucacac

SEQ ID NO: 416432 - RNA, 20 nt, Human
caucaucacaugagccaauu

SEQ ID NO: 416433 - RNA, 22 nt, Human
cuauuucuaaaccuauaaguga

SEQ ID NO: 416434 - RNA, 22 nt, Human
gccuuuuuuguugcucugucac

SEQ ID NO: 416435 - RNA, 21 nt, Human
uuucccagcugaaaauaaaug

SEQ ID NO: 416436 - RNA, 22 nt, Human
gcugggagccccgagccagcgc

SEQ ID NO: 416437 - RNA, 22 nt, Human
agcucugcaggcacagcugagg

SEQ ID NO: 416438 - RNA, 22 nt, Human
aucuggaaaacacaguguagac

SEQ ID NO: 416439 - RNA, 22 nt, Human
gcugaggcuccucgggaggaca

SEQ ID NO: 416440 - RNA, 20 nt, Human
gugugaagcccucaggagga

SEQ ID NO: 416441 - RNA, 23 nt, Human
ccucagggucuagcagagagaag

SEQ ID NO: 416442 - RNA, 22 nt, Human
cugaggucaauuaaucaacaac

SEQ ID NO: 416443 - RNA, 19 nt, Human
aauuagggagucgguuaag

SEQ ID NO: 416444 - RNA, 19 nt, Human
gcacugaagaguuggucac

SEQ ID NO: 416445 - RNA, 22 nt, Human
ugaagccaccgaaccagaagag

SEQ ID NO: 416446 - RNA, 22 nt, Human
cugccucuccccagaguggccc

SEQ ID NO: 416447 - RNA, 19 nt, Human
ucucagaggaaaaauugcu

SEQ ID NO: 416448 - RNA, 22 nt, Human
uuucacauacaguguauaguag

SEQ ID NO: 416449 - RNA, 22 nt, Human
uggggaggacgggcgccuuccu

SEQ ID NO: 416450 - RNA, 22 nt, Human
uacaaacuuguuuuaaguaagu

SEQ ID NO: 416451 - RNA, 22 nt, Human
uuuccuuccuugcuagccugag

SEQ ID NO: 416452 - RNA, 22 nt, Human
gcuggcagaauuucuucuugcu

SEQ ID NO: 416453 - RNA, 22 nt, Human
aggcugugacagggucauggag

SEQ ID NO: 416454 - RNA, 22 nt, Human
gugucaugggguuuguuauaca

SEQ ID NO: 416455 - RNA, 22 nt, Human
ugggccuguggcuuggcucuag

SEQ ID NO: 416456 - RNA, 22 nt, Human
cagaaggcauagaugaaggccu

SEQ ID NO: 416457 - RNA, 22 nt, Human
gaauuguacgcuuuacauaggu

SEQ ID NO: 416458 - RNA, 22 nt, Human
ugggcccugacuucaagcaucc

SEQ ID NO: 416459 - RNA, 19 nt, Human
ugucccagacuccgugucu

SEQ ID NO: 416460 - RNA, 22 nt, Human
ccccuuccgucucuugaguguc

SEQ ID NO: 416461 - RNA, 22 nt, Human
aacucagucauaaagcgaaugc

SEQ ID NO: 416462 - RNA, 22 nt, Human
ugcagggcacggugcgcguggg

SEQ ID NO: 416463 - RNA, 22 nt, Human
uagcaguggaaucuuuugucca

SEQ ID NO: 416464 - RNA, 22 nt, Human
auaauauaauccuacuucccau

SEQ ID NO: 416465 - RNA, 22 nt, Human
ucuggcuccaccuccuuuacua

SEQ ID NO: 416466 - RNA, 22 nt, Human
ggccaggcgaugaccccuccac

SEQ ID NO: 416467 - RNA, 22 nt, Human
gaggccuggaccagccacagag

SEQ ID NO: 416468 - RNA, 22 nt, Human
gcucaagagagaugcaguucuu

SEQ ID NO: 416469 - RNA, 22 nt, Human
aaggcugccucugccagaggag

SEQ ID NO: 416470 - RNA, 22 nt, Human
uggcugagugaacauguccauu

SEQ ID NO: 416471 - RNA, 22 nt, Human
gggaggugauggcaagcagcgg

SEQ ID NO: 416472 - RNA, 22 nt, Human
guauuauuggguaguaugguaa

SEQ ID NO: 416473 - RNA, 22 nt, Human
cugggcucagaugagaggaagg

SEQ ID NO: 416474 - RNA, 22 nt, Human
gcuggggagcuagaccucagca

SEQ ID NO: 416475 - RNA, 22 nt, Human
ggauccuucuuugaccucacag

SEQ ID NO: 416476 - RNA, 22 nt, Human
ggaaagaaucaagugauccugu

SEQ ID NO: 416477 - RNA, 20 nt, Human
gccugcagagaaggucagag

SEQ ID NO: 416478 - RNA, 22 nt, Human
cucacagguaccagcacccucc

SEQ ID NO: 416479 - RNA, 22 nt, Human
acaugcauacaagcacauguag

SEQ ID NO: 416480 - RNA, 22 nt, Human
uuuguuuacucauucauugaug

SEQ ID NO: 416481 - RNA, 22 nt, Human
gggggucccaagcugggcugcu

SEQ ID NO: 416482 - RNA, 22 nt, Human
agaagagccuggggaccauggc

SEQ ID NO: 416483 - RNA, 22 nt, Human
cacaggaggaggugcccgggcc

SEQ ID NO: 416484 - RNA, 22 nt, Human
ugucccucauugacgcugugcc

SEQ ID NO: 416485 - RNA, 23 nt, Human
uggcucucucagugcugcagagg

SEQ ID NO: 416486 - RNA, 22 nt, Human
caagggcauugcuugggaccuu

SEQ ID NO: 416487 - RNA, 22 nt, Human
gaggcagcaugguaccuuggag

SEQ ID NO: 416488 - RNA, 22 nt, Human
auuguauuuccagcuugaaugu

SEQ ID NO: 416489 - RNA, 22 nt, Human
agauuucacaugcugcucuauu

SEQ ID NO: 416490 - RNA, 20 nt, Human
cucaggauugucuagccccu

SEQ ID NO: 416491 - RNA, 22 nt, Human
agcaauauuucagcuagcaggu

SEQ ID NO: 416492 - RNA, 22 nt, Human
gccggggcuggggagagacaug

SEQ ID NO: 416493 - RNA, 22 nt, Human
aagggcuggaauaucucuuaga

SEQ ID NO: 416494 - RNA, 22 nt, Human
agucucugagguucagaugccu

SEQ ID NO: 416495 - RNA, 20 nt, Human
uaugaguauuacuuucagga

SEQ ID NO: 416496 - RNA, 22 nt, Human
cugcugcaggaugggcacucug

SEQ ID NO: 416497 - RNA, 22 nt, Human
cugccugugcaugcagucagaa

SEQ ID NO: 416498 - RNA, 22 nt, Human
gagccugagugcugccuccccu

SEQ ID NO: 416499 - RNA, 22 nt, Human
ucaggaaaauacugcuuaucca

SEQ ID NO: 416500 - RNA, 22 nt, Human
gcucucugccuuucucaaugac

SEQ ID NO: 416501 - RNA, 22 nt, Human
auguaauuugcccucaaguuaa

SEQ ID NO: 416502 - RNA, 22 nt, Human
ccagcuggaagagugcagaacu

SEQ ID NO: 416503 - RNA, 22 nt, Human
uagggcagagcuuguacacgau

SEQ ID NO: 416504 - RNA, 23 nt, Human
agaggccaacuucuugccccucc

SEQ ID NO: 416505 - RNA, 22 nt, Human
guguccuuauuucugucucuca

SEQ ID NO: 416506 - RNA, 22 nt, Human
ccugccagugaagcugacgggc

SEQ ID NO: 416507 - RNA, 22 nt, Human
aggcacugaaagguggccagag

SEQ ID NO: 416508 - RNA, 22 nt, Human
ccagccugguucagaauuggcu

SEQ ID NO: 416509 - RNA, 22 nt, Human
cagagacaguuucacagggucu

SEQ ID NO: 416510 - RNA, 22 nt, Human
uuaguuuucccaucuuuauggu

SEQ ID NO: 416511 - RNA, 22 nt, Human
uccaggcauaagccuugagugu

SEQ ID NO: 416512 - RNA, 22 nt, Human
auuuucucucaaaccuuaaaau

SEQ ID NO: 416513 - RNA, 17 nt, Human
ucugggcuucagugguc

SEQ ID NO: 416514 - RNA, 22 nt, Human
cugagcugggaguagagacucu

SEQ ID NO: 416515 - RNA, 22 nt, Human
uggagcaggccggaaguggcuu

SEQ ID NO: 416516 - RNA, 21 nt, Human
ugaaaucugaugggacaaaug

SEQ ID NO: 416517 - RNA, 22 nt, Human
agaagugccgaaaggaagacag

SEQ ID NO: 416518 - RNA, 19 nt, Human
ugccagcauuaggcugaag

SEQ ID NO: 416519 - RNA, 22 nt, Human
acauuuacagugcuagacaauc

SEQ ID NO: 416520 - RNA, 19 nt, Human
aucugccuguuaucacaua

SEQ ID NO: 416521 - RNA, 22 nt, Human
cagaagaaaguggggagacaag

SEQ ID NO: 416522 - RNA, 22 nt, Human
aagugguagacaaagauaauug

SEQ ID NO: 416523 - RNA, 22 nt, Human
cuucugugcuucacaguugcca

SEQ ID NO: 416524 - RNA, 22 nt, Human
cuacaaaaguaauugugguuuu

SEQ ID NO: 416525 - RNA, 22 nt, Human
aggcugugcacagggcaccugc

SEQ ID NO: 416526 - RNA, 22 nt, Human
aggaagccugcaggugacugcu

SEQ ID NO: 416527 - RNA, 22 nt, Human
cucugcagaauuugagcugcuc

SEQ ID NO: 416528 - RNA, 22 nt, Human
ucagcccugaggacagaggcag

SEQ ID NO: 416529 - RNA, 22 nt, Human
uuaacaugucuugacuucaucu

SEQ ID NO: 416530 - RNA, 22 nt, Human
ugguuuaccccuguccuauauc

SEQ ID NO: 416531 - RNA, 22 nt, Human
gaaaucugaaucuucuguuggu

SEQ ID NO: 416532 - RNA, 22 nt, Human
auggcagagggauugaacagcu

SEQ ID NO: 416533 - RNA, 22 nt, Human
acaggcagguugagaaacauuu

SEQ ID NO: 416534 - RNA, 22 nt, Human
gauuucaaaaguagauccauca

SEQ ID NO: 416535 - RNA, 22 nt, Human
uccaggcauagaaggcacgcac

SEQ ID NO: 416536 - RNA, 22 nt, Human
ugaggcagugugagauaauaaa

SEQ ID NO: 416537 - RNA, 22 nt, Human
ucucaguguuguucugcagaug

SEQ ID NO: 416538 - RNA, 22 nt, Human
ggcucagggaaugaggaagaau

SEQ ID NO: 416539 - RNA, 22 nt, Human
gcagcacauauaaacaaagaga

SEQ ID NO: 416540 - RNA, 22 nt, Human
ugcucuguugugcaugugggau

SEQ ID NO: 416541 - RNA, 22 nt, Human
caggaaccuaaagagacauuac

SEQ ID NO: 416542 - RNA, 22 nt, Human
ucaagauaccaccauuauaugu

SEQ ID NO: 416543 - RNA, 22 nt, Human
aaugauauagcagacauagccu

SEQ ID NO: 416544 - RNA, 22 nt, Human
uccuccucuaucagacagugcc

SEQ ID NO: 416545 - RNA, 22 nt, Human
aaggcauaugcuguguacaguu

SEQ ID NO: 416546 - RNA, 22 nt, Human
caugucuugcccugauuaguag

SEQ ID NO: 416547 - RNA, 22 nt, Human
ucaggcugguccccacagugga

SEQ ID NO: 416548 - RNA, 22 nt, Human
uucagcagugcagacacccagu

SEQ ID NO: 416549 - RNA, 18 nt, Human
ucugagggugcgggagcu

SEQ ID NO: 416550 - RNA, 20 nt, Human
guauuagguguuccucuuuc

SEQ ID NO: 416551 - RNA, 22 nt, Human
uuucauguuuauggaaaaugag

SEQ ID NO: 416552 - RNA, 22 nt, Human
ggaaagaccugagauaggaaua

SEQ ID NO: 416553 - RNA, 22 nt, Human
cugaaggagcauagucaguuuu

SEQ ID NO: 416554 - RNA, 22 nt, Human
cugugcaguaggucagggcugg

SEQ ID NO: 416555 - RNA, 22 nt, Human
cagcuuucaucagugacacuca

SEQ ID NO: 416556 - RNA, 22 nt, Human
uggcagcacuugaacuugagcc

SEQ ID NO: 416557 - RNA, 22 nt, Human
aacauugcagcuuaauugcagg

SEQ ID NO: 416558 - RNA, 22 nt, Human
aguuauucauuuauucuguaca

SEQ ID NO: 416559 - RNA, 22 nt, Human
cuuccaaauguaaauaaguuuc

SEQ ID NO: 416560 - RNA, 22 nt, Human
uacaagacgagggaaguucuuu

SEQ ID NO: 416561 - RNA, 19 nt, Human
gcuccugggccucacucau

SEQ ID NO: 416562 - RNA, 22 nt, Human
guguccaucagcagccacugug

SEQ ID NO: 416563 - RNA, 22 nt, Human
aucugccugcaguggagguggg

SEQ ID NO: 416564 - RNA, 22 nt, Human
ucugcaggccucgacaaggcca

SEQ ID NO: 416565 - RNA, 22 nt, Human
ggauggcaggacaaggacccag

SEQ ID NO: 416566 - RNA, 22 nt, Human
ugaagcagcaccauuuuagagc

SEQ ID NO: 416567 - RNA, 22 nt, Human
ucucugagcgcauuccuccggc

SEQ ID NO: 416568 - RNA, 22 nt, Human
ucacaccuguaaucccaggccu

SEQ ID NO: 416569 - RNA, 22 nt, Human
uuuuaauacugcuauuguagga

SEQ ID NO: 416570 - RNA, 23 nt, Human
gagcugggauacaggcuuacugc

SEQ ID NO: 416571 - RNA, 22 nt, Human
uccucacaagcaagcacaggua

SEQ ID NO: 416572 - RNA, 22 nt, Human
ggccucaguuucuucaacugua

SEQ ID NO: 416573 - RNA, 22 nt, Human
caguguggugugcacagcuuag

SEQ ID NO: 416574 - RNA, 22 nt, Human
acagaauugauggaaaucucag

SEQ ID NO: 416575 - RNA, 22 nt, Human
uuugggcaguagauguaucacu

SEQ ID NO: 416576 - RNA, 22 nt, Human
cucagaaguucagccuagagua

SEQ ID NO: 416577 - RNA, 19 nt, Human
ccuuggaguuccaggugga

SEQ ID NO: 416578 - RNA, 22 nt, Human
ugcagcugaggccagcuaugcc

SEQ ID NO: 416579 - RNA, 22 nt, Human
ggcucagagaccugcgaucuga

SEQ ID NO: 416580 - RNA, 22 nt, Human
cuacauaaucuggauuugucug

SEQ ID NO: 416581 - RNA, 22 nt, Human
gguggcagucuuaagagaucuu

SEQ ID NO: 416582 - RNA, 22 nt, Human
uugggcucaggaguuugagacc

SEQ ID NO: 416583 - RNA, 22 nt, Human
gcugaagagagaugcguccagc

SEQ ID NO: 416584 - RNA, 22 nt, Human
aggcacugugcugaugucuuau

SEQ ID NO: 416585 - RNA, 22 nt, Human
cugcuguggaugcaggaccuca

SEQ ID NO: 416586 - RNA, 22 nt, Human
uuugaaaguucuucugacacua

SEQ ID NO: 416587 - RNA, 22 nt, Human
acuguaaccaguguggugagag

SEQ ID NO: 416588 - RNA, 22 nt, Human
ucacaggguuuggaagccuccu

SEQ ID NO: 416589 - RNA, 22 nt, Human
caguggaaaucagagugagagu

SEQ ID NO: 416590 - RNA, 19 nt, Human
gugauuucuuuccacaagc

SEQ ID NO: 416591 - RNA, 22 nt, Human
acacuucuauucccugcacaaa

SEQ ID NO: 416592 - RNA, 22 nt, Human
uuucaagcauaacugggaagag

SEQ ID NO: 416593 - RNA, 19 nt, Human
uggcagggagaguuugaag

SEQ ID NO: 416594 - RNA, 22 nt, Human
cccaggcagccccagaagcuug

SEQ ID NO: 416595 - RNA, 21 nt, Human
ccuggcugcacaguugcuggu

SEQ ID NO: 416596 - RNA, 22 nt, Human
cacccaggcagguggcugagaa

SEQ ID NO: 416597 - RNA, 22 nt, Human
aggauccuuuggccacuucuua

SEQ ID NO: 416598 - RNA, 22 nt, Human
cucuggagaugguucucaauug

SEQ ID NO: 416599 - RNA, 22 nt, Human
aaaugucuaucuggcauauucc

SEQ ID NO: 416600 - RNA, 22 nt, Human
ucuguuuaggcaaaauagcuac

SEQ ID NO: 416601 - RNA, 22 nt, Human
uuccaaagaaguucacauuuac

SEQ ID NO: 416602 - RNA, 22 nt, Human
gaagcaaaaugucugcacauau

SEQ ID NO: 416603 - RNA, 18 nt, Human
ggagagugacagagucgu

SEQ ID NO: 416604 - RNA, 22 nt, Human
gcaggcugggguagccccacuu

SEQ ID NO: 416605 - RNA, 22 nt, Human
cuauuagguaugcagccuauuu

SEQ ID NO: 416606 - RNA, 22 nt, Human
gcaggaugagugaguacauuua

SEQ ID NO: 416607 - RNA, 22 nt, Human
agagugaaguucaucgugcagc

SEQ ID NO: 416608 - RNA, 21 nt, Human
ggcuccugcuuugugaggggc

SEQ ID NO: 416609 - RNA, 19 nt, Human
gugaggauacugcucagag

SEQ ID NO: 416610 - RNA, 22 nt, Human
aucaggaucagggcuagcagag

SEQ ID NO: 416611 - RNA, 22 nt, Human
ugggccuccaauuccagcggga

SEQ ID NO: 416612 - RNA, 22 nt, Human
agggcuggccacaugauuuggu

SEQ ID NO: 416613 - RNA, 21 nt, Human
ucugagaacuucugcugcagc

SEQ ID NO: 416614 - RNA, 22 nt, Human
gguaacaguauguagaguaaga

SEQ ID NO: 416615 - RNA, 23 nt, Human
uaguuauuuucucuguaauuugc

SEQ ID NO: 416616 - RNA, 22 nt, Human
aaaggcuccuucucccaugacc

SEQ ID NO: 416617 - RNA, 22 nt, Human
gaagucugacucuuuguaagcu

SEQ ID NO: 416618 - RNA, 22 nt, Human
cuggaagggucuacuuagcaga

SEQ ID NO: 416619 - RNA, 22 nt, Human
agcaauauaaauguuggguaga

SEQ ID NO: 416620 - RNA, 22 nt, Human
cuugcaggauuuugcugcugua

SEQ ID NO: 416621 - RNA, 22 nt, Human
agaauucuuggugguuagaaua

SEQ ID NO: 416622 - RNA, 22 nt, Human
uuuuuuaguuaggucagaaugu

SEQ ID NO: 416623 - RNA, 19 nt, Human
uccaggaggcugccauuga

SEQ ID NO: 416624 - RNA, 22 nt, Human
gaugccucuuuuggcugaauua

SEQ ID NO: 416625 - RNA, 22 nt, Human
gccaggcacaguucuaggugcu

SEQ ID NO: 416626 - RNA, 22 nt, Human
ugcagucuggauguccucagau

SEQ ID NO: 416627 - RNA, 19 nt, Human
gcuggggccugaccagaca

SEQ ID NO: 416628 - RNA, 17 nt, Human
guuugcaugguguuaac

SEQ ID NO: 416629 - RNA, 22 nt, Human
ggcucaccauggccucccugcu

SEQ ID NO: 416630 - RNA, 22 nt, Human
cagggccucauccucagagauu

SEQ ID NO: 416631 - RNA, 22 nt, Human
agcagaaccacagcacuguuga

SEQ ID NO: 416632 - RNA, 22 nt, Human
cugggcugcaguuccugguccu

SEQ ID NO: 416633 - RNA, 22 nt, Human
aaaugcagaucccugaaucuca

SEQ ID NO: 416634 - RNA, 22 nt, Human
cagggagaaaucuccaggaggu

SEQ ID NO: 416635 - RNA, 22 nt, Human
cugugcuuccaggauggcagcu

SEQ ID NO: 416636 - RNA, 22 nt, Human
gcucuguacgcaggaugagggg

SEQ ID NO: 416637 - RNA, 22 nt, Human
ccugagggcgccgagcucccag

SEQ ID NO: 416638 - RNA, 22 nt, Human
acuguacuguguauuguagaau

SEQ ID NO: 416639 - RNA, 22 nt, Human
acaagagauuaucuacagauga

SEQ ID NO: 416640 - RNA, 22 nt, Human
cugcuuccauaaauaaugugcu

SEQ ID NO: 416641 - RNA, 22 nt, Human
acagggcaccugagguaggaag

SEQ ID NO: 416642 - RNA, 22 nt, Human
cuuguauuccccuaucucuaaa

SEQ ID NO: 416643 - RNA, 18 nt, Human
acauuucucucugcguga

SEQ ID NO: 416644 - RNA, 22 nt, Human
augaggcaucugcagucacuag

SEQ ID NO: 416645 - RNA, 22 nt, Human
acuguguccuauuuccuugaca

SEQ ID NO: 416646 - RNA, 22 nt, Human
cugaaauuccauuucagccaca

SEQ ID NO: 416647 - RNA, 22 nt, Human
ccaggggaaacagggagcacuc

SEQ ID NO: 416648 - RNA, 22 nt, Human
aggccagacagcuagaaacagg

SEQ ID NO: 416649 - RNA, 22 nt, Human
gacccaggguggucaccugaaa

SEQ ID NO: 416650 - RNA, 22 nt, Human
gccuggagaccugcuccucuac

SEQ ID NO: 416651 - RNA, 22 nt, Human
ugcuugagacacauaugaauuu

SEQ ID NO: 416652 - RNA, 22 nt, Human
auguccuuccauuuugaucugu

SEQ ID NO: 416653 - RNA, 22 nt, Human
acucugccuuucagcagaugaa

SEQ ID NO: 416654 - RNA, 22 nt, Human
cuggaaugccucccugucagag

SEQ ID NO: 416655 - RNA, 18 nt, Human
ucucagaggccauccuag

SEQ ID NO: 416656 - RNA, 22 nt, Human
gugucccaaucuacuuuucccu

SEQ ID NO: 416657 - RNA, 22 nt, Human
ggggcagagaauaaaaaccuaa

SEQ ID NO: 416658 - RNA, 22 nt, Human
auucucaguucacuaguuucuu

SEQ ID NO: 416659 - RNA, 22 nt, Human
agcagccacagcagaucugagu

SEQ ID NO: 416660 - RNA, 23 nt, Human
uggcauuuuaguuagcuucagug

SEQ ID NO: 416661 - RNA, 22 nt, Human
ucuucacaccgggcagcaggaa

SEQ ID NO: 416662 - RNA, 22 nt, Human
cagcagagcauuugguaggagg

SEQ ID NO: 416663 - RNA, 22 nt, Human
caguguacuuggaauguaacag

SEQ ID NO: 416664 - RNA, 22 nt, Human
ccugucaggguuugccucagaa

SEQ ID NO: 416665 - RNA, 22 nt, Human
cacccaggcuggagugcagggg

SEQ ID NO: 416666 - RNA, 22 nt, Human
acagugucuccugguacccagu

SEQ ID NO: 416667 - RNA, 22 nt, Human
gcagcagagcuuuguccuggcu

SEQ ID NO: 416668 - RNA, 20 nt, Human
cagcuuggaugagaggcuga

SEQ ID NO: 416669 - RNA, 22 nt, Human
caggugcccagcuccugcugug

SEQ ID NO: 416670 - RNA, 22 nt, Human
ccuggcugguggcagcgacaag

SEQ ID NO: 416671 - RNA, 23 nt, Human
ucaggauauugugugccaaggug

SEQ ID NO: 416672 - RNA, 22 nt, Human
agcaggaacucagggaguucuc

SEQ ID NO: 416673 - RNA, 22 nt, Human
ugaugggaggugcugcaggacc

SEQ ID NO: 416674 - RNA, 22 nt, Human
agggcucugagugggaaagagg

SEQ ID NO: 416675 - RNA, 22 nt, Human
aagcagaacugggaaguagugg

SEQ ID NO: 416676 - RNA, 22 nt, Human
ccugucuggaacauggccuguu

SEQ ID NO: 416677 - RNA, 22 nt, Human
aaacugaauucccaagggcaug

SEQ ID NO: 416678 - RNA, 22 nt, Human
gaaaaugugccuuuggguauug

SEQ ID NO: 416679 - RNA, 22 nt, Human
cauggccucaaaggacugcaga

SEQ ID NO: 416680 - RNA, 22 nt, Human
agcagccagaaagggcagucga

SEQ ID NO: 416681 - RNA, 22 nt, Human
uguggcaguauaagagcuagaa

SEQ ID NO: 416682 - RNA, 22 nt, Human
ugcaagcacucaaugcaaacag

SEQ ID NO: 416683 - RNA, 22 nt, Human
gcuggugagcaaaggagaagga

SEQ ID NO: 416684 - RNA, 22 nt, Human
acagcugugaaaauccacagga

SEQ ID NO: 416685 - RNA, 22 nt, Human
ugugacagaucuuuaaauaaug

SEQ ID NO: 416686 - RNA, 22 nt, Human
aaauucuuucauggcuaauaag

SEQ ID NO: 416687 - RNA, 20 nt, Human
ugcagggcucugcuucucuc

SEQ ID NO: 416688 - RNA, 22 nt, Human
agaaguuaccacauacuucucu

SEQ ID NO: 416689 - RNA, 22 nt, Human
agcugcccuggcggagcugcuc

SEQ ID NO: 416690 - RNA, 22 nt, Human
ggcugcagauagccagccacca

SEQ ID NO: 416691 - RNA, 22 nt, Human
augaugguggguaauguguaaa

SEQ ID NO: 416692 - RNA, 22 nt, Human
ccuguacauuagcugugaauug

SEQ ID NO: 416693 - RNA, 22 nt, Human
ggagcuguugcgcaugcgcucg

SEQ ID NO: 416694 - RNA, 22 nt, Human
ggcugccugggagcccuccucu

SEQ ID NO: 416695 - RNA, 22 nt, Human
ugcaaacaggagaguaaguaua

SEQ ID NO: 416696 - RNA, 22 nt, Human
gcaggaguguggugggacaucc

SEQ ID NO: 416697 - RNA, 22 nt, Human
agccaaggacacggagccuccu

SEQ ID NO: 416698 - RNA, 20 nt, Human
uucuuaaagaccucacuuug

SEQ ID NO: 416699 - RNA, 22 nt, Human
gcugcccauuccacuggauggu

SEQ ID NO: 416700 - RNA, 22 nt, Human
aguguguguuugggcgguuuau

SEQ ID NO: 416701 - RNA, 22 nt, Human
uucucuuagcuguaaagucaau

SEQ ID NO: 416702 - RNA, 22 nt, Human
gaggccuggagccgccuaggcg

SEQ ID NO: 416703 - RNA, 22 nt, Human
gcugccuggagcucagccugcc

SEQ ID NO: 416704 - RNA, 22 nt, Human
aggagcugagggagcgcccuug

SEQ ID NO: 416705 - RNA, 22 nt, Human
uggcagagcaaaaagauagaau

SEQ ID NO: 416706 - RNA, 19 nt, Human
ugggcagcucccucugucc

SEQ ID NO: 416707 - RNA, 22 nt, Human
cauuguuaccaucuuuuaccua

SEQ ID NO: 416708 - RNA, 22 nt, Human
gcugaggccccagggugauggg

SEQ ID NO: 416709 - RNA, 22 nt, Human
aggcagccaguucagguuucuu

SEQ ID NO: 416710 - RNA, 22 nt, Human
agauuucaaugugagcauuagu

SEQ ID NO: 416711 - RNA, 22 nt, Human
uguccacaucacucacuuguca

SEQ ID NO: 416712 - RNA, 22 nt, Human
cauccacuagaaugacagaguu

SEQ ID NO: 416713 - RNA, 22 nt, Human
auguaguguagagauuagucuc

SEQ ID NO: 416714 - RNA, 22 nt, Human
gggaaggagccugcuugcuaga

SEQ ID NO: 416715 - RNA, 22 nt, Human
ucauugcaguagggagagaccc

SEQ ID NO: 416716 - RNA, 22 nt, Human
ucauuacagagauauaaucuac

SEQ ID NO: 416717 - RNA, 22 nt, Human
uucacaggaggguggaugcaug

SEQ ID NO: 416718 - RNA, 22 nt, Human
guaaacaugcuguguacucagc

SEQ ID NO: 416719 - RNA, 22 nt, Human
uuggcucaggaccccugugacu

SEQ ID NO: 416720 - RNA, 22 nt, Human
ccucgaccuccccaggcucagg

SEQ ID NO: 416721 - RNA, 22 nt, Human
gucagcacuuuuccgaggcaga

SEQ ID NO: 416722 - RNA, 22 nt, Human
ggcuuccuuucacuacccucag

SEQ ID NO: 416723 - RNA, 22 nt, Human
guguuuccaguucagaaagcaa

SEQ ID NO: 416724 - RNA, 22 nt, Human
agaccaugggcucugaagagca

SEQ ID NO: 416725 - RNA, 22 nt, Human
uggcucagaguucaucuuuuag

SEQ ID NO: 416726 - RNA, 22 nt, Human
agaaaucugacugcugugcaca

SEQ ID NO: 416727 - RNA, 22 nt, Human
ucauuuucaaguuugaacagga

SEQ ID NO: 416728 - RNA, 22 nt, Human
ugacuccaaacagaaaacgaau

SEQ ID NO: 416729 - RNA, 22 nt, Human
uccuuccucggggacccagauc

SEQ ID NO: 416730 - RNA, 22 nt, Human
uuucacauaaauauuaugccua

SEQ ID NO: 416731 - RNA, 18 nt, Human
agcagcugucagaaugcc

SEQ ID NO: 416732 - RNA, 18 nt, Human
aggggcagcuugugugga

SEQ ID NO: 416733 - RNA, 22 nt, Human
uggggcugaggagccucacucu

SEQ ID NO: 416734 - RNA, 22 nt, Human
ugcccacauucaaaaggugaug

SEQ ID NO: 416735 - RNA, 22 nt, Human
cuggugggagcagcaggcagcu

SEQ ID NO: 416736 - RNA, 20 nt, Human
uggcaggaauagggccagag

SEQ ID NO: 416737 - RNA, 22 nt, Human
ugagcccaggaguuggagaccg

SEQ ID NO: 416738 - RNA, 22 nt, Human
agggaccucuucuugcagcuga

SEQ ID NO: 416739 - RNA, 22 nt, Human
cagccucuaagcacagccucuc

SEQ ID NO: 416740 - RNA, 22 nt, Human
uauugaaaugaaugacagugau

SEQ ID NO: 416741 - RNA, 22 nt, Human
ugaaggccacuuccugugagcu

SEQ ID NO: 416742 - RNA, 22 nt, Human
uccuggagauaauugcagugaa

SEQ ID NO: 416743 - RNA, 22 nt, Human
gaggcagugaacaauuccugug

SEQ ID NO: 416744 - RNA, 22 nt, Human
uuagauaaauugcaacuugauu

SEQ ID NO: 416745 - RNA, 22 nt, Human
ugacacagaaauuaagcuguca

SEQ ID NO: 416746 - RNA, 22 nt, Human
agggcagccaugagccuucagg

SEQ ID NO: 416747 - RNA, 21 nt, Human
gccucugcugucuuauuguga

SEQ ID NO: 416748 - RNA, 22 nt, Human
gaauucugucgcuuacuagaug

SEQ ID NO: 416749 - RNA, 18 nt, Human
uucagcagcagacacacu

SEQ ID NO: 416750 - RNA, 22 nt, Human
ucaaggcuaaacuuucagagua

SEQ ID NO: 416751 - RNA, 22 nt, Human
cuggagccgcauggagcaggga

SEQ ID NO: 416752 - RNA, 22 nt, Human
agagaggcgaguuaccugugcu

SEQ ID NO: 416753 - RNA, 22 nt, Human
uuucuucugagaucagggagaa

SEQ ID NO: 416754 - RNA, 22 nt, Human
caggaggcuccuagggcucugu

SEQ ID NO: 416755 - RNA, 22 nt, Human
gcugcaggggggucuggacuug

SEQ ID NO: 416756 - RNA, 22 nt, Human
aagaagguguggaaagaugcuc

SEQ ID NO: 416757 - RNA, 22 nt, Human
acaggcuggugguccuggccau

SEQ ID NO: 416758 - RNA, 19 nt, Human
uuagggacaugaauucuag

SEQ ID NO: 416759 - RNA, 22 nt, Human
ucaaaccaccuuguuacugggg

SEQ ID NO: 416760 - RNA, 22 nt, Human
caguuucuucaucaguuaagca

SEQ ID NO: 416761 - RNA, 22 nt, Human
ucacaagauacaguuagaagca

SEQ ID NO: 416762 - RNA, 22 nt, Human
gcccagcuggcuuccagcacau

SEQ ID NO: 416763 - RNA, 22 nt, Human
caggauggagaguuguugguug

SEQ ID NO: 416764 - RNA, 18 nt, Human
uggacaggguggagaaaa

SEQ ID NO: 416765 - RNA, 19 nt, Human
cugaagucuuuucagcugg

SEQ ID NO: 416766 - RNA, 22 nt, Human
uaauccacaauagagauuaucu

SEQ ID NO: 416767 - RNA, 20 nt, Human
ggcagggcaucaacagcucu

SEQ ID NO: 416768 - RNA, 22 nt, Human
uacaaaguagaaauucaguaaa

SEQ ID NO: 416769 - RNA, 22 nt, Human
acauauuuccaugcagcauguc

SEQ ID NO: 416770 - RNA, 22 nt, Human
agcugcccugggucuugcugcu

SEQ ID NO: 416771 - RNA, 22 nt, Human
aucuggcuccuacacuugaaga

SEQ ID NO: 416772 - RNA, 22 nt, Human
ccugagagagaagcgaccuggu

SEQ ID NO: 416773 - RNA, 22 nt, Human
ucucuuaaaagauuuuaaugac

SEQ ID NO: 416774 - RNA, 22 nt, Human
agccaagcugaucuccugcuga

SEQ ID NO: 416775 - RNA, 22 nt, Human
cuggagccuagguugaccuggg

SEQ ID NO: 416776 - RNA, 22 nt, Human
cccagcacuuugaauaugucac

SEQ ID NO: 416777 - RNA, 22 nt, Human
ccugggcagggagaccaggcuc

SEQ ID NO: 416778 - RNA, 22 nt, Human
uagaaauguugguauuaacauu

SEQ ID NO: 416779 - RNA, 22 nt, Human
cauggggagacaccuagggaaa

SEQ ID NO: 416780 - RNA, 22 nt, Human
ugagcccagagcccuuguaggg

SEQ ID NO: 416781 - RNA, 22 nt, Human
ggagcugcacgcucugaagccu

SEQ ID NO: 416782 - RNA, 22 nt, Human
cauuugcauaugaagaaguaag

SEQ ID NO: 416783 - RNA, 22 nt, Human
cuccaguggcaaguccgggcgg

SEQ ID NO: 416784 - RNA, 22 nt, Human
ccaggcagcucugauuuauguc

SEQ ID NO: 416785 - RNA, 22 nt, Human
agguaaagacagugaaagaggg

SEQ ID NO: 416786 - RNA, 22 nt, Human
agaugugguaguugaagggaag

SEQ ID NO: 416787 - RNA, 22 nt, Human
gugccugugcggacucagggaa

SEQ ID NO: 416788 - RNA, 22 nt, Human
ugggcuccggcggccucaggcu

SEQ ID NO: 416789 - RNA, 22 nt, Human
cucuguccuccaccugcuuuca

SEQ ID NO: 416790 - RNA, 22 nt, Human
agagauaugaguaguugugaca

SEQ ID NO: 416791 - RNA, 20 nt, Human
guccugggagccacagcaca

SEQ ID NO: 416792 - RNA, 22 nt, Human
aguggggaagagcaugggcccu

SEQ ID NO: 416793 - RNA, 22 nt, Human
ccuggcuuccuggagcucacaa

SEQ ID NO: 416794 - RNA, 22 nt, Human
agcucacagaaauccugcagga

SEQ ID NO: 416795 - RNA, 16 nt, Human
ccacagggcaaggggc

SEQ ID NO: 416796 - RNA, 22 nt, Human
uuucaaugacacaaaagagaaa

SEQ ID NO: 416797 - RNA, 22 nt, Human
guggccucugugcuccugccua

SEQ ID NO: 416798 - RNA, 22 nt, Human
aucugacaaccuauugacuuga

SEQ ID NO: 416799 - RNA, 22 nt, Human
ucagagagaaauaguuuuugac

SEQ ID NO: 416800 - RNA, 22 nt, Human
agggcagauggaacuuccccga

SEQ ID NO: 416801 - RNA, 22 nt, Human
gccaggcauucuagaaguagug

SEQ ID NO: 416802 - RNA, 22 nt, Human
uaggcagaaaggaaggcaaguu

SEQ ID NO: 416803 - RNA, 22 nt, Human
uaauuucuggagggagaaagag

SEQ ID NO: 416804 - RNA, 20 nt, Human
gaggccucagccucagcucc

SEQ ID NO: 416805 - RNA, 22 nt, Human
aaaagguaguugccaaauaagg

SEQ ID NO: 416806 - RNA, 22 nt, Human
ucacagaaauaagauaguuauu

SEQ ID NO: 416807 - RNA, 22 nt, Human
acccagcuaacccuacccugga

SEQ ID NO: 416808 - RNA, 22 nt, Human
agggcagcagcccauggcucug

SEQ ID NO: 416809 - RNA, 17 nt, Human
gcagugaaaagagauca

SEQ ID NO: 416810 - RNA, 22 nt, Human
aauuucaaacuaauaggaacca

SEQ ID NO: 416811 - RNA, 19 nt, Human
aauguaguguuaugucaac

SEQ ID NO: 416812 - RNA, 22 nt, Human
gaggccuggugugucucccgcu

SEQ ID NO: 416813 - RNA, 22 nt, Human
aaaugcacaggagaaccaauuc

SEQ ID NO: 416814 - RNA, 21 nt, Human
cucuggaggcaagggagagug

SEQ ID NO: 416815 - RNA, 22 nt, Human
aaggcagagggcuggaucagag

SEQ ID NO: 416816 - RNA, 22 nt, Human
caguggagaggcaugcuuggca

SEQ ID NO: 416817 - RNA, 22 nt, Human
ggcuggccuguguggccgccac

SEQ ID NO: 416818 - RNA, 22 nt, Human
uauaauuuuaagugguaaauua

SEQ ID NO: 416819 - RNA, 22 nt, Human
ucauucuccucuggaaaaggca

SEQ ID NO: 416820 - RNA, 22 nt, Human
cccacucccugcacgccugccg

SEQ ID NO: 416821 - RNA, 22 nt, Human
ugggcagaaggaagagccaccu

SEQ ID NO: 416822 - RNA, 22 nt, Human
gccaguggcaugcggcagggac

SEQ ID NO: 416823 - RNA, 22 nt, Human
aggcuggguaccugucauaugc

SEQ ID NO: 416824 - RNA, 22 nt, Human
aauuaugagguagauaucacau

SEQ ID NO: 416825 - RNA, 22 nt, Human
gcugguuaggugagggugcgcc

SEQ ID NO: 416826 - RNA, 22 nt, Human
aggcugagagcaacgugucaga

SEQ ID NO: 416827 - RNA, 22 nt, Human
ggcuuuauuucacuguaccaua

SEQ ID NO: 416828 - RNA, 22 nt, Human
uuuaaucaggcaaagcauaaua

SEQ ID NO: 416829 - RNA, 22 nt, Human
aggccacaguacuuugcagacc

SEQ ID NO: 416830 - RNA, 18 nt, Human
ggcaugugagugcugagg

SEQ ID NO: 416831 - RNA, 19 nt, Human
uucaggauugacccuacug

SEQ ID NO: 416832 - RNA, 22 nt, Human
ggcagugagucccggagaggcc

SEQ ID NO: 416833 - RNA, 22 nt, Human
uuuugagauggugucucgcucc

SEQ ID NO: 416834 - RNA, 22 nt, Human
ggggacaguuaaagaccaagac

SEQ ID NO: 416835 - RNA, 22 nt, Human
uccaggcauguggccaguacuc

SEQ ID NO: 416836 - RNA, 22 nt, Human
uccaggcaguuuuccagguugu

SEQ ID NO: 416837 - RNA, 20 nt, Human
ccagagcagccacugaaguu

SEQ ID NO: 416838 - RNA, 22 nt, Human
gcuguccaugucuggccucagu

SEQ ID NO: 416839 - RNA, 18 nt, Human
aaugcacacauuuacucc

SEQ ID NO: 416840 - RNA, 22 nt, Human
acaguggaugacauccuuuugc

SEQ ID NO: 416841 - RNA, 22 nt, Human
ggugaccucaccuggucccacc

SEQ ID NO: 416842 - RNA, 22 nt, Human
agaugaagacucaggagcaggu

SEQ ID NO: 416843 - RNA, 22 nt, Human
aggcuccuugcucacaggcuca

SEQ ID NO: 416844 - RNA, 22 nt, Human
auuuccucaugaucauaaugca

SEQ ID NO: 416845 - RNA, 22 nt, Human
agagaugaaaaguggagacugg

SEQ ID NO: 416846 - RNA, 22 nt, Human
uaugcacaauaugaucuauuug

SEQ ID NO: 416847 - RNA, 20 nt, Human
augugagggguugaaguggg

SEQ ID NO: 416848 - RNA, 22 nt, Human
auauucuuccaaaacaucauuu

SEQ ID NO: 416849 - RNA, 22 nt, Human
ucucuuauuuugccuuugacaa

SEQ ID NO: 416850 - RNA, 22 nt, Human
cugugucccccucagccaggug

SEQ ID NO: 416851 - RNA, 22 nt, Human
ucacaacuugaagcugauuuaa

SEQ ID NO: 416852 - RNA, 22 nt, Human
aaugucugaaaaucagacugca

SEQ ID NO: 416853 - RNA, 22 nt, Human
gcugagcucccagcaguaucug

SEQ ID NO: 416854 - RNA, 22 nt, Human
uggcagggugggcuucagcccc

SEQ ID NO: 416855 - RNA, 22 nt, Human
uccagcagguuggucaggugca

SEQ ID NO: 416856 - RNA, 22 nt, Human
ggcaggagggcggacaaugacc

SEQ ID NO: 416857 - RNA, 22 nt, Human
ugaguccauguggaggggaggu

SEQ ID NO: 416858 - RNA, 22 nt, Human
ggccaugguuggggaagacaug

SEQ ID NO: 416859 - RNA, 22 nt, Human
ucagagaggcaauacuguuuaa

SEQ ID NO: 416860 - RNA, 22 nt, Human
uguggaaaagaauaagggagau

SEQ ID NO: 416861 - RNA, 22 nt, Human
cucuggagaacuccuugugucu

SEQ ID NO: 416862 - RNA, 22 nt, Human
gggccugacugagagcuccuca

SEQ ID NO: 416863 - RNA, 23 nt, Human
gggaccugguaggaggugauugg

SEQ ID NO: 416864 - RNA, 22 nt, Human
uguauacauuuaacuagauaga

SEQ ID NO: 416865 - RNA, 22 nt, Human
cagccagugugaccgaggagga

SEQ ID NO: 416866 - RNA, 22 nt, Human
ccacaggggcccacgagccgcu

SEQ ID NO: 416867 - RNA, 22 nt, Human
ccagccuuacugcccuucagug

SEQ ID NO: 416868 - RNA, 22 nt, Human
ucgggguagacgccagcucgga

SEQ ID NO: 416869 - RNA, 22 nt, Human
ugugaaagcaagucuaguucuc

SEQ ID NO: 416870 - RNA, 22 nt, Human
uuagccaugcccuagaagagga

SEQ ID NO: 416871 - RNA, 20 nt, Human
ucccuggaggugguggcauc

SEQ ID NO: 416872 - RNA, 22 nt, Human
uaaugcuuuguuuugaucuaac

SEQ ID NO: 416873 - RNA, 22 nt, Human
gugcaaugugcuucgugccaug

SEQ ID NO: 416874 - RNA, 21 nt, Human
uggcucugaaagagugcugca

SEQ ID NO: 416875 - RNA, 22 nt, Human
ugagccuggcggaagcagcgug

SEQ ID NO: 416876 - RNA, 16 nt, Human
ugggcagaugagaaga

SEQ ID NO: 416877 - RNA, 22 nt, Human
aauauuucuccuucguuauagc

SEQ ID NO: 416878 - RNA, 22 nt, Human
cugugacuagaccugcaggaga

SEQ ID NO: 416879 - RNA, 23 nt, Human
ccucagcauggcaggagcccagc

SEQ ID NO: 416880 - RNA, 22 nt, Human
gcagcccaaaaaagagguagau

SEQ ID NO: 416881 - RNA, 22 nt, Human
gaaaugugggucaugacccauu

SEQ ID NO: 416882 - RNA, 22 nt, Human
ccugggcuucugucuagauguu

SEQ ID NO: 416883 - RNA, 22 nt, Human
caaugacauggauaaucauauu

SEQ ID NO: 416884 - RNA, 22 nt, Human
caucaucaaaagugacagagaa

SEQ ID NO: 416885 - RNA, 22 nt, Human
ggaggcagaauagagugugggu

SEQ ID NO: 416886 - RNA, 18 nt, Human
agucucagcggaggagua

SEQ ID NO: 416887 - RNA, 19 nt, Human
caucuggaugauucuccug

SEQ ID NO: 416888 - RNA, 22 nt, Human
cagaggaaaguauuucuggaag

SEQ ID NO: 416889 - RNA, 22 nt, Human
aagaugauaggacuugcuuaag

SEQ ID NO: 416890 - RNA, 19 nt, Human
uggcugggugccaauggcc

SEQ ID NO: 416891 - RNA, 22 nt, Human
uuaaaaugcagauucugauuca

SEQ ID NO: 416892 - RNA, 19 nt, Human
aucuuacagagcagaguac

SEQ ID NO: 416893 - RNA, 22 nt, Human
guggcugcuacagagcuggagg

SEQ ID NO: 416894 - RNA, 22 nt, Human
agauggagaccuuggaugaacu

SEQ ID NO: 416895 - RNA, 22 nt, Human
ggauggcagucugcaugagaaa

SEQ ID NO: 416896 - RNA, 22 nt, Human
accaaggagacaaagguguauu

SEQ ID NO: 416897 - RNA, 22 nt, Human
ccagcuccaaguuugggcauca

SEQ ID NO: 416898 - RNA, 22 nt, Human
cagagcaguccuugucaaucag

SEQ ID NO: 416899 - RNA, 22 nt, Human
cucaaggaaagucuggagaaga

SEQ ID NO: 416900 - RNA, 22 nt, Human
ugcuuucaaaggcuuucuagau

SEQ ID NO: 416901 - RNA, 22 nt, Human
uggcagcuuccugcucauagga

SEQ ID NO: 416902 - RNA, 22 nt, Human
auccaaaccuggacaugagugg

SEQ ID NO: 416903 - RNA, 22 nt, Human
cagcugcccaggccaccuggag

SEQ ID NO: 416904 - RNA, 17 nt, Human
acagggcagaaacagcu

SEQ ID NO: 416905 - RNA, 22 nt, Human
ggccucagaccggagcuggcca

SEQ ID NO: 416906 - RNA, 22 nt, Human
aacaaguaaguuuauauauauu

SEQ ID NO: 416907 - RNA, 22 nt, Human
uauuucugaggcccaggaagug

SEQ ID NO: 416908 - RNA, 21 nt, Human
aggcagcucaggcccagagag

SEQ ID NO: 416909 - RNA, 22 nt, Human
caggaggaggugagguagaacu

SEQ ID NO: 416910 - RNA, 20 nt, Human
cucugcagcaaggccugggu

SEQ ID NO: 416911 - RNA, 22 nt, Human
gagagugaugaaugguuaaaca

SEQ ID NO: 416912 - RNA, 22 nt, Human
cagcugaauucuucagacucca

SEQ ID NO: 416913 - RNA, 22 nt, Human
aggaggcugguucaggccauau

SEQ ID NO: 416914 - RNA, 22 nt, Human
accaugccaguggcagccagac

SEQ ID NO: 416915 - RNA, 22 nt, Human
cagggagcuggcuggcugugcc

SEQ ID NO: 416916 - RNA, 22 nt, Human
guucaaguucauaucucuuaac

SEQ ID NO: 416917 - RNA, 22 nt, Human
uuagauaacaguagaauaucaa

SEQ ID NO: 416918 - RNA, 20 nt, Human
cucuuaaauguaaaguaggc

SEQ ID NO: 416919 - RNA, 22 nt, Human
ggcugcagcagagggacucacg

SEQ ID NO: 416920 - RNA, 22 nt, Human
gauuuucaugauaaacuuguga

SEQ ID NO: 416921 - RNA, 22 nt, Human
ugagcaucuuuuuacagguuua

SEQ ID NO: 416922 - RNA, 22 nt, Human
gcagcugccgugagcucacgcc

SEQ ID NO: 416923 - RNA, 22 nt, Human
ucaaaguaaaaguauagaguuu

SEQ ID NO: 416924 - RNA, 22 nt, Human
ccugggcaacauagugagaccu

SEQ ID NO: 416925 - RNA, 22 nt, Human
uauugaaauccauuacguucuu

SEQ ID NO: 416926 - RNA, 22 nt, Human
agagccugaggaugucccagcu

SEQ ID NO: 416927 - RNA, 22 nt, Human
cagacaugauguaagcagaggc

SEQ ID NO: 416928 - RNA, 22 nt, Human
gggcugagaaguugaucccaag

SEQ ID NO: 416929 - RNA, 22 nt, Human
uacuuucuguccuucuguuaaa

SEQ ID NO: 416930 - RNA, 22 nt, Human
acauuucuggaguuucucaaca

SEQ ID NO: 416931 - RNA, 22 nt, Human
gcuguauuuauuuucuaggguu

SEQ ID NO: 416932 - RNA, 22 nt, Human
aggucaaaccacagcucuaggc

SEQ ID NO: 416933 - RNA, 22 nt, Human
ugcagaaguauuccaggcccca

SEQ ID NO: 416934 - RNA, 22 nt, Human
ugugacaucgcugugucuguuu

SEQ ID NO: 416935 - RNA, 22 nt, Human
cucucccccacagcagccuucu

SEQ ID NO: 416936 - RNA, 22 nt, Human
gagaggcugaaaucacaggagc

SEQ ID NO: 416937 - RNA, 22 nt, Human
augcagcaguuuacaaagcaau

SEQ ID NO: 416938 - RNA, 22 nt, Human
caggcagcaggagcccugcucg

SEQ ID NO: 416939 - RNA, 22 nt, Human
uggccuggcagagcaaggccug

SEQ ID NO: 416940 - RNA, 22 nt, Human
cccuggagugugacgaggcauu

SEQ ID NO: 416941 - RNA, 22 nt, Human
gcuguuccugcuuagaggucgg

SEQ ID NO: 416942 - RNA, 22 nt, Human
ugagggaggcccuuugagcaga

SEQ ID NO: 416943 - RNA, 22 nt, Human
uucuucaaaauccagcaugauu

SEQ ID NO: 416944 - RNA, 22 nt, Human
aacauuucuucugaaacugagu

SEQ ID NO: 416945 - RNA, 22 nt, Human
ggcuguggggccggguacagug

SEQ ID NO: 416946 - RNA, 22 nt, Human
ggagcugggguuggcaucuucc

SEQ ID NO: 416947 - RNA, 22 nt, Human
gggggacuggaccguccugggu

SEQ ID NO: 416948 - RNA, 22 nt, Human
gcaggggcugagcaccagcggg

SEQ ID NO: 416949 - RNA, 23 nt, Human
ccagggccccuacaccacugucc

SEQ ID NO: 416950 - RNA, 22 nt, Human
agcagggcuucugugccugugc

SEQ ID NO: 416951 - RNA, 22 nt, Human
cucaggaugcaauuccaucaag

SEQ ID NO: 416952 - RNA, 22 nt, Human
uggcaggagacacauggcauag

SEQ ID NO: 416953 - RNA, 22 nt, Human
ugcagggccaugguggcggcug

SEQ ID NO: 416954 - RNA, 22 nt, Human
gacagggccgcagauggagacu

SEQ ID NO: 416955 - RNA, 22 nt, Human
aaaauacacauacuaggggaaa

SEQ ID NO: 416956 - RNA, 22 nt, Human
aagugaaacauguaucucuuua

SEQ ID NO: 416957 - RNA, 23 nt, Human
ccugugugcccuuaauucacagc

SEQ ID NO: 416958 - RNA, 22 nt, Human
cuccuuccugguuagcaccuua

SEQ ID NO: 416959 - RNA, 22 nt, Human
ugcauugcauuugucaugaaga

SEQ ID NO: 416960 - RNA, 22 nt, Human
uauguacauguuaaagggcaaa

SEQ ID NO: 416961 - RNA, 22 nt, Human
cauuuguuaauuacuauuaucu

SEQ ID NO: 416962 - RNA, 22 nt, Human
auaugcauguacgugugcacaa

SEQ ID NO: 416963 - RNA, 22 nt, Human
caauguaucaagaagcaucagu

SEQ ID NO: 416964 - RNA, 22 nt, Human
cucuguccuugcacaguuccua

SEQ ID NO: 416965 - RNA, 22 nt, Human
ccuggcagguggagguugcagu

SEQ ID NO: 416966 - RNA, 22 nt, Human
agagugggugaucucuguuguc

SEQ ID NO: 416967 - RNA, 18 nt, Human
cuguccaguagacucugc

SEQ ID NO: 416968 - RNA, 22 nt, Human
guuuuuccuugcugaggacccg

SEQ ID NO: 416969 - RNA, 22 nt, Human
agugggcaggcagggugcgcag

SEQ ID NO: 416970 - RNA, 22 nt, Human
uagaaaugauuuugaugcuuca

SEQ ID NO: 416971 - RNA, 18 nt, Human
uggcagagugucuguucu

SEQ ID NO: 416972 - RNA, 22 nt, Human
cugagcaggauauucacagcag

SEQ ID NO: 416973 - RNA, 22 nt, Human
uggccuuggacagagcgcuccu

SEQ ID NO: 416974 - RNA, 22 nt, Human
uauuucuugaguggucaguuuc

SEQ ID NO: 416975 - RNA, 22 nt, Human
gagcugccagacaugggaauga

SEQ ID NO: 416976 - RNA, 22 nt, Human
cuccagucuaguagagccugcu

SEQ ID NO: 416977 - RNA, 22 nt, Human
uagagcaguuggcagcuguauu

SEQ ID NO: 416978 - RNA, 22 nt, Human
uauguguacaucugguugagca

SEQ ID NO: 416979 - RNA, 22 nt, Human
ucucaggguuuccugggggcug

SEQ ID NO: 416980 - RNA, 22 nt, Human
gugaauggggcaggaaggaugg

SEQ ID NO: 416981 - RNA, 22 nt, Human
ucugccuggauuccauucucca

SEQ ID NO: 416982 - RNA, 22 nt, Human
ggcuugcuucuuguccaggaau

SEQ ID NO: 416983 - RNA, 22 nt, Human
ggaggaagcacacggcuuguau

SEQ ID NO: 416984 - RNA, 19 nt, Human
ggcauccagaacuaccagu

SEQ ID NO: 416985 - RNA, 22 nt, Human
cugugaggcccugggugcugga

SEQ ID NO: 416986 - RNA, 23 nt, Human
uggccucuccccaccuggcagaa

SEQ ID NO: 416987 - RNA, 22 nt, Human
ugcagaggaccauuguccugga

SEQ ID NO: 416988 - RNA, 22 nt, Human
cgcagggccgcgagcgggacca

SEQ ID NO: 416989 - RNA, 22 nt, Human
uggccugccucccggcuucuuu

SEQ ID NO: 416990 - RNA, 22 nt, Human
uagcuuuaaaaaucaucaaagc

SEQ ID NO: 416991 - RNA, 22 nt, Human
ucugcgcugccuugauccuugg

SEQ ID NO: 416992 - RNA, 22 nt, Human
cagggugccuguccucagcaaa

SEQ ID NO: 416993 - RNA, 22 nt, Human
gaggccugguuuccagcauccu

SEQ ID NO: 416994 - RNA, 22 nt, Human
cagggcucccuugcaaggaggg

SEQ ID NO: 416995 - RNA, 22 nt, Human
uaugcacaccuggguccuuguc

SEQ ID NO: 416996 - RNA, 23 nt, Human
gggugggccaaauuagguagccu

SEQ ID NO: 416997 - RNA, 22 nt, Human
ucucacugggucacagcagagg

SEQ ID NO: 416998 - RNA, 22 nt, Human
ucccagcacgucugcuguuucu

SEQ ID NO: 416999 - RNA, 22 nt, Human
uccuggcccacuaugccagcau

SEQ ID NO: 417000 - RNA, 22 nt, Human
augcugugccuggaaagcggcu

SEQ ID NO: 417001 - RNA, 22 nt, Human
aagacaagcaucaaaucaggca

SEQ ID NO: 417002 - RNA, 22 nt, Human
ccaggguggcguagaugcuggg

SEQ ID NO: 417003 - RNA, 22 nt, Human
ucucaguguuaucuaucugccu

SEQ ID NO: 417004 - RNA, 22 nt, Human
aguaaacauuuucauauuuucu

SEQ ID NO: 417005 - RNA, 22 nt, Human
cagggccugcuuccuucuuguu

SEQ ID NO: 417006 - RNA, 22 nt, Human
uaggcagcugcaaacuucgguc

SEQ ID NO: 417007 - RNA, 22 nt, Human
agcuucuugaccaagccuguaa

SEQ ID NO: 417008 - RNA, 22 nt, Human
uauuuagaacagacaauagaaa

SEQ ID NO: 417009 - RNA, 22 nt, Human
ucagagugggagaaugugccaa

SEQ ID NO: 417010 - RNA, 22 nt, Human
uuccuguccgcaauggccuggg

SEQ ID NO: 417011 - RNA, 22 nt, Human
gcuucgggguccaagcgcgugu

SEQ ID NO: 417012 - RNA, 22 nt, Human
aggcuucccaagcagcugcaaa

SEQ ID NO: 417013 - RNA, 22 nt, Human
agacaggacacaagcugcauaa

SEQ ID NO: 417014 - RNA, 22 nt, Human
gcacagggcugccaggcggcuu

SEQ ID NO: 417015 - RNA, 22 nt, Human
aagagcuggcucuugcagcagc

SEQ ID NO: 417016 - RNA, 22 nt, Human
cauugcacaucugagaagagau

SEQ ID NO: 417017 - RNA, 22 nt, Human
aggucaggguauucacgucugu

SEQ ID NO: 417018 - RNA, 22 nt, Human
ggcuagaguggaacuggagcgg

SEQ ID NO: 417019 - RNA, 22 nt, Human
aauaugugagguauguucagug

SEQ ID NO: 417020 - RNA, 22 nt, Human
uacagucuuuggaaagagauag

SEQ ID NO: 417021 - RNA, 22 nt, Human
agccuggauccauguggcuacc

SEQ ID NO: 417022 - RNA, 22 nt, Human
caggcagccugcggucugcaca

SEQ ID NO: 417023 - RNA, 22 nt, Human
cccugcaggcucagacuggagu

SEQ ID NO: 417024 - RNA, 22 nt, Human
caaagagcuguucagugucgcu

SEQ ID NO: 417025 - RNA, 22 nt, Human
ucuguagcaagugagaggcauu

SEQ ID NO: 417026 - RNA, 22 nt, Human
acugccuuauaugcugugugug

SEQ ID NO: 417027 - RNA, 20 nt, Human
uuguuucugcuauuuucuaa

SEQ ID NO: 417028 - RNA, 19 nt, Human
uaaaaugucuguggucagu

SEQ ID NO: 417029 - RNA, 22 nt, Human
gaggcugcacuggcuaaaggcu

SEQ ID NO: 417030 - RNA, 22 nt, Human
auggcagccuguggacagucaa

SEQ ID NO: 417031 - RNA, 22 nt, Human
cuuucacacacauacauuugga

SEQ ID NO: 417032 - RNA, 22 nt, Human
cuucacauguuggaguccuuug

SEQ ID NO: 417033 - RNA, 22 nt, Human
aaacagaaauuuccucaugcuc

SEQ ID NO: 417034 - RNA, 22 nt, Human
ucaaaugcuucuacuccuaaga

SEQ ID NO: 417035 - RNA, 22 nt, Human
caucaaauggcaagugaaagcu

SEQ ID NO: 417036 - RNA, 23 nt, Human
acucacaaagcaggaucauguug

SEQ ID NO: 417037 - RNA, 22 nt, Human
agggccaggaucacagccaaga

SEQ ID NO: 417038 - RNA, 22 nt, Human
cugcagagaauuguggggcuuc

SEQ ID NO: 417039 - RNA, 22 nt, Human
aagagagaacucccuucgccag

SEQ ID NO: 417040 - RNA, 22 nt, Human
cucucugggcccaguuggcacc

SEQ ID NO: 417041 - RNA, 22 nt, Human
gggcugcuuuuaagggucucag

SEQ ID NO: 417042 - RNA, 22 nt, Human
caggaugguggcaugaucagaa

SEQ ID NO: 417043 - RNA, 22 nt, Human
cugugcuuaccugcccagguga

SEQ ID NO: 417044 - RNA, 22 nt, Human
gccugcuguuaacugcaggaau

SEQ ID NO: 417045 - RNA, 22 nt, Human
cuccucuuuggggauuuacaca

SEQ ID NO: 417046 - RNA, 22 nt, Human
agaggccaguggcugugcuguc

SEQ ID NO: 417047 - RNA, 23 nt, Human
ugcucugggaggcccuggagagc

SEQ ID NO: 417048 - RNA, 22 nt, Human
ugggcuggcugaacuucaaccu

SEQ ID NO: 417049 - RNA, 22 nt, Human
caggaaagagcugccaggcagg

SEQ ID NO: 417050 - RNA, 22 nt, Human
gucagaggggacaagacacaga

SEQ ID NO: 417051 - RNA, 22 nt, Human
uaaaggcuucugcagggacuga

SEQ ID NO: 417052 - RNA, 22 nt, Human
cugggcaguaugaauauucaaa

SEQ ID NO: 417053 - RNA, 22 nt, Human
gagcagaacuacucacauaucg

SEQ ID NO: 417054 - RNA, 22 nt, Human
cacaggugcuccucggggagcu

SEQ ID NO: 417055 - RNA, 22 nt, Human
ugcaccauacccauuccccucu

SEQ ID NO: 417056 - RNA, 22 nt, Human
acaggccuuggcaggcauguga

SEQ ID NO: 417057 - RNA, 21 nt, Human
gcccucaggggaggauggccu

SEQ ID NO: 417058 - RNA, 22 nt, Human
gaaccaaguaggauacaaggag

SEQ ID NO: 417059 - RNA, 22 nt, Human
aggcugccucgugagcucgcug

SEQ ID NO: 417060 - RNA, 22 nt, Human
ucuggaaguuagaggaggaaag

SEQ ID NO: 417061 - RNA, 22 nt, Human
cugggaguguucuaggucacau

SEQ ID NO: 417062 - RNA, 22 nt, Human
cagcaauaguguguuuguuuca

SEQ ID NO: 417063 - RNA, 19 nt, Human
gagggcucauuugaacaau

SEQ ID NO: 417064 - RNA, 22 nt, Human
aucuauuaugcugagaaacugu

SEQ ID NO: 417065 - RNA, 22 nt, Human
gggagguucuguucgcacuuga

SEQ ID NO: 417066 - RNA, 22 nt, Human
ugcaccugagaggucucugagg

SEQ ID NO: 417067 - RNA, 22 nt, Human
uggcccugccacucacugcuga

SEQ ID NO: 417068 - RNA, 22 nt, Human
ccugggcagggcuggacucuca

SEQ ID NO: 417069 - RNA, 22 nt, Human
cuggccuuuagccccagugucu

SEQ ID NO: 417070 - RNA, 22 nt, Human
guaaaauugcaauuacuuuugc

SEQ ID NO: 417071 - RNA, 22 nt, Human
aagacauuacuggaaucugacu

SEQ ID NO: 417072 - RNA, 22 nt, Human
gaagcccagcaaacugugauca

SEQ ID NO: 417073 - RNA, 22 nt, Human
cagagcagaagcgguccucaca

SEQ ID NO: 417074 - RNA, 22 nt, Human
aaagucaaaaugcucuccuguc

SEQ ID NO: 417075 - RNA, 22 nt, Human
uguggccagcagguggcugugu

SEQ ID NO: 417076 - RNA, 22 nt, Human
aaggcccuaauagagcacauau

SEQ ID NO: 417077 - RNA, 22 nt, Human
cuauuagguuggugcaaaagua

SEQ ID NO: 417078 - RNA, 20 nt, Human
uuuacauuuugaaacaguga

SEQ ID NO: 417079 - RNA, 19 nt, Human
uucacauuggaagaaguag

SEQ ID NO: 417080 - RNA, 22 nt, Human
gcugccuuugugagccaagggg

SEQ ID NO: 417081 - RNA, 22 nt, Human
acuuuggguaagccaggugcua

SEQ ID NO: 417082 - RNA, 22 nt, Human
cagcuuuuuagaaucuagggca

SEQ ID NO: 417083 - RNA, 19 nt, Human
ugaguucugugguucucaa

SEQ ID NO: 417084 - RNA, 22 nt, Human
gcccaucaucacuguggaggcu

SEQ ID NO: 417085 - RNA, 22 nt, Human
ucagaggaacuggacuaaagcc

SEQ ID NO: 417086 - RNA, 19 nt, Human
ggugaccaccuggucagug

SEQ ID NO: 417087 - RNA, 22 nt, Human
ggaugcugcuaucaggcuucga

SEQ ID NO: 417088 - RNA, 22 nt, Human
gaagucuggcugacgagaguua

SEQ ID NO: 417089 - RNA, 22 nt, Human
ucccagaggcuccagucucuau

SEQ ID NO: 417090 - RNA, 23 nt, Human
gccucugcucugcguuggggacu

SEQ ID NO: 417091 - RNA, 22 nt, Human
gcuggcagguccaagauagagc

SEQ ID NO: 417092 - RNA, 22 nt, Human
gggcuggucuggcuuagucagg

SEQ ID NO: 417093 - RNA, 18 nt, Human
cccucuccugcuaguggg

SEQ ID NO: 417094 - RNA, 22 nt, Human
gcagggagguuugcugaccugg

SEQ ID NO: 417095 - RNA, 20 nt, Human
ggcugugcccuuccguggcc

SEQ ID NO: 417096 - RNA, 16 nt, Human
cagcuuuaugucagug

SEQ ID NO: 417097 - RNA, 22 nt, Human
agcagagcgccugcucagaggg

SEQ ID NO: 417098 - RNA, 22 nt, Human
acagcugugagggucacuugua

SEQ ID NO: 417099 - RNA, 22 nt, Human
gccucccuggcccacagcagcg

SEQ ID NO: 417100 - RNA, 22 nt, Human
agcuaggaaauugaggcugaga

SEQ ID NO: 417101 - RNA, 22 nt, Human
ucugcugcacaaauucaucucu

SEQ ID NO: 417102 - RNA, 22 nt, Human
gcucaggacccaggugugaccu

SEQ ID NO: 417103 - RNA, 22 nt, Human
ucuuagaaauuccccaguggcu

SEQ ID NO: 417104 - RNA, 22 nt, Human
ccagcaccuugaucuuggaguu

SEQ ID NO: 417105 - RNA, 22 nt, Human
gccaggcuggucuugaacuccu

SEQ ID NO: 417106 - RNA, 22 nt, Human
gcucuguccagcgugcacagaa

SEQ ID NO: 417107 - RNA, 22 nt, Human
accagggcacaggagucugaag

SEQ ID NO: 417108 - RNA, 22 nt, Human
gugcaguggcagauccuagcuc

SEQ ID NO: 417109 - RNA, 22 nt, Human
cccaggcuggagugcaauggca

SEQ ID NO: 417110 - RNA, 22 nt, Human
cugcugucuuuauuucacugcu

SEQ ID NO: 417111 - RNA, 22 nt, Human
ugcaccauuuugucaggcuacu

SEQ ID NO: 417112 - RNA, 22 nt, Human
uggagaagucaaagugaacagg

SEQ ID NO: 417113 - RNA, 23 nt, Human
gccucagagaaacagcugcacac

SEQ ID NO: 417114 - RNA, 22 nt, Human
agacucugauaagcaacucuug

SEQ ID NO: 417115 - RNA, 22 nt, Human
auaucuuuguaugguucagcag

SEQ ID NO: 417116 - RNA, 20 nt, Human
uucuggaggcuacaagucug

SEQ ID NO: 417117 - RNA, 22 nt, Human
agaggugacauaggagaggcuc

SEQ ID NO: 417118 - RNA, 22 nt, Human
acacugugacaaaggcuguucu

SEQ ID NO: 417119 - RNA, 22 nt, Human
aauacaaucaaauucacuagca

SEQ ID NO: 417120 - RNA, 19 nt, Human
ccagaggacuguuaaugaa

SEQ ID NO: 417121 - RNA, 22 nt, Human
ggagagugggagcaacuguugc

SEQ ID NO: 417122 - RNA, 19 nt, Human
ugaagcagcaaacucucag

SEQ ID NO: 417123 - RNA, 22 nt, Human
auucagcauaaucaguagcuug

SEQ ID NO: 417124 - RNA, 22 nt, Human
cauuuauucaugaucuguagcu

SEQ ID NO: 417125 - RNA, 22 nt, Human
caguuucuuaucuucaaaauug

SEQ ID NO: 417126 - RNA, 22 nt, Human
cacauggggcgcugcauuggcc

SEQ ID NO: 417127 - RNA, 22 nt, Human
ugccagaguuacaugaggguca

SEQ ID NO: 417128 - RNA, 22 nt, Human
ugcuuccugaggccgucuucuc

SEQ ID NO: 417129 - RNA, 22 nt, Human
ggagaugguggaagcuggugca

SEQ ID NO: 417130 - RNA, 22 nt, Human
uuugcaauuugugcugcaaaug

SEQ ID NO: 417131 - RNA, 22 nt, Human
acacugugagcugaagggcugc

SEQ ID NO: 417132 - RNA, 22 nt, Human
cccucugcucaggugcauaggc

SEQ ID NO: 417133 - RNA, 22 nt, Human
gcagcccagguguagcucuuug

SEQ ID NO: 417134 - RNA, 22 nt, Human
ccauuguaaagaguauacuuug

SEQ ID NO: 417135 - RNA, 22 nt, Human
aucaguuugagugcugugucaa

SEQ ID NO: 417136 - RNA, 22 nt, Human
cugcuguguuucacaccucugg

SEQ ID NO: 417137 - RNA, 21 nt, Human
ugaagccugaggcauagcccc

SEQ ID NO: 417138 - RNA, 22 nt, Human
cuuauuuugcugaugacccagg

SEQ ID NO: 417139 - RNA, 23 nt, Human
aaggucacagaacuuagcaagcc

SEQ ID NO: 417140 - RNA, 22 nt, Human
gcaccugguuuauauaaucaua

SEQ ID NO: 417141 - RNA, 22 nt, Human
ucucagaguaauucuuuaaggu

SEQ ID NO: 417142 - RNA, 23 nt, Human
agaugaggcuucuccauguuggu

SEQ ID NO: 417143 - RNA, 22 nt, Human
auguaaggcugccuaugacacu

SEQ ID NO: 417144 - RNA, 22 nt, Human
gcaagcugcuuaagcucauugu

SEQ ID NO: 417145 - RNA, 22 nt, Human
agcugucuaccugcagaguccu

SEQ ID NO: 417146 - RNA, 22 nt, Human
guguacaugagaaaucaacuuu

SEQ ID NO: 417147 - RNA, 22 nt, Human
caagaauuguacaaacugggug

SEQ ID NO: 417148 - RNA, 22 nt, Human
augaaacaaaccucuauggagu

SEQ ID NO: 417149 - RNA, 22 nt, Human
ugggcugaguggcagccagagu

SEQ ID NO: 417150 - RNA, 22 nt, Human
gcucugaggcugggagcacucu

SEQ ID NO: 417151 - RNA, 22 nt, Human
gcuguggccaacaaaccacuuu

SEQ ID NO: 417152 - RNA, 22 nt, Human
cauuuauucauuugcuagggcu

SEQ ID NO: 417153 - RNA, 22 nt, Human
aucuggcuauugacauguuaua

SEQ ID NO: 417154 - RNA, 22 nt, Human
cugagauggccacugggucuca

SEQ ID NO: 417155 - RNA, 22 nt, Human
aaaguguugggaagaaagugca

SEQ ID NO: 417156 - RNA, 22 nt, Human
ccaaagucagugcucagucguc

SEQ ID NO: 417157 - RNA, 22 nt, Human
uagcuuuaaugaguugguaaga

SEQ ID NO: 417158 - RNA, 22 nt, Human
uauuuugacuauuaaaccaaca

SEQ ID NO: 417159 - RNA, 22 nt, Human
caaaggcuuccacugcauccuu

SEQ ID NO: 417160 - RNA, 22 nt, Human
cugggcacuugcucacagcucu

SEQ ID NO: 417161 - RNA, 22 nt, Human
caggggccaggcugucugcugu

SEQ ID NO: 417162 - RNA, 22 nt, Human
aucuggaacaaagcuuaggaau

SEQ ID NO: 417163 - RNA, 22 nt, Human
cacagggccuugugugacugca

SEQ ID NO: 417164 - RNA, 22 nt, Human
uuuuucauugcagccucucucc

SEQ ID NO: 417165 - RNA, 22 nt, Human
caauaugcaagcuauuaaguau

SEQ ID NO: 417166 - RNA, 22 nt, Human
uucaagaucgaguuuaaaguga

SEQ ID NO: 417167 - RNA, 22 nt, Human
aaggaaagacauauaaaugacu

SEQ ID NO: 417168 - RNA, 19 nt, Human
ccugggagucagcugaagg

SEQ ID NO: 417169 - RNA, 22 nt, Human
cauacauaugcauguguguaua

SEQ ID NO: 417170 - RNA, 22 nt, Human
acauacuaugaauacauguguc

SEQ ID NO: 417171 - RNA, 22 nt, Human
ugaacccaggagguugcaguga

SEQ ID NO: 417172 - RNA, 22 nt, Human
uguguccuuuggaggaucagcg

SEQ ID NO: 417173 - RNA, 22 nt, Human
agcccucugcaaacaccugaua

SEQ ID NO: 417174 - RNA, 22 nt, Human
gcugggcagccuggccgcugcc

SEQ ID NO: 417175 - RNA, 22 nt, Human
aaagcaaugaugguagacacgu

SEQ ID NO: 417176 - RNA, 22 nt, Human
augagcuucccagacaggaugg

SEQ ID NO: 417177 - RNA, 22 nt, Human
cugaggcuuugugugcaugccu

SEQ ID NO: 417178 - RNA, 22 nt, Human
cugcucuggucucuucauguuu

SEQ ID NO: 417179 - RNA, 22 nt, Human
uuccauaauaggcuuaagugaa

SEQ ID NO: 417180 - RNA, 22 nt, Human
uucaggaggugagcaagaaggg

SEQ ID NO: 417181 - RNA, 21 nt, Human
ccugucuuggacugaggcacc

SEQ ID NO: 417182 - RNA, 20 nt, Human
cucugcuuuaggagagucag

SEQ ID NO: 417183 - RNA, 22 nt, Human
ggugaggcccagugaucugugu

SEQ ID NO: 417184 - RNA, 22 nt, Human
caucccugcccucaugccuaua

SEQ ID NO: 417185 - RNA, 22 nt, Human
gcccucucuucugcagccucca

SEQ ID NO: 417186 - RNA, 21 nt, Human
ucauuuuuauugcuaccuugc

SEQ ID NO: 417187 - RNA, 22 nt, Human
uaaguucauaagcuuauucuua

SEQ ID NO: 417188 - RNA, 22 nt, Human
ucagcagugcagggugaggcag

SEQ ID NO: 417189 - RNA, 22 nt, Human
aaaauguguuuaugcauuucgu

SEQ ID NO: 417190 - RNA, 22 nt, Human
caggacagaaauaaggaauaua

SEQ ID NO: 417191 - RNA, 22 nt, Human
gaggcacaauacaugucucaag

SEQ ID NO: 417192 - RNA, 21 nt, Human
agaaaaacacgauauaagccc

SEQ ID NO: 417193 - RNA, 22 nt, Human
gcacaggcacagagggccacug

SEQ ID NO: 417194 - RNA, 22 nt, Human
uuuccucuccggggccuccagg

SEQ ID NO: 417195 - RNA, 22 nt, Human
caguggugaagagcaggggcuc

SEQ ID NO: 417196 - RNA, 22 nt, Human
gaauccaggguuguuugagcua

SEQ ID NO: 417197 - RNA, 20 nt, Human
ucauuucuugggguuccaag

SEQ ID NO: 417198 - RNA, 22 nt, Human
ccaggugcucuugccagggcug

SEQ ID NO: 417199 - RNA, 22 nt, Human
agccaaggcagcuagagcucug

SEQ ID NO: 417200 - RNA, 22 nt, Human
acugcuuuucuaagauucugug

SEQ ID NO: 417201 - RNA, 22 nt, Human
ccagcauggcaccugagaugag

SEQ ID NO: 417202 - RNA, 22 nt, Human
ucucucagggggaaggcugaag

SEQ ID NO: 417203 - RNA, 22 nt, Human
ccaggaguuggagguugcagug

SEQ ID NO: 417204 - RNA, 22 nt, Human
gcugcagccaaauucauuguca

SEQ ID NO: 417205 - RNA, 22 nt, Human
aagggcugcuguagaagcagag

SEQ ID NO: 417206 - RNA, 22 nt, Human
uugucuuuggaaauuuaauguu

SEQ ID NO: 417207 - RNA, 22 nt, Human
cugcucugaguauuaacggagg

SEQ ID NO: 417208 - RNA, 22 nt, Human
uuucuuucaauucuccuaaugc

SEQ ID NO: 417209 - RNA, 22 nt, Human
ugggcucauggcccagcacugg

SEQ ID NO: 417210 - RNA, 22 nt, Human
ccuggcagcaggugggcccgug

SEQ ID NO: 417211 - RNA, 22 nt, Human
uuagccauauagaaaaagagcu

SEQ ID NO: 417212 - RNA, 22 nt, Human
ucagugucuugggcuugaaugc

SEQ ID NO: 417213 - RNA, 22 nt, Human
uaugcacagaaguuugcugaau

SEQ ID NO: 417214 - RNA, 17 nt, Human
uggcacagaggugcuau

SEQ ID NO: 417215 - RNA, 22 nt, Human
cugcugugcacccaggaaggcu

SEQ ID NO: 417216 - RNA, 22 nt, Human
uggccuggcucacagugagauu

SEQ ID NO: 417217 - RNA, 22 nt, Human
ugccuacauuccuugcuuaugg

SEQ ID NO: 417218 - RNA, 22 nt, Human
acagguggcuuauuggcugauu

SEQ ID NO: 417219 - RNA, 19 nt, Human
ccagcccugucacuucuug

SEQ ID NO: 417220 - RNA, 22 nt, Human
guuauguaugggggccuuauga

SEQ ID NO: 417221 - RNA, 19 nt, Human
cuggcagccugucuguguc

SEQ ID NO: 417222 - RNA, 22 nt, Human
ugaggcagaguaagauacauga

SEQ ID NO: 417223 - RNA, 22 nt, Human
ugaggcaguucuuacuuguauu

SEQ ID NO: 417224 - RNA, 22 nt, Human
ucacagggauggaauagaaaua

SEQ ID NO: 417225 - RNA, 22 nt, Human
uagcugccaaaagggugggcua

SEQ ID NO: 417226 - RNA, 22 nt, Human
agagccugcaucaggcuugggg

SEQ ID NO: 417227 - RNA, 22 nt, Human
cugaggaggggccugagugaga

SEQ ID NO: 417228 - RNA, 22 nt, Human
ccagcagcagcguccaaggaga

SEQ ID NO: 417229 - RNA, 19 nt, Human
ucaaagucugagucacuuu

SEQ ID NO: 417230 - RNA, 22 nt, Human
uggcagcugauuagauggugcc

SEQ ID NO: 417231 - RNA, 22 nt, Human
uguuucauguggacauaguugu

SEQ ID NO: 417232 - RNA, 23 nt, Human
agcaauaagaagggauacaugug

SEQ ID NO: 417233 - RNA, 22 nt, Human
uggcagcagggccccuggagga

SEQ ID NO: 417234 - RNA, 22 nt, Human
cuuuauuagauguagacuuucu

SEQ ID NO: 417235 - RNA, 22 nt, Human
auuucccuccagggaaagcuua

SEQ ID NO: 417236 - RNA, 22 nt, Human
ccagguggugaaagugggcccu

SEQ ID NO: 417237 - RNA, 22 nt, Human
gucccagggaugcagacaugag

SEQ ID NO: 417238 - RNA, 18 nt, Human
cccagcuccacuucccuc

SEQ ID NO: 417239 - RNA, 22 nt, Human
gcuccucuccucggagucgggg

SEQ ID NO: 417240 - RNA, 22 nt, Human
ccucaggggugcccacagcugc

SEQ ID NO: 417241 - RNA, 22 nt, Human
ccagcuuucugggugguuucug

SEQ ID NO: 417242 - RNA, 22 nt, Human
caggcagaaggaaguaccaggc

SEQ ID NO: 417243 - RNA, 22 nt, Human
agaauuagaggccauguacuug

SEQ ID NO: 417244 - RNA, 23 nt, Human
aaagacugcugagaauuuuagga

SEQ ID NO: 417245 - RNA, 22 nt, Human
auaauaaaccaggaugggucug

SEQ ID NO: 417246 - RNA, 22 nt, Human
gcagagcucuguucuuaucucc

SEQ ID NO: 417247 - RNA, 22 nt, Human
cugcagggcccgccugagcccu

SEQ ID NO: 417248 - RNA, 22 nt, Human
ggcugcuucucacucauuugca

SEQ ID NO: 417249 - RNA, 22 nt, Human
uuccuuccgggcaccaggcacu

SEQ ID NO: 417250 - RNA, 22 nt, Human
cagguccccuccccuaccaggc

SEQ ID NO: 417251 - RNA, 22 nt, Human
cagcuccccucuguggggcagu

SEQ ID NO: 417252 - RNA, 22 nt, Human
gccuggagaggaagccggugga

SEQ ID NO: 417253 - RNA, 22 nt, Human
ggcagaagaaaggcuaagucuc

SEQ ID NO: 417254 - RNA, 22 nt, Human
caggaggcuuugggauccaagu

SEQ ID NO: 417255 - RNA, 22 nt, Human
gagagcugggaaagccguggag

SEQ ID NO: 417256 - RNA, 22 nt, Human
ucagcagggaggcucugugccc

SEQ ID NO: 417257 - RNA, 22 nt, Human
gccuggagacaaggacaaaggg

SEQ ID NO: 417258 - RNA, 22 nt, Human
ucacaucuuauuagaguaucuc

SEQ ID NO: 417259 - RNA, 22 nt, Human
acagaaauaacuuuuuauguuu

SEQ ID NO: 417260 - RNA, 22 nt, Human
ggagcuguaacgagccauugcu

SEQ ID NO: 417261 - RNA, 22 nt, Human
ccuuuuucaauauagaauugca

SEQ ID NO: 417262 - RNA, 19 nt, Human
gagcugccuuuugaagacc

SEQ ID NO: 417263 - RNA, 22 nt, Human
gccaggcucagcagucaaccug

SEQ ID NO: 417264 - RNA, 22 nt, Human
gccaccucggcuuucucugcuc

SEQ ID NO: 417265 - RNA, 22 nt, Human
ccagguggaaggucugugcucu

SEQ ID NO: 417266 - RNA, 22 nt, Human
ggagaguggauuccagcuguau

SEQ ID NO: 417267 - RNA, 18 nt, Human
cucagggcaucagucugg

SEQ ID NO: 417268 - RNA, 22 nt, Human
cagcugccccuccagggcuggg

SEQ ID NO: 417269 - RNA, 22 nt, Human
ucucagaggugcccuggcaucu

SEQ ID NO: 417270 - RNA, 22 nt, Human
cuggcagcgguuugcagccugg

SEQ ID NO: 417271 - RNA, 22 nt, Human
ggaggccaugaggcucuaggug

SEQ ID NO: 417272 - RNA, 22 nt, Human
ugguaaaguguacugaauauga

SEQ ID NO: 417273 - RNA, 22 nt, Human
acagcagcaauagcagugacau

SEQ ID NO: 417274 - RNA, 22 nt, Human
cugagagaugauauagcuuaau

SEQ ID NO: 417275 - RNA, 22 nt, Human
cuguugucccugggagcucagc

SEQ ID NO: 417276 - RNA, 22 nt, Human
uccaguggcaccuuggcccuca

SEQ ID NO: 417277 - RNA, 22 nt, Human
ggcugcuggcauugagguaggu

SEQ ID NO: 417278 - RNA, 22 nt, Human
cagcuucccuuggcugagcaga

SEQ ID NO: 417279 - RNA, 21 nt, Human
aaaaugugagcgugaugcuua

SEQ ID NO: 417280 - RNA, 22 nt, Human
gcugccugaucauacaccaggg

SEQ ID NO: 417281 - RNA, 22 nt, Human
ucaggcaggacaauuauuuagg

SEQ ID NO: 417282 - RNA, 22 nt, Human
uggaccugaagaauaggaagua

SEQ ID NO: 417283 - RNA, 22 nt, Human
ccauggcauuuuaugugucuua

SEQ ID NO: 417284 - RNA, 22 nt, Human
ugccugucagggggagugggaa

SEQ ID NO: 417285 - RNA, 22 nt, Human
aguucacauuccgagguacugg

SEQ ID NO: 417286 - RNA, 22 nt, Human
uacugugacagaguacuuaaac

SEQ ID NO: 417287 - RNA, 18 nt, Human
gcaaggcucaggccaggc

SEQ ID NO: 417288 - RNA, 22 nt, Human
uccaggcuggaaaugucaaacu

SEQ ID NO: 417289 - RNA, 22 nt, Human
ugccuuccuggagcugaaggcu

SEQ ID NO: 417290 - RNA, 22 nt, Human
cacagguguaugaauaugucca

SEQ ID NO: 417291 - RNA, 22 nt, Human
gcaggcaguugcaguuuucuag

SEQ ID NO: 417292 - RNA, 22 nt, Human
aggcugagguaggaggaucgcu

SEQ ID NO: 417293 - RNA, 22 nt, Human
cagagcugcaaaugccccuccg

SEQ ID NO: 417294 - RNA, 22 nt, Human
uccuuggcaugccgucuucucc

SEQ ID NO: 417295 - RNA, 22 nt, Human
uggcagcaauuagcuagagcug

SEQ ID NO: 417296 - RNA, 22 nt, Human
cuucuaggcuucucagggggca

SEQ ID NO: 417297 - RNA, 23 nt, Human
uggggagaguuacccuggaagcg

SEQ ID NO: 417298 - RNA, 22 nt, Human
gacaaaggaucagagguuggga

SEQ ID NO: 417299 - RNA, 22 nt, Human
acauuguagacuuuucauaugu

SEQ ID NO: 417300 - RNA, 22 nt, Human
agcagcugggcucagagcuggg

SEQ ID NO: 417301 - RNA, 22 nt, Human
guuuauuauacaacaaaagcua

SEQ ID NO: 417302 - RNA, 22 nt, Human
ugcccuguuccugccuccagcu

SEQ ID NO: 417303 - RNA, 21 nt, Human
ggggcagagcuaggcccugca

SEQ ID NO: 417304 - RNA, 22 nt, Human
auuuucugguugagguuuaaca

SEQ ID NO: 417305 - RNA, 21 nt, Human
auggagccuaagaguggaggu

SEQ ID NO: 417306 - RNA, 22 nt, Human
agggucuguggaugcaucuggg

SEQ ID NO: 417307 - RNA, 22 nt, Human
uggucagacaaaggagaauguu

SEQ ID NO: 417308 - RNA, 22 nt, Human
uggcagucggacuucuaucuca

SEQ ID NO: 417309 - RNA, 22 nt, Human
auagacuugguuaguaaauuug

SEQ ID NO: 417310 - RNA, 22 nt, Human
cuacauaaauauuuaugugucu

SEQ ID NO: 417311 - RNA, 22 nt, Human
aguccccucuaacccaacuuua

SEQ ID NO: 417312 - RNA, 22 nt, Human
gcagggaccucacuacccccag

SEQ ID NO: 417313 - RNA, 22 nt, Human
uggaagaauaggauagaagaac

SEQ ID NO: 417314 - RNA, 22 nt, Human
gcagaggagugauuaugccgug

SEQ ID NO: 417315 - RNA, 19 nt, Human
uugguggugguuuugguuc

SEQ ID NO: 417316 - RNA, 22 nt, Human
agggcugcaucugccuggugaa

SEQ ID NO: 417317 - RNA, 22 nt, Human
acaguguguuggaggagacugu

SEQ ID NO: 417318 - RNA, 22 nt, Human
uguuugaauuuugcuaacgugu

SEQ ID NO: 417319 - RNA, 18 nt, Human
ugacagaaccuggagccu

SEQ ID NO: 417320 - RNA, 22 nt, Human
uguggcaggcaagauguacaga

SEQ ID NO: 417321 - RNA, 22 nt, Human
gaggcugcuguuagcccugggc

SEQ ID NO: 417322 - RNA, 22 nt, Human
ccagcuuucucagaggcuucua

SEQ ID NO: 417323 - RNA, 22 nt, Human
accauuuaauaaguauuuccau

SEQ ID NO: 417324 - RNA, 22 nt, Human
agauguguuucuaguuccugca

SEQ ID NO: 417325 - RNA, 22 nt, Human
ugucaguguauacauacaguau

SEQ ID NO: 417326 - RNA, 22 nt, Human
aaucaguuucuuggcaaguuua

SEQ ID NO: 417327 - RNA, 22 nt, Human
cugaaggauuuaguucuuugcu

SEQ ID NO: 417328 - RNA, 22 nt, Human
cccagcccccgagugucuggaa

SEQ ID NO: 417329 - RNA, 22 nt, Human
gccagaagacuggagucagcug

SEQ ID NO: 417330 - RNA, 22 nt, Human
agggccugagcuggcugaccuc

SEQ ID NO: 417331 - RNA, 21 nt, Human
uagaaaucagcuggugccucu

SEQ ID NO: 417332 - RNA, 22 nt, Human
gcugccacucugagcuugcuuc

SEQ ID NO: 417333 - RNA, 19 nt, Human
ggaccagguccugggcagc

SEQ ID NO: 417334 - RNA, 22 nt, Human
aaggucauuuaacaauuuauga

SEQ ID NO: 417335 - RNA, 22 nt, Human
cucccugggcagauguggcucu

SEQ ID NO: 417336 - RNA, 22 nt, Human
cuucaagauauuucuagaauca

SEQ ID NO: 417337 - RNA, 18 nt, Human
ugcuggcaacuacuauug

SEQ ID NO: 417338 - RNA, 22 nt, Human
ugcaaaauaaugaacgauuuuu

SEQ ID NO: 417339 - RNA, 22 nt, Human
acaaaggugcgucccuucagcu

SEQ ID NO: 417340 - RNA, 22 nt, Human
ccuguguggccaggcuggaguc

SEQ ID NO: 417341 - RNA, 23 nt, Human
ccaggccucucagagggugugcc

SEQ ID NO: 417342 - RNA, 22 nt, Human
gauuuuucaguauaaaauauau

SEQ ID NO: 417343 - RNA, 22 nt, Human
acacuucucccaucuccuguug

SEQ ID NO: 417344 - RNA, 22 nt, Human
auuucuuuucaagagggugcuu

SEQ ID NO: 417345 - RNA, 22 nt, Human
uucagaaagugaaucuuguuau

SEQ ID NO: 417346 - RNA, 22 nt, Human
gcugcuccgucugagcucuggu

SEQ ID NO: 417347 - RNA, 22 nt, Human
ugggaccucucuugagagagca

SEQ ID NO: 417348 - RNA, 22 nt, Human
uacauuguucaugcaugagaaa

SEQ ID NO: 417349 - RNA, 22 nt, Human
ugucuuuagccagcagucuucu

SEQ ID NO: 417350 - RNA, 22 nt, Human
aacuagaaccacuuguauuucc

SEQ ID NO: 417351 - RNA, 22 nt, Human
cucuuucaguucugauagucuc

SEQ ID NO: 417352 - RNA, 22 nt, Human
cagcugaggucaaagaagcagg

SEQ ID NO: 417353 - RNA, 22 nt, Human
augcagcugugggcaagaaaug

SEQ ID NO: 417354 - RNA, 22 nt, Human
gcccagcagaucucagugucuc

SEQ ID NO: 417355 - RNA, 22 nt, Human
aagggcuggagacugggucuuc

SEQ ID NO: 417356 - RNA, 22 nt, Human
gcauguuuugcaacaagugacc

SEQ ID NO: 417357 - RNA, 22 nt, Human
aagaugcacaauguggcaauua

SEQ ID NO: 417358 - RNA, 22 nt, Human
ggcccaaggcccaggucgagcu

SEQ ID NO: 417359 - RNA, 22 nt, Human
uguccucuuccagugcuccuuc

SEQ ID NO: 417360 - RNA, 22 nt, Human
gaagaacugugacagaagcagu

SEQ ID NO: 417361 - RNA, 22 nt, Human
gcuuccuggagggagagagcug

SEQ ID NO: 417362 - RNA, 22 nt, Human
uauuucuguaacucagggucug

SEQ ID NO: 417363 - RNA, 22 nt, Human
gagagcugggggacuguggaug

SEQ ID NO: 417364 - RNA, 22 nt, Human
uugcucugaacccagggcacca

SEQ ID NO: 417365 - RNA, 22 nt, Human
agagcagguggcaacucuggga

SEQ ID NO: 417366 - RNA, 22 nt, Human
aagcccagaugggagcauuuca

SEQ ID NO: 417367 - RNA, 19 nt, Human
auuccucaaggacagaaau

SEQ ID NO: 417368 - RNA, 22 nt, Human
aagggcagcuuaaauugguagc

SEQ ID NO: 417369 - RNA, 22 nt, Human
ugggaaauguguuucuggacca

SEQ ID NO: 417370 - RNA, 22 nt, Human
caggccugucugcacaugaggc

SEQ ID NO: 417371 - RNA, 22 nt, Human
uaagaacauuuucggaaagaua

SEQ ID NO: 417372 - RNA, 22 nt, Human
cagucacauggaugauggauag

SEQ ID NO: 417373 - RNA, 22 nt, Human
gaaggcuguuucugguagugau

SEQ ID NO: 417374 - RNA, 22 nt, Human
gcucugcugucuucuugcaggc

SEQ ID NO: 417375 - RNA, 22 nt, Human
gagcagcuuaugucaagccaga

SEQ ID NO: 417376 - RNA, 22 nt, Human
agcaccugcuaugugucaggga

SEQ ID NO: 417377 - RNA, 22 nt, Human
aaaugcauaucaaagacuugaa

SEQ ID NO: 417378 - RNA, 22 nt, Human
gcaguccucucauuggccuccu

SEQ ID NO: 417379 - RNA, 22 nt, Human
aaagccuuggucaucugguucc

SEQ ID NO: 417380 - RNA, 20 nt, Human
cagagcuguuauggaugaug

SEQ ID NO: 417381 - RNA, 22 nt, Human
ucucagggcagcaaggaagcau

SEQ ID NO: 417382 - RNA, 22 nt, Human
ggcagcuccucucagcaaaaga

SEQ ID NO: 417383 - RNA, 22 nt, Human
guggauggauugaggcaguggg

SEQ ID NO: 417384 - RNA, 22 nt, Human
ggcuggcuuucucuccgcaccu

SEQ ID NO: 417385 - RNA, 22 nt, Human
accuggagucauuugaggagua

SEQ ID NO: 417386 - RNA, 22 nt, Human
uaccaggcagcugcacagaggc

SEQ ID NO: 417387 - RNA, 22 nt, Human
uuccaggaauucagcucucagu

SEQ ID NO: 417388 - RNA, 22 nt, Human
aggagcugcagauucugccuug

SEQ ID NO: 417389 - RNA, 22 nt, Human
uuccuguauuuugcgaauuuuc

SEQ ID NO: 417390 - RNA, 22 nt, Human
auaugaagaauuccaauuugga

SEQ ID NO: 417391 - RNA, 18 nt, Human
gaugggagcaagagaaga

SEQ ID NO: 417392 - RNA, 22 nt, Human
uacaaagcuguauagccugguc

SEQ ID NO: 417393 - RNA, 22 nt, Human
uacuuugucauucuaaccuucc

SEQ ID NO: 417394 - RNA, 18 nt, Human
gcaggagauggguggggu

SEQ ID NO: 417395 - RNA, 22 nt, Human
ggccaggcugcccugggagcag

SEQ ID NO: 417396 - RNA, 22 nt, Human
uacauauacugagugauuugcu

SEQ ID NO: 417397 - RNA, 22 nt, Human
uauuugcaaagaacuacacuag

SEQ ID NO: 417398 - RNA, 22 nt, Human
ugccugggguuggcaaacugcu

SEQ ID NO: 417399 - RNA, 22 nt, Human
ccagcucccugaagccuggucu

SEQ ID NO: 417400 - RNA, 22 nt, Human
ugaggccuggagggaggaguuu

SEQ ID NO: 417401 - RNA, 22 nt, Human
ucagggcaucucuuaaguggug

SEQ ID NO: 417402 - RNA, 20 nt, Human
accaauguuagcuuaguacu

SEQ ID NO: 417403 - RNA, 22 nt, Human
uuguccaaggucccacaguuag

SEQ ID NO: 417404 - RNA, 22 nt, Human
ccucugcugcuguugagcaccg

SEQ ID NO: 417405 - RNA, 22 nt, Human
uuauacuaaaacgcauugaauu

SEQ ID NO: 417406 - RNA, 22 nt, Human
agcugcugaaugacacugcaag

SEQ ID NO: 417407 - RNA, 22 nt, Human
uccaugagggacacuggaugcu

SEQ ID NO: 417408 - RNA, 22 nt, Human
ucugugcucuucucaguaucac

SEQ ID NO: 417409 - RNA, 22 nt, Human
ucauugcaccccagucccagcu

SEQ ID NO: 417410 - RNA, 22 nt, Human
cagcugagucugagguucuuug

SEQ ID NO: 417411 - RNA, 19 nt, Human
gggaaauucacuugcuucc

SEQ ID NO: 417412 - RNA, 22 nt, Human
ccuggggcucaagauggcgccg

SEQ ID NO: 417413 - RNA, 20 nt, Human
caagcccucuuuagccugcc

SEQ ID NO: 417414 - RNA, 22 nt, Human
gagggaggcaucaugaauccag

SEQ ID NO: 417415 - RNA, 22 nt, Human
ggaggccaggguggguggaucg

SEQ ID NO: 417416 - RNA, 22 nt, Human
gcugccacgaucucugcuguag

SEQ ID NO: 417417 - RNA, 22 nt, Human
gggcagagacucagaaacagaa

SEQ ID NO: 417418 - RNA, 22 nt, Human
cuugaaagauuuggccucugug

SEQ ID NO: 417419 - RNA, 22 nt, Human
ggagacagugacuuagagacug

SEQ ID NO: 417420 - RNA, 22 nt, Human
gcugaaggaggcucugguacua

SEQ ID NO: 417421 - RNA, 22 nt, Human
agggcagagcugucuaaauggc

SEQ ID NO: 417422 - RNA, 18 nt, Human
caggaugagugaugggga

SEQ ID NO: 417423 - RNA, 22 nt, Human
cagcccaggccgacaguuccuc

SEQ ID NO: 417424 - RNA, 22 nt, Human
ugucauuuucuaaucuguuguc

SEQ ID NO: 417425 - RNA, 22 nt, Human
uaucuuuagaggaagagaaucu

SEQ ID NO: 417426 - RNA, 22 nt, Human
uggacucagaaguguucuuuua

SEQ ID NO: 417427 - RNA, 22 nt, Human
cggggacacacuggcagcuccu

SEQ ID NO: 417428 - RNA, 22 nt, Human
ucaguaacuuacuuauucaccu

SEQ ID NO: 417429 - RNA, 22 nt, Human
gaaauugucagcuucuuucagu

SEQ ID NO: 417430 - RNA, 22 nt, Human
ccaggccaaauucagucagcag

SEQ ID NO: 417431 - RNA, 20 nt, Human
ugcagcugguuucacaggga

SEQ ID NO: 417432 - RNA, 22 nt, Human
uuugagaagcaucugguccacu

SEQ ID NO: 417433 - RNA, 22 nt, Human
ugcugcuccccagcacacagca

SEQ ID NO: 417434 - RNA, 22 nt, Human
uuagauauguuuuugcuaaugc

SEQ ID NO: 417435 - RNA, 22 nt, Human
gcagggaccagggccagaucca

SEQ ID NO: 417436 - RNA, 22 nt, Human
agccugagugcuuaggacuguu

SEQ ID NO: 417437 - RNA, 22 nt, Human
aggugcagcugacaccaugugg

SEQ ID NO: 417438 - RNA, 22 nt, Human
ccacagggcucuaggcgcuucc

SEQ ID NO: 417439 - RNA, 22 nt, Human
ucagagccccuccgcuguccca

SEQ ID NO: 417440 - RNA, 22 nt, Human
uuacaagauaaccugaugcugu

SEQ ID NO: 417441 - RNA, 22 nt, Human
aggcucagucuguucaugcacu

SEQ ID NO: 417442 - RNA, 22 nt, Human
gcauuuagcuuuaaaauauuuc

SEQ ID NO: 417443 - RNA, 22 nt, Human
uccugcugagcgucugucauuu

SEQ ID NO: 417444 - RNA, 19 nt, Human
agcagccauagacaauaug

SEQ ID NO: 417445 - RNA, 23 nt, Human
ugcagccacucaggagcucagug

SEQ ID NO: 417446 - RNA, 22 nt, Human
uaauccaauggcacaauguaug

SEQ ID NO: 417447 - RNA, 22 nt, Human
gacgccucuucccugcugcacu

SEQ ID NO: 417448 - RNA, 22 nt, Human
aggagcugaaacuucucauaug

SEQ ID NO: 417449 - RNA, 22 nt, Human
gugucacaugguuuacugcagc

SEQ ID NO: 417450 - RNA, 23 nt, Human
ucuccuccuagauacagucaugg

SEQ ID NO: 417451 - RNA, 23 nt, Human
ccagcucccaggucugaggacug

SEQ ID NO: 417452 - RNA, 20 nt, Human
aggaaaaggguggugguaga

SEQ ID NO: 417453 - RNA, 22 nt, Human
uucuaguuuugccuuaucaaca

SEQ ID NO: 417454 - RNA, 22 nt, Human
gugucccaggccucuggaauua

SEQ ID NO: 417455 - RNA, 18 nt, Human
gugcugugggcaguggcc

SEQ ID NO: 417456 - RNA, 23 nt, Human
ggcugagacuacaggcgcuugcc

SEQ ID NO: 417457 - RNA, 21 nt, Human
ccacauucucauucugacugc

SEQ ID NO: 417458 - RNA, 22 nt, Human
ucuuuuggguucuuaugauuua

SEQ ID NO: 417459 - RNA, 21 nt, Human
ugguuugcggccaaaguuaaa

SEQ ID NO: 417460 - RNA, 22 nt, Human
aaaguguaaggaauuuaaguaa

SEQ ID NO: 417461 - RNA, 22 nt, Human
uaaggcagaaauaugagcaggg

SEQ ID NO: 417462 - RNA, 17 nt, Human
gcucccugaggacagcu

SEQ ID NO: 417463 - RNA, 22 nt, Human
guauuuucaagagcaguaguau

SEQ ID NO: 417464 - RNA, 22 nt, Human
cccuuccucccaggcuucugug

SEQ ID NO: 417465 - RNA, 22 nt, Human
gugggggcaggcagugcuagga

SEQ ID NO: 417466 - RNA, 22 nt, Human
cccagugccaggcacaggcagc

SEQ ID NO: 417467 - RNA, 21 nt, Human
gaaaagcaagggaguagaaca

SEQ ID NO: 417468 - RNA, 22 nt, Human
cugcccuguuuggacagcccgg

SEQ ID NO: 417469 - RNA, 22 nt, Human
gccugccuggagcuugagguga

SEQ ID NO: 417470 - RNA, 22 nt, Human
cuagagggauguuaggauagca

SEQ ID NO: 417471 - RNA, 22 nt, Human
cugccucuauaggaguccacca

SEQ ID NO: 417472 - RNA, 16 nt, Human
agccaggcugccucgg

SEQ ID NO: 417473 - RNA, 22 nt, Human
gagcuggaagucuguggucaga

SEQ ID NO: 417474 - RNA, 22 nt, Human
ugcagggagcucuggggugcag

SEQ ID NO: 417475 - RNA, 22 nt, Human
ugccaggcauguaguagacuug

SEQ ID NO: 417476 - RNA, 22 nt, Human
gggggaagacugggcuagugau

SEQ ID NO: 417477 - RNA, 22 nt, Human
agccagggagguggagguugca

SEQ ID NO: 417478 - RNA, 22 nt, Human
caggacaguuugcuuugcccug

SEQ ID NO: 417479 - RNA, 22 nt, Human
aucuaagaguuaacaucaagaa

SEQ ID NO: 417480 - RNA, 22 nt, Human
cacugcaguaacucuaggacug

SEQ ID NO: 417481 - RNA, 22 nt, Human
cagacuuucaaggagugaaggc

SEQ ID NO: 417482 - RNA, 22 nt, Human
ucccagccuuccagucugguuu

SEQ ID NO: 417483 - RNA, 22 nt, Human
agaaaguucacugguauauuuu

SEQ ID NO: 417484 - RNA, 22 nt, Human
cugagaguguggcuuccaggcc

SEQ ID NO: 417485 - RNA, 19 nt, Human
caagugaagccugggaugg

SEQ ID NO: 417486 - RNA, 22 nt, Human
cccaguggaaggaguagaagac

SEQ ID NO: 417487 - RNA, 19 nt, Human
agaggcugucaccuguagc

SEQ ID NO: 417488 - RNA, 22 nt, Human
ucaggcugcuggccagcaggcu

SEQ ID NO: 417489 - RNA, 22 nt, Human
gggaagggacuuguuuaagguc

SEQ ID NO: 417490 - RNA, 22 nt, Human
uaaacagaaagcagauguacuu

SEQ ID NO: 417491 - RNA, 20 nt, Human
ccugccugccucggcucauu

SEQ ID NO: 417492 - RNA, 22 nt, Human
cagaaacuucuggugucaaaua

SEQ ID NO: 417493 - RNA, 22 nt, Human
ugagccagaguggagugugccu

SEQ ID NO: 417494 - RNA, 20 nt, Human
caaugcacacagcugcuucu

SEQ ID NO: 417495 - RNA, 22 nt, Human
aaacuugauuuagaacuaaggc

SEQ ID NO: 417496 - RNA, 22 nt, Human
caggagcucucaucgucagggc

SEQ ID NO: 417497 - RNA, 22 nt, Human
gccugaggaaugcuccugacuu

SEQ ID NO: 417498 - RNA, 22 nt, Human
guuugcauuccaauuuagggga

SEQ ID NO: 417499 - RNA, 22 nt, Human
uuuccacuguagagauguugaa

SEQ ID NO: 417500 - RNA, 22 nt, Human
cugcuggccuagcccauccucu

SEQ ID NO: 417501 - RNA, 22 nt, Human
agcagcugcagagggcuccccc

SEQ ID NO: 417502 - RNA, 22 nt, Human
aaauguagaccuauagggaccu

SEQ ID NO: 417503 - RNA, 22 nt, Human
cagggccaagccccuuuggcug

SEQ ID NO: 417504 - RNA, 22 nt, Human
gcagaggccaggccaccagcaa

SEQ ID NO: 417505 - RNA, 22 nt, Human
uugcugaauugaauccuuuggu

SEQ ID NO: 417506 - RNA, 22 nt, Human
auaaacagaguaguugcuacug

SEQ ID NO: 417507 - RNA, 22 nt, Human
agcuucuggaagccuggcagca

SEQ ID NO: 417508 - RNA, 22 nt, Human
uggcuucaucugcagcacugcc

SEQ ID NO: 417509 - RNA, 22 nt, Human
ugggacagggaaucugaucccc

SEQ ID NO: 417510 - RNA, 22 nt, Human
gagggcuccucacauucucuau

SEQ ID NO: 417511 - RNA, 19 nt, Human
cugugcaggccgggcugag

SEQ ID NO: 417512 - RNA, 22 nt, Human
cuuccugcaggacagccaucug

SEQ ID NO: 417513 - RNA, 22 nt, Human
uccuccagugucuggggccuug

SEQ ID NO: 417514 - RNA, 22 nt, Human
cagcuugggaguuugguuuuau

SEQ ID NO: 417515 - RNA, 22 nt, Human
caguguuuaaucauugugaauu

SEQ ID NO: 417516 - RNA, 22 nt, Human
ucccagcagcauagcucagaau

SEQ ID NO: 417517 - RNA, 22 nt, Human
gggacagaaggaagugagcaca

SEQ ID NO: 417518 - RNA, 22 nt, Human
ucuuuccauggccacacagucu

SEQ ID NO: 417519 - RNA, 22 nt, Human
aagaauguuaguuucugauaca

SEQ ID NO: 417520 - RNA, 22 nt, Human
aaggcuaugaucuuuuucauga

SEQ ID NO: 417521 - RNA, 22 nt, Human
cccaggcacauccacucuguga

SEQ ID NO: 417522 - RNA, 22 nt, Human
uuuauguaauuucauaggugug

SEQ ID NO: 417523 - RNA, 22 nt, Human
uugcugaaaucuaugacauccu

SEQ ID NO: 417524 - RNA, 22 nt, Human
aaggcucucugauggcagcagu

SEQ ID NO: 417525 - RNA, 22 nt, Human
ugaagccagucaauguuaaguu

SEQ ID NO: 417526 - RNA, 22 nt, Human
ugcuuccuucccguucuucucc

SEQ ID NO: 417527 - RNA, 22 nt, Human
uguggucucguuauguugccca

SEQ ID NO: 417528 - RNA, 22 nt, Human
ccagcuggugggucuuucucug

SEQ ID NO: 417529 - RNA, 22 nt, Human
auacaaaaauuagccgggagua

SEQ ID NO: 417530 - RNA, 22 nt, Human
agcugugguucugggcagcgac

SEQ ID NO: 417531 - RNA, 22 nt, Human
uugguuuaggaacuggcuugga

SEQ ID NO: 417532 - RNA, 22 nt, Human
aggcugagcugguagugaguac

SEQ ID NO: 417533 - RNA, 22 nt, Human
agcuguguggugucugacagcu

SEQ ID NO: 417534 - RNA, 19 nt, Human
ggcuggaguggccaucugu

SEQ ID NO: 417535 - RNA, 22 nt, Human
ggacacagcugcagccacaccc

SEQ ID NO: 417536 - RNA, 22 nt, Human
acagaauacuacagacugguua

SEQ ID NO: 417537 - RNA, 22 nt, Human
uccuucagucuucugagccaua

SEQ ID NO: 417538 - RNA, 20 nt, Human
gcccacucuaauccacuguc

SEQ ID NO: 417539 - RNA, 22 nt, Human
gggcagauggggcacaggcuga

SEQ ID NO: 417540 - RNA, 22 nt, Human
acccagccuacaaagcucaccu

SEQ ID NO: 417541 - RNA, 19 nt, Human
gcaggcaguggcauucgga

SEQ ID NO: 417542 - RNA, 22 nt, Human
gcuuccucgcugggcagaggca

SEQ ID NO: 417543 - RNA, 22 nt, Human
ugcaggagcagagauggcugga

SEQ ID NO: 417544 - RNA, 22 nt, Human
ucuggcagggguucugcacuug

SEQ ID NO: 417545 - RNA, 21 nt, Human
agaguaauuccugcuggaaag

SEQ ID NO: 417546 - RNA, 22 nt, Human
cagaggcugccagccaugugca

SEQ ID NO: 417547 - RNA, 22 nt, Human
aaaucaguucucccuuucuuca

SEQ ID NO: 417548 - RNA, 22 nt, Human
acagauauaaacuauaguagug

SEQ ID NO: 417549 - RNA, 22 nt, Human
guguuuggucagacguccgggg

SEQ ID NO: 417550 - RNA, 22 nt, Human
gcuggccucaucacugacuucu

SEQ ID NO: 417551 - RNA, 22 nt, Human
agaggucauaucucagaagaga

SEQ ID NO: 417552 - RNA, 19 nt, Human
cugagagaugcuucacaca

SEQ ID NO: 417553 - RNA, 22 nt, Human
cacagcagaaauaugaaggcag

SEQ ID NO: 417554 - RNA, 22 nt, Human
gacaugcaacaauuuggcauuu

SEQ ID NO: 417555 - RNA, 22 nt, Human
gagagcuggccagcuucaguau

SEQ ID NO: 417556 - RNA, 22 nt, Human
aucaguuucuaccauguggaau

SEQ ID NO: 417557 - RNA, 22 nt, Human
cugcccuggcagccuaccaugg

SEQ ID NO: 417558 - RNA, 22 nt, Human
uuauucuucuucucuugccagg

SEQ ID NO: 417559 - RNA, 22 nt, Human
gaggcaugucuggccuguccca

SEQ ID NO: 417560 - RNA, 23 nt, Human
uugugggcagauuccauggggag

SEQ ID NO: 417561 - RNA, 17 nt, Human
uccuucagugccucugc

SEQ ID NO: 417562 - RNA, 22 nt, Human
agggaggaguccucaaagucau

SEQ ID NO: 417563 - RNA, 22 nt, Human
cuggagcuccagggucuccucu

SEQ ID NO: 417564 - RNA, 22 nt, Human
ugcccaggguggagugcagcgg

SEQ ID NO: 417565 - RNA, 22 nt, Human
agcucccauuaucuucugaaac

SEQ ID NO: 417566 - RNA, 22 nt, Human
aggcugaggggcgagggacccu

SEQ ID NO: 417567 - RNA, 22 nt, Human
aggagaaggaagugcaucacua

SEQ ID NO: 417568 - RNA, 22 nt, Human
gccuggagugguccugcugccc

SEQ ID NO: 417569 - RNA, 22 nt, Human
uuggccacacucacuagagccc

SEQ ID NO: 417570 - RNA, 22 nt, Human
aggccuguuccuuccugggcac

SEQ ID NO: 417571 - RNA, 22 nt, Human
guuugcauguauuaagucaaua

SEQ ID NO: 417572 - RNA, 22 nt, Human
ugugcagggaagggcaugcuau

SEQ ID NO: 417573 - RNA, 22 nt, Human
ugcaggcucacccuggagcuga

SEQ ID NO: 417574 - RNA, 22 nt, Human
auggacagugugucuguuucca

SEQ ID NO: 417575 - RNA, 22 nt, Human
agguacagcaauauaagagguc

SEQ ID NO: 417576 - RNA, 16 nt, Human
cuuccucuucacuggc

SEQ ID NO: 417577 - RNA, 22 nt, Human
gcugagggcuguaacagcagag

SEQ ID NO: 417578 - RNA, 19 nt, Human
cccucaggucugagcaguc

SEQ ID NO: 417579 - RNA, 19 nt, Human
gccugggaugggcagaacu

SEQ ID NO: 417580 - RNA, 22 nt, Human
cagaggcauuacugaaaaggug

SEQ ID NO: 417581 - RNA, 22 nt, Human
cuuacauuaaguaagagauuga

SEQ ID NO: 417582 - RNA, 22 nt, Human
aaggcauauauucuaaacagga

SEQ ID NO: 417583 - RNA, 22 nt, Human
cugugccuuuguagcugugccu

SEQ ID NO: 417584 - RNA, 22 nt, Human
ggcugaggcucaugccaucuug

SEQ ID NO: 417585 - RNA, 22 nt, Human
gcagagaggauauuauugucca

SEQ ID NO: 417586 - RNA, 23 nt, Human
cugcuguguuggucucgauggga

SEQ ID NO: 417587 - RNA, 22 nt, Human
aagggcaggaaaagauggaugu

SEQ ID NO: 417588 - RNA, 22 nt, Human
ucagggacugcagagggaagcu

SEQ ID NO: 417589 - RNA, 22 nt, Human
uuagucaauagugaauauagag

SEQ ID NO: 417590 - RNA, 22 nt, Human
ugagaagcaguuucaguaagaa

SEQ ID NO: 417591 - RNA, 17 nt, Human
gcuuccugugcugggga

SEQ ID NO: 417592 - RNA, 22 nt, Human
aggggccauuguucugcccgcu

SEQ ID NO: 417593 - RNA, 22 nt, Human
cucuuccuacagucugcuaugc

SEQ ID NO: 417594 - RNA, 22 nt, Human
aggagagaauguuccaggcuug

SEQ ID NO: 417595 - RNA, 22 nt, Human
caguggccaugguggcaggggu

SEQ ID NO: 417596 - RNA, 22 nt, Human
ccagcccuugcugaaggguggc

SEQ ID NO: 417597 - RNA, 22 nt, Human
gagugcaguaugagaggcugcu

SEQ ID NO: 417598 - RNA, 18 nt, Human
acacacacaccuguguau

SEQ ID NO: 417599 - RNA, 22 nt, Human
uucaguuucagucuugcaaaaa

SEQ ID NO: 417600 - RNA, 22 nt, Human
gggacuggcacagggcugggag

SEQ ID NO: 417601 - RNA, 22 nt, Human
uuacaguuuaguccaagccaga

SEQ ID NO: 417602 - RNA, 22 nt, Human
ugagaaagugggugccuagcaa

SEQ ID NO: 417603 - RNA, 22 nt, Human
uuucuacauuuguaaccagauu

SEQ ID NO: 417604 - RNA, 22 nt, Human
gcucccacgcaauucuuuucag

SEQ ID NO: 417605 - RNA, 22 nt, Human
aaaaaugugaccacaggguguu

SEQ ID NO: 417606 - RNA, 22 nt, Human
ggggccuguagagcuucaggga

SEQ ID NO: 417607 - RNA, 22 nt, Human
caggacagguguucuagaucag

SEQ ID NO: 417608 - RNA, 22 nt, Human
cuauugaaaguguacaauucaa

SEQ ID NO: 417609 - RNA, 22 nt, Human
gcaccugcaggaugagccaggg

SEQ ID NO: 417610 - RNA, 22 nt, Human
agaaagaacgcacuugugcugc

SEQ ID NO: 417611 - RNA, 22 nt, Human
uauaagaaacaaggcaaauuuu

SEQ ID NO: 417612 - RNA, 22 nt, Human
aguggagaauaugcagaaagcc

SEQ ID NO: 417613 - RNA, 18 nt, Human
aggcaggugcuggaaguc

SEQ ID NO: 417614 - RNA, 22 nt, Human
gccaaaucacagggccaaaagc

SEQ ID NO: 417615 - RNA, 22 nt, Human
cagaguucaaagccugcuggga

SEQ ID NO: 417616 - RNA, 22 nt, Human
acaguccuguacaggccauauc

SEQ ID NO: 417617 - RNA, 22 nt, Human
agcugccaucugaagaacugca

SEQ ID NO: 417618 - RNA, 22 nt, Human
gcagggcagcugaagcuaggug

SEQ ID NO: 417619 - RNA, 17 nt, Human
ugcauuguaggcuagcc

SEQ ID NO: 417620 - RNA, 22 nt, Human
gcaaaggcuagagacacaggga

SEQ ID NO: 417621 - RNA, 22 nt, Human
caggcagcucaaccuugggagc

SEQ ID NO: 417622 - RNA, 17 nt, Human
uuuucucucuuggauuc

SEQ ID NO: 417623 - RNA, 22 nt, Human
cagagcaugaauaaaaguuaca

SEQ ID NO: 417624 - RNA, 22 nt, Human
acaggccugagauuuugcauuu

SEQ ID NO: 417625 - RNA, 22 nt, Human
aauuuguuacacagcaauauaa

SEQ ID NO: 417626 - RNA, 22 nt, Human
gaaggcugaugacagauucugc

SEQ ID NO: 417627 - RNA, 22 nt, Human
cacagaggacuguagcggggag

SEQ ID NO: 417628 - RNA, 22 nt, Human
gcacagaagagcuuuggaauga

SEQ ID NO: 417629 - RNA, 19 nt, Human
uuagccauccacagugaaa

SEQ ID NO: 417630 - RNA, 22 nt, Human
cagccagccucucaaccaugca

SEQ ID NO: 417631 - RNA, 22 nt, Human
gggcagguuggcaucccgggca

SEQ ID NO: 417632 - RNA, 22 nt, Human
cccaggagguggagguugcagu

SEQ ID NO: 417633 - RNA, 22 nt, Human
caggguggcaggcaccauggcc

SEQ ID NO: 417634 - RNA, 22 nt, Human
uagaaaucuacuuagacuuucu

SEQ ID NO: 417635 - RNA, 22 nt, Human
ccaggcagagggauccccaucc

SEQ ID NO: 417636 - RNA, 22 nt, Human
ucucagagggaggauuacugcc

SEQ ID NO: 417637 - RNA, 22 nt, Human
uccuuuguugagauaaauuggg

SEQ ID NO: 417638 - RNA, 22 nt, Human
agccucugguccucccucagcu

SEQ ID NO: 417639 - RNA, 22 nt, Human
cauuuauucucagauccuuguc

SEQ ID NO: 417640 - RNA, 22 nt, Human
gcacacccucucaccagcacug

SEQ ID NO: 417641 - RNA, 21 nt, Human
uccuccuucaaguccuggccu

SEQ ID NO: 417642 - RNA, 22 nt, Human
augcaucauggaaaacucaguu

SEQ ID NO: 417643 - RNA, 22 nt, Human
gcucugucauuuugcagacacu

SEQ ID NO: 417644 - RNA, 22 nt, Human
cuuccucccggcccaugcucug

SEQ ID NO: 417645 - RNA, 22 nt, Human
cagggcuagugacaccccaguc

SEQ ID NO: 417646 - RNA, 22 nt, Human
ggagagcaggguccugagauac

SEQ ID NO: 417647 - RNA, 22 nt, Human
guacauuuuacuuuguuugaau

SEQ ID NO: 417648 - RNA, 22 nt, Human
ucaguggagcuaagcaugagau

SEQ ID NO: 417649 - RNA, 21 nt, Human
acagagccgggcacaaagcug

SEQ ID NO: 417650 - RNA, 22 nt, Human
cagagcucuauguucauggagg

SEQ ID NO: 417651 - RNA, 22 nt, Human
uggcucaggauaauuuucccaa

SEQ ID NO: 417652 - RNA, 22 nt, Human
ugaccugcguaggugguuucug

SEQ ID NO: 417653 - RNA, 20 nt, Human
gagauggacagaugaagggg

SEQ ID NO: 417654 - RNA, 22 nt, Human
ggagggcaucaaucaggccugg

SEQ ID NO: 417655 - RNA, 22 nt, Human
auguaucagauaaagcaugugg

SEQ ID NO: 417656 - RNA, 22 nt, Human
guugggaagcagauggaugagc

SEQ ID NO: 417657 - RNA, 22 nt, Human
gggagccaugcuggucuucuuu

SEQ ID NO: 417658 - RNA, 22 nt, Human
ggccuugggcagacacgucaca

SEQ ID NO: 417659 - RNA, 22 nt, Human
augcccaaugucacaauuuuug

SEQ ID NO: 417660 - RNA, 22 nt, Human
aaagacugcaaaaacgcacaga

SEQ ID NO: 417661 - RNA, 22 nt, Human
ugcauccuuaaccagcaucacu

SEQ ID NO: 417662 - RNA, 22 nt, Human
ggagggagcauccccuugcuga

SEQ ID NO: 417663 - RNA, 22 nt, Human
ucucagagcuucagaaagcacc

SEQ ID NO: 417664 - RNA, 22 nt, Human
uccuggcccgaucccugugaag

SEQ ID NO: 417665 - RNA, 22 nt, Human
cuggggacuugcagacacaauu

SEQ ID NO: 417666 - RNA, 19 nt, Human
ccaggccuccugggagguc

SEQ ID NO: 417667 - RNA, 22 nt, Human
ccuggaagauucaccacuacca

SEQ ID NO: 417668 - RNA, 22 nt, Human
cugaaggacacgugaggagcca

SEQ ID NO: 417669 - RNA, 22 nt, Human
gucugcccucacgccagcuggg

SEQ ID NO: 417670 - RNA, 22 nt, Human
gggcauggaggucugucugcag

SEQ ID NO: 417671 - RNA, 22 nt, Human
uuagagccaguuacaaggucaa

SEQ ID NO: 417672 - RNA, 22 nt, Human
ucuuacagaaaauagauaacau

SEQ ID NO: 417673 - RNA, 22 nt, Human
cuucaggauuuaggaagaugaa

SEQ ID NO: 417674 - RNA, 22 nt, Human
agagacagaggcaauauagcuu

SEQ ID NO: 417675 - RNA, 22 nt, Human
auccuugacacacuccaguacu

SEQ ID NO: 417676 - RNA, 22 nt, Human
caugggagguuggcuuggcaug

SEQ ID NO: 417677 - RNA, 22 nt, Human
ggcaaggccuugcccagcauuc

SEQ ID NO: 417678 - RNA, 22 nt, Human
auaaaacuuauuagaauugugu

SEQ ID NO: 417679 - RNA, 23 nt, Human
gggcugcuccaggccaaggcugg

SEQ ID NO: 417680 - RNA, 22 nt, Human
ggagauaguccaggugaaggga

SEQ ID NO: 417681 - RNA, 22 nt, Human
cacuguacuggguugaaggacg

SEQ ID NO: 417682 - RNA, 22 nt, Human
ucucccaggugggugccuggag

SEQ ID NO: 417683 - RNA, 22 nt, Human
uuuguaaaggccugaauuucag

SEQ ID NO: 417684 - RNA, 22 nt, Human
cuggaggcugaguugggucucc

SEQ ID NO: 417685 - RNA, 22 nt, Human
agaggccaucugcucugugggg

SEQ ID NO: 417686 - RNA, 21 nt, Human
agcagagugcuuugacuuugu

SEQ ID NO: 417687 - RNA, 22 nt, Human
agagacaggguuuugccauguu

SEQ ID NO: 417688 - RNA, 22 nt, Human
acagaaaugauguuuggcaaua

SEQ ID NO: 417689 - RNA, 22 nt, Human
cugugcugauucagcacaggcc

SEQ ID NO: 417690 - RNA, 22 nt, Human
agauggggcagaauggagccau

SEQ ID NO: 417691 - RNA, 22 nt, Human
cagcugccaagaaucuuuucua

SEQ ID NO: 417692 - RNA, 22 nt, Human
cagcucucacacccuccuccca

SEQ ID NO: 417693 - RNA, 22 nt, Human
ccuuguccucugguuuccuguu

SEQ ID NO: 417694 - RNA, 21 nt, Human
gcucccuggcugugugaccug

SEQ ID NO: 417695 - RNA, 22 nt, Human
caagaaauguuuacugagcauc

SEQ ID NO: 417696 - RNA, 22 nt, Human
aggcuggcccuacuggcugccu

SEQ ID NO: 417697 - RNA, 22 nt, Human
gauuucuucauucauuagaugg

SEQ ID NO: 417698 - RNA, 22 nt, Human
aacaaauguguuuuguaauuaa

SEQ ID NO: 417699 - RNA, 22 nt, Human
ggcugggcugcugggucagagc

SEQ ID NO: 417700 - RNA, 22 nt, Human
auggauaagaacaaauaucuga

SEQ ID NO: 417701 - RNA, 22 nt, Human
gcagaauguaggccuucagugu

SEQ ID NO: 417702 - RNA, 22 nt, Human
ccagcuuuggaguguuguugcu

SEQ ID NO: 417703 - RNA, 21 nt, Human
uggcucugcucagagcagucc

SEQ ID NO: 417704 - RNA, 22 nt, Human
cugcagagcagccaguccccca

SEQ ID NO: 417705 - RNA, 22 nt, Human
acagggcaugugcaagagacau

SEQ ID NO: 417706 - RNA, 22 nt, Human
ucaacacucuuuggcacaguua

SEQ ID NO: 417707 - RNA, 22 nt, Human
uauuucuuuucgugacuuauug

SEQ ID NO: 417708 - RNA, 22 nt, Human
gagcagugagugaauguugccu

SEQ ID NO: 417709 - RNA, 22 nt, Human
cugagccauccauaccagcuua

SEQ ID NO: 417710 - RNA, 22 nt, Human
ugggcacaaacaucugccuguu

SEQ ID NO: 417711 - RNA, 22 nt, Human
cagcuucucagaaagcugaggu

SEQ ID NO: 417712 - RNA, 22 nt, Human
aagaauucacugguagagucaa

SEQ ID NO: 417713 - RNA, 22 nt, Human
ugcauauuuguaugauguuuag

SEQ ID NO: 417714 - RNA, 22 nt, Human
ugucucugggugauucaguccu

SEQ ID NO: 417715 - RNA, 22 nt, Human
ugggccugugaugcugggcuau

SEQ ID NO: 417716 - RNA, 22 nt, Human
auguccaguuucuacacacaua

SEQ ID NO: 417717 - RNA, 22 nt, Human
uucaggauuauacucucuuccc

SEQ ID NO: 417718 - RNA, 23 nt, Human
uagagcagggaaaucugucagag

SEQ ID NO: 417719 - RNA, 22 nt, Human
guauuagggccaaaggcaggaa

SEQ ID NO: 417720 - RNA, 22 nt, Human
auuaagggccaauccuccagcc

SEQ ID NO: 417721 - RNA, 22 nt, Human
gcagccucaaacuccccagcuc

SEQ ID NO: 417722 - RNA, 18 nt, Human
aggcuucuuggcucaguc

SEQ ID NO: 417723 - RNA, 23 nt, Human
cagagcugauuaaacuuaaucuc

SEQ ID NO: 417724 - RNA, 22 nt, Human
cccaggaggccaagguugcagu

SEQ ID NO: 417725 - RNA, 22 nt, Human
ccugucuggccaccagggcgau

SEQ ID NO: 417726 - RNA, 22 nt, Human
gcaggcagagagggguuuccag

SEQ ID NO: 417727 - RNA, 22 nt, Human
gagcacagccaaaguaagaagg

SEQ ID NO: 417728 - RNA, 22 nt, Human
uccucaggauguggaguagaau

SEQ ID NO: 417729 - RNA, 22 nt, Human
gcauuuauuucuuuacugcauc

SEQ ID NO: 417730 - RNA, 22 nt, Human
ucuucucccaucuccaggcagg

SEQ ID NO: 417731 - RNA, 22 nt, Human
uccugccuugccugggacauca

SEQ ID NO: 417732 - RNA, 22 nt, Human
ugcagcucauugguguccuggu

SEQ ID NO: 417733 - RNA, 22 nt, Human
cuccagggggcauccacacagc

SEQ ID NO: 417734 - RNA, 22 nt, Human
guaagcaucugucucuucugca

SEQ ID NO: 417735 - RNA, 22 nt, Human
augaggcaucuaacauugcaaa

SEQ ID NO: 417736 - RNA, 22 nt, Human
aaaucugguucaguaaguccuc

SEQ ID NO: 417737 - RNA, 22 nt, Human
gaugguuuggaaugaaguagcu

SEQ ID NO: 417738 - RNA, 22 nt, Human
ucuguacaccaggggccauucu

SEQ ID NO: 417739 - RNA, 22 nt, Human
agcuuuaucuucaccugggaau

SEQ ID NO: 417740 - RNA, 20 nt, Human
aggcugggguguuuugccca

SEQ ID NO: 417741 - RNA, 22 nt, Human
gaaaaugugucaucccuacugu

SEQ ID NO: 417742 - RNA, 22 nt, Human
gccagagcugagacacgagucc

SEQ ID NO: 417743 - RNA, 22 nt, Human
uacuuguuaucaucuuuuccuu

SEQ ID NO: 417744 - RNA, 22 nt, Human
gugccuggcaugcgccggugcu

SEQ ID NO: 417745 - RNA, 22 nt, Human
ucccacacagcccgcucaccgg

SEQ ID NO: 417746 - RNA, 17 nt, Human
cacaggugugguuugag

SEQ ID NO: 417747 - RNA, 22 nt, Human
accugagaccuaaucugacugu

SEQ ID NO: 417748 - RNA, 22 nt, Human
ugguagggacacuaugcagaaa

SEQ ID NO: 417749 - RNA, 22 nt, Human
ugcugggcuagaagcugaggcc

SEQ ID NO: 417750 - RNA, 22 nt, Human
accugaggcuguuagucuaggu

SEQ ID NO: 417751 - RNA, 20 nt, Human
ucuggcucuuugcuccuccc

SEQ ID NO: 417752 - RNA, 22 nt, Human
ucccaggcuggggccaggugac

SEQ ID NO: 417753 - RNA, 22 nt, Human
acugugugggccgcucacuggg

SEQ ID NO: 417754 - RNA, 22 nt, Human
uggaaagaaaguaaaggcguau

SEQ ID NO: 417755 - RNA, 22 nt, Human
uuuccucugacugcuccccugc

SEQ ID NO: 417756 - RNA, 22 nt, Human
uggguaaacugggucuggagag

SEQ ID NO: 417757 - RNA, 22 nt, Human
ugggcuguccagcaccugggcu

SEQ ID NO: 417758 - RNA, 22 nt, Human
aucacaaaggcugcuucaugau

SEQ ID NO: 417759 - RNA, 22 nt, Human
agaaauguggaucguuuuaaaa

SEQ ID NO: 417760 - RNA, 20 nt, Human
gugggcagcaggcauacugg

SEQ ID NO: 417761 - RNA, 22 nt, Human
ggcuggcuugccaagcucaggg

SEQ ID NO: 417762 - RNA, 22 nt, Human
cccagccucugggcucacccaa

SEQ ID NO: 417763 - RNA, 22 nt, Human
uuccaaagucauguugcugaua

SEQ ID NO: 417764 - RNA, 22 nt, Human
ucgagucauguucucccauuaa

SEQ ID NO: 417765 - RNA, 22 nt, Human
cccuggugguacggcacuggca

SEQ ID NO: 417766 - RNA, 22 nt, Human
gaggagaagcuaagaaacacag

SEQ ID NO: 417767 - RNA, 22 nt, Human
ggucccugaagaggccuggggu

SEQ ID NO: 417768 - RNA, 22 nt, Human
ucuuugcuccacacucuagaga

SEQ ID NO: 417769 - RNA, 22 nt, Human
ccuccaggaacuugagagacac

SEQ ID NO: 417770 - RNA, 22 nt, Human
cucugguguccuuuagaauuua

SEQ ID NO: 417771 - RNA, 22 nt, Human
uaagcauaacuaaaaaugauuu

SEQ ID NO: 417772 - RNA, 22 nt, Human
guuauuuuaucucugagagguu

SEQ ID NO: 417773 - RNA, 22 nt, Human
ggcuggguuauuuauggccaag

SEQ ID NO: 417774 - RNA, 22 nt, Human
guccucuguguaggcugcagac

SEQ ID NO: 417775 - RNA, 22 nt, Human
aaaugguauuuacucuguauua

SEQ ID NO: 417776 - RNA, 22 nt, Human
gggcugccaagccugccugccu

SEQ ID NO: 417777 - RNA, 22 nt, Human
ccaaaguccauaguuuacauaa

SEQ ID NO: 417778 - RNA, 22 nt, Human
cauugcacucuggcuggaacgg

SEQ ID NO: 417779 - RNA, 22 nt, Human
cagcauugaucccaggcugugg

SEQ ID NO: 417780 - RNA, 22 nt, Human
aauccagguggcggagguugug

SEQ ID NO: 417781 - RNA, 22 nt, Human
cagggcuggauuucauuucuag

SEQ ID NO: 417782 - RNA, 22 nt, Human
ugcuggcuguauaugugagagu

SEQ ID NO: 417783 - RNA, 20 nt, Human
aggcugccaggucucacauc

SEQ ID NO: 417784 - RNA, 22 nt, Human
gagcugcccugagcuuugcaug

SEQ ID NO: 417785 - RNA, 22 nt, Human
uugcauaaaagaguauaucuua

SEQ ID NO: 417786 - RNA, 22 nt, Human
cagcagcugcgugcccaggccg

SEQ ID NO: 417787 - RNA, 22 nt, Human
ccaggugugauuuggcaguguc

SEQ ID NO: 417788 - RNA, 22 nt, Human
ggccaggcacugugugagauau

SEQ ID NO: 417789 - RNA, 22 nt, Human
gaaaggucuuccggucuuccag

SEQ ID NO: 417790 - RNA, 22 nt, Human
ugcagggcuuccucuuggaguu

SEQ ID NO: 417791 - RNA, 22 nt, Human
gcugagaguccaggaaaacauc

SEQ ID NO: 417792 - RNA, 22 nt, Human
cagaagaggacuggguagcuca

SEQ ID NO: 417793 - RNA, 22 nt, Human
uaaacaaggguuacugagcaug

SEQ ID NO: 417794 - RNA, 22 nt, Human
caugcagugacucagacacagg

SEQ ID NO: 417795 - RNA, 22 nt, Human
aagcuuuaugacuuggagacag

SEQ ID NO: 417796 - RNA, 22 nt, Human
uuuacucuugcuacacaacugu

SEQ ID NO: 417797 - RNA, 22 nt, Human
agggaaggagguuagaacccac

SEQ ID NO: 417798 - RNA, 22 nt, Human
cagcuugcuaauuuugacuuca

SEQ ID NO: 417799 - RNA, 20 nt, Human
ggagcugcccugggcuggag

SEQ ID NO: 417800 - RNA, 22 nt, Human
acagaauugaaaguauaaucug

SEQ ID NO: 417801 - RNA, 22 nt, Human
gggcugagagugacuguucugu

SEQ ID NO: 417802 - RNA, 22 nt, Human
ccuggcucuguccucgcgcaaa

SEQ ID NO: 417803 - RNA, 22 nt, Human
guggugcauccuugaguaagcu

SEQ ID NO: 417804 - RNA, 23 nt, Human
agacccagagacuggcucugcuc

SEQ ID NO: 417805 - RNA, 22 nt, Human
aggcugaggcagguggaucacu

SEQ ID NO: 417806 - RNA, 22 nt, Human
augggcaguguauuggaaggaa

SEQ ID NO: 417807 - RNA, 22 nt, Human
ccugcaggggagagacuucuag

SEQ ID NO: 417808 - RNA, 22 nt, Human
caggguugcaugcaucuguggg

SEQ ID NO: 417809 - RNA, 22 nt, Human
auggcagagaaagcgagccaca

SEQ ID NO: 417810 - RNA, 22 nt, Human
gugcccugguccccagcauaua

SEQ ID NO: 417811 - RNA, 20 nt, Human
cuuggccuacuuagcuuugu

SEQ ID NO: 417812 - RNA, 22 nt, Human
ucucuccuuaucauuguguuua

SEQ ID NO: 417813 - RNA, 22 nt, Human
caguggaagcuggcugugaaga

SEQ ID NO: 417814 - RNA, 22 nt, Human
cagcuuccaucuccacugcccu

SEQ ID NO: 417815 - RNA, 22 nt, Human
aaugaugguuaaacacuggagg

SEQ ID NO: 417816 - RNA, 22 nt, Human
cuccugaguaguagcauuguca

SEQ ID NO: 417817 - RNA, 22 nt, Human
cagguaagagacggauuggccc

SEQ ID NO: 417818 - RNA, 17 nt, Human
gccucugcuugugucau

SEQ ID NO: 417819 - RNA, 22 nt, Human
uuucaauguaacauuuccaggc

SEQ ID NO: 417820 - RNA, 22 nt, Human
ucaauucaacacaugcacauug

SEQ ID NO: 417821 - RNA, 22 nt, Human
agaucucaccucuguguauuau

SEQ ID NO: 417822 - RNA, 22 nt, Human
ccagagagaguacugggcucug

SEQ ID NO: 417823 - RNA, 18 nt, Human
ugggcugccuggccucug

SEQ ID NO: 417824 - RNA, 22 nt, Human
cccaggcuggagugcaauggug

SEQ ID NO: 417825 - RNA, 22 nt, Human
agggugggcuagacucuucccc

SEQ ID NO: 417826 - RNA, 22 nt, Human
ccagcugcgggcaucgagaguu

SEQ ID NO: 417827 - RNA, 22 nt, Human
ccugucuguauugguuugcuau

SEQ ID NO: 417828 - RNA, 22 nt, Human
cauugaaaccuaacauaggcug

SEQ ID NO: 417829 - RNA, 22 nt, Human
ccagccuggacugggucuugug

SEQ ID NO: 417830 - RNA, 21 nt, Human
cugccuugaaugguacuggga

SEQ ID NO: 417831 - RNA, 22 nt, Human
ugccugucuucaggagugucac

SEQ ID NO: 417832 - RNA, 22 nt, Human
gccuggugguauccuggcaaga

SEQ ID NO: 417833 - RNA, 22 nt, Human
gggaucagaaacauagcccuga

SEQ ID NO: 417834 - RNA, 22 nt, Human
aggccagcucacccuggcuccu

SEQ ID NO: 417835 - RNA, 22 nt, Human
agggccagggaaacgaucagca

SEQ ID NO: 417836 - RNA, 22 nt, Human
ucccagcauaacaaacugcccg

SEQ ID NO: 417837 - RNA, 22 nt, Human
ugcuuaaaaugaugauuauuuu

SEQ ID NO: 417838 - RNA, 21 nt, Human
ccaggcuccugaggcugguca

SEQ ID NO: 417839 - RNA, 20 nt, Human
aggaagccaaaggcugucuu

SEQ ID NO: 417840 - RNA, 22 nt, Human
aauguauaaaguguuaauaacu

SEQ ID NO: 417841 - RNA, 22 nt, Human
ggcccagcacagugcuuggggg

SEQ ID NO: 417842 - RNA, 22 nt, Human
acauuucugagcagggagcugu

SEQ ID NO: 417843 - RNA, 22 nt, Human
cccugcagggaggauucugaag

SEQ ID NO: 417844 - RNA, 22 nt, Human
acugcagggcauccuggccaag

SEQ ID NO: 417845 - RNA, 22 nt, Human
ugaggccuuuucugucuggcua

SEQ ID NO: 417846 - RNA, 22 nt, Human
acuuguguaacacagaaagaac

SEQ ID NO: 417847 - RNA, 22 nt, Human
aaugauuuggcaaaggaaucca

SEQ ID NO: 417848 - RNA, 22 nt, Human
aguuuuucuccccuggcuucau

SEQ ID NO: 417849 - RNA, 18 nt, Human
agugucuggauauuuggg

SEQ ID NO: 417850 - RNA, 22 nt, Human
gacaagacagcuugcagacaac

SEQ ID NO: 417851 - RNA, 22 nt, Human
cacuguuuuauuccaacauagg

SEQ ID NO: 417852 - RNA, 22 nt, Human
uaccaaaagcuuguuucauaca

SEQ ID NO: 417853 - RNA, 22 nt, Human
agcagggcuuugucucugugaa

SEQ ID NO: 417854 - RNA, 22 nt, Human
gccagaagggguggauccaggc

SEQ ID NO: 417855 - RNA, 20 nt, Human
acauugauuauguuuguaga

SEQ ID NO: 417856 - RNA, 22 nt, Human
ugcauuaucuuuaauguucuca

SEQ ID NO: 417857 - RNA, 22 nt, Human
caaaauucugcauuucuaauaa

SEQ ID NO: 417858 - RNA, 22 nt, Human
auuauucuuaugucaucauggc

SEQ ID NO: 417859 - RNA, 22 nt, Human
aaguccagguccucauuccauc

SEQ ID NO: 417860 - RNA, 23 nt, Human
agggcugaaugcagagaagcaga

SEQ ID NO: 417861 - RNA, 22 nt, Human
cgggcuggcugcagcugcugga

SEQ ID NO: 417862 - RNA, 22 nt, Human
ccagaggagggcucugaugagg

SEQ ID NO: 417863 - RNA, 23 nt, Human
aggauguaggauguauggcagag

SEQ ID NO: 417864 - RNA, 22 nt, Human
agggacuuguguccuauguaug

SEQ ID NO: 417865 - RNA, 22 nt, Human
aagguacaguuuuaagaauaag

SEQ ID NO: 417866 - RNA, 22 nt, Human
gcccagugguaaaagcaggccu

SEQ ID NO: 417867 - RNA, 22 nt, Human
aauaaauguuaagauugucuca

SEQ ID NO: 417868 - RNA, 18 nt, Human
gagagcugcuaccuagcu

SEQ ID NO: 417869 - RNA, 22 nt, Human
ccagggccaagagaccucgagg

SEQ ID NO: 417870 - RNA, 22 nt, Human
gugcuuccugccuggugccuuu

SEQ ID NO: 417871 - RNA, 22 nt, Human
uuguggcagaccaugagucuaa

SEQ ID NO: 417872 - RNA, 22 nt, Human
ccugucuggccuuccacggggg

SEQ ID NO: 417873 - RNA, 19 nt, Human
uugaaagauuagcuuucua

SEQ ID NO: 417874 - RNA, 22 nt, Human
ucacagugaugacgugggagca

SEQ ID NO: 417875 - RNA, 22 nt, Human
guguggcuaccucagaggagca

SEQ ID NO: 417876 - RNA, 22 nt, Human
uauucuugucuuuuccagaaau

SEQ ID NO: 417877 - RNA, 22 nt, Human
ucuggcucaaaauacguacucu

SEQ ID NO: 417878 - RNA, 22 nt, Human
cucucuucccgugaguguugca

SEQ ID NO: 417879 - RNA, 22 nt, Human
ggcaggagaaaggucucuucuu

SEQ ID NO: 417880 - RNA, 22 nt, Human
ggaggcaggaaagacagguuca

SEQ ID NO: 417881 - RNA, 20 nt, Human
cuuguacaugauaaagauuu

SEQ ID NO: 417882 - RNA, 22 nt, Human
cuggggcucacuuuggucaggc

SEQ ID NO: 417883 - RNA, 22 nt, Human
aucacauugccagugauuaccc

SEQ ID NO: 417884 - RNA, 22 nt, Human
aauauuuguuaguguuuuaaug

SEQ ID NO: 417885 - RNA, 22 nt, Human
ucagcagucacauguuguccca

SEQ ID NO: 417886 - RNA, 22 nt, Human
ugagugccugaacauagaguag

SEQ ID NO: 417887 - RNA, 21 nt, Human
aaagugguaaggauuauuuug

SEQ ID NO: 417888 - RNA, 22 nt, Human
acauaauggacaauaaugcauc

SEQ ID NO: 417889 - RNA, 22 nt, Human
uggcucagcugacucggcuucu

SEQ ID NO: 417890 - RNA, 22 nt, Human
agugcauuauauguuucaaugg

SEQ ID NO: 417891 - RNA, 22 nt, Human
ugggugggagcgcccugucugg

SEQ ID NO: 417892 - RNA, 22 nt, Human
gccaguggcccucuggagaagg

SEQ ID NO: 417893 - RNA, 22 nt, Human
aggcuauuuccacucuucucau

SEQ ID NO: 417894 - RNA, 22 nt, Human
acuucuugggacccuggcaccg

SEQ ID NO: 417895 - RNA, 22 nt, Human
uggcuggggccacaguuuuccu

SEQ ID NO: 417896 - RNA, 22 nt, Human
ccagcugcaggggagcagugga

SEQ ID NO: 417897 - RNA, 22 nt, Human
agagucuuccaggcagccugag

SEQ ID NO: 417898 - RNA, 22 nt, Human
gagcagcugcagugcagacccu

SEQ ID NO: 417899 - RNA, 22 nt, Human
ggcacugaucugauuucccucc

SEQ ID NO: 417900 - RNA, 22 nt, Human
gggccugggaacuugcauuuag

SEQ ID NO: 417901 - RNA, 22 nt, Human
uauuaggguuuugaagguuugu

SEQ ID NO: 417902 - RNA, 22 nt, Human
ucucuuaauuuuggaauagugu

SEQ ID NO: 417903 - RNA, 22 nt, Human
ugacauuuuaucaauaucacag

SEQ ID NO: 417904 - RNA, 22 nt, Human
gcguaaggccucuggucucgga

SEQ ID NO: 417905 - RNA, 22 nt, Human
cuggcagcaguuaugaaacaau

SEQ ID NO: 417906 - RNA, 22 nt, Human
gagcugucuggggacucugggu

SEQ ID NO: 417907 - RNA, 22 nt, Human
uagcugccauugcuccaggaag

SEQ ID NO: 417908 - RNA, 22 nt, Human
cacacaugaaucccuaguaccu

SEQ ID NO: 417909 - RNA, 22 nt, Human
acauacuuuuuaaaagauugcu

SEQ ID NO: 417910 - RNA, 22 nt, Human
ccagggcagcgccccuccacgc

SEQ ID NO: 417911 - RNA, 22 nt, Human
aagggcucugugcuugucccau

SEQ ID NO: 417912 - RNA, 22 nt, Human
auuuuuaugacaaaccauccuc

SEQ ID NO: 417913 - RNA, 22 nt, Human
uaaaugcaguacaaauuguucu

SEQ ID NO: 417914 - RNA, 22 nt, Human
ggucagggcucuuccaguggcu

SEQ ID NO: 417915 - RNA, 22 nt, Human
uugcauugauguuccuucuugc

SEQ ID NO: 417916 - RNA, 22 nt, Human
acagcuuuguuuucccugcuga

SEQ ID NO: 417917 - RNA, 22 nt, Human
ccugggaggcugugggucugcu

SEQ ID NO: 417918 - RNA, 22 nt, Human
aguucuuuugugaacauaugcu

SEQ ID NO: 417919 - RNA, 22 nt, Human
aaacuuuaagacaguccucaag

SEQ ID NO: 417920 - RNA, 22 nt, Human
cagggcaggaugcugugauuau

SEQ ID NO: 417921 - RNA, 22 nt, Human
gccugccugcugucaucugccu

SEQ ID NO: 417922 - RNA, 22 nt, Human
auuuauuaccucggaguuucug

SEQ ID NO: 417923 - RNA, 22 nt, Human
gccccagcucugccacaacuag

SEQ ID NO: 417924 - RNA, 22 nt, Human
acagcuuuucugauagauccug

SEQ ID NO: 417925 - RNA, 22 nt, Human
agucucagggccacccggggaa

SEQ ID NO: 417926 - RNA, 22 nt, Human
agaaauguuguggguuuuguua

SEQ ID NO: 417927 - RNA, 22 nt, Human
gcaaaucaccaccuagcuggau

SEQ ID NO: 417928 - RNA, 22 nt, Human
ugaggaaacuuacaaggcagaa

SEQ ID NO: 417929 - RNA, 22 nt, Human
aaauuagucgguuuaggaauuu

SEQ ID NO: 417930 - RNA, 22 nt, Human
ugcuuuauagacaaggaaguag

SEQ ID NO: 417931 - RNA, 22 nt, Human
uggcuagcccuuguggggagag

SEQ ID NO: 417932 - RNA, 22 nt, Human
ugugcagcucuagagccaagcc

SEQ ID NO: 417933 - RNA, 22 nt, Human
acacauuucuaaauuuuuaccg

SEQ ID NO: 417934 - RNA, 22 nt, Human
ggcaggcugcuugggucauguc

SEQ ID NO: 417935 - RNA, 22 nt, Human
gaaggcugagcagacaggccaa

SEQ ID NO: 417936 - RNA, 22 nt, Human
augcacuugcguguuugcaaau

SEQ ID NO: 417937 - RNA, 22 nt, Human
ucaugacaacuauauuauucca

SEQ ID NO: 417938 - RNA, 22 nt, Human
cuggggcuggugaggcaggcuc

SEQ ID NO: 417939 - RNA, 22 nt, Human
aaugggagguaguaugggaggu

SEQ ID NO: 417940 - RNA, 22 nt, Human
gccaggcuguggggaacuugaa

SEQ ID NO: 417941 - RNA, 22 nt, Human
acaacaggguaaggcaggccau

SEQ ID NO: 417942 - RNA, 22 nt, Human
ggcccuguuagagcucccacaa

SEQ ID NO: 417943 - RNA, 22 nt, Human
gccagggaggcuguaggguccu

SEQ ID NO: 417944 - RNA, 22 nt, Human
agggcagagaucugagugggca

SEQ ID NO: 417945 - RNA, 22 nt, Human
uccagggagauggcagaggcug

SEQ ID NO: 417946 - RNA, 22 nt, Human
guggagcccugguagggacccc

SEQ ID NO: 417947 - RNA, 22 nt, Human
ugagccuggguggucgaggcug

SEQ ID NO: 417948 - RNA, 22 nt, Human
aucaguuuauacuuauaaaucu

SEQ ID NO: 417949 - RNA, 22 nt, Human
aaucuggcauuugagaguagga

SEQ ID NO: 417950 - RNA, 22 nt, Human
ucuuuauuucugaaucccccau

SEQ ID NO: 417951 - RNA, 18 nt, Human
cugucaccgccaccacac

SEQ ID NO: 417952 - RNA, 22 nt, Human
ucagaaauuuucucaguaguuc

SEQ ID NO: 417953 - RNA, 22 nt, Human
aggcugucaucuuugcaggcag

SEQ ID NO: 417954 - RNA, 22 nt, Human
cuuuuuccagcuucaggguggg

SEQ ID NO: 417955 - RNA, 22 nt, Human
uggccuggcccugaggcccugu

SEQ ID NO: 417956 - RNA, 23 nt, Human
uuuuaauuuggacauaagaagau

SEQ ID NO: 417957 - RNA, 22 nt, Human
gaagccacccuccuuccagccc

SEQ ID NO: 417958 - RNA, 22 nt, Human
auugaaaaauucacaauucugg

SEQ ID NO: 417959 - RNA, 18 nt, Human
gcuggcugcacuucugcu

SEQ ID NO: 417960 - RNA, 22 nt, Human
agaguguuuuucugucaaggac

SEQ ID NO: 417961 - RNA, 22 nt, Human
uuccaaagaaauugaccaagac

SEQ ID NO: 417962 - RNA, 20 nt, Human
guucucacugaucugcaggg

SEQ ID NO: 417963 - RNA, 22 nt, Human
aaccugcaguuuuuauucugag

SEQ ID NO: 417964 - RNA, 22 nt, Human
ccaaggcaggggaucaaaguuu

SEQ ID NO: 417965 - RNA, 22 nt, Human
cuuccaaacccaggguaugggc

SEQ ID NO: 417966 - RNA, 22 nt, Human
ugcagagguguugcugagauaa

SEQ ID NO: 417967 - RNA, 22 nt, Human
aggcagaauguuggaaaggaag

SEQ ID NO: 417968 - RNA, 21 nt, Human
uauacaugugugcauacgugu

SEQ ID NO: 417969 - RNA, 22 nt, Human
gggcuccaacggugagcaugga

SEQ ID NO: 417970 - RNA, 22 nt, Human
uuguaacacuuuucuauuaaua

SEQ ID NO: 417971 - RNA, 23 nt, Human
acacaaggguaacugccagccau

SEQ ID NO: 417972 - RNA, 22 nt, Human
cagcuccccaugguuccugaag

SEQ ID NO: 417973 - RNA, 22 nt, Human
aagucacagcuaaauagcuaag

SEQ ID NO: 417974 - RNA, 22 nt, Human
ugccaggcugucaauucaccca

SEQ ID NO: 417975 - RNA, 18 nt, Human
cagcagagacauucaaaa

SEQ ID NO: 417976 - RNA, 23 nt, Human
gaagccacacaaaggucgccaag

SEQ ID NO: 417977 - RNA, 22 nt, Human
aauaugcauguauacaugugua

SEQ ID NO: 417978 - RNA, 22 nt, Human
uuuccucuuauacaguguuuau

SEQ ID NO: 417979 - RNA, 23 nt, Human
gugcaugugucuuuacaguagca

SEQ ID NO: 417980 - RNA, 22 nt, Human
uucacaggaauguaggggucuu

SEQ ID NO: 417981 - RNA, 22 nt, Human
agucucagaaaagaagcaugga

SEQ ID NO: 417982 - RNA, 22 nt, Human
cggcagagcuuccugcucagcg

SEQ ID NO: 417983 - RNA, 22 nt, Human
ggcaggagcucagguugguucc

SEQ ID NO: 417984 - RNA, 23 nt, Human
ugaugggaaggaacgacuaccac

SEQ ID NO: 417985 - RNA, 22 nt, Human
gucagaggaauggaugagugau

SEQ ID NO: 417986 - RNA, 22 nt, Human
guaagagcacugucuccugcug

SEQ ID NO: 417987 - RNA, 22 nt, Human
aaggcugaauucaaggguaggc

SEQ ID NO: 417988 - RNA, 22 nt, Human
caucuuuaaaggggagacaccc

SEQ ID NO: 417989 - RNA, 21 nt, Human
aaguaaaucagagaaauaacc

SEQ ID NO: 417990 - RNA, 22 nt, Human
gugucaugggagucagaaguga

SEQ ID NO: 417991 - RNA, 22 nt, Human
gagaggccaccugacgagcagu

SEQ ID NO: 417992 - RNA, 22 nt, Human
gcaaagucucaagacccaagug

SEQ ID NO: 417993 - RNA, 22 nt, Human
aaugcacauauauguguauaca

SEQ ID NO: 417994 - RNA, 22 nt, Human
agaagccagucgcucucccgca

SEQ ID NO: 417995 - RNA, 22 nt, Human
ccagagaggcaaaacuccuucc

SEQ ID NO: 417996 - RNA, 22 nt, Human
ccuggagcuuuuccauccugga

SEQ ID NO: 417997 - RNA, 19 nt, Human
ucaguggaugaacauguuu

SEQ ID NO: 417998 - RNA, 22 nt, Human
aaauaauuauagcgagucuauc

SEQ ID NO: 417999 - RNA, 22 nt, Human
cuguggcaggaagggacuagca

SEQ ID NO: 418000 - RNA, 22 nt, Human
uuacaaacaagaucuuauucuu

SEQ ID NO: 418001 - RNA, 22 nt, Human
acguguucaauuuccaucugac

SEQ ID NO: 418002 - RNA, 21 nt, Human
gugucaugguugacuuuggca

SEQ ID NO: 418003 - RNA, 22 nt, Human
cagaggccauauuucuucacuc

SEQ ID NO: 418004 - RNA, 22 nt, Human
gcauacagagaggauguggcau

SEQ ID NO: 418005 - RNA, 22 nt, Human
ccacccugagccgcaagagcag

SEQ ID NO: 418006 - RNA, 22 nt, Human
cagggcuggcucaugaaaaguu

SEQ ID NO: 418007 - RNA, 18 nt, Human
uccagcgugcuccagggc

SEQ ID NO: 418008 - RNA, 23 nt, Human
aucaagucaucagcaaaauacau

SEQ ID NO: 418009 - RNA, 22 nt, Human
ugggaugggaucucgcuguguc

SEQ ID NO: 418010 - RNA, 22 nt, Human
gcugaggccucagaaggcugag

SEQ ID NO: 418011 - RNA, 22 nt, Human
uccucuucugcccaucagaggc

SEQ ID NO: 418012 - RNA, 21 nt, Human
uucuacaggaugaaugaaaac

SEQ ID NO: 418013 - RNA, 22 nt, Human
ggguggggcccaggaaaucuau

SEQ ID NO: 418014 - RNA, 22 nt, Human
cacaaaaguaggaggcaggcgg

SEQ ID NO: 418015 - RNA, 21 nt, Human
agggcagauuagcuguaagag

SEQ ID NO: 418016 - RNA, 22 nt, Human
aagaacagauucagccugaacu

SEQ ID NO: 418017 - RNA, 22 nt, Human
cagaggguugucaggcgccuug

SEQ ID NO: 418018 - RNA, 22 nt, Human
cagggcugugcccaucuucccc

SEQ ID NO: 418019 - RNA, 22 nt, Human
cuguuuauacgacagguggagg

SEQ ID NO: 418020 - RNA, 22 nt, Human
uccugaaaaauuacauguucag

SEQ ID NO: 418021 - RNA, 22 nt, Human
cagggcaggaauuugacauugc

SEQ ID NO: 418022 - RNA, 22 nt, Human
ggaggaagugcaguucuacuac

SEQ ID NO: 418023 - RNA, 22 nt, Human
aagaaacuguugcgugacagcg

SEQ ID NO: 418024 - RNA, 22 nt, Human
cuucccuuggugaacagagcau

SEQ ID NO: 418025 - RNA, 22 nt, Human
aaggcuuuaugugaccaaaaga

SEQ ID NO: 418026 - RNA, 22 nt, Human
gcucccaggaugaggagccagg

SEQ ID NO: 418027 - RNA, 22 nt, Human
gggcccuggggccugauuugca

SEQ ID NO: 418028 - RNA, 22 nt, Human
ugggccagcaauugcugcucag

SEQ ID NO: 418029 - RNA, 22 nt, Human
aggccucacucucagagcuucu

SEQ ID NO: 418030 - RNA, 21 nt, Human
agccugggaggcggagguugc

SEQ ID NO: 418031 - RNA, 22 nt, Human
aggagcccugcgggaggcagag

SEQ ID NO: 418032 - RNA, 22 nt, Human
agggucugacuccucuggcaag

SEQ ID NO: 418033 - RNA, 22 nt, Human
agggcugccauuucuggcccaa

SEQ ID NO: 418034 - RNA, 22 nt, Human
gggaccuggcgagggucacaca

SEQ ID NO: 418035 - RNA, 22 nt, Human
ugcagcuucuuguccugugauu

SEQ ID NO: 418036 - RNA, 22 nt, Human
cugugucggacgugggcagcag

SEQ ID NO: 418037 - RNA, 22 nt, Human
auaaaauuugcuacuguuaaau

SEQ ID NO: 418038 - RNA, 22 nt, Human
gcaggaagcauagaagaaugcc

SEQ ID NO: 418039 - RNA, 22 nt, Human
ugcucuggagggugaagcuuuu

SEQ ID NO: 418040 - RNA, 22 nt, Human
agcuaagacuuagugacuuagu

SEQ ID NO: 418041 - RNA, 22 nt, Human
aaggccugaacaugaggagaug

SEQ ID NO: 418042 - RNA, 22 nt, Human
aaugauggauuuagacaagcug

SEQ ID NO: 418043 - RNA, 22 nt, Human
uucuguuuacucagaaauacaa

SEQ ID NO: 418044 - RNA, 22 nt, Human
uucuucauggguucuuuuagga

SEQ ID NO: 418045 - RNA, 22 nt, Human
agcugccucagcaacacagacc

SEQ ID NO: 418046 - RNA, 22 nt, Human
uggcagcuccggguaggggcug

SEQ ID NO: 418047 - RNA, 22 nt, Human
acaggcaggcgggacagcccga

SEQ ID NO: 418048 - RNA, 21 nt, Human
agaaaauggcguuuuagauuu

SEQ ID NO: 418049 - RNA, 22 nt, Human
agcaauauuuaaagguuugcaa

SEQ ID NO: 418050 - RNA, 22 nt, Human
cccagcagaaucugaugagggc

SEQ ID NO: 418051 - RNA, 22 nt, Human
uugcucugauuagguggaaaca

SEQ ID NO: 418052 - RNA, 22 nt, Human
ggccuguccagccugccuggcu

SEQ ID NO: 418053 - RNA, 22 nt, Human
aagcaauaagccagauuuggau

SEQ ID NO: 418054 - RNA, 22 nt, Human
caccugagcacuggggccgccc

SEQ ID NO: 418055 - RNA, 22 nt, Human
uucacauaaugauacaaagcuu

SEQ ID NO: 418056 - RNA, 22 nt, Human
gggcaguugauggaggucugga

SEQ ID NO: 418057 - RNA, 23 nt, Human
ugggcagcuucugcaugcccacc

SEQ ID NO: 418058 - RNA, 22 nt, Human
cucugaauggacacuccagugu

SEQ ID NO: 418059 - RNA, 22 nt, Human
gugcuugggggaaguaacagac

SEQ ID NO: 418060 - RNA, 22 nt, Human
ugugccuacugauagagccaag

SEQ ID NO: 418061 - RNA, 22 nt, Human
cugaggcuggcguuugaggaag

SEQ ID NO: 418062 - RNA, 18 nt, Human
ccucagggagagagacgc

SEQ ID NO: 418063 - RNA, 22 nt, Human
agcaguggcugaagauguuccu

SEQ ID NO: 418064 - RNA, 22 nt, Human
gcuggccacauugugccguccu

SEQ ID NO: 418065 - RNA, 22 nt, Human
agggcuggcuccguuaccuuga

SEQ ID NO: 418066 - RNA, 18 nt, Human
ccuggcagccaugcgcgc

SEQ ID NO: 418067 - RNA, 22 nt, Human
gcugagagcggccagcugggaa

SEQ ID NO: 418068 - RNA, 23 nt, Human
uguugaaguaacuguuacauaga

SEQ ID NO: 418069 - RNA, 22 nt, Human
uauuugauagagauaaaugaua

SEQ ID NO: 418070 - RNA, 22 nt, Human
agggcagaaaccaccuugaugg

SEQ ID NO: 418071 - RNA, 22 nt, Human
caggggcaagaaugcugucagc

SEQ ID NO: 418072 - RNA, 22 nt, Human
aacuguucuucauuuucaguau

SEQ ID NO: 418073 - RNA, 22 nt, Human
agcagcuucuuucacuccugga

SEQ ID NO: 418074 - RNA, 22 nt, Human
uuuccucuaaacgcauuugcuu

SEQ ID NO: 418075 - RNA, 22 nt, Human
ccccaggacacauggaccaagu

SEQ ID NO: 418076 - RNA, 22 nt, Human
cucuuaaagaauguuccagcug

SEQ ID NO: 418077 - RNA, 22 nt, Human
uauucacaaaaugagguccuca

SEQ ID NO: 418078 - RNA, 22 nt, Human
ucccagagcaguacuccaggag

SEQ ID NO: 418079 - RNA, 22 nt, Human
ucaggagaaucagggcuguccu

SEQ ID NO: 418080 - RNA, 22 nt, Human
cagggcuccccagagagccucu

SEQ ID NO: 418081 - RNA, 22 nt, Human
agggcugagcccaggcauguag

SEQ ID NO: 418082 - RNA, 22 nt, Human
uagagugguuaacaguuuagaa

SEQ ID NO: 418083 - RNA, 22 nt, Human
ucagggcauacucuucaagguc

SEQ ID NO: 418084 - RNA, 22 nt, Human
cuggagagggagcccuggcagu

SEQ ID NO: 418085 - RNA, 22 nt, Human
ugauuucaaguagugacaugcu

SEQ ID NO: 418086 - RNA, 22 nt, Human
aacaaaugaccugauuucuucc

SEQ ID NO: 418087 - RNA, 22 nt, Human
aggaccugaaauucuugcuuuu

SEQ ID NO: 418088 - RNA, 19 nt, Human
ucaggcaguuauucacaaa

SEQ ID NO: 418089 - RNA, 22 nt, Human
ggggaggaagcuggaacacggg

SEQ ID NO: 418090 - RNA, 22 nt, Human
cccagcacaggcaauuccauac

SEQ ID NO: 418091 - RNA, 22 nt, Human
cagcccugcacgcugccuccgc

SEQ ID NO: 418092 - RNA, 22 nt, Human
ggagccagagucugcaguguaa

SEQ ID NO: 418093 - RNA, 22 nt, Human
gggacccugggaggcuggcgca

SEQ ID NO: 418094 - RNA, 19 nt, Human
uggagacugagagugagca

SEQ ID NO: 418095 - RNA, 22 nt, Human
gcagagccgugaauggauuuca

SEQ ID NO: 418096 - RNA, 22 nt, Human
agucucugugagcucccaaugg

SEQ ID NO: 418097 - RNA, 22 nt, Human
uuccaugugaguacacugugau

SEQ ID NO: 418098 - RNA, 22 nt, Human
uggcagagaacacggcugaucu

SEQ ID NO: 418099 - RNA, 22 nt, Human
ggugacuggagggacccaggcc

SEQ ID NO: 418100 - RNA, 22 nt, Human
ucagaaaugaucguuauucauu

SEQ ID NO: 418101 - RNA, 22 nt, Human
aaauccuaaggagaauaugauu

SEQ ID NO: 418102 - RNA, 22 nt, Human
aaaacaggugucagcaaacuau

SEQ ID NO: 418103 - RNA, 22 nt, Human
acacaggaagucagcacugaug

SEQ ID NO: 418104 - RNA, 22 nt, Human
uccucaggucaaagcaggagaa

SEQ ID NO: 418105 - RNA, 22 nt, Human
cagcagugugcaggugugcugg

SEQ ID NO: 418106 - RNA, 22 nt, Human
aacucaguucuuuccacaaugc

SEQ ID NO: 418107 - RNA, 22 nt, Human
aagcagccucauuugugguaag

SEQ ID NO: 418108 - RNA, 22 nt, Human
agauacauugaguuuccuccug

SEQ ID NO: 418109 - RNA, 22 nt, Human
gaagagcuguagccugcucuuu

SEQ ID NO: 418110 - RNA, 22 nt, Human
ggcaggcaagucugcucuguga

SEQ ID NO: 418111 - RNA, 22 nt, Human
uugcagggcaggaccauggaca

SEQ ID NO: 418112 - RNA, 22 nt, Human
guuucuuagguaaauucuuuga

SEQ ID NO: 418113 - RNA, 22 nt, Human
uaguaucuauuaguaacaagag

SEQ ID NO: 418114 - RNA, 18 nt, Human
gagcugggagaaggaagg

SEQ ID NO: 418115 - RNA, 21 nt, Human
gcagccagacgggauucaguu

SEQ ID NO: 418116 - RNA, 22 nt, Human
ccuuccaggugcaggcaagccu

SEQ ID NO: 418117 - RNA, 22 nt, Human
auauucacugagcauaaagcca

SEQ ID NO: 418118 - RNA, 22 nt, Human
cgccugggaguccacaccugcu

SEQ ID NO: 418119 - RNA, 22 nt, Human
ccaggcugcucacaagcugccc

SEQ ID NO: 418120 - RNA, 22 nt, Human
uuccuaaaagaauacacuggau

SEQ ID NO: 418121 - RNA, 22 nt, Human
uggagcagagaugggagcccaa

SEQ ID NO: 418122 - RNA, 22 nt, Human
ggcagugaugucaaacagugaa

SEQ ID NO: 418123 - RNA, 22 nt, Human
ucagagugaccuuacauggucu

SEQ ID NO: 418124 - RNA, 21 nt, Human
agauuguauggaggugagagg

SEQ ID NO: 418125 - RNA, 22 nt, Human
aggcugcagaacagucaggugc

SEQ ID NO: 418126 - RNA, 22 nt, Human
gagagcuggauucuggauaggu

SEQ ID NO: 418127 - RNA, 22 nt, Human
ccagggcugcugugggacucca

SEQ ID NO: 418128 - RNA, 22 nt, Human
acagagcuguacaugugccaug

SEQ ID NO: 418129 - RNA, 22 nt, Human
gcuggccauggggagugaggag

SEQ ID NO: 418130 - RNA, 22 nt, Human
uccauucauucauugaugaaca

SEQ ID NO: 418131 - RNA, 22 nt, Human
ugcagggcagauaugacuguag

SEQ ID NO: 418132 - RNA, 22 nt, Human
cacucugagaaguacaagcucc

SEQ ID NO: 418133 - RNA, 22 nt, Human
gauuauauaauggaagcucuug

SEQ ID NO: 418134 - RNA, 22 nt, Human
auuaaacaauguaaaguucuug

SEQ ID NO: 418135 - RNA, 22 nt, Human
cucaucugauaaaucacucuua

SEQ ID NO: 418136 - RNA, 22 nt, Human
agcugauuccacuuuuucccca

SEQ ID NO: 418137 - RNA, 22 nt, Human
ucugcagcuucuugccagagag

SEQ ID NO: 418138 - RNA, 21 nt, Human
uuagaaagcucacuacaguua

SEQ ID NO: 418139 - RNA, 22 nt, Human
uugaauaggacucagcagugau

SEQ ID NO: 418140 - RNA, 18 nt, Human
gaucgggggcgccccaag

SEQ ID NO: 418141 - RNA, 22 nt, Human
uucugaaaggcagguuguuugc

SEQ ID NO: 418142 - RNA, 22 nt, Human
ggggcugggauuugaacccagg

SEQ ID NO: 418143 - RNA, 16 nt, Human
gcagaggaaaggggag

SEQ ID NO: 418144 - RNA, 22 nt, Human
agacucaagacugcagaagacg

SEQ ID NO: 418145 - RNA, 22 nt, Human
uagaacacuugaccacugcucc

SEQ ID NO: 418146 - RNA, 22 nt, Human
uggcucuguugagguauggauu

SEQ ID NO: 418147 - RNA, 22 nt, Human
ucucagagccuaacuaaccuaa

SEQ ID NO: 418148 - RNA, 22 nt, Human
aggcucagaggugagcaucugc

SEQ ID NO: 418149 - RNA, 22 nt, Human
cucaggauagcugcgcagccug

SEQ ID NO: 418150 - RNA, 22 nt, Human
guacccaggcacgccuugcuga

SEQ ID NO: 418151 - RNA, 20 nt, Human
ucaggaugugcugagugaag

SEQ ID NO: 418152 - RNA, 22 nt, Human
ggcucacgcaauuaucccggcc

SEQ ID NO: 418153 - RNA, 22 nt, Human
acaggcuuuuuuagaaugacau

SEQ ID NO: 418154 - RNA, 22 nt, Human
aaaauguaaagcuugaguguag

SEQ ID NO: 418155 - RNA, 22 nt, Human
uagggcagaguccaggaugggc

SEQ ID NO: 418156 - RNA, 22 nt, Human
gagagcccugcuccuaucccag

SEQ ID NO: 418157 - RNA, 22 nt, Human
uccaggcagggcagccaucaag

SEQ ID NO: 418158 - RNA, 22 nt, Human
agaggcagcagucauacuacag

SEQ ID NO: 418159 - RNA, 22 nt, Human
cagcuuuaccuuuaggaguaac

SEQ ID NO: 418160 - RNA, 22 nt, Human
uauuucuuucagguauguguug

SEQ ID NO: 418161 - RNA, 22 nt, Human
ugcuggccaacaaggcuccaag

SEQ ID NO: 418162 - RNA, 22 nt, Human
ucuauuucgcauauaaguuuug

SEQ ID NO: 418163 - RNA, 22 nt, Human
gaaugugugacucuauugagca

SEQ ID NO: 418164 - RNA, 22 nt, Human
gaguccaguucuuuccagcagu

SEQ ID NO: 418165 - RNA, 22 nt, Human
aaaucugggucaagguggagug

SEQ ID NO: 418166 - RNA, 22 nt, Human
ccucacugaagaggugacauuu

SEQ ID NO: 418167 - RNA, 22 nt, Human
gaugcagggcuggcaggagcuu

SEQ ID NO: 418168 - RNA, 22 nt, Human
accaaaggcagagcugaacacu

SEQ ID NO: 418169 - RNA, 22 nt, Human
cuggcugcgucugcucugacag

SEQ ID NO: 418170 - RNA, 22 nt, Human
ucauugcaguugaguuguguua

SEQ ID NO: 418171 - RNA, 21 nt, Human
aggucccagguuugggcagca

SEQ ID NO: 418172 - RNA, 18 nt, Human
cucagagaugcccuuauu

SEQ ID NO: 418173 - RNA, 22 nt, Human
uccuggaggcaaaugaagacuc

SEQ ID NO: 418174 - RNA, 22 nt, Human
uggcagcagacaaaaggccauu

SEQ ID NO: 418175 - RNA, 22 nt, Human
agggacugagcuaggaucuagu

SEQ ID NO: 418176 - RNA, 22 nt, Human
uuugcuuguucaagauuucugu

SEQ ID NO: 418177 - RNA, 21 nt, Human
agcagaggcugccuggugacu

SEQ ID NO: 418178 - RNA, 22 nt, Human
gcacugcagccucagauggugg

SEQ ID NO: 418179 - RNA, 22 nt, Human
uaaggccaauuacauauguuca

SEQ ID NO: 418180 - RNA, 22 nt, Human
ggggaugguggcauuuguaaaa

SEQ ID NO: 418181 - RNA, 22 nt, Human
aaugcacauaaauauggucuua

SEQ ID NO: 418182 - RNA, 23 nt, Human
uuucauaugguguggaugaagaa

SEQ ID NO: 418183 - RNA, 22 nt, Human
ggucaggguauaaucaagugag

SEQ ID NO: 418184 - RNA, 22 nt, Human
agaggaaaaugaguuccagaau

SEQ ID NO: 418185 - RNA, 23 nt, Human
ucuguacaauugagaagagaaca

SEQ ID NO: 418186 - RNA, 22 nt, Human
ugucuucaucuccaugcacaga

SEQ ID NO: 418187 - RNA, 22 nt, Human
acuuaaaaacagauccagcagg

SEQ ID NO: 418188 - RNA, 22 nt, Human
uuuuuccuagugcuuucuggua

SEQ ID NO: 418189 - RNA, 22 nt, Human
aggucauuccuugucuucuugc

SEQ ID NO: 418190 - RNA, 22 nt, Human
aggaaacuguccccucauccua

SEQ ID NO: 418191 - RNA, 22 nt, Human
cugucugucaaguucaucucca

SEQ ID NO: 418192 - RNA, 22 nt, Human
acagaaugcguagugcauguug

SEQ ID NO: 418193 - RNA, 22 nt, Human
gaugccuccaaaugagggcaga

SEQ ID NO: 418194 - RNA, 22 nt, Human
ucuuuacacaagacaagaauaa

SEQ ID NO: 418195 - RNA, 22 nt, Human
uuucauaauacuguacaugaaa

SEQ ID NO: 418196 - RNA, 20 nt, Human
gcugggggugugcugaguga

SEQ ID NO: 418197 - RNA, 22 nt, Human
cacaucagggcugcuugggggu

SEQ ID NO: 418198 - RNA, 22 nt, Human
cacugccugugagcugugugcc

SEQ ID NO: 418199 - RNA, 22 nt, Human
gaacaaacacaucccagcagug

SEQ ID NO: 418200 - RNA, 22 nt, Human
ugaaaaggaguccuuguuuuca

SEQ ID NO: 418201 - RNA, 22 nt, Human
uugaaggaggcuccuuuuuaaa

SEQ ID NO: 418202 - RNA, 22 nt, Human
gagggcucugaaaggaggucac

SEQ ID NO: 418203 - RNA, 21 nt, Human
ucagaacaauuccaugccucc

SEQ ID NO: 418204 - RNA, 22 nt, Human
ggccuugggcuggcugcaguau

SEQ ID NO: 418205 - RNA, 22 nt, Human
aggcuggaguacaguggcuauu

SEQ ID NO: 418206 - RNA, 22 nt, Human
uauaauuuaucaugucacaguu

SEQ ID NO: 418207 - RNA, 22 nt, Human
ggagccagugcccucuggugga

SEQ ID NO: 418208 - RNA, 22 nt, Human
cuggagaggcugggaacagguu

SEQ ID NO: 418209 - RNA, 22 nt, Human
aaggcaggaugcggacccaucu

SEQ ID NO: 418210 - RNA, 22 nt, Human
ugcaccccauuuuacauuuaca

SEQ ID NO: 418211 - RNA, 22 nt, Human
cacaggccugucucuuucuaac

SEQ ID NO: 418212 - RNA, 18 nt, Human
uggcagcaggaagccauu

SEQ ID NO: 418213 - RNA, 22 nt, Human
agaagccaauucugugugaguc

SEQ ID NO: 418214 - RNA, 18 nt, Human
cccagcuuagcgccccuc

SEQ ID NO: 418215 - RNA, 22 nt, Human
ucauuuucacacauaaauagca

SEQ ID NO: 418216 - RNA, 22 nt, Human
uaaauuguuuucuagaaguugu

SEQ ID NO: 418217 - RNA, 22 nt, Human
ggcuuuauaggguagaggauca

SEQ ID NO: 418218 - RNA, 22 nt, Human
ucugucugcucauuuaccucag

SEQ ID NO: 418219 - RNA, 22 nt, Human
gauggcagucaaccaggugagg

SEQ ID NO: 418220 - RNA, 21 nt, Human
uggcucuguucaauauaugga

SEQ ID NO: 418221 - RNA, 22 nt, Human
augcugaauugaugcgagggag

SEQ ID NO: 418222 - RNA, 22 nt, Human
agaggaaguaaucaggaccugc

SEQ ID NO: 418223 - RNA, 22 nt, Human
aaaaguauuggccaccauuucu

SEQ ID NO: 418224 - RNA, 19 nt, Human
caggagagcaugcacuuug

SEQ ID NO: 418225 - RNA, 18 nt, Human
ccuggcuuccaucuuggu

SEQ ID NO: 418226 - RNA, 22 nt, Human
uuucacauaucaacucuauccu

SEQ ID NO: 418227 - RNA, 22 nt, Human
acucagaguuugcguuccauac

SEQ ID NO: 418228 - RNA, 22 nt, Human
ggccucagugggccgcugcagg

SEQ ID NO: 418229 - RNA, 22 nt, Human
cugccucucaggucccugagau

SEQ ID NO: 418230 - RNA, 22 nt, Human
ccagagccugcugagccccauu

SEQ ID NO: 418231 - RNA, 22 nt, Human
gcaguggggcgcugggaguugg

SEQ ID NO: 418232 - RNA, 23 nt, Human
ccagccucugggucuucauccag

SEQ ID NO: 418233 - RNA, 22 nt, Human
gcagagcagcaaauggaaagga

SEQ ID NO: 418234 - RNA, 22 nt, Human
agccagagcagggaauuggaca

SEQ ID NO: 418235 - RNA, 22 nt, Human
augguacaaaauguauaaaguc

SEQ ID NO: 418236 - RNA, 23 nt, Human
ugcagagggacugaagccagcuu

SEQ ID NO: 418237 - RNA, 21 nt, Human
uucaaugaaaacaaagugagg

SEQ ID NO: 418238 - RNA, 22 nt, Human
augcaguagauaggcacuuuua

SEQ ID NO: 418239 - RNA, 22 nt, Human
caaggccacugcucagguuucc

SEQ ID NO: 418240 - RNA, 22 nt, Human
uugaaaggugcugugugcugau

SEQ ID NO: 418241 - RNA, 22 nt, Human
auccuugagccuuaucuuuugu

SEQ ID NO: 418242 - RNA, 22 nt, Human
ugauguucuguauaucauauag

SEQ ID NO: 418243 - RNA, 22 nt, Human
cuggccuuggaagggagcccgu

SEQ ID NO: 418244 - RNA, 22 nt, Human
aaagccagugguaugagagaaa

SEQ ID NO: 418245 - RNA, 22 nt, Human
uggucaggcugcucugcggcgu

SEQ ID NO: 418246 - RNA, 22 nt, Human
uacaaagugugcccaugcugag

SEQ ID NO: 418247 - RNA, 21 nt, Human
ggcacugagccagauggacuc

SEQ ID NO: 418248 - RNA, 22 nt, Human
ccugcugggccugagcaaugag

SEQ ID NO: 418249 - RNA, 19 nt, Human
uggcugggcgugccuccgu

SEQ ID NO: 418250 - RNA, 22 nt, Human
accaggcaguauggugcugcaa

SEQ ID NO: 418251 - RNA, 22 nt, Human
ccaggccucuggcugcuuaguc

SEQ ID NO: 418252 - RNA, 22 nt, Human
uucaacacaggaacaugauaua

SEQ ID NO: 418253 - RNA, 22 nt, Human
ucccagacaaucauuggccacc

SEQ ID NO: 418254 - RNA, 22 nt, Human
acuugguugaugucauaagguu

SEQ ID NO: 418255 - RNA, 22 nt, Human
uuugaaaggaauuaggaugaca

SEQ ID NO: 418256 - RNA, 22 nt, Human
acaugggaucaaugaggcaggc

SEQ ID NO: 418257 - RNA, 22 nt, Human
gcagggugauagugaggcucag

SEQ ID NO: 418258 - RNA, 22 nt, Human
ggcuccugaaagacuaugggaa

SEQ ID NO: 418259 - RNA, 19 nt, Human
gccaggagggcucuggcug

SEQ ID NO: 418260 - RNA, 22 nt, Human
uuggaugaagucuagcuuuagu

SEQ ID NO: 418261 - RNA, 22 nt, Human
uccauccauguaggaagauggu

SEQ ID NO: 418262 - RNA, 22 nt, Human
gucauuucuguuucuucagugc

SEQ ID NO: 418263 - RNA, 22 nt, Human
ucugccugcaguguggcagggc

SEQ ID NO: 418264 - RNA, 22 nt, Human
cucaggauggaagccuacagga

SEQ ID NO: 418265 - RNA, 22 nt, Human
uuuguuagagugugggaggcug

SEQ ID NO: 418266 - RNA, 22 nt, Human
uucuuaaagaggcaaaacacag

SEQ ID NO: 418267 - RNA, 22 nt, Human
uccucagggcggccuccgucuu

SEQ ID NO: 418268 - RNA, 22 nt, Human
cggcagggcuccaugcauuucu

SEQ ID NO: 418269 - RNA, 22 nt, Human
aguuuauagcccagauucaugg

SEQ ID NO: 418270 - RNA, 22 nt, Human
ggcugcugguagggguaggaag

SEQ ID NO: 418271 - RNA, 22 nt, Human
gugccugugccaggggugugcu

SEQ ID NO: 418272 - RNA, 22 nt, Human
gagagcuguaauagucaugucu

SEQ ID NO: 418273 - RNA, 23 nt, Human
ucacacagcuggucagguacaga

SEQ ID NO: 418274 - RNA, 22 nt, Human
cucacagaugcugugggucagg

SEQ ID NO: 418275 - RNA, 22 nt, Human
cugccucugguuuuggucccug

SEQ ID NO: 418276 - RNA, 22 nt, Human
augccagucaaagaagaugaca

SEQ ID NO: 418277 - RNA, 22 nt, Human
agcuuccugaugcaagagggcu

SEQ ID NO: 418278 - RNA, 22 nt, Human
cagagcucagagcagggcacuc

SEQ ID NO: 418279 - RNA, 22 nt, Human
gucacacucagaaugacuagag

SEQ ID NO: 418280 - RNA, 23 nt, Human
ucagaaugcacugaauuuacccu

SEQ ID NO: 418281 - RNA, 22 nt, Human
agggcccuaaggaaggcacaca

SEQ ID NO: 418282 - RNA, 22 nt, Human
ucuuuugugauucuucaguuac

SEQ ID NO: 418283 - RNA, 22 nt, Human
uaauuuaauccaaguguuacau

SEQ ID NO: 418284 - RNA, 22 nt, Human
gagcccagguucugcuuccagc

SEQ ID NO: 418285 - RNA, 23 nt, Human
gugugccaagcacugugccagga

SEQ ID NO: 418286 - RNA, 23 nt, Human
acagagaucuugacuuguaugga

SEQ ID NO: 418287 - RNA, 22 nt, Human
cuggcagcccaaccuagagucu

SEQ ID NO: 418288 - RNA, 22 nt, Human
ccagccaguccagcauuggugu

SEQ ID NO: 418289 - RNA, 20 nt, Human
uucugcuugcaaauaucaag

SEQ ID NO: 418290 - RNA, 22 nt, Human
agauggagaaugacaauuaagg

SEQ ID NO: 418291 - RNA, 22 nt, Human
uacaguagaauuuuuaguaacu

SEQ ID NO: 418292 - RNA, 22 nt, Human
uggccugaauuauggcagaucu

SEQ ID NO: 418293 - RNA, 22 nt, Human
gcaggccuccccugcuggagcu

SEQ ID NO: 418294 - RNA, 22 nt, Human
gcagcuggagccagccagacac

SEQ ID NO: 418295 - RNA, 22 nt, Human
accugccuaucagcugccugcu

SEQ ID NO: 418296 - RNA, 22 nt, Human
caguguggagggagagagccug

SEQ ID NO: 418297 - RNA, 22 nt, Human
cuggcuucugggccagggcaga

SEQ ID NO: 418298 - RNA, 22 nt, Human
ccccuuccaggaagcagaaucg

SEQ ID NO: 418299 - RNA, 22 nt, Human
uucaggaucaaguugccaguag

SEQ ID NO: 418300 - RNA, 22 nt, Human
ucuguccuguuuccuccugaca

SEQ ID NO: 418301 - RNA, 19 nt, Human
agguggucuaggcuggaga

SEQ ID NO: 418302 - RNA, 22 nt, Human
gagaaagauguaggcugggagg

SEQ ID NO: 418303 - RNA, 22 nt, Human
ucccccacucuaaaggagccuu

SEQ ID NO: 418304 - RNA, 22 nt, Human
aggaccagaggccagagucagc

SEQ ID NO: 418305 - RNA, 22 nt, Human
agcaccugcacaguggaggaaa

SEQ ID NO: 418306 - RNA, 20 nt, Human
ggguggaguugcggucugug

SEQ ID NO: 418307 - RNA, 22 nt, Human
cuagggacagaaagaggguaga

SEQ ID NO: 418308 - RNA, 21 nt, Human
gcugucucuggcuccugggaa

SEQ ID NO: 418309 - RNA, 22 nt, Human
ggcagagcugcaugagcacuca

SEQ ID NO: 418310 - RNA, 22 nt, Human
ugggccugggucuuugcugcca

SEQ ID NO: 418311 - RNA, 22 nt, Human
ggcuccuguccuccuggagcuc

SEQ ID NO: 418312 - RNA, 22 nt, Human
gagggccaacuagcaccacuuu

SEQ ID NO: 418313 - RNA, 22 nt, Human
uuagccauuaaauuacaaggug

SEQ ID NO: 418314 - RNA, 20 nt, Human
cccugcagccaugggagugg

SEQ ID NO: 418315 - RNA, 22 nt, Human
gcugagguggagauugcaguga

SEQ ID NO: 418316 - RNA, 22 nt, Human
ugugucccuuggaaccucagcu

SEQ ID NO: 418317 - RNA, 22 nt, Human
augggguggaguccgggcagcg

SEQ ID NO: 418318 - RNA, 22 nt, Human
uggcccugcuggccaaaggcua

SEQ ID NO: 418319 - RNA, 22 nt, Human
uugauaaaaugauaucuucuuu

SEQ ID NO: 418320 - RNA, 22 nt, Human
caggagcaugcugaugccagaa

SEQ ID NO: 418321 - RNA, 22 nt, Human
ucaggcagagcuguggagcucu

SEQ ID NO: 418322 - RNA, 19 nt, Human
ugucuuaauuaacucagag

SEQ ID NO: 418323 - RNA, 16 nt, Human
agcagccagcacugga

SEQ ID NO: 418324 - RNA, 22 nt, Human
auuguuaugaaaauaagauguu

SEQ ID NO: 418325 - RNA, 22 nt, Human
ugucacaaacauacauuauaga

SEQ ID NO: 418326 - RNA, 23 nt, Human
cccagcgcugagcccugcaggca

SEQ ID NO: 418327 - RNA, 22 nt, Human
uagcagcucugauucugggccc

SEQ ID NO: 418328 - RNA, 22 nt, Human
cccagggagguagcaggagaaa

SEQ ID NO: 418329 - RNA, 22 nt, Human
aagcaauauacugauaugauua

SEQ ID NO: 418330 - RNA, 22 nt, Human
uccuggagccacggagcuuuca

SEQ ID NO: 418331 - RNA, 22 nt, Human
uaggcaggugugcacugcccac

SEQ ID NO: 418332 - RNA, 22 nt, Human
cacauacaaugguguuauuugg

SEQ ID NO: 418333 - RNA, 22 nt, Human
uaggagcuaaaauauuuuauau

SEQ ID NO: 418334 - RNA, 22 nt, Human
uugggcugaaguagagggcaga

SEQ ID NO: 418335 - RNA, 19 nt, Human
gcugugugaccuugggcaa

SEQ ID NO: 418336 - RNA, 22 nt, Human
gcugccuguugaagggucugug

SEQ ID NO: 418337 - RNA, 22 nt, Human
ccuguggcucucuuuggagguc

SEQ ID NO: 418338 - RNA, 22 nt, Human
gagcccuggcagucugggaugg

SEQ ID NO: 418339 - RNA, 22 nt, Human
ucccaaggccaggcaucuagaa

SEQ ID NO: 418340 - RNA, 22 nt, Human
agcucuccacacauaggacuag

SEQ ID NO: 418341 - RNA, 21 nt, Human
guggcccugccgcagugucca

SEQ ID NO: 418342 - RNA, 22 nt, Human
gaggugagaagggggucagaug

SEQ ID NO: 418343 - RNA, 22 nt, Human
cacugaaucucaaggggagggu

SEQ ID NO: 418344 - RNA, 22 nt, Human
aauuucaagucuugaagaagua

SEQ ID NO: 418345 - RNA, 22 nt, Human
gugauuccuauuaguacaugca

SEQ ID NO: 418346 - RNA, 22 nt, Human
ccaggcagagugcuccagaaag

SEQ ID NO: 418347 - RNA, 22 nt, Human
agaagaaacugucggggauauu

SEQ ID NO: 418348 - RNA, 22 nt, Human
acuucaaacaauuaacagagaa

SEQ ID NO: 418349 - RNA, 22 nt, Human
cccaggcaguagaaagaagagg

SEQ ID NO: 418350 - RNA, 22 nt, Human
acagagauggcacagagaaggu

SEQ ID NO: 418351 - RNA, 22 nt, Human
cucaggagagucuuauaucucc

SEQ ID NO: 418352 - RNA, 17 nt, Human
gagaguguauuggaugc

SEQ ID NO: 418353 - RNA, 19 nt, Human
gggaugggcccucacccuc

SEQ ID NO: 418354 - RNA, 22 nt, Human
ggguuucaugguucucacaaug

SEQ ID NO: 418355 - RNA, 23 nt, Human
uggcucuguggaucccucaggag

SEQ ID NO: 418356 - RNA, 22 nt, Human
ucaaggaggugcuuggcuucac

SEQ ID NO: 418357 - RNA, 22 nt, Human
cucaggagguuuccugucuagg

SEQ ID NO: 418358 - RNA, 22 nt, Human
ccagagggccuuuggaguuauc

SEQ ID NO: 418359 - RNA, 22 nt, Human
ggucccaguugcccaggucagg

SEQ ID NO: 418360 - RNA, 22 nt, Human
agaauaauacugaaaugcugaa

SEQ ID NO: 418361 - RNA, 22 nt, Human
gccagguggagguugcagugag

SEQ ID NO: 418362 - RNA, 21 nt, Human
ucagggcagcugcucuucaga

SEQ ID NO: 418363 - RNA, 22 nt, Human
aguauuucuaguugguucuacu

SEQ ID NO: 418364 - RNA, 23 nt, Human
cuuuuaacuugaucugagaccag

SEQ ID NO: 418365 - RNA, 22 nt, Human
aggcuggagggcaauggcaaga

SEQ ID NO: 418366 - RNA, 19 nt, Human
ccucugccagcccgccucu

SEQ ID NO: 418367 - RNA, 22 nt, Human
uucagagagaaaccagugggaa

SEQ ID NO: 418368 - RNA, 22 nt, Human
guuugucuuaauuaggcaucga

SEQ ID NO: 418369 - RNA, 22 nt, Human
uggcagagucaucacaucugga

SEQ ID NO: 418370 - RNA, 22 nt, Human
gcugcucugaaaaugacuguug

SEQ ID NO: 418371 - RNA, 22 nt, Human
aauguuguuuuucugcaugucu

SEQ ID NO: 418372 - RNA, 17 nt, Human
cccagcuggcagugccg

SEQ ID NO: 418373 - RNA, 22 nt, Human
gaaagagaaccugggccuagau

SEQ ID NO: 418374 - RNA, 22 nt, Human
cagucaccaccagguggcagua

SEQ ID NO: 418375 - RNA, 22 nt, Human
uugacaaaggaccuugcuauuu

SEQ ID NO: 418376 - RNA, 22 nt, Human
ugccugggaaccaauccuggcu

SEQ ID NO: 418377 - RNA, 17 nt, Human
aaguccagccugcagcu

SEQ ID NO: 418378 - RNA, 22 nt, Human
augagcugggccauccagugau

SEQ ID NO: 418379 - RNA, 22 nt, Human
agggagaagguuuagcugugag

SEQ ID NO: 418380 - RNA, 22 nt, Human
uguuuguucccucucuuuccug

SEQ ID NO: 418381 - RNA, 22 nt, Human
caauauucaguggaaaagccau

SEQ ID NO: 418382 - RNA, 22 nt, Human
gcugagccccccugcguggguc

SEQ ID NO: 418383 - RNA, 22 nt, Human
gucucccaucguuugugaggaa

SEQ ID NO: 418384 - RNA, 21 nt, Human
uggcucuggguaggagagugc

SEQ ID NO: 418385 - RNA, 22 nt, Human
ugccaggcuguccugggccugg

SEQ ID NO: 418386 - RNA, 22 nt, Human
agccugccuugggcugcuugag

SEQ ID NO: 418387 - RNA, 22 nt, Human
cuggcagcauuaacagagagca

SEQ ID NO: 418388 - RNA, 22 nt, Human
aacaggcaggagaauucugccu

SEQ ID NO: 418389 - RNA, 22 nt, Human
uccugcaggccuguucccagua

SEQ ID NO: 418390 - RNA, 22 nt, Human
agaggagugggaagcagugcaa

SEQ ID NO: 418391 - RNA, 22 nt, Human
uuucaauguaugucuuucugag

SEQ ID NO: 418392 - RNA, 22 nt, Human
ccaguccagugccaugcauggc

SEQ ID NO: 418393 - RNA, 22 nt, Human
cucaacagcucugccauacucc

SEQ ID NO: 418394 - RNA, 22 nt, Human
agggcugacacaccuuauccuc

SEQ ID NO: 418395 - RNA, 22 nt, Human
auagugggaauuacgauauacu

SEQ ID NO: 418396 - RNA, 22 nt, Human
uggcuccuaggauggugccugg

SEQ ID NO: 418397 - RNA, 22 nt, Human
cagugccaugucugagccccua

SEQ ID NO: 418398 - RNA, 22 nt, Human
gcuggcagucccaucagcuggg

SEQ ID NO: 418399 - RNA, 22 nt, Human
agccagcaugaagacagaggcc

SEQ ID NO: 418400 - RNA, 22 nt, Human
ccagagaguaaacauuuuccgg

SEQ ID NO: 418401 - RNA, 22 nt, Human
cagagccaaaugcugugguuau

SEQ ID NO: 418402 - RNA, 22 nt, Human
uuccauauuuguguggcaaaag

SEQ ID NO: 418403 - RNA, 22 nt, Human
gccaccagggggcuccagugag

SEQ ID NO: 418404 - RNA, 22 nt, Human
guucacaagaguuacagacaga

SEQ ID NO: 418405 - RNA, 17 nt, Human
agcagcuggguugaucu

SEQ ID NO: 418406 - RNA, 22 nt, Human
gcaggcagucaucuuucauauu

SEQ ID NO: 418407 - RNA, 22 nt, Human
uguaucaaggguuuauguaagc

SEQ ID NO: 418408 - RNA, 22 nt, Human
cagucucugugccagauccugg

SEQ ID NO: 418409 - RNA, 22 nt, Human
uagggcugugucuccaggacca

SEQ ID NO: 418410 - RNA, 22 nt, Human
cccagcuccuuacagggccgaa

SEQ ID NO: 418411 - RNA, 22 nt, Human
cugcugggcagaggcugcauga

SEQ ID NO: 418412 - RNA, 22 nt, Human
uucuuucucaacaugaauguuu

SEQ ID NO: 418413 - RNA, 18 nt, Human
caugucugcgccacaagg

SEQ ID NO: 418414 - RNA, 22 nt, Human
uggcucuguucgccaucaggag

SEQ ID NO: 418415 - RNA, 22 nt, Human
uugcacagaugagggugaugcu

SEQ ID NO: 418416 - RNA, 22 nt, Human
caggcagcugaggacuuugcua

SEQ ID NO: 418417 - RNA, 22 nt, Human
aacagcuuugcuucuggagaca

SEQ ID NO: 418418 - RNA, 22 nt, Human
uccaggcugauccaugaagaau

SEQ ID NO: 418419 - RNA, 22 nt, Human
acugucacuccaacugagucgu

SEQ ID NO: 418420 - RNA, 21 nt, Human
aggggacagaguagcuccagg

SEQ ID NO: 418421 - RNA, 22 nt, Human
uaccauuucauucuuuccucau

SEQ ID NO: 418422 - RNA, 22 nt, Human
guggcagguuauaagcaucuca

SEQ ID NO: 418423 - RNA, 22 nt, Human
gcugccuggaauaacggcuggc

SEQ ID NO: 418424 - RNA, 22 nt, Human
aggguggggugcuacaucuuua

SEQ ID NO: 418425 - RNA, 22 nt, Human
ucuggcuccaggaccgggcaca

SEQ ID NO: 418426 - RNA, 22 nt, Human
agugggggccaacgagggcagc

SEQ ID NO: 418427 - RNA, 22 nt, Human
ugcagaggagcuggaaggcugg

SEQ ID NO: 418428 - RNA, 22 nt, Human
acccugagucagacagccugac

SEQ ID NO: 418429 - RNA, 22 nt, Human
auaaggaaugauguaucaguuu

SEQ ID NO: 418430 - RNA, 22 nt, Human
guguccucuuauugcucuuggc

SEQ ID NO: 418431 - RNA, 22 nt, Human
aaggaagacacagaugaaguga

SEQ ID NO: 418432 - RNA, 22 nt, Human
uuguuacaucuuauguaagugg

SEQ ID NO: 418433 - RNA, 18 nt, Human
agggucagugucacuggc

SEQ ID NO: 418434 - RNA, 22 nt, Human
ggcagcaacucggagagaagag

SEQ ID NO: 418435 - RNA, 22 nt, Human
auauuucuccaaauguuuucaa

SEQ ID NO: 418436 - RNA, 17 nt, Human
ggcagcugccacuuuuu

SEQ ID NO: 418437 - RNA, 22 nt, Human
agaauuuuugauuaucuacucg

SEQ ID NO: 418438 - RNA, 22 nt, Human
cagagccugcucacgucucugu

SEQ ID NO: 418439 - RNA, 22 nt, Human
cagcuggcuggucagugcacaa

SEQ ID NO: 418440 - RNA, 22 nt, Human
gagagugaggcaucaggggcag

SEQ ID NO: 418441 - RNA, 22 nt, Human
cacacaugucucuccaugcucu

SEQ ID NO: 418442 - RNA, 22 nt, Human
agcagcaggcuguguggacuga

SEQ ID NO: 418443 - RNA, 19 nt, Human
ucaaagcaagcauguucug

SEQ ID NO: 418444 - RNA, 21 nt, Human
ugucagcaacaauacuuucuc

SEQ ID NO: 418445 - RNA, 22 nt, Human
cucuggaaaaccacuagcagga

SEQ ID NO: 418446 - RNA, 22 nt, Human
ucucuuuuauguacacccugac

SEQ ID NO: 418447 - RNA, 22 nt, Human
ccugccuggagcugagugugga

SEQ ID NO: 418448 - RNA, 20 nt, Human
cauuuguuagcuuucuacug

SEQ ID NO: 418449 - RNA, 22 nt, Human
cccucugcaggcuggaccugcc

SEQ ID NO: 418450 - RNA, 22 nt, Human
ggaugcugacuuuggagcaugg

SEQ ID NO: 418451 - RNA, 22 nt, Human
ccagguggcuucugcccgaugu

SEQ ID NO: 418452 - RNA, 22 nt, Human
gggcagaggggcgcuucccucu

SEQ ID NO: 418453 - RNA, 22 nt, Human
aggacuccauguguccuggaga

SEQ ID NO: 418454 - RNA, 22 nt, Human
gcagggcagugugucugugggg

SEQ ID NO: 418455 - RNA, 22 nt, Human
aguggugcugcgcgcggagcuc

SEQ ID NO: 418456 - RNA, 22 nt, Human
cccacagguccccaugaacucg

SEQ ID NO: 418457 - RNA, 22 nt, Human
gaggaugugucuggucugggca

SEQ ID NO: 418458 - RNA, 22 nt, Human
aagacagagggaagcaaugaug

SEQ ID NO: 418459 - RNA, 22 nt, Human
uaguggaggggaugcaaagcuu

SEQ ID NO: 418460 - RNA, 22 nt, Human
cuagggaccucagcuccuggag

SEQ ID NO: 418461 - RNA, 22 nt, Human
cccagcuugcccaggacugagg

SEQ ID NO: 418462 - RNA, 22 nt, Human
ucagagcuaaggggagagcaaa

SEQ ID NO: 418463 - RNA, 22 nt, Human
agagugaucagauaucaggugu

SEQ ID NO: 418464 - RNA, 22 nt, Human
gccaggcuccccggaucccugg

SEQ ID NO: 418465 - RNA, 22 nt, Human
cuguccugcaguugggggcagg

SEQ ID NO: 418466 - RNA, 22 nt, Human
cgccucagccguggucaucuuc

SEQ ID NO: 418467 - RNA, 22 nt, Human
auagacauauggcuuuguuucu

SEQ ID NO: 418468 - RNA, 22 nt, Human
ggccugcacagagguggcucua

SEQ ID NO: 418469 - RNA, 20 nt, Human
aggcacuggggauagguaag

SEQ ID NO: 418470 - RNA, 22 nt, Human
uuguguccugauuugacacaau

SEQ ID NO: 418471 - RNA, 22 nt, Human
acccagaggcggagguugcagu

SEQ ID NO: 418472 - RNA, 22 nt, Human
gugucccacucuggaggugaag

SEQ ID NO: 418473 - RNA, 22 nt, Human
ugugucaauuuucauuccuacu

SEQ ID NO: 418474 - RNA, 22 nt, Human
cagcuuugcaggcuggucagug

SEQ ID NO: 418475 - RNA, 22 nt, Human
ggucccaggaaucuguguucua

SEQ ID NO: 418476 - RNA, 22 nt, Human
aaagccaguucuuagagaaagc

SEQ ID NO: 418477 - RNA, 22 nt, Human
acagccauagaugcuuauguaa

SEQ ID NO: 418478 - RNA, 22 nt, Human
agguagaggccuccaggcagca

SEQ ID NO: 418479 - RNA, 22 nt, Human
acauucuagaagucuuugcaau

SEQ ID NO: 418480 - RNA, 22 nt, Human
agaagccagaauauucauggau

SEQ ID NO: 418481 - RNA, 22 nt, Human
ugcuuuauguggcugauacuca

SEQ ID NO: 418482 - RNA, 22 nt, Human
acuuucuuaggcuguauaaaug

SEQ ID NO: 418483 - RNA, 22 nt, Human
caggaacaauguaagucucauu

SEQ ID NO: 418484 - RNA, 22 nt, Human
auaccuguguauccacaagcgu

SEQ ID NO: 418485 - RNA, 22 nt, Human
aaguaacaaugcuguugaauug

SEQ ID NO: 418486 - RNA, 18 nt, Human
uggguggcuagggaguuu

SEQ ID NO: 418487 - RNA, 22 nt, Human
acaauguaggauauguacuugu

SEQ ID NO: 418488 - RNA, 22 nt, Human
ugggggagauuagagcuucuua

SEQ ID NO: 418489 - RNA, 22 nt, Human
aacuguaaggcuuagaacagca

SEQ ID NO: 418490 - RNA, 22 nt, Human
ggcagccaugcacgcugccugg

SEQ ID NO: 418491 - RNA, 22 nt, Human
cagcucugugcaggccugggga

SEQ ID NO: 418492 - RNA, 22 nt, Human
aggcugcucugcgaagucagcu

SEQ ID NO: 418493 - RNA, 22 nt, Human
cggcugugucuucacaggagcc

SEQ ID NO: 418494 - RNA, 22 nt, Human
auguuacacauaggcauaaaug

SEQ ID NO: 418495 - RNA, 22 nt, Human
uuuacacauaccucuuuaaagu

SEQ ID NO: 418496 - RNA, 22 nt, Human
agggcaguucaacuucauagug

SEQ ID NO: 418497 - RNA, 22 nt, Human
gcucccugcagcugagaguucc

SEQ ID NO: 418498 - RNA, 22 nt, Human
cugcccugagucaugccagaug

SEQ ID NO: 418499 - RNA, 22 nt, Human
aucagcaaucucguguauuagg

SEQ ID NO: 418500 - RNA, 23 nt, Human
ugagcugguauuguccaucucca

SEQ ID NO: 418501 - RNA, 22 nt, Human
ccagucugaggccuggugaggg

SEQ ID NO: 418502 - RNA, 22 nt, Human
agcuggcccucgagagccaauu

SEQ ID NO: 418503 - RNA, 22 nt, Human
caagggugguauugggagcaua

SEQ ID NO: 418504 - RNA, 22 nt, Human
uaaugcacagaauugacauggg

SEQ ID NO: 418505 - RNA, 22 nt, Human
cuggccugaggucggcuguagg

SEQ ID NO: 418506 - RNA, 22 nt, Human
agccaaagaucagugugcaagu

SEQ ID NO: 418507 - RNA, 22 nt, Human
ugccuggguccaggccaagccu

SEQ ID NO: 418508 - RNA, 22 nt, Human
ugcagaaggccugacauugcac

SEQ ID NO: 418509 - RNA, 22 nt, Human
ucagggcaggacaguguaggcc

SEQ ID NO: 418510 - RNA, 22 nt, Human
cuucugcaauaaguuuuggucc

SEQ ID NO: 418511 - RNA, 22 nt, Human
uauugaaauucuucauguccuc

SEQ ID NO: 418512 - RNA, 22 nt, Human
guuucaaagcacagcucacauu

SEQ ID NO: 418513 - RNA, 22 nt, Human
cauaauaucuccgauuacuugc

SEQ ID NO: 418514 - RNA, 19 nt, Human
uagaaugcccacuuaaaaa

SEQ ID NO: 418515 - RNA, 22 nt, Human
agaggcugaaugaugucaucau

SEQ ID NO: 418516 - RNA, 21 nt, Human
aaaggccauaaucacggagca

SEQ ID NO: 418517 - RNA, 22 nt, Human
agccucucuccagcuuggcaga

SEQ ID NO: 418518 - RNA, 22 nt, Human
auacauacguacauacguaugu

SEQ ID NO: 418519 - RNA, 22 nt, Human
ucucaugugauucccgugcaug

SEQ ID NO: 418520 - RNA, 20 nt, Human
ucacauccucucccaacaug

SEQ ID NO: 418521 - RNA, 22 nt, Human
uccugcagcucugagaagcauc

SEQ ID NO: 418522 - RNA, 22 nt, Human
uguuugcucugacuaucuugcg

SEQ ID NO: 418523 - RNA, 22 nt, Human
ugcauuucagaagaaaauucgg

SEQ ID NO: 418524 - RNA, 22 nt, Human
aggcacaguuucauccccgggc

SEQ ID NO: 418525 - RNA, 22 nt, Human
uaggccaggacagagcuuccag

SEQ ID NO: 418526 - RNA, 22 nt, Human
aggagccuccuucucaugugca

SEQ ID NO: 418527 - RNA, 22 nt, Human
cugggagcugucaggagcgugu

SEQ ID NO: 418528 - RNA, 22 nt, Human
cagcuguguaugagagcaugcu

SEQ ID NO: 418529 - RNA, 22 nt, Human
gcagagccuugcgucaugugcc

SEQ ID NO: 418530 - RNA, 22 nt, Human
cucugugcccuacugcucagcu

SEQ ID NO: 418531 - RNA, 22 nt, Human
ggacuucuaagugccagacacu

SEQ ID NO: 418532 - RNA, 22 nt, Human
aagaggaacugggggcugaguc

SEQ ID NO: 418533 - RNA, 22 nt, Human
ucaaagucucugcuucuguaac

SEQ ID NO: 418534 - RNA, 22 nt, Human
gggcacuguacacugugcaugg

SEQ ID NO: 418535 - RNA, 22 nt, Human
acagucuugcuguauggucagg

SEQ ID NO: 418536 - RNA, 22 nt, Human
caaggccacguucugcaugcgg

SEQ ID NO: 418537 - RNA, 22 nt, Human
gucccucugugucccugcaguc

SEQ ID NO: 418538 - RNA, 22 nt, Human
gugugggcugcagaggcacagc

SEQ ID NO: 418539 - RNA, 22 nt, Human
cacagcugcccuacuccaugug

SEQ ID NO: 418540 - RNA, 22 nt, Human
caggggcugugggcggagccuc

SEQ ID NO: 418541 - RNA, 22 nt, Human
uugauguacagaauuguucaca

SEQ ID NO: 418542 - RNA, 18 nt, Human
ccagcaugccagaggcug

SEQ ID NO: 418543 - RNA, 22 nt, Human
cugccuuggcccuaguucaugg

SEQ ID NO: 418544 - RNA, 20 nt, Human
auaauuuacccugcaccacu

SEQ ID NO: 418545 - RNA, 22 nt, Human
gcuuuaaaccucuacucugucc

SEQ ID NO: 418546 - RNA, 22 nt, Human
ggcugccuccugcugggcugga

SEQ ID NO: 418547 - RNA, 22 nt, Human
gagcuuuaagggcacuggucuu

SEQ ID NO: 418548 - RNA, 22 nt, Human
ucugggcuuuacacugugcuua

SEQ ID NO: 418549 - RNA, 22 nt, Human
aucuggcucacuuagucuagga

SEQ ID NO: 418550 - RNA, 22 nt, Human
gcagaggagcaagcuggacacc

SEQ ID NO: 418551 - RNA, 22 nt, Human
cucagccccaauucuccccauu

SEQ ID NO: 418552 - RNA, 22 nt, Human
cagcucugugggagcguaugug

SEQ ID NO: 418553 - RNA, 19 nt, Human
uggggccuccugucccugg

SEQ ID NO: 418554 - RNA, 21 nt, Human
gagugcagcaagguagagucu

SEQ ID NO: 418555 - RNA, 22 nt, Human
caguaaaagauggaaauagaau

SEQ ID NO: 418556 - RNA, 22 nt, Human
gaggggcucuuuaauaguaaca

SEQ ID NO: 418557 - RNA, 22 nt, Human
aggacccagaggcagaggacgu

SEQ ID NO: 418558 - RNA, 22 nt, Human
uccuugaagaaugauucuugga

SEQ ID NO: 418559 - RNA, 22 nt, Human
agagcagagggcucugggacaa

SEQ ID NO: 418560 - RNA, 22 nt, Human
acagagagcugugauugaguua

SEQ ID NO: 418561 - RNA, 22 nt, Human
agagccaguuacaacuguggag

SEQ ID NO: 418562 - RNA, 22 nt, Human
caaacuguucucugugggauuc

SEQ ID NO: 418563 - RNA, 22 nt, Human
auccuugagaaaauaaaugacc

SEQ ID NO: 418564 - RNA, 22 nt, Human
cagggcucgcucgcucgcucgc

SEQ ID NO: 418565 - RNA, 22 nt, Human
ugggcugagcacugaggaagga

SEQ ID NO: 418566 - RNA, 22 nt, Human
guccucagggaauguggcgggu

SEQ ID NO: 418567 - RNA, 19 nt, Human
gagcccucuccauggccac

SEQ ID NO: 418568 - RNA, 22 nt, Human
ugggaguguucuuggcuugcuu

SEQ ID NO: 418569 - RNA, 22 nt, Human
ugaaagguagcuggccucauag

SEQ ID NO: 418570 - RNA, 22 nt, Human
cccccuggcaggcuggccucuc

SEQ ID NO: 418571 - RNA, 22 nt, Human
agcaggaaguagucuguaagca

SEQ ID NO: 418572 - RNA, 21 nt, Human
ccagagccugcugagcccccu

SEQ ID NO: 418573 - RNA, 22 nt, Human
ggggcuguuuuuggaauggcug

SEQ ID NO: 418574 - RNA, 22 nt, Human
ggcugcucugccuuccagcugg

SEQ ID NO: 418575 - RNA, 22 nt, Human
ggccccugcggacugccuagag

SEQ ID NO: 418576 - RNA, 22 nt, Human
caguacuuauuucuauuuaggg

SEQ ID NO: 418577 - RNA, 22 nt, Human
cugagccagagggagucggguc

SEQ ID NO: 418578 - RNA, 22 nt, Human
cagcacaauuuucaggagucca

SEQ ID NO: 418579 - RNA, 22 nt, Human
auugaaagauauacuguucuca

SEQ ID NO: 418580 - RNA, 23 nt, Human
gggaccagcuagggcugugaccu

SEQ ID NO: 418581 - RNA, 22 nt, Human
caggcugcagcagcaguggccc

SEQ ID NO: 418582 - RNA, 22 nt, Human
uggaggaaguugcuggaaguca

SEQ ID NO: 418583 - RNA, 22 nt, Human
uggcugagagucauccugugug

SEQ ID NO: 418584 - RNA, 22 nt, Human
agagugggccucugagucccag

SEQ ID NO: 418585 - RNA, 22 nt, Human
cugagcuuggccaggaaugaau

SEQ ID NO: 418586 - RNA, 22 nt, Human
ucagcuuugggggucucaggag

SEQ ID NO: 418587 - RNA, 23 nt, Human
aggaaggagguccuaacaguauc

SEQ ID NO: 418588 - RNA, 22 nt, Human
agcaugaagacuucagagcuag

SEQ ID NO: 418589 - RNA, 22 nt, Human
gcacugcaucuacuggcaagua

SEQ ID NO: 418590 - RNA, 22 nt, Human
agggcucuguccccagaggccc

SEQ ID NO: 418591 - RNA, 22 nt, Human
cugagcagccccaccagccauu

SEQ ID NO: 418592 - RNA, 22 nt, Human
ucagagguaguagcagaguuga

SEQ ID NO: 418593 - RNA, 22 nt, Human
ugcucauuggcgaucugaggga

SEQ ID NO: 418594 - RNA, 22 nt, Human
gaacagcugcuagagaucugug

SEQ ID NO: 418595 - RNA, 22 nt, Human
ggaggacaggggcugcagcaca

SEQ ID NO: 418596 - RNA, 22 nt, Human
ucagagaugcagugccaccuac

SEQ ID NO: 418597 - RNA, 22 nt, Human
ccaggccuucugaggacacucu

SEQ ID NO: 418598 - RNA, 22 nt, Human
ggcacagggagccgcaguugca

SEQ ID NO: 418599 - RNA, 22 nt, Human
acugugcuuucucuggaggcau

SEQ ID NO: 418600 - RNA, 22 nt, Human
cagcagcuacuuggagcagcag

SEQ ID NO: 418601 - RNA, 22 nt, Human
cuuugaaaacuuaaauaacagc

SEQ ID NO: 418602 - RNA, 22 nt, Human
ggagccugagcggcccagggcc

SEQ ID NO: 418603 - RNA, 22 nt, Human
accaaggagaaggugcaagcuu

SEQ ID NO: 418604 - RNA, 22 nt, Human
ucagagucauugcaaguagaag

SEQ ID NO: 418605 - RNA, 22 nt, Human
uccuggccuugcuccugaugcc

SEQ ID NO: 418606 - RNA, 22 nt, Human
cugcugagguccuugcucagac

SEQ ID NO: 418607 - RNA, 23 nt, Human
gccaggcacaugguggacacgca

SEQ ID NO: 418608 - RNA, 22 nt, Human
ugcuggcugggcugcuggagac

SEQ ID NO: 418609 - RNA, 22 nt, Human
gccugaaguuucaugccucuau

SEQ ID NO: 418610 - RNA, 23 nt, Human
uggcuggcagaaacugaagcaug

SEQ ID NO: 418611 - RNA, 22 nt, Human
agguaagggucacaguucauau

SEQ ID NO: 418612 - RNA, 22 nt, Human
ugaaaucuacccuauucagggu

SEQ ID NO: 418613 - RNA, 22 nt, Human
gcuggccauggccugcgccauc

SEQ ID NO: 418614 - RNA, 22 nt, Human
ugaugaauaaacuugagaguca

SEQ ID NO: 418615 - RNA, 22 nt, Human
uuucucuaaauagggaggcuua

SEQ ID NO: 418616 - RNA, 22 nt, Human
gaaagacauaguugcaagaugg

SEQ ID NO: 418617 - RNA, 18 nt, Human
agcagaauucuaggguuc

SEQ ID NO: 418618 - RNA, 22 nt, Human
ggccugcucugcagccucuaca

SEQ ID NO: 418619 - RNA, 22 nt, Human
ugauucuauggaaggcauaagg

SEQ ID NO: 418620 - RNA, 22 nt, Human
acccagcaugacaccugcacau

SEQ ID NO: 418621 - RNA, 22 nt, Human
uuuggaaaguguacaaauuuga

SEQ ID NO: 418622 - RNA, 22 nt, Human
uaacacugguauuucauuuagu

SEQ ID NO: 418623 - RNA, 17 nt, Human
aggagucucagaugagc

SEQ ID NO: 418624 - RNA, 22 nt, Human
aagugggaauagaaaugaaggu

SEQ ID NO: 418625 - RNA, 22 nt, Human
gcuuggccagcagccgggaugc

SEQ ID NO: 418626 - RNA, 22 nt, Human
aaagaggaaccaagagcacgug

SEQ ID NO: 418627 - RNA, 22 nt, Human
uggccugauuuugcuaagagaa

SEQ ID NO: 418628 - RNA, 22 nt, Human
gucugaggaagaugcaggggga

SEQ ID NO: 418629 - RNA, 22 nt, Human
ucuggcucaucucuccagguaa

SEQ ID NO: 418630 - RNA, 22 nt, Human
guggaggguuugcaaugugcag

SEQ ID NO: 418631 - RNA, 22 nt, Human
auuuuuuagaaccuggccugau

SEQ ID NO: 418632 - RNA, 22 nt, Human
gaguguggugaacaggagcacc

SEQ ID NO: 418633 - RNA, 22 nt, Human
cugugcuggcagaccuggaguu

SEQ ID NO: 418634 - RNA, 22 nt, Human
accagaguaauguguggaaauu

SEQ ID NO: 418635 - RNA, 22 nt, Human
aaagaagggacagacugccucu

SEQ ID NO: 418636 - RNA, 22 nt, Human
auaauuaauuucaguaaucucc

SEQ ID NO: 418637 - RNA, 22 nt, Human
cugggagguggagguugcauug

SEQ ID NO: 418638 - RNA, 22 nt, Human
gcagcuuggugaaaggugaugg

SEQ ID NO: 418639 - RNA, 22 nt, Human
uggcacuggcgcaggauggcgg

SEQ ID NO: 418640 - RNA, 22 nt, Human
acuuuuuacaggguguauacca

SEQ ID NO: 418641 - RNA, 22 nt, Human
ucaacacuauccaggcaaucuu

SEQ ID NO: 418642 - RNA, 22 nt, Human
auacauguaacugcauuguaau

SEQ ID NO: 418643 - RNA, 22 nt, Human
agugacugacaccuguaauccc

SEQ ID NO: 418644 - RNA, 22 nt, Human
uuauguacaauguuaauguaaa

SEQ ID NO: 418645 - RNA, 22 nt, Human
cagcuuuaggacucauaauaaa

SEQ ID NO: 418646 - RNA, 22 nt, Human
cugucuguuucugauucaaccu

SEQ ID NO: 418647 - RNA, 22 nt, Human
acagcuuuguguuaaugggaag

SEQ ID NO: 418648 - RNA, 22 nt, Human
acaggcucucagccaguuggca

SEQ ID NO: 418649 - RNA, 22 nt, Human
ggggcagagucuggacuguugu

SEQ ID NO: 418650 - RNA, 22 nt, Human
acauguuagaaaugcagaaucu

SEQ ID NO: 418651 - RNA, 22 nt, Human
gcuuuuucaaaugaaagcuggu

SEQ ID NO: 418652 - RNA, 22 nt, Human
guccucaggaaggcuuucugac

SEQ ID NO: 418653 - RNA, 22 nt, Human
uccaugccaggcagucgaugca

SEQ ID NO: 418654 - RNA, 22 nt, Human
ucaggugggaccugcuaggaca

SEQ ID NO: 418655 - RNA, 22 nt, Human
ggacagaggguugacagaguau

SEQ ID NO: 418656 - RNA, 22 nt, Human
uugacaauugggagauauaaag

SEQ ID NO: 418657 - RNA, 22 nt, Human
cacugcccagcgucuuaggcac

SEQ ID NO: 418658 - RNA, 22 nt, Human
uggaaugacagagagucugaau

SEQ ID NO: 418659 - RNA, 22 nt, Human
cugcagggagaggggacagccu

SEQ ID NO: 418660 - RNA, 17 nt, Human
agaaagaggauccacag

SEQ ID NO: 418661 - RNA, 22 nt, Human
gccagacacuccccugggcagg

SEQ ID NO: 418662 - RNA, 22 nt, Human
gcaucuaaauaaacgugggagu

SEQ ID NO: 418663 - RNA, 22 nt, Human
gaggaguguauuccacaccacu

SEQ ID NO: 418664 - RNA, 22 nt, Human
ccagaagaccccguccaccucc

SEQ ID NO: 418665 - RNA, 22 nt, Human
uauuucuauuccccaggcaagu

SEQ ID NO: 418666 - RNA, 22 nt, Human
ucccagggacugggcuaggcuu

SEQ ID NO: 418667 - RNA, 22 nt, Human
ugcaggugguuuggacacugcu

SEQ ID NO: 418668 - RNA, 22 nt, Human
gaggcagcuuggggcugugggu

SEQ ID NO: 418669 - RNA, 22 nt, Human
agggaaaguaagcauuucauua

SEQ ID NO: 418670 - RNA, 22 nt, Human
ccaggaagccucagaugcugag

SEQ ID NO: 418671 - RNA, 22 nt, Human
guugaguggguuaggaugcuga

SEQ ID NO: 418672 - RNA, 22 nt, Human
cugggcuccuaaccauccaggu

SEQ ID NO: 418673 - RNA, 22 nt, Human
caugaaaaauuuacuguuaaca

SEQ ID NO: 418674 - RNA, 22 nt, Human
gcuggccugucuagagccuuac

SEQ ID NO: 418675 - RNA, 22 nt, Human
ucaggauaaaauguaauggcaa

SEQ ID NO: 418676 - RNA, 22 nt, Human
aagagccagcuagugaagaggc

SEQ ID NO: 418677 - RNA, 22 nt, Human
agggccucugacgcccccagcc

SEQ ID NO: 418678 - RNA, 22 nt, Human
uuucuuauacuauauugucauc

SEQ ID NO: 418679 - RNA, 22 nt, Human
aaagaugucauacacauuaaga

SEQ ID NO: 418680 - RNA, 20 nt, Human
aggcagacaaggagucuguu

SEQ ID NO: 418681 - RNA, 22 nt, Human
uacagagacuuuauggcacaaa

SEQ ID NO: 418682 - RNA, 22 nt, Human
ggggcuccagucuucacauuuu

SEQ ID NO: 418683 - RNA, 22 nt, Human
uggcucugaucagauguccagu

SEQ ID NO: 418684 - RNA, 22 nt, Human
gccagggaacccaagggccuca

SEQ ID NO: 418685 - RNA, 22 nt, Human
uggaagcaucacuucuugccug

SEQ ID NO: 418686 - RNA, 22 nt, Human
uggcugaaggaagauucuucua

SEQ ID NO: 418687 - RNA, 22 nt, Human
ucacuuuugaucccuaugcagu

SEQ ID NO: 418688 - RNA, 22 nt, Human
cucaccaggaacagcugcggag

SEQ ID NO: 418689 - RNA, 22 nt, Human
caaaguuaucaacugcaacauu

SEQ ID NO: 418690 - RNA, 22 nt, Human
auagaaauggcagcuggugcua

SEQ ID NO: 418691 - RNA, 22 nt, Human
uccuugaagcaacgugcagaca

SEQ ID NO: 418692 - RNA, 19 nt, Human
accugcaguaauaauuccu

SEQ ID NO: 418693 - RNA, 19 nt, Human
ucaucucacagggccuggc

SEQ ID NO: 418694 - RNA, 22 nt, Human
uggcccugcuguaucaucugcu

SEQ ID NO: 418695 - RNA, 22 nt, Human
gcaccugggguacacagcuaca

SEQ ID NO: 418696 - RNA, 22 nt, Human
agagcccucucauuggcuuauu

SEQ ID NO: 418697 - RNA, 22 nt, Human
gggacagcuguagugcuuggcu

SEQ ID NO: 418698 - RNA, 20 nt, Human
cccaggugucugaagcucug

SEQ ID NO: 418699 - RNA, 22 nt, Human
ucuuggagacucuuguauauuu

SEQ ID NO: 418700 - RNA, 22 nt, Human
gagagaggccuccauguacuga

SEQ ID NO: 418701 - RNA, 22 nt, Human
cuggugccuccucccugugcuu

SEQ ID NO: 418702 - RNA, 22 nt, Human
cagcuccuauuagacacugaau

SEQ ID NO: 418703 - RNA, 22 nt, Human
gcugugagcugccugugucaca

SEQ ID NO: 418704 - RNA, 22 nt, Human
ggucucaggagacuggagagca

SEQ ID NO: 418705 - RNA, 22 nt, Human
ggccccacgggggaguccuagu

SEQ ID NO: 418706 - RNA, 21 nt, Human
ugauuuccaucuuaaaauaaa

SEQ ID NO: 418707 - RNA, 22 nt, Human
auaugucgcuacaucauuagau

SEQ ID NO: 418708 - RNA, 22 nt, Human
ggaaagagcccagcagugcuug

SEQ ID NO: 418709 - RNA, 22 nt, Human
ccugccugucccucaguccaca

SEQ ID NO: 418710 - RNA, 22 nt, Human
guggccuggauagacuccaucu

SEQ ID NO: 418711 - RNA, 22 nt, Human
ugggccacaagccaugggacca

SEQ ID NO: 418712 - RNA, 20 nt, Human
agggucagagagcgugagug

SEQ ID NO: 418713 - RNA, 22 nt, Human
uuugcauuccugccugcauuca

SEQ ID NO: 418714 - RNA, 22 nt, Human
ucugaaaauguugacuuuguuu

SEQ ID NO: 418715 - RNA, 22 nt, Human
guguuuccucuagaagccaugg

SEQ ID NO: 418716 - RNA, 22 nt, Human
ucacuuaaaaauucuaguuaug

SEQ ID NO: 418717 - RNA, 19 nt, Human
ccugggaggcggagguugc

SEQ ID NO: 418718 - RNA, 21 nt, Human
gcaugccugcaucuuaguguu

SEQ ID NO: 418719 - RNA, 22 nt, Human
gccagcagggcccaaaugcugg

SEQ ID NO: 418720 - RNA, 22 nt, Human
agccuggagcuugaguuaugag

SEQ ID NO: 418721 - RNA, 22 nt, Human
ucugaggcuauguucaggcuaa

SEQ ID NO: 418722 - RNA, 22 nt, Human
aaagccacugcauguguaguau

SEQ ID NO: 418723 - RNA, 22 nt, Human
gauacaaauucaugucugaauu

SEQ ID NO: 418724 - RNA, 22 nt, Human
uuguacaaguauuaugugaaca

SEQ ID NO: 418725 - RNA, 22 nt, Human
cagcuucuucaguccuggagcu

SEQ ID NO: 418726 - RNA, 22 nt, Human
guugaaaguagaugcuauuugg

SEQ ID NO: 418727 - RNA, 22 nt, Human
ugcaucuguucagagcugucga

SEQ ID NO: 418728 - RNA, 22 nt, Human
ucaggcagcuccaggaauggua

SEQ ID NO: 418729 - RNA, 22 nt, Human
uucacaguggcugugccauuug

SEQ ID NO: 418730 - RNA, 22 nt, Human
ggggaccuuuccauuucugaga

SEQ ID NO: 418731 - RNA, 22 nt, Human
agugcauauaugaagaguauga

SEQ ID NO: 418732 - RNA, 22 nt, Human
ugggccuggaguuuguccagag

SEQ ID NO: 418733 - RNA, 22 nt, Human
gccagggcucgcggucccucgu

SEQ ID NO: 418734 - RNA, 22 nt, Human
ccaggccuguguuguguggagg

SEQ ID NO: 418735 - RNA, 22 nt, Human
ccugccugcagaaaguaucucc

SEQ ID NO: 418736 - RNA, 22 nt, Human
gcacacacaugugaguacaugc

SEQ ID NO: 418737 - RNA, 22 nt, Human
uucaagguaugguagcugguca

SEQ ID NO: 418738 - RNA, 22 nt, Human
ucuggcuuucauuuguuuaaag

SEQ ID NO: 418739 - RNA, 22 nt, Human
ugugccugucacccucagagag

SEQ ID NO: 418740 - RNA, 22 nt, Human
uggacagguugaguaggaggag

SEQ ID NO: 418741 - RNA, 22 nt, Human
gcuguauuccugcacuguauag

SEQ ID NO: 418742 - RNA, 22 nt, Human
gcuggcagccaagugaagaggg

SEQ ID NO: 418743 - RNA, 22 nt, Human
ucucccaggucauacacagaga

SEQ ID NO: 418744 - RNA, 22 nt, Human
gaaggcacugaacuccuucugg

SEQ ID NO: 418745 - RNA, 22 nt, Human
gagggcugauguugccaccuca

SEQ ID NO: 418746 - RNA, 22 nt, Human
gaacagcuucuugggagcuggg

SEQ ID NO: 418747 - RNA, 22 nt, Human
gugguaaucggauucuuaccgg

SEQ ID NO: 418748 - RNA, 22 nt, Human
aggccuggguguucaccagaag

SEQ ID NO: 418749 - RNA, 22 nt, Human
agugucauuccagggacccucg

SEQ ID NO: 418750 - RNA, 22 nt, Human
auaaggcagucacuggaauguu

SEQ ID NO: 418751 - RNA, 22 nt, Human
ggcugccagugagugcagaccg

SEQ ID NO: 418752 - RNA, 22 nt, Human
ucucugagcaugccauauugcu

SEQ ID NO: 418753 - RNA, 22 nt, Human
agcucccagcuccuuugagaga

SEQ ID NO: 418754 - RNA, 22 nt, Human
uggaccugcguaggugcugggc

SEQ ID NO: 418755 - RNA, 22 nt, Human
ggcaaaaaguucccaucagugu

SEQ ID NO: 418756 - RNA, 22 nt, Human
gcugucuugcucacucuugcag

SEQ ID NO: 418757 - RNA, 22 nt, Human
uugugucccccuuugagagcca

SEQ ID NO: 418758 - RNA, 21 nt, Human
ugaggcaggggugcuuuuguc

SEQ ID NO: 418759 - RNA, 22 nt, Human
ucacauaaauuauacaauuuca

SEQ ID NO: 418760 - RNA, 22 nt, Human
cugccacuuacuaggcauggug

SEQ ID NO: 418761 - RNA, 22 nt, Human
gucaggauuggggucaugaguc

SEQ ID NO: 418762 - RNA, 22 nt, Human
ucuguacaguaccagauaguaa

SEQ ID NO: 418763 - RNA, 22 nt, Human
gggaucagcaagccacugcacc

SEQ ID NO: 418764 - RNA, 22 nt, Human
uggagcugagagccaggcuggc

SEQ ID NO: 418765 - RNA, 23 nt, Human
ucagugauguugaaccuagcagu

SEQ ID NO: 418766 - RNA, 21 nt, Human
uuagcaaagcaaacacaugcu

SEQ ID NO: 418767 - RNA, 22 nt, Human
ugaggccugacagaccaagccu

SEQ ID NO: 418768 - RNA, 22 nt, Human
agccucaguuucaggccuccuc

SEQ ID NO: 418769 - RNA, 22 nt, Human
aaacacaccuuuggaacuguga

SEQ ID NO: 418770 - RNA, 22 nt, Human
cugcuccacaccuccauuuccu

SEQ ID NO: 418771 - RNA, 22 nt, Human
accagagcucuucagcacagga

SEQ ID NO: 418772 - RNA, 22 nt, Human
uccacuuuagcaaugauugaau

SEQ ID NO: 418773 - RNA, 22 nt, Human
aagccuuccugagugcaaggcc

SEQ ID NO: 418774 - RNA, 22 nt, Human
aagcagccuggacuugggcugg

SEQ ID NO: 418775 - RNA, 22 nt, Human
gcaggaguguauuugcauguaa

SEQ ID NO: 418776 - RNA, 22 nt, Human
gugccagcaguuauggugauuu

SEQ ID NO: 418777 - RNA, 22 nt, Human
agggugcagaaggagccuagga

SEQ ID NO: 418778 - RNA, 22 nt, Human
gagagcuguccggcugagcagc

SEQ ID NO: 418779 - RNA, 22 nt, Human
ugcauuguugaccaguugugca

SEQ ID NO: 418780 - RNA, 21 nt, Human
ggcagcacuaccugaagcaua

SEQ ID NO: 418781 - RNA, 21 nt, Human
ucuuugcaucaguuguuuucu

SEQ ID NO: 418782 - RNA, 22 nt, Human
gcuguacaucacaauuugcugu

SEQ ID NO: 418783 - RNA, 22 nt, Human
uacacuuuuuacuacagauucu

SEQ ID NO: 418784 - RNA, 22 nt, Human
gaugaggggucauuggcuggga

SEQ ID NO: 418785 - RNA, 22 nt, Human
uucaagauaauaggaaugaaaa

SEQ ID NO: 418786 - RNA, 22 nt, Human
agcuuuaucacaauauuggcua

SEQ ID NO: 418787 - RNA, 22 nt, Human
ucuaauccuugcuaccugggug

SEQ ID NO: 418788 - RNA, 22 nt, Human
gucucagaccacccucuuuggc

SEQ ID NO: 418789 - RNA, 22 nt, Human
uggaaggcaacggagugagcug

SEQ ID NO: 418790 - RNA, 22 nt, Human
gcccagcuuuuugaggcaggca

SEQ ID NO: 418791 - RNA, 22 nt, Human
agaauuagucacaauuauagga

SEQ ID NO: 418792 - RNA, 22 nt, Human
acuguacaaauauugcaaaaua

SEQ ID NO: 418793 - RNA, 22 nt, Human
aaauguguuucuuugugaaugg

SEQ ID NO: 418794 - RNA, 22 nt, Human
gccugggaagacuaagugggag

SEQ ID NO: 418795 - RNA, 22 nt, Human
cugccucaugcugccugcagcc

SEQ ID NO: 418796 - RNA, 22 nt, Human
aagggcugcauuugauguguca

SEQ ID NO: 418797 - RNA, 20 nt, Human
cguaaggcaagugcugcauc

SEQ ID NO: 418798 - RNA, 22 nt, Human
gcagcuggauuucaagagggag

SEQ ID NO: 418799 - RNA, 23 nt, Human
gggagccauggguggucauggag

SEQ ID NO: 418800 - RNA, 22 nt, Human
ccacccagccagaugcaggaag

SEQ ID NO: 418801 - RNA, 22 nt, Human
gcucaggaaggcucaaccagga

SEQ ID NO: 418802 - RNA, 22 nt, Human
agagcuguagcuuccuagagcc

SEQ ID NO: 418803 - RNA, 22 nt, Human
ugacaccacaacuagccauuga

SEQ ID NO: 418804 - RNA, 22 nt, Human
gacuguacuugagagaggaacu

SEQ ID NO: 418805 - RNA, 22 nt, Human
uggcucugugcuucuaguaucu

SEQ ID NO: 418806 - RNA, 18 nt, Human
cugaggcccagagagggc

SEQ ID NO: 418807 - RNA, 22 nt, Human
agagccagagaccuggguucac

SEQ ID NO: 418808 - RNA, 22 nt, Human
ugcuggggcucugaccacucca

SEQ ID NO: 418809 - RNA, 15 nt, Human
cagucccagggaccc

SEQ ID NO: 418810 - RNA, 22 nt, Human
ucuuuauuuaagucuguuguaa

SEQ ID NO: 418811 - RNA, 22 nt, Human
agcaauaacagaaaacuuuccu

SEQ ID NO: 418812 - RNA, 22 nt, Human
gcagggcaucccugagcgggug

SEQ ID NO: 418813 - RNA, 22 nt, Human
agagcugaauuuggguggugga

SEQ ID NO: 418814 - RNA, 22 nt, Human
aaaggccacacagagcagggag

SEQ ID NO: 418815 - RNA, 22 nt, Human
ccugaagcaaggguaggcaggu

SEQ ID NO: 418816 - RNA, 22 nt, Human
agugcugaagacuggcuaggga

SEQ ID NO: 418817 - RNA, 22 nt, Human
ucaggauguccaaaauccagcc

SEQ ID NO: 418818 - RNA, 22 nt, Human
agagacaggguuuugucguguu

SEQ ID NO: 418819 - RNA, 22 nt, Human
cucacuggcaagacuacaggug

SEQ ID NO: 418820 - RNA, 22 nt, Human
augggaggaucacuugaggcca

SEQ ID NO: 418821 - RNA, 22 nt, Human
ccagagaggggaagggcuugcc

SEQ ID NO: 418822 - RNA, 22 nt, Human
auauauuuacucuccuguugca

SEQ ID NO: 418823 - RNA, 22 nt, Human
ugaggccagugacauauauuaa

SEQ ID NO: 418824 - RNA, 22 nt, Human
cugccgagugggucaugaggca

SEQ ID NO: 418825 - RNA, 22 nt, Human
agggcuccuaugaugcucugcc

SEQ ID NO: 418826 - RNA, 22 nt, Human
agcugggccugagcuggaagcu

SEQ ID NO: 418827 - RNA, 22 nt, Human
ggugaagguggaacgcagagca

SEQ ID NO: 418828 - RNA, 22 nt, Human
cugagcagcaacccagagccuc

SEQ ID NO: 418829 - RNA, 22 nt, Human
acauuucucagggaguuuugcu

SEQ ID NO: 418830 - RNA, 22 nt, Human
agcagugaaacagcugcauaug

SEQ ID NO: 418831 - RNA, 22 nt, Human
agccaggcgggucuuugcuccu

SEQ ID NO: 418832 - RNA, 22 nt, Human
cuggagcagguuuaggaguccc

SEQ ID NO: 418833 - RNA, 22 nt, Human
agccagugcaacagcagugaag

SEQ ID NO: 418834 - RNA, 22 nt, Human
augcugugauuguagaaauauu

SEQ ID NO: 418835 - RNA, 20 nt, Human
acagcagauaccacaacuau

SEQ ID NO: 418836 - RNA, 19 nt, Human
ucucugcuucucuuggcau

SEQ ID NO: 418837 - RNA, 22 nt, Human
agggcaugugggagaggagccu

SEQ ID NO: 418838 - RNA, 20 nt, Human
cugagcugagcuccaugggu

SEQ ID NO: 418839 - RNA, 22 nt, Human
aagcuuuaagugucagucagcc

SEQ ID NO: 418840 - RNA, 22 nt, Human
aauaagaauuuacuugucaaga

SEQ ID NO: 418841 - RNA, 22 nt, Human
agcccucauggaacagcuccua

SEQ ID NO: 418842 - RNA, 22 nt, Human
aaggaggaauuucagggugaau

SEQ ID NO: 418843 - RNA, 22 nt, Human
cacaguccuacagagaucagag

SEQ ID NO: 418844 - RNA, 22 nt, Human
caaaugcagucccuuuguugcu

SEQ ID NO: 418845 - RNA, 22 nt, Human
ugaggccuggacucugcaugga

SEQ ID NO: 418846 - RNA, 22 nt, Human
cugccugugccaccgccucauu

SEQ ID NO: 418847 - RNA, 22 nt, Human
uagccgggugugguggaacucc

SEQ ID NO: 418848 - RNA, 22 nt, Human
ugacacauuaaaugcucacaaa

SEQ ID NO: 418849 - RNA, 20 nt, Human
cuguaucagguuacaaagua

SEQ ID NO: 418850 - RNA, 22 nt, Human
agagacuggagaugggcagugu

SEQ ID NO: 418851 - RNA, 22 nt, Human
ccugagcuggaagagcuugugc

SEQ ID NO: 418852 - RNA, 22 nt, Human
caggggcugagaaggaacgucc

SEQ ID NO: 418853 - RNA, 22 nt, Human
gcucucugccauaugaggauac

SEQ ID NO: 418854 - RNA, 22 nt, Human
auuguaauuuuagagaaagugg

SEQ ID NO: 418855 - RNA, 18 nt, Human
aggagccuuugcacugga

SEQ ID NO: 418856 - RNA, 22 nt, Human
uagaaaucauuuagaaguauug

SEQ ID NO: 418857 - RNA, 22 nt, Human
gaaaggagggaaacagagcggu

SEQ ID NO: 418858 - RNA, 22 nt, Human
aggcagccuauggggagcucag

SEQ ID NO: 418859 - RNA, 19 nt, Human
ucauaaggagagaggaaau

SEQ ID NO: 418860 - RNA, 22 nt, Human
gcauucaucuuccuccaugcag

SEQ ID NO: 418861 - RNA, 19 nt, Human
cucucacucgccacauccu

SEQ ID NO: 418862 - RNA, 22 nt, Human
agucacccuccaacucuccacu

SEQ ID NO: 418863 - RNA, 22 nt, Human
aagagcuggaugaagaaaucaa

SEQ ID NO: 418864 - RNA, 22 nt, Human
gggcugggaauggcuaaguaug

SEQ ID NO: 418865 - RNA, 22 nt, Human
gaggcauaaaucacaguguuca

SEQ ID NO: 418866 - RNA, 22 nt, Human
agcuggugcugaagcucuugag

SEQ ID NO: 418867 - RNA, 22 nt, Human
augcccgauaccuaguuaacuc

SEQ ID NO: 418868 - RNA, 22 nt, Human
ggucucagaucuuuauuaaggc

SEQ ID NO: 418869 - RNA, 22 nt, Human
aggcagccugguuugaauggaa

SEQ ID NO: 418870 - RNA, 22 nt, Human
acagcagccuuguugguuucga

SEQ ID NO: 418871 - RNA, 22 nt, Human
ugcugccacugguagucucauu

SEQ ID NO: 418872 - RNA, 22 nt, Human
gcugucccgaaccccugguaau

SEQ ID NO: 418873 - RNA, 20 nt, Human
auucuacaagaauaagcaug

SEQ ID NO: 418874 - RNA, 22 nt, Human
cugaggaguuuggguuguucaa

SEQ ID NO: 418875 - RNA, 22 nt, Human
auuagcugaccucuaaggagcc

SEQ ID NO: 418876 - RNA, 22 nt, Human
uagggacaaagagcugaggccu

SEQ ID NO: 418877 - RNA, 22 nt, Human
uggaugcuguaggacacgcucu

SEQ ID NO: 418878 - RNA, 19 nt, Human
ggcuccuguggcugcagcc

SEQ ID NO: 418879 - RNA, 22 nt, Human
guggcagcaaaauccugcauuc

SEQ ID NO: 418880 - RNA, 22 nt, Human
aguagaaagaaggcacugggcc

SEQ ID NO: 418881 - RNA, 22 nt, Human
ugcaaucucggcacuuugggag

SEQ ID NO: 418882 - RNA, 22 nt, Human
gacacauagaucuaucucacuc

SEQ ID NO: 418883 - RNA, 22 nt, Human
aaacauuguaauuuuagcaugg

SEQ ID NO: 418884 - RNA, 22 nt, Human
caggcagaguuagugauuuagg

SEQ ID NO: 418885 - RNA, 22 nt, Human
cucagcccagcccaggaccagg

SEQ ID NO: 418886 - RNA, 22 nt, Human
gcaaaaaaugcuuguugcuuag

SEQ ID NO: 418887 - RNA, 23 nt, Human
ugagaagccauuagagcaggugg

SEQ ID NO: 418888 - RNA, 22 nt, Human
aaaucagucccucuuggaauuu

SEQ ID NO: 418889 - RNA, 22 nt, Human
gagccuggccuccugccucagc

SEQ ID NO: 418890 - RNA, 22 nt, Human
ggcagcuggccuccucgcccac

SEQ ID NO: 418891 - RNA, 22 nt, Human
uccaggcaucccccaggacaga

SEQ ID NO: 418892 - RNA, 22 nt, Human
gcugccugggcaggaggcgcug

SEQ ID NO: 418893 - RNA, 22 nt, Human
ugaaugauacagaauuauguag

SEQ ID NO: 418894 - RNA, 22 nt, Human
aaagguuaagguguucaagaaa

SEQ ID NO: 418895 - RNA, 22 nt, Human
auccuugaacuuagacacuagg

SEQ ID NO: 418896 - RNA, 21 nt, Human
acagacagggccagugucccc

SEQ ID NO: 418897 - RNA, 22 nt, Human
ggcaggugugagaucgaggcca

SEQ ID NO: 418898 - RNA, 23 nt, Human
ccacagagcugccaauuccugug

SEQ ID NO: 418899 - RNA, 22 nt, Human
aaagcccauguggaaguacagg

SEQ ID NO: 418900 - RNA, 22 nt, Human
gggcacugcuggaggcucccug

SEQ ID NO: 418901 - RNA, 22 nt, Human
ugguccuggggaucugcaguga

SEQ ID NO: 418902 - RNA, 22 nt, Human
uugauuucuuacucuuccaagg

SEQ ID NO: 418903 - RNA, 22 nt, Human
cacugcauggaugauggcugua

SEQ ID NO: 418904 - RNA, 22 nt, Human
uacaguaaagcugcuaugaauu

SEQ ID NO: 418905 - RNA, 19 nt, Human
uccuccuuacuuccucuug

SEQ ID NO: 418906 - RNA, 22 nt, Human
gcugagagaaaagugagguucu

SEQ ID NO: 418907 - RNA, 22 nt, Human
ugagccugcugucgcuggaccc

SEQ ID NO: 418908 - RNA, 22 nt, Human
uggucgaccaguuggaaaguaa

SEQ ID NO: 418909 - RNA, 22 nt, Human
agucccagcccaguccuguaag

SEQ ID NO: 418910 - RNA, 22 nt, Human
ccagggcugagcugugaccaug

SEQ ID NO: 418911 - RNA, 23 nt, Human
uugcuucugugcaauucaguacu

SEQ ID NO: 418912 - RNA, 20 nt, Human
gaagccagaggggaaaggag

SEQ ID NO: 418913 - RNA, 22 nt, Human
acagagagaauuggguuuacag

SEQ ID NO: 418914 - RNA, 22 nt, Human
agaaaguucugugaguuguuca

SEQ ID NO: 418915 - RNA, 22 nt, Human
ucagaaugaaauuucuuucaga

SEQ ID NO: 418916 - RNA, 22 nt, Human
cagguacauucguagacccauu

SEQ ID NO: 418917 - RNA, 22 nt, Human
cuggcugguuacuauuucuggu

SEQ ID NO: 418918 - RNA, 22 nt, Human
aagaacaacugcuuuaaaagca

SEQ ID NO: 418919 - RNA, 22 nt, Human
uggcugcuuguuuuagugaggc

SEQ ID NO: 418920 - RNA, 22 nt, Human
ggcagcuccuccuagucugccc

SEQ ID NO: 418921 - RNA, 19 nt, Human
gucagcaccauggacaggg

SEQ ID NO: 418922 - RNA, 22 nt, Human
ugaggcuuagagaagaugggau

SEQ ID NO: 418923 - RNA, 22 nt, Human
agugugugcaugcauucgugca

SEQ ID NO: 418924 - RNA, 22 nt, Human
ggcucuggguucugcaaugcgu

SEQ ID NO: 418925 - RNA, 22 nt, Human
ccacagggcacagacaggaagc

SEQ ID NO: 418926 - RNA, 22 nt, Human
agucucugcugguugugccuau

SEQ ID NO: 418927 - RNA, 22 nt, Human
ucugcagaaguggcugggccac

SEQ ID NO: 418928 - RNA, 22 nt, Human
uaauccaggguauucuaguuuc

SEQ ID NO: 418929 - RNA, 22 nt, Human
caaaguuuggcucucaugacau

SEQ ID NO: 418930 - RNA, 22 nt, Human
gggcgccgugggaaacagccgg

SEQ ID NO: 418931 - RNA, 22 nt, Human
cagacccugggccacagaggag

SEQ ID NO: 418932 - RNA, 17 nt, Human
ggccuugggcugcucuu

SEQ ID NO: 418933 - RNA, 22 nt, Human
cauuuguauguuccuccuuagg

SEQ ID NO: 418934 - RNA, 22 nt, Human
auucuguauggaaaagcacuau

SEQ ID NO: 418935 - RNA, 22 nt, Human
ugcuguagcccugcacagugca

SEQ ID NO: 418936 - RNA, 22 nt, Human
acauuguauaaugauuaucaca

SEQ ID NO: 418937 - RNA, 22 nt, Human
cgccaggcuugguagcucaugc

SEQ ID NO: 418938 - RNA, 22 nt, Human
ucccagagauuuccucuccuuc

SEQ ID NO: 418939 - RNA, 22 nt, Human
cagcccuggccccagguggucu

SEQ ID NO: 418940 - RNA, 22 nt, Human
aggauccuguauggagaagcug

SEQ ID NO: 418941 - RNA, 22 nt, Human
gcuggcuguaucaccuggccag

SEQ ID NO: 418942 - RNA, 22 nt, Human
ggcucuggugugaagcagccuc

SEQ ID NO: 418943 - RNA, 22 nt, Human
gagagaagggggauaugagccu

SEQ ID NO: 418944 - RNA, 22 nt, Human
cagcccuuuccuucucagcuuu

SEQ ID NO: 418945 - RNA, 22 nt, Human
ccguggaguugugcugaguaug

SEQ ID NO: 418946 - RNA, 21 nt, Human
uccugcagaaugccuuccuac

SEQ ID NO: 418947 - RNA, 22 nt, Human
cuggcagcuuagcacucugguu

SEQ ID NO: 418948 - RNA, 22 nt, Human
augccaggaacaaacaguggug

SEQ ID NO: 418949 - RNA, 22 nt, Human
cauuauguucaguagcuuaaaa

SEQ ID NO: 418950 - RNA, 21 nt, Human
agcuuguguguaucacagugu

SEQ ID NO: 418951 - RNA, 22 nt, Human
aaggcacucauucaaggagaua

SEQ ID NO: 418952 - RNA, 23 nt, Human
cucccuggaguuucuggaagaug

SEQ ID NO: 418953 - RNA, 22 nt, Human
uagagcuguaucaaagagccuu

SEQ ID NO: 418954 - RNA, 22 nt, Human
ucccaggcuggcaggcagcagu

SEQ ID NO: 418955 - RNA, 22 nt, Human
uggagccagagcgcagccuggg

SEQ ID NO: 418956 - RNA, 22 nt, Human
cagagccauccaggugccuguu

SEQ ID NO: 418957 - RNA, 19 nt, Human
cuugguuaugguaugaugc

SEQ ID NO: 418958 - RNA, 22 nt, Human
acuuccuguuaugugugccucu

SEQ ID NO: 418959 - RNA, 22 nt, Human
cagcugaguuacucugaggucu

SEQ ID NO: 418960 - RNA, 22 nt, Human
ucagaaauacuaucagcuuuug

SEQ ID NO: 418961 - RNA, 22 nt, Human
gcauggcaaauaucgagggcag

SEQ ID NO: 418962 - RNA, 22 nt, Human
gcugagaguguaggauguuuac

SEQ ID NO: 418963 - RNA, 21 nt, Human
agcugccacccuagcuucuga

SEQ ID NO: 418964 - RNA, 22 nt, Human
ucagacaguuugcagugugccu

SEQ ID NO: 418965 - RNA, 18 nt, Human
gucuggaggucaggagcu

SEQ ID NO: 418966 - RNA, 18 nt, Human
cugaggcuggcaggagcc

SEQ ID NO: 418967 - RNA, 22 nt, Human
gaaggagaggauugugaggcug

SEQ ID NO: 418968 - RNA, 21 nt, Human
gagccuucccucugcccuuuc

SEQ ID NO: 418969 - RNA, 22 nt, Human
uccugcagcugcagaccugggg

SEQ ID NO: 418970 - RNA, 23 nt, Human
gggauauggaccuuggaggaguc

SEQ ID NO: 418971 - RNA, 22 nt, Human
aggcugagucaaguuaggguga

SEQ ID NO: 418972 - RNA, 22 nt, Human
caaauguguuuuuucuucuaca

SEQ ID NO: 418973 - RNA, 22 nt, Human
aauuagggagccaucauaaggu

SEQ ID NO: 418974 - RNA, 22 nt, Human
cuccacagccccuccaguggca

SEQ ID NO: 418975 - RNA, 22 nt, Human
ugguuuugcuccaguauaaaua

SEQ ID NO: 418976 - RNA, 22 nt, Human
aagcacagaaaaggagcaugga

SEQ ID NO: 418977 - RNA, 22 nt, Human
aaaugcuugcucuugauuauuu

SEQ ID NO: 418978 - RNA, 22 nt, Human
gggcugcacguauucugcucac

SEQ ID NO: 418979 - RNA, 23 nt, Human
aaaugcagggucgcagguuacag

SEQ ID NO: 418980 - RNA, 22 nt, Human
uggcugaacuaaugugcuguuu

SEQ ID NO: 418981 - RNA, 22 nt, Human
ugaugauguuuaucuugguauu

SEQ ID NO: 418982 - RNA, 22 nt, Human
guuuucaugucuauugggcaua

SEQ ID NO: 418983 - RNA, 22 nt, Human
ucagggcaaagggcagaguuug

SEQ ID NO: 418984 - RNA, 23 nt, Human
agcagugaguaaacagauaggau

SEQ ID NO: 418985 - RNA, 22 nt, Human
agucucaggcagaggaaggcua

SEQ ID NO: 418986 - RNA, 22 nt, Human
uccaggcaaagggacuagcagg

SEQ ID NO: 418987 - RNA, 22 nt, Human
gcagugcugaucccauggcaga

SEQ ID NO: 418988 - RNA, 22 nt, Human
aaagguuugcauggaauuuacc

SEQ ID NO: 418989 - RNA, 22 nt, Human
auagcuguuagauuggggucga

SEQ ID NO: 418990 - RNA, 22 nt, Human
aaaugaacaguugcauucucug

SEQ ID NO: 418991 - RNA, 22 nt, Human
aaggcacugaaaaauugugugu

SEQ ID NO: 418992 - RNA, 22 nt, Human
gcaggcaguuauuuaguagaau

SEQ ID NO: 418993 - RNA, 22 nt, Human
aucuggcuuacgaagcacuggu

SEQ ID NO: 418994 - RNA, 22 nt, Human
uggcagagucugggcuugggca

SEQ ID NO: 418995 - RNA, 22 nt, Human
ucugagcuuuuauuaucaaccu

SEQ ID NO: 418996 - RNA, 22 nt, Human
ccugcagcuguaggagaaggcg

SEQ ID NO: 418997 - RNA, 22 nt, Human
aauucuauaggcaagcuauuuu

SEQ ID NO: 418998 - RNA, 20 nt, Human
gguagcagcugcugucaucc

SEQ ID NO: 418999 - RNA, 22 nt, Human
ggcaggcagaggcugagacagg

SEQ ID NO: 419000 - RNA, 22 nt, Human
uuugaacaugcugcaugauaau

SEQ ID NO: 419001 - RNA, 22 nt, Human
ggccaggaagggaagaucagca

SEQ ID NO: 419002 - RNA, 22 nt, Human
cacucugacuggcccugcagga

SEQ ID NO: 419003 - RNA, 22 nt, Human
cuguacauauacauuuuuuucc

SEQ ID NO: 419004 - RNA, 22 nt, Human
ucccagaaaaaggaggcuauga

SEQ ID NO: 419005 - RNA, 22 nt, Human
agggccagaguacaucagggcu

SEQ ID NO: 419006 - RNA, 22 nt, Human
uggaggaugccauccaggauac

SEQ ID NO: 419007 - RNA, 22 nt, Human
uuucuuccuuaccuuacuagag

SEQ ID NO: 419008 - RNA, 22 nt, Human
gcauagucaguaggauucucaa

SEQ ID NO: 419009 - RNA, 22 nt, Human
cagccugggcuccagagucccu

SEQ ID NO: 419010 - RNA, 22 nt, Human
ucuugggauugcccugcaguuc

SEQ ID NO: 419011 - RNA, 22 nt, Human
guuacaaaugccaaagcugaga

SEQ ID NO: 419012 - RNA, 22 nt, Human
aagcagugcgcucaucuaaggg

SEQ ID NO: 419013 - RNA, 22 nt, Human
acuguggaugccaaaggggagg

SEQ ID NO: 419014 - RNA, 22 nt, Human
gaggcagcaaaauauaucauaa

SEQ ID NO: 419015 - RNA, 22 nt, Human
cuggccaggcuugggacagaca

SEQ ID NO: 419016 - RNA, 22 nt, Human
ugaaacaagggaccguccuuuc

SEQ ID NO: 419017 - RNA, 22 nt, Human
augucuuucaaauucugccuag

SEQ ID NO: 419018 - RNA, 23 nt, Human
uccugcagauaagcugguugaca

SEQ ID NO: 419019 - RNA, 22 nt, Human
ugcagggccuucuagaccaugg

SEQ ID NO: 419020 - RNA, 22 nt, Human
agaaaaggauugauggaucaga

SEQ ID NO: 419021 - RNA, 22 nt, Human
agguaguguagcugagugggau

SEQ ID NO: 419022 - RNA, 21 nt, Human
agccaggcaagcacccccacu

SEQ ID NO: 419023 - RNA, 22 nt, Human
cuguuuucccuggaguucagca

SEQ ID NO: 419024 - RNA, 22 nt, Human
gccagcuggagacuggcagggg

SEQ ID NO: 419025 - RNA, 22 nt, Human
ggcgcaggccuuggauccuggu

SEQ ID NO: 419026 - RNA, 22 nt, Human
auccaggguguggagagagcuc

SEQ ID NO: 419027 - RNA, 22 nt, Human
cacaggagcuguggggcagugu

SEQ ID NO: 419028 - RNA, 22 nt, Human
aguggggacuuaugccagcauu

SEQ ID NO: 419029 - RNA, 19 nt, Human
ucuggagcugaugcaggug

SEQ ID NO: 419030 - RNA, 21 nt, Human
gcugcucgagauccagugcuu

SEQ ID NO: 419031 - RNA, 22 nt, Human
cuggcucaauuuguacugcugu

SEQ ID NO: 419032 - RNA, 22 nt, Human
gagcagugaagacagaaguaca

SEQ ID NO: 419033 - RNA, 22 nt, Human
aagcagcauaauugcuauuuua

SEQ ID NO: 419034 - RNA, 22 nt, Human
aggacuucaucaccuguauaaa

SEQ ID NO: 419035 - RNA, 20 nt, Human
aguggggagucaggagugcc

SEQ ID NO: 419036 - RNA, 22 nt, Human
agucccaguucgguucuuccuc

SEQ ID NO: 419037 - RNA, 22 nt, Human
ucugcaggaaaaaagugccugg

SEQ ID NO: 419038 - RNA, 22 nt, Human
guccagggcuaaaucagguucc

SEQ ID NO: 419039 - RNA, 22 nt, Human
uaaaauguuugcaagagaccag

SEQ ID NO: 419040 - RNA, 22 nt, Human
caggaacacaaguucagggaug

SEQ ID NO: 419041 - RNA, 22 nt, Human
gagaggcugacuggcuguccug

SEQ ID NO: 419042 - RNA, 22 nt, Human
gagggaaagguuaauacaugau

SEQ ID NO: 419043 - RNA, 19 nt, Human
ccuuugaaucaggacacuu

SEQ ID NO: 419044 - RNA, 22 nt, Human
gaaaugugugacaaguuucaau

SEQ ID NO: 419045 - RNA, 22 nt, Human
aaggggaaguagcaccagaggu

SEQ ID NO: 419046 - RNA, 22 nt, Human
uuuguguuuuagcuggugaggc

SEQ ID NO: 419047 - RNA, 22 nt, Human
cacccacauggaaauucacagu

SEQ ID NO: 419048 - RNA, 22 nt, Human
uguucuugagccuuuagaccua

SEQ ID NO: 419049 - RNA, 22 nt, Human
acagacagauuuugucugaugu

SEQ ID NO: 419050 - RNA, 22 nt, Human
cauuuucagcacccaucugaaa

SEQ ID NO: 419051 - RNA, 22 nt, Human
aucaggauuauuaaaucuggau

SEQ ID NO: 419052 - RNA, 22 nt, Human
acauaaaggugacuaacaucuu

SEQ ID NO: 419053 - RNA, 22 nt, Human
gcucuguguugucagaggcacc

SEQ ID NO: 419054 - RNA, 22 nt, Human
gccccagguugccugucccagg

SEQ ID NO: 419055 - RNA, 22 nt, Human
gcucugagccgggggccugucc

SEQ ID NO: 419056 - RNA, 23 nt, Human
agccacuucuaucuugcuccugg

SEQ ID NO: 419057 - RNA, 22 nt, Human
ucagagagguuggugauaagaa

SEQ ID NO: 419058 - RNA, 23 nt, Human
uggagcugacagucagagggagg

SEQ ID NO: 419059 - RNA, 22 nt, Human
auguaucaacaaauuguacagu

SEQ ID NO: 419060 - RNA, 22 nt, Human
ugaggcagauauuuauuggguu

SEQ ID NO: 419061 - RNA, 22 nt, Human
aggugagugugacugcaagaga

SEQ ID NO: 419062 - RNA, 22 nt, Human
ucagaggaauuugcuuuucaug

SEQ ID NO: 419063 - RNA, 22 nt, Human
cauuuguuggucagauuguagu

SEQ ID NO: 419064 - RNA, 22 nt, Human
acacaugagaaacaucaguugu

SEQ ID NO: 419065 - RNA, 22 nt, Human
aaauuucuaagcagccacuucc

SEQ ID NO: 419066 - RNA, 22 nt, Human
cauguacauucuguagauggag

SEQ ID NO: 419067 - RNA, 22 nt, Human
gucacuggggccacaugcagaa

SEQ ID NO: 419068 - RNA, 22 nt, Human
cagggcucaucugugugaccag

SEQ ID NO: 419069 - RNA, 22 nt, Human
auuccaaaaggauguuagaaug

SEQ ID NO: 419070 - RNA, 22 nt, Human
ucaggaucggccuuuuuuuaag

SEQ ID NO: 419071 - RNA, 22 nt, Human
aguuacuugagacguuuaugaa

SEQ ID NO: 419072 - RNA, 22 nt, Human
caguuccuaugggcaaaacaca

SEQ ID NO: 419073 - RNA, 22 nt, Human
accauuugacucucuaaggaua

SEQ ID NO: 419074 - RNA, 22 nt, Human
uuucaaauggagucgugaaaug

SEQ ID NO: 419075 - RNA, 18 nt, Human
ucucuuuuccccucauug

SEQ ID NO: 419076 - RNA, 22 nt, Human
uuacauuuggcuauguccucua

SEQ ID NO: 419077 - RNA, 22 nt, Human
gcugagagcaguguggccuuaa

SEQ ID NO: 419078 - RNA, 22 nt, Human
ccugcagagccacgugccagcg

SEQ ID NO: 419079 - RNA, 22 nt, Human
ccagaggaguugaggcuuuggg

SEQ ID NO: 419080 - RNA, 22 nt, Human
caaggcugugcaggguccauau

SEQ ID NO: 419081 - RNA, 20 nt, Human
gucagaggacccuagagcga

SEQ ID NO: 419082 - RNA, 22 nt, Human
aggucauuuuugccuucuauuu

SEQ ID NO: 419083 - RNA, 22 nt, Human
gaaucacgguauucugcacggg

SEQ ID NO: 419084 - RNA, 22 nt, Human
guauccuccccgcuggccuuca

SEQ ID NO: 419085 - RNA, 22 nt, Human
agagggcuggacgcagguugga

SEQ ID NO: 419086 - RNA, 22 nt, Human
agcacuuuccuggcaaaugugg

SEQ ID NO: 419087 - RNA, 20 nt, Human
agugugcauuuagagucugc

SEQ ID NO: 419088 - RNA, 22 nt, Human
gugauuucuaaucaucugaaug

SEQ ID NO: 419089 - RNA, 21 nt, Human
gccacugcacuccagccuggg

SEQ ID NO: 419090 - RNA, 22 nt, Human
augggaggcagcagagcccagc

SEQ ID NO: 419091 - RNA, 22 nt, Human
gcagagcaccaaagugaaagau

SEQ ID NO: 419092 - RNA, 23 nt, Human
uggagaugccccacucccugucu

SEQ ID NO: 419093 - RNA, 22 nt, Human
gaauuagguaauagaacuagua

SEQ ID NO: 419094 - RNA, 22 nt, Human
cuagaaauacaggcacgugcca

SEQ ID NO: 419095 - RNA, 22 nt, Human
gccuuggcugaugugcgaauga

SEQ ID NO: 419096 - RNA, 21 nt, Human
ggcagccucuguggaagggga

SEQ ID NO: 419097 - RNA, 22 nt, Human
ucagaagacuacuaggacacau

SEQ ID NO: 419098 - RNA, 22 nt, Human
guguccacggcugagaaugauu

SEQ ID NO: 419099 - RNA, 20 nt, Human
acaggggcagcacaauaaug

SEQ ID NO: 419100 - RNA, 22 nt, Human
cagcuuguuuuauuuggggacc

SEQ ID NO: 419101 - RNA, 22 nt, Human
aaagccagagcaagcugucaca

SEQ ID NO: 419102 - RNA, 18 nt, Human
gggaucaggcugccuagg

SEQ ID NO: 419103 - RNA, 22 nt, Human
ccugucauacuaacguaguggg

SEQ ID NO: 419104 - RNA, 22 nt, Human
acugagcugcaagucagggagg

SEQ ID NO: 419105 - RNA, 22 nt, Human
uuguuacagcacuuaaccuuuu

SEQ ID NO: 419106 - RNA, 19 nt, Human
aggcaggugcagagguccc

SEQ ID NO: 419107 - RNA, 22 nt, Human
ccuccacaggagcugcagugcu

SEQ ID NO: 419108 - RNA, 22 nt, Human
ugaggcucagaagugccaagug

SEQ ID NO: 419109 - RNA, 22 nt, Human
augcugugucaccuuaggauuu

SEQ ID NO: 419110 - RNA, 22 nt, Human
caggcccagugaucagggcucu

SEQ ID NO: 419111 - RNA, 22 nt, Human
aagaagaaguguuauuuuuaga

SEQ ID NO: 419112 - RNA, 22 nt, Human
uaacacacugaaggugagaugg

SEQ ID NO: 419113 - RNA, 22 nt, Human
uacagagaguacagcauccaca

SEQ ID NO: 419114 - RNA, 22 nt, Human
uuuauuuggcauccagggagaa

SEQ ID NO: 419115 - RNA, 22 nt, Human
guccucuccaggaggcucugau

SEQ ID NO: 419116 - RNA, 22 nt, Human
gaggcugauucggggaacagca

SEQ ID NO: 419117 - RNA, 22 nt, Human
gccaggcuggugucacaacucu

SEQ ID NO: 419118 - RNA, 22 nt, Human
ucucccagaaguccucaguaca

SEQ ID NO: 419119 - RNA, 22 nt, Human
ugaaaugcuguagagacuguau

SEQ ID NO: 419120 - RNA, 22 nt, Human
gcagggcuguucaggagggugg

SEQ ID NO: 419121 - RNA, 22 nt, Human
auacaucuaugccuuucugaca

SEQ ID NO: 419122 - RNA, 22 nt, Human
accaggcacuccugaggucuga

SEQ ID NO: 419123 - RNA, 22 nt, Human
gggcuacagacaugcucuaagc

SEQ ID NO: 419124 - RNA, 22 nt, Human
caggcagcccugcaccaagugu

SEQ ID NO: 419125 - RNA, 22 nt, Human
ugauuuccacgugcacccaggu

SEQ ID NO: 419126 - RNA, 22 nt, Human
auccagggauaaaaguaagguu

SEQ ID NO: 419127 - RNA, 22 nt, Human
gagcccuccauggagccaggca

SEQ ID NO: 419128 - RNA, 22 nt, Human
auuuccaagaaagcuuuaggau

SEQ ID NO: 419129 - RNA, 22 nt, Human
aagggcagccugacucacgguc

SEQ ID NO: 419130 - RNA, 22 nt, Human
auugacaaucuacuauguucug

SEQ ID NO: 419131 - RNA, 22 nt, Human
agugggguccucaguaugguuc

SEQ ID NO: 419132 - RNA, 22 nt, Human
uccagcagggaauuaguagucu

SEQ ID NO: 419133 - RNA, 22 nt, Human
guuugcauggaagacagugagu

SEQ ID NO: 419134 - RNA, 22 nt, Human
ggcuagaacuuuacacuuugca

SEQ ID NO: 419135 - RNA, 22 nt, Human
caggcacugugcugagcucugc

SEQ ID NO: 419136 - RNA, 22 nt, Human
ucaaagcaucagucaauuuagg

SEQ ID NO: 419137 - RNA, 22 nt, Human
caggguuucaccauguuagcag

SEQ ID NO: 419138 - RNA, 22 nt, Human
uguggcuguguccaccugcugc

SEQ ID NO: 419139 - RNA, 22 nt, Human
aggcugagggcuccugagggca

SEQ ID NO: 419140 - RNA, 22 nt, Human
agaagccauugaagcagaccuc

SEQ ID NO: 419141 - RNA, 22 nt, Human
gcugggcuucucaaugcugccu

SEQ ID NO: 419142 - RNA, 22 nt, Human
gcugcagcaagcccuccagggg

SEQ ID NO: 419143 - RNA, 21 nt, Human
ggucagggggugccuccaggu

SEQ ID NO: 419144 - RNA, 22 nt, Human
aagagaaggauucugagccugg

SEQ ID NO: 419145 - RNA, 22 nt, Human
agaccauggccauccuaggaaa

SEQ ID NO: 419146 - RNA, 22 nt, Human
ucaccgccuugcccggccgggc

SEQ ID NO: 419147 - RNA, 22 nt, Human
ugccugcuaggcccugcugggu

SEQ ID NO: 419148 - RNA, 22 nt, Human
gccuggcugagguggggaggca

SEQ ID NO: 419149 - RNA, 22 nt, Human
cuuaacagcaagaucuguguca

SEQ ID NO: 419150 - RNA, 19 nt, Human
auuucaagagguuuauugg

SEQ ID NO: 419151 - RNA, 22 nt, Human
gcugccuggcuuuaguccacuu

SEQ ID NO: 419152 - RNA, 22 nt, Human
ggugggcagcucuuggcaggca

SEQ ID NO: 419153 - RNA, 22 nt, Human
uuguaacaggcacucugugcca

SEQ ID NO: 419154 - RNA, 22 nt, Human
augaccccuaaaauuuacuguc

SEQ ID NO: 419155 - RNA, 22 nt, Human
cugcagggcagaagggcauaga

SEQ ID NO: 419156 - RNA, 22 nt, Human
uucuuuccucccagccuuugga

SEQ ID NO: 419157 - RNA, 22 nt, Human
uacauguaauuuucauaguaag

SEQ ID NO: 419158 - RNA, 22 nt, Human
gccuucaggaggguuccagaca

SEQ ID NO: 419159 - RNA, 22 nt, Human
cucaggguaaugaaagacgaau

SEQ ID NO: 419160 - RNA, 22 nt, Human
ugcugccaagcccgugcuccug

SEQ ID NO: 419161 - RNA, 22 nt, Human
auagaaaacagauguccuuaaa

SEQ ID NO: 419162 - RNA, 22 nt, Human
ugucagagagcaggcaguagaa

SEQ ID NO: 419163 - RNA, 22 nt, Human
acauuucugcauguaggguaau

SEQ ID NO: 419164 - RNA, 22 nt, Human
cacacaggaugaagcagcagaa

SEQ ID NO: 419165 - RNA, 22 nt, Human
acaggccugacacacagagggc

SEQ ID NO: 419166 - RNA, 22 nt, Human
cugaggugagcuucccugggcu

SEQ ID NO: 419167 - RNA, 22 nt, Human
uuuacauugcauuagguauuau

SEQ ID NO: 419168 - RNA, 22 nt, Human
ggcugagcguggcugccguggg

SEQ ID NO: 419169 - RNA, 22 nt, Human
agccagagcugaugucauucuc

SEQ ID NO: 419170 - RNA, 22 nt, Human
aaucacaauuacuuuugcacca

SEQ ID NO: 419171 - RNA, 22 nt, Human
uggccugcuuucauuugaugcu

SEQ ID NO: 419172 - RNA, 22 nt, Human
aaggcgacacaggcagcaggcc

SEQ ID NO: 419173 - RNA, 22 nt, Human
ccucuggggguccucagagucu

SEQ ID NO: 419174 - RNA, 22 nt, Human
uauucacaggcuggagugaugu

SEQ ID NO: 419175 - RNA, 17 nt, Human
ugcauuguuggaaauuu

SEQ ID NO: 419176 - RNA, 22 nt, Human
cugggguggauggguccaaguu

SEQ ID NO: 419177 - RNA, 22 nt, Human
aucauguuccagaaacagugau

SEQ ID NO: 419178 - RNA, 22 nt, Human
aguguuguaugggaugacugcu

SEQ ID NO: 419179 - RNA, 22 nt, Human
uauguuaaauguuugauguuua

SEQ ID NO: 419180 - RNA, 22 nt, Human
ugaggccugcauugaacuagaa

SEQ ID NO: 419181 - RNA, 22 nt, Human
gcugagucuugagcacugagca

SEQ ID NO: 419182 - RNA, 22 nt, Human
cagcaggcccagaguuucaugg

SEQ ID NO: 419183 - RNA, 22 nt, Human
cacagggcagugauuguccaca

SEQ ID NO: 419184 - RNA, 22 nt, Human
caccagggcagcagccuagucu

SEQ ID NO: 419185 - RNA, 22 nt, Human
ggcaucuguccaucucuccagc

SEQ ID NO: 419186 - RNA, 22 nt, Human
uggaaggggagcuggaaagggg

SEQ ID NO: 419187 - RNA, 22 nt, Human
gaagccacuauagauauucuaa

SEQ ID NO: 419188 - RNA, 22 nt, Human
ugguccugagcaccagccugac

SEQ ID NO: 419189 - RNA, 22 nt, Human
ccagccagccuugaucugagua

SEQ ID NO: 419190 - RNA, 22 nt, Human
ccuguggcacaugcagggauuc

SEQ ID NO: 419191 - RNA, 22 nt, Human
gcagcugccuauucagggcuug

SEQ ID NO: 419192 - RNA, 18 nt, Human
cagauccaggcagcuauu

SEQ ID NO: 419193 - RNA, 22 nt, Human
gcagcugauggaaguccuauug

SEQ ID NO: 419194 - RNA, 22 nt, Human
gcagugaaacaauaggaucaaa

SEQ ID NO: 419195 - RNA, 22 nt, Human
cucaggaggaggaaguucauug

SEQ ID NO: 419196 - RNA, 22 nt, Human
agaaauaugcugauuagaugaa

SEQ ID NO: 419197 - RNA, 22 nt, Human
ugcagagggacagccacagcuc

SEQ ID NO: 419198 - RNA, 22 nt, Human
cagugggugaugaguccugggg

SEQ ID NO: 419199 - RNA, 18 nt, Human
uggagcaggaagccuggc

SEQ ID NO: 419200 - RNA, 22 nt, Human
gccaggcaggugucggagcccu

SEQ ID NO: 419201 - RNA, 22 nt, Human
cccaucaggaacccaggagccc

SEQ ID NO: 419202 - RNA, 20 nt, Human
gagagcuggggaugaggcug

SEQ ID NO: 419203 - RNA, 18 nt, Human
cucucugggugaggacaa

SEQ ID NO: 419204 - RNA, 22 nt, Human
gccuaauaugcaaaauugauac

SEQ ID NO: 419205 - RNA, 22 nt, Human
aagggcucuucuauuuauggcc

SEQ ID NO: 419206 - RNA, 22 nt, Human
uggcagcauuuuuuccagaaca

SEQ ID NO: 419207 - RNA, 19 nt, Human
ucugugcugggaggcagca

SEQ ID NO: 419208 - RNA, 22 nt, Human
gaggccuggucuaugagauguu

SEQ ID NO: 419209 - RNA, 21 nt, Human
aagagcugucaggaaggcugc

SEQ ID NO: 419210 - RNA, 22 nt, Human
ccaggccuccugugaguggacc

SEQ ID NO: 419211 - RNA, 22 nt, Human
ugagagggcccagagcacacca

SEQ ID NO: 419212 - RNA, 22 nt, Human
agagcaauggcauccagcugau

SEQ ID NO: 419213 - RNA, 22 nt, Human
ccaggagcaaagaucacuggga

SEQ ID NO: 419214 - RNA, 22 nt, Human
caggauggccccggggcugugc

SEQ ID NO: 419215 - RNA, 22 nt, Human
uuugaaauaugaggcauuauga

SEQ ID NO: 419216 - RNA, 22 nt, Human
gaggcuggaauauuagaaaugu

SEQ ID NO: 419217 - RNA, 22 nt, Human
gcagggcaaacccagguguuca

SEQ ID NO: 419218 - RNA, 22 nt, Human
ugaggaagcaaaggcuugugug

SEQ ID NO: 419219 - RNA, 22 nt, Human
cucugugagggucuguacagaa

SEQ ID NO: 419220 - RNA, 18 nt, Human
cacaggcucccagugagg

SEQ ID NO: 419221 - RNA, 22 nt, Human
agcaggcuccuuccuucucugg

SEQ ID NO: 419222 - RNA, 22 nt, Human
agcagagguguuuauuauggga

SEQ ID NO: 419223 - RNA, 22 nt, Human
cagccugcucucagauguugag

SEQ ID NO: 419224 - RNA, 22 nt, Human
uuucacauucagauauagacuu

SEQ ID NO: 419225 - RNA, 22 nt, Human
ugucaccagcugcuccucagga

SEQ ID NO: 419226 - RNA, 22 nt, Human
aguuuuuccugauuuuacagaa

SEQ ID NO: 419227 - RNA, 22 nt, Human
gccaggcuggugcaaggauauu

SEQ ID NO: 419228 - RNA, 22 nt, Human
uacccagcaaucccuagagguu

SEQ ID NO: 419229 - RNA, 22 nt, Human
gccuggaguuguggugaagcca

SEQ ID NO: 419230 - RNA, 22 nt, Human
ucuggagcgaggucccugucug

SEQ ID NO: 419231 - RNA, 22 nt, Human
aacaaauggggccuuguaugaa

SEQ ID NO: 419232 - RNA, 22 nt, Human
gccugcagggcccuuguggguc

SEQ ID NO: 419233 - RNA, 22 nt, Human
ccaaaguccauaguuuacauua

SEQ ID NO: 419234 - RNA, 22 nt, Human
ugccaaauugcccuauaaauga

SEQ ID NO: 419235 - RNA, 22 nt, Human
uuauuauaaugagggauaaaaa

SEQ ID NO: 419236 - RNA, 22 nt, Human
uggcagaguuggagguggaaga

SEQ ID NO: 419237 - RNA, 22 nt, Human
gccuguccacuaaacagccaag

SEQ ID NO: 419238 - RNA, 22 nt, Human
ucaggccacggcucacugagac

SEQ ID NO: 419239 - RNA, 22 nt, Human
gcccucagaguuccccacagug

SEQ ID NO: 419240 - RNA, 22 nt, Human
ccaggcugagcaugauuggagc

SEQ ID NO: 419241 - RNA, 22 nt, Human
agugaccauuuucagcuagagg

SEQ ID NO: 419242 - RNA, 22 nt, Human
ucaguuuuuacggucacaggga

SEQ ID NO: 419243 - RNA, 22 nt, Human
aagggccuccuggggagccugg

SEQ ID NO: 419244 - RNA, 22 nt, Human
caggacccaaccucccugcucu

SEQ ID NO: 419245 - RNA, 22 nt, Human
gcaugggcaagaggacuggggg

SEQ ID NO: 419246 - RNA, 22 nt, Human
gcuggcagacugggggcagaac

SEQ ID NO: 419247 - RNA, 22 nt, Human
cucagcagagaccagggaggaa

SEQ ID NO: 419248 - RNA, 18 nt, Human
gccagagggaagcaggug

SEQ ID NO: 419249 - RNA, 19 nt, Human
uuacaucugcaacacuggu

SEQ ID NO: 419250 - RNA, 15 nt, Human
aaucuggcggcaagu

SEQ ID NO: 419251 - RNA, 22 nt, Human
caaaaugugagucccaccucaa

SEQ ID NO: 419252 - RNA, 22 nt, Human
agauggguaacuggagucugcu

SEQ ID NO: 419253 - RNA, 22 nt, Human
agaggagguccuuuucugaugu

SEQ ID NO: 419254 - RNA, 22 nt, Human
aggcaagaacagacaugggagu

SEQ ID NO: 419255 - RNA, 22 nt, Human
cagaugaggcaaccucauugcu

SEQ ID NO: 419256 - RNA, 22 nt, Human
gucuggaguggggccugagaau

SEQ ID NO: 419257 - RNA, 21 nt, Human
ugaggccugccagucucagaa

SEQ ID NO: 419258 - RNA, 22 nt, Human
gcaaggagacuguagggccaag

SEQ ID NO: 419259 - RNA, 22 nt, Human
cccuggagguggagguugcagg

SEQ ID NO: 419260 - RNA, 18 nt, Human
gggcaucauucacaaagu

SEQ ID NO: 419261 - RNA, 22 nt, Human
acaggcagcacuaaucucuggu

SEQ ID NO: 419262 - RNA, 22 nt, Human
caauuucuggaacuaauucuga

SEQ ID NO: 419263 - RNA, 16 nt, Human
gcacacacaucaauga

SEQ ID NO: 419264 - RNA, 21 nt, Human
ucagggcagugggagguuccu

SEQ ID NO: 419265 - RNA, 22 nt, Human
agaugaagauaucugcaggggc

SEQ ID NO: 419266 - RNA, 22 nt, Human
ugccugggagugaccaagacuc

SEQ ID NO: 419267 - RNA, 22 nt, Human
guggagccaggggcuguaggua

SEQ ID NO: 419268 - RNA, 22 nt, Human
aauguguguucggggcccagag

SEQ ID NO: 419269 - RNA, 22 nt, Human
cucagaagaacaaaggcucuac

SEQ ID NO: 419270 - RNA, 22 nt, Human
gagugugggcacgggggccuug

SEQ ID NO: 419271 - RNA, 22 nt, Human
guacccagaggcaugaucccag

SEQ ID NO: 419272 - RNA, 22 nt, Human
gcagagccccauugcuggcggg

SEQ ID NO: 419273 - RNA, 22 nt, Human
uaacagaaaggggacagaaaua

SEQ ID NO: 419274 - RNA, 22 nt, Human
ggcccugggaugcucagcagug

SEQ ID NO: 419275 - RNA, 22 nt, Human
agcugcugagagucugccgggc

SEQ ID NO: 419276 - RNA, 22 nt, Human
agcacagauucugaagaguccu

SEQ ID NO: 419277 - RNA, 18 nt, Human
acaggccucaguccugca

SEQ ID NO: 419278 - RNA, 22 nt, Human
acagcuuuucaauucugcugag

SEQ ID NO: 419279 - RNA, 22 nt, Human
uugcaggggaaggagcagagcu

SEQ ID NO: 419280 - RNA, 23 nt, Human
gccugggacucaggaggagcuca

SEQ ID NO: 419281 - RNA, 22 nt, Human
uucacagucacccuucuccaug

SEQ ID NO: 419282 - RNA, 22 nt, Human
aacccgggaggcagagguugug

SEQ ID NO: 419283 - RNA, 22 nt, Human
gauuuucugagccuucaaauuu

SEQ ID NO: 419284 - RNA, 22 nt, Human
gcaccuggacagugacccuagc

SEQ ID NO: 419285 - RNA, 22 nt, Human
aggcugccuguuccaaucuccu

SEQ ID NO: 419286 - RNA, 22 nt, Human
aacuuuaaggcuauaaauuaug

SEQ ID NO: 419287 - RNA, 19 nt, Human
cacaucagcagggcugugg

SEQ ID NO: 419288 - RNA, 22 nt, Human
agcugcugagccaggcugaugu

SEQ ID NO: 419289 - RNA, 22 nt, Human
aaaaugcaugagaaugugcucg

SEQ ID NO: 419290 - RNA, 22 nt, Human
cuguccccgcgaguccagagcu

SEQ ID NO: 419291 - RNA, 22 nt, Human
accugcagguguuuccacacuu

SEQ ID NO: 419292 - RNA, 22 nt, Human
aaaguucugggggagaagaacg

SEQ ID NO: 419293 - RNA, 22 nt, Human
ugggugaggaugaugaggcagc

SEQ ID NO: 419294 - RNA, 22 nt, Human
gcauggcauuugaagguagaag

SEQ ID NO: 419295 - RNA, 22 nt, Human
agguaaggcuguaagcuaagcc

SEQ ID NO: 419296 - RNA, 22 nt, Human
ccugccagcauggcuuaucucc

SEQ ID NO: 419297 - RNA, 20 nt, Human
cuguccccgaggucaccagg

SEQ ID NO: 419298 - RNA, 22 nt, Human
gauccuugcacuugacuuggca

SEQ ID NO: 419299 - RNA, 22 nt, Human
uccuggagaauccugccaccug

SEQ ID NO: 419300 - RNA, 22 nt, Human
cacaggguuguucugaggauuc

SEQ ID NO: 419301 - RNA, 22 nt, Human
gagcucugacugcugggugaca

SEQ ID NO: 419302 - RNA, 22 nt, Human
auauucguggucaaguaaggcc

SEQ ID NO: 419303 - RNA, 22 nt, Human
ucucugagcugcuucuugcaua

SEQ ID NO: 419304 - RNA, 22 nt, Human
ucagagugcagcgggaggcugg

SEQ ID NO: 419305 - RNA, 22 nt, Human
ucugggugaugaaaugcacugu

SEQ ID NO: 419306 - RNA, 22 nt, Human
gggacagacccaugggccaggu

SEQ ID NO: 419307 - RNA, 22 nt, Human
uuucuguagggauuucacaguu

SEQ ID NO: 419308 - RNA, 22 nt, Human
auuguacaaugccuggaacauu

SEQ ID NO: 419309 - RNA, 22 nt, Human
auagugguuggauaugucagag

SEQ ID NO: 419310 - RNA, 22 nt, Human
gcaggccucuguugagggccuu

SEQ ID NO: 419311 - RNA, 22 nt, Human
ccagguguggggaggacucaca

SEQ ID NO: 419312 - RNA, 22 nt, Human
ggagaggcgaugagucacagcc

SEQ ID NO: 419313 - RNA, 18 nt, Human
uggcucagauggcuuuaa

SEQ ID NO: 419314 - RNA, 22 nt, Human
aggaaagcucccaguagggcuc

SEQ ID NO: 419315 - RNA, 22 nt, Human
uuccuuguuuguagcucuggga

SEQ ID NO: 419316 - RNA, 22 nt, Human
cagcuggaugggagaccauguu

SEQ ID NO: 419317 - RNA, 22 nt, Human
ugucauuuaguccucugugugu

SEQ ID NO: 419318 - RNA, 22 nt, Human
agcaggaguguccccuggcugu

SEQ ID NO: 419319 - RNA, 22 nt, Human
uuucagauuaucucaacuuugg

SEQ ID NO: 419320 - RNA, 22 nt, Human
cuauugcauuugcaucuucauc

SEQ ID NO: 419321 - RNA, 22 nt, Human
ggcucuggcguccaauggagcg

SEQ ID NO: 419322 - RNA, 21 nt, Human
uggcugcuggcccucucucca

SEQ ID NO: 419323 - RNA, 20 nt, Human
agucugucaauuuacagugg

SEQ ID NO: 419324 - RNA, 22 nt, Human
uacaaaguauauuucuagcugu

SEQ ID NO: 419325 - RNA, 22 nt, Human
ugcagccaggaaauauuugcug

SEQ ID NO: 419326 - RNA, 22 nt, Human
ccagcuuuucuuaucauuauaa

SEQ ID NO: 419327 - RNA, 22 nt, Human
aguaaaaauugaggugcaaaau

SEQ ID NO: 419328 - RNA, 22 nt, Human
ccagcugguuaaaauagagaaa

SEQ ID NO: 419329 - RNA, 22 nt, Human
gaggaagaagcaaaccagcuaa

SEQ ID NO: 419330 - RNA, 22 nt, Human
cagaaauguucuaaugauucag

SEQ ID NO: 419331 - RNA, 22 nt, Human
ugaagcaggguggccagauugu

SEQ ID NO: 419332 - RNA, 21 nt, Human
aaagagcccgcugagagguuc

SEQ ID NO: 419333 - RNA, 22 nt, Human
uaagaacaucuguccccagauu

SEQ ID NO: 419334 - RNA, 22 nt, Human
gcccugcugucuucagaguaua

SEQ ID NO: 419335 - RNA, 22 nt, Human
aggagaaagacuggacagccaa

SEQ ID NO: 419336 - RNA, 22 nt, Human
gcucugcuugcaucaugacugc

SEQ ID NO: 419337 - RNA, 22 nt, Human
cugggaggauacacaagaucag

SEQ ID NO: 419338 - RNA, 22 nt, Human
ggccuuggugccauggccaguu

SEQ ID NO: 419339 - RNA, 22 nt, Human
uuuccucuucuggcaggcaggg

SEQ ID NO: 419340 - RNA, 22 nt, Human
uagggcaguuauaacauuagug

SEQ ID NO: 419341 - RNA, 22 nt, Human
gcucugagaggugcagcaguaa

SEQ ID NO: 419342 - RNA, 22 nt, Human
uuagccaugugggaaaaacagc

SEQ ID NO: 419343 - RNA, 22 nt, Human
cagagaaacucagauagcugau

SEQ ID NO: 419344 - RNA, 22 nt, Human
ucugucuccugccagugccucu

SEQ ID NO: 419345 - RNA, 21 nt, Human
uauuucuuugacucucucccu

SEQ ID NO: 419346 - RNA, 22 nt, Human
aggcuucuuagauuggcuggag

SEQ ID NO: 419347 - RNA, 22 nt, Human
agaugcugccucuccucacaag

SEQ ID NO: 419348 - RNA, 22 nt, Human
ucuggccuauuucugucagauc

SEQ ID NO: 419349 - RNA, 22 nt, Human
uggucucuucuuccaagauggc

SEQ ID NO: 419350 - RNA, 22 nt, Human
gggaauuauagcugucacaggc

SEQ ID NO: 419351 - RNA, 22 nt, Human
gaaggcaggcuucugauuaggu

SEQ ID NO: 419352 - RNA, 22 nt, Human
uuuacaaguuuacagaaugaug

SEQ ID NO: 419353 - RNA, 22 nt, Human
aggcagagcuggguuuugaaau

SEQ ID NO: 419354 - RNA, 22 nt, Human
agggaaaggcugaugcuguggg

SEQ ID NO: 419355 - RNA, 22 nt, Human
ucaggggcugugcauuucccag

SEQ ID NO: 419356 - RNA, 22 nt, Human
uuuaauuuucugggcccagcag

SEQ ID NO: 419357 - RNA, 22 nt, Human
aagucaauuaguaaacuuggaa

SEQ ID NO: 419358 - RNA, 22 nt, Human
acagccagggucucaggaggcg

SEQ ID NO: 419359 - RNA, 22 nt, Human
uugugaaauguuucaaaauagu

SEQ ID NO: 419360 - RNA, 22 nt, Human
aggugccagugcuguggucccc

SEQ ID NO: 419361 - RNA, 22 nt, Human
aaacaucauaggcaugcaugau

SEQ ID NO: 419362 - RNA, 22 nt, Human
cggcuggguucggcugcaggcc

SEQ ID NO: 419363 - RNA, 22 nt, Human
cugugccaggcccagcugacuu

SEQ ID NO: 419364 - RNA, 22 nt, Human
ucagggcaaaagggaaaccauu

SEQ ID NO: 419365 - RNA, 22 nt, Human
uuucuacaguacugauuucaua

SEQ ID NO: 419366 - RNA, 22 nt, Human
ccugggaggcagagguugcagu

SEQ ID NO: 419367 - RNA, 22 nt, Human
gucuggaggaggaagaaggcac

SEQ ID NO: 419368 - RNA, 22 nt, Human
aaucaggaugacugucauuuca

SEQ ID NO: 419369 - RNA, 22 nt, Human
aucuccaggcauuucaagagac

SEQ ID NO: 419370 - RNA, 22 nt, Human
ugucucugaggugagggucagc

SEQ ID NO: 419371 - RNA, 22 nt, Human
gcagagaggaaugaagccaucc

SEQ ID NO: 419372 - RNA, 22 nt, Human
ggcccagcugugcuuccagccc

SEQ ID NO: 419373 - RNA, 22 nt, Human
gagagugagauaauuucacaua

SEQ ID NO: 419374 - RNA, 22 nt, Human
ucugugucugcagaaguucagc

SEQ ID NO: 419375 - RNA, 22 nt, Human
auacuaaaguauagaacuuagu

SEQ ID NO: 419376 - RNA, 22 nt, Human
auuucuacugugagaaacauga

SEQ ID NO: 419377 - RNA, 20 nt, Human
ggcagcaggaguuuccucuu

SEQ ID NO: 419378 - RNA, 22 nt, Human
ugcugccaugcagagcaacaga

SEQ ID NO: 419379 - RNA, 22 nt, Human
agggcagagcacugaauuggga

SEQ ID NO: 419380 - RNA, 22 nt, Human
ucuguggcacgauugcacugca

SEQ ID NO: 419381 - RNA, 22 nt, Human
cacaggcuccggccuugcagcc

SEQ ID NO: 419382 - RNA, 22 nt, Human
aguuuccaaauauuguuuuagc

SEQ ID NO: 419383 - RNA, 22 nt, Human
uccaaacgggagccaaaugagc

SEQ ID NO: 419384 - RNA, 22 nt, Human
ugagaugaauaacuccugcuaa

SEQ ID NO: 419385 - RNA, 22 nt, Human
uuacacaacagugcaucagcag

SEQ ID NO: 419386 - RNA, 22 nt, Human
aaugauggucauggcaacuuuu

SEQ ID NO: 419387 - RNA, 19 nt, Human
ugccugucaguagaucuca

SEQ ID NO: 419388 - RNA, 22 nt, Human
cuacagguaugugcaugacauc

SEQ ID NO: 419389 - RNA, 22 nt, Human
ggcuuuauuaagcaggguaagu

SEQ ID NO: 419390 - RNA, 22 nt, Human
ccucaggguggcaucagaucuu

SEQ ID NO: 419391 - RNA, 22 nt, Human
gcagggacugugaucucacaga

SEQ ID NO: 419392 - RNA, 22 nt, Human
ugugcuucuugcagcuccugua

SEQ ID NO: 419393 - RNA, 22 nt, Human
cagaccuggaaaacaggcuugc

SEQ ID NO: 419394 - RNA, 22 nt, Human
auuaauuuccaggcacugugcu

SEQ ID NO: 419395 - RNA, 22 nt, Human
agagcuggguggacuuguaguu

SEQ ID NO: 419396 - RNA, 20 nt, Human
aguuuauuccaggagaacug

SEQ ID NO: 419397 - RNA, 22 nt, Human
ucccagggacaccaagcuguuu

SEQ ID NO: 419398 - RNA, 22 nt, Human
cuggagugaagucuggcagcuu

SEQ ID NO: 419399 - RNA, 22 nt, Human
gagacagaguuucacucuuguu

SEQ ID NO: 419400 - RNA, 18 nt, Human
uggugaaggguggaggag

SEQ ID NO: 419401 - RNA, 22 nt, Human
cuggauuuaauuaacuguugcu

SEQ ID NO: 419402 - RNA, 22 nt, Human
aguggcagagcugugucuugaa

SEQ ID NO: 419403 - RNA, 22 nt, Human
ccucuccaguuuuaacgugacc

SEQ ID NO: 419404 - RNA, 22 nt, Human
uucccaguauuaccuucaggaa

SEQ ID NO: 419405 - RNA, 22 nt, Human
ggguccagacacuccagaggaa

SEQ ID NO: 419406 - RNA, 23 nt, Human
ccaaagucgaagucuaguccaga

SEQ ID NO: 419407 - RNA, 22 nt, Human
gcagauggcugagccugcagau

SEQ ID NO: 419408 - RNA, 21 nt, Human
acagagcauaaugguguggca

SEQ ID NO: 419409 - RNA, 19 nt, Human
gaaggagagcugaguuagg

SEQ ID NO: 419410 - RNA, 22 nt, Human
uaaaugcagcaguuucuguucu

SEQ ID NO: 419411 - RNA, 22 nt, Human
auguagcagauauuugugcaca

SEQ ID NO: 419412 - RNA, 22 nt, Human
ucuggcucucauacucgccagu

SEQ ID NO: 419413 - RNA, 22 nt, Human
aggcucagccccugggaggaga

SEQ ID NO: 419414 - RNA, 22 nt, Human
caaaugcauagaaagaugaaac

SEQ ID NO: 419415 - RNA, 22 nt, Human
uauguacacauacacuuguaau

SEQ ID NO: 419416 - RNA, 17 nt, Human
gcagccagugcagcagg

SEQ ID NO: 419417 - RNA, 21 nt, Human
aaacugaagagacaggaacuu

SEQ ID NO: 419418 - RNA, 22 nt, Human
caguuucuacgaaggucaaccc

SEQ ID NO: 419419 - RNA, 22 nt, Human
uaaauguguuguggaugaaguu

SEQ ID NO: 419420 - RNA, 22 nt, Human
agaguccagaaaacagugugcu

SEQ ID NO: 419421 - RNA, 22 nt, Human
cccagccuggugcacugugggg

SEQ ID NO: 419422 - RNA, 22 nt, Human
cagcagccuacaaugcacagaa

SEQ ID NO: 419423 - RNA, 22 nt, Human
uauguacaugauuucauuugcu

SEQ ID NO: 419424 - RNA, 19 nt, Human
cagugcccgacgcaggucu

SEQ ID NO: 419425 - RNA, 22 nt, Human
aaggcugcuuuuaacaugcaua

SEQ ID NO: 419426 - RNA, 23 nt, Human
gacagagugagaccuugucuuac

SEQ ID NO: 419427 - RNA, 22 nt, Human
gauacauuuuaucuccuaacag

SEQ ID NO: 419428 - RNA, 22 nt, Human
gccaggcugcuccagggaggcc

SEQ ID NO: 419429 - RNA, 22 nt, Human
caguggagugggacuggucuga

SEQ ID NO: 419430 - RNA, 22 nt, Human
ggaccugcauuuuaacaagauc

SEQ ID NO: 419431 - RNA, 22 nt, Human
acaacugucaguaaagaauauu

SEQ ID NO: 419432 - RNA, 22 nt, Human
cuggccuguccugacccagccu

SEQ ID NO: 419433 - RNA, 22 nt, Human
acagagcuucccagccugagca

SEQ ID NO: 419434 - RNA, 22 nt, Human
gauggcagcagcagccagggau

SEQ ID NO: 419435 - RNA, 22 nt, Human
ucugagaggcagaccuuccuaa

SEQ ID NO: 419436 - RNA, 22 nt, Human
augucuuucgcaucaguagcua

SEQ ID NO: 419437 - RNA, 22 nt, Human
ccugcagguccccggaugcgca

SEQ ID NO: 419438 - RNA, 22 nt, Human
uggcagaaagaaccaugugcaa

SEQ ID NO: 419439 - RNA, 22 nt, Human
cugaaacauugcaauaacaaag

SEQ ID NO: 419440 - RNA, 22 nt, Human
cugccagcacugccuccugagg

SEQ ID NO: 419441 - RNA, 22 nt, Human
cgaggcagacaaaaguuggaag

SEQ ID NO: 419442 - RNA, 20 nt, Human
ucagauuuuucuaacuuuga

SEQ ID NO: 419443 - RNA, 22 nt, Human
agaagccacuggagguugagau

SEQ ID NO: 419444 - RNA, 22 nt, Human
gggcaguagcuucguaggcauc

SEQ ID NO: 419445 - RNA, 22 nt, Human
gagcugccggcccacaguacua

SEQ ID NO: 419446 - RNA, 22 nt, Human
cauaccuuucucaagcacaugu

SEQ ID NO: 419447 - RNA, 22 nt, Human
cuauuuaucuauuucugaauga

SEQ ID NO: 419448 - RNA, 22 nt, Human
cagagcuggcucugcauguaca

SEQ ID NO: 419449 - RNA, 22 nt, Human
ucagggcaaugucccucagaag

SEQ ID NO: 419450 - RNA, 22 nt, Human
ucagcuuucucucgccaucagg

SEQ ID NO: 419451 - RNA, 22 nt, Human
uggcccugcugggucagagcug

SEQ ID NO: 419452 - RNA, 21 nt, Human
cagagcagcguucugcugugg

SEQ ID NO: 419453 - RNA, 22 nt, Human
cagaagccugccucagaugcac

SEQ ID NO: 419454 - RNA, 22 nt, Human
gccuucugcgcucgugucuccg

SEQ ID NO: 419455 - RNA, 22 nt, Human
ggccaggagcaagccaggcucu

SEQ ID NO: 419456 - RNA, 22 nt, Human
aacuucuugguccugagcuguu

SEQ ID NO: 419457 - RNA, 22 nt, Human
agagggaaugugauugcaccau

SEQ ID NO: 419458 - RNA, 23 nt, Human
uuccuuaacuguuaagauugucu

SEQ ID NO: 419459 - RNA, 22 nt, Human
aggacccugaggucuccuguga

SEQ ID NO: 419460 - RNA, 22 nt, Human
acccaggagccgugagagguua

SEQ ID NO: 419461 - RNA, 22 nt, Human
ugggcagaucuuugguggcuag

SEQ ID NO: 419462 - RNA, 22 nt, Human
cagcccagcagggucuggcccu

SEQ ID NO: 419463 - RNA, 22 nt, Human
ucaccaggauuccuaucaguag

SEQ ID NO: 419464 - RNA, 22 nt, Human
uggcucagcuuacuuuugaggg

SEQ ID NO: 419465 - RNA, 22 nt, Human
uggcucaguuugggggauugaa

SEQ ID NO: 419466 - RNA, 22 nt, Human
aggcucauucuugccucugagc

SEQ ID NO: 419467 - RNA, 22 nt, Human
ccacugucagaggggcugugcc

SEQ ID NO: 419468 - RNA, 22 nt, Human
uugucugucccagcuugugcau

SEQ ID NO: 419469 - RNA, 18 nt, Human
ugucucugaauuccagug

SEQ ID NO: 419470 - RNA, 22 nt, Human
aaagggcugucaaauaagcaac

SEQ ID NO: 419471 - RNA, 22 nt, Human
ggccugcugcuaugacuuccug

SEQ ID NO: 419472 - RNA, 22 nt, Human
auaacagagagcuacugaacug

SEQ ID NO: 419473 - RNA, 21 nt, Human
auuuucauuuccaggggagga

SEQ ID NO: 419474 - RNA, 22 nt, Human
uccagcagaccaucaaggcuca

SEQ ID NO: 419475 - RNA, 22 nt, Human
cuggccugggagcugcuagcgu

SEQ ID NO: 419476 - RNA, 22 nt, Human
ccaggaugacccccacuuuccu

SEQ ID NO: 419477 - RNA, 22 nt, Human
ucuguaguagguuguaguucuu

SEQ ID NO: 419478 - RNA, 22 nt, Human
caggagcagaggguggucagca

SEQ ID NO: 419479 - RNA, 22 nt, Human
ucugcucagugcuuaucucuaa

SEQ ID NO: 419480 - RNA, 22 nt, Human
uggcucuggcgugaagcccaga

SEQ ID NO: 419481 - RNA, 22 nt, Human
aaaaacuguaauuacuuuugca

SEQ ID NO: 419482 - RNA, 22 nt, Human
ugcuucaggaagaaacgccagg

SEQ ID NO: 419483 - RNA, 22 nt, Human
auugacaauuagcccuuaggug

SEQ ID NO: 419484 - RNA, 22 nt, Human
agagugaaggccagguuacagu

SEQ ID NO: 419485 - RNA, 17 nt, Human
ucaggauccaggguucu

SEQ ID NO: 419486 - RNA, 22 nt, Human
ucuuuccuuagaauaauucuuu

SEQ ID NO: 419487 - RNA, 22 nt, Human
uggguagagcaggcuggggcuu

SEQ ID NO: 419488 - RNA, 22 nt, Human
guaacacagaaaugaaauucca

SEQ ID NO: 419489 - RNA, 22 nt, Human
agaugcugcuccacaggccagg

SEQ ID NO: 419490 - RNA, 22 nt, Human
aacacuguggucuuuucaguaa

SEQ ID NO: 419491 - RNA, 19 nt, Human
uggcagggagugauauuag

SEQ ID NO: 419492 - RNA, 22 nt, Human
uauaacacucagaaagaaucau

SEQ ID NO: 419493 - RNA, 22 nt, Human
gagccaggucgggccgcggcga

SEQ ID NO: 419494 - RNA, 22 nt, Human
uugaaaguuaucuagauucuga

SEQ ID NO: 419495 - RNA, 22 nt, Human
gagagucuagugcaccuaguuu

SEQ ID NO: 419496 - RNA, 22 nt, Human
ucaaugauaguacaaucagccu

SEQ ID NO: 419497 - RNA, 22 nt, Human
cauugcacuccaucuugggcaa

SEQ ID NO: 419498 - RNA, 22 nt, Human
cucugcaggggaggcaugcacu

SEQ ID NO: 419499 - RNA, 22 nt, Human
aaacaaacauagguuugaaagu

SEQ ID NO: 419500 - RNA, 21 nt, Human
uuugcauuuuacaugugggga

SEQ ID NO: 419501 - RNA, 22 nt, Human
aggaccaacauagcagcagugg

SEQ ID NO: 419502 - RNA, 22 nt, Human
ggcagcaggagccaucugguag

SEQ ID NO: 419503 - RNA, 22 nt, Human
cagagggcucaguccugcugga

SEQ ID NO: 419504 - RNA, 22 nt, Human
acaugucaauuuaguacucuua

SEQ ID NO: 419505 - RNA, 19 nt, Human
ggcugggucuggcagguuc

SEQ ID NO: 419506 - RNA, 22 nt, Human
cccugcaggggaccugcagccu

SEQ ID NO: 419507 - RNA, 22 nt, Human
uccaggcuggccucgcgugaca

SEQ ID NO: 419508 - RNA, 22 nt, Human
ugccaggcgauugcuaucagca

SEQ ID NO: 419509 - RNA, 22 nt, Human
cauuuagaaacuguuuuuaaca

SEQ ID NO: 419510 - RNA, 22 nt, Human
uguggccucaaggcugcccuca

SEQ ID NO: 419511 - RNA, 22 nt, Human
auccaguucucagugcuuacag

SEQ ID NO: 419512 - RNA, 22 nt, Human
ucugucacccagagugcagugg

SEQ ID NO: 419513 - RNA, 22 nt, Human
aaauugugagcuauagaucuag

SEQ ID NO: 419514 - RNA, 22 nt, Human
ccaaggagcugcaggcacuugu

SEQ ID NO: 419515 - RNA, 22 nt, Human
aaggagcucccggcagaccagg

SEQ ID NO: 419516 - RNA, 20 nt, Human
uccaggcagacagcuauggg

SEQ ID NO: 419517 - RNA, 22 nt, Human
ccagugcacagccaggcaggug

SEQ ID NO: 419518 - RNA, 22 nt, Human
ccagcagccaccuucucgaaau

SEQ ID NO: 419519 - RNA, 22 nt, Human
agcaguggcuggauggugugcu

SEQ ID NO: 419520 - RNA, 22 nt, Human
aggcuuuaaguggccuacagcu

SEQ ID NO: 419521 - RNA, 22 nt, Human
aggcacugggggaugagcaagg

SEQ ID NO: 419522 - RNA, 22 nt, Human
aagugaagaaauacaugagaau

SEQ ID NO: 419523 - RNA, 22 nt, Human
acagcuggaggucugugagcac

SEQ ID NO: 419524 - RNA, 21 nt, Human
agaggcaggcauuaaguacac

SEQ ID NO: 419525 - RNA, 22 nt, Human
gcuggccugaccagccacaggc

SEQ ID NO: 419526 - RNA, 22 nt, Human
gcugccugcacagagcugcuuu

SEQ ID NO: 419527 - RNA, 22 nt, Human
uugaagcauuguggcuuguauu

SEQ ID NO: 419528 - RNA, 21 nt, Human
gcagccagccgagaccaugcc

SEQ ID NO: 419529 - RNA, 22 nt, Human
gagcugcuggcuccucagguua

SEQ ID NO: 419530 - RNA, 21 nt, Human
gagcucucaggcaagaagcag

SEQ ID NO: 419531 - RNA, 22 nt, Human
gucagcugucuccccagagugg

SEQ ID NO: 419532 - RNA, 22 nt, Human
cucugcuuggaacuggacagaa

SEQ ID NO: 419533 - RNA, 22 nt, Human
auggcaagcaagcugaagagau

SEQ ID NO: 419534 - RNA, 22 nt, Human
ugccugucuccucugcagggug

SEQ ID NO: 419535 - RNA, 22 nt, Human
cuuuggcaaugaaacacaagaa

SEQ ID NO: 419536 - RNA, 22 nt, Human
gcucaggaaaacagucuaguaa

SEQ ID NO: 419537 - RNA, 22 nt, Human
ucauugcagcuucagguguuca

SEQ ID NO: 419538 - RNA, 22 nt, Human
ccaggcagggcucaaggaaccu

SEQ ID NO: 419539 - RNA, 22 nt, Human
agcagccauagauagcaugcaa

SEQ ID NO: 419540 - RNA, 22 nt, Human
uggcagaguucgcuccuauuca

SEQ ID NO: 419541 - RNA, 22 nt, Human
aagauuuagggccaguuuacau

SEQ ID NO: 419542 - RNA, 22 nt, Human
uccaggcuaauuuugcauuguu

SEQ ID NO: 419543 - RNA, 22 nt, Human
uggaggcauuuuagguugucac

SEQ ID NO: 419544 - RNA, 22 nt, Human
aagcccaguuucacacugagac

SEQ ID NO: 419545 - RNA, 22 nt, Human
cagagcagggguuucccagguu

SEQ ID NO: 419546 - RNA, 22 nt, Human
ugggcccaagagagucuccaac

SEQ ID NO: 419547 - RNA, 23 nt, Human
uauuacaauuggucuuauuaaga

SEQ ID NO: 419548 - RNA, 22 nt, Human
aucaguuuggaacauucaggcc

SEQ ID NO: 419549 - RNA, 21 nt, Human
ugaaugaggaggauggcauuu

SEQ ID NO: 419550 - RNA, 22 nt, Human
guaaucucagcuacuugggagg

SEQ ID NO: 419551 - RNA, 22 nt, Human
auucuccagcucacuguccaua

SEQ ID NO: 419552 - RNA, 22 nt, Human
agcaggagagcagugcgugguc

SEQ ID NO: 419553 - RNA, 22 nt, Human
aggcagguguuaccucugguuu

SEQ ID NO: 419554 - RNA, 23 nt, Human
uuaggcacuuaguagggccagag

SEQ ID NO: 419555 - RNA, 18 nt, Human
cagaggagagacauucag

SEQ ID NO: 419556 - RNA, 22 nt, Human
ucauugaacgaagagcuccauu

SEQ ID NO: 419557 - RNA, 20 nt, Human
uggcuccucuuggcuguggc

SEQ ID NO: 419558 - RNA, 22 nt, Human
uucaaaauuguucuaagcucug

SEQ ID NO: 419559 - RNA, 22 nt, Human
ucucacagugcaggucugucuc

SEQ ID NO: 419560 - RNA, 22 nt, Human
agcccaaggcuucccugcuggc

SEQ ID NO: 419561 - RNA, 22 nt, Human
agucauaauuauaaacaucagu

SEQ ID NO: 419562 - RNA, 22 nt, Human
auccuugagccaaugacugauu

SEQ ID NO: 419563 - RNA, 22 nt, Human
ccacuggcauccagcugccauc

SEQ ID NO: 419564 - RNA, 22 nt, Human
gcagaggccaucaacuuugcca

SEQ ID NO: 419565 - RNA, 22 nt, Human
uguaucaaaccaaauuaauucu

SEQ ID NO: 419566 - RNA, 22 nt, Human
gggcugugcugaguaggaggug

SEQ ID NO: 419567 - RNA, 22 nt, Human
cugggccucauccucagaguuu

SEQ ID NO: 419568 - RNA, 22 nt, Human
uccugccugagcguggaggagg

SEQ ID NO: 419569 - RNA, 22 nt, Human
aacuguaagacaaaugacuucu

SEQ ID NO: 419570 - RNA, 22 nt, Human
gcacugaaugcuuuuacuguaa

SEQ ID NO: 419571 - RNA, 22 nt, Human
guccucugacucagccuuggga

SEQ ID NO: 419572 - RNA, 22 nt, Human
cugcagccuaggugcagcuggg

SEQ ID NO: 419573 - RNA, 22 nt, Human
cagagcuggagaaguggauuua

SEQ ID NO: 419574 - RNA, 22 nt, Human
cagggccuuuuagcaucuucuc

SEQ ID NO: 419575 - RNA, 22 nt, Human
cacauuucugugagucaauauu

SEQ ID NO: 419576 - RNA, 22 nt, Human
cauaagaaauaaugaugaugac

SEQ ID NO: 419577 - RNA, 22 nt, Human
ucaguggaguauggaugaaguc

SEQ ID NO: 419578 - RNA, 22 nt, Human
agcaaacagugugcuaagaaau

SEQ ID NO: 419579 - RNA, 22 nt, Human
guuccacaaaauguacccaguu

SEQ ID NO: 419580 - RNA, 20 nt, Human
aauguauauuuuaugccagg

SEQ ID NO: 419581 - RNA, 23 nt, Human
aggagccaggugcagcccuugug

SEQ ID NO: 419582 - RNA, 22 nt, Human
guggccucuguuggcuccuagg

SEQ ID NO: 419583 - RNA, 22 nt, Human
agcugcuccuuuccugcaggcg

SEQ ID NO: 419584 - RNA, 22 nt, Human
ugcagaagcugcaggucagugg

SEQ ID NO: 419585 - RNA, 21 nt, Human
gcacagcaugaguguuggcau

SEQ ID NO: 419586 - RNA, 22 nt, Human
uagcugccuaugugauaagaga

SEQ ID NO: 419587 - RNA, 22 nt, Human
ggucucuguugccuccaucaag

SEQ ID NO: 419588 - RNA, 22 nt, Human
ccuggccagaggcgugccugug

SEQ ID NO: 419589 - RNA, 22 nt, Human
cucuguagaaacagggcagaag

SEQ ID NO: 419590 - RNA, 22 nt, Human
cacucccuucaggagccuagga

SEQ ID NO: 419591 - RNA, 22 nt, Human
caggugucuaauucucaccccc

SEQ ID NO: 419592 - RNA, 22 nt, Human
ggcucaggggccaggccugucc

SEQ ID NO: 419593 - RNA, 22 nt, Human
gagacauggcaaaagcacuggu

SEQ ID NO: 419594 - RNA, 22 nt, Human
guccucaggaaagcagauaaca

SEQ ID NO: 419595 - RNA, 22 nt, Human
gagccagguuggaggcugcagu

SEQ ID NO: 419596 - RNA, 22 nt, Human
guggaaguagauuugagaaggu

SEQ ID NO: 419597 - RNA, 22 nt, Human
ugggggugacuaucucgggaau

SEQ ID NO: 419598 - RNA, 18 nt, Human
uccugcagcuucuaugua

SEQ ID NO: 419599 - RNA, 22 nt, Human
uuuccucuucgauuaaguuugg

SEQ ID NO: 419600 - RNA, 22 nt, Human
aaagacuuggcuuaugauuugc

SEQ ID NO: 419601 - RNA, 22 nt, Human
ugccaggcccagcuccagagcu

SEQ ID NO: 419602 - RNA, 22 nt, Human
cugaagccacgauagcuuccua

SEQ ID NO: 419603 - RNA, 22 nt, Human
ggcagcugagcauggcuaccuu

SEQ ID NO: 419604 - RNA, 22 nt, Human
caguacuuugaagauauuuuag

SEQ ID NO: 419605 - RNA, 21 nt, Human
cacuggaauuuucugugacau

SEQ ID NO: 419606 - RNA, 20 nt, Human
uaucaaucagaaagaagacu

SEQ ID NO: 419607 - RNA, 22 nt, Human
gggcucugcgcucagcuccagc

SEQ ID NO: 419608 - RNA, 22 nt, Human
gaaaguuuauagguuauauaau

SEQ ID NO: 419609 - RNA, 22 nt, Human
cagccugacaccagcuuugggc

SEQ ID NO: 419610 - RNA, 20 nt, Human
ucauuguguugccaauuccc

SEQ ID NO: 419611 - RNA, 22 nt, Human
aagacugugucuauggcuacuc

SEQ ID NO: 419612 - RNA, 22 nt, Human
ccuuucucuaucgacccaucgc

SEQ ID NO: 419613 - RNA, 22 nt, Human
ugucauaaaacacaagcuguug

SEQ ID NO: 419614 - RNA, 22 nt, Human
cuaguucuagaucccugaggaa

SEQ ID NO: 419615 - RNA, 21 nt, Human
uugaaaguaaauucagcagcu

SEQ ID NO: 419616 - RNA, 22 nt, Human
ccugcucagccccagcucaccc

SEQ ID NO: 419617 - RNA, 22 nt, Human
uccagccuaggggaacagcugc

SEQ ID NO: 419618 - RNA, 22 nt, Human
aacauugccaugguuaauuuua

SEQ ID NO: 419619 - RNA, 22 nt, Human
ucagucuucccuccagugcaac

SEQ ID NO: 419620 - RNA, 22 nt, Human
cugcaggcccccuuccuggagu

SEQ ID NO: 419621 - RNA, 22 nt, Human
ccuccagggcagacggggagca

SEQ ID NO: 419622 - RNA, 22 nt, Human
acaguggaguugggguagcccu

SEQ ID NO: 419623 - RNA, 22 nt, Human
uuugucuuguguccuuaggacc

SEQ ID NO: 419624 - RNA, 22 nt, Human
auggggcugggauucuccucgg

SEQ ID NO: 419625 - RNA, 22 nt, Human
cccucugaccuccugccacagu

SEQ ID NO: 419626 - RNA, 21 nt, Human
ucagcuuugcaacugcacauc

SEQ ID NO: 419627 - RNA, 22 nt, Human
uuucaaaguggagaauuagaca

SEQ ID NO: 419628 - RNA, 22 nt, Human
cuucugggcauucagcugcaca

SEQ ID NO: 419629 - RNA, 22 nt, Human
gcuucucgggccugaugucguc

SEQ ID NO: 419630 - RNA, 22 nt, Human
gaggaguggaguugcuggguug

SEQ ID NO: 419631 - RNA, 22 nt, Human
cacuacuugaaagaauuacaga

SEQ ID NO: 419632 - RNA, 22 nt, Human
uugccucccagcaugggcagcu

SEQ ID NO: 419633 - RNA, 22 nt, Human
uggccugggccugccggugcaa

SEQ ID NO: 419634 - RNA, 22 nt, Human
acuuggcaaguaucuauaaagu

SEQ ID NO: 419635 - RNA, 22 nt, Human
aguggccagugcugcucugggg

SEQ ID NO: 419636 - RNA, 22 nt, Human
uuguuucaaauauuucagaaua

SEQ ID NO: 419637 - RNA, 22 nt, Human
aggcugggcaccguuuugaucc

SEQ ID NO: 419638 - RNA, 22 nt, Human
cugggcacagcguugggcucuu

SEQ ID NO: 419639 - RNA, 22 nt, Human
uaagcauucaaugcuuagcacu

SEQ ID NO: 419640 - RNA, 22 nt, Human
ugaaagcagcaccaauaccauu

SEQ ID NO: 419641 - RNA, 22 nt, Human
gggcugaccccaccccucacuc

SEQ ID NO: 419642 - RNA, 22 nt, Human
uuacaaagagugccagagugug

SEQ ID NO: 419643 - RNA, 22 nt, Human
caaagugcuggaauuacaggug

SEQ ID NO: 419644 - RNA, 22 nt, Human
cagggugcagugucgcugcuag

SEQ ID NO: 419645 - RNA, 22 nt, Human
aacaacugaaaagcuuuuucug

SEQ ID NO: 419646 - RNA, 22 nt, Human
gagugugucggucagcguggcg

SEQ ID NO: 419647 - RNA, 22 nt, Human
agagugcaaccgaaacaagcag

SEQ ID NO: 419648 - RNA, 18 nt, Human
ugaacagaugaguugaag

SEQ ID NO: 419649 - RNA, 22 nt, Human
uggaggaugagugugggcucug

SEQ ID NO: 419650 - RNA, 22 nt, Human
ugcugggcuaggguggagcucu

SEQ ID NO: 419651 - RNA, 22 nt, Human
caagagcucagaaacccuugcu

SEQ ID NO: 419652 - RNA, 22 nt, Human
acaggcacugucaagucaugaa

SEQ ID NO: 419653 - RNA, 22 nt, Human
uugaagcaggaaaauuucuauu

SEQ ID NO: 419654 - RNA, 22 nt, Human
gggcacuggaaggcucucaggc

SEQ ID NO: 419655 - RNA, 22 nt, Human
acaggcugcccgcuccccaccu

SEQ ID NO: 419656 - RNA, 22 nt, Human
uuugacaggacuaacauauggc

SEQ ID NO: 419657 - RNA, 22 nt, Human
cugccuggucucaggcaugggg

SEQ ID NO: 419658 - RNA, 22 nt, Human
ucaagcaucuuggucuacgauc

SEQ ID NO: 419659 - RNA, 22 nt, Human
ggagaagcagcuucuugaugaa

SEQ ID NO: 419660 - RNA, 22 nt, Human
augugaaacugaagcauccaua

SEQ ID NO: 419661 - RNA, 22 nt, Human
ucaguuuuuaagaguuaugcga

SEQ ID NO: 419662 - RNA, 22 nt, Human
uggcccugacuuggaggccuga

SEQ ID NO: 419663 - RNA, 18 nt, Human
uguacaguuaugagcauu

SEQ ID NO: 419664 - RNA, 22 nt, Human
uagggcagcugcaucaggcacu

SEQ ID NO: 419665 - RNA, 22 nt, Human
aaaacauguccauacagaaacu

SEQ ID NO: 419666 - RNA, 22 nt, Human
acagcuguggggacucuugccc

SEQ ID NO: 419667 - RNA, 18 nt, Human
agaagccacgaggagucc

SEQ ID NO: 419668 - RNA, 22 nt, Human
augcaucuauucccaagggcag

SEQ ID NO: 419669 - RNA, 22 nt, Human
acagaaauauucguggugcuug

SEQ ID NO: 419670 - RNA, 22 nt, Human
uccauuuucuugcucuagguaa

SEQ ID NO: 419671 - RNA, 22 nt, Human
gcugccugauguccagcaggac

SEQ ID NO: 419672 - RNA, 22 nt, Human
cagaggaaguuccuugaugaga

SEQ ID NO: 419673 - RNA, 22 nt, Human
uuugcauuuuagauuuaggccu

SEQ ID NO: 419674 - RNA, 22 nt, Human
agggaggaccaaugugugguua

SEQ ID NO: 419675 - RNA, 22 nt, Human
cauugcugugggcauuugcugc

SEQ ID NO: 419676 - RNA, 22 nt, Human
ucaauuaugccauugcaauauu

SEQ ID NO: 419677 - RNA, 22 nt, Human
ggucaggguuccagguaucuuc

SEQ ID NO: 419678 - RNA, 22 nt, Human
caaaugcaugagaaauaagagg

SEQ ID NO: 419679 - RNA, 22 nt, Human
accagguggccccagcgugguu

SEQ ID NO: 419680 - RNA, 22 nt, Human
aggugauguccacagcuugcag

SEQ ID NO: 419681 - RNA, 22 nt, Human
cuggcucccagcuuucagggag

SEQ ID NO: 419682 - RNA, 22 nt, Human
cuggagcccaggccuggugucu

SEQ ID NO: 419683 - RNA, 20 nt, Human
ucaaaggcaaaggugggugu

SEQ ID NO: 419684 - RNA, 22 nt, Human
ugggauaguggccaggaccccc

SEQ ID NO: 419685 - RNA, 22 nt, Human
gcugagcuagaaaaggaccaca

SEQ ID NO: 419686 - RNA, 22 nt, Human
gaagcccuauccucuccuggga

SEQ ID NO: 419687 - RNA, 22 nt, Human
acucccagguugccuggcaggc

SEQ ID NO: 419688 - RNA, 22 nt, Human
aucucccagccacagcauucuu

SEQ ID NO: 419689 - RNA, 22 nt, Human
uccaugucuucaugugucuaac

SEQ ID NO: 419690 - RNA, 20 nt, Human
caggaugauuggacacgaug

SEQ ID NO: 419691 - RNA, 22 nt, Human
ucuuacauauagcaugaguaca

SEQ ID NO: 419692 - RNA, 22 nt, Human
aaggcagcccuggcucagccug

SEQ ID NO: 419693 - RNA, 17 nt, Human
agugacuuggaaagagc

SEQ ID NO: 419694 - RNA, 22 nt, Human
ugggccuggagcccuggagagu

SEQ ID NO: 419695 - RNA, 22 nt, Human
uacaggaggauuaucaaaggau

SEQ ID NO: 419696 - RNA, 17 nt, Human
aggugcuggagcaucag

SEQ ID NO: 419697 - RNA, 22 nt, Human
gaggcaggcagauugcuugagg

SEQ ID NO: 419698 - RNA, 22 nt, Human
uccagugguuugaaaggggugu

SEQ ID NO: 419699 - RNA, 22 nt, Human
gcagagccugggggucugcgga

SEQ ID NO: 419700 - RNA, 22 nt, Human
ggucuuccgagaggccugugcu

SEQ ID NO: 419701 - RNA, 22 nt, Human
cugucccucaucaccucugggu

SEQ ID NO: 419702 - RNA, 22 nt, Human
agccacagcaacaagugcaauu

SEQ ID NO: 419703 - RNA, 22 nt, Human
gcucuggaagcaucugagagga

SEQ ID NO: 419704 - RNA, 22 nt, Human
ggcuccucucuggccgcucccg

SEQ ID NO: 419705 - RNA, 22 nt, Human
aggcucagauccuuguguccug

SEQ ID NO: 419706 - RNA, 22 nt, Human
aagggacccuggaucaaaugga

SEQ ID NO: 419707 - RNA, 22 nt, Human
caauagcagcuucugaaugcaa

SEQ ID NO: 419708 - RNA, 22 nt, Human
aaccaggacaauuuugaaagua

SEQ ID NO: 419709 - RNA, 22 nt, Human
uugcauugugauuacagaggug

SEQ ID NO: 419710 - RNA, 22 nt, Human
uggcugagccacuuguucagau

SEQ ID NO: 419711 - RNA, 22 nt, Human
ccuggagcaaaaaucuaaggag

SEQ ID NO: 419712 - RNA, 22 nt, Human
gggacaggccccucgcuagcuu

SEQ ID NO: 419713 - RNA, 22 nt, Human
ccuggagcacauggcaggaggc

SEQ ID NO: 419714 - RNA, 22 nt, Human
auguguuuguaccuuuaaauau

SEQ ID NO: 419715 - RNA, 22 nt, Human
auguccagagccggccugcuga

SEQ ID NO: 419716 - RNA, 19 nt, Human
cugagcagcggcagcacuu

SEQ ID NO: 419717 - RNA, 22 nt, Human
uccagggaaggugugaggcugg

SEQ ID NO: 419718 - RNA, 22 nt, Human
cugucagcacucuacuacagau

SEQ ID NO: 419719 - RNA, 22 nt, Human
uaacaucuuuagcagcucgaac

SEQ ID NO: 419720 - RNA, 22 nt, Human
accagggcugacaaucugaugg

SEQ ID NO: 419721 - RNA, 22 nt, Human
ugggggugugccagggaccucc

SEQ ID NO: 419722 - RNA, 22 nt, Human
gaaaagggcaagagagagggca

SEQ ID NO: 419723 - RNA, 22 nt, Human
uggcucuguuuguuaacuagac

SEQ ID NO: 419724 - RNA, 22 nt, Human
agggccucuaccauccaagguu

SEQ ID NO: 419725 - RNA, 22 nt, Human
gccugugcauagcagcggacuc

SEQ ID NO: 419726 - RNA, 22 nt, Human
uguuuuaugagccauauaaccu

SEQ ID NO: 419727 - RNA, 22 nt, Human
aagcccagaugugagaacugag

SEQ ID NO: 419728 - RNA, 22 nt, Human
caggcugcggucggcucugguc

SEQ ID NO: 419729 - RNA, 22 nt, Human
guucacauccuugugaggauuu

SEQ ID NO: 419730 - RNA, 22 nt, Human
acauuucuccuacuuguuauuu

SEQ ID NO: 419731 - RNA, 23 nt, Human
cauuucugggagauuuauaaaau

SEQ ID NO: 419732 - RNA, 22 nt, Human
uccuggccucacaguccugggu

SEQ ID NO: 419733 - RNA, 22 nt, Human
gaugugggguugagggaccagc

SEQ ID NO: 419734 - RNA, 22 nt, Human
gagcaggaugggagcuggggcc

SEQ ID NO: 419735 - RNA, 22 nt, Human
ccagagcaauucucacagaacu

SEQ ID NO: 419736 - RNA, 22 nt, Human
aaauaauguuaggccuuugcuc

SEQ ID NO: 419737 - RNA, 22 nt, Human
ugaauggucacugagcaucugu

SEQ ID NO: 419738 - RNA, 22 nt, Human
agcagaagaaagccacaugacu

SEQ ID NO: 419739 - RNA, 22 nt, Human
cucugcagaggcccaaggcuga

SEQ ID NO: 419740 - RNA, 22 nt, Human
uggagugaaguaaagaggacaa

SEQ ID NO: 419741 - RNA, 22 nt, Human
gcacugaaaauguuggauucca

SEQ ID NO: 419742 - RNA, 22 nt, Human
uccaggcaaaaaccaacuacag

SEQ ID NO: 419743 - RNA, 22 nt, Human
ugcuagaauaccuaccuggagg

SEQ ID NO: 419744 - RNA, 22 nt, Human
gccagcugguaggcaccuagcc

SEQ ID NO: 419745 - RNA, 22 nt, Human
gcugccuguggcccuucugggu

SEQ ID NO: 419746 - RNA, 22 nt, Human
ucagcuggauguggaagugcua

SEQ ID NO: 419747 - RNA, 22 nt, Human
ugcuggggucauggggcgcccg

SEQ ID NO: 419748 - RNA, 22 nt, Human
agcucccaggcagucaugagga

SEQ ID NO: 419749 - RNA, 22 nt, Human
cucccagagagcaggugggccg

SEQ ID NO: 419750 - RNA, 22 nt, Human
gcagggcuguggacacuuuggu

SEQ ID NO: 419751 - RNA, 22 nt, Human
gagggcagagacagugauucac

SEQ ID NO: 419752 - RNA, 22 nt, Human
aguucccaggugaugcugaugu

SEQ ID NO: 419753 - RNA, 22 nt, Human
aagcaaaagguuacacuucugg

SEQ ID NO: 419754 - RNA, 22 nt, Human
uucugcaggagcccuaguguau

SEQ ID NO: 419755 - RNA, 22 nt, Human
ggcaggaggugaguggcgggug

SEQ ID NO: 419756 - RNA, 22 nt, Human
ggcagggaggaggugaaaguga

SEQ ID NO: 419757 - RNA, 22 nt, Human
ucuggccuuaucuguccaagcc

SEQ ID NO: 419758 - RNA, 22 nt, Human
uggcagggaguugcaggauuuc

SEQ ID NO: 419759 - RNA, 19 nt, Human
ggacacagaaagcugcauu

SEQ ID NO: 419760 - RNA, 22 nt, Human
gccugugacucgucuugggcca

SEQ ID NO: 419761 - RNA, 22 nt, Human
acaaauguggacauggauaaug

SEQ ID NO: 419762 - RNA, 22 nt, Human
cacccagcacagagggaggcga

SEQ ID NO: 419763 - RNA, 20 nt, Human
gcagggcaagggauaugaaa

SEQ ID NO: 419764 - RNA, 22 nt, Human
aaggcagccucugccagccggg

SEQ ID NO: 419765 - RNA, 22 nt, Human
aggcugugagcaagaacaccua

SEQ ID NO: 419766 - RNA, 22 nt, Human
uuuuuaaugcagucugagacau

SEQ ID NO: 419767 - RNA, 22 nt, Human
aagaugcagcuuuacaauaagg

SEQ ID NO: 419768 - RNA, 22 nt, Human
uccuucagaggacggcagccag

SEQ ID NO: 419769 - RNA, 22 nt, Human
agccuggcacugaggcagggcg

SEQ ID NO: 419770 - RNA, 22 nt, Human
aggccuuccucggagacaggga

SEQ ID NO: 419771 - RNA, 17 nt, Human
gcaaucucagucuccuu

SEQ ID NO: 419772 - RNA, 22 nt, Human
agagccuguuuugugggagaug

SEQ ID NO: 419773 - RNA, 22 nt, Human
ugcagggcuacaggacuacaac

SEQ ID NO: 419774 - RNA, 16 nt, Human
gaggcuggcagauguc

SEQ ID NO: 419775 - RNA, 22 nt, Human
cugcagagguugguucuaagau

SEQ ID NO: 419776 - RNA, 22 nt, Human
uccuuuuuauaguuagagaaac

SEQ ID NO: 419777 - RNA, 22 nt, Human
cuagagaggcagauguccugug

SEQ ID NO: 419778 - RNA, 22 nt, Human
uggucucugacucugaagaccc

SEQ ID NO: 419779 - RNA, 22 nt, Human
cauucucaauaguagaugagua

SEQ ID NO: 419780 - RNA, 22 nt, Human
cauuaucugccauugacaccau

SEQ ID NO: 419781 - RNA, 22 nt, Human
agccuggcacugccccauccau

SEQ ID NO: 419782 - RNA, 22 nt, Human
uuuuaaucaugcuucuaugucc

SEQ ID NO: 419783 - RNA, 22 nt, Human
gaggaacccagcugggguugcc

SEQ ID NO: 419784 - RNA, 22 nt, Human
uguuuaagcugaugagguaucg

SEQ ID NO: 419785 - RNA, 22 nt, Human
ucugccuggauuuuggaaagcu

SEQ ID NO: 419786 - RNA, 22 nt, Human
ccagcagagggucuuggccauu

SEQ ID NO: 419787 - RNA, 22 nt, Human
cugccuuugcccuugacacugu

SEQ ID NO: 419788 - RNA, 22 nt, Human
gccucugccaagggggcugcgg

SEQ ID NO: 419789 - RNA, 22 nt, Human
uaaauucugaucaaguuccuuc

SEQ ID NO: 419790 - RNA, 22 nt, Human
cugagcugggaguggauagugg

SEQ ID NO: 419791 - RNA, 22 nt, Human
ucagcuuucucuucuaucgaua

SEQ ID NO: 419792 - RNA, 22 nt, Human
ugaggcagugcugggaagccug

SEQ ID NO: 419793 - RNA, 22 nt, Human
gugccagcucuccccacaucug

SEQ ID NO: 419794 - RNA, 22 nt, Human
ucaggagauguaaccuuagcug

SEQ ID NO: 419795 - RNA, 23 nt, Human
auugaugacuugauuacacuuuu

SEQ ID NO: 419796 - RNA, 22 nt, Human
cuacagaaaaucagccacaggc

SEQ ID NO: 419797 - RNA, 22 nt, Human
uuucccaauugagagguucugu

SEQ ID NO: 419798 - RNA, 22 nt, Human
ccagagagucgaugggggacac

SEQ ID NO: 419799 - RNA, 22 nt, Human
uuaggaaauuaugguuucagau

SEQ ID NO: 419800 - RNA, 22 nt, Human
caaagguaaagaucugcugugg

SEQ ID NO: 419801 - RNA, 18 nt, Human
uuucacagauucaugacu

SEQ ID NO: 419802 - RNA, 22 nt, Human
agcagggcucacauuaguggau

SEQ ID NO: 419803 - RNA, 22 nt, Human
ucugccuguucaagucuucuag

SEQ ID NO: 419804 - RNA, 22 nt, Human
ccaccuccaccuauugccagcc

SEQ ID NO: 419805 - RNA, 22 nt, Human
cugacucccaaagaggacgcgu

SEQ ID NO: 419806 - RNA, 22 nt, Human
aagcugcccuguguuagaguuc

SEQ ID NO: 419807 - RNA, 22 nt, Human
ucucagagggaaaggccaauuu

SEQ ID NO: 419808 - RNA, 22 nt, Human
gcucccaccuuugcuaucagua

SEQ ID NO: 419809 - RNA, 22 nt, Human
aaggccaggagacuuggaguca

SEQ ID NO: 419810 - RNA, 22 nt, Human
cucuguccacagguuugucccu

SEQ ID NO: 419811 - RNA, 22 nt, Human
uagcauuuauggucaugugucc

SEQ ID NO: 419812 - RNA, 22 nt, Human
augaguucaauuguuucaguca

SEQ ID NO: 419813 - RNA, 22 nt, Human
cagagccagcuguccuuggcau

SEQ ID NO: 419814 - RNA, 22 nt, Human
uggggcuguggauucucacgaa

SEQ ID NO: 419815 - RNA, 20 nt, Human
ucagugauuuugaagaggaa

SEQ ID NO: 419816 - RNA, 22 nt, Human
auugaggcagcauaguucaggg

SEQ ID NO: 419817 - RNA, 22 nt, Human
gcucucuggguggugggcaaca

SEQ ID NO: 419818 - RNA, 22 nt, Human
cugggaggcccacguugggaag

SEQ ID NO: 419819 - RNA, 22 nt, Human
aacagacagaaaaaugugaucu

SEQ ID NO: 419820 - RNA, 22 nt, Human
cauuugcagagggugacacucu

SEQ ID NO: 419821 - RNA, 22 nt, Human
cagggcagagccaggauuucaa

SEQ ID NO: 419822 - RNA, 22 nt, Human
aaggaggagcggaggcuuguug

SEQ ID NO: 419823 - RNA, 22 nt, Human
aggaggccccuccuggguugcu

SEQ ID NO: 419824 - RNA, 22 nt, Human
ucacauuuucauauucucugag

SEQ ID NO: 419825 - RNA, 22 nt, Human
gacugccagaaugugaggccug

SEQ ID NO: 419826 - RNA, 22 nt, Human
cucugggcaaagaugccucauc

SEQ ID NO: 419827 - RNA, 22 nt, Human
ggccacuccgcugcuacuggaa

SEQ ID NO: 419828 - RNA, 22 nt, Human
gagguagcaugcuggaagggac

SEQ ID NO: 419829 - RNA, 22 nt, Human
uuucacaaguuucaggauucug

SEQ ID NO: 419830 - RNA, 22 nt, Human
ucaccagucuuucuuaccauug

SEQ ID NO: 419831 - RNA, 22 nt, Human
aaaugcaauuguauguacucca

SEQ ID NO: 419832 - RNA, 22 nt, Human
gacaggggucccucugggcugu

SEQ ID NO: 419833 - RNA, 22 nt, Human
uuuucacacaaggugauaaguu

SEQ ID NO: 419834 - RNA, 22 nt, Human
cagaacugggcagggagcagag

SEQ ID NO: 419835 - RNA, 22 nt, Human
ggcagagaugugggucagaauc

SEQ ID NO: 419836 - RNA, 22 nt, Human
cagggccauuggcguggcuguc

SEQ ID NO: 419837 - RNA, 22 nt, Human
ccagagcuaaacacacaggcug

SEQ ID NO: 419838 - RNA, 18 nt, Human
acaaauguagugucuuaa

SEQ ID NO: 419839 - RNA, 22 nt, Human
uaguucuucaugaauucagcuu

SEQ ID NO: 419840 - RNA, 22 nt, Human
ccauccuaucugaccuacuugu

SEQ ID NO: 419841 - RNA, 22 nt, Human
agcagcagaggucagaaaggua

SEQ ID NO: 419842 - RNA, 22 nt, Human
acagcagcuaaaggugucuccu

SEQ ID NO: 419843 - RNA, 22 nt, Human
gggccuggggacaccaccauga

SEQ ID NO: 419844 - RNA, 22 nt, Human
aacauguagcagaaacgacuaa

SEQ ID NO: 419845 - RNA, 22 nt, Human
acuuaguauuuuucagcuuuga

SEQ ID NO: 419846 - RNA, 21 nt, Human
gaggccacuaauaggggcaga

SEQ ID NO: 419847 - RNA, 22 nt, Human
cuccagggagcugcgggagcca

SEQ ID NO: 419848 - RNA, 22 nt, Human
gcagcugcagguggucccaugc

SEQ ID NO: 419849 - RNA, 22 nt, Human
agaggggcucauauccugucau

SEQ ID NO: 419850 - RNA, 22 nt, Human
uggagccauaacccuuucguac

SEQ ID NO: 419851 - RNA, 22 nt, Human
uuuuaagaugcuaguauuucag

SEQ ID NO: 419852 - RNA, 22 nt, Human
cagcugaguuuccaagucugcc

SEQ ID NO: 419853 - RNA, 22 nt, Human
ugcccaaguccuccaccgaggu

SEQ ID NO: 419854 - RNA, 22 nt, Human
uccagggcugacuugggagagg

SEQ ID NO: 419855 - RNA, 19 nt, Human
ccuguacauuauucucccc

SEQ ID NO: 419856 - RNA, 23 nt, Human
uggcagcuguguaagagaaagca

SEQ ID NO: 419857 - RNA, 22 nt, Human
caugucuuauauccugucuuca

SEQ ID NO: 419858 - RNA, 22 nt, Human
ucugggagauccaagcagaacu

SEQ ID NO: 419859 - RNA, 22 nt, Human
uagggcagccuuauagcuccca

SEQ ID NO: 419860 - RNA, 22 nt, Human
uguccucuaauuggccucuugc

SEQ ID NO: 419861 - RNA, 22 nt, Human
agggcugaaacauaauccuucu

SEQ ID NO: 419862 - RNA, 22 nt, Human
ugcugaaggcaggggagguggc

SEQ ID NO: 419863 - RNA, 22 nt, Human
ccuggaggcucugggagggcag

SEQ ID NO: 419864 - RNA, 22 nt, Human
aggucagcugcugauaggcagc

SEQ ID NO: 419865 - RNA, 22 nt, Human
gggcacugcuuugcucugucac

SEQ ID NO: 419866 - RNA, 22 nt, Human
ugagcuguagcagaugcuguug

SEQ ID NO: 419867 - RNA, 22 nt, Human
acccuggacuggggcugaggcu

SEQ ID NO: 419868 - RNA, 19 nt, Human
uugaaauuguuugauaugg

SEQ ID NO: 419869 - RNA, 22 nt, Human
gggucuggacggcugcaggaag

SEQ ID NO: 419870 - RNA, 22 nt, Human
ucagcugcucuguugagcugaa

SEQ ID NO: 419871 - RNA, 22 nt, Human
ggagccagggaagcugcuuccu

SEQ ID NO: 419872 - RNA, 22 nt, Human
cagugucuuauuuguagcucag

SEQ ID NO: 419873 - RNA, 22 nt, Human
acacuuuacagcuuccuuugca

SEQ ID NO: 419874 - RNA, 22 nt, Human
cagugcaugaaacaauaugcag

SEQ ID NO: 419875 - RNA, 21 nt, Human
uggaccuguccuucucgcugu

SEQ ID NO: 419876 - RNA, 22 nt, Human
agcugcccccagggcugugcuu

SEQ ID NO: 419877 - RNA, 22 nt, Human
ucuccgaucacagguuuucaau

SEQ ID NO: 419878 - RNA, 22 nt, Human
gcagagugaagcaguauggaaa

SEQ ID NO: 419879 - RNA, 18 nt, Human
uggcagggaggaaauaua

SEQ ID NO: 419880 - RNA, 22 nt, Human
cccagggacagcuagguggggc

SEQ ID NO: 419881 - RNA, 22 nt, Human
aggcacugauucucagaguuac

SEQ ID NO: 419882 - RNA, 22 nt, Human
cugggaguugacgaggcuugua

SEQ ID NO: 419883 - RNA, 22 nt, Human
aagcagaauuuaauagaaaggu

SEQ ID NO: 419884 - RNA, 22 nt, Human
uucuuugcccuuaaugaaauaa

SEQ ID NO: 419885 - RNA, 22 nt, Human
ccagggcagaaaaagagggaau

SEQ ID NO: 419886 - RNA, 22 nt, Human
gcaggagcucguuuccaggcug

SEQ ID NO: 419887 - RNA, 22 nt, Human
gccaggcaaauuaaggaaugca

SEQ ID NO: 419888 - RNA, 22 nt, Human
uagaaagugaagguuaauuaau

SEQ ID NO: 419889 - RNA, 22 nt, Human
uagcuuuaggaugguucucuug

SEQ ID NO: 419890 - RNA, 22 nt, Human
uguugaagauaaaguucucauu

SEQ ID NO: 419891 - RNA, 19 nt, Human
ugggcagguucaguaaugg

SEQ ID NO: 419892 - RNA, 22 nt, Human
uacaugaacaaaauagcagaaa

SEQ ID NO: 419893 - RNA, 22 nt, Human
ugucaugccauuuaaaauguuu

SEQ ID NO: 419894 - RNA, 22 nt, Human
cugaggugcuagggucccugcu

SEQ ID NO: 419895 - RNA, 22 nt, Human
gccugccuucggugcgcagcgg

SEQ ID NO: 419896 - RNA, 22 nt, Human
gguucacacuaagcuuaagugg

SEQ ID NO: 419897 - RNA, 22 nt, Human
ggcugugccucaaggcuacuca

SEQ ID NO: 419898 - RNA, 22 nt, Human
gagggcucaacuacuacuaggc

SEQ ID NO: 419899 - RNA, 22 nt, Human
aacuuuauuguuaggggcuaaa

SEQ ID NO: 419900 - RNA, 17 nt, Human
gagauggguggaucacc

SEQ ID NO: 419901 - RNA, 22 nt, Human
uuagauaauguagagauaugag

SEQ ID NO: 419902 - RNA, 22 nt, Human
aggcaggagugacccugacagg

SEQ ID NO: 419903 - RNA, 22 nt, Human
ugcuggggauccguaccaaccc

SEQ ID NO: 419904 - RNA, 22 nt, Human
cugaggccucucuccugggcuu

SEQ ID NO: 419905 - RNA, 22 nt, Human
ggccuguguccuccuugcccug

SEQ ID NO: 419906 - RNA, 20 nt, Human
cacaggccuugugagcagac

SEQ ID NO: 419907 - RNA, 20 nt, Human
cugcucugcuuugcaggugg

SEQ ID NO: 419908 - RNA, 22 nt, Human
acuggaagccaguugacaauca

SEQ ID NO: 419909 - RNA, 22 nt, Human
cagagcagcagagcuuccaugg

SEQ ID NO: 419910 - RNA, 22 nt, Human
cuugccuucuguuccuauagaa

SEQ ID NO: 419911 - RNA, 22 nt, Human
auaaguucagguaaagaaauca

SEQ ID NO: 419912 - RNA, 22 nt, Human
guucuugccagcauccucaggu

SEQ ID NO: 419913 - RNA, 22 nt, Human
cucuggaguggguggccgggag

SEQ ID NO: 419914 - RNA, 22 nt, Human
uaaagguagcaugaaacugcaa

SEQ ID NO: 419915 - RNA, 22 nt, Human
ucagaagcaaacaucacucuag

SEQ ID NO: 419916 - RNA, 22 nt, Human
aggcuucuacguggucccaggg

SEQ ID NO: 419917 - RNA, 22 nt, Human
agcugcucccuauccuuuccuu

SEQ ID NO: 419918 - RNA, 22 nt, Human
cagcuuggaggaggaucuaaga

SEQ ID NO: 419919 - RNA, 22 nt, Human
ucucuggagggcuccaggcggg

SEQ ID NO: 419920 - RNA, 22 nt, Human
gguucccggaucuccgaguccc

SEQ ID NO: 419921 - RNA, 22 nt, Human
acacuguagcugagggcaugcg

SEQ ID NO: 419922 - RNA, 22 nt, Human
ucacaggcuugugaacauugca

SEQ ID NO: 419923 - RNA, 22 nt, Human
gagaaagacguaggcugggagg

SEQ ID NO: 419924 - RNA, 22 nt, Human
cagagcagguaucuuuggugaa

SEQ ID NO: 419925 - RNA, 22 nt, Human
acagagcuaaauuucaauccca

SEQ ID NO: 419926 - RNA, 22 nt, Human
acaaaggcagccaaucaucugc

SEQ ID NO: 419927 - RNA, 22 nt, Human
ggagagcagggaggcugcucug

SEQ ID NO: 419928 - RNA, 22 nt, Human
agcuguggcaaccuugucagac

SEQ ID NO: 419929 - RNA, 22 nt, Human
cugggacacccaaggaaagagc

SEQ ID NO: 419930 - RNA, 22 nt, Human
aaugcagugagccauuaaaugg

SEQ ID NO: 419931 - RNA, 22 nt, Human
ugggcuacucugggagccuaac

SEQ ID NO: 419932 - RNA, 22 nt, Human
aaugggaagccagaagacaagg

SEQ ID NO: 419933 - RNA, 22 nt, Human
gcaaguacaaacgcaucggcug

SEQ ID NO: 419934 - RNA, 22 nt, Human
agggcaaguugagugugcgugg

SEQ ID NO: 419935 - RNA, 22 nt, Human
cccuggggcugagggauggccg

SEQ ID NO: 419936 - RNA, 22 nt, Human
ucccagagcucugacaccagcu

SEQ ID NO: 419937 - RNA, 22 nt, Human
ggccucuguucugcauuccucc

SEQ ID NO: 419938 - RNA, 22 nt, Human
uggcagagucucuccuuuccag

SEQ ID NO: 419939 - RNA, 22 nt, Human
agaaauguuacaguuguuauuu

SEQ ID NO: 419940 - RNA, 22 nt, Human
ggggcaggagguguucucuuuu

SEQ ID NO: 419941 - RNA, 22 nt, Human
acugugugaaacaucaaugugu

SEQ ID NO: 419942 - RNA, 22 nt, Human
cuggcagcugugugaagaacug

SEQ ID NO: 419943 - RNA, 22 nt, Human
cugcugcucagugucaucaugu

SEQ ID NO: 419944 - RNA, 22 nt, Human
ugaggaaacugaggcacagaug

SEQ ID NO: 419945 - RNA, 19 nt, Human
agcuguggaugugggauuu

SEQ ID NO: 419946 - RNA, 22 nt, Human
gaggagaagcuauuggaaggac

SEQ ID NO: 419947 - RNA, 22 nt, Human
caaacugagcaucagaaaguuu

SEQ ID NO: 419948 - RNA, 22 nt, Human
ugaguaauaaacugucuugcuc

SEQ ID NO: 419949 - RNA, 22 nt, Human
uggagcugggguuugaaucugg

SEQ ID NO: 419950 - RNA, 22 nt, Human
agguggaacguucaggugcuag

SEQ ID NO: 419951 - RNA, 22 nt, Human
agccacagcgaaccucucuucc

SEQ ID NO: 419952 - RNA, 22 nt, Human
gcugagacuggcagcaggaagu

SEQ ID NO: 419953 - RNA, 22 nt, Human
ugggcagaggcucugaagucca

SEQ ID NO: 419954 - RNA, 19 nt, Human
accucugcagagauguuua

SEQ ID NO: 419955 - RNA, 22 nt, Human
cagcuuggcuuccgcuuuacug

SEQ ID NO: 419956 - RNA, 21 nt, Human
guuugcaugaacaagucagcc

SEQ ID NO: 419957 - RNA, 22 nt, Human
gccuggcccagggcuccgcagg

SEQ ID NO: 419958 - RNA, 22 nt, Human
aguggcagagccaaguagagcc

SEQ ID NO: 419959 - RNA, 22 nt, Human
uuaguuagucccugguaccuuu

SEQ ID NO: 419960 - RNA, 22 nt, Human
ucucagucagccuugauguccc

SEQ ID NO: 419961 - RNA, 22 nt, Human
cuccuggacauggagcggagga

SEQ ID NO: 419962 - RNA, 19 nt, Human
gaagaagcuugagaaguag

SEQ ID NO: 419963 - RNA, 22 nt, Human
ugaaaucugcaugcaaaguccu

SEQ ID NO: 419964 - RNA, 22 nt, Human
ccugagaccaaguugcagccau

SEQ ID NO: 419965 - RNA, 18 nt, Human
caaagcucacguuccauc

SEQ ID NO: 419966 - RNA, 22 nt, Human
ucugagggugggagaaggagcu

SEQ ID NO: 419967 - RNA, 21 nt, Human
cccuguguuccacagcagaca

SEQ ID NO: 419968 - RNA, 22 nt, Human
gaugcacugcaguauauacugu

SEQ ID NO: 419969 - RNA, 22 nt, Human
augcaguaaaauaggagguaau

SEQ ID NO: 419970 - RNA, 22 nt, Human
caggugaccuuuguccuaaguu

SEQ ID NO: 419971 - RNA, 22 nt, Human
acagaguuaauggauaggcagg

SEQ ID NO: 419972 - RNA, 22 nt, Human
gcagggaggaagagaugcuucc

SEQ ID NO: 419973 - RNA, 22 nt, Human
acauuuaaauaccuauguuucu

SEQ ID NO: 419974 - RNA, 22 nt, Human
ggagugaguacuggaguagcug

SEQ ID NO: 419975 - RNA, 22 nt, Human
gcucucugucguuaugcuucau

SEQ ID NO: 419976 - RNA, 22 nt, Human
uagaaguuaaaggaauacagaa

SEQ ID NO: 419977 - RNA, 20 nt, Human
ccagucccugagcaccaggg

SEQ ID NO: 419978 - RNA, 22 nt, Human
aucuuucaguuucauaccaauu

SEQ ID NO: 419979 - RNA, 22 nt, Human
aaugguuuguaccuguccuugg

SEQ ID NO: 419980 - RNA, 22 nt, Human
ucccuggcagcuaagggugguc

SEQ ID NO: 419981 - RNA, 22 nt, Human
acauuucuuccacaugcugcug

SEQ ID NO: 419982 - RNA, 19 nt, Human
cugcugggugcugagggag

SEQ ID NO: 419983 - RNA, 22 nt, Human
aggaagagcuggaccagaggac

SEQ ID NO: 419984 - RNA, 22 nt, Human
ggacuggacucucaggcucaca

SEQ ID NO: 419985 - RNA, 22 nt, Human
ucuguacaugaguugagaauca

SEQ ID NO: 419986 - RNA, 22 nt, Human
ucccagagcugauaagccuuua

SEQ ID NO: 419987 - RNA, 22 nt, Human
gagggcugcugccagauaugcc

SEQ ID NO: 419988 - RNA, 22 nt, Human
acagggcaaccucugggagacu

SEQ ID NO: 419989 - RNA, 22 nt, Human
cagugauggauauggagaaguc

SEQ ID NO: 419990 - RNA, 22 nt, Human
agcugccccaugagaggcaggu

SEQ ID NO: 419991 - RNA, 22 nt, Human
uggggcagggaugggaaacuau

SEQ ID NO: 419992 - RNA, 22 nt, Human
gaagccaguguuugaagaauuu

SEQ ID NO: 419993 - RNA, 22 nt, Human
agagaggcugggcguagggcuu

SEQ ID NO: 419994 - RNA, 22 nt, Human
ucaagucuugaugagacaaacc

SEQ ID NO: 419995 - RNA, 22 nt, Human
aucuggcuauuucuggucgggg

SEQ ID NO: 419996 - RNA, 22 nt, Human
cccuggaggaccccaauguggc

SEQ ID NO: 419997 - RNA, 16 nt, Human
gccuggaguggcaggg

SEQ ID NO: 419998 - RNA, 22 nt, Human
ccugagcugaacuaagcaguuu

SEQ ID NO: 419999 - RNA, 22 nt, Human
uccucaggugacuagguaucuu

SEQ ID NO: 420000 - RNA, 22 nt, Human
gcugggagaggcccugaaguga

SEQ ID NO: 420001 - RNA, 22 nt, Human
gaagcagccacggggagacaga

SEQ ID NO: 420002 - RNA, 22 nt, Human
auguaucagaaauagcauuggc

SEQ ID NO: 420003 - RNA, 22 nt, Human
guaauuaggaauaaaaugggaa

SEQ ID NO: 420004 - RNA, 22 nt, Human
ugcugaggagguggcugugcuu

SEQ ID NO: 420005 - RNA, 22 nt, Human
acagucucuccacacugcaggg

SEQ ID NO: 420006 - RNA, 20 nt, Human
ucagagucaucaaagauggu

SEQ ID NO: 420007 - RNA, 22 nt, Human
ccuauugacaauucucuucucc

SEQ ID NO: 420008 - RNA, 22 nt, Human
agagcugugcuuugcaccacgu

SEQ ID NO: 420009 - RNA, 22 nt, Human
ggccugagucccaccuggcugu

SEQ ID NO: 420010 - RNA, 22 nt, Human
gcagagccaggcuggggcaggu

SEQ ID NO: 420011 - RNA, 22 nt, Human
ugaaauauuuagagaguaaguu

SEQ ID NO: 420012 - RNA, 22 nt, Human
ucacucagguucaugucuuugu

SEQ ID NO: 420013 - RNA, 22 nt, Human
uugaaagucacaauggcauuaa

SEQ ID NO: 420014 - RNA, 22 nt, Human
caggccucccggugcacacuga

SEQ ID NO: 420015 - RNA, 22 nt, Human
ucccagagaagagcuggaugga

SEQ ID NO: 420016 - RNA, 22 nt, Human
gguguccucaugauuuucuaga

SEQ ID NO: 420017 - RNA, 22 nt, Human
agagugaaguuuuugaaaguga

SEQ ID NO: 420018 - RNA, 22 nt, Human
ugccaggcccucccacagauua

SEQ ID NO: 420019 - RNA, 22 nt, Human
cccugccucugaagcugcucag

SEQ ID NO: 420020 - RNA, 23 nt, Human
aucaaaguggaaaucaauuaucu

SEQ ID NO: 420021 - RNA, 22 nt, Human
agugucauuuuguccaucuucu

SEQ ID NO: 420022 - RNA, 22 nt, Human
gcugucuucacuuccugguuuc

SEQ ID NO: 420023 - RNA, 22 nt, Human
ugaggcucaagaaucugcauuu

SEQ ID NO: 420024 - RNA, 22 nt, Human
aagggcuggaucucucugagca

SEQ ID NO: 420025 - RNA, 22 nt, Human
auggaaagggaagcaaggaaca

SEQ ID NO: 420026 - RNA, 22 nt, Human
cagagccaaaccucagggcccg

SEQ ID NO: 420027 - RNA, 22 nt, Human
augaggcaggauuaagcuauca

SEQ ID NO: 420028 - RNA, 22 nt, Human
cugauuccugauucaugcucuu

SEQ ID NO: 420029 - RNA, 22 nt, Human
cugcucugugguccaugagaca

SEQ ID NO: 420030 - RNA, 22 nt, Human
ggagaggaaaugccagcacuuc

SEQ ID NO: 420031 - RNA, 22 nt, Human
guuucauucggcagcucauaag

SEQ ID NO: 420032 - RNA, 22 nt, Human
aaugcuguauaucuuagcuaau

SEQ ID NO: 420033 - RNA, 22 nt, Human
gcugaagcccacguggcuugua

SEQ ID NO: 420034 - RNA, 22 nt, Human
uggcucaggggucuggcucugu

SEQ ID NO: 420035 - RNA, 23 nt, Human
uuguuuuuagagguggcaugaga

SEQ ID NO: 420036 - RNA, 22 nt, Human
cccugccuacaggguuuucuuu

SEQ ID NO: 420037 - RNA, 22 nt, Human
cuuaagaauauugaaguugugg

SEQ ID NO: 420038 - RNA, 22 nt, Human
uagcugcccaucuuuccuuuag

SEQ ID NO: 420039 - RNA, 22 nt, Human
uuuuaucuucauuccuaucuac

SEQ ID NO: 420040 - RNA, 22 nt, Human
ugcuuuauaucucucuucuuag

SEQ ID NO: 420041 - RNA, 22 nt, Human
agaggccagcagugccuaucug

SEQ ID NO: 420042 - RNA, 22 nt, Human
ggagccagcagggugacacuga

SEQ ID NO: 420043 - RNA, 22 nt, Human
uaaagucaucuuuacaucuuug

SEQ ID NO: 420044 - RNA, 22 nt, Human
ugaaagcuguccacuaggcugu

SEQ ID NO: 420045 - RNA, 22 nt, Human
ucccagcagggccgaccagccu

SEQ ID NO: 420046 - RNA, 22 nt, Human
uagugauuaaaggcagaauguu

SEQ ID NO: 420047 - RNA, 21 nt, Human
gcagccacagccaccaagcua

SEQ ID NO: 420048 - RNA, 22 nt, Human
ggcagcucugaugaugcucugg

SEQ ID NO: 420049 - RNA, 22 nt, Human
uucacuuauagggauguuauug

SEQ ID NO: 420050 - RNA, 22 nt, Human
ugcaguggugguaaagaugcuc

SEQ ID NO: 420051 - RNA, 22 nt, Human
cccugggacccgcugcagaggc

SEQ ID NO: 420052 - RNA, 22 nt, Human
auuuccauacacccauuucuga

SEQ ID NO: 420053 - RNA, 22 nt, Human
ggaggagacccugugucaguuu

SEQ ID NO: 420054 - RNA, 22 nt, Human
uuuauuugucuugccauuuagu

SEQ ID NO: 420055 - RNA, 21 nt, Human
agcugggccucagccugcagu

SEQ ID NO: 420056 - RNA, 22 nt, Human
ugaaugauuugggugcauucag

SEQ ID NO: 420057 - RNA, 21 nt, Human
agacagagugcagucuacaua

SEQ ID NO: 420058 - RNA, 23 nt, Human
uggcucugagcuuccugguggcc

SEQ ID NO: 420059 - RNA, 22 nt, Human
agggcuccuccccggccuccac

SEQ ID NO: 420060 - RNA, 22 nt, Human
agaauucugacaauagaauugg

SEQ ID NO: 420061 - RNA, 20 nt, Human
caggccagagguuugauggc

SEQ ID NO: 420062 - RNA, 22 nt, Human
ugugccugaguuggcugaguac

SEQ ID NO: 420063 - RNA, 22 nt, Human
gaggcagagaccuucaggaccu

SEQ ID NO: 420064 - RNA, 22 nt, Human
caggaugaagggcaaaggcaag

SEQ ID NO: 420065 - RNA, 22 nt, Human
cccagguggguuggccucuguc

SEQ ID NO: 420066 - RNA, 22 nt, Human
aaaggccagguuggcugguauu

SEQ ID NO: 420067 - RNA, 22 nt, Human
uuguuuuuaugaacauccagga

SEQ ID NO: 420068 - RNA, 22 nt, Human
ccaggugggaggaaagcagaga

SEQ ID NO: 420069 - RNA, 22 nt, Human
gggccuggcaugcagccccguu

SEQ ID NO: 420070 - RNA, 22 nt, Human
aggccagcaagaaagagagucu

SEQ ID NO: 420071 - RNA, 22 nt, Human
ugaggugaagaguggagcucag

SEQ ID NO: 420072 - RNA, 22 nt, Human
gggcaguguggucgugccuuug

SEQ ID NO: 420073 - RNA, 22 nt, Human
agcccaugcaacaggccuagcg

SEQ ID NO: 420074 - RNA, 22 nt, Human
caggcagcagccacucugguau

SEQ ID NO: 420075 - RNA, 22 nt, Human
uaggcagagguaugguaaggac

SEQ ID NO: 420076 - RNA, 20 nt, Human
gcccuggagccuuguccugg

SEQ ID NO: 420077 - RNA, 22 nt, Human
ugcauauuuuauaaagauggaa

SEQ ID NO: 420078 - RNA, 20 nt, Human
gucagugucuucaguaguga

SEQ ID NO: 420079 - RNA, 22 nt, Human
gcagggugaaggucacauagaa

SEQ ID NO: 420080 - RNA, 22 nt, Human
aauggccagcugggagaguuga

SEQ ID NO: 420081 - RNA, 22 nt, Human
aagcgccaugguuccugcgcag

SEQ ID NO: 420082 - RNA, 22 nt, Human
aagugacacauggcacuucuau

SEQ ID NO: 420083 - RNA, 22 nt, Human
cgugucaucugagccuugggcg

SEQ ID NO: 420084 - RNA, 22 nt, Human
uucacauuauaaucaguucugc

SEQ ID NO: 420085 - RNA, 22 nt, Human
uaugcauacaaugagauauucc

SEQ ID NO: 420086 - RNA, 22 nt, Human
gggcugagucugcugccuguca

SEQ ID NO: 420087 - RNA, 22 nt, Human
cacagcugcacagaggaggugc

SEQ ID NO: 420088 - RNA, 22 nt, Human
accucugcuucccggguucaag

SEQ ID NO: 420089 - RNA, 22 nt, Human
ucugucacccgagcaggcgaga

SEQ ID NO: 420090 - RNA, 22 nt, Human
aggcugaggaucccuguguucu

SEQ ID NO: 420091 - RNA, 22 nt, Human
auuaaauuuucacuaggcuccc

SEQ ID NO: 420092 - RNA, 22 nt, Human
ggggcacacuuuugguagauau

SEQ ID NO: 420093 - RNA, 22 nt, Human
uggcucuggggacaguaagucc

SEQ ID NO: 420094 - RNA, 22 nt, Human
gggcuggaggugagcaggacag

SEQ ID NO: 420095 - RNA, 22 nt, Human
ucucaggacuuugggaagcuca

SEQ ID NO: 420096 - RNA, 22 nt, Human
ccugugccauccugagcauccc

SEQ ID NO: 420097 - RNA, 22 nt, Human
acugugcaugaaccgaaacaaa

SEQ ID NO: 420098 - RNA, 22 nt, Human
uguauuagagcaguagaauuau

SEQ ID NO: 420099 - RNA, 22 nt, Human
uuuuaucugcuucauuaguuga

SEQ ID NO: 420100 - RNA, 22 nt, Human
aggcugcuggcaggcguggacg

SEQ ID NO: 420101 - RNA, 22 nt, Human
caugucuuuguuaugcucacca

SEQ ID NO: 420102 - RNA, 22 nt, Human
ucaaaagucugcauucuucaca

SEQ ID NO: 420103 - RNA, 22 nt, Human
acaugaaaagacuaucugauua

SEQ ID NO: 420104 - RNA, 22 nt, Human
cucaaggacuuauucaugccug

SEQ ID NO: 420105 - RNA, 22 nt, Human
uccuucaguuaucacaguacug

SEQ ID NO: 420106 - RNA, 22 nt, Human
gcucccaggaagagaagggcca

SEQ ID NO: 420107 - RNA, 22 nt, Human
cccaggaggcagagcuugcagu

SEQ ID NO: 420108 - RNA, 22 nt, Human
gccaggcugcuggcugcugucc

SEQ ID NO: 420109 - RNA, 22 nt, Human
gaguuauuaauggcugaguuug

SEQ ID NO: 420110 - RNA, 21 nt, Human
aggcuguccuuugccagcccu

SEQ ID NO: 420111 - RNA, 22 nt, Human
gagcucauccccaugguccguc

SEQ ID NO: 420112 - RNA, 22 nt, Human
ucaagaaagggcuucaccagga

SEQ ID NO: 420113 - RNA, 22 nt, Human
aacaucagaauauccauguugg

SEQ ID NO: 420114 - RNA, 22 nt, Human
uccgcccgcacguauggagugg

SEQ ID NO: 420115 - RNA, 22 nt, Human
ucccagagcagaugugcuaaag

SEQ ID NO: 420116 - RNA, 22 nt, Human
cccagggauuauaaaggugaaa

SEQ ID NO: 420117 - RNA, 22 nt, Human
accuuucaaaguggcuaucacu

SEQ ID NO: 420118 - RNA, 22 nt, Human
guggcaggagagacacagccau

SEQ ID NO: 420119 - RNA, 21 nt, Human
guguuuccuguuuauggcuug

SEQ ID NO: 420120 - RNA, 22 nt, Human
uuuagaaauugcagagugggug

SEQ ID NO: 420121 - RNA, 22 nt, Human
ucccucuguguugggcaugccu

SEQ ID NO: 420122 - RNA, 20 nt, Human
cugggaggucuuccaaauca

SEQ ID NO: 420123 - RNA, 22 nt, Human
agcagcugucccuuaacaucag

SEQ ID NO: 420124 - RNA, 22 nt, Human
gugcuaggauuacaggcauggg

SEQ ID NO: 420125 - RNA, 22 nt, Human
gggcugggcaugguguucccuc

SEQ ID NO: 420126 - RNA, 22 nt, Human
ccaaggagaaugacaccaugga

SEQ ID NO: 420127 - RNA, 22 nt, Human
acaggcucuggggcaggauggc

SEQ ID NO: 420128 - RNA, 22 nt, Human
cagagcugcuucccaguuugug

SEQ ID NO: 420129 - RNA, 22 nt, Human
acugucuccucaucaugccugg

SEQ ID NO: 420130 - RNA, 22 nt, Human
aagcagccaccucaucuccacu

SEQ ID NO: 420131 - RNA, 22 nt, Human
uuccauuuauucuuguccagau

SEQ ID NO: 420132 - RNA, 22 nt, Human
ccacaggggucucuguagcuga

SEQ ID NO: 420133 - RNA, 22 nt, Human
cggggcugcucguccuccugug

SEQ ID NO: 420134 - RNA, 22 nt, Human
ccaggcaggcgauggugcagug

SEQ ID NO: 420135 - RNA, 20 nt, Human
agagugagacuccaucucag

SEQ ID NO: 420136 - RNA, 19 nt, Human
agggcuaggcacauagggc

SEQ ID NO: 420137 - RNA, 22 nt, Human
agaguggggaagguguugagaa

SEQ ID NO: 420138 - RNA, 22 nt, Human
ugccagaagugcuuuauaagug

SEQ ID NO: 420139 - RNA, 22 nt, Human
ugucagagcaaggccaggccag

SEQ ID NO: 420140 - RNA, 22 nt, Human
aagagccagugggaaagucuug

SEQ ID NO: 420141 - RNA, 22 nt, Human
ugugcugguacaugugaggaug

SEQ ID NO: 420142 - RNA, 18 nt, Human
gcccagaggucugggccc

SEQ ID NO: 420143 - RNA, 22 nt, Human
cugugugcugaaaugcagugag

SEQ ID NO: 420144 - RNA, 22 nt, Human
caggccuccacuccacgcagac

SEQ ID NO: 420145 - RNA, 22 nt, Human
agugggcagugcgcucggaugc

SEQ ID NO: 420146 - RNA, 22 nt, Human
gcccagcaggacagagugguuu

SEQ ID NO: 420147 - RNA, 22 nt, Human
ugcccugugugugcaagcacug

SEQ ID NO: 420148 - RNA, 22 nt, Human
gggcugggauggcuugaagauu

SEQ ID NO: 420149 - RNA, 21 nt, Human
ugauuuccagaaaauuggccc

SEQ ID NO: 420150 - RNA, 22 nt, Human
agaagauuuagguugacgcuau

SEQ ID NO: 420151 - RNA, 22 nt, Human
aggcuuuaauuaucuacaggag

SEQ ID NO: 420152 - RNA, 22 nt, Human
agggcaguucagccacaggcuc

SEQ ID NO: 420153 - RNA, 21 nt, Human
uuuagggaggauauuuaacuu

SEQ ID NO: 420154 - RNA, 22 nt, Human
acuggcaguuugagaaugcauu

SEQ ID NO: 420155 - RNA, 22 nt, Human
aggagcugcaaauauuaguaau

SEQ ID NO: 420156 - RNA, 22 nt, Human
agagggcaugcuugguggccug

SEQ ID NO: 420157 - RNA, 22 nt, Human
aaagagcuaacauugccgagau

SEQ ID NO: 420158 - RNA, 22 nt, Human
uccucugcuccaucuuuacugu

SEQ ID NO: 420159 - RNA, 17 nt, Human
ucagagggaugagcagg

SEQ ID NO: 420160 - RNA, 22 nt, Human
uguacauugucacucaucaagu

SEQ ID NO: 420161 - RNA, 22 nt, Human
cagcucucuaaggucuugcuuu

SEQ ID NO: 420162 - RNA, 22 nt, Human
ucugccagugguuuggcccuga

SEQ ID NO: 420163 - RNA, 23 nt, Human
aaauauucuuuuuuaguaagugc

SEQ ID NO: 420164 - RNA, 22 nt, Human
uccagacccaugacccugggga

SEQ ID NO: 420165 - RNA, 22 nt, Human
agcuguggggcaggcagcgagg

SEQ ID NO: 420166 - RNA, 19 nt, Human
uccccagcaccucugaguc

SEQ ID NO: 420167 - RNA, 22 nt, Human
cagccacguagcccuuggccgu

SEQ ID NO: 420168 - RNA, 21 nt, Human
uggcucugagccucauggcug

SEQ ID NO: 420169 - RNA, 23 nt, Human
ucaguuuuggcuguucaguguug

SEQ ID NO: 420170 - RNA, 22 nt, Human
ucugaaaugcaaauuugacuga

SEQ ID NO: 420171 - RNA, 22 nt, Human
gagagcugcagccgagaggggg

SEQ ID NO: 420172 - RNA, 22 nt, Human
gacccagccugguuuuuauagg

SEQ ID NO: 420173 - RNA, 22 nt, Human
gaaggaaaaauacucuguaagg

SEQ ID NO: 420174 - RNA, 22 nt, Human
ugccacagaggugaagcccacu

SEQ ID NO: 420175 - RNA, 22 nt, Human
acaggugggcuuaagagucggc

SEQ ID NO: 420176 - RNA, 22 nt, Human
aaaguuuuagaacuaggaagca

SEQ ID NO: 420177 - RNA, 22 nt, Human
aaacauuugcaacucgguuugg

SEQ ID NO: 420178 - RNA, 22 nt, Human
cagcacaguacaaggcacggau

SEQ ID NO: 420179 - RNA, 22 nt, Human
ccagugccugugggcauggugc

SEQ ID NO: 420180 - RNA, 22 nt, Human
cagcucccaguggcagcuccuu

SEQ ID NO: 420181 - RNA, 22 nt, Human
uaugcacauauaaccugcacug

SEQ ID NO: 420182 - RNA, 22 nt, Human
aaggaagagucuagaacaggca

SEQ ID NO: 420183 - RNA, 21 nt, Human
acagggcaugcagcuggcugu

SEQ ID NO: 420184 - RNA, 22 nt, Human
ggugaggcagguggcugcugag

SEQ ID NO: 420185 - RNA, 22 nt, Human
uaagacauuugaaaugugaucc

SEQ ID NO: 420186 - RNA, 22 nt, Human
gcacagccagcaucugagggau

SEQ ID NO: 420187 - RNA, 22 nt, Human
agagccaggcggcugggcaccu

SEQ ID NO: 420188 - RNA, 22 nt, Human
gucccugcaucaccacgggacu

SEQ ID NO: 420189 - RNA, 22 nt, Human
ggagaagcaggugcuuuggguc

SEQ ID NO: 420190 - RNA, 23 nt, Human
uguaaaaugggguaguguuacca

SEQ ID NO: 420191 - RNA, 22 nt, Human
uagagcuggccgggacagcugg

SEQ ID NO: 420192 - RNA, 22 nt, Human
ucacugcucuccaauguggagu

SEQ ID NO: 420193 - RNA, 22 nt, Human
cauugcacuccagcuugggcaa

SEQ ID NO: 420194 - RNA, 22 nt, Human
ugugcuucaucacuucucaguu

SEQ ID NO: 420195 - RNA, 22 nt, Human
gccacaugucaugugcucagua

SEQ ID NO: 420196 - RNA, 22 nt, Human
gcuuucuugguucugcaggggc

SEQ ID NO: 420197 - RNA, 17 nt, Human
uucaaugauuaaugcau

SEQ ID NO: 420198 - RNA, 22 nt, Human
gucccugggaugcccuucuggg

SEQ ID NO: 420199 - RNA, 22 nt, Human
uaagaagcuucugcuaaugccu

SEQ ID NO: 420200 - RNA, 21 nt, Human
aucagaaguuuuggucaguag

SEQ ID NO: 420201 - RNA, 19 nt, Human
cuuuucaucaacagccaau

SEQ ID NO: 420202 - RNA, 22 nt, Human
aaauguauugcauaggauauuu

SEQ ID NO: 420203 - RNA, 22 nt, Human
gcaccugggacccagaggcacc

SEQ ID NO: 420204 - RNA, 22 nt, Human
gugacagaguuuuagaucucau

SEQ ID NO: 420205 - RNA, 19 nt, Human
cagagcagugguuccugaa

SEQ ID NO: 420206 - RNA, 22 nt, Human
acugucugcuggccccugguua

SEQ ID NO: 420207 - RNA, 22 nt, Human
cagaggcauacucccagucuug

SEQ ID NO: 420208 - RNA, 22 nt, Human
ucaggcuggagugcaguggcgc

SEQ ID NO: 420209 - RNA, 22 nt, Human
uugugugguagcuucauugaac

SEQ ID NO: 420210 - RNA, 22 nt, Human
cagcugggugaucuugggcagg

SEQ ID NO: 420211 - RNA, 22 nt, Human
uccugcagaccucagucagguc

SEQ ID NO: 420212 - RNA, 22 nt, Human
caggccucuauggucagcugag

SEQ ID NO: 420213 - RNA, 22 nt, Human
ucucuucugaaaccugucuuua

SEQ ID NO: 420214 - RNA, 22 nt, Human
gcaggccugacuguagggggca

SEQ ID NO: 420215 - RNA, 20 nt, Human
ugcagagcuggcuggcuccu

SEQ ID NO: 420216 - RNA, 22 nt, Human
cccugcagaucuaggguccuuc

SEQ ID NO: 420217 - RNA, 22 nt, Human
cggggcugcgcucuuccugccg

SEQ ID NO: 420218 - RNA, 22 nt, Human
gaauucugguccuguccaaggu

SEQ ID NO: 420219 - RNA, 22 nt, Human
gccugggagagggauagugcag

SEQ ID NO: 420220 - RNA, 22 nt, Human
aaagggaggggcgauaagccgg

SEQ ID NO: 420221 - RNA, 22 nt, Human
uuaauacagucuccagaaguaa

SEQ ID NO: 420222 - RNA, 22 nt, Human
gaggcucagggaaacagcgcag

SEQ ID NO: 420223 - RNA, 22 nt, Human
aggaccugccaggugcaaagca

SEQ ID NO: 420224 - RNA, 22 nt, Human
ccuccaggcugaauaucuagaa

SEQ ID NO: 420225 - RNA, 22 nt, Human
gccugcuggauguggccaggcc

SEQ ID NO: 420226 - RNA, 22 nt, Human
uguaaucauuacaguacaugga

SEQ ID NO: 420227 - RNA, 20 nt, Human
cccuggagagaagcuccacg

SEQ ID NO: 420228 - RNA, 22 nt, Human
agcuuccuuggcgcugaggccu

SEQ ID NO: 420229 - RNA, 19 nt, Human
cugcucaggucagucuguc

SEQ ID NO: 420230 - RNA, 22 nt, Human
gcagggucgcucuaggagauca

SEQ ID NO: 420231 - RNA, 22 nt, Human
agccuccaaaugucaggucccg

SEQ ID NO: 420232 - RNA, 22 nt, Human
uagggcugcugcagaugacagg

SEQ ID NO: 420233 - RNA, 22 nt, Human
aaugaacaaaauaugcuuugca

SEQ ID NO: 420234 - RNA, 22 nt, Human
ucaggcugaaggaggccuaucu

SEQ ID NO: 420235 - RNA, 22 nt, Human
uuauccaacaugacuuaugucc

SEQ ID NO: 420236 - RNA, 22 nt, Human
auuucacaaagaacagaugcag

SEQ ID NO: 420237 - RNA, 22 nt, Human
ucugucacccaggcuggagugc

SEQ ID NO: 420238 - RNA, 22 nt, Human
ggaagaagggucauuggcagcc

SEQ ID NO: 420239 - RNA, 22 nt, Human
acagaacugcaggaggaaaagc

SEQ ID NO: 420240 - RNA, 22 nt, Human
auguuauuaaaguacagauucu

SEQ ID NO: 420241 - RNA, 20 nt, Human
uaaggcuguuuuguauuccu

SEQ ID NO: 420242 - RNA, 22 nt, Human
ggcugccuccucgagacaggau

SEQ ID NO: 420243 - RNA, 22 nt, Human
aucuggcuuaccuagggugccu

SEQ ID NO: 420244 - RNA, 22 nt, Human
acauuucuauagugcaucuguu

SEQ ID NO: 420245 - RNA, 22 nt, Human
ucuaugaaaagucuauucauuc

SEQ ID NO: 420246 - RNA, 22 nt, Human
cugggcacacagugacucugca

SEQ ID NO: 420247 - RNA, 22 nt, Human
guguuccauguuugagguaguu

SEQ ID NO: 420248 - RNA, 22 nt, Human
gucaggauuaaugggaguaugc

SEQ ID NO: 420249 - RNA, 22 nt, Human
uccucuggcccagcugccucug

SEQ ID NO: 420250 - RNA, 22 nt, Human
gcuggggucugugaggagggcu

SEQ ID NO: 420251 - RNA, 20 nt, Human
uggagccaaggugugucugg

SEQ ID NO: 420252 - RNA, 22 nt, Human
uggugcaagucucugaggaggg

SEQ ID NO: 420253 - RNA, 22 nt, Human
uauaauuuuagaagagauggaa

SEQ ID NO: 420254 - RNA, 22 nt, Human
cccaccaguacagaugguagau

SEQ ID NO: 420255 - RNA, 22 nt, Human
uucucuagguuuuagaugaaga

SEQ ID NO: 420256 - RNA, 22 nt, Human
ucaaagagcuauucaguugugg

SEQ ID NO: 420257 - RNA, 22 nt, Human
agggcagugggaaagccugcuc

SEQ ID NO: 420258 - RNA, 22 nt, Human
gggcugagaauucagcuuuccu

SEQ ID NO: 420259 - RNA, 22 nt, Human
aguggcagaagccaagucugca

SEQ ID NO: 420260 - RNA, 22 nt, Human
ggaaggaggggcaaagcaguuc

SEQ ID NO: 420261 - RNA, 19 nt, Human
gggcagaauggcaucucag

SEQ ID NO: 420262 - RNA, 22 nt, Human
uccaaacacccuccaugcugca

SEQ ID NO: 420263 - RNA, 21 nt, Human
agagacugucacugcaguacc

SEQ ID NO: 420264 - RNA, 22 nt, Human
uggcccugacugauguggaggg

SEQ ID NO: 420265 - RNA, 22 nt, Human
auugaaagauuuugggcucaug

SEQ ID NO: 420266 - RNA, 22 nt, Human
cugcccucuagaggaggacuga

SEQ ID NO: 420267 - RNA, 22 nt, Human
caagaaggcuauaugggccagg

SEQ ID NO: 420268 - RNA, 20 nt, Human
uggcaucucucaauuguagg

SEQ ID NO: 420269 - RNA, 22 nt, Human
aagcugccuagaguugaauguc

SEQ ID NO: 420270 - RNA, 22 nt, Human
caguuauuaugaggucauuagg

SEQ ID NO: 420271 - RNA, 22 nt, Human
agaaggcacucacacuggcacg

SEQ ID NO: 420272 - RNA, 22 nt, Human
aauucugugcaggcagagcuau

SEQ ID NO: 420273 - RNA, 22 nt, Human
uaaccauauuuuccauuaaguu

SEQ ID NO: 420274 - RNA, 23 nt, Human
gggcuccagucucugcucaguug

SEQ ID NO: 420275 - RNA, 22 nt, Human
acuaaggaauaugacaaacuca

SEQ ID NO: 420276 - RNA, 22 nt, Human
ucuuucagccacuuaccugucu

SEQ ID NO: 420277 - RNA, 22 nt, Human
uuauguaccugaauuaguaaag

SEQ ID NO: 420278 - RNA, 22 nt, Human
ucugccugagcagagggaggcc

SEQ ID NO: 420279 - RNA, 22 nt, Human
aaggcaggagcuguaucuuauu

SEQ ID NO: 420280 - RNA, 22 nt, Human
agggccacaguggggccugaga

SEQ ID NO: 420281 - RNA, 22 nt, Human
uugaaaggugaacaugaugcac

SEQ ID NO: 420282 - RNA, 22 nt, Human
uugcaacaucugaacauuuauc

SEQ ID NO: 420283 - RNA, 22 nt, Human
aggugcaggagcugugcaggga

SEQ ID NO: 420284 - RNA, 22 nt, Human
caguagcacuagauaugugugg

SEQ ID NO: 420285 - RNA, 22 nt, Human
uguuuauucauggcuaaugaaa

SEQ ID NO: 420286 - RNA, 22 nt, Human
uggcagggucuugcuguguugc

SEQ ID NO: 420287 - RNA, 22 nt, Human
caggagcucuuaaggaugugau

SEQ ID NO: 420288 - RNA, 22 nt, Human
uggcucaggguccccaaauggu

SEQ ID NO: 420289 - RNA, 23 nt, Human
agaaaagcuuggacacauggccu

SEQ ID NO: 420290 - RNA, 22 nt, Human
acaagagacaagagguucuucu

SEQ ID NO: 420291 - RNA, 22 nt, Human
cucucagacugaagggccugug

SEQ ID NO: 420292 - RNA, 22 nt, Human
ugggcucugcaucagugcccau

SEQ ID NO: 420293 - RNA, 22 nt, Human
ugcagggccccucugcaugagu

SEQ ID NO: 420294 - RNA, 22 nt, Human
aauaugcauuaacuguguacau

SEQ ID NO: 420295 - RNA, 22 nt, Human
gaaaucuuuauggaaauaacaa

SEQ ID NO: 420296 - RNA, 22 nt, Human
ucacaguaaaagcauggaagag

SEQ ID NO: 420297 - RNA, 22 nt, Human
gccaggcagccacccucugcga

SEQ ID NO: 420298 - RNA, 21 nt, Human
aggcugcuggcucaggguccu

SEQ ID NO: 420299 - RNA, 22 nt, Human
cacagcuggugcacuagcucug

SEQ ID NO: 420300 - RNA, 22 nt, Human
caggagcccagaguccucagcu

SEQ ID NO: 420301 - RNA, 22 nt, Human
auguagagcaguguuguccaau

SEQ ID NO: 420302 - RNA, 22 nt, Human
ugcagcaggagccaggccuggu

SEQ ID NO: 420303 - RNA, 21 nt, Human
gagacagcccagugccagggc

SEQ ID NO: 420304 - RNA, 22 nt, Human
acuguauaaggcauagguaagc

SEQ ID NO: 420305 - RNA, 22 nt, Human
ugcucuccggcuuccguggccu

SEQ ID NO: 420306 - RNA, 22 nt, Human
gggccacauugaagggugggua

SEQ ID NO: 420307 - RNA, 22 nt, Human
ggcugcaggaugcccagccgug

SEQ ID NO: 420308 - RNA, 22 nt, Human
cuggccuuuaaaaugaccuuau

SEQ ID NO: 420309 - RNA, 22 nt, Human
ggcagccauacucagaccuggg

SEQ ID NO: 420310 - RNA, 23 nt, Human
agggaaaguaguaauggccuuug

SEQ ID NO: 420311 - RNA, 18 nt, Human
acaaaggucugcaagacc

SEQ ID NO: 420312 - RNA, 22 nt, Human
ccaucagcuccaguaucuucug

SEQ ID NO: 420313 - RNA, 21 nt, Human
cagagcuguccaaacccugac

SEQ ID NO: 420314 - RNA, 22 nt, Human
ggaagccacccagcuuugauag

SEQ ID NO: 420315 - RNA, 22 nt, Human
cucaggccauucuuccagcugc

SEQ ID NO: 420316 - RNA, 18 nt, Human
cauuguacaaugcuuuau

SEQ ID NO: 420317 - RNA, 20 nt, Human
ucccaggcugggcuccagcu

SEQ ID NO: 420318 - RNA, 22 nt, Human
aagucacacuagacaacugagg

SEQ ID NO: 420319 - RNA, 22 nt, Human
ucuuuccuagaggcugaugagu

SEQ ID NO: 420320 - RNA, 22 nt, Human
uuccauaaucaccuuauucuuu

SEQ ID NO: 420321 - RNA, 22 nt, Human
aagaguuaagcaacagauacca

SEQ ID NO: 420322 - RNA, 22 nt, Human
accaggagccauagagucaggc

SEQ ID NO: 420323 - RNA, 22 nt, Human
uggggcaguuaauaaacauucu

SEQ ID NO: 420324 - RNA, 22 nt, Human
cuggcucaccuccgcuccagca

SEQ ID NO: 420325 - RNA, 19 nt, Human
agccacagaacuugcagga

SEQ ID NO: 420326 - RNA, 22 nt, Human
cacaggggcaaacuguagggga

SEQ ID NO: 420327 - RNA, 23 nt, Human
agcagccauagggaagcaauaca

SEQ ID NO: 420328 - RNA, 22 nt, Human
uggaggaugccuggggaggccu

SEQ ID NO: 420329 - RNA, 22 nt, Human
cucagagaaaugucacaacaau

SEQ ID NO: 420330 - RNA, 22 nt, Human
ucagaagguggagguugcagug

SEQ ID NO: 420331 - RNA, 22 nt, Human
uucuacuuuagcaugcucauuc

SEQ ID NO: 420332 - RNA, 22 nt, Human
uguguguauaugcauuuaucua

SEQ ID NO: 420333 - RNA, 22 nt, Human
gcugggagcccuggucugcucc

SEQ ID NO: 420334 - RNA, 23 nt, Human
uggauaaagcugugcugcauagg

SEQ ID NO: 420335 - RNA, 19 nt, Human
ugagagugaggaaggcuuc

SEQ ID NO: 420336 - RNA, 22 nt, Human
cagccugcauuuguaucuguau

SEQ ID NO: 420337 - RNA, 22 nt, Human
cagcugcuguucaguuuuguuu

SEQ ID NO: 420338 - RNA, 22 nt, Human
gggaguggguuuggccuaggcc

SEQ ID NO: 420339 - RNA, 22 nt, Human
ucagagcugcccaugcaagggg

SEQ ID NO: 420340 - RNA, 22 nt, Human
ucugaggcauaaccuguucugc

SEQ ID NO: 420341 - RNA, 22 nt, Human
ggugaaggucuacugugugcca

SEQ ID NO: 420342 - RNA, 22 nt, Human
uucuaguucccacauaguugcc

SEQ ID NO: 420343 - RNA, 22 nt, Human
cguguacagucuaucuuuuuuc

SEQ ID NO: 420344 - RNA, 22 nt, Human
aggcucagcccaagguggagag

SEQ ID NO: 420345 - RNA, 22 nt, Human
ccugcuggccaguggagggcug

SEQ ID NO: 420346 - RNA, 22 nt, Human
ucagcuuggacagcuugguuga

SEQ ID NO: 420347 - RNA, 22 nt, Human
gugccugcugcagagucgcugu

SEQ ID NO: 420348 - RNA, 22 nt, Human
uccauaagcagguucuuccuga

SEQ ID NO: 420349 - RNA, 22 nt, Human
caaugugucaggaaaagggcca

SEQ ID NO: 420350 - RNA, 22 nt, Human
aggcacagcacaccuggccccc

SEQ ID NO: 420351 - RNA, 17 nt, Human
ccugggaggaguuauga

SEQ ID NO: 420352 - RNA, 21 nt, Human
ccugggagaucagcugccuuc

SEQ ID NO: 420353 - RNA, 22 nt, Human
gcucccaguucccaaagugacc

SEQ ID NO: 420354 - RNA, 22 nt, Human
agggcccucuggcaggccaggc

SEQ ID NO: 420355 - RNA, 22 nt, Human
ggccucugcccucacuccuguc

SEQ ID NO: 420356 - RNA, 22 nt, Human
ucacauuuuccuugguaucugu

SEQ ID NO: 420357 - RNA, 22 nt, Human
gucagagagggcacgugcacac

SEQ ID NO: 420358 - RNA, 22 nt, Human
ugaaggcauugaugaaggaauc

SEQ ID NO: 420359 - RNA, 22 nt, Human
uccagaguacggaagagucauc

SEQ ID NO: 420360 - RNA, 22 nt, Human
acagcuuuuaugggaccagcca

SEQ ID NO: 420361 - RNA, 17 nt, Human
aggcugcugggccaggg

SEQ ID NO: 420362 - RNA, 22 nt, Human
acuggcagcuguaggaugcaug

SEQ ID NO: 420363 - RNA, 22 nt, Human
ugugcucuggaguugccuucac

SEQ ID NO: 420364 - RNA, 22 nt, Human
cagaguccuggacacagagaca

SEQ ID NO: 420365 - RNA, 22 nt, Human
agcagggccuggcacuccuggg

SEQ ID NO: 420366 - RNA, 22 nt, Human
agccaggcagacucucuuucuu

SEQ ID NO: 420367 - RNA, 23 nt, Human
agcauggaauaggaaagaggcag

SEQ ID NO: 420368 - RNA, 21 nt, Human
uuaagagcuuagcaguaggcc

SEQ ID NO: 420369 - RNA, 22 nt, Human
caggaagcugagcugcacugca

SEQ ID NO: 420370 - RNA, 22 nt, Human
gcuguacaaauuccacaagaga

SEQ ID NO: 420371 - RNA, 22 nt, Human
uggaguuccuuugaaaggcucu

SEQ ID NO: 420372 - RNA, 22 nt, Human
gcuggcagaagagcugguucaa

SEQ ID NO: 420373 - RNA, 22 nt, Human
gggagggaaagcuugaucuguc

SEQ ID NO: 420374 - RNA, 21 nt, Human
gucagcagauccagcacuugu

SEQ ID NO: 420375 - RNA, 22 nt, Human
ucagggacauuuagacacugau

SEQ ID NO: 420376 - RNA, 22 nt, Human
ccagcugcugugcagggaggcu

SEQ ID NO: 420377 - RNA, 22 nt, Human
cacuguaucuuuuccaaagucu

SEQ ID NO: 420378 - RNA, 22 nt, Human
cuuauuagugucugucugaguu

SEQ ID NO: 420379 - RNA, 22 nt, Human
auucaguaggucuagaauaaga

SEQ ID NO: 420380 - RNA, 22 nt, Human
cugaggucucuuuccauaguga

SEQ ID NO: 420381 - RNA, 22 nt, Human
aucugaagggaaguggaaggca

SEQ ID NO: 420382 - RNA, 22 nt, Human
ucucaguguuuaaaaagauuuc

SEQ ID NO: 420383 - RNA, 22 nt, Human
gguuugguuuuggccaucuucc

SEQ ID NO: 420384 - RNA, 22 nt, Human
agcugccaggccccugagaacc

SEQ ID NO: 420385 - RNA, 17 nt, Human
uccuucagggccucaca

SEQ ID NO: 420386 - RNA, 22 nt, Human
gaaaguauuuaaguccauauuu

SEQ ID NO: 420387 - RNA, 22 nt, Human
ccuuccuggagcccaugcagau

SEQ ID NO: 420388 - RNA, 22 nt, Human
agcagggcuguguagguaauga

SEQ ID NO: 420389 - RNA, 17 nt, Human
ucugccgacugccagcu

SEQ ID NO: 420390 - RNA, 22 nt, Human
auaaacagcuccauuuagugcc

SEQ ID NO: 420391 - RNA, 22 nt, Human
ggcaggugcaccugagccaucu

SEQ ID NO: 420392 - RNA, 22 nt, Human
uccaguggcacuggagacuaga

SEQ ID NO: 420393 - RNA, 22 nt, Human
uucuugcucaaugucuguuuaa

SEQ ID NO: 420394 - RNA, 23 nt, Human
ugcauuauccucucugaagacca

SEQ ID NO: 420395 - RNA, 22 nt, Human
gaggaggaaguucucuguaggc

SEQ ID NO: 420396 - RNA, 23 nt, Human
uucuuauuuacuuuggaaucucc

SEQ ID NO: 420397 - RNA, 22 nt, Human
agugucugccaacugcaugguc

SEQ ID NO: 420398 - RNA, 19 nt, Human
acagaaauguaagugagac

SEQ ID NO: 420399 - RNA, 22 nt, Human
acagagccaaaaggacauagua

SEQ ID NO: 420400 - RNA, 22 nt, Human
uggccucuuacgacauagccuu

SEQ ID NO: 420401 - RNA, 22 nt, Human
agccaagcacucaacuccugga

SEQ ID NO: 420402 - RNA, 22 nt, Human
gugucccaauguucaggacggc

SEQ ID NO: 420403 - RNA, 22 nt, Human
uugucugaaagaucauuacauu

SEQ ID NO: 420404 - RNA, 22 nt, Human
ccagggagccuggugugucagc

SEQ ID NO: 420405 - RNA, 23 nt, Human
aagcugccagucugaagccuggg

SEQ ID NO: 420406 - RNA, 22 nt, Human
ccagagccagagaggugccugc

SEQ ID NO: 420407 - RNA, 22 nt, Human
uuucacaacguuguggugagag

SEQ ID NO: 420408 - RNA, 22 nt, Human
guccagugacaaguagcuggcc

SEQ ID NO: 420409 - RNA, 21 nt, Human
uccugccuuaguccagagcag

SEQ ID NO: 420410 - RNA, 22 nt, Human
gucaggauuauuuuauuaaaag

SEQ ID NO: 420411 - RNA, 22 nt, Human
uccagcuugacaaaugauuuua

SEQ ID NO: 420412 - RNA, 22 nt, Human
ucuuccugaaacccuguuccag

SEQ ID NO: 420413 - RNA, 22 nt, Human
gcucagagauggggaaugaaaa

SEQ ID NO: 420414 - RNA, 22 nt, Human
caagggcucuuuugaggaaugu

SEQ ID NO: 420415 - RNA, 22 nt, Human
gcuggguggaucggaggcucug

SEQ ID NO: 420416 - RNA, 22 nt, Human
agaguguaauaagggcaagggc

SEQ ID NO: 420417 - RNA, 22 nt, Human
uggaggcaguaacugagcaaca

SEQ ID NO: 420418 - RNA, 22 nt, Human
aacagaaaucauuuagggcucu

SEQ ID NO: 420419 - RNA, 22 nt, Human
caggugggaccaugauagggca

SEQ ID NO: 420420 - RNA, 22 nt, Human
ccucugcucugguccaugugcu

SEQ ID NO: 420421 - RNA, 22 nt, Human
agaacagaugugggcagaccug

SEQ ID NO: 420422 - RNA, 22 nt, Human
gggaccaggugggugcauuccg

SEQ ID NO: 420423 - RNA, 17 nt, Human
uguuuucauucauugcu

SEQ ID NO: 420424 - RNA, 20 nt, Human
ggggcugcaugcagagaaga

SEQ ID NO: 420425 - RNA, 22 nt, Human
agauuugcggcuuuacuuugca

SEQ ID NO: 420426 - RNA, 22 nt, Human
cagcugagcaucacuagucugg

SEQ ID NO: 420427 - RNA, 22 nt, Human
auuacacaggcuggcucuuuga

SEQ ID NO: 420428 - RNA, 22 nt, Human
augcaccugaacuccaucagcu

SEQ ID NO: 420429 - RNA, 22 nt, Human
gagcuuuacuucugacuggugc

SEQ ID NO: 420430 - RNA, 22 nt, Human
uuucuacaugucaauccaaacc

SEQ ID NO: 420431 - RNA, 22 nt, Human
cgcuggccauagccuccugugu

SEQ ID NO: 420432 - RNA, 22 nt, Human
ugcuuuauucgacaucugguag

SEQ ID NO: 420433 - RNA, 20 nt, Human
cccucccagaugcuucccaa

SEQ ID NO: 420434 - RNA, 22 nt, Human
aggcacugaauauccaguaaaa

SEQ ID NO: 420435 - RNA, 22 nt, Human
agccuggcuguaaccucauggu

SEQ ID NO: 420436 - RNA, 22 nt, Human
agggacacacuccaguguuauu

SEQ ID NO: 420437 - RNA, 22 nt, Human
aagcacaaugaacaucuuagau

SEQ ID NO: 420438 - RNA, 22 nt, Human
acaggcuuacaggcugcaagua

SEQ ID NO: 420439 - RNA, 20 nt, Human
acaguggaaauugaugucug

SEQ ID NO: 420440 - RNA, 22 nt, Human
agccuauuccaggaugagcuca

SEQ ID NO: 420441 - RNA, 22 nt, Human
ugaagaagccaauugguaggcu

SEQ ID NO: 420442 - RNA, 22 nt, Human
acagaacugagaauucucuauc

SEQ ID NO: 420443 - RNA, 22 nt, Human
guguggcugugggagauguuca

SEQ ID NO: 420444 - RNA, 22 nt, Human
ucuguccucuuugaagcugcuc

SEQ ID NO: 420445 - RNA, 22 nt, Human
ugaaacagucuccagacuugga

SEQ ID NO: 420446 - RNA, 22 nt, Human
uuuccucugaugcugacuugga

SEQ ID NO: 420447 - RNA, 22 nt, Human
ugcucccaaacgaccuacugug

SEQ ID NO: 420448 - RNA, 22 nt, Human
aacccagccguguagcugccgc

SEQ ID NO: 420449 - RNA, 22 nt, Human
agcauggggcuccgcaaugaac

SEQ ID NO: 420450 - RNA, 22 nt, Human
auccagcuuugucuggucuucg

SEQ ID NO: 420451 - RNA, 22 nt, Human
cucagagagggcaccagggcca

SEQ ID NO: 420452 - RNA, 22 nt, Human
cugcuuccauggucuggagacu

SEQ ID NO: 420453 - RNA, 22 nt, Human
aaacaccagucccaguauacac

SEQ ID NO: 420454 - RNA, 22 nt, Human
agcucccagggcugggcaaguu

SEQ ID NO: 420455 - RNA, 22 nt, Human
uguaugcuuguguauaauauaa

SEQ ID NO: 420456 - RNA, 22 nt, Human
ugucucuggcccaugagcagag

SEQ ID NO: 420457 - RNA, 20 nt, Human
ugggccuguggcagaagucu

SEQ ID NO: 420458 - RNA, 22 nt, Human
ucacugaauacuugucucaucc

SEQ ID NO: 420459 - RNA, 22 nt, Human
gggcugucaugugucagugacc

SEQ ID NO: 420460 - RNA, 22 nt, Human
gcuggcuguguuccuucugcca

SEQ ID NO: 420461 - RNA, 22 nt, Human
agcaggaacgaguucaugggga

SEQ ID NO: 420462 - RNA, 22 nt, Human
caaggccaguccauuuuggaag

SEQ ID NO: 420463 - RNA, 22 nt, Human
auuuuucucuccacuccauuaa

SEQ ID NO: 420464 - RNA, 22 nt, Human
ccuccuggcccugggccuggaa

SEQ ID NO: 420465 - RNA, 22 nt, Human
gcugucugggaugucacugcug

SEQ ID NO: 420466 - RNA, 22 nt, Human
cccaggagauggagguugcagu

SEQ ID NO: 420467 - RNA, 22 nt, Human
agugaaauccuggucaacaggu

SEQ ID NO: 420468 - RNA, 22 nt, Human
uggguagaggaauugggcuacc

SEQ ID NO: 420469 - RNA, 22 nt, Human
aagguacagaaauuaacaagga

SEQ ID NO: 420470 - RNA, 22 nt, Human
agagcugcaggguggacccagg

SEQ ID NO: 420471 - RNA, 22 nt, Human
ggagucagccugucagagugua

SEQ ID NO: 420472 - RNA, 22 nt, Human
cugccuggguucaaguccuguu

SEQ ID NO: 420473 - RNA, 22 nt, Human
ccuuaaaagaacuaucucuucu

SEQ ID NO: 420474 - RNA, 22 nt, Human
gucaggauuugaacucaggucu

SEQ ID NO: 420475 - RNA, 22 nt, Human
ccagggugagugucauggguua

SEQ ID NO: 420476 - RNA, 22 nt, Human
gaaggagagagacaucgucccu

SEQ ID NO: 420477 - RNA, 22 nt, Human
guaacagaaagucaugcucauu

SEQ ID NO: 420478 - RNA, 22 nt, Human
uggccugacugucaggcuguau

SEQ ID NO: 420479 - RNA, 22 nt, Human
ucugcucuccauacuuccgcac

SEQ ID NO: 420480 - RNA, 22 nt, Human
accagugcuuccugcuggagcu

SEQ ID NO: 420481 - RNA, 22 nt, Human
ugcaggaguccaaucaggagac

SEQ ID NO: 420482 - RNA, 22 nt, Human
ugcaggagcugugcggugaggg

SEQ ID NO: 420483 - RNA, 19 nt, Human
uuagaaacuguugacacug

SEQ ID NO: 420484 - RNA, 19 nt, Human
ggagaagcccaggaauccu

SEQ ID NO: 420485 - RNA, 22 nt, Human
auguaacaggugaagcucugag

SEQ ID NO: 420486 - RNA, 22 nt, Human
uccagccaccaccuugauugcc

SEQ ID NO: 420487 - RNA, 22 nt, Human
uacauuccauguguguguauuc

SEQ ID NO: 420488 - RNA, 22 nt, Human
gccucacugcagccccaggaag

SEQ ID NO: 420489 - RNA, 22 nt, Human
uuuaagaugguauuuuauaaag

SEQ ID NO: 420490 - RNA, 22 nt, Human
cagccaccauacagcagaagcu

SEQ ID NO: 420491 - RNA, 22 nt, Human
ggcugccuacuuucccagaguu

SEQ ID NO: 420492 - RNA, 22 nt, Human
ggcuguggcauuaggugaggcc

SEQ ID NO: 420493 - RNA, 23 nt, Human
gccugccugaccugugcaaaguc

SEQ ID NO: 420494 - RNA, 22 nt, Human
ccucugugugugcaugcaugcg

SEQ ID NO: 420495 - RNA, 23 nt, Human
ccucccaggcugcgagucccgag

SEQ ID NO: 420496 - RNA, 22 nt, Human
ccucaggaaaugaauaaauggc

SEQ ID NO: 420497 - RNA, 22 nt, Human
ggaaaaggccacagggacacau

SEQ ID NO: 420498 - RNA, 19 nt, Human
gagcugagaguagcacugg

SEQ ID NO: 420499 - RNA, 22 nt, Human
gcaagcuggcuguuagaggaug

SEQ ID NO: 420500 - RNA, 22 nt, Human
ggagagaaauugagguagcaag

SEQ ID NO: 420501 - RNA, 22 nt, Human
cacauccuucagcugagcccag

SEQ ID NO: 420502 - RNA, 22 nt, Human
uggcucugcaccucaguguacc

SEQ ID NO: 420503 - RNA, 22 nt, Human
acuggcaguggcagcagaaaga

SEQ ID NO: 420504 - RNA, 22 nt, Human
ugggaccuguuacauugaguua

SEQ ID NO: 420505 - RNA, 22 nt, Human
agugcacuggcaccaucucagc

SEQ ID NO: 420506 - RNA, 22 nt, Human
cugggaggugcagcaaaaauca

SEQ ID NO: 420507 - RNA, 22 nt, Human
cagcugggcuaagaguagaggc

SEQ ID NO: 420508 - RNA, 22 nt, Human
gaggccuggcugucagucccca

SEQ ID NO: 420509 - RNA, 22 nt, Human
caggcugggcuccggagauaaa

SEQ ID NO: 420510 - RNA, 21 nt, Human
uucauaaaccauucucaugca

SEQ ID NO: 420511 - RNA, 20 nt, Human
uauuuagauucaaguaugga

SEQ ID NO: 420512 - RNA, 22 nt, Human
aaugauguauuaguacaacaca

SEQ ID NO: 420513 - RNA, 22 nt, Human
cagggacaauggcagagccuga

SEQ ID NO: 420514 - RNA, 22 nt, Human
agcucccagaagccagagucgg

SEQ ID NO: 420515 - RNA, 22 nt, Human
ucccaguguggcaggccaugga

SEQ ID NO: 420516 - RNA, 22 nt, Human
cagggagcuuucccaggacccu

SEQ ID NO: 420517 - RNA, 20 nt, Human
cucuccuugccgacuuggca

SEQ ID NO: 420518 - RNA, 22 nt, Human
agcagggcacuggaaggcacug

SEQ ID NO: 420519 - RNA, 21 nt, Human
ggccucugccuugccccacuc

SEQ ID NO: 420520 - RNA, 22 nt, Human
uauccaauucaccauugauggg

SEQ ID NO: 420521 - RNA, 22 nt, Human
aauguacaauaagacaaagagg

SEQ ID NO: 420522 - RNA, 22 nt, Human
gaguccaggcucagaaacccgu

SEQ ID NO: 420523 - RNA, 22 nt, Human
aggggacacggcuucuccaggg

SEQ ID NO: 420524 - RNA, 22 nt, Human
ucuuucuacaucauuugcuucu

SEQ ID NO: 420525 - RNA, 22 nt, Human
accugggagucacaccugagaa

SEQ ID NO: 420526 - RNA, 22 nt, Human
acagccugagaguggagcuggc

SEQ ID NO: 420527 - RNA, 22 nt, Human
cagggccagagagggcuggcug

SEQ ID NO: 420528 - RNA, 21 nt, Human
uuugaaagugggugauucuuu

SEQ ID NO: 420529 - RNA, 22 nt, Human
ccagacccugcucuggggcucu

SEQ ID NO: 420530 - RNA, 18 nt, Human
gaggccugagaaccaggu

SEQ ID NO: 420531 - RNA, 22 nt, Human
auuuuccaaaauaauuguuacu

SEQ ID NO: 420532 - RNA, 22 nt, Human
aggcaguggcugagaccagggg

SEQ ID NO: 420533 - RNA, 21 nt, Human
gagagggcauuauaggaagug

SEQ ID NO: 420534 - RNA, 22 nt, Human
ccaucagcaugggagcaugggc

SEQ ID NO: 420535 - RNA, 22 nt, Human
ccagcccuucccaacuggccag

SEQ ID NO: 420536 - RNA, 22 nt, Human
uggcagagugcagaagaggcau

SEQ ID NO: 420537 - RNA, 22 nt, Human
ccagcagagucuaggaaggagg

SEQ ID NO: 420538 - RNA, 22 nt, Human
aucacugucgucaucugagauu

SEQ ID NO: 420539 - RNA, 22 nt, Human
agcugcugcggaaagaugccac

SEQ ID NO: 420540 - RNA, 22 nt, Human
cuggccugcugggugagguccu

SEQ ID NO: 420541 - RNA, 22 nt, Human
aaguucaagucuccugaguaua

SEQ ID NO: 420542 - RNA, 22 nt, Human
ggccucgcggcuucugguggcu

SEQ ID NO: 420543 - RNA, 22 nt, Human
aucuguaaaugcaaauguagcu

SEQ ID NO: 420544 - RNA, 22 nt, Human
accaggcagagcugggccuuaa

SEQ ID NO: 420545 - RNA, 22 nt, Human
gccuggaguacuccuugaagug

SEQ ID NO: 420546 - RNA, 22 nt, Human
cugaaugucgaucagcuugggu

SEQ ID NO: 420547 - RNA, 22 nt, Human
ugauuuccuagcugacaugaaa

SEQ ID NO: 420548 - RNA, 22 nt, Human
ucagcagggcugugguguggcu

SEQ ID NO: 420549 - RNA, 21 nt, Human
agcagccauuucacagagacu

SEQ ID NO: 420550 - RNA, 22 nt, Human
cagaccagcucuaugaacccaa

SEQ ID NO: 420551 - RNA, 22 nt, Human
uuuuuggguccaggcuguaucu

SEQ ID NO: 420552 - RNA, 22 nt, Human
aagaauguucuuguagucauga

SEQ ID NO: 420553 - RNA, 22 nt, Human
gaaaugugaccuacuuccuugu

SEQ ID NO: 420554 - RNA, 22 nt, Human
cuucuuaaugcauaaacugugu

SEQ ID NO: 420555 - RNA, 23 nt, Human
uggcaccaggcauucuaggggua

SEQ ID NO: 420556 - RNA, 22 nt, Human
aagccucuggggccucaucugu

SEQ ID NO: 420557 - RNA, 22 nt, Human
uggcucagaaggcugccuucac

SEQ ID NO: 420558 - RNA, 22 nt, Human
cuacauuuuucaccgagccucu

SEQ ID NO: 420559 - RNA, 22 nt, Human
uagagaaauaagcuuugccuug

SEQ ID NO: 420560 - RNA, 22 nt, Human
cagcagagcuuauguuggguca

SEQ ID NO: 420561 - RNA, 22 nt, Human
guggccagcaagugcugccucu

SEQ ID NO: 420562 - RNA, 22 nt, Human
cucaggaugcaggucacaggac

SEQ ID NO: 420563 - RNA, 22 nt, Human
ugggccugggagggcagacgcu

SEQ ID NO: 420564 - RNA, 22 nt, Human
agcagccagugggagugauaca

SEQ ID NO: 420565 - RNA, 22 nt, Human
ggagccuugggcgcucucccau

SEQ ID NO: 420566 - RNA, 22 nt, Human
uucuagaugauaaaccagcagc

SEQ ID NO: 420567 - RNA, 22 nt, Human
gccaaaucuugcacacucuugu

SEQ ID NO: 420568 - RNA, 22 nt, Human
uggagcagcaucacuuugagcu

SEQ ID NO: 420569 - RNA, 22 nt, Human
aaagccaaaugaaagaugguuc

SEQ ID NO: 420570 - RNA, 17 nt, Human
uccaggcagcaacugag

SEQ ID NO: 420571 - RNA, 22 nt, Human
cagagcagugaggaguugugua

SEQ ID NO: 420572 - RNA, 22 nt, Human
uccaaaaaacguuugaauaguu

SEQ ID NO: 420573 - RNA, 22 nt, Human
ucaaaguccuugcuuuuucugu

SEQ ID NO: 420574 - RNA, 22 nt, Human
gucaccaggucugaugcagcca

SEQ ID NO: 420575 - RNA, 22 nt, Human
gccugucugcgucacgcuuauu

SEQ ID NO: 420576 - RNA, 19 nt, Human
gaggaggaaaacuagugua

SEQ ID NO: 420577 - RNA, 22 nt, Human
agggagcaugggugaagcaggc

SEQ ID NO: 420578 - RNA, 20 nt, Human
gcaaggcacagugaggaggg

SEQ ID NO: 420579 - RNA, 22 nt, Human
agggugccuggaagccacucac

SEQ ID NO: 420580 - RNA, 22 nt, Human
caaaugugacuuuugggcuucu

SEQ ID NO: 420581 - RNA, 22 nt, Human
uuauggcauauuccucauugua

SEQ ID NO: 420582 - RNA, 22 nt, Human
agcauccaacaggagggaaggg

SEQ ID NO: 420583 - RNA, 22 nt, Human
gcugauccuuuuaugucuagcu

SEQ ID NO: 420584 - RNA, 20 nt, Human
gaaggaagggggcaagguga

SEQ ID NO: 420585 - RNA, 22 nt, Human
ucaggagauggucuuuauaggc

SEQ ID NO: 420586 - RNA, 20 nt, Human
ugaggcaggagaauggcaug

SEQ ID NO: 420587 - RNA, 22 nt, Human
gccugucugcagggcugucauu

SEQ ID NO: 420588 - RNA, 20 nt, Human
aaagucuuaugguuaauuuu

SEQ ID NO: 420589 - RNA, 21 nt, Human
ggagcugcaggagccgaaggc

SEQ ID NO: 420590 - RNA, 22 nt, Human
gagagggcucuguguggguacu

SEQ ID NO: 420591 - RNA, 22 nt, Human
gcaggaugaaggcagaggcuga

SEQ ID NO: 420592 - RNA, 22 nt, Human
ugcucugguaacucacuuccau

SEQ ID NO: 420593 - RNA, 19 nt, Human
caugagcugcucacuuccc

SEQ ID NO: 420594 - RNA, 22 nt, Human
cucuggaauuaaggaagccugu

SEQ ID NO: 420595 - RNA, 19 nt, Human
cugguccugacugaggggu

SEQ ID NO: 420596 - RNA, 22 nt, Human
uagggcucgggcacaggacagg

SEQ ID NO: 420597 - RNA, 19 nt, Human
gcugucugaugcugagguc

SEQ ID NO: 420598 - RNA, 22 nt, Human
cuggugcuggagccuagucccu

SEQ ID NO: 420599 - RNA, 22 nt, Human
uggcauuucaccuuucauuucc

SEQ ID NO: 420600 - RNA, 22 nt, Human
guggagacuucuacuagagacc

SEQ ID NO: 420601 - RNA, 22 nt, Human
cauguuauuuauccauuaaaca

SEQ ID NO: 420602 - RNA, 22 nt, Human
cagccccucccucaggcaggug

SEQ ID NO: 420603 - RNA, 22 nt, Human
acauuucucuugaugucucuau

SEQ ID NO: 420604 - RNA, 22 nt, Human
ccucuggcuguaccacuggcac

SEQ ID NO: 420605 - RNA, 22 nt, Human
cagcaguguggaagcugagggg

SEQ ID NO: 420606 - RNA, 22 nt, Human
caggguggggcuggcuaucaaa

SEQ ID NO: 420607 - RNA, 22 nt, Human
uaaauucccaacucugcucuuc

SEQ ID NO: 420608 - RNA, 21 nt, Human
ucagcagcuuuugcagucccu

SEQ ID NO: 420609 - RNA, 22 nt, Human
caaugauguuuagauaaaaucc

SEQ ID NO: 420610 - RNA, 22 nt, Human
cucagaauuacaucccauuuua

SEQ ID NO: 420611 - RNA, 22 nt, Human
agaaggccuaacuugggggcaa

SEQ ID NO: 420612 - RNA, 22 nt, Human
ucagcuuugaucucaggcaauc

SEQ ID NO: 420613 - RNA, 22 nt, Human
aaugaugguauugaugagcuaa

SEQ ID NO: 420614 - RNA, 22 nt, Human
agacucugauucccucauguca

SEQ ID NO: 420615 - RNA, 22 nt, Human
guucauuuaugauguaacaugu

SEQ ID NO: 420616 - RNA, 22 nt, Human
gccucugcaacuccgccuuggu

SEQ ID NO: 420617 - RNA, 22 nt, Human
guccuggggaauacagaagccg

SEQ ID NO: 420618 - RNA, 19 nt, Human
ucucagagcccuagaggcc

SEQ ID NO: 420619 - RNA, 21 nt, Human
aagagcuggaucaaggauaag

SEQ ID NO: 420620 - RNA, 22 nt, Human
gccugaugagcuuccagcugag

SEQ ID NO: 420621 - RNA, 22 nt, Human
ccaggccuggccaggggaugcc

SEQ ID NO: 420622 - RNA, 22 nt, Human
ggagcagagcugggcuuggcug

SEQ ID NO: 420623 - RNA, 22 nt, Human
uguaugcuuuccaaaaaugcug

SEQ ID NO: 420624 - RNA, 20 nt, Human
cuggcaggagcgagucuacc

SEQ ID NO: 420625 - RNA, 22 nt, Human
caaaugcaggucauaaccugag

SEQ ID NO: 420626 - RNA, 22 nt, Human
ucaggaugaccacgagccucua

SEQ ID NO: 420627 - RNA, 22 nt, Human
augaggcauuccacucaaacuc

SEQ ID NO: 420628 - RNA, 22 nt, Human
cuggccaguuguccuggcuugg

SEQ ID NO: 420629 - RNA, 22 nt, Human
ccaaaauuauuacauuuguagg

SEQ ID NO: 420630 - RNA, 22 nt, Human
gggcugacaguuuccccugaaa

SEQ ID NO: 420631 - RNA, 22 nt, Human
gggccacacagaaccuccuggu

SEQ ID NO: 420632 - RNA, 23 nt, Human
uguagcaucucuuauuucucagc

SEQ ID NO: 420633 - RNA, 22 nt, Human
uucaagaugcacaguggcauuc

SEQ ID NO: 420634 - RNA, 22 nt, Human
gucccagagagcacuaguccau

SEQ ID NO: 420635 - RNA, 22 nt, Human
ccagaggcuggguucaccucag

SEQ ID NO: 420636 - RNA, 22 nt, Human
ugcuuccuugagcucuccaauc

SEQ ID NO: 420637 - RNA, 22 nt, Human
agucccagaucuccauucgguc

SEQ ID NO: 420638 - RNA, 22 nt, Human
uccaggcauaaugcccaguggu

SEQ ID NO: 420639 - RNA, 22 nt, Human
ggagcuguuggcagcuaucuug

SEQ ID NO: 420640 - RNA, 22 nt, Human
aacucagcauccugcacagaga

SEQ ID NO: 420641 - RNA, 22 nt, Human
cccaggugggcaccucgaggaa

SEQ ID NO: 420642 - RNA, 22 nt, Human
gggcugagugucccaggccgaa

SEQ ID NO: 420643 - RNA, 22 nt, Human
caucucaugggcaugccaagcu

SEQ ID NO: 420644 - RNA, 22 nt, Human
acuguguccucauguggcagaa

SEQ ID NO: 420645 - RNA, 22 nt, Human
agacagcauggagcugauaaca

SEQ ID NO: 420646 - RNA, 22 nt, Human
agcaguggccuggggcucugug

SEQ ID NO: 420647 - RNA, 22 nt, Human
uagcuuuaagacauggugaaug

SEQ ID NO: 420648 - RNA, 22 nt, Human
agagacaccgcgcaucauggcu

SEQ ID NO: 420649 - RNA, 22 nt, Human
uaagccacuagucuguuaugaa

SEQ ID NO: 420650 - RNA, 22 nt, Human
agagccaggcaggcaauguuga

SEQ ID NO: 420651 - RNA, 22 nt, Human
cauucacucagcgaugccagua

SEQ ID NO: 420652 - RNA, 22 nt, Human
cagcaggggaacugugggccag

SEQ ID NO: 420653 - RNA, 22 nt, Human
gaggccuguagucauggaugua

SEQ ID NO: 420654 - RNA, 22 nt, Human
caaagugcuaggauuacaggcc

SEQ ID NO: 420655 - RNA, 22 nt, Human
aacagaaugcaggggaugcugc

SEQ ID NO: 420656 - RNA, 22 nt, Human
cagccagcuucagauccaagcc

SEQ ID NO: 420657 - RNA, 22 nt, Human
ggugucuguugccuccugguua

SEQ ID NO: 420658 - RNA, 22 nt, Human
agccaggccagacucacacccu

SEQ ID NO: 420659 - RNA, 23 nt, Human
aggauccugguacaggagcagag

SEQ ID NO: 420660 - RNA, 22 nt, Human
cauuuguauagugcuuagacca

SEQ ID NO: 420661 - RNA, 22 nt, Human
ugugggcacuaaugacaugcag

SEQ ID NO: 420662 - RNA, 22 nt, Human
ucacaguuauagucuguagaau

SEQ ID NO: 420663 - RNA, 22 nt, Human
uggcugagcucccuguguguug

SEQ ID NO: 420664 - RNA, 17 nt, Human
uccuggcucugccacug

SEQ ID NO: 420665 - RNA, 22 nt, Human
aggccucacauugggcuucaag

SEQ ID NO: 420666 - RNA, 22 nt, Human
uugcucagcacuggagccagcu

SEQ ID NO: 420667 - RNA, 18 nt, Human
guaggucaguaccaagca

SEQ ID NO: 420668 - RNA, 22 nt, Human
ggcugaguugagaggauuacuu

SEQ ID NO: 420669 - RNA, 22 nt, Human
agugucugccagcugccaggug

SEQ ID NO: 420670 - RNA, 22 nt, Human
cauuuauugaguggccacagug

SEQ ID NO: 420671 - RNA, 22 nt, Human
gcucccucugcucaggcacuug

SEQ ID NO: 420672 - RNA, 22 nt, Human
gcugagugagguccagagcuug

SEQ ID NO: 420673 - RNA, 22 nt, Human
uuuuucaagacaaccugcaugu

SEQ ID NO: 420674 - RNA, 22 nt, Human
uaauuuuaacugugcuguuugg

SEQ ID NO: 420675 - RNA, 21 nt, Human
uggccucccacacuuccaugg

SEQ ID NO: 420676 - RNA, 22 nt, Human
cuguuauuucugccaggugagu

SEQ ID NO: 420677 - RNA, 22 nt, Human
aggggugaaggcccgauaggag

SEQ ID NO: 420678 - RNA, 22 nt, Human
agucuccuuggccucaaugccu

SEQ ID NO: 420679 - RNA, 22 nt, Human
uacuguacugcaguucugcaaa

SEQ ID NO: 420680 - RNA, 22 nt, Human
cugaggaugguguggucuucuc

SEQ ID NO: 420681 - RNA, 22 nt, Human
ccuucucuacuccugaugcaug

SEQ ID NO: 420682 - RNA, 22 nt, Human
uuacaaagcaggucagcugaaa

SEQ ID NO: 420683 - RNA, 22 nt, Human
aagaaaacguuuugaggaguuu

SEQ ID NO: 420684 - RNA, 22 nt, Human
gagacguggccuuugccugagc

SEQ ID NO: 420685 - RNA, 22 nt, Human
ugcaggcuguaaucugaggcua

SEQ ID NO: 420686 - RNA, 22 nt, Human
auuuauuaugggauuuggcaca

SEQ ID NO: 420687 - RNA, 22 nt, Human
acaguggaugugauguccaggu

SEQ ID NO: 420688 - RNA, 22 nt, Human
agugaaaucagguuuugacugc

SEQ ID NO: 420689 - RNA, 22 nt, Human
uucuccucuguuggccuucccu

SEQ ID NO: 420690 - RNA, 22 nt, Human
uaauuuuaugacaguguauuuu

SEQ ID NO: 420691 - RNA, 22 nt, Human
augggaggcagacacuaaguuc

SEQ ID NO: 420692 - RNA, 22 nt, Human
acaguguguucugggaccucca

SEQ ID NO: 420693 - RNA, 22 nt, Human
ugagccuguggggugacaacca

SEQ ID NO: 420694 - RNA, 22 nt, Human
uucugcagcccaacaguaguuu

SEQ ID NO: 420695 - RNA, 22 nt, Human
cugagccaugagccugcgccca

SEQ ID NO: 420696 - RNA, 18 nt, Human
gggcucugauccuucacc

SEQ ID NO: 420697 - RNA, 22 nt, Human
acucaggagggaucagcuauca

SEQ ID NO: 420698 - RNA, 22 nt, Human
uucaagaucuuccaaaggauac

SEQ ID NO: 420699 - RNA, 22 nt, Human
aaaggccacacugcucuuucuc

SEQ ID NO: 420700 - RNA, 22 nt, Human
gcagagugagauaugaacccag

SEQ ID NO: 420701 - RNA, 22 nt, Human
cagggcuguggcuuugugcugu

SEQ ID NO: 420702 - RNA, 22 nt, Human
acaguggaauggugggccugca

SEQ ID NO: 420703 - RNA, 22 nt, Human
ccagggcagccaacccagaugc

SEQ ID NO: 420704 - RNA, 22 nt, Human
ccagggcacguugggacaguac

SEQ ID NO: 420705 - RNA, 22 nt, Human
cccagagccucauucuguuggg

SEQ ID NO: 420706 - RNA, 22 nt, Human
gagucugagaacugggcucagu

SEQ ID NO: 420707 - RNA, 22 nt, Human
agcuggguguguaucagauaaa

SEQ ID NO: 420708 - RNA, 22 nt, Human
cccuggaggcaaagguugcagu

SEQ ID NO: 420709 - RNA, 22 nt, Human
cacccacccacugcucauuggc

SEQ ID NO: 420710 - RNA, 22 nt, Human
caucaguguggcaguucacugu

SEQ ID NO: 420711 - RNA, 22 nt, Human
aagccucaccuuuuagaagcua

SEQ ID NO: 420712 - RNA, 22 nt, Human
uggagcaggacugcugcccuca

SEQ ID NO: 420713 - RNA, 22 nt, Human
ucuuuuauuaggcugaaauggg

SEQ ID NO: 420714 - RNA, 22 nt, Human
ugggacuugccucgagggcugc

SEQ ID NO: 420715 - RNA, 22 nt, Human
aaggccagccugagagcuaaca

SEQ ID NO: 420716 - RNA, 22 nt, Human
aggccugggcaagaaggggcgu

SEQ ID NO: 420717 - RNA, 22 nt, Human
guauuaggagguggagccuuug

SEQ ID NO: 420718 - RNA, 22 nt, Human
aaggcaguaggaucuuccacag

SEQ ID NO: 420719 - RNA, 21 nt, Human
ucucugugucuuuaagcugga

SEQ ID NO: 420720 - RNA, 22 nt, Human
cugucauugagccugucagggc

SEQ ID NO: 420721 - RNA, 22 nt, Human
aaaggccaccaacaugaagcau

SEQ ID NO: 420722 - RNA, 22 nt, Human
ccacagaguuacaaaacaguca

SEQ ID NO: 420723 - RNA, 22 nt, Human
gccaggcucucagugacugccc

SEQ ID NO: 420724 - RNA, 22 nt, Human
ggagccugacagugcccagcau

SEQ ID NO: 420725 - RNA, 22 nt, Human
aggcaggugggucacuugaguc

SEQ ID NO: 420726 - RNA, 22 nt, Human
uucaagucaaggaaagaggucu

SEQ ID NO: 420727 - RNA, 19 nt, Human
ccagcagcuuugauucucu

SEQ ID NO: 420728 - RNA, 21 nt, Human
acuuugggcacuuuccugccc

SEQ ID NO: 420729 - RNA, 22 nt, Human
uugcagcagggugaauucacuc

SEQ ID NO: 420730 - RNA, 22 nt, Human
uuauguauggauggcugaaagu

SEQ ID NO: 420731 - RNA, 21 nt, Human
aaaugaaugugguagugcaag

SEQ ID NO: 420732 - RNA, 22 nt, Human
caaaugcaggucagcagguguc

SEQ ID NO: 420733 - RNA, 22 nt, Human
caaaguauauuggauugaaugg

SEQ ID NO: 420734 - RNA, 23 nt, Human
cagggccaggcagcagcugucac

SEQ ID NO: 420735 - RNA, 22 nt, Human
caggguggaaaagcuaguugga

SEQ ID NO: 420736 - RNA, 22 nt, Human
caaugauggcuaggcagcugcu

SEQ ID NO: 420737 - RNA, 22 nt, Human
caggaucccuggccuccgccca

SEQ ID NO: 420738 - RNA, 22 nt, Human
uaguccaguaaaacagcuaacg

SEQ ID NO: 420739 - RNA, 22 nt, Human
caguuuuuagauuaguuggugg

SEQ ID NO: 420740 - RNA, 22 nt, Human
gaucauuuacuuguucuggacu

SEQ ID NO: 420741 - RNA, 22 nt, Human
acacagggcggaaagcaugaga

SEQ ID NO: 420742 - RNA, 22 nt, Human
ggcucagaaacuaaaggcgcug

SEQ ID NO: 420743 - RNA, 22 nt, Human
uagcagggaaggugugcugagc

SEQ ID NO: 420744 - RNA, 19 nt, Human
gcucugagaggggcauggg

SEQ ID NO: 420745 - RNA, 22 nt, Human
auccucagcaucuagcaugaag

SEQ ID NO: 420746 - RNA, 22 nt, Human
agaugauggccauguccucucc

SEQ ID NO: 420747 - RNA, 22 nt, Human
uucaggaucauuuguuuuaucu

SEQ ID NO: 420748 - RNA, 22 nt, Human
ugcagggcagcuagggagcuuu

SEQ ID NO: 420749 - RNA, 23 nt, Human
cagagcuggcucagagcugccug

SEQ ID NO: 420750 - RNA, 21 nt, Human
ggcagcugaccgcgcggugca

SEQ ID NO: 420751 - RNA, 22 nt, Human
cugccugugccaaugcuccuuu

SEQ ID NO: 420752 - RNA, 22 nt, Human
gcagagcuccccaagacaccaa

SEQ ID NO: 420753 - RNA, 18 nt, Human
agcugcagaccaggaggu

SEQ ID NO: 420754 - RNA, 22 nt, Human
cuggucugagggcucuugaggc

SEQ ID NO: 420755 - RNA, 22 nt, Human
ucccuggacaacagacuucacu

SEQ ID NO: 420756 - RNA, 22 nt, Human
accuuaaaacugacacauggag

SEQ ID NO: 420757 - RNA, 22 nt, Human
ugaguacucggagugcuuugga

SEQ ID NO: 420758 - RNA, 22 nt, Human
guguugaugacauuuuagaaac

SEQ ID NO: 420759 - RNA, 22 nt, Human
agcagagccaggucucucugua

SEQ ID NO: 420760 - RNA, 22 nt, Human
cucuccuugcagauggcugccu

SEQ ID NO: 420761 - RNA, 22 nt, Human
ggcugucugugguggagcguug

SEQ ID NO: 420762 - RNA, 22 nt, Human
cucucccagucaggcucaggau

SEQ ID NO: 420763 - RNA, 22 nt, Human
uggcucagagcagggacucugg

SEQ ID NO: 420764 - RNA, 18 nt, Human
agagaugguguagaguuu

SEQ ID NO: 420765 - RNA, 22 nt, Human
uacauucaacaugucacuaugu

SEQ ID NO: 420766 - RNA, 22 nt, Human
agguuuucagcuguauccugag

SEQ ID NO: 420767 - RNA, 22 nt, Human
guggcuugaccaucccugcuac

SEQ ID NO: 420768 - RNA, 22 nt, Human
ugucacauaggcaaaauguuuu

SEQ ID NO: 420769 - RNA, 22 nt, Human
agugcagccgagaucaggugcu

SEQ ID NO: 420770 - RNA, 21 nt, Human
uggccaaacuggagcauuuga

SEQ ID NO: 420771 - RNA, 22 nt, Human
caggggcucccugggugccagu

SEQ ID NO: 420772 - RNA, 22 nt, Human
aucagagauuguaguaugugca

SEQ ID NO: 420773 - RNA, 22 nt, Human
ggcaggguccacaccugggaaa

SEQ ID NO: 420774 - RNA, 22 nt, Human
ccucccuggccagagcagcagc

SEQ ID NO: 420775 - RNA, 22 nt, Human
gauugaaacauaggcagucgag

SEQ ID NO: 420776 - RNA, 22 nt, Human
cagaaacuauguaagaaaguga

SEQ ID NO: 420777 - RNA, 22 nt, Human
cagguggguguaugaaugcaaa

SEQ ID NO: 420778 - RNA, 22 nt, Human
cagguuuagguggacgugcagg

SEQ ID NO: 420779 - RNA, 18 nt, Human
cagaagcaggcagugcag

SEQ ID NO: 420780 - RNA, 22 nt, Human
agugugagccuacaggccaaag

SEQ ID NO: 420781 - RNA, 23 nt, Human
ggcaccaggccauggagcgggag

SEQ ID NO: 420782 - RNA, 18 nt, Human
uacaugcauaaaugaagc

SEQ ID NO: 420783 - RNA, 22 nt, Human
gucaggauuuacaaacuucagu

SEQ ID NO: 420784 - RNA, 22 nt, Human
ccuggcuuuuguuuauaaauuc

SEQ ID NO: 420785 - RNA, 22 nt, Human
auaaauuuauaauuguuuccug

SEQ ID NO: 420786 - RNA, 22 nt, Human
acccugagggguauagcagaag

SEQ ID NO: 420787 - RNA, 22 nt, Human
gaugagggccugguggcugugc

SEQ ID NO: 420788 - RNA, 22 nt, Human
ggcaaaaacagcaaugacuuuu

SEQ ID NO: 420789 - RNA, 21 nt, Human
uccucugcucucauaccacaa

SEQ ID NO: 420790 - RNA, 22 nt, Human
agcaauaugacauugcuacauc

SEQ ID NO: 420791 - RNA, 22 nt, Human
agucagugaaaacuagaauguu

SEQ ID NO: 420792 - RNA, 22 nt, Human
guaauugacucagcucuguuca

SEQ ID NO: 420793 - RNA, 22 nt, Human
auugacaagcaguaugucuuag

SEQ ID NO: 420794 - RNA, 22 nt, Human
gaugggaggaaccugggucccu

SEQ ID NO: 420795 - RNA, 22 nt, Human
ucuccucucuuaccugguacaa

SEQ ID NO: 420796 - RNA, 22 nt, Human
gagcugcuucugugugccgggu

SEQ ID NO: 420797 - RNA, 22 nt, Human
uuauucagauuggcuacaggau

SEQ ID NO: 420798 - RNA, 22 nt, Human
ucugucacuuuuauuuacugaa

SEQ ID NO: 420799 - RNA, 22 nt, Human
ucuguccauucagccauccauc

SEQ ID NO: 420800 - RNA, 22 nt, Human
ugagccaggcucaagugauccu

SEQ ID NO: 420801 - RNA, 22 nt, Human
cugagcugggcucucuugaggg

SEQ ID NO: 420802 - RNA, 22 nt, Human
ggaagaggcucucauugagggc

SEQ ID NO: 420803 - RNA, 22 nt, Human
guauuuuaagugacuacuaggu

SEQ ID NO: 420804 - RNA, 22 nt, Human
ugauucacagacuucacaaggc

SEQ ID NO: 420805 - RNA, 22 nt, Human
acagacagggcaccugccuccu

SEQ ID NO: 420806 - RNA, 22 nt, Human
caggccacaaguuggguucaag

SEQ ID NO: 420807 - RNA, 22 nt, Human
ugcucacugaacucuugcuguc

SEQ ID NO: 420808 - RNA, 22 nt, Human
ugcccacauggugccauggcca

SEQ ID NO: 420809 - RNA, 22 nt, Human
gucucagauaacauguauucua

SEQ ID NO: 420810 - RNA, 22 nt, Human
uauugacaauaggcaacugagg

SEQ ID NO: 420811 - RNA, 22 nt, Human
agggcugcuuugcuaaauaugg

SEQ ID NO: 420812 - RNA, 22 nt, Human
ugucugagugugccugggcauu

SEQ ID NO: 420813 - RNA, 22 nt, Human
auuuauuaugggauuuggcuca

SEQ ID NO: 420814 - RNA, 22 nt, Human
uucacauugguucuugauagcu

SEQ ID NO: 420815 - RNA, 22 nt, Human
cagccagagaaagggcacugcc

SEQ ID NO: 420816 - RNA, 22 nt, Human
cagaaauggaauuuuccaucac

SEQ ID NO: 420817 - RNA, 23 nt, Human
cuugcagggcuggaggcuuagaa

SEQ ID NO: 420818 - RNA, 22 nt, Human
auacagaaaaugaugcagaguu

SEQ ID NO: 420819 - RNA, 22 nt, Human
agcauuuaggagaauuugagaa

SEQ ID NO: 420820 - RNA, 23 nt, Human
cagcugaagcagccugggcugga

SEQ ID NO: 420821 - RNA, 22 nt, Human
ugcuauugugaacagugccaca

SEQ ID NO: 420822 - RNA, 22 nt, Human
auacaagaucacuccagaaaau

SEQ ID NO: 420823 - RNA, 22 nt, Human
uugcagcuuagugauguuaucu

SEQ ID NO: 420824 - RNA, 22 nt, Human
ccagcccucacugaggccucuc

SEQ ID NO: 420825 - RNA, 22 nt, Human
ggcuucagugacuggugcccuc

SEQ ID NO: 420826 - RNA, 22 nt, Human
caaggccaagucucugugaaga

SEQ ID NO: 420827 - RNA, 22 nt, Human
acugugcacaauucuaaguccu

SEQ ID NO: 420828 - RNA, 22 nt, Human
uuuuagauaguuuaacugcacu

SEQ ID NO: 420829 - RNA, 20 nt, Human
uguacacaguacuuuacaau

SEQ ID NO: 420830 - RNA, 22 nt, Human
cugucccaggagcuguaagaca

SEQ ID NO: 420831 - RNA, 22 nt, Human
ugucagaacucuauugaugucc

SEQ ID NO: 420832 - RNA, 22 nt, Human
caaaaacugcaauuacuuuuac

SEQ ID NO: 420833 - RNA, 22 nt, Human
acagagcuaauguugcauaggc

SEQ ID NO: 420834 - RNA, 22 nt, Human
ucaucacauaugucaugauuug

SEQ ID NO: 420835 - RNA, 22 nt, Human
ugccuggguucccaccccaaag

SEQ ID NO: 420836 - RNA, 22 nt, Human
uccugcagccauuagaggucaa

SEQ ID NO: 420837 - RNA, 22 nt, Human
ugggacagagugagcuuuggcc

SEQ ID NO: 420838 - RNA, 22 nt, Human
gccuggaguagcauggcaagcc

SEQ ID NO: 420839 - RNA, 22 nt, Human
cugagccuguguuucucuggca

SEQ ID NO: 420840 - RNA, 22 nt, Human
ucagggcaucaucaugaauaua

SEQ ID NO: 420841 - RNA, 22 nt, Human
agccccuuccaguucucagauc

SEQ ID NO: 420842 - RNA, 23 nt, Human
ggccucuguguucugcccacaug

SEQ ID NO: 420843 - RNA, 22 nt, Human
ucucaggaguagugggauccau

SEQ ID NO: 420844 - RNA, 22 nt, Human
acaguggaagcaugaugcuauc

SEQ ID NO: 420845 - RNA, 22 nt, Human
aaaugcaccuugcugugagacu

SEQ ID NO: 420846 - RNA, 22 nt, Human
aaugcaguuucauuuguagaau

SEQ ID NO: 420847 - RNA, 22 nt, Human
ugugaaagucaaauuaauugaa

SEQ ID NO: 420848 - RNA, 22 nt, Human
ugaaaucugucccacuuuagcu

SEQ ID NO: 420849 - RNA, 22 nt, Human
ugcucucucaggccuggcccac

SEQ ID NO: 420850 - RNA, 22 nt, Human
uccagcagguccgagacaaguu

SEQ ID NO: 420851 - RNA, 22 nt, Human
agauguuccagccaaugggaau

SEQ ID NO: 420852 - RNA, 18 nt, Human
cugcugcaggcacucagg

SEQ ID NO: 420853 - RNA, 22 nt, Human
agccucucuuucugguggcuaa

SEQ ID NO: 420854 - RNA, 22 nt, Human
uuuuaccugaaccacacaguau

SEQ ID NO: 420855 - RNA, 22 nt, Human
uauguacauggagagcaauuga

SEQ ID NO: 420856 - RNA, 22 nt, Human
auauuucuugagcaccugguau

SEQ ID NO: 420857 - RNA, 22 nt, Human
aauuaguauugcgauucauuag

SEQ ID NO: 420858 - RNA, 20 nt, Human
ugucauuguuucuaggaccu

SEQ ID NO: 420859 - RNA, 22 nt, Human
aggguggcaguuacuggagcaa

SEQ ID NO: 420860 - RNA, 22 nt, Human
uaaagguaacaugaacugcuuu

SEQ ID NO: 420861 - RNA, 22 nt, Human
ccuacacaucucaccucacagg

SEQ ID NO: 420862 - RNA, 22 nt, Human
aauauuuuaggcuuuccaggcu

SEQ ID NO: 420863 - RNA, 22 nt, Human
auguacauuuuccuaauguuuu

SEQ ID NO: 420864 - RNA, 22 nt, Human
auuauuagacuuauaugguagu

SEQ ID NO: 420865 - RNA, 23 nt, Human
gugauuucagggaacagaaucag

SEQ ID NO: 420866 - RNA, 22 nt, Human
cccucugccugggaccaagucc

SEQ ID NO: 420867 - RNA, 22 nt, Human
ugcccugucuaagcugucagua

SEQ ID NO: 420868 - RNA, 22 nt, Human
aggacagugguguucuggagug

SEQ ID NO: 420869 - RNA, 22 nt, Human
aaauccuaaugacaaguuuagu

SEQ ID NO: 420870 - RNA, 22 nt, Human
aucagagauggcuccagugcuc

SEQ ID NO: 420871 - RNA, 22 nt, Human
uagccgcuuaauuauuugguga

SEQ ID NO: 420872 - RNA, 22 nt, Human
agcugcagugaacuguuuuguc

SEQ ID NO: 420873 - RNA, 22 nt, Human
agccagugaugaagacucugga

SEQ ID NO: 420874 - RNA, 22 nt, Human
cacaucagguagaccuacagag

SEQ ID NO: 420875 - RNA, 22 nt, Human
gccugccuagaauugcagcuuu

SEQ ID NO: 420876 - RNA, 22 nt, Human
uuauuauagauuaugcaagauu

SEQ ID NO: 420877 - RNA, 22 nt, Human
gccuggugcuaugagggccagc

SEQ ID NO: 420878 - RNA, 22 nt, Human
cagcugaagagaggugcugagu

SEQ ID NO: 420879 - RNA, 22 nt, Human
gaggccaaguuggagaccaggu

SEQ ID NO: 420880 - RNA, 22 nt, Human
agcauuuaauuacaguuuaauu

SEQ ID NO: 420881 - RNA, 22 nt, Human
uaauuauuaugacaacaauugc

SEQ ID NO: 420882 - RNA, 22 nt, Human
agcagggcuggggcacgagcca

SEQ ID NO: 420883 - RNA, 22 nt, Human
cacuggggaaaacaggcuucuu

SEQ ID NO: 420884 - RNA, 22 nt, Human
aggcuucuaggguuggcagcgg

SEQ ID NO: 420885 - RNA, 22 nt, Human
auccccagaaaauaggugccua

SEQ ID NO: 420886 - RNA, 22 nt, Human
ugcugugagguugagaaggaag

SEQ ID NO: 420887 - RNA, 22 nt, Human
cuggggcuucaaugcuucggug

SEQ ID NO: 420888 - RNA, 22 nt, Human
caggcacuggggaugcugggau

SEQ ID NO: 420889 - RNA, 22 nt, Human
ggugcccaccugucuuccugga

SEQ ID NO: 420890 - RNA, 22 nt, Human
auaagagcuagucuuuuccuug

SEQ ID NO: 420891 - RNA, 22 nt, Human
ucucccacugcaagcccaggcu

SEQ ID NO: 420892 - RNA, 22 nt, Human
ggcagcuccaaaaggaaacacu

SEQ ID NO: 420893 - RNA, 22 nt, Human
aacaaaugauuguugguuggag

SEQ ID NO: 420894 - RNA, 22 nt, Human
ucauguuuuaguaaagugaagg

SEQ ID NO: 420895 - RNA, 22 nt, Human
cucaggauguacuacagaaggc

SEQ ID NO: 420896 - RNA, 22 nt, Human
caguagccacuagacacaugua

SEQ ID NO: 420897 - RNA, 22 nt, Human
uacuuccagcaaucugcauauu

SEQ ID NO: 420898 - RNA, 22 nt, Human
cucaggauuaaggaaucuaaau

SEQ ID NO: 420899 - RNA, 22 nt, Human
aauuaguaaccuaauuccaucu

SEQ ID NO: 420900 - RNA, 22 nt, Human
uugaaucauuacaauagauaag

SEQ ID NO: 420901 - RNA, 22 nt, Human
uucucuuauucuggauaugcag

SEQ ID NO: 420902 - RNA, 22 nt, Human
agcuccugaaaagcgcuugcuu

SEQ ID NO: 420903 - RNA, 22 nt, Human
cuuuccuagauggccaucuuuc

SEQ ID NO: 420904 - RNA, 22 nt, Human
caaugguggugucagaagagau

SEQ ID NO: 420905 - RNA, 22 nt, Human
aaagcaguauauugguaguugu

SEQ ID NO: 420906 - RNA, 22 nt, Human
ccagcacugcucucagacugag

SEQ ID NO: 420907 - RNA, 22 nt, Human
uccugcagcugauaaauacagu

SEQ ID NO: 420908 - RNA, 22 nt, Human
auugaaagagaauguagcucuu

SEQ ID NO: 420909 - RNA, 22 nt, Human
aaguccagcagugcuuguugau

SEQ ID NO: 420910 - RNA, 22 nt, Human
ucuggccacccgaggccccugc

SEQ ID NO: 420911 - RNA, 21 nt, Human
ccuauugaauauaggaagauu

SEQ ID NO: 420912 - RNA, 22 nt, Human
ucucagggccucccucuguuuc

SEQ ID NO: 420913 - RNA, 22 nt, Human
acagaguaggugcugucgacug

SEQ ID NO: 420914 - RNA, 22 nt, Human
aaaagguuuugaguacaaauau

SEQ ID NO: 420915 - RNA, 22 nt, Human
uacaacauguaaagugguuuaa

SEQ ID NO: 420916 - RNA, 22 nt, Human
aggccuguuggcgugggcucua

SEQ ID NO: 420917 - RNA, 22 nt, Human
ccagagagaaauggauuugagu

SEQ ID NO: 420918 - RNA, 22 nt, Human
ucucagggaccaugaugaugac

SEQ ID NO: 420919 - RNA, 22 nt, Human
gaaaggccagcucacagaugag

SEQ ID NO: 420920 - RNA, 22 nt, Human
agcaguggaccucagugcuauu

SEQ ID NO: 420921 - RNA, 23 nt, Human
acagugugguggacaaggagcag

SEQ ID NO: 420922 - RNA, 18 nt, Human
ugaauuaguuugugguuu

SEQ ID NO: 420923 - RNA, 22 nt, Human
uucaugugaauauauuugucuu

SEQ ID NO: 420924 - RNA, 22 nt, Human
cagggcucgcucuugcccuucg

SEQ ID NO: 420925 - RNA, 22 nt, Human
gcccugagggguggugucugua

SEQ ID NO: 420926 - RNA, 22 nt, Human
ccuccugguccagcaucucuuu

SEQ ID NO: 420927 - RNA, 22 nt, Human
ccaggccuggaccaugccaggg

SEQ ID NO: 420928 - RNA, 18 nt, Human
agcuggcccuggcugccg

SEQ ID NO: 420929 - RNA, 22 nt, Human
ggcacucagagauucaggcugu

SEQ ID NO: 420930 - RNA, 22 nt, Human
ccacagcaugcaggccugacac

SEQ ID NO: 420931 - RNA, 22 nt, Human
gauuuauuggucuuucauuggu

SEQ ID NO: 420932 - RNA, 22 nt, Human
cccaagaucuuucgugcacuaa

SEQ ID NO: 420933 - RNA, 22 nt, Human
ucgggcucgcucuccuagcgga

SEQ ID NO: 420934 - RNA, 22 nt, Human
ucccaggcuaggccucugcguu

SEQ ID NO: 420935 - RNA, 22 nt, Human
agugagcauucguuuggaaccc

SEQ ID NO: 420936 - RNA, 22 nt, Human
aaacugaaacaucaucauguug

SEQ ID NO: 420937 - RNA, 22 nt, Human
cauuucuagggaucauaaagua

SEQ ID NO: 420938 - RNA, 22 nt, Human
agcucuggaauaaugaugugau

SEQ ID NO: 420939 - RNA, 17 nt, Human
ucagcaggggccaagcu

SEQ ID NO: 420940 - RNA, 22 nt, Human
uaauaucuacuucauagaguuu

SEQ ID NO: 420941 - RNA, 22 nt, Human
uagcugcugcagcacagggagg

SEQ ID NO: 420942 - RNA, 22 nt, Human
caaggccaguucaccaagggca

SEQ ID NO: 420943 - RNA, 22 nt, Human
gccugagauucugcauuucuaa

SEQ ID NO: 420944 - RNA, 22 nt, Human
ggugggcaacauuuggccugag

SEQ ID NO: 420945 - RNA, 22 nt, Human
caggagugaguuggggucuaca

SEQ ID NO: 420946 - RNA, 20 nt, Human
cugcaggguuagaggcucca

SEQ ID NO: 420947 - RNA, 22 nt, Human
gcccucucggcauagcaggggc

SEQ ID NO: 420948 - RNA, 22 nt, Human
uuagaaaucaccucugaagauc

SEQ ID NO: 420949 - RNA, 22 nt, Human
ugggcugccggcaggcucugcc

SEQ ID NO: 420950 - RNA, 22 nt, Human
gagcuggcuccgccaugcugcu

SEQ ID NO: 420951 - RNA, 22 nt, Human
uugaggagcacuagucagguau

SEQ ID NO: 420952 - RNA, 22 nt, Human
uuugcauuauauuuauagaaga

SEQ ID NO: 420953 - RNA, 18 nt, Human
gggaagccgggaagccgg

SEQ ID NO: 420954 - RNA, 22 nt, Human
aggcagggugaugauaaugauu

SEQ ID NO: 420955 - RNA, 22 nt, Human
gagcuuccacucuagaaggagu

SEQ ID NO: 420956 - RNA, 22 nt, Human
augggaugcauggcuguggcca

SEQ ID NO: 420957 - RNA, 22 nt, Human
agugugcugcuuaaacaguugu

SEQ ID NO: 420958 - RNA, 22 nt, Human
agagccagcaacucuagcccug

SEQ ID NO: 420959 - RNA, 22 nt, Human
ccaggccugauugggaaucuug

SEQ ID NO: 420960 - RNA, 22 nt, Human
uuggaaggagucaaccagcuga

SEQ ID NO: 420961 - RNA, 22 nt, Human
cugcugugaguuuggaggucua

SEQ ID NO: 420962 - RNA, 22 nt, Human
guagggacuguucucaccugag

SEQ ID NO: 420963 - RNA, 22 nt, Human
cauggcugcgagaagagugggu

SEQ ID NO: 420964 - RNA, 22 nt, Human
uaauuucuaauucauuuucagu

SEQ ID NO: 420965 - RNA, 22 nt, Human
ggccuggaagaggacagagaaa

SEQ ID NO: 420966 - RNA, 22 nt, Human
ucuguacauuuguguugugaau

SEQ ID NO: 420967 - RNA, 20 nt, Human
agagccuggaaaaagacauc

SEQ ID NO: 420968 - RNA, 22 nt, Human
ccaguggaguuuuuauacccag

SEQ ID NO: 420969 - RNA, 22 nt, Human
aggcugggaaaccugaaguugu

SEQ ID NO: 420970 - RNA, 21 nt, Human
auccauccaucuuggccuaac

SEQ ID NO: 420971 - RNA, 22 nt, Human
agcagcagauccaaaaaaugug

SEQ ID NO: 420972 - RNA, 21 nt, Human
aggcccagagucuugggggga

SEQ ID NO: 420973 - RNA, 22 nt, Human
ucccagagccaagcuauggaug

SEQ ID NO: 420974 - RNA, 19 nt, Human
agggucaggacaaggacuu

SEQ ID NO: 420975 - RNA, 22 nt, Human
aaaucuggccccuugccuauuu

SEQ ID NO: 420976 - RNA, 22 nt, Human
ccagagggcaaaaugaagcuua

SEQ ID NO: 420977 - RNA, 22 nt, Human
ucacaguaucacacaaggauua

SEQ ID NO: 420978 - RNA, 20 nt, Human
uauuucugggcaaccauuua

SEQ ID NO: 420979 - RNA, 22 nt, Human
gagaaacuaacaucugaaggug

SEQ ID NO: 420980 - RNA, 22 nt, Human
acagagcugggaucugaaccca

SEQ ID NO: 420981 - RNA, 22 nt, Human
ucaaacuagccugacugguauu

SEQ ID NO: 420982 - RNA, 22 nt, Human
aagcagaugggacuccaaggca

SEQ ID NO: 420983 - RNA, 22 nt, Human
auggacaggcugagcuuccuca

SEQ ID NO: 420984 - RNA, 22 nt, Human
ggagccuggcaaugcugcgucc

SEQ ID NO: 420985 - RNA, 22 nt, Human
cggcugagcagugcugauggaa

SEQ ID NO: 420986 - RNA, 22 nt, Human
uagcugugagcacccaggcugu

SEQ ID NO: 420987 - RNA, 22 nt, Human
agccucugcacgggcacgggug

SEQ ID NO: 420988 - RNA, 22 nt, Human
ugaaggugucuuugugaacauc

SEQ ID NO: 420989 - RNA, 22 nt, Human
gcuuuuauuucuucacaaaagu

SEQ ID NO: 420990 - RNA, 16 nt, Human
uccaggcauaucugag

SEQ ID NO: 420991 - RNA, 22 nt, Human
aagucuguuugagugucacacu

SEQ ID NO: 420992 - RNA, 22 nt, Human
acauuucuuugcuagacagcag

SEQ ID NO: 420993 - RNA, 22 nt, Human
uuccagggcuaauuccugugga

SEQ ID NO: 420994 - RNA, 23 nt, Human
aagcugccuucgcaguuggucug

SEQ ID NO: 420995 - RNA, 22 nt, Human
cugggaggcagucucucuagaa

SEQ ID NO: 420996 - RNA, 22 nt, Human
uagggacccucccugcucuaac

SEQ ID NO: 420997 - RNA, 22 nt, Human
gugucaugcacacucaguguug

SEQ ID NO: 420998 - RNA, 22 nt, Human
cagggccuccccggcagucuuu

SEQ ID NO: 420999 - RNA, 22 nt, Human
gagaggucaucucccaucagca

SEQ ID NO: 421000 - RNA, 22 nt, Human
aggaacugauuuauaacuuuag

SEQ ID NO: 421001 - RNA, 21 nt, Human
agucccaggggugagugaugu

SEQ ID NO: 421002 - RNA, 22 nt, Human
uccucucagugugguuguggga

SEQ ID NO: 421003 - RNA, 22 nt, Human
uuagggcaggcaugagagaacu

SEQ ID NO: 421004 - RNA, 22 nt, Human
aagagggaggugcgggugcaga

SEQ ID NO: 421005 - RNA, 22 nt, Human
ccagcucuagccccauguggcu

SEQ ID NO: 421006 - RNA, 22 nt, Human
augcauaauguauguauugacu

SEQ ID NO: 421007 - RNA, 22 nt, Human
gcugccugccuaguuccacagu

SEQ ID NO: 421008 - RNA, 22 nt, Human
ucacacacauaaucuaagauua

SEQ ID NO: 421009 - RNA, 22 nt, Human
auaguuuucuaugcacuguuau

SEQ ID NO: 421010 - RNA, 22 nt, Human
uauaaaguuucgaaagauguau

SEQ ID NO: 421011 - RNA, 22 nt, Human
gcugcccaguucugcugcugcc

SEQ ID NO: 421012 - RNA, 22 nt, Human
ggagccugcgggagcucccauu

SEQ ID NO: 421013 - RNA, 22 nt, Human
cuggcucccucgcugaggugcu

SEQ ID NO: 421014 - RNA, 22 nt, Human
agccucugugacucacagguca

SEQ ID NO: 421015 - RNA, 22 nt, Human
gagucccaugaugauagccaca

SEQ ID NO: 421016 - RNA, 22 nt, Human
cacaagacuuauuuguguagaa

SEQ ID NO: 421017 - RNA, 22 nt, Human
gaaaacuaacggaaaaguuagg

SEQ ID NO: 421018 - RNA, 22 nt, Human
cugcaggaauucaaagugagcu

SEQ ID NO: 421019 - RNA, 22 nt, Human
augugaggaagaaagagguaag

SEQ ID NO: 421020 - RNA, 22 nt, Human
acuuugcagagccagaagagaa

SEQ ID NO: 421021 - RNA, 22 nt, Human
agccugucugucuccaaagcug

SEQ ID NO: 421022 - RNA, 22 nt, Human
uggcuuccugcacagugucugc

SEQ ID NO: 421023 - RNA, 22 nt, Human
cuuuauguuggggugucuuagu

SEQ ID NO: 421024 - RNA, 22 nt, Human
acacccagagcgccagugccga

SEQ ID NO: 421025 - RNA, 22 nt, Human
cagaaugagauaacccagauug

SEQ ID NO: 421026 - RNA, 23 nt, Human
uauuagggccaggacuggcaaau

SEQ ID NO: 421027 - RNA, 22 nt, Human
aucagcaaucaaauugcagagu

SEQ ID NO: 421028 - RNA, 22 nt, Human
ggcagaggagcuggaaacaugg

SEQ ID NO: 421029 - RNA, 22 nt, Human
agcagcugguaggaguggccac

SEQ ID NO: 421030 - RNA, 22 nt, Human
gaggcaggcacuguuaucagca

SEQ ID NO: 421031 - RNA, 22 nt, Human
caguacuuugcaucauuccacu

SEQ ID NO: 421032 - RNA, 22 nt, Human
gaagagcuauguccagggagca

SEQ ID NO: 421033 - RNA, 22 nt, Human
cugggcagaauuuuaggauggc

SEQ ID NO: 421034 - RNA, 22 nt, Human
acauuugacauuuaguaucagc

SEQ ID NO: 421035 - RNA, 21 nt, Human
aggcucccagaaaugggcauc

SEQ ID NO: 421036 - RNA, 22 nt, Human
cugggaggacaacuuggagcuc

SEQ ID NO: 421037 - RNA, 22 nt, Human
acagagcaguucuggagcuggc

SEQ ID NO: 421038 - RNA, 22 nt, Human
ccagcuuguuugaagcucguca

SEQ ID NO: 421039 - RNA, 22 nt, Human
gaggugaguggaucacgagguc

SEQ ID NO: 421040 - RNA, 22 nt, Human
agcugacucuggccucuggucc

SEQ ID NO: 421041 - RNA, 22 nt, Human
ucucugagaaguuccuuuguga

SEQ ID NO: 421042 - RNA, 22 nt, Human
gggcugccuuucuucugggagc

SEQ ID NO: 421043 - RNA, 22 nt, Human
uaagaacaguguuucaucucua

SEQ ID NO: 421044 - RNA, 22 nt, Human
ggcugagacuagagugaggcau

SEQ ID NO: 421045 - RNA, 22 nt, Human
gcagccacagaggagggaugca

SEQ ID NO: 421046 - RNA, 22 nt, Human
gggcccuggauuuaagcaugga

SEQ ID NO: 421047 - RNA, 22 nt, Human
ucuguccauuuuccauuuuggc

SEQ ID NO: 421048 - RNA, 22 nt, Human
ccucuugccaaucagcuacaga

SEQ ID NO: 421049 - RNA, 22 nt, Human
ucccuguccugggcaaucccag

SEQ ID NO: 421050 - RNA, 22 nt, Human
ccagcuggcaggagagucaggg

SEQ ID NO: 421051 - RNA, 22 nt, Human
aucaccaggcaaaaugucagag

SEQ ID NO: 421052 - RNA, 22 nt, Human
gccuggagaaaggaagguggga

SEQ ID NO: 421053 - RNA, 22 nt, Human
gucuggggaagucagggcauca

SEQ ID NO: 421054 - RNA, 22 nt, Human
gcagagccaggagcccaggauc

SEQ ID NO: 421055 - RNA, 18 nt, Human
ccuggagcuccacagcaa

SEQ ID NO: 421056 - RNA, 22 nt, Human
aaagccagggacagugugcaug

SEQ ID NO: 421057 - RNA, 22 nt, Human
augcauugucugguuucauuuu

SEQ ID NO: 421058 - RNA, 22 nt, Human
ucuuuucuggacucugcaugga

SEQ ID NO: 421059 - RNA, 17 nt, Human
aucuggcugcuucuaga

SEQ ID NO: 421060 - RNA, 22 nt, Human
cugccuugaaaaugaagcuuua

SEQ ID NO: 421061 - RNA, 22 nt, Human
aagcucugcucagcagacuagg

SEQ ID NO: 421062 - RNA, 22 nt, Human
cacauuucucuaccucacacaa

SEQ ID NO: 421063 - RNA, 22 nt, Human
agaccacagucaggcuccuggu

SEQ ID NO: 421064 - RNA, 22 nt, Human
ggaguucacugugcaggcucug

SEQ ID NO: 421065 - RNA, 22 nt, Human
augcaguacauacaaacacuga

SEQ ID NO: 421066 - RNA, 22 nt, Human
aucagcaagauguaauuucuau

SEQ ID NO: 421067 - RNA, 21 nt, Human
caaagccaggcaacucucucc

SEQ ID NO: 421068 - RNA, 22 nt, Human
cuggaagugggguuggcuugaa

SEQ ID NO: 421069 - RNA, 22 nt, Human
uguauguaaaguuuguaauaga

SEQ ID NO: 421070 - RNA, 22 nt, Human
gccugccuuugugaggaagcgg

SEQ ID NO: 421071 - RNA, 22 nt, Human
aaagaggauggaguagucagcu

SEQ ID NO: 421072 - RNA, 22 nt, Human
uggagcagccaugaugacagag

SEQ ID NO: 421073 - RNA, 19 nt, Human
aggcagcaggccagggaug

SEQ ID NO: 421074 - RNA, 22 nt, Human
cagggccaagcugcagcaucug

SEQ ID NO: 421075 - RNA, 18 nt, Human
gccaggcaggguggggaa

SEQ ID NO: 421076 - RNA, 22 nt, Human
cagagcugguaagugguagagg

SEQ ID NO: 421077 - RNA, 22 nt, Human
uucugggacaucuggacaguuu

SEQ ID NO: 421078 - RNA, 22 nt, Human
ucaccaggcuggaaugcagugg

SEQ ID NO: 421079 - RNA, 21 nt, Human
ugcuucucuagaucaacuacu

SEQ ID NO: 421080 - RNA, 22 nt, Human
ccuaagaauuaaugaauacacc

SEQ ID NO: 421081 - RNA, 22 nt, Human
ucccuggguccugcuugcucuc

SEQ ID NO: 421082 - RNA, 22 nt, Human
uggggccugagguggagcugca

SEQ ID NO: 421083 - RNA, 22 nt, Human
uggagcugacucacaccagcua

SEQ ID NO: 421084 - RNA, 22 nt, Human
ugucuuuauauauuuggaaaau

SEQ ID NO: 421085 - RNA, 22 nt, Human
gggcccagcgugguuccaucug

SEQ ID NO: 421086 - RNA, 22 nt, Human
acugggccggugcagaguaguu

SEQ ID NO: 421087 - RNA, 21 nt, Human
uucaagauauuuaaaaggugg

SEQ ID NO: 421088 - RNA, 22 nt, Human
ggccuggcucuugcccagccug

SEQ ID NO: 421089 - RNA, 22 nt, Human
aggguccaucaaggacugcaca

SEQ ID NO: 421090 - RNA, 22 nt, Human
guuagggagggugcauaugugu

SEQ ID NO: 421091 - RNA, 22 nt, Human
ugucaugcccaggagcaaggua

SEQ ID NO: 421092 - RNA, 22 nt, Human
agcagcugaucaaagcacuuau

SEQ ID NO: 421093 - RNA, 22 nt, Human
gagaggccaaaaucccugcccc

SEQ ID NO: 421094 - RNA, 22 nt, Human
caugccaguuuugagaugcacc

SEQ ID NO: 421095 - RNA, 22 nt, Human
ucccaggugaugcugaggccac

SEQ ID NO: 421096 - RNA, 22 nt, Human
aguucaggcauaaggcaugaac

SEQ ID NO: 421097 - RNA, 22 nt, Human
caagagcuagaaauugguuaga

SEQ ID NO: 421098 - RNA, 22 nt, Human
ugcucacagcccagaacauaau

SEQ ID NO: 421099 - RNA, 22 nt, Human
auugcacaaacacagucagacu

SEQ ID NO: 421100 - RNA, 22 nt, Human
ugaggccucuugguauggugug

SEQ ID NO: 421101 - RNA, 19 nt, Human
aggacccuuauccuggcuu

SEQ ID NO: 421102 - RNA, 18 nt, Human
uugagggaggggcagagu

SEQ ID NO: 421103 - RNA, 21 nt, Human
agacagaacaacugcucucca

SEQ ID NO: 421104 - RNA, 22 nt, Human
gaguuauuuguagggauuauau

SEQ ID NO: 421105 - RNA, 22 nt, Human
cuacuuuaauuuucugcagaga

SEQ ID NO: 421106 - RNA, 22 nt, Human
cagccugcccuggaagcccagc

SEQ ID NO: 421107 - RNA, 22 nt, Human
cugucuuuucauacuuucccuc

SEQ ID NO: 421108 - RNA, 22 nt, Human
ugcucugggcaacagccucccu

SEQ ID NO: 421109 - RNA, 22 nt, Human
gaguggagaucgugccacugca

SEQ ID NO: 421110 - RNA, 22 nt, Human
ucugagcuggagcccaucaccu

SEQ ID NO: 421111 - RNA, 22 nt, Human
acagggucaagggugcuacaag

SEQ ID NO: 421112 - RNA, 22 nt, Human
auuuagaaguuggagggcaaga

SEQ ID NO: 421113 - RNA, 22 nt, Human
gugcagugagcagugcagcacc

SEQ ID NO: 421114 - RNA, 22 nt, Human
guguguccaggcgggagucaag

SEQ ID NO: 421115 - RNA, 22 nt, Human
agggagccuuccuggcuguggu

SEQ ID NO: 421116 - RNA, 22 nt, Human
uuccuucucagcccucgaggau

SEQ ID NO: 421117 - RNA, 22 nt, Human
uacaacauaacgggcauucagu

SEQ ID NO: 421118 - RNA, 22 nt, Human
gaaaacacuuugaucugaaagu

SEQ ID NO: 421119 - RNA, 22 nt, Human
aaggcacucagccuugggacag

SEQ ID NO: 421120 - RNA, 18 nt, Human
cacaggcaggugauaggu

SEQ ID NO: 421121 - RNA, 22 nt, Human
gcugccuugaacuuggccuggg

SEQ ID NO: 421122 - RNA, 22 nt, Human
aguucucagcuuaguaugcugu

SEQ ID NO: 421123 - RNA, 22 nt, Human
auccuugaaugacucugcccuc

SEQ ID NO: 421124 - RNA, 22 nt, Human
ucuccuggauggaccuucucuu

SEQ ID NO: 421125 - RNA, 22 nt, Human
gagcaacaguuuaugguuuuuc

SEQ ID NO: 421126 - RNA, 22 nt, Human
uacaaagucacauugaaaugaa

SEQ ID NO: 421127 - RNA, 22 nt, Human
auguuuauguugggcuauauuu

SEQ ID NO: 421128 - RNA, 20 nt, Human
gccugagcuccgccuccugu

SEQ ID NO: 421129 - RNA, 22 nt, Human
uuguuucaggaugguuuguuac

SEQ ID NO: 421130 - RNA, 22 nt, Human
gggacuguaaauucauauggcc

SEQ ID NO: 421131 - RNA, 22 nt, Human
uccuuucaccaaaaaguguugu

SEQ ID NO: 421132 - RNA, 22 nt, Human
aauuugauucccugcaccuguu

SEQ ID NO: 421133 - RNA, 22 nt, Human
uuuagaaauucaucuauggccu

SEQ ID NO: 421134 - RNA, 22 nt, Human
aaggugugaagagaugggaaga

SEQ ID NO: 421135 - RNA, 22 nt, Human
ggagcagagcauuucacagccu

SEQ ID NO: 421136 - RNA, 22 nt, Human
uggagcagcacaagaaagggga

SEQ ID NO: 421137 - RNA, 22 nt, Human
gggauggggggaagcguccaug

SEQ ID NO: 421138 - RNA, 22 nt, Human
cacauaauacauguuccacuua

SEQ ID NO: 421139 - RNA, 22 nt, Human
auaaaaacugacccauccuuug

SEQ ID NO: 421140 - RNA, 22 nt, Human
uccagggccaagucauggaacc

SEQ ID NO: 421141 - RNA, 22 nt, Human
ccugucuguccucucaugagcc

SEQ ID NO: 421142 - RNA, 22 nt, Human
auguggaaugaacaaaggaggc

SEQ ID NO: 421143 - RNA, 17 nt, Human
aaguccagaguugagca

SEQ ID NO: 421144 - RNA, 22 nt, Human
gugguaauagagcuccaaacua

SEQ ID NO: 421145 - RNA, 21 nt, Human
acaugucucuaaucucaguga

SEQ ID NO: 421146 - RNA, 22 nt, Human
cucugagcuccuggaagcgugc

SEQ ID NO: 421147 - RNA, 22 nt, Human
agagccacugggagacagagca

SEQ ID NO: 421148 - RNA, 19 nt, Human
gcaggguguugacuguccc

SEQ ID NO: 421149 - RNA, 22 nt, Human
ugucccagacacaguaugcgcu

SEQ ID NO: 421150 - RNA, 22 nt, Human
ugcagggauuagaggccgggga

SEQ ID NO: 421151 - RNA, 22 nt, Human
aaaguguagagacuuuggaacc

SEQ ID NO: 421152 - RNA, 22 nt, Human
ccagccagucccgcaugaccgc

SEQ ID NO: 421153 - RNA, 22 nt, Human
ccucuuugugccugcaggcugc

SEQ ID NO: 421154 - RNA, 22 nt, Human
ggcugggcucgcugauuggcug

SEQ ID NO: 421155 - RNA, 22 nt, Human
ccagaauagaaggcagcuguca

SEQ ID NO: 421156 - RNA, 22 nt, Human
ggcagcuggggcagugcccugu

SEQ ID NO: 421157 - RNA, 22 nt, Human
ucagcuuuccuugcuuuagauu

SEQ ID NO: 421158 - RNA, 22 nt, Human
ucuguacacuucagcaugcauc

SEQ ID NO: 421159 - RNA, 22 nt, Human
uguuaaucaaucaacaguauua

SEQ ID NO: 421160 - RNA, 22 nt, Human
cugccagcucucuggaggcucu

SEQ ID NO: 421161 - RNA, 22 nt, Human
aagggacuuugucagcuuucca

SEQ ID NO: 421162 - RNA, 22 nt, Human
ucugcaggaggcuggcugcagg

SEQ ID NO: 421163 - RNA, 22 nt, Human
ugcugucccuaagucucuucaa

SEQ ID NO: 421164 - RNA, 22 nt, Human
ucccacuggacgucugugcugg

SEQ ID NO: 421165 - RNA, 22 nt, Human
agacccagaaagcagcugcauu

SEQ ID NO: 421166 - RNA, 22 nt, Human
aggcccagacucagcggggcgg

SEQ ID NO: 421167 - RNA, 23 nt, Human
aaguaacagggauaauagcaguu

SEQ ID NO: 421168 - RNA, 23 nt, Human
caugccaguuugugcaggcagau

SEQ ID NO: 421169 - RNA, 22 nt, Human
aaagcugcugccaaucaggcuu

SEQ ID NO: 421170 - RNA, 23 nt, Human
cccuggaguaaauucuuggaagg

SEQ ID NO: 421171 - RNA, 21 nt, Human
aucuuuauuacgcagagaaga

SEQ ID NO: 421172 - RNA, 22 nt, Human
ucuggcucagggcucugaggga

SEQ ID NO: 421173 - RNA, 22 nt, Human
uggccugguuguugcugccguu

SEQ ID NO: 421174 - RNA, 22 nt, Human
uuagauaauguuauuguaauuu

SEQ ID NO: 421175 - RNA, 22 nt, Human
aggcagccuuuagacagucugc

SEQ ID NO: 421176 - RNA, 22 nt, Human
uggaaacuaagacuagagagac

SEQ ID NO: 421177 - RNA, 22 nt, Human
agagggcccauguugggcugcu

SEQ ID NO: 421178 - RNA, 22 nt, Human
ggcuugggagcaggcaugugac

SEQ ID NO: 421179 - RNA, 22 nt, Human
caggaugcacuaggaaccaggg

SEQ ID NO: 421180 - RNA, 22 nt, Human
agcugggcagacugcagugguu

SEQ ID NO: 421181 - RNA, 22 nt, Human
cacugcucgcugcagcauggcc

SEQ ID NO: 421182 - RNA, 22 nt, Human
ccaggcagagggaauagcaagu

SEQ ID NO: 421183 - RNA, 22 nt, Human
auuguauuagcacaauacaauu

SEQ ID NO: 421184 - RNA, 22 nt, Human
aaaugcaaggccaugugaagga

SEQ ID NO: 421185 - RNA, 22 nt, Human
gcagagcuaucuucuggauuug

SEQ ID NO: 421186 - RNA, 22 nt, Human
gggcuaggcuuggccagcacug

SEQ ID NO: 421187 - RNA, 22 nt, Human
uucaggauucuuucagacuggg

SEQ ID NO: 421188 - RNA, 22 nt, Human
gagagcuggguucaaguagcug

SEQ ID NO: 421189 - RNA, 22 nt, Human
gaggaaaauaacaacuaagggc

SEQ ID NO: 421190 - RNA, 23 nt, Human
gagagcugacugucaagacuguu

SEQ ID NO: 421191 - RNA, 22 nt, Human
cagagcccagggccuacguccc

SEQ ID NO: 421192 - RNA, 22 nt, Human
aucucagacauguuguccauga

SEQ ID NO: 421193 - RNA, 22 nt, Human
uucacauuggugauauguuucu

SEQ ID NO: 421194 - RNA, 19 nt, Human
augauacaggugaaaauug

SEQ ID NO: 421195 - RNA, 22 nt, Human
cuugugcaauugacauugaauc

SEQ ID NO: 421196 - RNA, 22 nt, Human
uggcugaggucuggggcuucug

SEQ ID NO: 421197 - RNA, 19 nt, Human
ugcucauggggacuucucc

SEQ ID NO: 421198 - RNA, 22 nt, Human
cugggcuacguguugacagcau

SEQ ID NO: 421199 - RNA, 22 nt, Human
gcugucugcugugcacugagca

SEQ ID NO: 421200 - RNA, 22 nt, Human
ccugaggcuuaaucugucccaa

SEQ ID NO: 421201 - RNA, 22 nt, Human
gcaugggcuuucucagaguucu

SEQ ID NO: 421202 - RNA, 22 nt, Human
caugaaugcuggguucauguaa

SEQ ID NO: 421203 - RNA, 17 nt, Human
acagagguuauacagac

SEQ ID NO: 421204 - RNA, 22 nt, Human
ugaggcagcuuuuucugugugu

SEQ ID NO: 421205 - RNA, 22 nt, Human
gcauggcaagaucaggagacca

SEQ ID NO: 421206 - RNA, 22 nt, Human
uggcugagggggcucugcucag

SEQ ID NO: 421207 - RNA, 22 nt, Human
cuuauaaaguccaucugaacaa

SEQ ID NO: 421208 - RNA, 22 nt, Human
ccugucucccuggcauggcuca

SEQ ID NO: 421209 - RNA, 22 nt, Human
uacaaaguuuucuuggauugag

SEQ ID NO: 421210 - RNA, 22 nt, Human
cugcucugaagccaggauucug

SEQ ID NO: 421211 - RNA, 22 nt, Human
gccugagaaggauaggaagcga

SEQ ID NO: 421212 - RNA, 22 nt, Human
uuagauaaauuaagacuuuaca

SEQ ID NO: 421213 - RNA, 22 nt, Human
augcuguagaucuuagccucua

SEQ ID NO: 421214 - RNA, 22 nt, Human
gcugaaggucucuggagagguc

SEQ ID NO: 421215 - RNA, 22 nt, Human
ucaguguccggagccugagugc

SEQ ID NO: 421216 - RNA, 22 nt, Human
cccugagaugccucacccuagu

SEQ ID NO: 421217 - RNA, 22 nt, Human
gagagcacaugaacauggagga

SEQ ID NO: 421218 - RNA, 22 nt, Human
uuugcauuaguuuagauuucaa

SEQ ID NO: 421219 - RNA, 20 nt, Human
aaaggaauauaugaaguaua

SEQ ID NO: 421220 - RNA, 22 nt, Human
auuuaugauuagccuauuguug

SEQ ID NO: 421221 - RNA, 18 nt, Human
auccuugaugagaggucu

SEQ ID NO: 421222 - RNA, 22 nt, Human
uucaucuugauggcuuccuaau

SEQ ID NO: 421223 - RNA, 22 nt, Human
ggccaggcugguuccuugaccu

SEQ ID NO: 421224 - RNA, 18 nt, Human
agagcagcggcaucacac

SEQ ID NO: 421225 - RNA, 22 nt, Human
uuuauuccaugugucuaugacc

SEQ ID NO: 421226 - RNA, 22 nt, Human
uauuuguauguguguacauaua

SEQ ID NO: 421227 - RNA, 22 nt, Human
aaccugcauguuucuaaaagca

SEQ ID NO: 421228 - RNA, 22 nt, Human
gagcucauucauucauugccug

SEQ ID NO: 421229 - RNA, 22 nt, Human
aagguacaaaguauuauuuaaa

SEQ ID NO: 421230 - RNA, 22 nt, Human
acagaguagcucaagaagauug

SEQ ID NO: 421231 - RNA, 22 nt, Human
aacuuucaggcaaugaauauuu

SEQ ID NO: 421232 - RNA, 22 nt, Human
uggaagggagugacagucagag

SEQ ID NO: 421233 - RNA, 22 nt, Human
gagugcaucguggccauuuuaa

SEQ ID NO: 421234 - RNA, 22 nt, Human
uggccuccccuaacagccucuu

SEQ ID NO: 421235 - RNA, 22 nt, Human
cuacagcagagcuacacuaacu

SEQ ID NO: 421236 - RNA, 22 nt, Human
auccucagaccucagcaaagcc

SEQ ID NO: 421237 - RNA, 18 nt, Human
ccagguggugacagagau

SEQ ID NO: 421238 - RNA, 22 nt, Human
gagagcugggcuuugggugaag

SEQ ID NO: 421239 - RNA, 23 nt, Human
gcagauggccccagagugcugcc

SEQ ID NO: 421240 - RNA, 22 nt, Human
agcagagcggggccuccggaag

SEQ ID NO: 421241 - RNA, 18 nt, Human
ugacucacccugucagug

SEQ ID NO: 421242 - RNA, 22 nt, Human
aggcaggaaaaucgcuugaacc

SEQ ID NO: 421243 - RNA, 22 nt, Human
accucccagcucugagcuuggg

SEQ ID NO: 421244 - RNA, 21 nt, Human
gcucagaguauugcacuguuu

SEQ ID NO: 421245 - RNA, 22 nt, Human
ucagaacagaagcuggcuauaa

SEQ ID NO: 421246 - RNA, 22 nt, Human
ugccaggcuaaguggaggacuu

SEQ ID NO: 421247 - RNA, 22 nt, Human
agugaaauaugcccauugcugu

SEQ ID NO: 421248 - RNA, 22 nt, Human
gcucuguguccacagcuggaaa

SEQ ID NO: 421249 - RNA, 22 nt, Human
aaaaugugcaguuuuuaagcug

SEQ ID NO: 421250 - RNA, 22 nt, Human
cugagcugguggaagcaugcag

SEQ ID NO: 421251 - RNA, 22 nt, Human
ggcagccagcaaugagaaguuu

SEQ ID NO: 421252 - RNA, 22 nt, Human
cagagcugcagauugaaggcau

SEQ ID NO: 421253 - RNA, 22 nt, Human
ucucaaacuaacaaugauuaua

SEQ ID NO: 421254 - RNA, 22 nt, Human
gccacaugcaauugcagcacgu

SEQ ID NO: 421255 - RNA, 22 nt, Human
aacaaauguguggcaguguggg

SEQ ID NO: 421256 - RNA, 22 nt, Human
aggagggagcuuaagccaggca

SEQ ID NO: 421257 - RNA, 22 nt, Human
ggcagucagugugguucauaaa

SEQ ID NO: 421258 - RNA, 22 nt, Human
agcagcagaagggagacccagg

SEQ ID NO: 421259 - RNA, 22 nt, Human
guccaguguguuuaucuuggau

SEQ ID NO: 421260 - RNA, 22 nt, Human
gugcaugugucuuuauaguagc

SEQ ID NO: 421261 - RNA, 22 nt, Human
ugugaaggcagagccagugaaa

SEQ ID NO: 421262 - RNA, 22 nt, Human
acacacaacucauuguguaaua

SEQ ID NO: 421263 - RNA, 22 nt, Human
ggcucagguuuaaagugcuuua

SEQ ID NO: 421264 - RNA, 22 nt, Human
cauuguuauagcauuacacacc

SEQ ID NO: 421265 - RNA, 22 nt, Human
uggcucugugucucccagcagc

SEQ ID NO: 421266 - RNA, 19 nt, Human
aagaagcaauaagcuguga

SEQ ID NO: 421267 - RNA, 22 nt, Human
gcagcuuucuaagcuuuauugc

SEQ ID NO: 421268 - RNA, 22 nt, Human
uccaaagggaagcgcuuucugu

SEQ ID NO: 421269 - RNA, 22 nt, Human
augauggugagguugagcacag

SEQ ID NO: 421270 - RNA, 20 nt, Human
ggcugccuccuuccuuuccu

SEQ ID NO: 421271 - RNA, 22 nt, Human
gcuguggcugaccaccaggggg

SEQ ID NO: 421272 - RNA, 21 nt, Human
agcaacucugacuagaugagg

SEQ ID NO: 421273 - RNA, 22 nt, Human
uaggacaggugaggggcugugg

SEQ ID NO: 421274 - RNA, 20 nt, Human
cugcuguguuauuguagaac

SEQ ID NO: 421275 - RNA, 22 nt, Human
aaggcagcagugcacgacugau

SEQ ID NO: 421276 - RNA, 22 nt, Human
cugaggccuaagacaugaauga

SEQ ID NO: 421277 - RNA, 22 nt, Human
ucuggccugggccugccggugc

SEQ ID NO: 421278 - RNA, 22 nt, Human
ccuccaguacuccaguccagcg

SEQ ID NO: 421279 - RNA, 22 nt, Human
gaaacuuuuaaaccucaugagu

SEQ ID NO: 421280 - RNA, 22 nt, Human
acagagcugggugcccccugga

SEQ ID NO: 421281 - RNA, 23 nt, Human
gcuguacaggaaccaguuuggag

SEQ ID NO: 421282 - RNA, 17 nt, Human
aggcauggucuggggug

SEQ ID NO: 421283 - RNA, 22 nt, Human
uuuaaauuauaguuaaugucug

SEQ ID NO: 421284 - RNA, 22 nt, Human
ucaccacugaacagaccuuugg

SEQ ID NO: 421285 - RNA, 22 nt, Human
uggcuuccuccagagcaggagg

SEQ ID NO: 421286 - RNA, 20 nt, Human
acauccuggugacuagaacu

SEQ ID NO: 421287 - RNA, 22 nt, Human
ggagggagucagcugauuagaa

SEQ ID NO: 421288 - RNA, 22 nt, Human
uugcagagaucagcagguuuga

SEQ ID NO: 421289 - RNA, 20 nt, Human
ccucucugaagaggucaucu

SEQ ID NO: 421290 - RNA, 22 nt, Human
caggcagcugcuggguucagcc

SEQ ID NO: 421291 - RNA, 17 nt, Human
ugaggccugcaucagug

SEQ ID NO: 421292 - RNA, 22 nt, Human
ggcggggguccaggagccugca

SEQ ID NO: 421293 - RNA, 22 nt, Human
aggaaaaucgagucuggaggca

SEQ ID NO: 421294 - RNA, 22 nt, Human
ucuagggaacaugggucaagcu

SEQ ID NO: 421295 - RNA, 22 nt, Human
auguucuguuuuguaauucaua

SEQ ID NO: 421296 - RNA, 20 nt, Human
cucuccucacccgugucagg

SEQ ID NO: 421297 - RNA, 21 nt, Human
uagggcucucugugucaggug

SEQ ID NO: 421298 - RNA, 22 nt, Human
auuuagaaauuccaaaaguauu

SEQ ID NO: 421299 - RNA, 21 nt, Human
gccugcagaccccaccaggcu

SEQ ID NO: 421300 - RNA, 20 nt, Human
uagauuucauacuucucuuu

SEQ ID NO: 421301 - RNA, 17 nt, Human
cagugcagagcccuuuc

SEQ ID NO: 421302 - RNA, 22 nt, Human
cugagguggaacagaggugaag

SEQ ID NO: 421303 - RNA, 17 nt, Human
cauguguaugugggagu

SEQ ID NO: 421304 - RNA, 22 nt, Human
ggcagcagaacuggcccuguau

SEQ ID NO: 421305 - RNA, 22 nt, Human
accaggcuggagugcaguggcg

SEQ ID NO: 421306 - RNA, 22 nt, Human
ugucuucaguaaaauacacuau

SEQ ID NO: 421307 - RNA, 22 nt, Human
ugucccaggccucauguugcca

SEQ ID NO: 421308 - RNA, 22 nt, Human
agggucugacaaugugacuuag

SEQ ID NO: 421309 - RNA, 22 nt, Human
agcccuucaaccugccuacucc

SEQ ID NO: 421310 - RNA, 22 nt, Human
ugggcuguggagcaccuuugca

SEQ ID NO: 421311 - RNA, 22 nt, Human
cauguuuucuaggcuuucacaa

SEQ ID NO: 421312 - RNA, 22 nt, Human
gcagauggaaagugcuugaggg

SEQ ID NO: 421313 - RNA, 22 nt, Human
auaguguuacccuucuuaaagu

SEQ ID NO: 421314 - RNA, 22 nt, Human
gcucccugccuacacggaccuu

SEQ ID NO: 421315 - RNA, 22 nt, Human
uggcuugucauguaucugaggc

SEQ ID NO: 421316 - RNA, 22 nt, Human
gcugaagggagugcugagucug

SEQ ID NO: 421317 - RNA, 22 nt, Human
cagcccucagguccucagcagc

SEQ ID NO: 421318 - RNA, 22 nt, Human
aagggcagagggaaucccacau

SEQ ID NO: 421319 - RNA, 22 nt, Human
cuuaauuucaaacugcuaguga

SEQ ID NO: 421320 - RNA, 22 nt, Human
ggaggccuagccagcuccaguu

SEQ ID NO: 421321 - RNA, 22 nt, Human
ccugcagaccacacucaguccu

SEQ ID NO: 421322 - RNA, 22 nt, Human
gaaauccaguucccuacucuua

SEQ ID NO: 421323 - RNA, 22 nt, Human
uucacaggauauaugugcaggg

SEQ ID NO: 421324 - RNA, 22 nt, Human
ucagagaaguaagguggggugc

SEQ ID NO: 421325 - RNA, 22 nt, Human
ccaggcugcagucaaggggcau

SEQ ID NO: 421326 - RNA, 22 nt, Human
agagccaggaaguggcgugggg

SEQ ID NO: 421327 - RNA, 22 nt, Human
uaacagaaguuguucauugugg

SEQ ID NO: 421328 - RNA, 22 nt, Human
cugcaggcucgaagacacggau

SEQ ID NO: 421329 - RNA, 22 nt, Human
uaauuuacuugcaaauaacaau

SEQ ID NO: 421330 - RNA, 22 nt, Human
caggaaagguagucacaaugua

SEQ ID NO: 421331 - RNA, 22 nt, Human
ggcagcucugcuccacaugagu

SEQ ID NO: 421332 - RNA, 22 nt, Human
ugucaugcagguuuguuauaga

SEQ ID NO: 421333 - RNA, 22 nt, Human
augggggccugaacaggcaaaa

SEQ ID NO: 421334 - RNA, 22 nt, Human
uagaaauccccagucucauagu

SEQ ID NO: 421335 - RNA, 22 nt, Human
aauacagaggggucacaauuca

SEQ ID NO: 421336 - RNA, 22 nt, Human
augauugcagcccuacagcugu

SEQ ID NO: 421337 - RNA, 22 nt, Human
aggcugaggugugcugugaucg

SEQ ID NO: 421338 - RNA, 22 nt, Human
ucagggugaaccaggcaggaau

SEQ ID NO: 421339 - RNA, 22 nt, Human
cucugucccagacccaccucuc

SEQ ID NO: 421340 - RNA, 22 nt, Human
aacaaaugauaccaguucucaa

SEQ ID NO: 421341 - RNA, 22 nt, Human
cagaggcucuuccucacugccc

SEQ ID NO: 421342 - RNA, 19 nt, Human
gcccugcaggagguggggc

SEQ ID NO: 421343 - RNA, 22 nt, Human
cuucuugcaauuuucaucuuau

SEQ ID NO: 421344 - RNA, 22 nt, Human
ggcugccacgucgaggguccaa

SEQ ID NO: 421345 - RNA, 18 nt, Human
acauuucuccuucugacc

SEQ ID NO: 421346 - RNA, 22 nt, Human
gagcuuuaccuuagguucuguu

SEQ ID NO: 421347 - RNA, 22 nt, Human
cucaggacccgguccagguggg

SEQ ID NO: 421348 - RNA, 19 nt, Human
uuugugaagaaaaugaugc

SEQ ID NO: 421349 - RNA, 22 nt, Human
gcagagccagaauggccaggac

SEQ ID NO: 421350 - RNA, 22 nt, Human
cuugaaagcacuuaguaaauua

SEQ ID NO: 421351 - RNA, 22 nt, Human
ggggccagcuucgcgugcucuu

SEQ ID NO: 421352 - RNA, 22 nt, Human
cagggcugaacugagcuuguga

SEQ ID NO: 421353 - RNA, 22 nt, Human
gcccaggccggagagcagugcu

SEQ ID NO: 421354 - RNA, 22 nt, Human
ucucagugcuauccauauucca

SEQ ID NO: 421355 - RNA, 22 nt, Human
aacaugauggggaagaacaaga

SEQ ID NO: 421356 - RNA, 22 nt, Human
gugugcaugcauagacaccaca

SEQ ID NO: 421357 - RNA, 22 nt, Human
cacagccuugagcgaggacaag

SEQ ID NO: 421358 - RNA, 22 nt, Human
auuucuuccucugucaguaacu

SEQ ID NO: 421359 - RNA, 22 nt, Human
ccagggcaggggcuggaguuca

SEQ ID NO: 421360 - RNA, 22 nt, Human
cugccagcucaaagcgcagcua

SEQ ID NO: 421361 - RNA, 22 nt, Human
gcuggccauucucuuugagaug

SEQ ID NO: 421362 - RNA, 22 nt, Human
gaugguuugguaaaaguauguu

SEQ ID NO: 421363 - RNA, 23 nt, Human
ugacacauuuccuuuccacugca

SEQ ID NO: 421364 - RNA, 22 nt, Human
cagcuuuauugagguauaauug

SEQ ID NO: 421365 - RNA, 22 nt, Human
ggguuccuccaguuccuagagc

SEQ ID NO: 421366 - RNA, 22 nt, Human
agagaacacgugcaucugcaau

SEQ ID NO: 421367 - RNA, 22 nt, Human
caagggaccugagauggucucu

SEQ ID NO: 421368 - RNA, 22 nt, Human
cacugcuuucacaguuuguucc

SEQ ID NO: 421369 - RNA, 22 nt, Human
gaggcucagagacuuuaaguuu

SEQ ID NO: 421370 - RNA, 22 nt, Human
cagagcauuaaaaccagcucug

SEQ ID NO: 421371 - RNA, 22 nt, Human
cagagcuguugcggggcuuggc

SEQ ID NO: 421372 - RNA, 22 nt, Human
agcagccagagucugaacauua

SEQ ID NO: 421373 - RNA, 20 nt, Human
cccagggaccugagcuccau

SEQ ID NO: 421374 - RNA, 22 nt, Human
caaugauucugcaacugugugc

SEQ ID NO: 421375 - RNA, 22 nt, Human
ucugagaggauuccugucccga

SEQ ID NO: 421376 - RNA, 22 nt, Human
cuguagccaguuuggccucacc

SEQ ID NO: 421377 - RNA, 22 nt, Human
cucacaggagaaagucaugguc

SEQ ID NO: 421378 - RNA, 22 nt, Human
cagggccaaguuggugccuuuu

SEQ ID NO: 421379 - RNA, 22 nt, Human
ccuggcucucugcagauccugg

SEQ ID NO: 421380 - RNA, 19 nt, Human
acauggcaucccaggaggu

SEQ ID NO: 421381 - RNA, 22 nt, Human
ugugaaaggagccauagacagu

SEQ ID NO: 421382 - RNA, 22 nt, Human
gggagaaguggaaaucucauua

SEQ ID NO: 421383 - RNA, 22 nt, Human
ggcugccuucagacuccagcuu

SEQ ID NO: 421384 - RNA, 22 nt, Human
aagcugccauagaacgagaggu

SEQ ID NO: 421385 - RNA, 22 nt, Human
gauuucaaggaguuuucacagu

SEQ ID NO: 421386 - RNA, 22 nt, Human
gugcaugaagacucagaaaguc

SEQ ID NO: 421387 - RNA, 22 nt, Human
cccauuuaucccaagguuacuc

SEQ ID NO: 421388 - RNA, 22 nt, Human
auauuaggaguuaaauguauua

SEQ ID NO: 421389 - RNA, 22 nt, Human
gccucugcccuccugggacugc

SEQ ID NO: 421390 - RNA, 20 nt, Human
aguaccuuuuguauguuacc

SEQ ID NO: 421391 - RNA, 22 nt, Human
cacugucuuuugugaagacaau

SEQ ID NO: 421392 - RNA, 22 nt, Human
ggcuccacugcugaccacucca

SEQ ID NO: 421393 - RNA, 22 nt, Human
augaggcaaggaucagguaagg

SEQ ID NO: 421394 - RNA, 22 nt, Human
uccuugaagagugggcggucga

SEQ ID NO: 421395 - RNA, 22 nt, Human
caaauccagaucccagucguag

SEQ ID NO: 421396 - RNA, 22 nt, Human
uacagaauuagauuauuagaga

SEQ ID NO: 421397 - RNA, 22 nt, Human
ucugccugcggcugcagguggc

SEQ ID NO: 421398 - RNA, 22 nt, Human
aaggcaguuaauuuggcuagaa

SEQ ID NO: 421399 - RNA, 19 nt, Human
uggaggagaggaaaaguca

SEQ ID NO: 421400 - RNA, 22 nt, Human
augguuuguguggcccagauga

SEQ ID NO: 421401 - RNA, 22 nt, Human
gcuggggagggcgucaaggcca

SEQ ID NO: 421402 - RNA, 22 nt, Human
uccagaccaugugagaggcgca

SEQ ID NO: 421403 - RNA, 22 nt, Human
gcugcaggcauuuuccugggca

SEQ ID NO: 421404 - RNA, 22 nt, Human
cugcuguguuccuccugcaucu

SEQ ID NO: 421405 - RNA, 19 nt, Human
uggcaggcccaggauggac

SEQ ID NO: 421406 - RNA, 22 nt, Human
cuuccagagauagggccucaag

SEQ ID NO: 421407 - RNA, 22 nt, Human
uucuacacucacccagcuguaa

SEQ ID NO: 421408 - RNA, 22 nt, Human
aucuggcuuuuaccccacggcc

SEQ ID NO: 421409 - RNA, 22 nt, Human
auugucuuuggugcuuccagga

SEQ ID NO: 421410 - RNA, 22 nt, Human
cugcccugugaggguccuuggg

SEQ ID NO: 421411 - RNA, 19 nt, Human
ggcugccuuuccuuaccag

SEQ ID NO: 421412 - RNA, 22 nt, Human
uccuucaggguugaggccgacu

SEQ ID NO: 421413 - RNA, 22 nt, Human
aucuagaaguggcaugaauuac

SEQ ID NO: 421414 - RNA, 22 nt, Human
ugaggcaggagaaucaccggaa

SEQ ID NO: 421415 - RNA, 22 nt, Human
ucuuguccuaagagcuggauuc

SEQ ID NO: 421416 - RNA, 22 nt, Human
cucagcagugacaagagaguau

SEQ ID NO: 421417 - RNA, 22 nt, Human
uagcuuuagugaaaaauaucag

SEQ ID NO: 421418 - RNA, 21 nt, Human
ggccuuggcgggggccgaauu

SEQ ID NO: 421419 - RNA, 22 nt, Human
gccugagcccaggugugcagag

SEQ ID NO: 421420 - RNA, 22 nt, Human
gggcaguggcucacgccuguaa

SEQ ID NO: 421421 - RNA, 22 nt, Human
auucccaucgucaacuucacug

SEQ ID NO: 421422 - RNA, 19 nt, Human
ugucacugucauggcccag

SEQ ID NO: 421423 - RNA, 22 nt, Human
cacuggcaugugaggcgguggc

SEQ ID NO: 421424 - RNA, 23 nt, Human
ugccagaggcagucacaguggug

SEQ ID NO: 421425 - RNA, 22 nt, Human
uuuugaaagggugauuuggcuu

SEQ ID NO: 421426 - RNA, 22 nt, Human
uagggcucuggugggcucuguu

SEQ ID NO: 421427 - RNA, 22 nt, Human
uucucuugugccaaguuguugc

SEQ ID NO: 421428 - RNA, 22 nt, Human
aguacauuuauuaaugguaaaa

SEQ ID NO: 421429 - RNA, 22 nt, Human
ugggcucugcugcguaccaguu

SEQ ID NO: 421430 - RNA, 22 nt, Human
gcaggagugacauggaugugga

SEQ ID NO: 421431 - RNA, 22 nt, Human
gcagcugcaggcaggcuugcug

SEQ ID NO: 421432 - RNA, 22 nt, Human
cagagccagaacuagaccuugu

SEQ ID NO: 421433 - RNA, 22 nt, Human
uguacaaugccgagacuaacuc

SEQ ID NO: 421434 - RNA, 22 nt, Human
ugcugccagagagacagggacu

SEQ ID NO: 421435 - RNA, 22 nt, Human
aggagccaugagugacaucaca

SEQ ID NO: 421436 - RNA, 22 nt, Human
ugcugccuucuaggcgugcccu

SEQ ID NO: 421437 - RNA, 22 nt, Human
uugcaagacacuuggaagcaca

SEQ ID NO: 421438 - RNA, 22 nt, Human
gcagggcaaugaucccgagagg

SEQ ID NO: 421439 - RNA, 23 nt, Human
aaaguguagccagguuaagaacc

SEQ ID NO: 421440 - RNA, 19 nt, Human
auuuccaagaauuggagag

SEQ ID NO: 421441 - RNA, 22 nt, Human
gugcagggcuggcaccggaggc

SEQ ID NO: 421442 - RNA, 22 nt, Human
ucaaaggcuugugguucuggga

SEQ ID NO: 421443 - RNA, 22 nt, Human
uguaugcaaauuuauuagcaca

SEQ ID NO: 421444 - RNA, 22 nt, Human
ucaggacagccagggugcagac

SEQ ID NO: 421445 - RNA, 22 nt, Human
aacucuauuuacccuacuaaac

SEQ ID NO: 421446 - RNA, 22 nt, Human
ggcagaagauaggacagggaau

SEQ ID NO: 421447 - RNA, 20 nt, Human
ggggcaguggcucaugccug

SEQ ID NO: 421448 - RNA, 22 nt, Human
gccucugcaucaucacuccagc

SEQ ID NO: 421449 - RNA, 22 nt, Human
auuauuaaagcuuaggucuuau

SEQ ID NO: 421450 - RNA, 22 nt, Human
gcuggccugggcucaagaccag

SEQ ID NO: 421451 - RNA, 22 nt, Human
aaggucauggcaaauuacuuuu

SEQ ID NO: 421452 - RNA, 22 nt, Human
acuuaaaaccagacagcgucau

SEQ ID NO: 421453 - RNA, 22 nt, Human
uggcaggguggcaacuuuuggu

SEQ ID NO: 421454 - RNA, 17 nt, Human
cagcuuuaugcuacugu

SEQ ID NO: 421455 - RNA, 22 nt, Human
gcucagaggagcaucauaagga

SEQ ID NO: 421456 - RNA, 22 nt, Human
gcucacugcaaccucugcuucc

SEQ ID NO: 421457 - RNA, 22 nt, Human
ccucccucuuucagucccacag

SEQ ID NO: 421458 - RNA, 22 nt, Human
ugggcuccuugggagcaaguga

SEQ ID NO: 421459 - RNA, 22 nt, Human
ggcuucucucccccagcuccac

SEQ ID NO: 421460 - RNA, 22 nt, Human
agggccaccucucuggguuccc

SEQ ID NO: 421461 - RNA, 22 nt, Human
uucuaguuuagggcucuucaac

SEQ ID NO: 421462 - RNA, 22 nt, Human
gcaagauguuaacauagggaga

SEQ ID NO: 421463 - RNA, 22 nt, Human
uuacaaagcguugagacaagua

SEQ ID NO: 421464 - RNA, 22 nt, Human
uggcucugaccagguagaggag

SEQ ID NO: 421465 - RNA, 22 nt, Human
cagguggguacaucacagagac

SEQ ID NO: 421466 - RNA, 22 nt, Human
ugccugucuuuccucccucgua

SEQ ID NO: 421467 - RNA, 22 nt, Human
aagaacaguguccugggacucg

SEQ ID NO: 421468 - RNA, 22 nt, Human
uggcucugucaaacugcacaca

SEQ ID NO: 421469 - RNA, 22 nt, Human
ggagcacccugcucagccaagc

SEQ ID NO: 421470 - RNA, 22 nt, Human
uauuuucuggacagucuugcuu

SEQ ID NO: 421471 - RNA, 22 nt, Human
cugggaggcaccgcgucgugcu

SEQ ID NO: 421472 - RNA, 22 nt, Human
uggcucaggccuacgacgccuu

SEQ ID NO: 421473 - RNA, 22 nt, Human
uucuccccugacccugaugagg

SEQ ID NO: 421474 - RNA, 22 nt, Human
cccaggacucggcacucuccuu

SEQ ID NO: 421475 - RNA, 22 nt, Human
agcuggccuucggugucacugg

SEQ ID NO: 421476 - RNA, 22 nt, Human
uggcuuccaaaggaaugggccu

SEQ ID NO: 421477 - RNA, 22 nt, Human
agggagcucaguuggaagcggu

SEQ ID NO: 421478 - RNA, 22 nt, Human
gagguagccacagauagagacu

SEQ ID NO: 421479 - RNA, 21 nt, Human
ggagauggguaucgccugggc

SEQ ID NO: 421480 - RNA, 22 nt, Human
gagggcagaaaauuaugcggug

SEQ ID NO: 421481 - RNA, 22 nt, Human
uuaaguccuugguaauuuucuu

SEQ ID NO: 421482 - RNA, 22 nt, Human
ucaggcacugcuuucugauaug

SEQ ID NO: 421483 - RNA, 22 nt, Human
aaugaucuacucucauuaucuc

SEQ ID NO: 421484 - RNA, 22 nt, Human
gaugcacaugugaguauagaag

SEQ ID NO: 421485 - RNA, 22 nt, Human
aggccagaugucgggcuagaag

SEQ ID NO: 421486 - RNA, 22 nt, Human
cugggcugcgggcgccccucca

SEQ ID NO: 421487 - RNA, 22 nt, Human
guguaucaaagcacagacuuca

SEQ ID NO: 421488 - RNA, 22 nt, Human
aaugcuuuagcagugauuagug

SEQ ID NO: 421489 - RNA, 22 nt, Human
gguggccucucaugcaagguag

SEQ ID NO: 421490 - RNA, 21 nt, Human
ugcuccuuagcugccccugcc

SEQ ID NO: 421491 - RNA, 22 nt, Human
cagacacaccaggcccauucug

SEQ ID NO: 421492 - RNA, 22 nt, Human
aggaagcaaaaggcagggucua

SEQ ID NO: 421493 - RNA, 18 nt, Human
uccagagcuacuguggug

SEQ ID NO: 421494 - RNA, 22 nt, Human
cagcuuauucaguaagcacaua

SEQ ID NO: 421495 - RNA, 22 nt, Human
cagggccaguucucgcagcagu

SEQ ID NO: 421496 - RNA, 22 nt, Human
ugcaccauuaauuuaugugaga

SEQ ID NO: 421497 - RNA, 22 nt, Human
gcaggccagcugugcagauggg

SEQ ID NO: 421498 - RNA, 22 nt, Human
gucaggcugccagucuuuauug

SEQ ID NO: 421499 - RNA, 21 nt, Human
acaggcucuggggaugcuggg

SEQ ID NO: 421500 - RNA, 22 nt, Human
ccaaggcuccucagcuggucuu

SEQ ID NO: 421501 - RNA, 22 nt, Human
ugguuuauuucucugaaagguu

SEQ ID NO: 421502 - RNA, 22 nt, Human
ugcagggcaguggagguugagu

SEQ ID NO: 421503 - RNA, 22 nt, Human
cccuggagcugcuugcauguug

SEQ ID NO: 421504 - RNA, 22 nt, Human
uagaaagcuugggguguuuaaa

SEQ ID NO: 421505 - RNA, 22 nt, Human
ugaggcucugcuucuguggcuc

SEQ ID NO: 421506 - RNA, 22 nt, Human
agcuuccuguugagagagggag

SEQ ID NO: 421507 - RNA, 22 nt, Human
ccuggcagacagcacugaagcu

SEQ ID NO: 421508 - RNA, 22 nt, Human
uccugagagcagaguccaggug

SEQ ID NO: 421509 - RNA, 22 nt, Human
gcugcagcccggcgcgccugag

SEQ ID NO: 421510 - RNA, 22 nt, Human
ucagagaguuggaaagaauuaa

SEQ ID NO: 421511 - RNA, 23 nt, Human
aggugcagcccuggaccugcccc

SEQ ID NO: 421512 - RNA, 22 nt, Human
ugcuuaauauugugauguaaua

SEQ ID NO: 421513 - RNA, 22 nt, Human
aucaguuuaaaugggcuguugg

SEQ ID NO: 421514 - RNA, 22 nt, Human
cuuucacagcacaagccugccu

SEQ ID NO: 421515 - RNA, 22 nt, Human
gcucugcuggaaguucucugga

SEQ ID NO: 421516 - RNA, 22 nt, Human
caggaggaggguacaccaucag

SEQ ID NO: 421517 - RNA, 22 nt, Human
ccuuuugcucucccauccagaa

SEQ ID NO: 421518 - RNA, 21 nt, Human
auugaaagucaacaaucaguu

SEQ ID NO: 421519 - RNA, 22 nt, Human
augggcagcagcugccauucau

SEQ ID NO: 421520 - RNA, 17 nt, Human
aggccucccuccaggcc

SEQ ID NO: 421521 - RNA, 18 nt, Human
gcugagguggugucagag

SEQ ID NO: 421522 - RNA, 20 nt, Human
ugggccugagccugugggcu

SEQ ID NO: 421523 - RNA, 22 nt, Human
accucugcaacccuggaauggg

SEQ ID NO: 421524 - RNA, 22 nt, Human
ugaggcaguauuuuagugacuu

SEQ ID NO: 421525 - RNA, 22 nt, Human
ugcuggaggaguuuacuguggc

SEQ ID NO: 421526 - RNA, 22 nt, Human
cagggcaguuugugccuaugag

SEQ ID NO: 421527 - RNA, 22 nt, Human
gcucuggagauggagccuugag

SEQ ID NO: 421528 - RNA, 22 nt, Human
caugcuuucuguccaaauguua

SEQ ID NO: 421529 - RNA, 22 nt, Human
uauguacagggauagaacuuga

SEQ ID NO: 421530 - RNA, 22 nt, Human
uacauucuacuuuuucacuccc

SEQ ID NO: 421531 - RNA, 22 nt, Human
agggcuggagccacagcuggga

SEQ ID NO: 421532 - RNA, 22 nt, Human
aagccaggcaugcuuggacagu

SEQ ID NO: 421533 - RNA, 22 nt, Human
uacuguuuuuuagacucauggu

SEQ ID NO: 421534 - RNA, 22 nt, Human
ggcucaagcagucugccugccu

SEQ ID NO: 421535 - RNA, 22 nt, Human
cagggcaguaacgggaacaucu

SEQ ID NO: 421536 - RNA, 22 nt, Human
ugugaaaggggucacagggaaa

SEQ ID NO: 421537 - RNA, 22 nt, Human
agauguaguagugggucuuuua

SEQ ID NO: 421538 - RNA, 22 nt, Human
aaugcuuugacuauaucuauaa

SEQ ID NO: 421539 - RNA, 22 nt, Human
acauuuaggauguuuugagaga

SEQ ID NO: 421540 - RNA, 23 nt, Human
aggcccaacucugugagggcugc

SEQ ID NO: 421541 - RNA, 22 nt, Human
uuguuucaugaguguaaaggga

SEQ ID NO: 421542 - RNA, 22 nt, Human
ucuaaaaaagucuguucacuug

SEQ ID NO: 421543 - RNA, 22 nt, Human
cucuguccuaugcuugauagaa

SEQ ID NO: 421544 - RNA, 22 nt, Human
aaaauccacaacgcucauuuca

SEQ ID NO: 421545 - RNA, 22 nt, Human
uggccugguaccacauagauuu

SEQ ID NO: 421546 - RNA, 20 nt, Human
ccaagagcaugcaugaggaa

SEQ ID NO: 421547 - RNA, 22 nt, Human
uaagaaauuuaguuauagaaug

SEQ ID NO: 421548 - RNA, 22 nt, Human
cauuaugugggaaaauguucuu

SEQ ID NO: 421549 - RNA, 22 nt, Human
aauguacaucucaguguaguac

SEQ ID NO: 421550 - RNA, 22 nt, Human
acguggagagaauagggcacca

SEQ ID NO: 421551 - RNA, 22 nt, Human
ucugggagagcugcugucagag

SEQ ID NO: 421552 - RNA, 22 nt, Human
ugugggcucccccucacucugu

SEQ ID NO: 421553 - RNA, 22 nt, Human
gggcaaguccggugcccagagc

SEQ ID NO: 421554 - RNA, 20 nt, Human
ccuggaagagcuccccaggc

SEQ ID NO: 421555 - RNA, 22 nt, Human
augaugugugcugaucaagcuu

SEQ ID NO: 421556 - RNA, 22 nt, Human
ccagucacuggaaaaugggaau

SEQ ID NO: 421557 - RNA, 22 nt, Human
agguggggaggagugucucuuu

SEQ ID NO: 421558 - RNA, 22 nt, Human
aggcagagaaaaaccagauaug

SEQ ID NO: 421559 - RNA, 22 nt, Human
ugggcugcuguuacaggggcug

SEQ ID NO: 421560 - RNA, 22 nt, Human
acaaaauuaccuaguuauuuuc

SEQ ID NO: 421561 - RNA, 22 nt, Human
guucauauuacuuugagugcag

SEQ ID NO: 421562 - RNA, 22 nt, Human
agcugguucauucauucauggu

SEQ ID NO: 421563 - RNA, 22 nt, Human
guacauuuugagguuaaaacaa

SEQ ID NO: 421564 - RNA, 22 nt, Human
aggccucuucagggagcaugga

SEQ ID NO: 421565 - RNA, 22 nt, Human
ucugcagauuuaucagcagcug

SEQ ID NO: 421566 - RNA, 22 nt, Human
aaaggaagaugccaggacucug

SEQ ID NO: 421567 - RNA, 22 nt, Human
uccuaguucucugccagucgcu

SEQ ID NO: 421568 - RNA, 22 nt, Human
agaaacuucagcuauucuuuug

SEQ ID NO: 421569 - RNA, 22 nt, Human
agcagagccugggcuaggggug

SEQ ID NO: 421570 - RNA, 22 nt, Human
gcaaggcugagcacauuugcau

SEQ ID NO: 421571 - RNA, 22 nt, Human
cccagggaaugacucuggccuu

SEQ ID NO: 421572 - RNA, 22 nt, Human
aagcuuuagagaugaguuccuu

SEQ ID NO: 421573 - RNA, 21 nt, Human
gacaggggaagaagcaaggag

SEQ ID NO: 421574 - RNA, 22 nt, Human
gaaggagacccugaagaugcug

SEQ ID NO: 421575 - RNA, 22 nt, Human
uaaguuuaaauguacaugaagc

SEQ ID NO: 421576 - RNA, 22 nt, Human
uacuguuuucuauaauggcugu

SEQ ID NO: 421577 - RNA, 22 nt, Human
caggagacaaguuagcagcuga

SEQ ID NO: 421578 - RNA, 22 nt, Human
agccacagagguugaugugguu

SEQ ID NO: 421579 - RNA, 22 nt, Human
gcuaucuuucugcaccauaauu

SEQ ID NO: 421580 - RNA, 22 nt, Human
agcuguggaagacugucagggu

SEQ ID NO: 421581 - RNA, 22 nt, Human
ugaagccauuacuguguuaggg

SEQ ID NO: 421582 - RNA, 22 nt, Human
gaaaugcagauucugauucugu

SEQ ID NO: 421583 - RNA, 22 nt, Human
ggcugcugugaccucaggugau

SEQ ID NO: 421584 - RNA, 22 nt, Human
ccagagcagggcagcagggcuc

SEQ ID NO: 421585 - RNA, 22 nt, Human
cagcugugcuguauuaagcucu

SEQ ID NO: 421586 - RNA, 22 nt, Human
ccugucugcagauaucucaggu

SEQ ID NO: 421587 - RNA, 22 nt, Human
uccugcagcauccgucgucugu

SEQ ID NO: 421588 - RNA, 22 nt, Human
uagaaacccauguuuauucagu

SEQ ID NO: 421589 - RNA, 22 nt, Human
cacccuagcugucauuucaguu

SEQ ID NO: 421590 - RNA, 22 nt, Human
cugcugagcaucagggcugccc

SEQ ID NO: 421591 - RNA, 21 nt, Human
cugagggccgcagcugggcuc

SEQ ID NO: 421592 - RNA, 22 nt, Human
ccacagggccuuuccugcuggc

SEQ ID NO: 421593 - RNA, 22 nt, Human
uuguuucauggggauguuuauu

SEQ ID NO: 421594 - RNA, 23 nt, Human
ugagaagccaggggagcgugagg

SEQ ID NO: 421595 - RNA, 22 nt, Human
ggccaggccaagaggguuggaa

SEQ ID NO: 421596 - RNA, 22 nt, Human
gccuggguuccaugaucuccag

SEQ ID NO: 421597 - RNA, 22 nt, Human
uucgaguuggcuuuauuaaacu

SEQ ID NO: 421598 - RNA, 22 nt, Human
gacagacauuuccugauccaau

SEQ ID NO: 421599 - RNA, 22 nt, Human
ccuggagcucacugggagccgg

SEQ ID NO: 421600 - RNA, 22 nt, Human
uuacugaaaauucuucaggauu

SEQ ID NO: 421601 - RNA, 22 nt, Human
aauuauauguuaaucuucaauu

SEQ ID NO: 421602 - RNA, 22 nt, Human
gggcagcagagcccugccgagu

SEQ ID NO: 421603 - RNA, 22 nt, Human
agccugcuucccuuugugcccc

SEQ ID NO: 421604 - RNA, 22 nt, Human
agagcugggacuuggacucaau

SEQ ID NO: 421605 - RNA, 22 nt, Human
uugugucugggggagugacauc

SEQ ID NO: 421606 - RNA, 22 nt, Human
ccagcagcuuuauuggcucucc

SEQ ID NO: 421607 - RNA, 22 nt, Human
uaauuuuacuuccugagcaccu

SEQ ID NO: 421608 - RNA, 22 nt, Human
gaaugcagauggcugguguaug

SEQ ID NO: 421609 - RNA, 22 nt, Human
gcugcagcagcugcaggguugu

SEQ ID NO: 421610 - RNA, 22 nt, Human
gcugcagcucgccuuccggccu

SEQ ID NO: 421611 - RNA, 22 nt, Human
aaauguguguauguacauauau

SEQ ID NO: 421612 - RNA, 22 nt, Human
uucuaauuguguuugcauaucu

SEQ ID NO: 421613 - RNA, 22 nt, Human
uuugaaagggacaaagucacug

SEQ ID NO: 421614 - RNA, 22 nt, Human
acucugaggagugacuagaggu

SEQ ID NO: 421615 - RNA, 22 nt, Human
ugcugugggcaguacauaagcu

SEQ ID NO: 421616 - RNA, 22 nt, Human
gcagcagagaacacaaugaugg

SEQ ID NO: 421617 - RNA, 22 nt, Human
ucuccacucugagugccuuuca

SEQ ID NO: 421618 - RNA, 20 nt, Human
ucuguacacucaucuucugc

SEQ ID NO: 421619 - RNA, 22 nt, Human
agcugccacugagggugcacag

SEQ ID NO: 421620 - RNA, 22 nt, Human
gcuggagguuucaccugaguuu

SEQ ID NO: 421621 - RNA, 22 nt, Human
acauaugcucaucugcauuccc

SEQ ID NO: 421622 - RNA, 22 nt, Human
ccagagcugauuccugggacuu

SEQ ID NO: 421623 - RNA, 22 nt, Human
cucuuuccucagccacagucua

SEQ ID NO: 421624 - RNA, 22 nt, Human
agaacuuaggaacaacagcuua

SEQ ID NO: 421625 - RNA, 22 nt, Human
uggcuccuucauucuccugcca

SEQ ID NO: 421626 - RNA, 22 nt, Human
agagugaaguaauuguuaggau

SEQ ID NO: 421627 - RNA, 22 nt, Human
cucugugauuuugugagccaga

SEQ ID NO: 421628 - RNA, 22 nt, Human
cugagcugcggcaggcaccugg

SEQ ID NO: 421629 - RNA, 22 nt, Human
acuuugcacuaaguuacucauu

SEQ ID NO: 421630 - RNA, 22 nt, Human
aagcagagccaccagcuuugga

SEQ ID NO: 421631 - RNA, 22 nt, Human
aagaaaugcagaaaugugcugg

SEQ ID NO: 421632 - RNA, 22 nt, Human
gggcugcuuauacugaugauaa

SEQ ID NO: 421633 - RNA, 22 nt, Human
gcuggccuugugucugaggaag

SEQ ID NO: 421634 - RNA, 22 nt, Human
aguauguagugcaaucagucag

SEQ ID NO: 421635 - RNA, 21 nt, Human
ugguggagugugcugagcaug

SEQ ID NO: 421636 - RNA, 22 nt, Human
ucagcuuucucaaagaagcugg

SEQ ID NO: 421637 - RNA, 22 nt, Human
caguggaaacuaugcugcugga

SEQ ID NO: 421638 - RNA, 22 nt, Human
uuuuccucuguauuugaaaugc

SEQ ID NO: 421639 - RNA, 22 nt, Human
acuggcagagguuggacaccau

SEQ ID NO: 421640 - RNA, 22 nt, Human
ccagcugucacucagaaaggcc

SEQ ID NO: 421641 - RNA, 22 nt, Human
cagggucuuauaaggccaauuu

SEQ ID NO: 421642 - RNA, 17 nt, Human
uuccccugaccaagccu

SEQ ID NO: 421643 - RNA, 22 nt, Human
uaucuguuccaggcacucagcu

SEQ ID NO: 421644 - RNA, 22 nt, Human
ccugggucacucaggcaggcgg

SEQ ID NO: 421645 - RNA, 22 nt, Human
ggcaguggguggaucucaggga

SEQ ID NO: 421646 - RNA, 22 nt, Human
aggcccugcccagagcuccucg

SEQ ID NO: 421647 - RNA, 20 nt, Human
aguuauaguaucuagccaug

SEQ ID NO: 421648 - RNA, 22 nt, Human
cagcugccugcaacacaagcuu

SEQ ID NO: 421649 - RNA, 22 nt, Human
agagaaggucacuaaggaccca

SEQ ID NO: 421650 - RNA, 22 nt, Human
gaaaaguacacagcccaaacau

SEQ ID NO: 421651 - RNA, 22 nt, Human
aacuagaacgucuaguugcugg

SEQ ID NO: 421652 - RNA, 22 nt, Human
uggagccaaugaacauuugcug

SEQ ID NO: 421653 - RNA, 22 nt, Human
ggaccugaacauaaaacgaggc

SEQ ID NO: 421654 - RNA, 22 nt, Human
agccaaggagugcagguggcuu

SEQ ID NO: 421655 - RNA, 22 nt, Human
cagccugcuagggcaaugccuu

SEQ ID NO: 421656 - RNA, 22 nt, Human
ccugccugguguaagucuaagg

SEQ ID NO: 421657 - RNA, 22 nt, Human
uuauucugcacuuuuaaaauau

SEQ ID NO: 421658 - RNA, 22 nt, Human
gccuccuggccuuugcuccuca

SEQ ID NO: 421659 - RNA, 22 nt, Human
gcugcucugugacagccuccgg

SEQ ID NO: 421660 - RNA, 22 nt, Human
ccaggccucaccugcccaccua

SEQ ID NO: 421661 - RNA, 22 nt, Human
uuuuagauugggaaauguaaag

SEQ ID NO: 421662 - RNA, 22 nt, Human
uuuccaauaaagugucauuguu

SEQ ID NO: 421663 - RNA, 20 nt, Human
uggcagaguugucccaccca

SEQ ID NO: 421664 - RNA, 22 nt, Human
gguuccccaggcggcccuugga

SEQ ID NO: 421665 - RNA, 22 nt, Human
uccaggcucucaggugucagca

SEQ ID NO: 421666 - RNA, 22 nt, Human
gggacaggcugagacuugagcu

SEQ ID NO: 421667 - RNA, 22 nt, Human
ccagagccuaagaucugauccu

SEQ ID NO: 421668 - RNA, 19 nt, Human
uggcugagcuggacugagg

SEQ ID NO: 421669 - RNA, 22 nt, Human
uguguccauucaggcacugacc

SEQ ID NO: 421670 - RNA, 22 nt, Human
accaaggagccacauacaaccu

SEQ ID NO: 421671 - RNA, 17 nt, Human
uuccuggaagucauucc

SEQ ID NO: 421672 - RNA, 22 nt, Human
cugcccugacugaccuuuugaa

SEQ ID NO: 421673 - RNA, 22 nt, Human
agggcacagccuaaagccuaug

SEQ ID NO: 421674 - RNA, 19 nt, Human
ggcucucccuugagagagc

SEQ ID NO: 421675 - RNA, 22 nt, Human
cgggcagauugggaagguucau

SEQ ID NO: 421676 - RNA, 21 nt, Human
ucuguacaucauugagucccc

SEQ ID NO: 421677 - RNA, 22 nt, Human
uaaggccaaacuauuauaguuc

SEQ ID NO: 421678 - RNA, 22 nt, Human
agcucccagaaggcccugcgcc

SEQ ID NO: 421679 - RNA, 22 nt, Human
ugggugcuucgucagcucugag

SEQ ID NO: 421680 - RNA, 22 nt, Human
ugcagaagugagucaugaggaa

SEQ ID NO: 421681 - RNA, 22 nt, Human
ccuaggccuuacuuuccugugc

SEQ ID NO: 421682 - RNA, 22 nt, Human
ucauuuguaccauuuuuuaaga

SEQ ID NO: 421683 - RNA, 19 nt, Human
gggcuccuugggccucucu

SEQ ID NO: 421684 - RNA, 22 nt, Human
aucauuccacauguaccacuag

SEQ ID NO: 421685 - RNA, 22 nt, Human
uccuuggcuuucuggagcuucu

SEQ ID NO: 421686 - RNA, 21 nt, Human
gggcagaggggccuccugggu

SEQ ID NO: 421687 - RNA, 22 nt, Human
agguggguaucaugagagauua

SEQ ID NO: 421688 - RNA, 22 nt, Human
auucuacaacccaauaauaauu

SEQ ID NO: 421689 - RNA, 22 nt, Human
aguuuauguaaaauuaguaaug

SEQ ID NO: 421690 - RNA, 21 nt, Human
aagaagcaauuuauuggaagg

SEQ ID NO: 421691 - RNA, 22 nt, Human
uuccucaucugugcaccucacu

SEQ ID NO: 421692 - RNA, 22 nt, Human
cucagagucugcauuucuguca

SEQ ID NO: 421693 - RNA, 22 nt, Human
gcaccaggaggcccuucucauc

SEQ ID NO: 421694 - RNA, 22 nt, Human
agcacccuccaacuucccugua

SEQ ID NO: 421695 - RNA, 22 nt, Human
ggaggcucugcuccguguguuc

SEQ ID NO: 421696 - RNA, 22 nt, Human
gauuucaccugaucuugucauc

SEQ ID NO: 421697 - RNA, 22 nt, Human
uaauuuaauuccauggauucua

SEQ ID NO: 421698 - RNA, 19 nt, Human
ugacaggcuguugccuuga

SEQ ID NO: 421699 - RNA, 22 nt, Human
uaaaauguguuucuguaugguu

SEQ ID NO: 421700 - RNA, 22 nt, Human
uccuggcccuguggccugcagu

SEQ ID NO: 421701 - RNA, 22 nt, Human
gcaugugucuccccaguggagg

SEQ ID NO: 421702 - RNA, 19 nt, Human
cacacccaugcuugccaag

SEQ ID NO: 421703 - RNA, 18 nt, Human
acauacauucugucugca

SEQ ID NO: 421704 - RNA, 22 nt, Human
gagcagcucugggugacccagu

SEQ ID NO: 421705 - RNA, 22 nt, Human
ucucaggcuaccuugcacaagg

SEQ ID NO: 421706 - RNA, 22 nt, Human
acugagcugugacaaugcuuaa

SEQ ID NO: 421707 - RNA, 22 nt, Human
ugucccaggcugaaguacagug

SEQ ID NO: 421708 - RNA, 22 nt, Human
gaauucugggagagaucugaca

SEQ ID NO: 421709 - RNA, 22 nt, Human
gcagagugccgagauggaagcg

SEQ ID NO: 421710 - RNA, 22 nt, Human
uguggcagaaccagaauucaaa

SEQ ID NO: 421711 - RNA, 22 nt, Human
ggcaggugaccuggccucccag

SEQ ID NO: 421712 - RNA, 22 nt, Human
uuucuacagcuggugcaacuuu

SEQ ID NO: 421713 - RNA, 22 nt, Human
ugccagaagauucucuaucaga

SEQ ID NO: 421714 - RNA, 22 nt, Human
gugucccagccccacaggccug

SEQ ID NO: 421715 - RNA, 23 nt, Human
augcucugggcugugggaccugc

SEQ ID NO: 421716 - RNA, 21 nt, Human
ucucuacacuuucacuaggcu

SEQ ID NO: 421717 - RNA, 22 nt, Human
cagggacugagauccagacugu

SEQ ID NO: 421718 - RNA, 17 nt, Human
cagggcugucugccuag

SEQ ID NO: 421719 - RNA, 22 nt, Human
acagauuugacugguaccuggc

SEQ ID NO: 421720 - RNA, 22 nt, Human
uaugcacauucacacaaaaaug

SEQ ID NO: 421721 - RNA, 15 nt, Human
ugggcagaucacuug

SEQ ID NO: 421722 - RNA, 22 nt, Human
gccuuggccaacaccuugcaaa

SEQ ID NO: 421723 - RNA, 22 nt, Human
uggccagaaccugcaguaggcc

SEQ ID NO: 421724 - RNA, 22 nt, Human
uucuggagagaaaccuuacaaa

SEQ ID NO: 421725 - RNA, 22 nt, Human
gggagccacagugaggugcaug

SEQ ID NO: 421726 - RNA, 22 nt, Human
gaggcagagugcaccccaggag

SEQ ID NO: 421727 - RNA, 22 nt, Human
uacuguacucaacaugugaguu

SEQ ID NO: 421728 - RNA, 21 nt, Human
ucaaagcacauauuugcacau

SEQ ID NO: 421729 - RNA, 22 nt, Human
auaaggcacacauagauagggu

SEQ ID NO: 421730 - RNA, 22 nt, Human
agcccuagagcuggaggucagu

SEQ ID NO: 421731 - RNA, 22 nt, Human
ccaaggagaaaugcugugcuuu

SEQ ID NO: 421732 - RNA, 22 nt, Human
ugcugggggugucucaccaggc

SEQ ID NO: 421733 - RNA, 22 nt, Human
gcugccugaagugucuacacug

SEQ ID NO: 421734 - RNA, 20 nt, Human
aacauugcuucaauguaacc

SEQ ID NO: 421735 - RNA, 22 nt, Human
aguuaacaaguuggcaaucaac

SEQ ID NO: 421736 - RNA, 22 nt, Human
ucucaguggacgugucugucuu

SEQ ID NO: 421737 - RNA, 22 nt, Human
cagcugccuaugaccuagccuc

SEQ ID NO: 421738 - RNA, 22 nt, Human
auuauuaggugcucucugacaa

SEQ ID NO: 421739 - RNA, 22 nt, Human
aacagugagaagguggacagga

SEQ ID NO: 421740 - RNA, 22 nt, Human
gcagggcacaaggacgcacagg

SEQ ID NO: 421741 - RNA, 22 nt, Human
cagggcaguuuuacuucucucu

SEQ ID NO: 421742 - RNA, 22 nt, Human
accaucagagcacaguccgugc

SEQ ID NO: 421743 - RNA, 22 nt, Human
uggagcaggacggggaguggua

SEQ ID NO: 421744 - RNA, 22 nt, Human
uugaagcauuucuuugagcuuc

SEQ ID NO: 421745 - RNA, 20 nt, Human
aauuuacucacagaaugaau

SEQ ID NO: 421746 - RNA, 22 nt, Human
aaaagucagucucuccuagcuc

SEQ ID NO: 421747 - RNA, 22 nt, Human
ucauggcacuuagcacaguccu

SEQ ID NO: 421748 - RNA, 22 nt, Human
guguccuuauaagaagagaugc

SEQ ID NO: 421749 - RNA, 22 nt, Human
caguuuauaugucagagcugua

SEQ ID NO: 421750 - RNA, 22 nt, Human
cuauuuuaagaggccauuaggu

SEQ ID NO: 421751 - RNA, 22 nt, Human
agccaggcgcaguggcuuaugc

SEQ ID NO: 421752 - RNA, 22 nt, Human
cuuagggaauugggaggaugcc

SEQ ID NO: 421753 - RNA, 22 nt, Human
ucuguucuauuggucuaugugu

SEQ ID NO: 421754 - RNA, 17 nt, Human
auccccagcaucuagaa

SEQ ID NO: 421755 - RNA, 22 nt, Human
gcugcccagcaggccccagggg

SEQ ID NO: 421756 - RNA, 22 nt, Human
acaguggagaaggcaugaggcu

SEQ ID NO: 421757 - RNA, 22 nt, Human
ucaggaguaaagacagaguucc

SEQ ID NO: 421758 - RNA, 22 nt, Human
uaucuuuaacuugcaguauuua

SEQ ID NO: 421759 - RNA, 20 nt, Human
agacccuguguccuguggcc

SEQ ID NO: 421760 - RNA, 22 nt, Human
ucaaugauagacaagaucuaag

SEQ ID NO: 421761 - RNA, 22 nt, Human
gaagaacaccugcugcccagug

SEQ ID NO: 421762 - RNA, 22 nt, Human
cuggcugcuggccugaggaugc

SEQ ID NO: 421763 - RNA, 22 nt, Human
uauuuauaaucugccaaagaga

SEQ ID NO: 421764 - RNA, 22 nt, Human
cugaggcacagugaacuucucc

SEQ ID NO: 421765 - RNA, 22 nt, Human
ucacaagacagaaaacauuuag

SEQ ID NO: 421766 - RNA, 22 nt, Human
ggagaggcuuggcccagccugg

SEQ ID NO: 421767 - RNA, 22 nt, Human
acuuccuguguuggucuugcug

SEQ ID NO: 421768 - RNA, 22 nt, Human
gcuccucuauuccccacauuuu

SEQ ID NO: 421769 - RNA, 22 nt, Human
auugacaagugagcugggcugc

SEQ ID NO: 421770 - RNA, 22 nt, Human
acccuuucuuacucacacgcuc

SEQ ID NO: 421771 - RNA, 22 nt, Human
uagcagagaggggacaguggca

SEQ ID NO: 421772 - RNA, 22 nt, Human
agcugcucaggagagccagguc

SEQ ID NO: 421773 - RNA, 22 nt, Human
gugugcagggaugagugcaggu

SEQ ID NO: 421774 - RNA, 20 nt, Human
gagggcaggcacccauuuca

SEQ ID NO: 421775 - RNA, 22 nt, Human
gcugccuccugaaagcgcucug

SEQ ID NO: 421776 - RNA, 22 nt, Human
uuuugaaagccagguuuguaug

SEQ ID NO: 421777 - RNA, 22 nt, Human
gggcagugucggggcccaggga

SEQ ID NO: 421778 - RNA, 22 nt, Human
caguucuaauuaauaggaguaa

SEQ ID NO: 421779 - RNA, 22 nt, Human
gcuguggcugaagaugcaggga

SEQ ID NO: 421780 - RNA, 22 nt, Human
ugcacacacucugcauauacuu

SEQ ID NO: 421781 - RNA, 22 nt, Human
gcccggcagucacacacccagg

SEQ ID NO: 421782 - RNA, 18 nt, Human
ugaggccucugcugggcc

SEQ ID NO: 421783 - RNA, 19 nt, Human
ucccgcccacugagcgugc

SEQ ID NO: 421784 - RNA, 22 nt, Human
uaaggcacccauguucauacag

SEQ ID NO: 421785 - RNA, 19 nt, Human
agcuuccauauucucuagu

SEQ ID NO: 421786 - RNA, 18 nt, Human
cagggccccagaauuauc

SEQ ID NO: 421787 - RNA, 22 nt, Human
ugaugaaauguugaggcaguga

SEQ ID NO: 421788 - RNA, 22 nt, Human
aggacagagggaccagagccca

SEQ ID NO: 421789 - RNA, 20 nt, Human
uguuccaugacuauuuggau

SEQ ID NO: 421790 - RNA, 22 nt, Human
uacauuuauaaggcuucucugu

SEQ ID NO: 421791 - RNA, 22 nt, Human
cagagaccccgcugcccuucug

SEQ ID NO: 421792 - RNA, 22 nt, Human
gucaggaucucccaguacauau

SEQ ID NO: 421793 - RNA, 22 nt, Human
uggcugaggcacagcugccgcc

SEQ ID NO: 421794 - RNA, 23 nt, Human
acacaauagaguacuauucagcc

SEQ ID NO: 421795 - RNA, 22 nt, Human
acuaagugauucuaagcaucuu

SEQ ID NO: 421796 - RNA, 22 nt, Human
aaguuugagaagcuuauagaua

SEQ ID NO: 421797 - RNA, 22 nt, Human
cuguacagaguucugaguguac

SEQ ID NO: 421798 - RNA, 22 nt, Human
uaggugugggcucaggaaugug

SEQ ID NO: 421799 - RNA, 22 nt, Human
augccuggacugacaugcacug

SEQ ID NO: 421800 - RNA, 22 nt, Human
uuuccucugggcccugccaccc

SEQ ID NO: 421801 - RNA, 20 nt, Human
accauaauguuaauuacaaa

SEQ ID NO: 421802 - RNA, 22 nt, Human
gucagcaccucuuuggggagcu

SEQ ID NO: 421803 - RNA, 22 nt, Human
cucugagaggugagaagcagca

SEQ ID NO: 421804 - RNA, 22 nt, Human
caggacauugauccauuggcac

SEQ ID NO: 421805 - RNA, 22 nt, Human
cagaggcagacccuccagggcg

SEQ ID NO: 421806 - RNA, 22 nt, Human
accacugcccauggugaaaacu

SEQ ID NO: 421807 - RNA, 22 nt, Human
agggacccauagagagaccagu

SEQ ID NO: 421808 - RNA, 22 nt, Human
ucucuguaguugggcagcugcu

SEQ ID NO: 421809 - RNA, 22 nt, Human
aggugcaguggcucaugccugu

SEQ ID NO: 421810 - RNA, 22 nt, Human
ucccagagugugggcaucaagg

SEQ ID NO: 421811 - RNA, 19 nt, Human
gcuuuaguuuacucaucua

SEQ ID NO: 421812 - RNA, 22 nt, Human
cacauuucuaggaaauuaaaug

SEQ ID NO: 421813 - RNA, 20 nt, Human
guguuucaugugauacaaug

SEQ ID NO: 421814 - RNA, 22 nt, Human
uuugcaaauaccaugaaacuug

SEQ ID NO: 421815 - RNA, 22 nt, Human
gagugaaaaaggaagggccaua

SEQ ID NO: 421816 - RNA, 22 nt, Human
gccaccagugggggccugggca

SEQ ID NO: 421817 - RNA, 22 nt, Human
cuccaguaucuguaggaaaagg

SEQ ID NO: 421818 - RNA, 22 nt, Human
gcauuccugagaaugcagagug

SEQ ID NO: 421819 - RNA, 22 nt, Human
uuucagaucauuuuuuaaguac

SEQ ID NO: 421820 - RNA, 22 nt, Human
gccuucugauaucucuuggcau

SEQ ID NO: 421821 - RNA, 22 nt, Human
uauuucaugugcaccauaauuc

SEQ ID NO: 421822 - RNA, 22 nt, Human
agagggaucacccuguuucugg

SEQ ID NO: 421823 - RNA, 22 nt, Human
ugcucugucaagaaaagaugcc

SEQ ID NO: 421824 - RNA, 22 nt, Human
ucaguuuugauuccugguucuc

SEQ ID NO: 421825 - RNA, 22 nt, Human
uggccuggggaagaccaugggc

SEQ ID NO: 421826 - RNA, 22 nt, Human
uggcccugucccuggagccugg

SEQ ID NO: 421827 - RNA, 22 nt, Human
uggcugcagacaccuauggcag

SEQ ID NO: 421828 - RNA, 22 nt, Human
ccucuguccuggggaguggagc

SEQ ID NO: 421829 - RNA, 18 nt, Human
agcuggggccucuggucc

SEQ ID NO: 421830 - RNA, 22 nt, Human
uauuauguagaguaaggguuaa

SEQ ID NO: 421831 - RNA, 22 nt, Human
ugguccaggguguaguacagag

SEQ ID NO: 421832 - RNA, 22 nt, Human
cagcuuuguggccuugaccucg

SEQ ID NO: 421833 - RNA, 22 nt, Human
agucucugcaugccugcugugc

SEQ ID NO: 421834 - RNA, 19 nt, Human
ucauuguugguuugucggg

SEQ ID NO: 421835 - RNA, 22 nt, Human
agcucccaauugacuugaacua

SEQ ID NO: 421836 - RNA, 22 nt, Human
gagcucccaggccccagcaagg

SEQ ID NO: 421837 - RNA, 22 nt, Human
uagcauuuggacauugucaccu

SEQ ID NO: 421838 - RNA, 22 nt, Human
uccucugcuggaagggcaagag

SEQ ID NO: 421839 - RNA, 22 nt, Human
guaaaauucuagcaucugaaag

SEQ ID NO: 421840 - RNA, 22 nt, Human
cagagguagccgagugcaaucg

SEQ ID NO: 421841 - RNA, 22 nt, Human
cucaggauauugggcuggagca

SEQ ID NO: 421842 - RNA, 22 nt, Human
uaguuauuauuguuacuaucag

SEQ ID NO: 421843 - RNA, 22 nt, Human
ugcagcugcuggcccaggugcu

SEQ ID NO: 421844 - RNA, 22 nt, Human
agaggcuccaccuucucugucc

SEQ ID NO: 421845 - RNA, 22 nt, Human
ccagcagacacacaggcguggg

SEQ ID NO: 421846 - RNA, 22 nt, Human
agcuuaggaggaugaugaacau

SEQ ID NO: 421847 - RNA, 22 nt, Human
gcucccacaaccuucuugcucc

SEQ ID NO: 421848 - RNA, 22 nt, Human
cagaggcucaccagccuuucac

SEQ ID NO: 421849 - RNA, 22 nt, Human
uggagcuggaauuugagcugga

SEQ ID NO: 421850 - RNA, 22 nt, Human
aauuagggaggacaaagguaca

SEQ ID NO: 421851 - RNA, 22 nt, Human
ggccugagaaccauggggccaa

SEQ ID NO: 421852 - RNA, 22 nt, Human
caggguccggcugccuggcugu

SEQ ID NO: 421853 - RNA, 22 nt, Human
cucaugauguagcgaaugagaa

SEQ ID NO: 421854 - RNA, 22 nt, Human
caggaaaggugugucaugaugg

SEQ ID NO: 421855 - RNA, 22 nt, Human
aauguuacgaucaacaacacau

SEQ ID NO: 421856 - RNA, 22 nt, Human
uggcucagccagcccuaggaac

SEQ ID NO: 421857 - RNA, 22 nt, Human
aaggcucccucuucucgagugu

SEQ ID NO: 421858 - RNA, 22 nt, Human
caggugggagccacagcguaca

SEQ ID NO: 421859 - RNA, 22 nt, Human
ucucauguauugcccuggugug

SEQ ID NO: 421860 - RNA, 22 nt, Human
aagaugcgguugaccauggugu

SEQ ID NO: 421861 - RNA, 22 nt, Human
uuugugaagggaacagaagugu

SEQ ID NO: 421862 - RNA, 23 nt, Human
uccaagggcuacaaacacagacc

SEQ ID NO: 421863 - RNA, 22 nt, Human
ucuccugguuuguuaaauaauu

SEQ ID NO: 421864 - RNA, 22 nt, Human
agcagugaugcaugacagccua

SEQ ID NO: 421865 - RNA, 22 nt, Human
uuuuaucuaccuaugcucauuu

SEQ ID NO: 421866 - RNA, 22 nt, Human
uuaucguacgcuucagaaauuu

SEQ ID NO: 421867 - RNA, 22 nt, Human
aucaauucuuaggaaaauagcu

SEQ ID NO: 421868 - RNA, 22 nt, Human
ugugucagagguagagauggca

SEQ ID NO: 421869 - RNA, 22 nt, Human
aauggccagcaacaggagugaa

SEQ ID NO: 421870 - RNA, 22 nt, Human
ucucaggaaauaggauuugagu

SEQ ID NO: 421871 - RNA, 23 nt, Human
agcuggguggccugcgugaagcu

SEQ ID NO: 421872 - RNA, 22 nt, Human
ugggagcucagaaagggagguc

SEQ ID NO: 421873 - RNA, 22 nt, Human
uucacagaugccugaugugugg

SEQ ID NO: 421874 - RNA, 22 nt, Human
ugggggaagagcuuguuaaagu

SEQ ID NO: 421875 - RNA, 22 nt, Human
ggcagccuccagggcacuggug

SEQ ID NO: 421876 - RNA, 22 nt, Human
guuauguaaucuaacacucagu

SEQ ID NO: 421877 - RNA, 22 nt, Human
cuggcuuccucaggagcagugg

SEQ ID NO: 421878 - RNA, 22 nt, Human
aagaaaagaaaccugaggcuuu

SEQ ID NO: 421879 - RNA, 22 nt, Human
agggcagcagcuccuccuagcu

SEQ ID NO: 421880 - RNA, 22 nt, Human
cccucugccucugaguaggaca

SEQ ID NO: 421881 - RNA, 22 nt, Human
ugcaugcauaaauguacacaca

SEQ ID NO: 421882 - RNA, 22 nt, Human
uucacaauaggagcaugcaaau

SEQ ID NO: 421883 - RNA, 22 nt, Human
cugccuggagcauucugaaggu

SEQ ID NO: 421884 - RNA, 22 nt, Human
ccugugcauccgguggucauug

SEQ ID NO: 421885 - RNA, 22 nt, Human
agcauuuauuucuuagaaauug

SEQ ID NO: 421886 - RNA, 22 nt, Human
ucuguggccuguguccaagugc

SEQ ID NO: 421887 - RNA, 22 nt, Human
aagugagauuauauguacggga

SEQ ID NO: 421888 - RNA, 22 nt, Human
ggccugcuauuggugggcagac

SEQ ID NO: 421889 - RNA, 22 nt, Human
cagagcauaauugacaugaggu

SEQ ID NO: 421890 - RNA, 22 nt, Human
uuuauguaaguggaaugaugcc

SEQ ID NO: 421891 - RNA, 22 nt, Human
uccagcuuauagguagauuuaa

SEQ ID NO: 421892 - RNA, 22 nt, Human
aguccaguguguucuggcagca

SEQ ID NO: 421893 - RNA, 22 nt, Human
ggcucaguguuuguggaacaua

SEQ ID NO: 421894 - RNA, 22 nt, Human
ggguggcacaggugcagagggu

SEQ ID NO: 421895 - RNA, 22 nt, Human
uguauauucugccuaaaagcuu

SEQ ID NO: 421896 - RNA, 19 nt, Human
gaucagagugucagcuugu

SEQ ID NO: 421897 - RNA, 22 nt, Human
gaaaacugugauuagaaugccu

SEQ ID NO: 421898 - RNA, 22 nt, Human
caggaugagguagaggcagaua

SEQ ID NO: 421899 - RNA, 22 nt, Human
gcagccaccucccauggcgggg

SEQ ID NO: 421900 - RNA, 22 nt, Human
cagagcuguccaaacccugaca

SEQ ID NO: 421901 - RNA, 22 nt, Human
cagcuggcgggcagagccgcca

SEQ ID NO: 421902 - RNA, 22 nt, Human
cugcucucuguuccccuggauc

SEQ ID NO: 421903 - RNA, 22 nt, Human
agugggaccggugcuauuccag

SEQ ID NO: 421904 - RNA, 22 nt, Human
cacaugaugguggaagccauag

SEQ ID NO: 421905 - RNA, 22 nt, Human
uucccucuccuacucaggaaag

SEQ ID NO: 421906 - RNA, 22 nt, Human
aguccagucucacucuuggcag

SEQ ID NO: 421907 - RNA, 19 nt, Human
uggaagaggaagggaaaua

SEQ ID NO: 421908 - RNA, 22 nt, Human
agccaggcuaaaugagccauga

SEQ ID NO: 421909 - RNA, 22 nt, Human
guguaauuauauaaagaucuac

SEQ ID NO: 421910 - RNA, 22 nt, Human
agcagcugagccccagcuguga

SEQ ID NO: 421911 - RNA, 22 nt, Human
agcauggggcaaugcaugugcu

SEQ ID NO: 421912 - RNA, 22 nt, Human
guggcuucugcggugugcgcag

SEQ ID NO: 421913 - RNA, 22 nt, Human
agcaggagcugugggaagaugg

SEQ ID NO: 421914 - RNA, 22 nt, Human
ccucugccaccucccacgaggc

SEQ ID NO: 421915 - RNA, 21 nt, Human
cucuugucuuugcucaguagc

SEQ ID NO: 421916 - RNA, 22 nt, Human
uuauuugcccauguuuagcaga

SEQ ID NO: 421917 - RNA, 20 nt, Human
gggagaagggcugaugagag

SEQ ID NO: 421918 - RNA, 22 nt, Human
agagcuggggccagagucaagg

SEQ ID NO: 421919 - RNA, 22 nt, Human
cacagcuucugagugaggauuu

SEQ ID NO: 421920 - RNA, 17 nt, Human
acacagccagguucucc

SEQ ID NO: 421921 - RNA, 22 nt, Human
ugcagaccucccauggcugccu

SEQ ID NO: 421922 - RNA, 22 nt, Human
caaugugguggcagaugucagu

SEQ ID NO: 421923 - RNA, 22 nt, Human
ugagagagccugaaucucuuac

SEQ ID NO: 421924 - RNA, 22 nt, Human
gcagaggcucuuuaaugcuuag

SEQ ID NO: 421925 - RNA, 22 nt, Human
cuggugggaggcaagguggaag

SEQ ID NO: 421926 - RNA, 22 nt, Human
ccucauggccuugagcugaggg

SEQ ID NO: 421927 - RNA, 19 nt, Human
cugugcuuuaaacuccuau

SEQ ID NO: 421928 - RNA, 22 nt, Human
cugggagcccgcguccuggugg

SEQ ID NO: 421929 - RNA, 22 nt, Human
gggcuguggagccgcgagggcu

SEQ ID NO: 421930 - RNA, 22 nt, Human
gaucaaaagcuggguucuaaaa

SEQ ID NO: 421931 - RNA, 22 nt, Human
aauauguuccacuuaaagcugg

SEQ ID NO: 421932 - RNA, 22 nt, Human
uucauaguguuuccuuccagug

SEQ ID NO: 421933 - RNA, 22 nt, Human
uuugacagcuuguuacaaaguu

SEQ ID NO: 421934 - RNA, 22 nt, Human
gucucuggguuaagcagugcau

SEQ ID NO: 421935 - RNA, 22 nt, Human
guuuauuauucaacuucauguu

SEQ ID NO: 421936 - RNA, 22 nt, Human
uaugcauauagaugcacacaca

SEQ ID NO: 421937 - RNA, 21 nt, Human
acagcagagaucaagacuaag

SEQ ID NO: 421938 - RNA, 22 nt, Human
ugcuuuauaaccauuucugugg

SEQ ID NO: 421939 - RNA, 22 nt, Human
gcacccagggacuuggcuggcc

SEQ ID NO: 421940 - RNA, 22 nt, Human
ggggccugcgagguucaacuuc

SEQ ID NO: 421941 - RNA, 17 nt, Human
ucuggccuuccugaacu

SEQ ID NO: 421942 - RNA, 22 nt, Human
uguuaucugagcaacgucgacg

SEQ ID NO: 421943 - RNA, 22 nt, Human
caggaggagcauuagcgucuca

SEQ ID NO: 421944 - RNA, 22 nt, Human
aggcagcaagauuauuuaaucc

SEQ ID NO: 421945 - RNA, 22 nt, Human
gcccagcaccucucucaggguu

SEQ ID NO: 421946 - RNA, 19 nt, Human
aauucuguuucagcagauc

SEQ ID NO: 421947 - RNA, 20 nt, Human
cuccagggaacagacuggag

SEQ ID NO: 421948 - RNA, 22 nt, Human
ucugggagacguguguugucag

SEQ ID NO: 421949 - RNA, 22 nt, Human
cuacugaguccuucagcugcca

SEQ ID NO: 421950 - RNA, 22 nt, Human
cagagccccccuucugaucaca

SEQ ID NO: 421951 - RNA, 21 nt, Human
uugaaggaucacuucuguacc

SEQ ID NO: 421952 - RNA, 22 nt, Human
gagccagcuacauggucugcaa

SEQ ID NO: 421953 - RNA, 22 nt, Human
uucauaaugagguccuagaggc

SEQ ID NO: 421954 - RNA, 22 nt, Human
gagcugccugaacaagcagcag

SEQ ID NO: 421955 - RNA, 19 nt, Human
agccagggugagaaggagc

SEQ ID NO: 421956 - RNA, 21 nt, Human
gccugcaguuuugaagcccuu

SEQ ID NO: 421957 - RNA, 22 nt, Human
agagcagcacguuguccccaca

SEQ ID NO: 421958 - RNA, 22 nt, Human
ucuuagaaugucaacugauguu

SEQ ID NO: 421959 - RNA, 22 nt, Human
ccugucagcugauggcuaugua

SEQ ID NO: 421960 - RNA, 22 nt, Human
ccucccuuggccauagccagcc

SEQ ID NO: 421961 - RNA, 22 nt, Human
uguaugcaccauuguauuaccu

SEQ ID NO: 421962 - RNA, 20 nt, Human
uuaagaaaagcacauccugc

SEQ ID NO: 421963 - RNA, 22 nt, Human
gcugccaguguggcaugaugca

SEQ ID NO: 421964 - RNA, 21 nt, Human
aucccagcacccaggagugca

SEQ ID NO: 421965 - RNA, 22 nt, Human
guuucgucaggcuuauucuauc

SEQ ID NO: 421966 - RNA, 20 nt, Human
ucagccagcuaacaugggga

SEQ ID NO: 421967 - RNA, 22 nt, Human
cugggccuuggauugacacugu

SEQ ID NO: 421968 - RNA, 22 nt, Human
ccuggcuguggcggugcucuca

SEQ ID NO: 421969 - RNA, 22 nt, Human
cagaggacaauagaauggaaag

SEQ ID NO: 421970 - RNA, 22 nt, Human
aguggcagagccaagauaugau

SEQ ID NO: 421971 - RNA, 22 nt, Human
cagcugugcuagaagccacgaa

SEQ ID NO: 421972 - RNA, 22 nt, Human
auuugauuagcuguguaauuuu

SEQ ID NO: 421973 - RNA, 23 nt, Human
agcacagacuagaaaggucuuuc

SEQ ID NO: 421974 - RNA, 22 nt, Human
uaaggcacuucaauguuuagaa

SEQ ID NO: 421975 - RNA, 22 nt, Human
agggcugacaaauggcagugac

SEQ ID NO: 421976 - RNA, 22 nt, Human
cugcuguguaucauuuuagaug

SEQ ID NO: 421977 - RNA, 23 nt, Human
ucucagugaaucucagaauucgc

SEQ ID NO: 421978 - RNA, 22 nt, Human
uggcuuccacugugugcccccu

SEQ ID NO: 421979 - RNA, 22 nt, Human
agaaaugcauuagcacauauag

SEQ ID NO: 421980 - RNA, 20 nt, Human
acuggacacugaggugagcu

SEQ ID NO: 421981 - RNA, 22 nt, Human
cagcuggguuuaguggggugug

SEQ ID NO: 421982 - RNA, 22 nt, Human
auguaacuguuauauuuuguug

SEQ ID NO: 421983 - RNA, 22 nt, Human
acagagcuuaauucaggagcuu

SEQ ID NO: 421984 - RNA, 22 nt, Human
ucuuacaccauucaaauauuuu

SEQ ID NO: 421985 - RNA, 20 nt, Human
acugccuugguucaguaggu

SEQ ID NO: 421986 - RNA, 22 nt, Human
aggcugcuucagcugcagggag

SEQ ID NO: 421987 - RNA, 20 nt, Human
ccuuuauuauuuguaugaug

SEQ ID NO: 421988 - RNA, 22 nt, Human
gaaaugcauaaucuuaguagau

SEQ ID NO: 421989 - RNA, 22 nt, Human
ccugccagggccuuggaagaaa

SEQ ID NO: 421990 - RNA, 22 nt, Human
uugacacagaucaauauucaac

SEQ ID NO: 421991 - RNA, 22 nt, Human
ugcuccauucucuagccagugc

SEQ ID NO: 421992 - RNA, 22 nt, Human
ggaccugcccuggcucagaugc

SEQ ID NO: 421993 - RNA, 23 nt, Human
ccugggcauuggcugcagcuucu

SEQ ID NO: 421994 - RNA, 22 nt, Human
acucaggaaauugagauaaugg

SEQ ID NO: 421995 - RNA, 21 nt, Human
cagcuuugucugucuucgggg

SEQ ID NO: 421996 - RNA, 22 nt, Human
accugccuucucaaggacauga

SEQ ID NO: 421997 - RNA, 22 nt, Human
uugaacaguuuugucagguuca

SEQ ID NO: 421998 - RNA, 22 nt, Human
uugaggagcaggaugggaggcu

SEQ ID NO: 421999 - RNA, 22 nt, Human
cagugggcugugauggauucac

SEQ ID NO: 422000 - RNA, 22 nt, Human
aggagcugagucagcccgacag

SEQ ID NO: 422001 - RNA, 22 nt, Human
aggcucaguucuguggugagcc

SEQ ID NO: 422002 - RNA, 22 nt, Human
augucuuucucacagccaguuc

SEQ ID NO: 422003 - RNA, 21 nt, Human
gcugagagguugggaaguuca

SEQ ID NO: 422004 - RNA, 23 nt, Human
uccuggugacaugccugagcauc

SEQ ID NO: 422005 - RNA, 22 nt, Human
aucaguuuugggggacauacug

SEQ ID NO: 422006 - RNA, 22 nt, Human
ggaaccaguggaaugauaugcu

SEQ ID NO: 422007 - RNA, 22 nt, Human
ucucuggaguauaaccagggau

SEQ ID NO: 422008 - RNA, 22 nt, Human
cuucccacagaauucaaucagu

SEQ ID NO: 422009 - RNA, 22 nt, Human
ucuucacagaugcauauacuuc

SEQ ID NO: 422010 - RNA, 22 nt, Human
aggugcuggaguagaagaaaaa

SEQ ID NO: 422011 - RNA, 22 nt, Human
ugguaucagagccaucuguauu

SEQ ID NO: 422012 - RNA, 22 nt, Human
guaaacaucgacccaacagggg

SEQ ID NO: 422013 - RNA, 22 nt, Human
ggcuccugggaugggacugagc

SEQ ID NO: 422014 - RNA, 22 nt, Human
cuggcagcucuacucagagccu

SEQ ID NO: 422015 - RNA, 22 nt, Human
cuuucucuguguuucacaugcu

SEQ ID NO: 422016 - RNA, 22 nt, Human
ccuggcucuucagagguuccua

SEQ ID NO: 422017 - RNA, 22 nt, Human
caguccugcccaggcugacaga

SEQ ID NO: 422018 - RNA, 22 nt, Human
gauuucaaguaucuugggcgag

SEQ ID NO: 422019 - RNA, 22 nt, Human
gagggucccgagcccugucaga

SEQ ID NO: 422020 - RNA, 22 nt, Human
ccugggaggcuguuuccagccu

SEQ ID NO: 422021 - RNA, 22 nt, Human
ucucaccauggugcuugcuuau

SEQ ID NO: 422022 - RNA, 22 nt, Human
ggacaggguaaguacuagugug

SEQ ID NO: 422023 - RNA, 22 nt, Human
aagcccagcaucccugcaccag

SEQ ID NO: 422024 - RNA, 22 nt, Human
ccaggagcagggcuggcugcac

SEQ ID NO: 422025 - RNA, 22 nt, Human
ugguggcaauguccuggagaag

SEQ ID NO: 422026 - RNA, 22 nt, Human
caguggguggcuaaguggcuga

SEQ ID NO: 422027 - RNA, 22 nt, Human
ccuagagcucugcuuuaucuaa

SEQ ID NO: 422028 - RNA, 22 nt, Human
agugccaggagcaaggagcucc

SEQ ID NO: 422029 - RNA, 23 nt, Human
uggccugcagaguuucugcuggg

SEQ ID NO: 422030 - RNA, 22 nt, Human
uggcucagcuuuccccaucugg

SEQ ID NO: 422031 - RNA, 22 nt, Human
caccagggacaaugcuaggggu

SEQ ID NO: 422032 - RNA, 22 nt, Human
ggcugccugcucaggugcggcg

SEQ ID NO: 422033 - RNA, 22 nt, Human
uagcagcuuccagagagggcag

SEQ ID NO: 422034 - RNA, 22 nt, Human
caaggccauaagagauacaaaa

SEQ ID NO: 422035 - RNA, 21 nt, Human
agaauaaugguaucauuugcu

SEQ ID NO: 422036 - RNA, 22 nt, Human
ugccucugaggaagauuguguu

SEQ ID NO: 422037 - RNA, 22 nt, Human
acagcugugaagcaagcacucu

SEQ ID NO: 422038 - RNA, 22 nt, Human
gagcagcucgagaaggaagcag

SEQ ID NO: 422039 - RNA, 22 nt, Human
cuuccagucuagagcuaucugu

SEQ ID NO: 422040 - RNA, 17 nt, Human
aaggccauuuccaccca

SEQ ID NO: 422041 - RNA, 22 nt, Human
aaggcacugaacuuaaauucug

SEQ ID NO: 422042 - RNA, 22 nt, Human
aagagcuggaguuugcagcccu

SEQ ID NO: 422043 - RNA, 18 nt, Human
ccugagcccugcuuacuu

SEQ ID NO: 422044 - RNA, 22 nt, Human
acccuggggguggccagugcca

SEQ ID NO: 422045 - RNA, 22 nt, Human
cagugcaggcugggggcccugc

SEQ ID NO: 422046 - RNA, 22 nt, Human
guggcugcagagccagcaagcu

SEQ ID NO: 422047 - RNA, 22 nt, Human
ggcuggcacugaggagagcucu

SEQ ID NO: 422048 - RNA, 22 nt, Human
uauccaaagagauucauguucu

SEQ ID NO: 422049 - RNA, 22 nt, Human
ccccuuccacagugcuuccuaa

SEQ ID NO: 422050 - RNA, 22 nt, Human
cugccuggggaaugugaggauu

SEQ ID NO: 422051 - RNA, 20 nt, Human
ucugugugccaucaccuaac

SEQ ID NO: 422052 - RNA, 21 nt, Human
gccagagcaguacaaugaggu

SEQ ID NO: 422053 - RNA, 22 nt, Human
agcacagguacggagaugcuac

SEQ ID NO: 422054 - RNA, 22 nt, Human
cccuuccuccucgccugucaga

SEQ ID NO: 422055 - RNA, 22 nt, Human
ugguaaauauguccauucucuu

SEQ ID NO: 422056 - RNA, 22 nt, Human
guauccuuugcggaaauuucua

SEQ ID NO: 422057 - RNA, 22 nt, Human
gagggcugugaaggagcggguu

SEQ ID NO: 422058 - RNA, 22 nt, Human
guaggaaagggagugaagggaa

SEQ ID NO: 422059 - RNA, 22 nt, Human
gcugccucugcacagcucacuc

SEQ ID NO: 422060 - RNA, 22 nt, Human
aaggcugagggcuguaccuggc

SEQ ID NO: 422061 - RNA, 22 nt, Human
gaggcacaucacuuggugcauu

SEQ ID NO: 422062 - RNA, 22 nt, Human
uaguggagaggauguggagaaa

SEQ ID NO: 422063 - RNA, 22 nt, Human
aauuugauuuucuuaaaccaua

SEQ ID NO: 422064 - RNA, 22 nt, Human
uacaugcaugucacagaaugaa

SEQ ID NO: 422065 - RNA, 18 nt, Human
uucaccagugugaugggu

SEQ ID NO: 422066 - RNA, 22 nt, Human
ccagcuccucuucccaguguca

SEQ ID NO: 422067 - RNA, 22 nt, Human
aaucuggcauguaagcuuagag

SEQ ID NO: 422068 - RNA, 22 nt, Human
ccagcucuuuuggcugagugag

SEQ ID NO: 422069 - RNA, 22 nt, Human
agcagcucuuaacaaagcaugg

SEQ ID NO: 422070 - RNA, 22 nt, Human
aguggacucuucccagugcuug

SEQ ID NO: 422071 - RNA, 22 nt, Human
gggaccugggccagaggacagu

SEQ ID NO: 422072 - RNA, 22 nt, Human
aaguaugacauuuaagacaauu

SEQ ID NO: 422073 - RNA, 22 nt, Human
ugggcagaaaucaguaucagau

SEQ ID NO: 422074 - RNA, 22 nt, Human
uacauauagacaguuacucuag

SEQ ID NO: 422075 - RNA, 22 nt, Human
ugcugccuuugggaccuggccu

SEQ ID NO: 422076 - RNA, 19 nt, Human
gaaggcugaaaugaagcac

SEQ ID NO: 422077 - RNA, 21 nt, Human
aaauguguuccauaaugcuuu

SEQ ID NO: 422078 - RNA, 22 nt, Human
acucugaggcaggucagggcag

SEQ ID NO: 422079 - RNA, 22 nt, Human
agugcaauguguacagaaaaau

SEQ ID NO: 422080 - RNA, 22 nt, Human
caguggaggcucaagugugcuu

SEQ ID NO: 422081 - RNA, 22 nt, Human
uggcugaggagggucuucuggu

SEQ ID NO: 422082 - RNA, 22 nt, Human
acagggcagcaacuuugugccu

SEQ ID NO: 422083 - RNA, 22 nt, Human
acccuguaugcuauaucccuaa

SEQ ID NO: 422084 - RNA, 22 nt, Human
uggggacacagagccaaacuau

SEQ ID NO: 422085 - RNA, 22 nt, Human
agugggcagcccaggaggucuu

SEQ ID NO: 422086 - RNA, 23 nt, Human
aggaaagcauucauuuuuaccau

SEQ ID NO: 422087 - RNA, 22 nt, Human
gccaggcagacaggucaucagg

SEQ ID NO: 422088 - RNA, 22 nt, Human
ggggcagaguagcuggggugug

SEQ ID NO: 422089 - RNA, 22 nt, Human
ucuggcucuaacuaggcaucag

SEQ ID NO: 422090 - RNA, 22 nt, Human
aggcugaggcaagaggaucacu

SEQ ID NO: 422091 - RNA, 22 nt, Human
ucccuagucgcaucuguggaga

SEQ ID NO: 422092 - RNA, 22 nt, Human
aaagccagcucugagcugcacc

SEQ ID NO: 422093 - RNA, 22 nt, Human
ccagcuugaagaugugcugguu

SEQ ID NO: 422094 - RNA, 22 nt, Human
gaaggccacaagagaaguuaag

SEQ ID NO: 422095 - RNA, 22 nt, Human
ucccagcagagccagcaagccg

SEQ ID NO: 422096 - RNA, 22 nt, Human
cacuuaagcaguuaauuuaucu

SEQ ID NO: 422097 - RNA, 22 nt, Human
uaagacaauucuucagucacaa

SEQ ID NO: 422098 - RNA, 22 nt, Human
ugcugcacucaccaacagauaa

SEQ ID NO: 422099 - RNA, 22 nt, Human
auguguaggugaaucgaggcug

SEQ ID NO: 422100 - RNA, 22 nt, Human
cccaaggcauggcaugguggca

SEQ ID NO: 422101 - RNA, 17 nt, Human
cugucugcgcaugaggu

SEQ ID NO: 422102 - RNA, 22 nt, Human
uuuguucaugccuauauucuca

SEQ ID NO: 422103 - RNA, 22 nt, Human
ccucugagaccagcucugcacc

SEQ ID NO: 422104 - RNA, 22 nt, Human
ggcugcuugcuguuucuuggau

SEQ ID NO: 422105 - RNA, 22 nt, Human
uuugggaagaggaaucucugga

SEQ ID NO: 422106 - RNA, 19 nt, Human
gcagccaccgcggcggccg

SEQ ID NO: 422107 - RNA, 21 nt, Human
aucagcaaaugccugucuccc

SEQ ID NO: 422108 - RNA, 22 nt, Human
cugccuuccaaccccagacucc

SEQ ID NO: 422109 - RNA, 22 nt, Human
cggagccugcuuguugcagcug

SEQ ID NO: 422110 - RNA, 22 nt, Human
gacugucauucuagugcccaug

SEQ ID NO: 422111 - RNA, 22 nt, Human
guggccaggccgacugccaggc

SEQ ID NO: 422112 - RNA, 21 nt, Human
uaaggccaagucuauuucugu

SEQ ID NO: 422113 - RNA, 22 nt, Human
acccaggagcaggcugggcagu

SEQ ID NO: 422114 - RNA, 22 nt, Human
gaagagcuuagacagaaucaaa

SEQ ID NO: 422115 - RNA, 22 nt, Human
cccagcucucucaguucugcuu

SEQ ID NO: 422116 - RNA, 22 nt, Human
aaauacaguguguguucuuuga

SEQ ID NO: 422117 - RNA, 22 nt, Human
caggggcucugggugaugugag

SEQ ID NO: 422118 - RNA, 22 nt, Human
caggccucaggggcucaggcug

SEQ ID NO: 422119 - RNA, 20 nt, Human
uccuugaaagugggguauau

SEQ ID NO: 422120 - RNA, 22 nt, Human
uggcaggaaaaagggccagagg

SEQ ID NO: 422121 - RNA, 20 nt, Human
guauuaggagguaaauguaa

SEQ ID NO: 422122 - RNA, 22 nt, Human
ugugaaggcagcagcucugucc

SEQ ID NO: 422123 - RNA, 22 nt, Human
aucacaggugguaggaaaagaa

SEQ ID NO: 422124 - RNA, 22 nt, Human
gagccuggauugaagugggugg

SEQ ID NO: 422125 - RNA, 20 nt, Human
aaaagcagccagagauggua

SEQ ID NO: 422126 - RNA, 22 nt, Human
uggcagaggaggcucagauuga

SEQ ID NO: 422127 - RNA, 22 nt, Human
uacauaaugagcuaguuaaguu

SEQ ID NO: 422128 - RNA, 22 nt, Human
ugcucuguauucuauggcaguu

SEQ ID NO: 422129 - RNA, 22 nt, Human
accccagaggcggaggcugcag

SEQ ID NO: 422130 - RNA, 17 nt, Human
accaggcaacacgccca

SEQ ID NO: 422131 - RNA, 19 nt, Human
augauggucccauucaccu

SEQ ID NO: 422132 - RNA, 22 nt, Human
agagccaggaucuguuuugggg

SEQ ID NO: 422133 - RNA, 22 nt, Human
agcagggcaguuaaaggguccu

SEQ ID NO: 422134 - RNA, 22 nt, Human
gggacuucauagcuaggcacuu

SEQ ID NO: 422135 - RNA, 22 nt, Human
cuugggagacacaagaagacau

SEQ ID NO: 422136 - RNA, 22 nt, Human
gcagcuuuaaacauuggaaaua

SEQ ID NO: 422137 - RNA, 22 nt, Human
gucucagagagcuacucucuua

SEQ ID NO: 422138 - RNA, 22 nt, Human
agacccugucaguguuaggaaa

SEQ ID NO: 422139 - RNA, 22 nt, Human
ccagcuuuuagugggcuuauua

SEQ ID NO: 422140 - RNA, 22 nt, Human
gcagacagacugcagugauuuu

SEQ ID NO: 422141 - RNA, 22 nt, Human
uggcagagguauauugggagga

SEQ ID NO: 422142 - RNA, 22 nt, Human
caggggcaggugugagaucauc

SEQ ID NO: 422143 - RNA, 17 nt, Human
ggugaguguccaggugg

SEQ ID NO: 422144 - RNA, 22 nt, Human
uaaaguuuggcagacaauaaca

SEQ ID NO: 422145 - RNA, 22 nt, Human
aacaugaaacccaaacagaaua

SEQ ID NO: 422146 - RNA, 22 nt, Human
ugggcaggggcccugcuuccgu

SEQ ID NO: 422147 - RNA, 22 nt, Human
auuuaguguguauugcuauuau

SEQ ID NO: 422148 - RNA, 22 nt, Human
cugggcagcuguaucagggagu

SEQ ID NO: 422149 - RNA, 22 nt, Human
uaguggaggccuguugugugca

SEQ ID NO: 422150 - RNA, 22 nt, Human
agccaccaccacugaaagguua

SEQ ID NO: 422151 - RNA, 22 nt, Human
ugcuuuauuggaaccucauccu

SEQ ID NO: 422152 - RNA, 19 nt, Human
agugcagggagcacccuca

SEQ ID NO: 422153 - RNA, 22 nt, Human
caggcaccccaggugagcacug

SEQ ID NO: 422154 - RNA, 22 nt, Human
uggcagggccugaaucuuauac

SEQ ID NO: 422155 - RNA, 22 nt, Human
cuucauuaaugucuauaaguuu

SEQ ID NO: 422156 - RNA, 22 nt, Human
uucuaucauacuugaauacauu

SEQ ID NO: 422157 - RNA, 22 nt, Human
ugggcagggucucuguuaucag

SEQ ID NO: 422158 - RNA, 22 nt, Human
gagcacagaaucuucccaugca

SEQ ID NO: 422159 - RNA, 22 nt, Human
gugcuuucugcugcauuccucu

SEQ ID NO: 422160 - RNA, 22 nt, Human
gcuucauuacugacagucugug

SEQ ID NO: 422161 - RNA, 22 nt, Human
ccagggugggaggcugaaggcg

SEQ ID NO: 422162 - RNA, 22 nt, Human
uccauuuucuaaguaucacuua

SEQ ID NO: 422163 - RNA, 22 nt, Human
agagccugugggagaugcagcu

SEQ ID NO: 422164 - RNA, 22 nt, Human
cagaggccucacuuccagccag

SEQ ID NO: 422165 - RNA, 19 nt, Human
cccuggcaggcaagccugg

SEQ ID NO: 422166 - RNA, 22 nt, Human
gaaggccacuuuguguugagaa

SEQ ID NO: 422167 - RNA, 22 nt, Human
cugacucagcagcugaugaucc

SEQ ID NO: 422168 - RNA, 22 nt, Human
aucagcaagauugugucuugua

SEQ ID NO: 422169 - RNA, 22 nt, Human
cugcaggauucucccaguugga

SEQ ID NO: 422170 - RNA, 22 nt, Human
uugcuuccaguccaagucuguu

SEQ ID NO: 422171 - RNA, 22 nt, Human
ugacaggcagugcugggcaugu

SEQ ID NO: 422172 - RNA, 22 nt, Human
uggcagagcccagacuccaguc

SEQ ID NO: 422173 - RNA, 22 nt, Human
gcccucugcuggccucaccucg

SEQ ID NO: 422174 - RNA, 22 nt, Human
ccagcuggcacuguggcugccc

SEQ ID NO: 422175 - RNA, 22 nt, Human
guggagccaggaucuccgcaca

SEQ ID NO: 422176 - RNA, 22 nt, Human
aggguccugggugcaguugcuu

SEQ ID NO: 422177 - RNA, 22 nt, Human
ucugucugcaccuaagcacagu

SEQ ID NO: 422178 - RNA, 22 nt, Human
cauuuagagucuugcaauuuua

SEQ ID NO: 422179 - RNA, 22 nt, Human
uuuaaaaaacuagucugagucu

SEQ ID NO: 422180 - RNA, 22 nt, Human
caugagaaguggccuucaaaaa

SEQ ID NO: 422181 - RNA, 21 nt, Human
uggcagagugcagucuauaca

SEQ ID NO: 422182 - RNA, 17 nt, Human
ggccuguguggcugcag

SEQ ID NO: 422183 - RNA, 22 nt, Human
acagagagggagugauaaaucc

SEQ ID NO: 422184 - RNA, 18 nt, Human
ggcucaggcuauccuaac

SEQ ID NO: 422185 - RNA, 22 nt, Human
uccuuuccagccucaccucagc

SEQ ID NO: 422186 - RNA, 22 nt, Human
ggcaaaaaccgcaauaacuucu

SEQ ID NO: 422187 - RNA, 22 nt, Human
ucccaaagcuacucuucugacu

SEQ ID NO: 422188 - RNA, 16 nt, Human
gagggcagaggcggaa

SEQ ID NO: 422189 - RNA, 21 nt, Human
uccugcaggaggccugagagg

SEQ ID NO: 422190 - RNA, 22 nt, Human
ccaccagcuuugccacccugcu

SEQ ID NO: 422191 - RNA, 22 nt, Human
gacaaaacacauuaguuuaaaa

SEQ ID NO: 422192 - RNA, 22 nt, Human
cacugaguucccugacauuuca

SEQ ID NO: 422193 - RNA, 17 nt, Human
uucucuuccuggauagu

SEQ ID NO: 422194 - RNA, 22 nt, Human
gagggccagcagccucagcaug

SEQ ID NO: 422195 - RNA, 22 nt, Human
ggcagaggugacagugucuuuu

SEQ ID NO: 422196 - RNA, 22 nt, Human
uguguugugacauucuuggaug

SEQ ID NO: 422197 - RNA, 22 nt, Human
cuguagcagugugcucuuuuuc

SEQ ID NO: 422198 - RNA, 22 nt, Human
cugaggcugggcauggggucca

SEQ ID NO: 422199 - RNA, 22 nt, Human
ucucaagaucucaagauggccc

SEQ ID NO: 422200 - RNA, 22 nt, Human
uguugagacugagggagucagc

SEQ ID NO: 422201 - RNA, 22 nt, Human
ugggcagauguggcucuccuug

SEQ ID NO: 422202 - RNA, 22 nt, Human
uuugugcagauguauauuugug

SEQ ID NO: 422203 - RNA, 22 nt, Human
uuaaaaccaucagcuguaagau

SEQ ID NO: 422204 - RNA, 20 nt, Human
uggcaggaggcagcagugga

SEQ ID NO: 422205 - RNA, 22 nt, Human
uggaauggaaacaaacugagga

SEQ ID NO: 422206 - RNA, 22 nt, Human
gcuuuauguaaguccaaaggca

SEQ ID NO: 422207 - RNA, 22 nt, Human
ccagucuggcaggagggggaac

SEQ ID NO: 422208 - RNA, 22 nt, Human
ggagccuuccagacugcccaca

SEQ ID NO: 422209 - RNA, 22 nt, Human
ucacaggacccugaggguggcg

SEQ ID NO: 422210 - RNA, 22 nt, Human
uugucugugaaauggaaauagu

SEQ ID NO: 422211 - RNA, 20 nt, Human
ucugcccaccccggcuccca

SEQ ID NO: 422212 - RNA, 22 nt, Human
gaaggagcuaaagggagcccug

SEQ ID NO: 422213 - RNA, 22 nt, Human
agcagggcagguaaggaucaga

SEQ ID NO: 422214 - RNA, 22 nt, Human
augauggugggagaugacccag

SEQ ID NO: 422215 - RNA, 22 nt, Human
ucucagagaagugaugagcaau

SEQ ID NO: 422216 - RNA, 22 nt, Human
ucagggcauucaagaggccugg

SEQ ID NO: 422217 - RNA, 22 nt, Human
gcaggagcugcucuccugacga

SEQ ID NO: 422218 - RNA, 22 nt, Human
uuaagaauggaaugaggaauuu

SEQ ID NO: 422219 - RNA, 20 nt, Human
cccagccccuaccuguugcc

SEQ ID NO: 422220 - RNA, 17 nt, Human
gcaagggaugggagauu

SEQ ID NO: 422221 - RNA, 22 nt, Human
gcaguggcuaggagucuggcgu

SEQ ID NO: 422222 - RNA, 23 nt, Human
ugcugggcagagcuggugcugag

SEQ ID NO: 422223 - RNA, 22 nt, Human
aacagaauugcugcugccaaug

SEQ ID NO: 422224 - RNA, 22 nt, Human
agcaccugcuuaaugugcagug

SEQ ID NO: 422225 - RNA, 22 nt, Human
ucagcaguuuuauaugcagcuu

SEQ ID NO: 422226 - RNA, 22 nt, Human
uuuuccucugagcuuugaauaa

SEQ ID NO: 422227 - RNA, 20 nt, Human
gucaggauuaguaaacucug

SEQ ID NO: 422228 - RNA, 22 nt, Human
augggugugaaaauggucaucu

SEQ ID NO: 422229 - RNA, 22 nt, Human
guccuggguccccgcaggucag

SEQ ID NO: 422230 - RNA, 22 nt, Human
gaagcagcuagcccacuaguca

SEQ ID NO: 422231 - RNA, 22 nt, Human
uugauagguuuuauguauaguu

SEQ ID NO: 422232 - RNA, 22 nt, Human
cagugagggcccccuuccaggu

SEQ ID NO: 422233 - RNA, 22 nt, Human
cucugaacucuugggcagcaug

SEQ ID NO: 422234 - RNA, 22 nt, Human
uugcauuguugcaaugaaguau

SEQ ID NO: 422235 - RNA, 22 nt, Human
ucuaguucuagaucccugagga

SEQ ID NO: 422236 - RNA, 22 nt, Human
aucagagaccggucaagucaug

SEQ ID NO: 422237 - RNA, 22 nt, Human
ugggccugccccaggcuucagc

SEQ ID NO: 422238 - RNA, 22 nt, Human
uucaaagugcauguuccucaga

SEQ ID NO: 422239 - RNA, 22 nt, Human
aucccuggacggcgccucccca

SEQ ID NO: 422240 - RNA, 18 nt, Human
cugaaggauccaggugua

SEQ ID NO: 422241 - RNA, 22 nt, Human
ggcaaaaaccacaauuacuuuu

SEQ ID NO: 422242 - RNA, 22 nt, Human
gagagggccagggugagaacua

SEQ ID NO: 422243 - RNA, 22 nt, Human
aggaaggguucuuugugaaaga

SEQ ID NO: 422244 - RNA, 23 nt, Human
ucugcucugaaguucggcugagc

SEQ ID NO: 422245 - RNA, 18 nt, Human
cccagcuggugggucagu

SEQ ID NO: 422246 - RNA, 22 nt, Human
ugaggcuugucucagauggggg

SEQ ID NO: 422247 - RNA, 22 nt, Human
cccagggcccuggacagcuaca

SEQ ID NO: 422248 - RNA, 22 nt, Human
gcagcuuuaaucugaauaagua

SEQ ID NO: 422249 - RNA, 22 nt, Human
cugggcagagcuaacaccugag

SEQ ID NO: 422250 - RNA, 22 nt, Human
agauacaucuugaacuucuaga

SEQ ID NO: 422251 - RNA, 19 nt, Human
cacagggcaggucucaugu

SEQ ID NO: 422252 - RNA, 22 nt, Human
gggauggacuuggggacuccag

SEQ ID NO: 422253 - RNA, 22 nt, Human
augcaagauguauagaagacuu

SEQ ID NO: 422254 - RNA, 22 nt, Human
uagaaaagaauuuuauuugaua

SEQ ID NO: 422255 - RNA, 22 nt, Human
ccugcaguuuguugugaccccg

SEQ ID NO: 422256 - RNA, 22 nt, Human
ugagacaguucugcagcugggu

SEQ ID NO: 422257 - RNA, 22 nt, Human
aaugaaugaaccacauauaaca

SEQ ID NO: 422258 - RNA, 22 nt, Human
cagcaucuaaucuucaugccgg

SEQ ID NO: 422259 - RNA, 22 nt, Human
acagaacuuccugcuggagugg

SEQ ID NO: 422260 - RNA, 22 nt, Human
aggaccuggaucacagagaucu

SEQ ID NO: 422261 - RNA, 22 nt, Human
gagcuuaggccagggacaggga

SEQ ID NO: 422262 - RNA, 22 nt, Human
uccuugaacagagggccugggu

SEQ ID NO: 422263 - RNA, 22 nt, Human
ucagggcauggcugcacuuggc

SEQ ID NO: 422264 - RNA, 18 nt, Human
agaaggagcuaugggcag

SEQ ID NO: 422265 - RNA, 22 nt, Human
agggcugccugacuccagagcc

SEQ ID NO: 422266 - RNA, 22 nt, Human
gccagccuucuguggccugcaa

SEQ ID NO: 422267 - RNA, 17 nt, Human
agccaggcauaugaagu

SEQ ID NO: 422268 - RNA, 22 nt, Human
gcaggaagccuuaccaagccca

SEQ ID NO: 422269 - RNA, 22 nt, Human
auuauaaagaacaugugugugg

SEQ ID NO: 422270 - RNA, 22 nt, Human
uguuccauaaguggugcuuugu

SEQ ID NO: 422271 - RNA, 22 nt, Human
gaaggaagucauuagugcagac

SEQ ID NO: 422272 - RNA, 22 nt, Human
ccucagaugucuuaaggcacug

SEQ ID NO: 422273 - RNA, 22 nt, Human
cagaggcugaugugggaugggc

SEQ ID NO: 422274 - RNA, 22 nt, Human
gaacauuuccagaaaggaacua

SEQ ID NO: 422275 - RNA, 22 nt, Human
guccucugggcuuugagcaguc

SEQ ID NO: 422276 - RNA, 22 nt, Human
ccuggaaggcaggcauggauug

SEQ ID NO: 422277 - RNA, 19 nt, Human
ucucccagcugagaagggc

SEQ ID NO: 422278 - RNA, 22 nt, Human
ucuuaaaaguaugccaauugga

SEQ ID NO: 422279 - RNA, 22 nt, Human
ggcaggcuggcuuuguuccagg

SEQ ID NO: 422280 - RNA, 22 nt, Human
aaaugucuuucaauagagaaau

SEQ ID NO: 422281 - RNA, 22 nt, Human
ugggcagaguagcucagaagaa

SEQ ID NO: 422282 - RNA, 22 nt, Human
guacauuucauuuaaaugaugu

SEQ ID NO: 422283 - RNA, 22 nt, Human
cauugcacgggcgucugucugu

SEQ ID NO: 422284 - RNA, 22 nt, Human
ggcuggcauccagggaaaucca

SEQ ID NO: 422285 - RNA, 22 nt, Human
acagauuuguucuuuugggcua

SEQ ID NO: 422286 - RNA, 22 nt, Human
cucucugaggaaggagcaucug

SEQ ID NO: 422287 - RNA, 22 nt, Human
ucacauucucagcaucuauaca

SEQ ID NO: 422288 - RNA, 22 nt, Human
gcccagcugucuggcagggaug

SEQ ID NO: 422289 - RNA, 22 nt, Human
ugcuaaauaaguggaauagaca

SEQ ID NO: 422290 - RNA, 22 nt, Human
cuggaaugagcagggcuuaugg

SEQ ID NO: 422291 - RNA, 22 nt, Human
acagcuuuuuacuaauagauug

SEQ ID NO: 422292 - RNA, 22 nt, Human
uugcaccauuucacuuccauua

SEQ ID NO: 422293 - RNA, 22 nt, Human
ccaaaguccacaguuuacauua

SEQ ID NO: 422294 - RNA, 22 nt, Human
cccacaggcuagggguagggca

SEQ ID NO: 422295 - RNA, 22 nt, Human
cucgcaggacagugcuaggacu

SEQ ID NO: 422296 - RNA, 21 nt, Human
ugagccaggcugacggcugug

SEQ ID NO: 422297 - RNA, 22 nt, Human
uauuuuguuaauaauccagucc

SEQ ID NO: 422298 - RNA, 22 nt, Human
agaguucugcucuucucaguga

SEQ ID NO: 422299 - RNA, 22 nt, Human
cgcuggggcuuuuugcuugaga

SEQ ID NO: 422300 - RNA, 17 nt, Human
ugagacagggcaggccc

SEQ ID NO: 422301 - RNA, 22 nt, Human
caagauggacauaaggagagaa

SEQ ID NO: 422302 - RNA, 21 nt, Human
gggccuggcugcgcaggacgg

SEQ ID NO: 422303 - RNA, 22 nt, Human
uaucuugagagacaacacagca

SEQ ID NO: 422304 - RNA, 20 nt, Human
ucucugcuguccacauuugc

SEQ ID NO: 422305 - RNA, 22 nt, Human
cauucugugauucuaaaucccu

SEQ ID NO: 422306 - RNA, 22 nt, Human
uaugaagaaguucugugaaaug

SEQ ID NO: 422307 - RNA, 22 nt, Human
ugaaaaaacaaguuggcccauu

SEQ ID NO: 422308 - RNA, 22 nt, Human
gcugagguaggagguugcagug

SEQ ID NO: 422309 - RNA, 22 nt, Human
ugaaacaaauuuggaaaaucua

SEQ ID NO: 422310 - RNA, 22 nt, Human
gcagagcucaagguguucagcu

SEQ ID NO: 422311 - RNA, 22 nt, Human
uucacauugugcagauuauggu

SEQ ID NO: 422312 - RNA, 22 nt, Human
cagggacauugguggccagguu

SEQ ID NO: 422313 - RNA, 22 nt, Human
agggaauguagcaagaugccaa

SEQ ID NO: 422314 - RNA, 22 nt, Human
ccagggcucaggcucccagugg

SEQ ID NO: 422315 - RNA, 22 nt, Human
uuacucagucucccauacauug

SEQ ID NO: 422316 - RNA, 22 nt, Human
gcagcuuugaagacuuauuugc

SEQ ID NO: 422317 - RNA, 18 nt, Human
ucucugaauauuuuaugu

SEQ ID NO: 422318 - RNA, 22 nt, Human
cagagccugccucuggcugugg

SEQ ID NO: 422319 - RNA, 22 nt, Human
gccuggagggcucuagagaggc

SEQ ID NO: 422320 - RNA, 22 nt, Human
auuuuccagccuuucuagaacu

SEQ ID NO: 422321 - RNA, 22 nt, Human
aggcugagaaagugggaagaug

SEQ ID NO: 422322 - RNA, 22 nt, Human
gcugugcuggaaggggaccugc

SEQ ID NO: 422323 - RNA, 22 nt, Human
ucaaaugcacguagagaaaaua

SEQ ID NO: 422324 - RNA, 22 nt, Human
gaagccucaacaucucugcguc

SEQ ID NO: 422325 - RNA, 21 nt, Human
acagaugggaugagcacacug

SEQ ID NO: 422326 - RNA, 22 nt, Human
cuguagcaaguuauucaauaaa

SEQ ID NO: 422327 - RNA, 22 nt, Human
ccuguguggaaaccgcaugacg

SEQ ID NO: 422328 - RNA, 22 nt, Human
aaagguuaguucuuagaagugc

SEQ ID NO: 422329 - RNA, 22 nt, Human
accuuucacgguaucagacauc

SEQ ID NO: 422330 - RNA, 22 nt, Human
agcugccauccuguucagcacc

SEQ ID NO: 422331 - RNA, 22 nt, Human
aggggaggagcuuuucuugccu

SEQ ID NO: 422332 - RNA, 22 nt, Human
agaaauguacgauguuaugcag

SEQ ID NO: 422333 - RNA, 22 nt, Human
auaaggcagucccuuaacaagg

SEQ ID NO: 422334 - RNA, 22 nt, Human
cuggguggcagagccugcagug

SEQ ID NO: 422335 - RNA, 22 nt, Human
uccucaggcggugaggaggggc

SEQ ID NO: 422336 - RNA, 22 nt, Human
cacaugcaucugucauguuugg

SEQ ID NO: 422337 - RNA, 22 nt, Human
augaaggcuguguagauggaug

SEQ ID NO: 422338 - RNA, 22 nt, Human
uucauauauaugcacuacguac

SEQ ID NO: 422339 - RNA, 21 nt, Human
agagucugcauuucugacaag

SEQ ID NO: 422340 - RNA, 22 nt, Human
gaacagcccuguuaagucuguu

SEQ ID NO: 422341 - RNA, 22 nt, Human
uuuccaaaggaggaaccaguuu

SEQ ID NO: 422342 - RNA, 22 nt, Human
uuccuccacgugacaggagcca

SEQ ID NO: 422343 - RNA, 22 nt, Human
gccaggcugacucccccggccu

SEQ ID NO: 422344 - RNA, 23 nt, Human
cccuggccuuggggcacaggcug

SEQ ID NO: 422345 - RNA, 22 nt, Human
ucucucagucagaugcuaaaga

SEQ ID NO: 422346 - RNA, 22 nt, Human
uucauucauuacgugccaggca

SEQ ID NO: 422347 - RNA, 22 nt, Human
uacaguaaccagucuacuuaga

SEQ ID NO: 422348 - RNA, 22 nt, Human
aagucauugguagcuugauagg

SEQ ID NO: 422349 - RNA, 22 nt, Human
ugggaggaucgcuugagcccag

SEQ ID NO: 422350 - RNA, 22 nt, Human
cuggagccacugggucuuguau

SEQ ID NO: 422351 - RNA, 22 nt, Human
auagucuuagaucagauaaagu

SEQ ID NO: 422352 - RNA, 23 nt, Human
aggcagugggggccacuuugcuu

SEQ ID NO: 422353 - RNA, 22 nt, Human
aggcagaggagaaugaucuucc

SEQ ID NO: 422354 - RNA, 21 nt, Human
uuugagaauuggucagagugc

SEQ ID NO: 422355 - RNA, 19 nt, Human
guggccugcgcugggugcg

SEQ ID NO: 422356 - RNA, 22 nt, Human
guuuauuaacugucaagugauu

SEQ ID NO: 422357 - RNA, 22 nt, Human
gggcucucgauuagacccuggg

SEQ ID NO: 422358 - RNA, 22 nt, Human
gggaaauugucaacacucucaa

SEQ ID NO: 422359 - RNA, 17 nt, Human
uuucuccuuccaucuca

SEQ ID NO: 422360 - RNA, 22 nt, Human
guacuuccagccaagugagaca

SEQ ID NO: 422361 - RNA, 22 nt, Human
auguagcaugaggcacugugcc

SEQ ID NO: 422362 - RNA, 22 nt, Human
cugagagccuccuguuggcuag

SEQ ID NO: 422363 - RNA, 22 nt, Human
aaguuucaaauauaaaauuaca

SEQ ID NO: 422364 - RNA, 22 nt, Human
agggagcugcucugcuuccgug

SEQ ID NO: 422365 - RNA, 18 nt, Human
ccgggcuuuggugacaca

SEQ ID NO: 422366 - RNA, 21 nt, Human
uccacaaguuagaaggaaauu

SEQ ID NO: 422367 - RNA, 22 nt, Human
guaagggauuugaacauagguu

SEQ ID NO: 422368 - RNA, 21 nt, Human
aguucauacugaguaacaaaa

SEQ ID NO: 422369 - RNA, 22 nt, Human
gcucucugaggugcuggcagag

SEQ ID NO: 422370 - RNA, 22 nt, Human
accugcagcuaaagauguaggg

SEQ ID NO: 422371 - RNA, 22 nt, Human
ggccuugggauguggcugcagc

SEQ ID NO: 422372 - RNA, 23 nt, Human
aaccagauaaauggcuccagggc

SEQ ID NO: 422373 - RNA, 22 nt, Human
ccaaguacucucaccaaagcuu

SEQ ID NO: 422374 - RNA, 22 nt, Human
aguugcagacgcagagauguug

SEQ ID NO: 422375 - RNA, 22 nt, Human
auguacaguuucuagacucaaa

SEQ ID NO: 422376 - RNA, 20 nt, Human
aagagaagaagucuuugaaa

SEQ ID NO: 422377 - RNA, 22 nt, Human
ucauuucuauugcuacugucug

SEQ ID NO: 422378 - RNA, 22 nt, Human
augccaggccccacgcugggca

SEQ ID NO: 422379 - RNA, 22 nt, Human
cugagccaaggggacagugaca

SEQ ID NO: 422380 - RNA, 17 nt, Human
uugggagagaaagguau

SEQ ID NO: 422381 - RNA, 22 nt, Human
acugcaucugaaacauggguca

SEQ ID NO: 422382 - RNA, 22 nt, Human
cugggagcggcugucacugguu

SEQ ID NO: 422383 - RNA, 22 nt, Human
uuuguaaaaggaggaagcaugg

SEQ ID NO: 422384 - RNA, 22 nt, Human
ugaggcagugauguuuaagcac

SEQ ID NO: 422385 - RNA, 22 nt, Human
guuuggggucugcagagcggcg

SEQ ID NO: 422386 - RNA, 22 nt, Human
aaagccuugagauccuauaguu

SEQ ID NO: 422387 - RNA, 22 nt, Human
agguauagaauugaaaggguuu

SEQ ID NO: 422388 - RNA, 22 nt, Human
ggcacugacugugcagcgcacc

SEQ ID NO: 422389 - RNA, 22 nt, Human
uuuccucuuugugacacagcug

SEQ ID NO: 422390 - RNA, 22 nt, Human
ugccagcaguagcaguaggcca

SEQ ID NO: 422391 - RNA, 22 nt, Human
ggagucaccaaguaggagucuu

SEQ ID NO: 422392 - RNA, 22 nt, Human
gcaguggcuaagcucgcaugca

SEQ ID NO: 422393 - RNA, 22 nt, Human
ugaaggcuguuggauggggaag

SEQ ID NO: 422394 - RNA, 22 nt, Human
agcaggugcauggcgagcgcgg

SEQ ID NO: 422395 - RNA, 22 nt, Human
ucaugcaaggcugaaacauggu

SEQ ID NO: 422396 - RNA, 22 nt, Human
ggcugggcuccgggagcaugcg

SEQ ID NO: 422397 - RNA, 23 nt, Human
ucccagccucuucucuugcauac

SEQ ID NO: 422398 - RNA, 22 nt, Human
cugaggcuggggaagggaagug

SEQ ID NO: 422399 - RNA, 22 nt, Human
ugugcauguauugauuuguacc

SEQ ID NO: 422400 - RNA, 22 nt, Human
aggcacuggguaauuaguagcu

SEQ ID NO: 422401 - RNA, 22 nt, Human
ucauugcagugauguuguaugu

SEQ ID NO: 422402 - RNA, 22 nt, Human
ucauccuuuugcaugggaaggc

SEQ ID NO: 422403 - RNA, 22 nt, Human
cucccucugucuuguccagaaa

SEQ ID NO: 422404 - RNA, 22 nt, Human
uccagcucaggguuggcucaag

SEQ ID NO: 422405 - RNA, 22 nt, Human
uggguggaauaaaucaguucug

SEQ ID NO: 422406 - RNA, 22 nt, Human
ucccugcacagccgagccaugc

SEQ ID NO: 422407 - RNA, 21 nt, Human
ggccugaguauaggacaggcc

SEQ ID NO: 422408 - RNA, 22 nt, Human
cagaggaggccaccgcauaggc

SEQ ID NO: 422409 - RNA, 22 nt, Human
ugaggccugaagccugaaguga

SEQ ID NO: 422410 - RNA, 22 nt, Human
ucagagagugcaaaauauagcu

SEQ ID NO: 422411 - RNA, 22 nt, Human
uuauugccugauugaggucauu

SEQ ID NO: 422412 - RNA, 22 nt, Human
gagggcugaagauuguggcccc

SEQ ID NO: 422413 - RNA, 22 nt, Human
uguccugcaacugaaggagaag

SEQ ID NO: 422414 - RNA, 22 nt, Human
agccuucaaccuagcuagagca

SEQ ID NO: 422415 - RNA, 22 nt, Human
gaaaaagugaccuugguagcua

SEQ ID NO: 422416 - RNA, 22 nt, Human
guggagcccugccuugcucaug

SEQ ID NO: 422417 - RNA, 22 nt, Human
agagccuggggauuggcaaggg

SEQ ID NO: 422418 - RNA, 22 nt, Human
uggacagcgaaagugccuggga

SEQ ID NO: 422419 - RNA, 22 nt, Human
ucuaccacuaagugugcuuuga

SEQ ID NO: 422420 - RNA, 22 nt, Human
ugaggcaggacauggacaacug

SEQ ID NO: 422421 - RNA, 18 nt, Human
ccuggaccugucuccuuu

SEQ ID NO: 422422 - RNA, 22 nt, Human
ugagcugggaguggugaugagg

SEQ ID NO: 422423 - RNA, 22 nt, Human
ugcuguuauacuuagcugguua

SEQ ID NO: 422424 - RNA, 22 nt, Human
cagagcuggcggugagaagaca

SEQ ID NO: 422425 - RNA, 23 nt, Human
ucugggcaccuuguugacaugau

SEQ ID NO: 422426 - RNA, 22 nt, Human
agaacagaggccuuauguuuca

SEQ ID NO: 422427 - RNA, 22 nt, Human
uauugaguuacagaaaauacuu

SEQ ID NO: 422428 - RNA, 19 nt, Human
acuuugcaugugugucuaa

SEQ ID NO: 422429 - RNA, 22 nt, Human
ucagggacuuacaaaccagaag

SEQ ID NO: 422430 - RNA, 22 nt, Human
aaguucaaucagaugaaaaagc

SEQ ID NO: 422431 - RNA, 22 nt, Human
uccugagauguggagcuccaug

SEQ ID NO: 422432 - RNA, 22 nt, Human
ccagacuguggaguuccuggug

SEQ ID NO: 422433 - RNA, 18 nt, Human
gugagcagagagcaucac

SEQ ID NO: 422434 - RNA, 21 nt, Human
cuguuucuugugaagugacac

SEQ ID NO: 422435 - RNA, 22 nt, Human
cugagcuggucuauggacuugg

SEQ ID NO: 422436 - RNA, 17 nt, Human
aggaagggcaaguuucu

SEQ ID NO: 422437 - RNA, 22 nt, Human
agccaggccagcugucuugagu

SEQ ID NO: 422438 - RNA, 22 nt, Human
aucuagaaaguguugaagauca

SEQ ID NO: 422439 - RNA, 22 nt, Human
uugcuauuuugagagucauagu

SEQ ID NO: 422440 - RNA, 22 nt, Human
uaaaugugucuuuuuaaggccu

SEQ ID NO: 422441 - RNA, 22 nt, Human
gaggaggcacuugagcagaugu

SEQ ID NO: 422442 - RNA, 22 nt, Human
ucuggcucugacacuacuguua

SEQ ID NO: 422443 - RNA, 22 nt, Human
ucauuuaauagcuuuugucuuu

SEQ ID NO: 422444 - RNA, 22 nt, Human
ggagaugcuauguaguuugguu

SEQ ID NO: 422445 - RNA, 22 nt, Human
ccugggagugucagacuugcuu

SEQ ID NO: 422446 - RNA, 22 nt, Human
aaguggagcuauaggcucagau

SEQ ID NO: 422447 - RNA, 22 nt, Human
gugcugaguagaaugaaugccu

SEQ ID NO: 422448 - RNA, 22 nt, Human
cagcaucuuucucuucuggagu

SEQ ID NO: 422449 - RNA, 22 nt, Human
cagcucugggugacaggagggc

SEQ ID NO: 422450 - RNA, 22 nt, Human
caauguguuugcauauuaaaau

SEQ ID NO: 422451 - RNA, 22 nt, Human
gcagccugaggcccuuucuggc

SEQ ID NO: 422452 - RNA, 22 nt, Human
accuggccauccagcuggcauc

SEQ ID NO: 422453 - RNA, 22 nt, Human
gaggcagcaggcugaggaggau

SEQ ID NO: 422454 - RNA, 21 nt, Human
gauuucacuuaccuucauuua

SEQ ID NO: 422455 - RNA, 20 nt, Human
agcuggccuguccuaggccu

SEQ ID NO: 422456 - RNA, 22 nt, Human
auaucuuuguuuuugccaagau

SEQ ID NO: 422457 - RNA, 22 nt, Human
agauuucccaaauacuuguuau

SEQ ID NO: 422458 - RNA, 23 nt, Human
uggcucugugucacauacaggau

SEQ ID NO: 422459 - RNA, 18 nt, Human
ggcugccuguuccugaag

SEQ ID NO: 422460 - RNA, 22 nt, Human
gcuggggcugggcugaggaaga

SEQ ID NO: 422461 - RNA, 22 nt, Human
cucagaguggggcucccugagg

SEQ ID NO: 422462 - RNA, 22 nt, Human
auuuuucucuuuccacugagau

SEQ ID NO: 422463 - RNA, 22 nt, Human
ucuggcucacuucaggcuucac

SEQ ID NO: 422464 - RNA, 22 nt, Human
ccuuucucauuuuaagcauuag

SEQ ID NO: 422465 - RNA, 22 nt, Human
aagagcuggauugugcugcaga

SEQ ID NO: 422466 - RNA, 22 nt, Human
uuucuggcagcgggacaggggu

SEQ ID NO: 422467 - RNA, 22 nt, Human
acacagggcugcgccugacccc

SEQ ID NO: 422468 - RNA, 20 nt, Human
gauuacaaaaugaaaugcau

SEQ ID NO: 422469 - RNA, 22 nt, Human
ccaaggagcaaguuuacaccug

SEQ ID NO: 422470 - RNA, 22 nt, Human
cccuguccuuggcugugaggcu

SEQ ID NO: 422471 - RNA, 22 nt, Human
cuuaaauucuuaaugcccucau

SEQ ID NO: 422472 - RNA, 22 nt, Human
gggaggucagggugccugcugg

SEQ ID NO: 422473 - RNA, 22 nt, Human
ggccagagagcagccaggauuc

SEQ ID NO: 422474 - RNA, 22 nt, Human
ugucagagcaaugagguucagc

SEQ ID NO: 422475 - RNA, 20 nt, Human
cagaggcauuuucagacucu

SEQ ID NO: 422476 - RNA, 22 nt, Human
cugccgaguacagccauagaaa

SEQ ID NO: 422477 - RNA, 22 nt, Human
ucagccucucugaguccagacc

SEQ ID NO: 422478 - RNA, 22 nt, Human
augugaggcagcacggagauua

SEQ ID NO: 422479 - RNA, 22 nt, Human
ggccucugccccagccacaccu

SEQ ID NO: 422480 - RNA, 22 nt, Human
gcugucaggaacaugccuuggu

SEQ ID NO: 422481 - RNA, 22 nt, Human
ucccagaguuuccuguguccca

SEQ ID NO: 422482 - RNA, 22 nt, Human
uucauguauuuaucauguaaau

SEQ ID NO: 422483 - RNA, 22 nt, Human
caaggagaaaacggcuucugaa

SEQ ID NO: 422484 - RNA, 22 nt, Human
gcugccuuuugcuccucccacc

SEQ ID NO: 422485 - RNA, 22 nt, Human
cccucagcuccacccucagcag

SEQ ID NO: 422486 - RNA, 20 nt, Human
ccugucuggagacaaagaga

SEQ ID NO: 422487 - RNA, 22 nt, Human
ucaggggcuugaggugcauguc

SEQ ID NO: 422488 - RNA, 22 nt, Human
agaaugcaguuugaaauaaggu

SEQ ID NO: 422489 - RNA, 22 nt, Human
gcagggucugaggccacagagg

SEQ ID NO: 422490 - RNA, 22 nt, Human
aggccugagcagaggaguggac

SEQ ID NO: 422491 - RNA, 22 nt, Human
acauuucugcuagaauagguga

SEQ ID NO: 422492 - RNA, 22 nt, Human
agcugccaaguuucucaguuua

SEQ ID NO: 422493 - RNA, 22 nt, Human
gugcuuucugcaugguuccuac

SEQ ID NO: 422494 - RNA, 22 nt, Human
gagcugggacauggguccucuc

SEQ ID NO: 422495 - RNA, 22 nt, Human
guuguauagagggcaugaaucu

SEQ ID NO: 422496 - RNA, 22 nt, Human
uagggcuguuuaaaagugaggu

SEQ ID NO: 422497 - RNA, 22 nt, Human
aggcucagagagcuguguccau

SEQ ID NO: 422498 - RNA, 22 nt, Human
aacuguacgauaauaaauuugu

SEQ ID NO: 422499 - RNA, 22 nt, Human
ucccagcagucagagcuaugug

SEQ ID NO: 422500 - RNA, 22 nt, Human
ugcaggagacauaauagggacu

SEQ ID NO: 422501 - RNA, 22 nt, Human
gcugucacucaccaggccugca

SEQ ID NO: 422502 - RNA, 22 nt, Human
aagugacaaaaggguauccaaa

SEQ ID NO: 422503 - RNA, 22 nt, Human
accaggcugugaagugagacua

SEQ ID NO: 422504 - RNA, 22 nt, Human
cacugaagcuuucauucucuug

SEQ ID NO: 422505 - RNA, 22 nt, Human
uucaagaugucuucacaauagu

SEQ ID NO: 422506 - RNA, 22 nt, Human
guccacauaggaacccagcuuc

SEQ ID NO: 422507 - RNA, 22 nt, Human
cugagcugagccaaaucugucu

SEQ ID NO: 422508 - RNA, 22 nt, Human
auuccaaacagugcugcagacu

SEQ ID NO: 422509 - RNA, 22 nt, Human
gggcaagcucuucagaagcucu

SEQ ID NO: 422510 - RNA, 22 nt, Human
cuggugugauugagcccaggug

SEQ ID NO: 422511 - RNA, 22 nt, Human
ggggacccucaggacugcgucu

SEQ ID NO: 422512 - RNA, 22 nt, Human
ucucugucugagccuggcagac

SEQ ID NO: 422513 - RNA, 22 nt, Human
cuggaaguauaggggagaugau

SEQ ID NO: 422514 - RNA, 22 nt, Human
gggggaagaaagaacauggcau

SEQ ID NO: 422515 - RNA, 22 nt, Human
ucuuuuuauauugacaaaaggu

SEQ ID NO: 422516 - RNA, 22 nt, Human
cagaggaagagauacaagcccu

SEQ ID NO: 422517 - RNA, 23 nt, Human
aggcacugaaugugucagugagu

SEQ ID NO: 422518 - RNA, 22 nt, Human
ggaggcugagaaguccaagauc

SEQ ID NO: 422519 - RNA, 22 nt, Human
uccugccucacaguugaaguuu

SEQ ID NO: 422520 - RNA, 22 nt, Human
cuccucuggaaauuccucugcc

SEQ ID NO: 422521 - RNA, 22 nt, Human
uacuuagagcgauaauuuauac

SEQ ID NO: 422522 - RNA, 22 nt, Human
cugggcaggagggcucuaugga

SEQ ID NO: 422523 - RNA, 22 nt, Human
uaguuacagcaggcaggauaua

SEQ ID NO: 422524 - RNA, 22 nt, Human
agcccccaaaagugcuuaugau

SEQ ID NO: 422525 - RNA, 19 nt, Human
ccauggcaaugaucugaug

SEQ ID NO: 422526 - RNA, 22 nt, Human
aaaucaguuagugguaggauug

SEQ ID NO: 422527 - RNA, 22 nt, Human
agaagugcuccagugaguuggg

SEQ ID NO: 422528 - RNA, 22 nt, Human
ugagcaguaacagcucacaggg

SEQ ID NO: 422529 - RNA, 22 nt, Human
gcauguguggaggagaugugcu

SEQ ID NO: 422530 - RNA, 22 nt, Human
ggcuucugguaaagaccacacc

SEQ ID NO: 422531 - RNA, 22 nt, Human
gcagccaggaaagcuggacccu

SEQ ID NO: 422532 - RNA, 22 nt, Human
gcuccugggcucuaccuugcua

SEQ ID NO: 422533 - RNA, 18 nt, Human
caggucagccuggccuca

SEQ ID NO: 422534 - RNA, 22 nt, Human
ucaaaggcccauugucccguug

SEQ ID NO: 422535 - RNA, 22 nt, Human
gucuuucuuaauucaagugcuu

SEQ ID NO: 422536 - RNA, 22 nt, Human
cuacauggagaagaaaauucuu

SEQ ID NO: 422537 - RNA, 16 nt, Human
cagccugcagugguca

SEQ ID NO: 422538 - RNA, 22 nt, Human
ccuggagcccaaggcagugaga

SEQ ID NO: 422539 - RNA, 20 nt, Human
guggccuguccuguuguggg

SEQ ID NO: 422540 - RNA, 22 nt, Human
ugagccugggagauggaggcug

SEQ ID NO: 422541 - RNA, 22 nt, Human
cugaggccucuguucaccagaa

SEQ ID NO: 422542 - RNA, 22 nt, Human
aggcuggcuuggcucuccugug

SEQ ID NO: 422543 - RNA, 19 nt, Human
cauaauacaguggaucuga

SEQ ID NO: 422544 - RNA, 22 nt, Human
aaagcuuuucaguauguucaug

SEQ ID NO: 422545 - RNA, 22 nt, Human
aaaaugaggucaauauccuuuu

SEQ ID NO: 422546 - RNA, 22 nt, Human
gccugccucaaaaucccaguuc

SEQ ID NO: 422547 - RNA, 22 nt, Human
uugggaaggcguggaagcagaa

SEQ ID NO: 422548 - RNA, 22 nt, Human
ucagggacuaggugcugccuga

SEQ ID NO: 422549 - RNA, 22 nt, Human
ggccucuguuuggagccaggau

SEQ ID NO: 422550 - RNA, 22 nt, Human
agggaaggaaaagcugucgcuu

SEQ ID NO: 422551 - RNA, 21 nt, Human
cagaggcagguccugggacgg

SEQ ID NO: 422552 - RNA, 22 nt, Human
ucaguggagagcuuccaggauu

SEQ ID NO: 422553 - RNA, 22 nt, Human
ggcugagcaauuuugaugacau

SEQ ID NO: 422554 - RNA, 22 nt, Human
gggagggaaggaccuuaugaau

SEQ ID NO: 422555 - RNA, 22 nt, Human
caguggguaggaaaggcucuuc

SEQ ID NO: 422556 - RNA, 22 nt, Human
gagggauggugugagaggcuca

SEQ ID NO: 422557 - RNA, 22 nt, Human
uccuggagggaggcggugcuac

SEQ ID NO: 422558 - RNA, 19 nt, Human
aggaaagguggccuuagca

SEQ ID NO: 422559 - RNA, 21 nt, Human
augaagucuaugcuucugugu

SEQ ID NO: 422560 - RNA, 22 nt, Human
auucuagaugcuguaaguagca

SEQ ID NO: 422561 - RNA, 22 nt, Human
acucaggaaaugagaggcucuc

SEQ ID NO: 422562 - RNA, 22 nt, Human
uucauucaucucuaaaaugccu

SEQ ID NO: 422563 - RNA, 22 nt, Human
aggucauuaaaguuaaaugagg

SEQ ID NO: 422564 - RNA, 22 nt, Human
cagaaaaccugacucuagaacu

SEQ ID NO: 422565 - RNA, 22 nt, Human
cagcuuugauucuuucugccau

SEQ ID NO: 422566 - RNA, 22 nt, Human
auuccaaagacagaagcagcug

SEQ ID NO: 422567 - RNA, 22 nt, Human
agccucugucaagcuuuucaaa

SEQ ID NO: 422568 - RNA, 19 nt, Human
uggcucugucgaaggcaca

SEQ ID NO: 422569 - RNA, 23 nt, Human
ugggcaucuccucugugccaggc

SEQ ID NO: 422570 - RNA, 22 nt, Human
aagggcagggaguuugugucua

SEQ ID NO: 422571 - RNA, 22 nt, Human
ucacguuuuacugagugagaua

SEQ ID NO: 422572 - RNA, 22 nt, Human
uaaaugugaccuucauuuuaua

SEQ ID NO: 422573 - RNA, 22 nt, Human
guuuucauuacugcugugauuu

SEQ ID NO: 422574 - RNA, 22 nt, Human
aggcugugauuccaccacucuc

SEQ ID NO: 422575 - RNA, 20 nt, Human
aggccaggaaauguaguucu

SEQ ID NO: 422576 - RNA, 22 nt, Human
gcugccaugccacagcacucac

SEQ ID NO: 422577 - RNA, 22 nt, Human
agcugacuucuugauccaauga

SEQ ID NO: 422578 - RNA, 22 nt, Human
augaugguuguccuaggugcau

SEQ ID NO: 422579 - RNA, 22 nt, Human
cugcugugggcaggguagcugg

SEQ ID NO: 422580 - RNA, 22 nt, Human
cagaaagaccugggcucaagag

SEQ ID NO: 422581 - RNA, 22 nt, Human
ugacaauacagagagagcaaaa

SEQ ID NO: 422582 - RNA, 22 nt, Human
agcagagcugcaguggccugcu

SEQ ID NO: 422583 - RNA, 22 nt, Human
cuguacaggucaaugauaagau

SEQ ID NO: 422584 - RNA, 22 nt, Human
cagggcucuucaucacacagua

SEQ ID NO: 422585 - RNA, 22 nt, Human
acacuuuguuguggcauauacg

SEQ ID NO: 422586 - RNA, 22 nt, Human
ucucagagggaaacaugaguga

SEQ ID NO: 422587 - RNA, 22 nt, Human
aaccauuugcaguuacugagac

SEQ ID NO: 422588 - RNA, 20 nt, Human
ccuggcuuugcaucugugau

SEQ ID NO: 422589 - RNA, 22 nt, Human
ugaggcucagaaauguaaguuu

SEQ ID NO: 422590 - RNA, 22 nt, Human
cugcugggcuccucaugugacu

SEQ ID NO: 422591 - RNA, 22 nt, Human
ccugaagggacuccagagagca

SEQ ID NO: 422592 - RNA, 22 nt, Human
gcaggauggugcccuuucugcc

SEQ ID NO: 422593 - RNA, 22 nt, Human
augaggcagaaaaaagucggag

SEQ ID NO: 422594 - RNA, 22 nt, Human
agaugcuucaguguuuaauuua

SEQ ID NO: 422595 - RNA, 22 nt, Human
ggccaccucugcccuacugagu

SEQ ID NO: 422596 - RNA, 22 nt, Human
gcagacuggucuucagccuugg

SEQ ID NO: 422597 - RNA, 22 nt, Human
uaccuugggcuauuaucuuuga

SEQ ID NO: 422598 - RNA, 22 nt, Human
gccaggugggagacagacagca

SEQ ID NO: 422599 - RNA, 22 nt, Human
aguuuuauuccaaugugcagca

SEQ ID NO: 422600 - RNA, 22 nt, Human
cugaggugcuauggaggauacg

SEQ ID NO: 422601 - RNA, 22 nt, Human
uuuuucaugagacuagaaguca

SEQ ID NO: 422602 - RNA, 22 nt, Human
uucaagaugacccagucacacg

SEQ ID NO: 422603 - RNA, 22 nt, Human
agagcugcaccuaugcagaccu

SEQ ID NO: 422604 - RNA, 22 nt, Human
agcagcuggugagcaagcucag

SEQ ID NO: 422605 - RNA, 22 nt, Human
cuacagacccaccuuggaagaa

SEQ ID NO: 422606 - RNA, 18 nt, Human
aagcugcccucaggcagg

SEQ ID NO: 422607 - RNA, 21 nt, Human
agagaauugccuuagauguuc

SEQ ID NO: 422608 - RNA, 22 nt, Human
aggaagcccuugucauuucugu

SEQ ID NO: 422609 - RNA, 22 nt, Human
uucaauucaauucuaaauauau

SEQ ID NO: 422610 - RNA, 21 nt, Human
accaucuuccaugcauuauau

SEQ ID NO: 422611 - RNA, 22 nt, Human
ugugugcauucacaugcaugcc

SEQ ID NO: 422612 - RNA, 22 nt, Human
uggagccaaggccaguucucag

SEQ ID NO: 422613 - RNA, 21 nt, Human
cagaaguaaggguaacuucuc

SEQ ID NO: 422614 - RNA, 22 nt, Human
auggccuggggagcaugggaag

SEQ ID NO: 422615 - RNA, 22 nt, Human
uggagggcaugcuguccauggg

SEQ ID NO: 422616 - RNA, 22 nt, Human
cagagcuggacuuaaauauauu

SEQ ID NO: 422617 - RNA, 22 nt, Human
ugcccacaggaagacaccagcg

SEQ ID NO: 422618 - RNA, 22 nt, Human
uccaggcaggguuaaggguccu

SEQ ID NO: 422619 - RNA, 22 nt, Human
ccagagagagaggucaauggca

SEQ ID NO: 422620 - RNA, 22 nt, Human
uagagcugcuggacuguaacag

SEQ ID NO: 422621 - RNA, 22 nt, Human
augcacagcagugaguucagug

SEQ ID NO: 422622 - RNA, 23 nt, Human
caggacaugggaggaaguauggc

SEQ ID NO: 422623 - RNA, 20 nt, Human
ugaugguucuuuccggguug

SEQ ID NO: 422624 - RNA, 20 nt, Human
ggaagccagcauccuugagg

SEQ ID NO: 422625 - RNA, 22 nt, Human
aagggcaggagaagacggauau

SEQ ID NO: 422626 - RNA, 21 nt, Human
ugcagaggcacaaacaagccc

SEQ ID NO: 422627 - RNA, 21 nt, Human
ugccagcauuaaacagucauu

SEQ ID NO: 422628 - RNA, 22 nt, Human
aggcccuguuaugagccacugu

SEQ ID NO: 422629 - RNA, 22 nt, Human
cugcuuugcauagcugccagag

SEQ ID NO: 422630 - RNA, 22 nt, Human
aggguaggguaaaugaugcauc

SEQ ID NO: 422631 - RNA, 17 nt, Human
agcagaagucagaggga

SEQ ID NO: 422632 - RNA, 22 nt, Human
ccuggccuuaagggcagggagc

SEQ ID NO: 422633 - RNA, 22 nt, Human
uccuggaggcaaaugagcacau

SEQ ID NO: 422634 - RNA, 22 nt, Human
aggggcucaaagugugcaggga

SEQ ID NO: 422635 - RNA, 22 nt, Human
gcugucagaaggugaaggguaa

SEQ ID NO: 422636 - RNA, 22 nt, Human
aggaagugcuaagagaacauca

SEQ ID NO: 422637 - RNA, 21 nt, Human
accagcaggagaucagaagga

SEQ ID NO: 422638 - RNA, 21 nt, Human
ugggggagaauugguugcuuu

SEQ ID NO: 422639 - RNA, 22 nt, Human
uccuguaguugcuaaguuuguu

SEQ ID NO: 422640 - RNA, 21 nt, Human
uggcagaguugaguaguuaug

SEQ ID NO: 422641 - RNA, 22 nt, Human
ggucugagcuugagcccaugcu

SEQ ID NO: 422642 - RNA, 22 nt, Human
auuuuaauaagauucccaagua

SEQ ID NO: 422643 - RNA, 23 nt, Human
uccaggcacgcauuucuucuagc

SEQ ID NO: 422644 - RNA, 22 nt, Human
gccagagcaugcacugccugca

SEQ ID NO: 422645 - RNA, 22 nt, Human
ugcugcucuucaccauggccuc

SEQ ID NO: 422646 - RNA, 22 nt, Human
aaugugguuaacccauuuaaga

SEQ ID NO: 422647 - RNA, 22 nt, Human
ugggacaguuguccuccacucu

SEQ ID NO: 422648 - RNA, 22 nt, Human
ucugucacucuagagauggcag

SEQ ID NO: 422649 - RNA, 22 nt, Human
gagaaguuucugguuugcauag

SEQ ID NO: 422650 - RNA, 22 nt, Human
cgggcagugcccagcggggcag

SEQ ID NO: 422651 - RNA, 22 nt, Human
auaugugugccauuucagcagu

SEQ ID NO: 422652 - RNA, 22 nt, Human
aagcagaaguugaucuaccaua

SEQ ID NO: 422653 - RNA, 23 nt, Human
aagaauaaaugacauuaaaggug

SEQ ID NO: 422654 - RNA, 22 nt, Human
uagacacauccguggaagcuuc

SEQ ID NO: 422655 - RNA, 22 nt, Human
ugaacauauucaccucuaaaua

SEQ ID NO: 422656 - RNA, 21 nt, Human
ggcccugguuacgccuccucu

SEQ ID NO: 422657 - RNA, 22 nt, Human
agccacagcccacaggacucuu

SEQ ID NO: 422658 - RNA, 22 nt, Human
gggcacuguguucagagugcag

SEQ ID NO: 422659 - RNA, 22 nt, Human
ggcagcugggucacaccgaucu

SEQ ID NO: 422660 - RNA, 22 nt, Human
agccucuguagaaagcagugug

SEQ ID NO: 422661 - RNA, 19 nt, Human
guccaguguuuuccaguca

SEQ ID NO: 422662 - RNA, 22 nt, Human
agggggaggcugugcugcgucu

SEQ ID NO: 422663 - RNA, 22 nt, Human
agcugccuguccuaggccauca

SEQ ID NO: 422664 - RNA, 22 nt, Human
guccagggaaauagcgacaggg

SEQ ID NO: 422665 - RNA, 22 nt, Human
ggccugugagcccuugcaugua

SEQ ID NO: 422666 - RNA, 22 nt, Human
caggcuggaguuaccuuuaggg

SEQ ID NO: 422667 - RNA, 23 nt, Human
cugaggccugcugcguucagguu

SEQ ID NO: 422668 - RNA, 18 nt, Human
ggcugagguugacuagaa

SEQ ID NO: 422669 - RNA, 21 nt, Human
gccagccuguuuaccuguggu

SEQ ID NO: 422670 - RNA, 22 nt, Human
caauuucuaacauuccauggau

SEQ ID NO: 422671 - RNA, 22 nt, Human
uggcagcugucuguggggucuc

SEQ ID NO: 422672 - RNA, 22 nt, Human
aggagggugauccgggcugguc

SEQ ID NO: 422673 - RNA, 22 nt, Human
aguguugucaaacggcucagca

SEQ ID NO: 422674 - RNA, 22 nt, Human
aggcucagagaugaguaagcac

SEQ ID NO: 422675 - RNA, 22 nt, Human
ccagaggugccacagaaagagc

SEQ ID NO: 422676 - RNA, 22 nt, Human
uucccaguuagucauuuuuaca

SEQ ID NO: 422677 - RNA, 22 nt, Human
uguguacacaaugauugcagag

SEQ ID NO: 422678 - RNA, 21 nt, Human
uccauaagagaccaucuccua

SEQ ID NO: 422679 - RNA, 22 nt, Human
cuggccuggagccucugggugg

SEQ ID NO: 422680 - RNA, 22 nt, Human
aauguguauaugaacauacagg

SEQ ID NO: 422681 - RNA, 22 nt, Human
ugcagggaaaacccaggaugcu

SEQ ID NO: 422682 - RNA, 22 nt, Human
aggcccuggguuagggcccacu

SEQ ID NO: 422683 - RNA, 22 nt, Human
ugcuuuauucagucucugccau

SEQ ID NO: 422684 - RNA, 22 nt, Human
uaaaugugggggccacgggcuu

SEQ ID NO: 422685 - RNA, 22 nt, Human
uuacaucauugagacauacaua

SEQ ID NO: 422686 - RNA, 22 nt, Human
ccugggcuuucaaaaccagccu

SEQ ID NO: 422687 - RNA, 22 nt, Human
agcugagcucaggcugauguaa

SEQ ID NO: 422688 - RNA, 22 nt, Human
ccuggagcuuggucacgcugcg

SEQ ID NO: 422689 - RNA, 22 nt, Human
cccccagccagcagugcucagc

SEQ ID NO: 422690 - RNA, 22 nt, Human
cccugggcagucugcacuucag

SEQ ID NO: 422691 - RNA, 22 nt, Human
cagcauuggguuaccuuuguuu

SEQ ID NO: 422692 - RNA, 22 nt, Human
uuugggcaauucagugggaccu

SEQ ID NO: 422693 - RNA, 22 nt, Human
auaugcacacucugcccacaga

SEQ ID NO: 422694 - RNA, 22 nt, Human
aagauuuccauuucuagcucau

SEQ ID NO: 422695 - RNA, 22 nt, Human
ugcucugcaagcaggagcaaga

SEQ ID NO: 422696 - RNA, 17 nt, Human
agugaaauuuacauugc

SEQ ID NO: 422697 - RNA, 22 nt, Human
agcuuuauuaacucuccaggug

SEQ ID NO: 422698 - RNA, 22 nt, Human
caggcccugggcaggaucagcc

SEQ ID NO: 422699 - RNA, 22 nt, Human
ugggcuccucgucacucgcugu

SEQ ID NO: 422700 - RNA, 22 nt, Human
uuuugcuuuuguaacacagugu

SEQ ID NO: 422701 - RNA, 20 nt, Human
auuuggcaugaaguauugau

SEQ ID NO: 422702 - RNA, 19 nt, Human
aucugccuuagugcugcug

SEQ ID NO: 422703 - RNA, 22 nt, Human
agcugccugcuuaugagcucca

SEQ ID NO: 422704 - RNA, 22 nt, Human
ucugaagggcugaguggaggag

SEQ ID NO: 422705 - RNA, 18 nt, Human
guccugagcucugcugua

SEQ ID NO: 422706 - RNA, 22 nt, Human
ugaguccaccuuaguauauggg

SEQ ID NO: 422707 - RNA, 22 nt, Human
gcagggcagccacaggcccccu

SEQ ID NO: 422708 - RNA, 22 nt, Human
uucaggagcuggcugcgaagga

SEQ ID NO: 422709 - RNA, 22 nt, Human
uguccaggucagcagcagggac

SEQ ID NO: 422710 - RNA, 22 nt, Human
agaauucucuuccauugaaaca

SEQ ID NO: 422711 - RNA, 22 nt, Human
ugugaggagaggcccagcuccc

SEQ ID NO: 422712 - RNA, 23 nt, Human
gcugggcuuacucuuucagugag

SEQ ID NO: 422713 - RNA, 17 nt, Human
uagagcugguucaggag

SEQ ID NO: 422714 - RNA, 22 nt, Human
aucaggauggguuuggcuuagg

SEQ ID NO: 422715 - RNA, 22 nt, Human
acagaguacauucagagacuau

SEQ ID NO: 422716 - RNA, 22 nt, Human
agccuccuguagcccucaccca

SEQ ID NO: 422717 - RNA, 22 nt, Human
uagcacaucuggcgcuuauagg

SEQ ID NO: 422718 - RNA, 22 nt, Human
agucaguguagaaagcccaggc

SEQ ID NO: 422719 - RNA, 22 nt, Human
uuguuuguaugcugagaagaau

SEQ ID NO: 422720 - RNA, 22 nt, Human
agcaggaaggucugugugaguc

SEQ ID NO: 422721 - RNA, 22 nt, Human
gaaagcaguaaaugggucccau

SEQ ID NO: 422722 - RNA, 22 nt, Human
ccaggccuuucuucuuggucug

SEQ ID NO: 422723 - RNA, 22 nt, Human
cuuuacaaagcaauuuugucuc

SEQ ID NO: 422724 - RNA, 22 nt, Human
ggaggagcacuucugagcucag

SEQ ID NO: 422725 - RNA, 22 nt, Human
ggcugcuggggacgugggagag

SEQ ID NO: 422726 - RNA, 22 nt, Human
agccacaggaaacagagacagc

SEQ ID NO: 422727 - RNA, 22 nt, Human
ugacuuccugcacucaggugau

SEQ ID NO: 422728 - RNA, 22 nt, Human
gaagaacacuucaugauucauu

SEQ ID NO: 422729 - RNA, 22 nt, Human
uucuuugaguuaguacagucca

SEQ ID NO: 422730 - RNA, 22 nt, Human
ugagcaguaggucugaauagug

SEQ ID NO: 422731 - RNA, 22 nt, Human
cuaguccagucucaaaaugcua

SEQ ID NO: 422732 - RNA, 22 nt, Human
uugagaagaggcuuuguaggaa

SEQ ID NO: 422733 - RNA, 22 nt, Human
aucuggcucccuuggaauccgu

SEQ ID NO: 422734 - RNA, 22 nt, Human
gcuggcuguguuucaucucuga

SEQ ID NO: 422735 - RNA, 22 nt, Human
cagcuggacuuuugauagaagu

SEQ ID NO: 422736 - RNA, 22 nt, Human
guggcagcggcccaggccgucu

SEQ ID NO: 422737 - RNA, 22 nt, Human
ucugcuguaaagaauuucugcc

SEQ ID NO: 422738 - RNA, 22 nt, Human
ugcagucuuccagcugcacaaa

SEQ ID NO: 422739 - RNA, 20 nt, Human
uuacucaguuccugccaugc

SEQ ID NO: 422740 - RNA, 22 nt, Human
gaagccagccuugucugccucu

SEQ ID NO: 422741 - RNA, 23 nt, Human
agcaggaaaccgagggugauguu

SEQ ID NO: 422742 - RNA, 22 nt, Human
ucccaggacaggccacauggaa

SEQ ID NO: 422743 - RNA, 22 nt, Human
auauaaaguguuuagaaagcug

SEQ ID NO: 422744 - RNA, 22 nt, Human
gcacccaguuugucucaggguu

SEQ ID NO: 422745 - RNA, 22 nt, Human
aggagcugcauggauaccuggu

SEQ ID NO: 422746 - RNA, 22 nt, Human
auuuucauuuugcagggugaga

SEQ ID NO: 422747 - RNA, 22 nt, Human
cuguauuuaguuaaaaugcuaa

SEQ ID NO: 422748 - RNA, 22 nt, Human
guuuuauaggcuguugcuauau

SEQ ID NO: 422749 - RNA, 22 nt, Human
caacuuuaugauugguuuguca

SEQ ID NO: 422750 - RNA, 21 nt, Human
ucaggggcuguguuuuccauc

SEQ ID NO: 422751 - RNA, 22 nt, Human
ugagcccaggaguuggaggcug

SEQ ID NO: 422752 - RNA, 22 nt, Human
guacucucuugaaggccuuucu

SEQ ID NO: 422753 - RNA, 22 nt, Human
cugggcagugguggcccuuccc

SEQ ID NO: 422754 - RNA, 22 nt, Human
ccaaaauguuugaaugcaugug

SEQ ID NO: 422755 - RNA, 22 nt, Human
agggaaauuaaugugagcaaug

SEQ ID NO: 422756 - RNA, 22 nt, Human
ccucugggagacugcuacugag

SEQ ID NO: 422757 - RNA, 22 nt, Human
ucccuggccauuccucuaggcc

SEQ ID NO: 422758 - RNA, 19 nt, Human
aacuagaaagguuuugaga

SEQ ID NO: 422759 - RNA, 20 nt, Human
aggagccauugacugcagca

SEQ ID NO: 422760 - RNA, 22 nt, Human
ccagcuggucugugcucauguu

SEQ ID NO: 422761 - RNA, 22 nt, Human
cucuccucugaaguggugaccc

SEQ ID NO: 422762 - RNA, 22 nt, Human
aaggcauagucuuuaaguucug

SEQ ID NO: 422763 - RNA, 22 nt, Human
uuugcuauaaaagggucacacg

SEQ ID NO: 422764 - RNA, 22 nt, Human
cuguccugauggugccacuggu

SEQ ID NO: 422765 - RNA, 22 nt, Human
cucaagacugaucgcaguggaa

SEQ ID NO: 422766 - RNA, 22 nt, Human
uuuccaaaaugaaucuaaugca

SEQ ID NO: 422767 - RNA, 19 nt, Human
ggucucagugcagcugcag

SEQ ID NO: 422768 - RNA, 22 nt, Human
uaagaacaagauguuccuguuu

SEQ ID NO: 422769 - RNA, 22 nt, Human
uggaaagaugaagauguuuaag

SEQ ID NO: 422770 - RNA, 22 nt, Human
accaggcagcaccaaagccggu

SEQ ID NO: 422771 - RNA, 22 nt, Human
gugaggugggcuggccagagac

SEQ ID NO: 422772 - RNA, 22 nt, Human
cucccagguuccgacgccucuu

SEQ ID NO: 422773 - RNA, 22 nt, Human
cuucuuuaauguauacaaaaga

SEQ ID NO: 422774 - RNA, 22 nt, Human
aguauguauuuuauacuuacag

SEQ ID NO: 422775 - RNA, 22 nt, Human
uccaggaggguuuucugccuuc

SEQ ID NO: 422776 - RNA, 22 nt, Human
ccuuuccuuuuuagugugggag

SEQ ID NO: 422777 - RNA, 22 nt, Human
caggcugucugaauggaggccc

SEQ ID NO: 422778 - RNA, 22 nt, Human
uuguacaaaggauuuggaagag

SEQ ID NO: 422779 - RNA, 22 nt, Human
agaaaugggccuugggacacaa

SEQ ID NO: 422780 - RNA, 21 nt, Human
uccaggaguggcugggcaggg

SEQ ID NO: 422781 - RNA, 22 nt, Human
gcagaaggauccgcaggugcaa

SEQ ID NO: 422782 - RNA, 22 nt, Human
uccagcagaaaagagguaggga

SEQ ID NO: 422783 - RNA, 22 nt, Human
aggacugacuuuugccaugaaa

SEQ ID NO: 422784 - RNA, 22 nt, Human
uuaaagaugcagcuuuagagaa

SEQ ID NO: 422785 - RNA, 20 nt, Human
cagcccuccaguggaggcag

SEQ ID NO: 422786 - RNA, 22 nt, Human
uccagucauuuccauuguuccc

SEQ ID NO: 422787 - RNA, 22 nt, Human
agagggcuuugauucucaguuc

SEQ ID NO: 422788 - RNA, 22 nt, Human
ugaaccaggaggcagccagcac

SEQ ID NO: 422789 - RNA, 22 nt, Human
ggccucucauguccugggcuuc

SEQ ID NO: 422790 - RNA, 21 nt, Human
gcugugcacauaguagaagug

SEQ ID NO: 422791 - RNA, 22 nt, Human
uuuugcuugagugcacaaaaug

SEQ ID NO: 422792 - RNA, 22 nt, Human
caguuucucucaauaagcaucg

SEQ ID NO: 422793 - RNA, 22 nt, Human
acuuccugcuaugagcuucugu

SEQ ID NO: 422794 - RNA, 22 nt, Human
uacaaagugagcaaccucuuuu

SEQ ID NO: 422795 - RNA, 22 nt, Human
aauaauuauuugagagcagacc

SEQ ID NO: 422796 - RNA, 22 nt, Human
acacacaauuaguuuuaugcuu

SEQ ID NO: 422797 - RNA, 22 nt, Human
aggcccaguagugcugccuuua

SEQ ID NO: 422798 - RNA, 22 nt, Human
cauugcacugcagcccgggcaa

SEQ ID NO: 422799 - RNA, 22 nt, Human
aaucagaauuuauugaaucuuu

SEQ ID NO: 422800 - RNA, 22 nt, Human
ggcugggccagggccuguggac

SEQ ID NO: 422801 - RNA, 22 nt, Human
agccuggaguucccaggagaag

SEQ ID NO: 422802 - RNA, 22 nt, Human
gacaauuucucaauauagaaac

SEQ ID NO: 422803 - RNA, 22 nt, Human
cuucccacuaguaucacagagc

SEQ ID NO: 422804 - RNA, 22 nt, Human
guuuuuccugcugacuuggguc

SEQ ID NO: 422805 - RNA, 22 nt, Human
agcauuuaugacuaauguaaaa

SEQ ID NO: 422806 - RNA, 23 nt, Human
aguuuuucugcaugguucuguau

SEQ ID NO: 422807 - RNA, 17 nt, Human
agcuccugcccauggcu

SEQ ID NO: 422808 - RNA, 22 nt, Human
cccuggaguccggagcucaccu

SEQ ID NO: 422809 - RNA, 22 nt, Human
aauguacaaggguuccaguuuu

SEQ ID NO: 422810 - RNA, 22 nt, Human
cacccagcagcacuuaagacua

SEQ ID NO: 422811 - RNA, 22 nt, Human
uucuuuaaaauagugagaaaga

SEQ ID NO: 422812 - RNA, 17 nt, Human
gaauuucuuggucaaaa

SEQ ID NO: 422813 - RNA, 22 nt, Human
ggcacugaauuucuuggcaucu

SEQ ID NO: 422814 - RNA, 22 nt, Human
ugcacacaaaugugaacgugcc

SEQ ID NO: 422815 - RNA, 22 nt, Human
gugcagguguuuuggcugccag

SEQ ID NO: 422816 - RNA, 22 nt, Human
ugggcagguuguuauuugacau

SEQ ID NO: 422817 - RNA, 22 nt, Human
gcaaauacauguugagcaccua

SEQ ID NO: 422818 - RNA, 22 nt, Human
ucagccagguaauguggagaug

SEQ ID NO: 422819 - RNA, 22 nt, Human
uugauuuauagaauguucaagc

SEQ ID NO: 422820 - RNA, 22 nt, Human
agaauuguaagcaauuugauua

SEQ ID NO: 422821 - RNA, 22 nt, Human
ggucagagggugggcugccugu

SEQ ID NO: 422822 - RNA, 23 nt, Human
aggcugagcucucccagcuucag

SEQ ID NO: 422823 - RNA, 19 nt, Human
agacagagcucaguggguu

SEQ ID NO: 422824 - RNA, 22 nt, Human
cagugguggaaugaggaauugu

SEQ ID NO: 422825 - RNA, 22 nt, Human
gcagcagcccagggcucucaga

SEQ ID NO: 422826 - RNA, 22 nt, Human
ucugguaaccuuuaucccuccu

SEQ ID NO: 422827 - RNA, 20 nt, Human
uuccuguauacaaagaguuc

SEQ ID NO: 422828 - RNA, 20 nt, Human
gcaugaggaaucauugcagc

SEQ ID NO: 422829 - RNA, 22 nt, Human
gcccucuggcagccuuggcugg

SEQ ID NO: 422830 - RNA, 22 nt, Human
aggcacugggaauaugcugagg

SEQ ID NO: 422831 - RNA, 20 nt, Human
ugggagcuggugaggucuca

SEQ ID NO: 422832 - RNA, 22 nt, Human
acagccaggagccaugggcagg

SEQ ID NO: 422833 - RNA, 22 nt, Human
gcaaaauuuacacuccuucuuc

SEQ ID NO: 422834 - RNA, 22 nt, Human
guggcugcuguccucucugguu

SEQ ID NO: 422835 - RNA, 22 nt, Human
gcagcugggccccagccucucc

SEQ ID NO: 422836 - RNA, 22 nt, Human
cacacacaguuuuguauucugu

SEQ ID NO: 422837 - RNA, 22 nt, Human
cagagugagggccugcaccugc

SEQ ID NO: 422838 - RNA, 22 nt, Human
guggggcaguggccugggagca

SEQ ID NO: 422839 - RNA, 19 nt, Human
gagcagcugcacccauuga

SEQ ID NO: 422840 - RNA, 22 nt, Human
cagaagaguagcugaacaaguu

SEQ ID NO: 422841 - RNA, 22 nt, Human
cagauggaacacagaaaggaga

SEQ ID NO: 422842 - RNA, 22 nt, Human
cgcccagggcaggaggccgcuc

SEQ ID NO: 422843 - RNA, 22 nt, Human
ccuggcagcgugccgagcugcg

SEQ ID NO: 422844 - RNA, 22 nt, Human
gggaccuggucuagcacugagc

SEQ ID NO: 422845 - RNA, 22 nt, Human
gcacacaguauaugcucauuaa

SEQ ID NO: 422846 - RNA, 22 nt, Human
ucccagccauuccuuuaggugu

SEQ ID NO: 422847 - RNA, 22 nt, Human
uuucugaauaacucuaugauau

SEQ ID NO: 422848 - RNA, 22 nt, Human
ggaggugguggcagugacaauu

SEQ ID NO: 422849 - RNA, 22 nt, Human
acagggcagagggcaguuggua

SEQ ID NO: 422850 - RNA, 18 nt, Human
gggcauggaugcagcauc

SEQ ID NO: 422851 - RNA, 20 nt, Human
aggcacuguugucuguaucc

SEQ ID NO: 422852 - RNA, 22 nt, Human
ugcuccagugagcuggccaucc

SEQ ID NO: 422853 - RNA, 22 nt, Human
ucagaggaugcuguucuuuaau

SEQ ID NO: 422854 - RNA, 22 nt, Human
cagcuggggcagccacgugcgg

SEQ ID NO: 422855 - RNA, 22 nt, Human
cagagccuaaaacgacuccacu

SEQ ID NO: 422856 - RNA, 22 nt, Human
cccuggagcuagucugagcaga

SEQ ID NO: 422857 - RNA, 22 nt, Human
agcugccaucagccuuuggaug

SEQ ID NO: 422858 - RNA, 22 nt, Human
auuuccaaucucugcauauggg

SEQ ID NO: 422859 - RNA, 22 nt, Human
uccagggacacagaguccuucu

SEQ ID NO: 422860 - RNA, 22 nt, Human
gccacguugccacccgggugac

SEQ ID NO: 422861 - RNA, 22 nt, Human
gagauggggaauaggagcaagc

SEQ ID NO: 422862 - RNA, 22 nt, Human
agucaccaucuguggcagccug

SEQ ID NO: 422863 - RNA, 22 nt, Human
aaacuguaagagaauaaacuac

SEQ ID NO: 422864 - RNA, 22 nt, Human
gagguauguaugcuacauucuu

SEQ ID NO: 422865 - RNA, 19 nt, Human
ggccaccucucuucccagg

SEQ ID NO: 422866 - RNA, 22 nt, Human
auugaaagcacaaagaacaagu

SEQ ID NO: 422867 - RNA, 22 nt, Human
cuccucacacccacugcaacca

SEQ ID NO: 422868 - RNA, 22 nt, Human
cccauucauccucgcuuccuuc

SEQ ID NO: 422869 - RNA, 22 nt, Human
agggcuccaggggcugggugac

SEQ ID NO: 422870 - RNA, 22 nt, Human
uuccaaugacuaguggcauccu

SEQ ID NO: 422871 - RNA, 22 nt, Human
ccacagggauaggaauggggcu

SEQ ID NO: 422872 - RNA, 22 nt, Human
aagacccacaaggcugaauguu

SEQ ID NO: 422873 - RNA, 22 nt, Human
acuuucuaggucucaguccuuu

SEQ ID NO: 422874 - RNA, 22 nt, Human
uuaaacagucccagaggcugac

SEQ ID NO: 422875 - RNA, 22 nt, Human
gagagcugcauucucagacaca

SEQ ID NO: 422876 - RNA, 22 nt, Human
cacugaagccacuggaagagga

SEQ ID NO: 422877 - RNA, 19 nt, Human
ggcugccuggagcgagggc

SEQ ID NO: 422878 - RNA, 22 nt, Human
ccucagggaggccucuguggcu

SEQ ID NO: 422879 - RNA, 22 nt, Human
uucagauguggcuuugucaggc

SEQ ID NO: 422880 - RNA, 22 nt, Human
uuuacagucucuauagucaaaa

SEQ ID NO: 422881 - RNA, 22 nt, Human
cccagcaucccagugggcagca

SEQ ID NO: 422882 - RNA, 22 nt, Human
ccucagagaaagguauggcuga

SEQ ID NO: 422883 - RNA, 22 nt, Human
caggccaggcugcauuugcccc

SEQ ID NO: 422884 - RNA, 22 nt, Human
gacauuucaaucucauuauggg

SEQ ID NO: 422885 - RNA, 22 nt, Human
cagagccacuuggagaugagaa

SEQ ID NO: 422886 - RNA, 20 nt, Human
ugccaugguaacagagugug

SEQ ID NO: 422887 - RNA, 22 nt, Human
uggcaugauaggaggugcagaa

SEQ ID NO: 422888 - RNA, 22 nt, Human
acagguggggaggcugagguuc

SEQ ID NO: 422889 - RNA, 22 nt, Human
agcagggcucuguggagggugg

SEQ ID NO: 422890 - RNA, 22 nt, Human
ccuuugggugaauuccucucuu

SEQ ID NO: 422891 - RNA, 22 nt, Human
uccaucuguuuacuauaaagau

SEQ ID NO: 422892 - RNA, 22 nt, Human
cacccaggacaggccagaugug

SEQ ID NO: 422893 - RNA, 22 nt, Human
agguuuaugccuuggagcuggg

SEQ ID NO: 422894 - RNA, 22 nt, Human
cauuuagacauuugauuugggg

SEQ ID NO: 422895 - RNA, 22 nt, Human
uuugaaagucaaccuuccaguu

SEQ ID NO: 422896 - RNA, 22 nt, Human
ucagcuuugccaccagcuguaa

SEQ ID NO: 422897 - RNA, 22 nt, Human
accagccugucugagucguggg

SEQ ID NO: 422898 - RNA, 22 nt, Human
ggcuccuggggaggugagcuug

SEQ ID NO: 422899 - RNA, 22 nt, Human
aagauacauaaagguagagucu

SEQ ID NO: 422900 - RNA, 22 nt, Human
ggaggccaaggcgggcggauca

SEQ ID NO: 422901 - RNA, 20 nt, Human
aggcacuggauuucuuauau

SEQ ID NO: 422902 - RNA, 22 nt, Human
ggcaccuggauguagcagugaa

SEQ ID NO: 422903 - RNA, 22 nt, Human
gaggcucagggaguauaugaau

SEQ ID NO: 422904 - RNA, 22 nt, Human
agggacuauuuacccaucucac

SEQ ID NO: 422905 - RNA, 22 nt, Human
ggcgcucaguguugccccagag

SEQ ID NO: 422906 - RNA, 22 nt, Human
agacuguaauugacaugucagc

SEQ ID NO: 422907 - RNA, 17 nt, Human
cagugaggccuuuccuc

SEQ ID NO: 422908 - RNA, 20 nt, Human
gccuggcacccggggcuggc

SEQ ID NO: 422909 - RNA, 22 nt, Human
ccuguacauggccaucuuuacc

SEQ ID NO: 422910 - RNA, 22 nt, Human
ggcugccugaacuuuggggaaa

SEQ ID NO: 422911 - RNA, 23 nt, Human
cccuguagcccaggacaggcuuu

SEQ ID NO: 422912 - RNA, 22 nt, Human
uuugauuuacuggauauucuca

SEQ ID NO: 422913 - RNA, 22 nt, Human
caagagcuacccugugccauau

SEQ ID NO: 422914 - RNA, 22 nt, Human
ccaggugugcucugcaguggau

SEQ ID NO: 422915 - RNA, 22 nt, Human
ucugaaaguaucuggaucuuuu

SEQ ID NO: 422916 - RNA, 22 nt, Human
aguaaugugccugaaauacuug

SEQ ID NO: 422917 - RNA, 22 nt, Human
caagaacauugugaucacuuca

SEQ ID NO: 422918 - RNA, 20 nt, Human
uccaguuuuggagacauucu

SEQ ID NO: 422919 - RNA, 22 nt, Human
augggcaguaacaguggcaguc

SEQ ID NO: 422920 - RNA, 22 nt, Human
ggcauauguagcguguguucug

SEQ ID NO: 422921 - RNA, 22 nt, Human
ccugagagcgaguggccucaug

SEQ ID NO: 422922 - RNA, 22 nt, Human
caguggcacccacgggcugggc

SEQ ID NO: 422923 - RNA, 22 nt, Human
gggugcagggucuccagcagcu

SEQ ID NO: 422924 - RNA, 22 nt, Human
ccaggaagcggugagggcugcc

SEQ ID NO: 422925 - RNA, 22 nt, Human
agcagagguuuguuggaaaccu

SEQ ID NO: 422926 - RNA, 22 nt, Human
cagcugagaagugauagcugca

SEQ ID NO: 422927 - RNA, 22 nt, Human
ucucaguggcuuccucacuuuu

SEQ ID NO: 422928 - RNA, 22 nt, Human
cagccaggagcucccccugcuc

SEQ ID NO: 422929 - RNA, 22 nt, Human
cagcagcuuugccaagucagcc

SEQ ID NO: 422930 - RNA, 22 nt, Human
uagaaaguaaaucaguuuuauu

SEQ ID NO: 422931 - RNA, 22 nt, Human
ugcuggaggccugacuguguuu

SEQ ID NO: 422932 - RNA, 23 nt, Human
gggcagguuuuuauaggcuucag

SEQ ID NO: 422933 - RNA, 23 nt, Human
ucagagagcuguugagagcugcc

SEQ ID NO: 422934 - RNA, 22 nt, Human
augccacugacauggacaauuu

SEQ ID NO: 422935 - RNA, 22 nt, Human
cagucuggaggucagcuggcuu

SEQ ID NO: 422936 - RNA, 22 nt, Human
cagagcuggagggaacccuggc

SEQ ID NO: 422937 - RNA, 22 nt, Human
cagcuuuauuaaugauugucuu

SEQ ID NO: 422938 - RNA, 22 nt, Human
uuagaaaaaggcuguggucuua

SEQ ID NO: 422939 - RNA, 22 nt, Human
acaggcuucucacagaaaaggg

SEQ ID NO: 422940 - RNA, 19 nt, Human
ccagucccauacaggagau

SEQ ID NO: 422941 - RNA, 22 nt, Human
cugggcacauuuugacuagugu

SEQ ID NO: 422942 - RNA, 22 nt, Human
cucaggauuuacuaauuucaag

SEQ ID NO: 422943 - RNA, 22 nt, Human
agggccagcacuccuggcagga

SEQ ID NO: 422944 - RNA, 22 nt, Human
gcagugggaagguuggcacaug

SEQ ID NO: 422945 - RNA, 22 nt, Human
ugggaggaaugucacugagcca

SEQ ID NO: 422946 - RNA, 22 nt, Human
cuggagcugucuucacaggccu

SEQ ID NO: 422947 - RNA, 22 nt, Human
gagggucccugcucagggccag

SEQ ID NO: 422948 - RNA, 22 nt, Human
uuucuguaauuaaaagggcagg

SEQ ID NO: 422949 - RNA, 22 nt, Human
ugcagggacaggcucuggggau

SEQ ID NO: 422950 - RNA, 22 nt, Human
aagucuggaagucucaguuuuc

SEQ ID NO: 422951 - RNA, 22 nt, Human
uguauuuuuagaccuuuagacc

SEQ ID NO: 422952 - RNA, 22 nt, Human
auggaaagcuaagccauuuacc

SEQ ID NO: 422953 - RNA, 22 nt, Human
acuccagggcuccaucccuugu

SEQ ID NO: 422954 - RNA, 22 nt, Human
uucagucuccucauuuuacaaa

SEQ ID NO: 422955 - RNA, 22 nt, Human
gaagcccacguuuggugaugua

SEQ ID NO: 422956 - RNA, 22 nt, Human
aucaggaagaagaauguguugg

SEQ ID NO: 422957 - RNA, 21 nt, Human
ccuccaggugauuccgugcuc

SEQ ID NO: 422958 - RNA, 22 nt, Human
ucaaagucauggcaggcucaga

SEQ ID NO: 422959 - RNA, 22 nt, Human
gacagggcauggugcagaguuc

SEQ ID NO: 422960 - RNA, 19 nt, Human
acccucucagugccugagg

SEQ ID NO: 422961 - RNA, 22 nt, Human
aauguguguauuucuaggcgag

SEQ ID NO: 422962 - RNA, 22 nt, Human
gaggcugcccaacuggagugga

SEQ ID NO: 422963 - RNA, 22 nt, Human
uggccugggccggcagauauac

SEQ ID NO: 422964 - RNA, 22 nt, Human
cauugaaaaacguugacugagu

SEQ ID NO: 422965 - RNA, 22 nt, Human
agagcuggcugguagcccugau

SEQ ID NO: 422966 - RNA, 22 nt, Human
aggaccaguaugagagcaucug

SEQ ID NO: 422967 - RNA, 22 nt, Human
aguuuuuccguggcuacgauaa

SEQ ID NO: 422968 - RNA, 22 nt, Human
guccugggcccaggggcugccu

SEQ ID NO: 422969 - RNA, 20 nt, Human
ccaggccugggccugcucua

SEQ ID NO: 422970 - RNA, 22 nt, Human
gaaugugucacccugucccaug

SEQ ID NO: 422971 - RNA, 22 nt, Human
agcccagcagaaaguccagccu

SEQ ID NO: 422972 - RNA, 22 nt, Human
aaguguguugacugaauugggg

SEQ ID NO: 422973 - RNA, 22 nt, Human
cugagcuuccaguuccuccagg

SEQ ID NO: 422974 - RNA, 22 nt, Human
caggcagagcaacugguccaga

SEQ ID NO: 422975 - RNA, 22 nt, Human
gagcccucucuguaggcaagua

SEQ ID NO: 422976 - RNA, 22 nt, Human
acagugaaugcccaagaaaagu

SEQ ID NO: 422977 - RNA, 17 nt, Human
ccaggugggaggugggg

SEQ ID NO: 422978 - RNA, 22 nt, Human
aaauguucccaauaugaagcug

SEQ ID NO: 422979 - RNA, 22 nt, Human
ucugucuccucugaggugccag

SEQ ID NO: 422980 - RNA, 22 nt, Human
ggggcagagagaaggaagcuug

SEQ ID NO: 422981 - RNA, 22 nt, Human
agggcugaccuaagcuccacuu

SEQ ID NO: 422982 - RNA, 22 nt, Human
ugggcagacgcuguuggaaggc

SEQ ID NO: 422983 - RNA, 22 nt, Human
gcuggagauaguaggauccaua

SEQ ID NO: 422984 - RNA, 22 nt, Human
ggaccagagcucgggcuucuca

SEQ ID NO: 422985 - RNA, 22 nt, Human
aacauacagugagcaguggacu

SEQ ID NO: 422986 - RNA, 22 nt, Human
uuugggaacucuaucauggaaa

SEQ ID NO: 422987 - RNA, 20 nt, Human
agggcagcuugaggagccgg

SEQ ID NO: 422988 - RNA, 22 nt, Human
caggagccccaggcugacaaua

SEQ ID NO: 422989 - RNA, 17 nt, Human
acacagggagagggagc

SEQ ID NO: 422990 - RNA, 22 nt, Human
uggcucagaacuacuucuaguu

SEQ ID NO: 422991 - RNA, 22 nt, Human
gggcuuggcacaugggcucagc

SEQ ID NO: 422992 - RNA, 23 nt, Human
aaacaugcagcacaugaaugcua

SEQ ID NO: 422993 - RNA, 20 nt, Human
gauuucaaagcagaguggcc

SEQ ID NO: 422994 - RNA, 22 nt, Human
cacugcuuuaaggcugaguaac

SEQ ID NO: 422995 - RNA, 22 nt, Human
uguggcuuaagaaugccuuuaa

SEQ ID NO: 422996 - RNA, 22 nt, Human
accaggcaacugugaaugggcu

SEQ ID NO: 422997 - RNA, 22 nt, Human
ggcuccuggcaucuggugggua

SEQ ID NO: 422998 - RNA, 19 nt, Human
gccugccuggguuucugag

SEQ ID NO: 422999 - RNA, 22 nt, Human
guccucaguaagagggccucug

SEQ ID NO: 423000 - RNA, 22 nt, Human
ucuagaaauuuugccuuguauu

SEQ ID NO: 423001 - RNA, 22 nt, Human
ugaaagcucugucaucauuccu

SEQ ID NO: 423002 - RNA, 21 nt, Human
gccaccucgucucggagcagc

SEQ ID NO: 423003 - RNA, 22 nt, Human
uagcuuuacaaagugcugcacc

SEQ ID NO: 423004 - RNA, 22 nt, Human
gucugucaucugagauggagug

SEQ ID NO: 423005 - RNA, 22 nt, Human
aaaaaugaaacggcugguuggc

SEQ ID NO: 423006 - RNA, 22 nt, Human
cccagccucuggauucugcccu

SEQ ID NO: 423007 - RNA, 22 nt, Human
gcagcuguggguuccaagucua

SEQ ID NO: 423008 - RNA, 22 nt, Human
ucuuugcaacucccauuuccau

SEQ ID NO: 423009 - RNA, 20 nt, Human
gugggcagaugugugcaugg

SEQ ID NO: 423010 - RNA, 22 nt, Human
ggaggccuugaggccaggagcu

SEQ ID NO: 423011 - RNA, 22 nt, Human
uaacagcucuguguggcuguaa

SEQ ID NO: 423012 - RNA, 22 nt, Human
ccucaggaaccacauugcugcu

SEQ ID NO: 423013 - RNA, 22 nt, Human
ucaguuaagaggccacggcagu

SEQ ID NO: 423014 - RNA, 22 nt, Human
cucugggcaaguuucuucauga

SEQ ID NO: 423015 - RNA, 22 nt, Human
cugggcaguuuuacaucauugc

SEQ ID NO: 423016 - RNA, 22 nt, Human
augucuuuauaaauguauaaug

SEQ ID NO: 423017 - RNA, 22 nt, Human
gggcugagcuaagcuggguuga

SEQ ID NO: 423018 - RNA, 22 nt, Human
cagcagcucccauccgcugagc

SEQ ID NO: 423019 - RNA, 22 nt, Human
aaagguaguacuucuagaaggg

SEQ ID NO: 423020 - RNA, 22 nt, Human
cuggcucucugagauauugagu

SEQ ID NO: 423021 - RNA, 22 nt, Human
aaguucaaggugauaguggcag

SEQ ID NO: 423022 - RNA, 22 nt, Human
uggcucaguuuagcagcucagu

SEQ ID NO: 423023 - RNA, 22 nt, Human
cacugcuuuuuuggcuauguac

SEQ ID NO: 423024 - RNA, 23 nt, Human
aggugccaacugagagcugagag

SEQ ID NO: 423025 - RNA, 22 nt, Human
cccagccugugacagccguccu

SEQ ID NO: 423026 - RNA, 22 nt, Human
aaaugcaugagaaaguauucug

SEQ ID NO: 423027 - RNA, 22 nt, Human
uucaggauuguguuuuuccuga

SEQ ID NO: 423028 - RNA, 23 nt, Human
aggcagugucucuuauccugucc

SEQ ID NO: 423029 - RNA, 22 nt, Human
uuauuuauggcacuguuggugg

SEQ ID NO: 423030 - RNA, 22 nt, Human
ucuggccagugaaaugcagaau

SEQ ID NO: 423031 - RNA, 22 nt, Human
ucagucucaucaacucuauucc

SEQ ID NO: 423032 - RNA, 22 nt, Human
gccuggugaaaggcagagagcg

SEQ ID NO: 423033 - RNA, 22 nt, Human
ugaggccucauaaugagauuuc

SEQ ID NO: 423034 - RNA, 22 nt, Human
ccccaggcagggccuaacagag

SEQ ID NO: 423035 - RNA, 22 nt, Human
agaagcugccuacaugaccagc

SEQ ID NO: 423036 - RNA, 22 nt, Human
agggcugcaggcaagauauggc

SEQ ID NO: 423037 - RNA, 22 nt, Human
agggcagcucucaccucuggcc

SEQ ID NO: 423038 - RNA, 22 nt, Human
gccucugcugcaagccugguug

SEQ ID NO: 423039 - RNA, 20 nt, Human
cacaggcuauaugagagcca

SEQ ID NO: 423040 - RNA, 22 nt, Human
gccugagcaggcguggaccaug

SEQ ID NO: 423041 - RNA, 21 nt, Human
agaagccaugugguggagaac

SEQ ID NO: 423042 - RNA, 22 nt, Human
gcaaaugcuaaaguguagagac

SEQ ID NO: 423043 - RNA, 20 nt, Human
caggcagaggaugcugacca

SEQ ID NO: 423044 - RNA, 22 nt, Human
uuuguacauauauaaaaucugu

SEQ ID NO: 423045 - RNA, 22 nt, Human
caagagcucccagaccugggca

SEQ ID NO: 423046 - RNA, 22 nt, Human
ggcagaaggccucccagcuccu

SEQ ID NO: 423047 - RNA, 19 nt, Human
cugccuguuauggagagaa

SEQ ID NO: 423048 - RNA, 22 nt, Human
cugcagaggguuugagcauccu

SEQ ID NO: 423049 - RNA, 23 nt, Human
ucguugaauagcaauagcacaac

SEQ ID NO: 423050 - RNA, 22 nt, Human
uuuaaugugagucccuuucaag

SEQ ID NO: 423051 - RNA, 22 nt, Human
cugugugugucugcagcauacu

SEQ ID NO: 423052 - RNA, 22 nt, Human
cacagaggaaaggcaguuggua

SEQ ID NO: 423053 - RNA, 22 nt, Human
gaaacaugucugacaauuuacc

SEQ ID NO: 423054 - RNA, 22 nt, Human
ggcagaggaagcuggaaguggg

SEQ ID NO: 423055 - RNA, 22 nt, Human
ggcagggcaggaaagucaggaa

SEQ ID NO: 423056 - RNA, 22 nt, Human
cugcagaguggagccucggcug

SEQ ID NO: 423057 - RNA, 22 nt, Human
ugggcaggcaagugaauaccuu

SEQ ID NO: 423058 - RNA, 20 nt, Human
cagggccacgcuccaaggca

SEQ ID NO: 423059 - RNA, 22 nt, Human
cuguggaguggggaguacuggu

SEQ ID NO: 423060 - RNA, 22 nt, Human
ccuccugggcuccugucugcac

SEQ ID NO: 423061 - RNA, 22 nt, Human
ucacaaaagcuuuugaauuugg

SEQ ID NO: 423062 - RNA, 21 nt, Human
acagcagggcuggcaugacag

SEQ ID NO: 423063 - RNA, 22 nt, Human
agagccuguacuuuucugugaa

SEQ ID NO: 423064 - RNA, 21 nt, Human
uccuguaagcuuggguggcuc

SEQ ID NO: 423065 - RNA, 22 nt, Human
ccaggugugccagcagggacug

SEQ ID NO: 423066 - RNA, 22 nt, Human
ccuaggcccuaggcuuccauca

SEQ ID NO: 423067 - RNA, 22 nt, Human
aaaugugugcacaaagacagcu

SEQ ID NO: 423068 - RNA, 22 nt, Human
ugccuggguguaaagggccaac

SEQ ID NO: 423069 - RNA, 22 nt, Human
aauugcuaaagauuauguuuuc

SEQ ID NO: 423070 - RNA, 20 nt, Human
ugcagggcugccucccagcu

SEQ ID NO: 423071 - RNA, 22 nt, Human
uggcucagagagggagugugga

SEQ ID NO: 423072 - RNA, 19 nt, Human
acauuuaaauucagaucuc

SEQ ID NO: 423073 - RNA, 22 nt, Human
guggccucaugucuauaaagag

SEQ ID NO: 423074 - RNA, 22 nt, Human
cugaagaggacgcagcagcaag

SEQ ID NO: 423075 - RNA, 22 nt, Human
uugaaaggcacaggcaccuggg

SEQ ID NO: 423076 - RNA, 22 nt, Human
uuucuguauuuaaaagaucugg

SEQ ID NO: 423077 - RNA, 22 nt, Human
accagggcaaauguuuguacuc

SEQ ID NO: 423078 - RNA, 21 nt, Human
ggagaaggacaauguugagua

SEQ ID NO: 423079 - RNA, 22 nt, Human
auggcucauuuaucuugcagcc

SEQ ID NO: 423080 - RNA, 22 nt, Human
cucaggauccaucuccugcccu

SEQ ID NO: 423081 - RNA, 22 nt, Human
aagagcaucuauuucacagugg

SEQ ID NO: 423082 - RNA, 22 nt, Human
cacugugucaguuugguuagac

SEQ ID NO: 423083 - RNA, 22 nt, Human
uacaaaaguaauuacgguuuuu

SEQ ID NO: 423084 - RNA, 22 nt, Human
agcagggguaacagaaggaaag

SEQ ID NO: 423085 - RNA, 22 nt, Human
aucaggauagugguuaccuggg

SEQ ID NO: 423086 - RNA, 22 nt, Human
caggcagcaucagucugcugua

SEQ ID NO: 423087 - RNA, 22 nt, Human
aguuauuucaguaacauaauag

SEQ ID NO: 423088 - RNA, 22 nt, Human
uccugcagaucaaagccuuuga

SEQ ID NO: 423089 - RNA, 21 nt, Human
aaugugugcuauuuaucuuuu

SEQ ID NO: 423090 - RNA, 22 nt, Human
ugguuucccauuaucugcagga

SEQ ID NO: 423091 - RNA, 22 nt, Human
uggugguuaugcgcuuuguggg

SEQ ID NO: 423092 - RNA, 22 nt, Human
aggguggccaugagggagagau

SEQ ID NO: 423093 - RNA, 22 nt, Human
aacagcaugcuggguaacauug

SEQ ID NO: 423094 - RNA, 22 nt, Human
uccagggaagagcagaggcuac

SEQ ID NO: 423095 - RNA, 20 nt, Human
cucuggcuccgcgugaccgc

SEQ ID NO: 423096 - RNA, 22 nt, Human
acacauuuacauguuuacguau

SEQ ID NO: 423097 - RNA, 22 nt, Human
ugcaccauguaaguggccacgu

SEQ ID NO: 423098 - RNA, 22 nt, Human
uaagaacaagcuggggguucca

SEQ ID NO: 423099 - RNA, 22 nt, Human
uauaucaccaaaaacaguucug

SEQ ID NO: 423100 - RNA, 22 nt, Human
uagggcucugagaguucagccu

SEQ ID NO: 423101 - RNA, 22 nt, Human
uuugcauuucuaaugagcuccg

SEQ ID NO: 423102 - RNA, 22 nt, Human
cccaggcacucuuggucauuuu

SEQ ID NO: 423103 - RNA, 22 nt, Human
aagugccugaccuagccuggag

SEQ ID NO: 423104 - RNA, 22 nt, Human
caggggacauuaaagcuccaua

SEQ ID NO: 423105 - RNA, 22 nt, Human
cagaguguauucugcaguugca

SEQ ID NO: 423106 - RNA, 22 nt, Human
aggcagguccccuggaaggcac

SEQ ID NO: 423107 - RNA, 22 nt, Human
caugaguucaucugcuucucuu

SEQ ID NO: 423108 - RNA, 22 nt, Human
gggagggaaggaggcgccgugu

SEQ ID NO: 423109 - RNA, 22 nt, Human
cauuuacagugagaguuuuuac

SEQ ID NO: 423110 - RNA, 19 nt, Human
cugaggugcaguaagaggc

SEQ ID NO: 423111 - RNA, 22 nt, Human
ugccaggcuuagagcaggggcu

SEQ ID NO: 423112 - RNA, 23 nt, Human
cccugcagucagggugagauggu

SEQ ID NO: 423113 - RNA, 22 nt, Human
ucaggcuggaaugcaguggggc

SEQ ID NO: 423114 - RNA, 22 nt, Human
uacaguauuaugagugauugaa

SEQ ID NO: 423115 - RNA, 22 nt, Human
gcuggcagagagcuggugagga

SEQ ID NO: 423116 - RNA, 22 nt, Human
agugugaccuuauuuggaaaca

SEQ ID NO: 423117 - RNA, 22 nt, Human
ucaggcaguagaauugcuugaa

SEQ ID NO: 423118 - RNA, 22 nt, Human
aacuguaauuuuuacauaguaa

SEQ ID NO: 423119 - RNA, 22 nt, Human
augggaggcaggcucagaaccg

SEQ ID NO: 423120 - RNA, 22 nt, Human
cuuucagagguuacucaggaaa

SEQ ID NO: 423121 - RNA, 22 nt, Human
aacaggcaacaguugacucuga

SEQ ID NO: 423122 - RNA, 22 nt, Human
gcugucacauuuggagcacugg

SEQ ID NO: 423123 - RNA, 23 nt, Human
ggagccuggcauaugagacgcau

SEQ ID NO: 423124 - RNA, 22 nt, Human
gcacccaggccggcgacugcag

SEQ ID NO: 423125 - RNA, 22 nt, Human
uguggcaggaagagcuucugag

SEQ ID NO: 423126 - RNA, 22 nt, Human
guucuuaagaccacaauaaaaa

SEQ ID NO: 423127 - RNA, 17 nt, Human
ugagcaguagaagaugc

SEQ ID NO: 423128 - RNA, 22 nt, Human
cuccuuccccuacucagcaucc

SEQ ID NO: 423129 - RNA, 22 nt, Human
gagggcagagucuaaugaugca

SEQ ID NO: 423130 - RNA, 21 nt, Human
ugcccacagcaaaugcagagg

SEQ ID NO: 423131 - RNA, 22 nt, Human
uagaggcacccuggaggagacu

SEQ ID NO: 423132 - RNA, 23 nt, Human
cuggggcuuucaaaucugggcag

SEQ ID NO: 423133 - RNA, 22 nt, Human
ucagcuuuggucacauugaguu

SEQ ID NO: 423134 - RNA, 22 nt, Human
ugcuuuauaggggauugcaggc

SEQ ID NO: 423135 - RNA, 22 nt, Human
gcucccagguucuugggccuug

SEQ ID NO: 423136 - RNA, 22 nt, Human
acgugcaggaucugguuggcga

SEQ ID NO: 423137 - RNA, 22 nt, Human
agcagugggugacagagcugag

SEQ ID NO: 423138 - RNA, 22 nt, Human
ucucuguacaguacaugccgug

SEQ ID NO: 423139 - RNA, 22 nt, Human
augcuguguccuagugaaagaa

SEQ ID NO: 423140 - RNA, 22 nt, Human
uugaauucauuucucauugagu

SEQ ID NO: 423141 - RNA, 22 nt, Human
ccaguggacaauuucugaggaa

SEQ ID NO: 423142 - RNA, 22 nt, Human
uucaggauucucucccauuuac

SEQ ID NO: 423143 - RNA, 22 nt, Human
ugggccugauucuugaauccug

SEQ ID NO: 423144 - RNA, 21 nt, Human
aaagaacaggcagauguucuu

SEQ ID NO: 423145 - RNA, 22 nt, Human
cucuugggagugcucuggagaa

SEQ ID NO: 423146 - RNA, 22 nt, Human
uauacagaaccgccugaagucu

SEQ ID NO: 423147 - RNA, 22 nt, Human
guuuauuagaguuuucugucug

SEQ ID NO: 423148 - RNA, 22 nt, Human
uacagggguaacaguggggaau

SEQ ID NO: 423149 - RNA, 22 nt, Human
gagcugaguuaccuccagauca

SEQ ID NO: 423150 - RNA, 22 nt, Human
cuggagcauccaugcccagggu

SEQ ID NO: 423151 - RNA, 22 nt, Human
gggcuggcaggaccugggcuga

SEQ ID NO: 423152 - RNA, 22 nt, Human
agucugucagucauucuaacaa

SEQ ID NO: 423153 - RNA, 22 nt, Human
cagcugccacaggacuuucuga

SEQ ID NO: 423154 - RNA, 18 nt, Human
ucugucuguacaaguauc

SEQ ID NO: 423155 - RNA, 22 nt, Human
ccucagggucugaggagaccgu

SEQ ID NO: 423156 - RNA, 22 nt, Human
gcuuccugagaaacaaucugau

SEQ ID NO: 423157 - RNA, 22 nt, Human
acaggcugcugggcuccgugcu

SEQ ID NO: 423158 - RNA, 22 nt, Human
ccacugggggcugcaggcacuc

SEQ ID NO: 423159 - RNA, 20 nt, Human
aaggcacuaugucugcuagc

SEQ ID NO: 423160 - RNA, 22 nt, Human
acaugcuuucuagguccuucug

SEQ ID NO: 423161 - RNA, 22 nt, Human
guugaaagcuuuucauuuaguu

SEQ ID NO: 423162 - RNA, 22 nt, Human
aguggaccagaagacugaagcu

SEQ ID NO: 423163 - RNA, 22 nt, Human
agcagaggacaguucuuaggaa

SEQ ID NO: 423164 - RNA, 22 nt, Human
cuuaacagauacaucugugguu

SEQ ID NO: 423165 - RNA, 22 nt, Human
gcagagcccuggggguauggug

SEQ ID NO: 423166 - RNA, 22 nt, Human
ccagagaguaggaggcauuauu

SEQ ID NO: 423167 - RNA, 22 nt, Human
ucuggccaggauggcaagacca

SEQ ID NO: 423168 - RNA, 22 nt, Human
uccaguggguugcugagggagg

SEQ ID NO: 423169 - RNA, 22 nt, Human
ggaaggagggcggcaaugauga

SEQ ID NO: 423170 - RNA, 20 nt, Human
cagucccaauccagggccag

SEQ ID NO: 423171 - RNA, 22 nt, Human
auaacagaguugggaagugaaa

SEQ ID NO: 423172 - RNA, 22 nt, Human
agaugguuuugucuuuaugauu

SEQ ID NO: 423173 - RNA, 22 nt, Human
ggaggccaguccuggccgggcu

SEQ ID NO: 423174 - RNA, 22 nt, Human
cuccucuggcuuccuggaggca

SEQ ID NO: 423175 - RNA, 22 nt, Human
ugagccugaguucaaggcugca

SEQ ID NO: 423176 - RNA, 22 nt, Human
uacaugcucaguaacuuucagu

SEQ ID NO: 423177 - RNA, 22 nt, Human
auucagcaguuccugcuucagu

SEQ ID NO: 423178 - RNA, 22 nt, Human
gcucagagcuugaaguuccacu

SEQ ID NO: 423179 - RNA, 22 nt, Human
agcugcagcguucauuuuucca

SEQ ID NO: 423180 - RNA, 22 nt, Human
gggcagugacaaaggggaugaa

SEQ ID NO: 423181 - RNA, 22 nt, Human
cuuccucacggugcaacaggaa

SEQ ID NO: 423182 - RNA, 22 nt, Human
gcaaggcagcgcggaguagcua

SEQ ID NO: 423183 - RNA, 19 nt, Human
gggcuuggggcugaagccu

SEQ ID NO: 423184 - RNA, 22 nt, Human
ugcucccagggacucuggcugg

SEQ ID NO: 423185 - RNA, 22 nt, Human
acacugaagagcacuuucaaag

SEQ ID NO: 423186 - RNA, 22 nt, Human
caaaggcuucaucucagagcag

SEQ ID NO: 423187 - RNA, 22 nt, Human
auaauguagguauguguauuua

SEQ ID NO: 423188 - RNA, 22 nt, Human
accaguccgcggagcuccgggg

SEQ ID NO: 423189 - RNA, 22 nt, Human
agcagggccugagugaccuaac

SEQ ID NO: 423190 - RNA, 22 nt, Human
agggagcuuccgaacuacagcu

SEQ ID NO: 423191 - RNA, 22 nt, Human
aggcaguuuauccccagagccu

SEQ ID NO: 423192 - RNA, 22 nt, Human
ugcagggaaaguguuggcagca

SEQ ID NO: 423193 - RNA, 22 nt, Human
guuagggaucaggaacaagagc

SEQ ID NO: 423194 - RNA, 22 nt, Human
ccagcccuguaaggaugaggca

SEQ ID NO: 423195 - RNA, 22 nt, Human
ugccagagaagacccagucacu

SEQ ID NO: 423196 - RNA, 22 nt, Human
ccugcucugguuuagucagucu

SEQ ID NO: 423197 - RNA, 22 nt, Human
acuuggagagcauugcugggga

SEQ ID NO: 423198 - RNA, 22 nt, Human
uguucuuucaguuagacacagu

SEQ ID NO: 423199 - RNA, 22 nt, Human
ggaggcccagagaggugaagug

SEQ ID NO: 423200 - RNA, 20 nt, Human
ccugccuguguuugugauga

SEQ ID NO: 423201 - RNA, 22 nt, Human
agaauucuccuucagggcagga

SEQ ID NO: 423202 - RNA, 22 nt, Human
cuggccuggcagggagggcaug

SEQ ID NO: 423203 - RNA, 22 nt, Human
agguggggaaaccagcgauccc

SEQ ID NO: 423204 - RNA, 22 nt, Human
gcagggacaccuuugugaagcu

SEQ ID NO: 423205 - RNA, 22 nt, Human
guguccagggccguguugucuu

SEQ ID NO: 423206 - RNA, 22 nt, Human
cagcccaaagccccaggcuaga

SEQ ID NO: 423207 - RNA, 22 nt, Human
ucggggucuuugacacgcucug

SEQ ID NO: 423208 - RNA, 22 nt, Human
uaaaaaguagugagaauggcgc

SEQ ID NO: 423209 - RNA, 20 nt, Human
ccuggagccuggaaggaguc

SEQ ID NO: 423210 - RNA, 22 nt, Human
uuucauguuuucuuaaauggca

SEQ ID NO: 423211 - RNA, 22 nt, Human
cugggugguucuaacuguugau

SEQ ID NO: 423212 - RNA, 22 nt, Human
uaauuucuagggacuaaggugc

SEQ ID NO: 423213 - RNA, 22 nt, Human
aaaugcuagggagaaacucucc

SEQ ID NO: 423214 - RNA, 22 nt, Human
ucuuugcaugugcuucuuggcc

SEQ ID NO: 423215 - RNA, 22 nt, Human
ugcagggccuugggaugugucc

SEQ ID NO: 423216 - RNA, 19 nt, Human
gggcucuggccucaguggg

SEQ ID NO: 423217 - RNA, 19 nt, Human
guuucauuaagauaggaaa

SEQ ID NO: 423218 - RNA, 22 nt, Human
cuuggggcugucacucuggcau

SEQ ID NO: 423219 - RNA, 23 nt, Human
ugagcaucacaggagaaccaggc

SEQ ID NO: 423220 - RNA, 22 nt, Human
ccucacucugcacccugcagca

SEQ ID NO: 423221 - RNA, 22 nt, Human
acaaagguggaccauguggcuu

SEQ ID NO: 423222 - RNA, 22 nt, Human
cagcugccuucugcgggaaguc

SEQ ID NO: 423223 - RNA, 22 nt, Human
uggagcaggugggaugucguga

SEQ ID NO: 423224 - RNA, 22 nt, Human
uuugcauuuauaaguuggugga

SEQ ID NO: 423225 - RNA, 22 nt, Human
cacacagaugguaagggaggga

SEQ ID NO: 423226 - RNA, 22 nt, Human
aaugggagagaacacaaagucc

SEQ ID NO: 423227 - RNA, 22 nt, Human
cagcccagcagucuuagccugc

SEQ ID NO: 423228 - RNA, 22 nt, Human
ucucacuggguauaaaugagua

SEQ ID NO: 423229 - RNA, 22 nt, Human
uggcagaguucgcugugccuuu

SEQ ID NO: 423230 - RNA, 22 nt, Human
cugggccauggaagucucugcc

SEQ ID NO: 423231 - RNA, 22 nt, Human
auuuccuauagauauggugagu

SEQ ID NO: 423232 - RNA, 22 nt, Human
agggcagacuaggauggaagug

SEQ ID NO: 423233 - RNA, 22 nt, Human
cagcuccugccugggcagcugu

SEQ ID NO: 423234 - RNA, 22 nt, Human
ugcuggggagugauugaccauc

SEQ ID NO: 423235 - RNA, 22 nt, Human
cuccucccucuuugccacacau

SEQ ID NO: 423236 - RNA, 22 nt, Human
aacuuaaacccacucauguaga

SEQ ID NO: 423237 - RNA, 22 nt, Human
aaggaaccuggaguagagggag

SEQ ID NO: 423238 - RNA, 22 nt, Human
ugaggaagggugugacggcacc

SEQ ID NO: 423239 - RNA, 22 nt, Human
caggauggagggagggcuguua

SEQ ID NO: 423240 - RNA, 22 nt, Human
uuauccaaacuggugaaucauu

SEQ ID NO: 423241 - RNA, 22 nt, Human
aggaggugacagccugcaucug

SEQ ID NO: 423242 - RNA, 22 nt, Human
gcagcuuugucacggagugucg

SEQ ID NO: 423243 - RNA, 22 nt, Human
agucuucagagaaauuaacucu

SEQ ID NO: 423244 - RNA, 17 nt, Human
gagccacccugugcgag

SEQ ID NO: 423245 - RNA, 22 nt, Human
augcaguacugauacaugccac

SEQ ID NO: 423246 - RNA, 22 nt, Human
ucucaggggccuggaguccugg

SEQ ID NO: 423247 - RNA, 22 nt, Human
gaaacuguauguaguuuuuggg

SEQ ID NO: 423248 - RNA, 22 nt, Human
uggcagaaguacacaagcaugc

SEQ ID NO: 423249 - RNA, 18 nt, Human
agaguguucucagugaaa

SEQ ID NO: 423250 - RNA, 22 nt, Human
cuuugaaagcucccaggacuua

SEQ ID NO: 423251 - RNA, 22 nt, Human
caagggcagaggcagggccccg

SEQ ID NO: 423252 - RNA, 22 nt, Human
caggcagcauuuacucugauga

SEQ ID NO: 423253 - RNA, 22 nt, Human
gccacugcacuccagcccaggc

SEQ ID NO: 423254 - RNA, 22 nt, Human
gcacagggaggcuggccuggcc

SEQ ID NO: 423255 - RNA, 22 nt, Human
aaaaauguuaucuacuguccga

SEQ ID NO: 423256 - RNA, 22 nt, Human
ugguggcagcugagugucaggu

SEQ ID NO: 423257 - RNA, 22 nt, Human
ccacagggucagccacucugca

SEQ ID NO: 423258 - RNA, 23 nt, Human
gcugcagcuguggauguucucag

SEQ ID NO: 423259 - RNA, 22 nt, Human
ugaucaguguugguucuaucua

SEQ ID NO: 423260 - RNA, 22 nt, Human
aggcugagacugugcauuagug

SEQ ID NO: 423261 - RNA, 22 nt, Human
ggaggccauaguuugggaguca

SEQ ID NO: 423262 - RNA, 22 nt, Human
gacucagugauuugacaugccu

SEQ ID NO: 423263 - RNA, 22 nt, Human
agcuuuauuugucauucacggc

SEQ ID NO: 423264 - RNA, 22 nt, Human
caggugggagcggagacugauu

SEQ ID NO: 423265 - RNA, 22 nt, Human
ccagcuccaggacugggagcug

SEQ ID NO: 423266 - RNA, 22 nt, Human
acagagguaggacaugagauau

SEQ ID NO: 423267 - RNA, 23 nt, Human
ugcugggguaguuuguggcacag

SEQ ID NO: 423268 - RNA, 22 nt, Human
acagagcacugcccugugccgc

SEQ ID NO: 423269 - RNA, 22 nt, Human
aucuaagauguauugagcacuu

SEQ ID NO: 423270 - RNA, 22 nt, Human
cacaucuucuuaacuccaaagu

SEQ ID NO: 423271 - RNA, 22 nt, Human
ccucacuuuccuuucuccuggg

SEQ ID NO: 423272 - RNA, 22 nt, Human
gaaagccauagcccagcuuuac

SEQ ID NO: 423273 - RNA, 22 nt, Human
ucagcaggcgguuccuuguggg

SEQ ID NO: 423274 - RNA, 22 nt, Human
gguggguauugaauacaggugu

SEQ ID NO: 423275 - RNA, 22 nt, Human
cugggccugggaggccaggucu

SEQ ID NO: 423276 - RNA, 22 nt, Human
cccaggcaucccauuaaggagc

SEQ ID NO: 423277 - RNA, 22 nt, Human
uggggugggcaugcgcuguccu

SEQ ID NO: 423278 - RNA, 22 nt, Human
uccugcagugugucuccugcac

SEQ ID NO: 423279 - RNA, 22 nt, Human
ggugcagaaggaagggagcugg

SEQ ID NO: 423280 - RNA, 22 nt, Human
agccaucauuucugucacuggc

SEQ ID NO: 423281 - RNA, 22 nt, Human
caccugagugucaguauucuca

SEQ ID NO: 423282 - RNA, 19 nt, Human
agagaaggauccuaugguu

SEQ ID NO: 423283 - RNA, 22 nt, Human
ucauuuccucaaauucaagguu

SEQ ID NO: 423284 - RNA, 22 nt, Human
caguguuccaggcggcagugaa

SEQ ID NO: 423285 - RNA, 22 nt, Human
acaagauuuuaugacucuuuuu

SEQ ID NO: 423286 - RNA, 22 nt, Human
gaaggaagugcucauacuaguu

SEQ ID NO: 423287 - RNA, 17 nt, Human
uagcugccccgaaugcu

SEQ ID NO: 423288 - RNA, 22 nt, Human
acauugaugaaaagguaucauu

SEQ ID NO: 423289 - RNA, 22 nt, Human
ucaucuaagagucuuacauuua

SEQ ID NO: 423290 - RNA, 22 nt, Human
aaaugcacagguuuuaaauccu

SEQ ID NO: 423291 - RNA, 22 nt, Human
augcuguguuugagaaccuagg

SEQ ID NO: 423292 - RNA, 22 nt, Human
ucucccacagucucccauggcu

SEQ ID NO: 423293 - RNA, 22 nt, Human
auguuacauaguccuuauuugu

SEQ ID NO: 423294 - RNA, 22 nt, Human
agggucagagucaggugcagua

SEQ ID NO: 423295 - RNA, 22 nt, Human
auacaguauuaccuguucagga

SEQ ID NO: 423296 - RNA, 22 nt, Human
cagaaccaggaacugauggaga

SEQ ID NO: 423297 - RNA, 22 nt, Human
augugcaugcacuuacaugugu

SEQ ID NO: 423298 - RNA, 22 nt, Human
caggccugcaggaaaggcuccc

SEQ ID NO: 423299 - RNA, 22 nt, Human
gagaaagauggaaucuuacagg

SEQ ID NO: 423300 - RNA, 22 nt, Human
aucaguuucacuugcuugcaaa

SEQ ID NO: 423301 - RNA, 19 nt, Human
gaaaggcugcugcuaccug

SEQ ID NO: 423302 - RNA, 22 nt, Human
ggugggcacauucagucucugu

SEQ ID NO: 423303 - RNA, 22 nt, Human
ugucccaguucccaggguugcu

SEQ ID NO: 423304 - RNA, 22 nt, Human
aggaaagggguagguguggacg

SEQ ID NO: 423305 - RNA, 22 nt, Human
cucucugguuucagcgaagggg

SEQ ID NO: 423306 - RNA, 22 nt, Human
gcugucugacuccaaguuggag

SEQ ID NO: 423307 - RNA, 22 nt, Human
gagaaggacuacacaucuggcc

SEQ ID NO: 423308 - RNA, 22 nt, Human
ucaggcaggcucagaggaaaac

SEQ ID NO: 423309 - RNA, 20 nt, Human
gcacugaaauucaauguuug

SEQ ID NO: 423310 - RNA, 22 nt, Human
aaauguguuccuuugcuacaga

SEQ ID NO: 423311 - RNA, 22 nt, Human
agcaggguuccaggaguugcag

SEQ ID NO: 423312 - RNA, 22 nt, Human
agggcugcccagugugagagcu

SEQ ID NO: 423313 - RNA, 22 nt, Human
ucccaggcugggggccugaagu

SEQ ID NO: 423314 - RNA, 22 nt, Human
ugucacuucaggaaugcaggga

SEQ ID NO: 423315 - RNA, 22 nt, Human
gcagacagccagacugcacugg

SEQ ID NO: 423316 - RNA, 18 nt, Human
gggcacuggggacuggag

SEQ ID NO: 423317 - RNA, 22 nt, Human
cucagaguucuccugggaggug

SEQ ID NO: 423318 - RNA, 22 nt, Human
uccugugccuccaccugcuccg

SEQ ID NO: 423319 - RNA, 22 nt, Human
uggcugagggggcaguucagga

SEQ ID NO: 423320 - RNA, 20 nt, Human
ucccaagggcugagaggauc

SEQ ID NO: 423321 - RNA, 22 nt, Human
uuaugggagcaauuggggaggu

SEQ ID NO: 423322 - RNA, 21 nt, Human
ugcaggcaggcagagaugcug

SEQ ID NO: 423323 - RNA, 22 nt, Human
acacugugucuagcauuuuaca

SEQ ID NO: 423324 - RNA, 22 nt, Human
aggcaaaauuacaaaguuauua

SEQ ID NO: 423325 - RNA, 18 nt, Human
cugugcagcaaacugagc

SEQ ID NO: 423326 - RNA, 22 nt, Human
ugacacaggcagcucccagcac

SEQ ID NO: 423327 - RNA, 22 nt, Human
cggggcuguagcacagcugagc

SEQ ID NO: 423328 - RNA, 22 nt, Human
gccagcucagugccaggccccu

SEQ ID NO: 423329 - RNA, 18 nt, Human
ugaauagggguuugcaga

SEQ ID NO: 423330 - RNA, 22 nt, Human
cuggagccugcaguuuucacuu

SEQ ID NO: 423331 - RNA, 22 nt, Human
cucagaguccccaguggguuug

SEQ ID NO: 423332 - RNA, 22 nt, Human
uucuuucccuuccagcagcucc

SEQ ID NO: 423333 - RNA, 22 nt, Human
auaaaaaugagggcgguagcua

SEQ ID NO: 423334 - RNA, 22 nt, Human
gugggcuggacccuccugcucc

SEQ ID NO: 423335 - RNA, 22 nt, Human
uuuugaaagaguccugcuacag

SEQ ID NO: 423336 - RNA, 22 nt, Human
caauguguguguuuuucucaac

SEQ ID NO: 423337 - RNA, 22 nt, Human
agccacagcauguguguaugua

SEQ ID NO: 423338 - RNA, 22 nt, Human
cuggagcagcagguggccaggg

SEQ ID NO: 423339 - RNA, 22 nt, Human
aggcugccaaagcuucugucuc

SEQ ID NO: 423340 - RNA, 19 nt, Human
cuguccuuggcugcacugu

SEQ ID NO: 423341 - RNA, 22 nt, Human
ggcaccaggcugggcauaggcc

SEQ ID NO: 423342 - RNA, 22 nt, Human
ucugggagcacacgcagugauc

SEQ ID NO: 423343 - RNA, 22 nt, Human
cugggccagucucggccgcucu

SEQ ID NO: 423344 - RNA, 22 nt, Human
gcauuuguguucuuccuagagc

SEQ ID NO: 423345 - RNA, 22 nt, Human
uccuugaaaaucuugguuuaga

SEQ ID NO: 423346 - RNA, 22 nt, Human
gggcugagcacauacugacagc

SEQ ID NO: 423347 - RNA, 22 nt, Human
ugaggcagaaauuccuguuuuc

SEQ ID NO: 423348 - RNA, 22 nt, Human
aauuccugucuuaacaguucug

SEQ ID NO: 423349 - RNA, 22 nt, Human
acagggcagguggcuacugguc

SEQ ID NO: 423350 - RNA, 20 nt, Human
aagcagaagcugcucucagc

SEQ ID NO: 423351 - RNA, 22 nt, Human
cuuuauguccaccagacugcaa

SEQ ID NO: 423352 - RNA, 22 nt, Human
uugggacagaaaaggagaagau

SEQ ID NO: 423353 - RNA, 20 nt, Human
agaaucugacccagagagac

SEQ ID NO: 423354 - RNA, 23 nt, Human
ugcagggcaaguuagagacccca

SEQ ID NO: 423355 - RNA, 22 nt, Human
uuuggaaaguugucacuuuaga

SEQ ID NO: 423356 - RNA, 22 nt, Human
cagagcuggccugugauuuuug

SEQ ID NO: 423357 - RNA, 22 nt, Human
cugguccuccuugccuucagau

SEQ ID NO: 423358 - RNA, 22 nt, Human
ggcucaggccuguaauccuagc

SEQ ID NO: 423359 - RNA, 22 nt, Human
gagugggcaccgugggcacacu

SEQ ID NO: 423360 - RNA, 22 nt, Human
gagccagccuucuucugagguc

SEQ ID NO: 423361 - RNA, 22 nt, Human
cuaugaccccagcaugaauaag

SEQ ID NO: 423362 - RNA, 21 nt, Human
gcuccuggugcugcguggcgc

SEQ ID NO: 423363 - RNA, 22 nt, Human
ucagcagggagaggagaaugca

SEQ ID NO: 423364 - RNA, 22 nt, Human
ggugauuuucgaguuucauguu

SEQ ID NO: 423365 - RNA, 22 nt, Human
uaaguggaagguuauaugcuaa

SEQ ID NO: 423366 - RNA, 22 nt, Human
gaugaagccugacuucucggug

SEQ ID NO: 423367 - RNA, 22 nt, Human
ucccagagacaucauuucuccg

SEQ ID NO: 423368 - RNA, 22 nt, Human
cugcuggggucagagcacuggg

SEQ ID NO: 423369 - RNA, 22 nt, Human
cagcaugguggagcugcucuuu

SEQ ID NO: 423370 - RNA, 20 nt, Human
accuuucaaaugauucagca

SEQ ID NO: 423371 - RNA, 22 nt, Human
uccaggagaggccugaccaggu

SEQ ID NO: 423372 - RNA, 22 nt, Human
ugucucagaggcaggaagagcc

SEQ ID NO: 423373 - RNA, 22 nt, Human
uacuuacagagcuuauaaguua

SEQ ID NO: 423374 - RNA, 18 nt, Human
uccuccuuuggccuuuuc

SEQ ID NO: 423375 - RNA, 22 nt, Human
ccagcugaggcagccacacagg

SEQ ID NO: 423376 - RNA, 22 nt, Human
uccuguguuacugccuggagcg

SEQ ID NO: 423377 - RNA, 22 nt, Human
gggacugggagauccuccuggc

SEQ ID NO: 423378 - RNA, 22 nt, Human
ucucaggguuuguacaagugua

SEQ ID NO: 423379 - RNA, 22 nt, Human
cuuguagaauugaaauggucuc

SEQ ID NO: 423380 - RNA, 22 nt, Human
ccaaggagcaaggcucaacaag

SEQ ID NO: 423381 - RNA, 22 nt, Human
cagguaggauggaagggcucaa

SEQ ID NO: 423382 - RNA, 22 nt, Human
ucucagggagggcgagucagcg

SEQ ID NO: 423383 - RNA, 22 nt, Human
agagcugcccacacagcagauu

SEQ ID NO: 423384 - RNA, 22 nt, Human
gaaaucugcuucuugcauagua

SEQ ID NO: 423385 - RNA, 22 nt, Human
cagaauuuuucgaauguacugu

SEQ ID NO: 423386 - RNA, 22 nt, Human
cccagcucucgcacuuacuagc

SEQ ID NO: 423387 - RNA, 22 nt, Human
ugcagggagggcccagcaaucu

SEQ ID NO: 423388 - RNA, 22 nt, Human
gccugagaguugaaguucagug

SEQ ID NO: 423389 - RNA, 22 nt, Human
uggccacagccucugccaguuc

SEQ ID NO: 423390 - RNA, 22 nt, Human
auagauacauuagguaacuugu

SEQ ID NO: 423391 - RNA, 22 nt, Human
gcaguggcaugaugugggcuca

SEQ ID NO: 423392 - RNA, 22 nt, Human
cauggcaggaggcugcuggcag

SEQ ID NO: 423393 - RNA, 22 nt, Human
cauucauuuaugaaauaucuau

SEQ ID NO: 423394 - RNA, 17 nt, Human
gccaaaggguuccaauc

SEQ ID NO: 423395 - RNA, 22 nt, Human
auggagugggccaauuuuagug

SEQ ID NO: 423396 - RNA, 22 nt, Human
uucuggagaucugccuauggga

SEQ ID NO: 423397 - RNA, 22 nt, Human
agggcuccugaggcccuucugg

SEQ ID NO: 423398 - RNA, 22 nt, Human
uuuuuaagcuccuuugauguca

SEQ ID NO: 423399 - RNA, 22 nt, Human
aaggcacugacugugcagggga

SEQ ID NO: 423400 - RNA, 22 nt, Human
aggcacuguucccaguuauccu

SEQ ID NO: 423401 - RNA, 22 nt, Human
aagcuuccugaaugcucauuua

SEQ ID NO: 423402 - RNA, 22 nt, Human
ugcuggggguucagaugaguaa

SEQ ID NO: 423403 - RNA, 22 nt, Human
uggcugaguguuccaaggagca

SEQ ID NO: 423404 - RNA, 22 nt, Human
uuuuggucagguuggucucgaa

SEQ ID NO: 423405 - RNA, 22 nt, Human
cacauguaguaagcaggcaaug

SEQ ID NO: 423406 - RNA, 22 nt, Human
uggggaagggcacccuggagac

SEQ ID NO: 423407 - RNA, 22 nt, Human
uacccaggaggaaacugaggcu

SEQ ID NO: 423408 - RNA, 22 nt, Human
uuauguaauuuguuugcucuuc

SEQ ID NO: 423409 - RNA, 22 nt, Human
aaaauccuuagccgagugaggu

SEQ ID NO: 423410 - RNA, 22 nt, Human
uuaauaaaguaugaauuggaaa

SEQ ID NO: 423411 - RNA, 22 nt, Human
uggcuucugggacuugugagca

SEQ ID NO: 423412 - RNA, 22 nt, Human
uucaggaugcucagaguagucu

SEQ ID NO: 423413 - RNA, 22 nt, Human
gagcugagaucgugccauugca

SEQ ID NO: 423414 - RNA, 22 nt, Human
gagcuuccugaugccgaccagu

SEQ ID NO: 423415 - RNA, 22 nt, Human
ucuggccaacaaaaacuaaguc

SEQ ID NO: 423416 - RNA, 22 nt, Human
aggccugacuugaauuuagggc

SEQ ID NO: 423417 - RNA, 22 nt, Human
uguagcauguaaauugguuauu

SEQ ID NO: 423418 - RNA, 22 nt, Human
acugaaggcuuaacucuuucau

SEQ ID NO: 423419 - RNA, 22 nt, Human
gcagacagcauguugggcuauu

SEQ ID NO: 423420 - RNA, 22 nt, Human
cugggaggcacuauucaggagg

SEQ ID NO: 423421 - RNA, 22 nt, Human
ccauggagcgggugagugagug

SEQ ID NO: 423422 - RNA, 22 nt, Human
aaugggaaagagacuagaugcu

SEQ ID NO: 423423 - RNA, 22 nt, Human
agagccaggugcugcuguuuga

SEQ ID NO: 423424 - RNA, 22 nt, Human
uacuacauuaauaaaacauuca

SEQ ID NO: 423425 - RNA, 22 nt, Human
caggaggcagagguugcaguga

SEQ ID NO: 423426 - RNA, 22 nt, Human
ucugaagaacugaguaaacaug

SEQ ID NO: 423427 - RNA, 22 nt, Human
gacacagggggauguguggacg

SEQ ID NO: 423428 - RNA, 22 nt, Human
agcugguguccuccuggagcug

SEQ ID NO: 423429 - RNA, 22 nt, Human
ugccaggcaggacccuagaacc

SEQ ID NO: 423430 - RNA, 22 nt, Human
ugaggugaccgcagaugggaag

SEQ ID NO: 423431 - RNA, 22 nt, Human
ugcugcacgauaaauaauuucu

SEQ ID NO: 423432 - RNA, 20 nt, Human
gugcuucagaagccauugcu

SEQ ID NO: 423433 - RNA, 22 nt, Human
caggggacaguaugguggauga

SEQ ID NO: 423434 - RNA, 22 nt, Human
ugucaugccaccguuucccaga

SEQ ID NO: 423435 - RNA, 22 nt, Human
aaaaaucacuuuuauaggcagc

SEQ ID NO: 423436 - RNA, 22 nt, Human
guggagacgggacagaagcuaa

SEQ ID NO: 423437 - RNA, 22 nt, Human
uucauugugaacacauucugcc

SEQ ID NO: 423438 - RNA, 22 nt, Human
aagccagcauuuucccauuccu

SEQ ID NO: 423439 - RNA, 22 nt, Human
cugucacacugauaucaggcuu

SEQ ID NO: 423440 - RNA, 22 nt, Human
gucccagaugucuggaacuccc

SEQ ID NO: 423441 - RNA, 22 nt, Human
uuacacaaacacauuccagaua

SEQ ID NO: 423442 - RNA, 22 nt, Human
aggcucagccugggccuagagc

SEQ ID NO: 423443 - RNA, 22 nt, Human
cugcucuggcuguguacuucag

SEQ ID NO: 423444 - RNA, 22 nt, Human
cugccuggaaggagcaagggga

SEQ ID NO: 423445 - RNA, 22 nt, Human
cccaggucuaugccagcucuga

SEQ ID NO: 423446 - RNA, 22 nt, Human
agcucagggcgaucugucucgg

SEQ ID NO: 423447 - RNA, 22 nt, Human
gagaagccgagucagcugagcc

SEQ ID NO: 423448 - RNA, 22 nt, Human
cagugcaguggcugagcuggag

SEQ ID NO: 423449 - RNA, 22 nt, Human
gcuggaaggcuaggcucaguug

SEQ ID NO: 423450 - RNA, 22 nt, Human
cagggcucaggaaaucagacgu

SEQ ID NO: 423451 - RNA, 22 nt, Human
aauuauauugaaguugaauguc

SEQ ID NO: 423452 - RNA, 22 nt, Human
ucucagaguuuagagcugagcc

SEQ ID NO: 423453 - RNA, 22 nt, Human
uucaggagaauuccaagaagua

SEQ ID NO: 423454 - RNA, 22 nt, Human
ugcuuuaucugugagaaccuga

SEQ ID NO: 423455 - RNA, 22 nt, Human
cccugggcaagcccuauuuucc

SEQ ID NO: 423456 - RNA, 22 nt, Human
acugaaggaagcgggcaggggu

SEQ ID NO: 423457 - RNA, 22 nt, Human
gcugcugugugggagacaggcg

SEQ ID NO: 423458 - RNA, 22 nt, Human
gcauuucuuccuggugugagcc

SEQ ID NO: 423459 - RNA, 22 nt, Human
uggcagcuggagggcaauggcc

SEQ ID NO: 423460 - RNA, 22 nt, Human
ugaagugaccuggggcagugua

SEQ ID NO: 423461 - RNA, 21 nt, Human
auuauuauuucuguguccagc

SEQ ID NO: 423462 - RNA, 22 nt, Human
cuucccagacgggguggcagcc

SEQ ID NO: 423463 - RNA, 22 nt, Human
aaaggccacuugaaggauuuuu

SEQ ID NO: 423464 - RNA, 20 nt, Human
agccagaagaaggcuggaga

SEQ ID NO: 423465 - RNA, 22 nt, Human
aacauuaauuacagucaaacau

SEQ ID NO: 423466 - RNA, 22 nt, Human
gcccagcuuuucacuuccacac

SEQ ID NO: 423467 - RNA, 22 nt, Human
gcuuucucuucacugauguuca

SEQ ID NO: 423468 - RNA, 22 nt, Human
aaugucugcucuacucaggagg

SEQ ID NO: 423469 - RNA, 22 nt, Human
uuugggaaacuuaggggucaga

SEQ ID NO: 423470 - RNA, 22 nt, Human
ucaggcagguggcuggcuaugg

SEQ ID NO: 423471 - RNA, 22 nt, Human
ucagcuggcaguucagaggcug

SEQ ID NO: 423472 - RNA, 22 nt, Human
augucccagcugagagacaacu

SEQ ID NO: 423473 - RNA, 22 nt, Human
ggauggcauguugggcucuguu

SEQ ID NO: 423474 - RNA, 22 nt, Human
uuccauaauaaccugagagaaa

SEQ ID NO: 423475 - RNA, 22 nt, Human
auuuuucucucacacuuaccag

SEQ ID NO: 423476 - RNA, 22 nt, Human
uccagggauguccuguagcacu

SEQ ID NO: 423477 - RNA, 22 nt, Human
ucuuuuggaaaugaugugcagg

SEQ ID NO: 423478 - RNA, 22 nt, Human
cauguaaaacacucagaacagu

SEQ ID NO: 423479 - RNA, 22 nt, Human
cugugcuugacagugggaagca

SEQ ID NO: 423480 - RNA, 22 nt, Human
ucauuuguugaacuuuagugcg

SEQ ID NO: 423481 - RNA, 22 nt, Human
agaguccaugaagacagcugag

SEQ ID NO: 423482 - RNA, 22 nt, Human
agugccuugugugugggcagcc

SEQ ID NO: 423483 - RNA, 22 nt, Human
gugcaugugcauccauguguac

SEQ ID NO: 423484 - RNA, 22 nt, Human
cauuagggccaccauaacaaaa

SEQ ID NO: 423485 - RNA, 22 nt, Human
cuggcuuucucugugguguuca

SEQ ID NO: 423486 - RNA, 22 nt, Human
ggugcuggacacguggcacucc

SEQ ID NO: 423487 - RNA, 22 nt, Human
cauccugguuaccccauaguca

SEQ ID NO: 423488 - RNA, 22 nt, Human
uuuccuaugauauucuaugugu

SEQ ID NO: 423489 - RNA, 22 nt, Human
uuagaaagcuuuccauagucaa

SEQ ID NO: 423490 - RNA, 22 nt, Human
ggaggaagagguuguucucuca

SEQ ID NO: 423491 - RNA, 22 nt, Human
augcagcuucaggauuaugaug

SEQ ID NO: 423492 - RNA, 22 nt, Human
gcugccaugguccaggcuccag

SEQ ID NO: 423493 - RNA, 22 nt, Human
agucccagccuaggcugugcug

SEQ ID NO: 423494 - RNA, 22 nt, Human
agugacagcugggaaggugaaa

SEQ ID NO: 423495 - RNA, 22 nt, Human
gcagcuuucuugcccuaaucuu

SEQ ID NO: 423496 - RNA, 22 nt, Human
gggagggauuaguucugccugg

SEQ ID NO: 423497 - RNA, 22 nt, Human
ggaggccaaggcaggcggauca

SEQ ID NO: 423498 - RNA, 22 nt, Human
agagcagccugugaugaugcac

SEQ ID NO: 423499 - RNA, 22 nt, Human
gaugcacagugacccugccagu

SEQ ID NO: 423500 - RNA, 23 nt, Human
auaaggcauaaagguacauugga

SEQ ID NO: 423501 - RNA, 21 nt, Human
cuccugggcuaagauauagug

SEQ ID NO: 423502 - RNA, 22 nt, Human
cagaggcugcucuggguggcau

SEQ ID NO: 423503 - RNA, 22 nt, Human
ccagagaguaucauggagagua

SEQ ID NO: 423504 - RNA, 22 nt, Human
ccaguggguaggccauggugag

SEQ ID NO: 423505 - RNA, 22 nt, Human
guuucuuuugugaucaccaacc

SEQ ID NO: 423506 - RNA, 22 nt, Human
gcuggcugggucccugagaggc

SEQ ID NO: 423507 - RNA, 22 nt, Human
ccagcuccccucagcagguaau

SEQ ID NO: 423508 - RNA, 22 nt, Human
ggucccagcugcucaagaggcu

SEQ ID NO: 423509 - RNA, 22 nt, Human
ugcucccaggcauucucuguug

SEQ ID NO: 423510 - RNA, 20 nt, Human
uuucauugucagaaucuuau

SEQ ID NO: 423511 - RNA, 23 nt, Human
gcagaggagcaagcuggacacca

SEQ ID NO: 423512 - RNA, 22 nt, Human
ccucuccuugcacccgucccgc

SEQ ID NO: 423513 - RNA, 22 nt, Human
uugcauugaucccagcuugggc

SEQ ID NO: 423514 - RNA, 23 nt, Human
ugcaggggaggcuuaaagcaggu

SEQ ID NO: 423515 - RNA, 22 nt, Human
uauuuguugcgggaauugcuau

SEQ ID NO: 423516 - RNA, 22 nt, Human
uucuaccagcuacucacugaua

SEQ ID NO: 423517 - RNA, 22 nt, Human
augugugccccuuuuacucuuu

SEQ ID NO: 423518 - RNA, 22 nt, Human
aucuggcucauucagggaacgg

SEQ ID NO: 423519 - RNA, 22 nt, Human
aggcccuggcacugccugggag

SEQ ID NO: 423520 - RNA, 18 nt, Human
gagcagaggcucaacugg

SEQ ID NO: 423521 - RNA, 22 nt, Human
agggcuguuuuuggcaccuggg

SEQ ID NO: 423522 - RNA, 22 nt, Human
cugggagagaagcgaagcuggg

SEQ ID NO: 423523 - RNA, 22 nt, Human
ugacauuucgguguaugugaug

SEQ ID NO: 423524 - RNA, 22 nt, Human
ccugacucuggccaggccagcu

SEQ ID NO: 423525 - RNA, 22 nt, Human
uguggcugacuccuggucccca

SEQ ID NO: 423526 - RNA, 19 nt, Human
ucuaacagaagugucgucc

SEQ ID NO: 423527 - RNA, 22 nt, Human
uagagcugauaaugaggccaag

SEQ ID NO: 423528 - RNA, 17 nt, Human
agcagcugaagcagcca

SEQ ID NO: 423529 - RNA, 22 nt, Human
ucaggcugagaaaaucuggacc

SEQ ID NO: 423530 - RNA, 22 nt, Human
ugugccagaaaauaugcugagg

SEQ ID NO: 423531 - RNA, 22 nt, Human
uggcucugggaaucuguugcuu

SEQ ID NO: 423532 - RNA, 22 nt, Human
ggcaugggguguauguggcacg

SEQ ID NO: 423533 - RNA, 22 nt, Human
gaggcacaccagggagucuugu

SEQ ID NO: 423534 - RNA, 17 nt, Human
gccugcaggcccgcaga

SEQ ID NO: 423535 - RNA, 22 nt, Human
ugccaggccucaggagucucca

SEQ ID NO: 423536 - RNA, 22 nt, Human
acagccagaggugguccugggu

SEQ ID NO: 423537 - RNA, 22 nt, Human
aaacaaguguaaacuagucugu

SEQ ID NO: 423538 - RNA, 22 nt, Human
ccaggaggcagagguuacagug

SEQ ID NO: 423539 - RNA, 21 nt, Human
ucugucugguuuuagaguggc

SEQ ID NO: 423540 - RNA, 22 nt, Human
agccugcuggaccaagcucaug

SEQ ID NO: 423541 - RNA, 22 nt, Human
ugcauuuuuaacaaggcuaauu

SEQ ID NO: 423542 - RNA, 22 nt, Human
ccagcuggagcucgcagauagg

SEQ ID NO: 423543 - RNA, 22 nt, Human
ccaaaggcggaacugagucucu

SEQ ID NO: 423544 - RNA, 20 nt, Human
uagggcucauuaugaucucc

SEQ ID NO: 423545 - RNA, 22 nt, Human
aaugcacagcguuccaugcuug

SEQ ID NO: 423546 - RNA, 22 nt, Human
ccuggccuggcacucccucugc

SEQ ID NO: 423547 - RNA, 22 nt, Human
cuugucagccaauuguggauuu

SEQ ID NO: 423548 - RNA, 22 nt, Human
ugcagccuugccuccucccagc

SEQ ID NO: 423549 - RNA, 23 nt, Human
ucuuuacauacugaugaguucuc

SEQ ID NO: 423550 - RNA, 22 nt, Human
ccuccucugggaagauucagag

SEQ ID NO: 423551 - RNA, 22 nt, Human
agagccugucugccuuucuacc

SEQ ID NO: 423552 - RNA, 22 nt, Human
ggcugagcucaggggcagcagg

SEQ ID NO: 423553 - RNA, 22 nt, Human
augggcagagcuggugggaggc

SEQ ID NO: 423554 - RNA, 22 nt, Human
ggguacuuaauauuuacggggu

SEQ ID NO: 423555 - RNA, 22 nt, Human
caaauguguaaggaaguguuag

SEQ ID NO: 423556 - RNA, 22 nt, Human
ugguggcaucacucagccuccc

SEQ ID NO: 423557 - RNA, 22 nt, Human
aaucgguugaacccaggaagug

SEQ ID NO: 423558 - RNA, 22 nt, Human
cagcagcugggaaggaggcuga

SEQ ID NO: 423559 - RNA, 21 nt, Human
aaggaaaagcuuggucucuga

SEQ ID NO: 423560 - RNA, 22 nt, Human
gcauuauuaauagcugcaugag

SEQ ID NO: 423561 - RNA, 22 nt, Human
agcagaugagccucaugacugg

SEQ ID NO: 423562 - RNA, 22 nt, Human
ucacagggcauuauggcuccag

SEQ ID NO: 423563 - RNA, 22 nt, Human
aaggcagauauaaagacuagag

SEQ ID NO: 423564 - RNA, 22 nt, Human
cuguacaaguccuucaucaggg

SEQ ID NO: 423565 - RNA, 22 nt, Human
gaggcagagucacaaagagucu

SEQ ID NO: 423566 - RNA, 22 nt, Human
uagcuuuaagaugagaugugga

SEQ ID NO: 423567 - RNA, 22 nt, Human
cagccugcagggcugccuguug

SEQ ID NO: 423568 - RNA, 22 nt, Human
aggagccaagauggggcaagua

SEQ ID NO: 423569 - RNA, 22 nt, Human
gcugucuguggugucagcugac

SEQ ID NO: 423570 - RNA, 22 nt, Human
aggugucuuugcggcccgccgc

SEQ ID NO: 423571 - RNA, 22 nt, Human
uaaggcacccgugagcugccag

SEQ ID NO: 423572 - RNA, 22 nt, Human
gcugucacacaugggaucucag

SEQ ID NO: 423573 - RNA, 22 nt, Human
gccucuggucccucaugcugug

SEQ ID NO: 423574 - RNA, 22 nt, Human
ccugaggacacacgcugcagga

SEQ ID NO: 423575 - RNA, 22 nt, Human
uaaaugugcacuuuacuuuuca

SEQ ID NO: 423576 - RNA, 22 nt, Human
ggagcugggacccugucaucug

SEQ ID NO: 423577 - RNA, 22 nt, Human
cuggugagacgguugacaggag

SEQ ID NO: 423578 - RNA, 22 nt, Human
ccuggguggcagagguugcagu

SEQ ID NO: 423579 - RNA, 22 nt, Human
agagcucaagacgcucacagua

SEQ ID NO: 423580 - RNA, 22 nt, Human
cauuuucaugaguuucuguuca

SEQ ID NO: 423581 - RNA, 22 nt, Human
ccauggaguuccucuggucuau

SEQ ID NO: 423582 - RNA, 22 nt, Human
cagagguacaagcuaaguuggg

SEQ ID NO: 423583 - RNA, 22 nt, Human
cccuucagcugagugggacagc

SEQ ID NO: 423584 - RNA, 22 nt, Human
acuuuggggaacuuuucuccuc

SEQ ID NO: 423585 - RNA, 22 nt, Human
acaaaugcaaguuuuaugucaa

SEQ ID NO: 423586 - RNA, 22 nt, Human
agaagccagauuguagugggac

SEQ ID NO: 423587 - RNA, 22 nt, Human
auuuguuccacacauauuuacu

SEQ ID NO: 423588 - RNA, 22 nt, Human
caggaggcaguuucagaaguca

SEQ ID NO: 423589 - RNA, 22 nt, Human
ucuccucuauuucuguauguau

SEQ ID NO: 423590 - RNA, 22 nt, Human
cagggccagccgcagcauccac

SEQ ID NO: 423591 - RNA, 22 nt, Human
auguacaguggaaacuaacaaa

SEQ ID NO: 423592 - RNA, 22 nt, Human
gacccagcuuaagucacauguu

SEQ ID NO: 423593 - RNA, 22 nt, Human
gggaagggagggccuccaguca

SEQ ID NO: 423594 - RNA, 22 nt, Human
ucucuggaauuuugagagugac

SEQ ID NO: 423595 - RNA, 22 nt, Human
ccugccuggcugucagcagagc

SEQ ID NO: 423596 - RNA, 22 nt, Human
uugcuuuguggugguucuucca

SEQ ID NO: 423597 - RNA, 22 nt, Human
cagggcugcuggccgugcccuc

SEQ ID NO: 423598 - RNA, 22 nt, Human
caggccugugacaccgugucug

SEQ ID NO: 423599 - RNA, 22 nt, Human
ggugaggcuaagugacacaggg

SEQ ID NO: 423600 - RNA, 22 nt, Human
aggcugagcaaagggccuuacc

SEQ ID NO: 423601 - RNA, 22 nt, Human
auacuuuggucacuauuauugg

SEQ ID NO: 423602 - RNA, 21 nt, Human
gaguggaacgcucuucacacc

SEQ ID NO: 423603 - RNA, 22 nt, Human
cagacaggcuagccagacucac

SEQ ID NO: 423604 - RNA, 22 nt, Human
ggcucugcgcgguaaagugacu

SEQ ID NO: 423605 - RNA, 22 nt, Human
gggcuucucuuuagugagcuga

SEQ ID NO: 423606 - RNA, 22 nt, Human
caguggguccuaaguacaguuc

SEQ ID NO: 423607 - RNA, 22 nt, Human
uacuuucuagcucuccccaguu

SEQ ID NO: 423608 - RNA, 22 nt, Human
aagggagguaaagcuauuuaaa

SEQ ID NO: 423609 - RNA, 20 nt, Human
cagcaggaaaagugccucag

SEQ ID NO: 423610 - RNA, 22 nt, Human
cauuuuauccucugggaagcua

SEQ ID NO: 423611 - RNA, 22 nt, Human
uauugacaauuugugaaacuau

SEQ ID NO: 423612 - RNA, 22 nt, Human
cagugcuguuguaagcucauug

SEQ ID NO: 423613 - RNA, 22 nt, Human
acuuccugcagcuucucagccc

SEQ ID NO: 423614 - RNA, 22 nt, Human
uuacaagugucagguacuggca

SEQ ID NO: 423615 - RNA, 22 nt, Human
ucccagaggcaguugguaacuu

SEQ ID NO: 423616 - RNA, 22 nt, Human
cugggcugcagcgggagcgacg

SEQ ID NO: 423617 - RNA, 22 nt, Human
acaggcauugggauggagguug

SEQ ID NO: 423618 - RNA, 22 nt, Human
acauuucucccugcaugccugc

SEQ ID NO: 423619 - RNA, 22 nt, Human
gaggggcugcccuggugucagg

SEQ ID NO: 423620 - RNA, 22 nt, Human
ccuggaggagcgcugaccagcu

SEQ ID NO: 423621 - RNA, 22 nt, Human
accucugcaaugcaaugucaug

SEQ ID NO: 423622 - RNA, 22 nt, Human
ggaggaguguggggcacucugc

SEQ ID NO: 423623 - RNA, 22 nt, Human
ugucagugaguuaguugcaagu

SEQ ID NO: 423624 - RNA, 22 nt, Human
gcugccugucccaggaugagga

SEQ ID NO: 423625 - RNA, 22 nt, Human
cuuuggaauaauuuccuggagu

SEQ ID NO: 423626 - RNA, 22 nt, Human
ugaccuauuagauuuccuugcc

SEQ ID NO: 423627 - RNA, 22 nt, Human
gcagggcucauucuaguacaau

SEQ ID NO: 423628 - RNA, 22 nt, Human
ucuggcuccacaccucacugca

SEQ ID NO: 423629 - RNA, 22 nt, Human
ucuucagauugcacugagcaag

SEQ ID NO: 423630 - RNA, 22 nt, Human
gcacccagccagcaucucagag

SEQ ID NO: 423631 - RNA, 22 nt, Human
ccuggcagucaggggaguccuu

SEQ ID NO: 423632 - RNA, 22 nt, Human
aguguauugauuggaacagccu

SEQ ID NO: 423633 - RNA, 22 nt, Human
uugcauuguaggauguuagaag

SEQ ID NO: 423634 - RNA, 22 nt, Human
gcuuuaaauggcuugcccaagu

SEQ ID NO: 423635 - RNA, 22 nt, Human
aagggcuggccacauucugggu

SEQ ID NO: 423636 - RNA, 22 nt, Human
acagagcaauaacagggagagg

SEQ ID NO: 423637 - RNA, 22 nt, Human
uucagagaugacaccugguguu

SEQ ID NO: 423638 - RNA, 22 nt, Human
ugagccaggaguuugaggcugu

SEQ ID NO: 423639 - RNA, 22 nt, Human
agggcacccucucugcaguacc

SEQ ID NO: 423640 - RNA, 23 nt, Human
gccuggagaaaagcugcaguuca

SEQ ID NO: 423641 - RNA, 22 nt, Human
ugaggcagaaaauagcaguuca

SEQ ID NO: 423642 - RNA, 22 nt, Human
cugcuuuguguggucccuccag

SEQ ID NO: 423643 - RNA, 22 nt, Human
ggguguguuccuaaggaaacca

SEQ ID NO: 423644 - RNA, 20 nt, Human
cacaagagaauacacacugg

SEQ ID NO: 423645 - RNA, 19 nt, Human
ucuggcuccugccaggcug

SEQ ID NO: 423646 - RNA, 22 nt, Human
uaacagaauccuguuauugcca

SEQ ID NO: 423647 - RNA, 22 nt, Human
gaggucaggggagaggcugaug

SEQ ID NO: 423648 - RNA, 22 nt, Human
cucugggcaaguaugauagaaa

SEQ ID NO: 423649 - RNA, 22 nt, Human
aggcuggcgacaucuggcgggc

SEQ ID NO: 423650 - RNA, 22 nt, Human
uggcagcaguggagguagaaag

SEQ ID NO: 423651 - RNA, 22 nt, Human
ugcauuguugaauauuucauag

SEQ ID NO: 423652 - RNA, 22 nt, Human
augaaaaguucgaucuagaagg

SEQ ID NO: 423653 - RNA, 22 nt, Human
ggccucugaggacagccuuggc

SEQ ID NO: 423654 - RNA, 22 nt, Human
aagggcaggcagagaucauaua

SEQ ID NO: 423655 - RNA, 22 nt, Human
aggaugggccugggauaugcuu

SEQ ID NO: 423656 - RNA, 22 nt, Human
gugaggugguacaauauuaacu

SEQ ID NO: 423657 - RNA, 22 nt, Human
gggcagguggagggcccagcca

SEQ ID NO: 423658 - RNA, 22 nt, Human
cuggcuccuccaaggccuggag

SEQ ID NO: 423659 - RNA, 22 nt, Human
ugggcagacgggagcuugccuu

SEQ ID NO: 423660 - RNA, 22 nt, Human
ucagcugccccaguggccccag

SEQ ID NO: 423661 - RNA, 22 nt, Human
uaugcacacaucgcagcaggaa

SEQ ID NO: 423662 - RNA, 22 nt, Human
agcagccauccuuagagaaaga

SEQ ID NO: 423663 - RNA, 20 nt, Human
uucaggauucuagaccacac

SEQ ID NO: 423664 - RNA, 22 nt, Human
agaagccagcuucagcugcccg

SEQ ID NO: 423665 - RNA, 22 nt, Human
aagggaaaucauauggugcagu

SEQ ID NO: 423666 - RNA, 22 nt, Human
caagcagacaguaggccuagaa

SEQ ID NO: 423667 - RNA, 23 nt, Human
aggaacugaggccuagggaggua

SEQ ID NO: 423668 - RNA, 22 nt, Human
aagccgggccugagaaaugaca

SEQ ID NO: 423669 - RNA, 20 nt, Human
uuugucuguuaaguguuucu

SEQ ID NO: 423670 - RNA, 22 nt, Human
auuacaaaagaagggagaaggu

SEQ ID NO: 423671 - RNA, 22 nt, Human
aagggccauaacuugcaguguu

SEQ ID NO: 423672 - RNA, 22 nt, Human
aagaauguucauuaaacuguug

SEQ ID NO: 423673 - RNA, 22 nt, Human
agggcagaccacgugcaaggau

SEQ ID NO: 423674 - RNA, 22 nt, Human
ugcagcucauugcuggggucug

SEQ ID NO: 423675 - RNA, 22 nt, Human
gagcagugggaaggaacagggu

SEQ ID NO: 423676 - RNA, 20 nt, Human
gggcagccucgggagugggu

SEQ ID NO: 423677 - RNA, 22 nt, Human
agccacagagagggagcugcaa

SEQ ID NO: 423678 - RNA, 22 nt, Human
ccuaugccugucacucugcgcu

SEQ ID NO: 423679 - RNA, 22 nt, Human
gcugucacaaauauuucucagc

SEQ ID NO: 423680 - RNA, 22 nt, Human
ccagucugugugccagccugcg

SEQ ID NO: 423681 - RNA, 22 nt, Human
cugcaggguuuuucaaggacaa

SEQ ID NO: 423682 - RNA, 22 nt, Human
gagggcuguggggcaugaccag

SEQ ID NO: 423683 - RNA, 22 nt, Human
ucaggcagaugcagggauggau

SEQ ID NO: 423684 - RNA, 22 nt, Human
ccugccagauccccugagcuga

SEQ ID NO: 423685 - RNA, 22 nt, Human
aaaacuguaggaauugggugcc

SEQ ID NO: 423686 - RNA, 16 nt, Human
uggcugagagaggguu

SEQ ID NO: 423687 - RNA, 22 nt, Human
ccagcuuuucagaaucugccug

SEQ ID NO: 423688 - RNA, 22 nt, Human
agauuguagaaacuguagcauu

SEQ ID NO: 423689 - RNA, 22 nt, Human
guuuuuaucuaauagcaguuau

SEQ ID NO: 423690 - RNA, 22 nt, Human
aggcugcaggucugggucaugu

SEQ ID NO: 423691 - RNA, 22 nt, Human
ugauuuccacagucaggggugc

SEQ ID NO: 423692 - RNA, 22 nt, Human
cagcucugaggaacacuccuuu

SEQ ID NO: 423693 - RNA, 22 nt, Human
cuggagccccagacagggagag

SEQ ID NO: 423694 - RNA, 22 nt, Human
ucuggcucuauaacuccuagcu

SEQ ID NO: 423695 - RNA, 22 nt, Human
uagacacaucaaguauaguuaa

SEQ ID NO: 423696 - RNA, 22 nt, Human
uggcccugcuaugauccugcaa

SEQ ID NO: 423697 - RNA, 22 nt, Human
gcaggagcuggaaagugauguu

SEQ ID NO: 423698 - RNA, 22 nt, Human
ugaaugauguauaauauugaga

SEQ ID NO: 423699 - RNA, 21 nt, Human
uuucugaaggcaacaucuauc

SEQ ID NO: 423700 - RNA, 17 nt, Human
guccuacccauggucua

SEQ ID NO: 423701 - RNA, 20 nt, Human
ggagaugcagcccaggugcc

SEQ ID NO: 423702 - RNA, 22 nt, Human
uugggcuggcagagguggucuu

SEQ ID NO: 423703 - RNA, 22 nt, Human
ccucuggucccagcucugcugc

SEQ ID NO: 423704 - RNA, 22 nt, Human
agcagcauguugggaugugaaa

SEQ ID NO: 423705 - RNA, 22 nt, Human
ggccccaggaccuccacggucc

SEQ ID NO: 423706 - RNA, 22 nt, Human
uacaguagacaauguuaguaug

SEQ ID NO: 423707 - RNA, 22 nt, Human
aguuuuucugcuggucucacua

SEQ ID NO: 423708 - RNA, 22 nt, Human
uccucugcuccaggcuggacuu

SEQ ID NO: 423709 - RNA, 22 nt, Human
agggucaguucugugagguguu

SEQ ID NO: 423710 - RNA, 22 nt, Human
acccugccgugggcugcuugug

SEQ ID NO: 423711 - RNA, 22 nt, Human
cacaugcauaaggauaauuacu

SEQ ID NO: 423712 - RNA, 22 nt, Human
ugugccuggaucucugugacaa

SEQ ID NO: 423713 - RNA, 21 nt, Human
aacauuucaggauccaaauug

SEQ ID NO: 423714 - RNA, 22 nt, Human
ccuguacacggucuaugccucc

SEQ ID NO: 423715 - RNA, 22 nt, Human
aucuggcugagcgaggcccaca

SEQ ID NO: 423716 - RNA, 19 nt, Human
cucagcuguagcucaugug

SEQ ID NO: 423717 - RNA, 22 nt, Human
acaccauacucauguugguucc

SEQ ID NO: 423718 - RNA, 22 nt, Human
ugagccuggagucguggagggg

SEQ ID NO: 423719 - RNA, 22 nt, Human
agaagccagaggcaguggguac

SEQ ID NO: 423720 - RNA, 22 nt, Human
cagucucucugaaguauuaaga

SEQ ID NO: 423721 - RNA, 20 nt, Human
agaagccaagugacauguuu

SEQ ID NO: 423722 - RNA, 22 nt, Human
ugcagcuccucuggcugccuga

SEQ ID NO: 423723 - RNA, 22 nt, Human
aaccaggacaauuugaauagaa

SEQ ID NO: 423724 - RNA, 22 nt, Human
gucuucuguaagaugagguccc

SEQ ID NO: 423725 - RNA, 22 nt, Human
cacuggugacuucugagcugga

SEQ ID NO: 423726 - RNA, 22 nt, Human
uggcucuguuuuaugaguacca

SEQ ID NO: 423727 - RNA, 22 nt, Human
uccacugcagcuucugauggaa

SEQ ID NO: 423728 - RNA, 22 nt, Human
agaagcagacucugaggcaagg

SEQ ID NO: 423729 - RNA, 20 nt, Human
agcugguuaucuuaauucuu

SEQ ID NO: 423730 - RNA, 22 nt, Human
uuacaugguuguuggaaaugcu

SEQ ID NO: 423731 - RNA, 21 nt, Human
ugaaaguuggagucaaaugua

SEQ ID NO: 423732 - RNA, 22 nt, Human
agaggaugauuuuaaggacacu

SEQ ID NO: 423733 - RNA, 22 nt, Human
guaguucugcagugucaccuga

SEQ ID NO: 423734 - RNA, 22 nt, Human
ggcagggugccuggcuccuguu

SEQ ID NO: 423735 - RNA, 22 nt, Human
cucuggagggaggcugagcugg

SEQ ID NO: 423736 - RNA, 22 nt, Human
cugugcaguggcagcguguggg

SEQ ID NO: 423737 - RNA, 22 nt, Human
ucaggaugguccuuuaugagaa

SEQ ID NO: 423738 - RNA, 22 nt, Human
gcucccacugcagcccugagcc

SEQ ID NO: 423739 - RNA, 22 nt, Human
uaaggaaacaacuuguauuuuu

SEQ ID NO: 423740 - RNA, 22 nt, Human
uauuucuuguuauucucguuga

SEQ ID NO: 423741 - RNA, 22 nt, Human
aaaaguguucaggaagaauaau

SEQ ID NO: 423742 - RNA, 22 nt, Human
acagagagaggcccgaggcugc

SEQ ID NO: 423743 - RNA, 22 nt, Human
aaguaaaacacacaguccaccg

SEQ ID NO: 423744 - RNA, 22 nt, Human
auuuaacaagacagagaacugg

SEQ ID NO: 423745 - RNA, 22 nt, Human
acagauuuaggacuguagcgau

SEQ ID NO: 423746 - RNA, 22 nt, Human
ucucccaggcuggagugcagug

SEQ ID NO: 423747 - RNA, 22 nt, Human
ggagugaaucacuagaugcaga

SEQ ID NO: 423748 - RNA, 22 nt, Human
ccacagaggacaacugccuggc

SEQ ID NO: 423749 - RNA, 22 nt, Human
ggagagagaugccgccuugcuc

SEQ ID NO: 423750 - RNA, 20 nt, Human
uggcuccugcgguggaacca

SEQ ID NO: 423751 - RNA, 22 nt, Human
agugcaugccuuccuguggaug

SEQ ID NO: 423752 - RNA, 22 nt, Human
gcucugucuucagcacacagua

SEQ ID NO: 423753 - RNA, 22 nt, Human
cuggagcaggcuugucccagcu

SEQ ID NO: 423754 - RNA, 22 nt, Human
agccagaggccagccugccuca

SEQ ID NO: 423755 - RNA, 22 nt, Human
aaggggaaaaaguguuaggagu

SEQ ID NO: 423756 - RNA, 19 nt, Human
auaaggcaggaggaaauuu

SEQ ID NO: 423757 - RNA, 22 nt, Human
agccuggaauuaaggaaaugca

SEQ ID NO: 423758 - RNA, 23 nt, Human
uugcuuagagaccuccucaucag

SEQ ID NO: 423759 - RNA, 22 nt, Human
gcugagguggcugccuuaguaa

SEQ ID NO: 423760 - RNA, 21 nt, Human
accaggcuugugggagggagc

SEQ ID NO: 423761 - RNA, 22 nt, Human
uuugcauuaucucacuuauaua

SEQ ID NO: 423762 - RNA, 22 nt, Human
aaaagacaucuauuucaggcag

SEQ ID NO: 423763 - RNA, 22 nt, Human
aagcugccugccacgcuagaua

SEQ ID NO: 423764 - RNA, 22 nt, Human
aaaagcucuuucugcuguagau

SEQ ID NO: 423765 - RNA, 22 nt, Human
agguccagcuguugcagccucc

SEQ ID NO: 423766 - RNA, 22 nt, Human
auaaggcagaaaugauucuagu

SEQ ID NO: 423767 - RNA, 22 nt, Human
gcagcuggagcaucuucucauc

SEQ ID NO: 423768 - RNA, 22 nt, Human
gcagcuggcccugacacgcaga

SEQ ID NO: 423769 - RNA, 22 nt, Human
ugguccugccccgugcacagag

SEQ ID NO: 423770 - RNA, 22 nt, Human
ucuuagcauuucauaacaacug

SEQ ID NO: 423771 - RNA, 22 nt, Human
caaaagcaguucuaucugaguu

SEQ ID NO: 423772 - RNA, 22 nt, Human
gaggagguuccggguggagaag

SEQ ID NO: 423773 - RNA, 22 nt, Human
acagggcccuugccagcacaag

SEQ ID NO: 423774 - RNA, 22 nt, Human
gauuuagagaauguuuuguaag

SEQ ID NO: 423775 - RNA, 22 nt, Human
ucccuggagauaacuucuggga

SEQ ID NO: 423776 - RNA, 22 nt, Human
ucauuucuccgaccugcugucc

SEQ ID NO: 423777 - RNA, 22 nt, Human
gaagccaguacugugcucugca

SEQ ID NO: 423778 - RNA, 22 nt, Human
gucccuggaauggacucugcgc

SEQ ID NO: 423779 - RNA, 22 nt, Human
caggcagcugggucaccguccc

SEQ ID NO: 423780 - RNA, 22 nt, Human
uccugggcuugcuccuccagcu

SEQ ID NO: 423781 - RNA, 22 nt, Human
guggauggauuuugaggaaugg

SEQ ID NO: 423782 - RNA, 22 nt, Human
cuacauuuggagaguauaggaa

SEQ ID NO: 423783 - RNA, 22 nt, Human
aaaugugucaguuucauucucu

SEQ ID NO: 423784 - RNA, 22 nt, Human
ccuuucagaugggcauggaccg

SEQ ID NO: 423785 - RNA, 22 nt, Human
ucaguuuuuguuugccagauag

SEQ ID NO: 423786 - RNA, 22 nt, Human
uuauuuuuaaaaguucacacag

SEQ ID NO: 423787 - RNA, 22 nt, Human
agggcagaaauauugauacugu

SEQ ID NO: 423788 - RNA, 22 nt, Human
cagcauggggaucacuguaggc

SEQ ID NO: 423789 - RNA, 22 nt, Human
caugaagcacagcucucuuuuu

SEQ ID NO: 423790 - RNA, 22 nt, Human
ccuccuggugggcgcuucuggc

SEQ ID NO: 423791 - RNA, 22 nt, Human
uucucaggugaggcugaggcug

SEQ ID NO: 423792 - RNA, 18 nt, Human
ucacagugcucuugccua

SEQ ID NO: 423793 - RNA, 22 nt, Human
cugcucuguuucuuagcugggu

SEQ ID NO: 423794 - RNA, 22 nt, Human
gaggcagaggaagguggucucu

SEQ ID NO: 423795 - RNA, 22 nt, Human
aggcugaugcuggcugaggcug

SEQ ID NO: 423796 - RNA, 22 nt, Human
aggcugggcuccgcccaacucc

SEQ ID NO: 423797 - RNA, 22 nt, Human
agagccaggaugucuucugggg

SEQ ID NO: 423798 - RNA, 22 nt, Human
ccagcagcccucuuccaagacu

SEQ ID NO: 423799 - RNA, 22 nt, Human
ucuauacaugugcacacacauc

SEQ ID NO: 423800 - RNA, 22 nt, Human
cucagaagaacccaggguccca

SEQ ID NO: 423801 - RNA, 22 nt, Human
caauaguaaauuacggaggaga

SEQ ID NO: 423802 - RNA, 22 nt, Human
gcugucaggccaugugggccuu

SEQ ID NO: 423803 - RNA, 22 nt, Human
uugccuugauucuucucaugug

SEQ ID NO: 423804 - RNA, 22 nt, Human
uucacaggcuuggagguggggg

SEQ ID NO: 423805 - RNA, 22 nt, Human
uaagugcaauguuuuacuuaaa

SEQ ID NO: 423806 - RNA, 22 nt, Human
ggcaccugcucaucuggacuca

SEQ ID NO: 423807 - RNA, 22 nt, Human
gucucccaaccccugugcccag

SEQ ID NO: 423808 - RNA, 22 nt, Human
cagggcuggcuguggcaaucuc

SEQ ID NO: 423809 - RNA, 22 nt, Human
auuauguagguuaggugguugu

SEQ ID NO: 423810 - RNA, 22 nt, Human
uggcaucucaaacaggcagauu

SEQ ID NO: 423811 - RNA, 22 nt, Human
guggagaccuccuaggaugugu

SEQ ID NO: 423812 - RNA, 22 nt, Human
ugggaccugcucuuggaaugag

SEQ ID NO: 423813 - RNA, 22 nt, Human
ucagucuccuuuccucuagaca

SEQ ID NO: 423814 - RNA, 22 nt, Human
uggagagcgugcuuagcacucu

SEQ ID NO: 423815 - RNA, 22 nt, Human
aaucaguuguucacucugaaaa

SEQ ID NO: 423816 - RNA, 22 nt, Human
ggcaaaguuuucaucucauaac

SEQ ID NO: 423817 - RNA, 22 nt, Human
cugcuuuagacaacugcuggga

SEQ ID NO: 423818 - RNA, 22 nt, Human
augggcagaguggggacaggaa

SEQ ID NO: 423819 - RNA, 22 nt, Human
uagucucuggagacucuagggg

SEQ ID NO: 423820 - RNA, 22 nt, Human
accaggcacucuuguggcagug

SEQ ID NO: 423821 - RNA, 22 nt, Human
ugaaagguuauuuaggucugcu

SEQ ID NO: 423822 - RNA, 22 nt, Human
caggaccuggaaugcuugugaa

SEQ ID NO: 423823 - RNA, 18 nt, Human
cagucccaaaccuuagga

SEQ ID NO: 423824 - RNA, 22 nt, Human
ugggcagaaugugggauccaga

SEQ ID NO: 423825 - RNA, 22 nt, Human
ucucuuaauaaguaaauacuga

SEQ ID NO: 423826 - RNA, 22 nt, Human
aaaauaucagcaaagggugaca

SEQ ID NO: 423827 - RNA, 22 nt, Human
cucaggagaugacagaagguau

SEQ ID NO: 423828 - RNA, 22 nt, Human
acaaguaccaaaugcucaagua

SEQ ID NO: 423829 - RNA, 22 nt, Human
ugaaagggguugaguuacagcu

SEQ ID NO: 423830 - RNA, 22 nt, Human
acucugccccgaguucugggaa

SEQ ID NO: 423831 - RNA, 22 nt, Human
gcacagggcccugugcguaggu

SEQ ID NO: 423832 - RNA, 21 nt, Human
gagugucuaauccaggcuguc

SEQ ID NO: 423833 - RNA, 22 nt, Human
uuucuucucacccaggacagag

SEQ ID NO: 423834 - RNA, 22 nt, Human
accuuuuuguucuguucucagc

SEQ ID NO: 423835 - RNA, 22 nt, Human
ggagagcugguagcuggcucca

SEQ ID NO: 423836 - RNA, 22 nt, Human
ggugcagaucuuucucuucagg

SEQ ID NO: 423837 - RNA, 21 nt, Human
gcaggcuggucaaaccucagu

SEQ ID NO: 423838 - RNA, 22 nt, Human
gcucuggcuacuguggcuaccg

SEQ ID NO: 423839 - RNA, 22 nt, Human
aagcuccccgaaacccaccucu

SEQ ID NO: 423840 - RNA, 22 nt, Human
cagcagggaagcugugcuguuu

SEQ ID NO: 423841 - RNA, 22 nt, Human
accaggcagucaccguccagga

SEQ ID NO: 423842 - RNA, 22 nt, Human
ggagccaguauuuaguggucuu

SEQ ID NO: 423843 - RNA, 22 nt, Human
ggaggccaaggcagguggaucg

SEQ ID NO: 423844 - RNA, 22 nt, Human
uaaggcacacaguugcugcaug

SEQ ID NO: 423845 - RNA, 22 nt, Human
agggcaugaagcaguggacagc

SEQ ID NO: 423846 - RNA, 22 nt, Human
ugccuugguucucuacuuggag

SEQ ID NO: 423847 - RNA, 22 nt, Human
ucugaaggugcuagagaaagcu

SEQ ID NO: 423848 - RNA, 22 nt, Human
ugaggccacuuccccacagccc

SEQ ID NO: 423849 - RNA, 22 nt, Human
agaauucuggaguugggaggaa

SEQ ID NO: 423850 - RNA, 22 nt, Human
uggguagagacacagucugggg

SEQ ID NO: 423851 - RNA, 20 nt, Human
cugcccagccacugagggau

SEQ ID NO: 423852 - RNA, 23 nt, Human
gccucuggagccccagugcucag

SEQ ID NO: 423853 - RNA, 22 nt, Human
ucagagaguuuucacuagggug

SEQ ID NO: 423854 - RNA, 22 nt, Human
acacugaauaauugagaguuga

SEQ ID NO: 423855 - RNA, 22 nt, Human
cuggccagguuuugaacaguug

SEQ ID NO: 423856 - RNA, 22 nt, Human
aauuaggaauaaaugaguacuu

SEQ ID NO: 423857 - RNA, 22 nt, Human
acagguggaaacaugguguugg

SEQ ID NO: 423858 - RNA, 23 nt, Human
guuuucaacacaauaaauguaac

SEQ ID NO: 423859 - RNA, 21 nt, Human
ccuggcuucagggugcacugg

SEQ ID NO: 423860 - RNA, 22 nt, Human
ucaggcagaccaccgugggcag

SEQ ID NO: 423861 - RNA, 22 nt, Human
cugcugcucgaccagucccagg

SEQ ID NO: 423862 - RNA, 22 nt, Human
aggcaagggggcgccaccuucc

SEQ ID NO: 423863 - RNA, 22 nt, Human
ccucacagcuuuucaaagugga

SEQ ID NO: 423864 - RNA, 23 nt, Human
aggaggccugaaacugaggcuga

SEQ ID NO: 423865 - RNA, 22 nt, Human
acccaggacucucuuccaguag

SEQ ID NO: 423866 - RNA, 22 nt, Human
ugaggcagcaauuguauuguau

SEQ ID NO: 423867 - RNA, 22 nt, Human
caguacuuaguucucaugguuu

SEQ ID NO: 423868 - RNA, 22 nt, Human
ccggcucggcgaccaggcugaa

SEQ ID NO: 423869 - RNA, 22 nt, Human
cugcccuggucccauggcugau

SEQ ID NO: 423870 - RNA, 22 nt, Human
caggcagcagaggaguguggga

SEQ ID NO: 423871 - RNA, 22 nt, Human
aucaggauuacacggggaugcu

SEQ ID NO: 423872 - RNA, 16 nt, Human
cuacccagugagaagg

SEQ ID NO: 423873 - RNA, 22 nt, Human
cacuucaauuaacuucagcauu

SEQ ID NO: 423874 - RNA, 22 nt, Human
uccagagccuauauguucaacu

SEQ ID NO: 423875 - RNA, 23 nt, Human
ggcacugaagcuacaauggugag

SEQ ID NO: 423876 - RNA, 22 nt, Human
gcuucucucucagacugcaagc

SEQ ID NO: 423877 - RNA, 22 nt, Human
cugcucuggcguacucggcauc

SEQ ID NO: 423878 - RNA, 23 nt, Human
gccuucagcucgggaaggcuccc

SEQ ID NO: 423879 - RNA, 22 nt, Human
caggcuugauuauucagacaau

SEQ ID NO: 423880 - RNA, 22 nt, Human
uucagagcaucucuaaagccag

SEQ ID NO: 423881 - RNA, 22 nt, Human
aagcuggacucugccauuuacu

SEQ ID NO: 423882 - RNA, 22 nt, Human
ggaggccaaggcagguggauca

SEQ ID NO: 423883 - RNA, 22 nt, Human
cuggcucacaggugagaugcau

SEQ ID NO: 423884 - RNA, 22 nt, Human
uccaagggcagccauagaacuu

SEQ ID NO: 423885 - RNA, 22 nt, Human
gcucccagacugaccagaggug

SEQ ID NO: 423886 - RNA, 22 nt, Human
uucaauucugcucugaucuuag

SEQ ID NO: 423887 - RNA, 22 nt, Human
uaaugcacaugacugaacuauu

SEQ ID NO: 423888 - RNA, 22 nt, Human
uguuuuguuuaugagagcacag

SEQ ID NO: 423889 - RNA, 22 nt, Human
gcugccucuguagcuuuggacc

SEQ ID NO: 423890 - RNA, 22 nt, Human
cagaggccccagaacuagcucu

SEQ ID NO: 423891 - RNA, 22 nt, Human
ucaucuuuccucaaaagaucca

SEQ ID NO: 423892 - RNA, 22 nt, Human
gauuucaagcccccagagauuc

SEQ ID NO: 423893 - RNA, 22 nt, Human
ucucagagauucagggagaagu

SEQ ID NO: 423894 - RNA, 22 nt, Human
acguuuucagccuuaauguaga

SEQ ID NO: 423895 - RNA, 22 nt, Human
augucuuuggcuuugacauggc

SEQ ID NO: 423896 - RNA, 22 nt, Human
cugggacuuuacccuguggccc

SEQ ID NO: 423897 - RNA, 22 nt, Human
ugaaauguuugaagaccacuga

SEQ ID NO: 423898 - RNA, 22 nt, Human
auugcagcuggucaggguaauu

SEQ ID NO: 423899 - RNA, 20 nt, Human
gucugaggagcagugggaaa

SEQ ID NO: 423900 - RNA, 22 nt, Human
uguuacacagcagaauagcaag

SEQ ID NO: 423901 - RNA, 22 nt, Human
cgggcagaucacacagggcuug

SEQ ID NO: 423902 - RNA, 22 nt, Human
accugcagcugagaaaaugacu

SEQ ID NO: 423903 - RNA, 22 nt, Human
aagcugccugggaggaagggcu

SEQ ID NO: 423904 - RNA, 22 nt, Human
ccccaccugugcgucugccgca

SEQ ID NO: 423905 - RNA, 22 nt, Human
ggaggccaaggagggcggauca

SEQ ID NO: 423906 - RNA, 22 nt, Human
cacugggcguguccugggugag

SEQ ID NO: 423907 - RNA, 22 nt, Human
agggauguaaauucuucuucuu

SEQ ID NO: 423908 - RNA, 22 nt, Human
cucccaagauaaauaaggcagu

SEQ ID NO: 423909 - RNA, 17 nt, Human
uggacccuugggccucc

SEQ ID NO: 423910 - RNA, 18 nt, Human
uggaggcagaguucuggc

SEQ ID NO: 423911 - RNA, 22 nt, Human
gaggccaaucaauagggcaaua

SEQ ID NO: 423912 - RNA, 22 nt, Human
uuggcugaagguuaagugcugg

SEQ ID NO: 423913 - RNA, 22 nt, Human
gccuggguccacugaucaugcu

SEQ ID NO: 423914 - RNA, 22 nt, Human
aggcugagugcuccccuagaug

SEQ ID NO: 423915 - RNA, 22 nt, Human
cagaaggcuggcagauugagau

SEQ ID NO: 423916 - RNA, 22 nt, Human
acugccuugucucuugccuguu

SEQ ID NO: 423917 - RNA, 22 nt, Human
caucugcuguuccuuggacuca

SEQ ID NO: 423918 - RNA, 22 nt, Human
ccaaugauggugcccacgauga

SEQ ID NO: 423919 - RNA, 22 nt, Human
gagaaagggauaauuugaagag

SEQ ID NO: 423920 - RNA, 22 nt, Human
cuaaaugcccuacaaugacugg

SEQ ID NO: 423921 - RNA, 22 nt, Human
uuuccauauuuggucuuuggga

SEQ ID NO: 423922 - RNA, 22 nt, Human
ugggacuuguguggcaguauuu

SEQ ID NO: 423923 - RNA, 22 nt, Human
uagcuguguagacacucagagc

SEQ ID NO: 423924 - RNA, 22 nt, Human
ugagaguauuuuggcauuauca

SEQ ID NO: 423925 - RNA, 22 nt, Human
agacucaagcagauaggaauua

SEQ ID NO: 423926 - RNA, 22 nt, Human
gggagcaggagccugccugcca

SEQ ID NO: 423927 - RNA, 22 nt, Human
agaugguguuuccccaggugga

SEQ ID NO: 423928 - RNA, 22 nt, Human
agcagccacacgccuccuucuc

SEQ ID NO: 423929 - RNA, 23 nt, Human
gcagagcugcccuauugccuugg

SEQ ID NO: 423930 - RNA, 22 nt, Human
gggcucuguccauuccuucaua

SEQ ID NO: 423931 - RNA, 22 nt, Human
ucucugcucugugccucaguuu

SEQ ID NO: 423932 - RNA, 18 nt, Human
aaggcuucaaagaguaga

SEQ ID NO: 423933 - RNA, 22 nt, Human
gaaaagagaacaucugaggauc

SEQ ID NO: 423934 - RNA, 22 nt, Human
cuguccagaaagggggcaacaa

SEQ ID NO: 423935 - RNA, 22 nt, Human
aauauguucaaaauagaucacu

SEQ ID NO: 423936 - RNA, 22 nt, Human
ggagaggugaauggcugcucua

SEQ ID NO: 423937 - RNA, 22 nt, Human
ugcuggcuggccuggccuggac

SEQ ID NO: 423938 - RNA, 22 nt, Human
ggcaaaaaccauaauuacuuuu

SEQ ID NO: 423939 - RNA, 22 nt, Human
ggagugaaguggcgcgaucucg

SEQ ID NO: 423940 - RNA, 22 nt, Human
ugaacagaucaauagaacugac

SEQ ID NO: 423941 - RNA, 22 nt, Human
aggcacaggccucagcacccag

SEQ ID NO: 423942 - RNA, 22 nt, Human
cuuauuagaguuguguucuguu

SEQ ID NO: 423943 - RNA, 22 nt, Human
acuguacacacuucucugucuu

SEQ ID NO: 423944 - RNA, 22 nt, Human
gugcucaggaagcuguuccugc

SEQ ID NO: 423945 - RNA, 21 nt, Human
agaagccuggguggagguggg

SEQ ID NO: 423946 - RNA, 22 nt, Human
aagcugccacacggugaguacu

SEQ ID NO: 423947 - RNA, 22 nt, Human
guucaagguuuuacagagugua

SEQ ID NO: 423948 - RNA, 22 nt, Human
aagccaguccucuacugggcac

SEQ ID NO: 423949 - RNA, 22 nt, Human
auuugucuuugagugcccugcu

SEQ ID NO: 423950 - RNA, 22 nt, Human
gaaggaaaggucucaugccuuu

SEQ ID NO: 423951 - RNA, 22 nt, Human
aaaugcauuuuuaauuagaccc

SEQ ID NO: 423952 - RNA, 22 nt, Human
ccuccugggacaggcuggcaca

SEQ ID NO: 423953 - RNA, 22 nt, Human
uggcuucugcuuucaguggagg

SEQ ID NO: 423954 - RNA, 22 nt, Human
gagccagccgcaagagcuguga

SEQ ID NO: 423955 - RNA, 22 nt, Human
gaggggcugggcagucccugga

SEQ ID NO: 423956 - RNA, 19 nt, Human
ugagaggcuuaaggcagcu

SEQ ID NO: 423957 - RNA, 22 nt, Human
cuggcuccauccuugagcucug

SEQ ID NO: 423958 - RNA, 22 nt, Human
cccaggcugaugggaugggcca

SEQ ID NO: 423959 - RNA, 22 nt, Human
uagucaaaccucagaauacccc

SEQ ID NO: 423960 - RNA, 22 nt, Human
guaucuuuugguggaaaaauaa

SEQ ID NO: 423961 - RNA, 22 nt, Human
gauuucaauccagcuuucuucu

SEQ ID NO: 423962 - RNA, 22 nt, Human
agguggagaagagaugggcagu

SEQ ID NO: 423963 - RNA, 22 nt, Human
gaccauuucuaggaaucagacu

SEQ ID NO: 423964 - RNA, 22 nt, Human
gcagaacauuucacaguaucuu

SEQ ID NO: 423965 - RNA, 22 nt, Human
cgucuuccucuuacgaugcgcu

SEQ ID NO: 423966 - RNA, 22 nt, Human
cccugcugucaggugcugggag

SEQ ID NO: 423967 - RNA, 22 nt, Human
uggcugaaucugcagcaggaag

SEQ ID NO: 423968 - RNA, 22 nt, Human
ccugggucuugguucaugcucu

SEQ ID NO: 423969 - RNA, 22 nt, Human
gcagaggcauuucugacgcugc

SEQ ID NO: 423970 - RNA, 22 nt, Human
caggagcccguugcuccggcgg

SEQ ID NO: 423971 - RNA, 22 nt, Human
cccugcagagccagcccugacc

SEQ ID NO: 423972 - RNA, 22 nt, Human
ugcucagugagucugugacagg

SEQ ID NO: 423973 - RNA, 22 nt, Human
ccauaagguugaaaacuguaca

SEQ ID NO: 423974 - RNA, 22 nt, Human
augaggcaaucaugguccaguu

SEQ ID NO: 423975 - RNA, 22 nt, Human
uuguauuagcuguaaauuuucu

SEQ ID NO: 423976 - RNA, 22 nt, Human
ucuuugcagaauuuaacuuugc

SEQ ID NO: 423977 - RNA, 22 nt, Human
auagauauuugaguuguuucca

SEQ ID NO: 423978 - RNA, 22 nt, Human
ugugucagaaggcaauggggau

SEQ ID NO: 423979 - RNA, 21 nt, Human
ccaggcagagcugugaguucu

SEQ ID NO: 423980 - RNA, 22 nt, Human
cgcagagggcaggcagugcugg

SEQ ID NO: 423981 - RNA, 22 nt, Human
ggcuccugauaggagaaugcgg

SEQ ID NO: 423982 - RNA, 22 nt, Human
uuucuucucgacaccuuauccc

SEQ ID NO: 423983 - RNA, 22 nt, Human
ccacaggaccagaggagaucac

SEQ ID NO: 423984 - RNA, 22 nt, Human
agucucagaaaauaugcuuuuu

SEQ ID NO: 423985 - RNA, 22 nt, Human
uagaggcauuaaugaauaaaca

SEQ ID NO: 423986 - RNA, 22 nt, Human
uucucagugaaguuuagaacau

SEQ ID NO: 423987 - RNA, 23 nt, Human
ccuggcuggauucucugcauuca

SEQ ID NO: 423988 - RNA, 22 nt, Human
cuccagcugccaccagauguuu

SEQ ID NO: 423989 - RNA, 22 nt, Human
auuauuuuaugugcggccugau

SEQ ID NO: 423990 - RNA, 22 nt, Human
agcaaaguagcugcuguucuua

SEQ ID NO: 423991 - RNA, 22 nt, Human
agcaguggugugaggagggcuc

SEQ ID NO: 423992 - RNA, 22 nt, Human
ggcacugauuccauucaugaag

SEQ ID NO: 423993 - RNA, 22 nt, Human
uugucuguccaggcaccccaag

SEQ ID NO: 423994 - RNA, 22 nt, Human
gcuggugccuuguuguuguuac

SEQ ID NO: 423995 - RNA, 22 nt, Human
uguggcugcucaggugcagacc

SEQ ID NO: 423996 - RNA, 20 nt, Human
ggccuuggguuucgccuguu

SEQ ID NO: 423997 - RNA, 22 nt, Human
cagaagucacccucagaauaac

SEQ ID NO: 423998 - RNA, 22 nt, Human
cccugcaguccuuucuuggcuc

SEQ ID NO: 423999 - RNA, 19 nt, Human
aagcagcccuggcaagagc

SEQ ID NO: 424000 - RNA, 22 nt, Human
auaugcacauacauacauaggu

SEQ ID NO: 424001 - RNA, 22 nt, Human
agaggccuuucuguugagugaa

SEQ ID NO: 424002 - RNA, 22 nt, Human
agaucaaagccaugagagauuu

SEQ ID NO: 424003 - RNA, 22 nt, Human
cucuccucagaacaggcccucu

SEQ ID NO: 424004 - RNA, 22 nt, Human
aagagguugucugugaugaguu

SEQ ID NO: 424005 - RNA, 22 nt, Human
ucagggcacguuucugcaaugc

SEQ ID NO: 424006 - RNA, 22 nt, Human
agagccuggagguucugcugaa

SEQ ID NO: 424007 - RNA, 22 nt, Human
cagccaggacagggaaacuagu

SEQ ID NO: 424008 - RNA, 22 nt, Human
aaguccagugcuuuagauucca

SEQ ID NO: 424009 - RNA, 22 nt, Human
uagugaaauuuaugcacagcua

SEQ ID NO: 424010 - RNA, 22 nt, Human
caguuucuacgacuuaagcaca

SEQ ID NO: 424011 - RNA, 22 nt, Human
aagcagccagccaucaugcccg

SEQ ID NO: 424012 - RNA, 22 nt, Human
uguuaacaucuuggacucguga

SEQ ID NO: 424013 - RNA, 22 nt, Human
gagcagugguugaacagaggca

SEQ ID NO: 424014 - RNA, 22 nt, Human
guaggcagauaggagugcagcc

SEQ ID NO: 424015 - RNA, 22 nt, Human
gcuguggccuggcgcagagcug

SEQ ID NO: 424016 - RNA, 22 nt, Human
agagggcugccucagucagcua

SEQ ID NO: 424017 - RNA, 19 nt, Human
ucaggaguuaguugugcuc

SEQ ID NO: 424018 - RNA, 23 nt, Human
auuuccuacuauaaaagagguaa

SEQ ID NO: 424019 - RNA, 22 nt, Human
ugcaggagaaaguacggagcgu

SEQ ID NO: 424020 - RNA, 20 nt, Human
agggcagagggauuacaggc

SEQ ID NO: 424021 - RNA, 22 nt, Human
caugggcuacagaagcaugcug

SEQ ID NO: 424022 - RNA, 22 nt, Human
cagacacagauaugcauauggc

SEQ ID NO: 424023 - RNA, 22 nt, Human
gacuguacgucauugaaggcca

SEQ ID NO: 424024 - RNA, 22 nt, Human
uccaagaucuacagcaguuuag

SEQ ID NO: 424025 - RNA, 22 nt, Human
aauuucuucagcucuaaaaugg

SEQ ID NO: 424026 - RNA, 18 nt, Human
ccagagcuggcuccucgc

SEQ ID NO: 424027 - RNA, 22 nt, Human
acaguggaaagaacauggauuu

SEQ ID NO: 424028 - RNA, 18 nt, Human
gcagagugcgucucugug

SEQ ID NO: 424029 - RNA, 21 nt, Human
ugcuuuaugggaaaaauguca

SEQ ID NO: 424030 - RNA, 22 nt, Human
gugaggggaguaaagccauguu

SEQ ID NO: 424031 - RNA, 22 nt, Human
cugagccagcgggcucacuuuu

SEQ ID NO: 424032 - RNA, 22 nt, Human
uagagcuggaauuugcagcaag

SEQ ID NO: 424033 - RNA, 22 nt, Human
aggcacugguccauuuucugca

SEQ ID NO: 424034 - RNA, 20 nt, Human
agcaggaaaagugccagucu

SEQ ID NO: 424035 - RNA, 22 nt, Human
ggcugccugaggcugaggcccg

SEQ ID NO: 424036 - RNA, 22 nt, Human
cccagcauuucugggcugcacu

SEQ ID NO: 424037 - RNA, 22 nt, Human
aaagauuucagaagccugugcc

SEQ ID NO: 424038 - RNA, 22 nt, Human
augggcugugagguccggcagg

SEQ ID NO: 424039 - RNA, 22 nt, Human
agggcagcuaaggugcugacug

SEQ ID NO: 424040 - RNA, 22 nt, Human
uggcucagaagaaaagguaaac

SEQ ID NO: 424041 - RNA, 22 nt, Human
ucuuuauuuuaugcuugugcaa

SEQ ID NO: 424042 - RNA, 22 nt, Human
cugugaccuccaggaaggggug

SEQ ID NO: 424043 - RNA, 22 nt, Human
gagugguaggcaguguuaggaa

SEQ ID NO: 424044 - RNA, 22 nt, Human
aaagaucagucugaagcaacau

SEQ ID NO: 424045 - RNA, 20 nt, Human
gccaggcacuguucucaaua

SEQ ID NO: 424046 - RNA, 22 nt, Human
ugccaggcugcccuccagucug

SEQ ID NO: 424047 - RNA, 22 nt, Human
gcagcuuuggagguggaacucu

SEQ ID NO: 424048 - RNA, 22 nt, Human
cagugcagccaaggacaggcac

SEQ ID NO: 424049 - RNA, 22 nt, Human
acaguggaaaugugggagggga

SEQ ID NO: 424050 - RNA, 18 nt, Human
ucauuuguuuugcaugaa

SEQ ID NO: 424051 - RNA, 22 nt, Human
gucccaggaguugcugggccuu

SEQ ID NO: 424052 - RNA, 22 nt, Human
cacagggcaggccccaggccuc

SEQ ID NO: 424053 - RNA, 22 nt, Human
agagguagagguugcagugagc

SEQ ID NO: 424054 - RNA, 22 nt, Human
agcaagcuaccuagauagucua

SEQ ID NO: 424055 - RNA, 22 nt, Human
uuagaaaacauaagugguaaag

SEQ ID NO: 424056 - RNA, 22 nt, Human
ucaaaauuagugaccaaaggca

SEQ ID NO: 424057 - RNA, 18 nt, Human
cagcugugcccuguuugg

SEQ ID NO: 424058 - RNA, 22 nt, Human
uccagaggcuccaaagggagau

SEQ ID NO: 424059 - RNA, 22 nt, Human
cagaggguugaugugaggcuua

SEQ ID NO: 424060 - RNA, 21 nt, Human
ccucugcucgggcaugcguuu

SEQ ID NO: 424061 - RNA, 22 nt, Human
guuccuauauagccuuaaggau

SEQ ID NO: 424062 - RNA, 22 nt, Human
cugccucuauucacugaggcag

SEQ ID NO: 424063 - RNA, 22 nt, Human
aacauaauguggccaaagucac

SEQ ID NO: 424064 - RNA, 22 nt, Human
acccaggaugauaauguucaca

SEQ ID NO: 424065 - RNA, 22 nt, Human
ugaugguuuuauuaauaggacc

SEQ ID NO: 424066 - RNA, 22 nt, Human
ccagcccuugagauggaaggga

SEQ ID NO: 424067 - RNA, 21 nt, Human
agcaggaggcagucacagcuc

SEQ ID NO: 424068 - RNA, 17 nt, Human
gguucaguucugcauuc

SEQ ID NO: 424069 - RNA, 20 nt, Human
cagggcacacugcagccucg

SEQ ID NO: 424070 - RNA, 20 nt, Human
cucugcugcccgccggcugc

SEQ ID NO: 424071 - RNA, 22 nt, Human
gggcagccucggugccugcugc

SEQ ID NO: 424072 - RNA, 22 nt, Human
gaggggcuggcuguggucccau

SEQ ID NO: 424073 - RNA, 22 nt, Human
acagauccugguuacagccauu

SEQ ID NO: 424074 - RNA, 22 nt, Human
gcuggccugaccugaggcuggg

SEQ ID NO: 424075 - RNA, 22 nt, Human
agucagcagccuggccaggaga

SEQ ID NO: 424076 - RNA, 22 nt, Human
cacaggagauugaucuauuggu

SEQ ID NO: 424077 - RNA, 22 nt, Human
agagccuguaacaucuuucuua

SEQ ID NO: 424078 - RNA, 22 nt, Human
ccagggugcucuguggcgucgc

SEQ ID NO: 424079 - RNA, 22 nt, Human
auuguguaauuuucagcucaua

SEQ ID NO: 424080 - RNA, 17 nt, Human
uauacacagacagacug

SEQ ID NO: 424081 - RNA, 17 nt, Human
gucugggcuuuagagac

SEQ ID NO: 424082 - RNA, 22 nt, Human
gucaggauuauaauccccaugg

SEQ ID NO: 424083 - RNA, 22 nt, Human
aucagcaaggcaaucacugcag

SEQ ID NO: 424084 - RNA, 20 nt, Human
aggcagagcgcacuuuuaga

SEQ ID NO: 424085 - RNA, 19 nt, Human
cucuccagcuccaguagcu

SEQ ID NO: 424086 - RNA, 19 nt, Human
cugaggcccauguaccaug

SEQ ID NO: 424087 - RNA, 22 nt, Human
gccuuccugcagcucugagcgu

SEQ ID NO: 424088 - RNA, 22 nt, Human
gcagaagggaauaaggagcuuu

SEQ ID NO: 424089 - RNA, 22 nt, Human
guguggcugccagccaagaggc

SEQ ID NO: 424090 - RNA, 20 nt, Human
cagcuuuagaucuuugauua

SEQ ID NO: 424091 - RNA, 22 nt, Human
auacauauaugguacuuccugg

SEQ ID NO: 424092 - RNA, 19 nt, Human
aguagcagaaagugcagug

SEQ ID NO: 424093 - RNA, 22 nt, Human
cuuggcugucuauaggaaagag

SEQ ID NO: 424094 - RNA, 22 nt, Human
ugucccauggauaccaggcuau

SEQ ID NO: 424095 - RNA, 22 nt, Human
cugaagcacagcauauaaauaa

SEQ ID NO: 424096 - RNA, 22 nt, Human
ggcucugcaugugagugggugg

SEQ ID NO: 424097 - RNA, 23 nt, Human
ucaugcccaggcuccagauguca

SEQ ID NO: 424098 - RNA, 22 nt, Human
aguuggagugaacaugagauug

SEQ ID NO: 424099 - RNA, 22 nt, Human
uggcugaguaaguugugauaug

SEQ ID NO: 424100 - RNA, 22 nt, Human
ugggcugcugagaaugagagag

SEQ ID NO: 424101 - RNA, 22 nt, Human
uugaaaguuuauggagucugca

SEQ ID NO: 424102 - RNA, 22 nt, Human
aauuaggggaggacguaucaua

SEQ ID NO: 424103 - RNA, 22 nt, Human
ccucagcucuucccugugcaca

SEQ ID NO: 424104 - RNA, 18 nt, Human
caguuuuuauaucuggca

SEQ ID NO: 424105 - RNA, 20 nt, Human
agugggagagggcagacugc

SEQ ID NO: 424106 - RNA, 22 nt, Human
ugagcugggcugggcugagcug

SEQ ID NO: 424107 - RNA, 21 nt, Human
aaagagguuaauauuguaagu

SEQ ID NO: 424108 - RNA, 22 nt, Human
ucugaggcauacccaggccccc

SEQ ID NO: 424109 - RNA, 22 nt, Human
gagaagcaaucgugacaucucc

SEQ ID NO: 424110 - RNA, 22 nt, Human
cccucugccugcgcccuggugu

SEQ ID NO: 424111 - RNA, 22 nt, Human
ucagagguaagggcugagagga

SEQ ID NO: 424112 - RNA, 20 nt, Human
gcugaccccugcugucaugc

SEQ ID NO: 424113 - RNA, 22 nt, Human
ggaaagaggauaguggguaggu

SEQ ID NO: 424114 - RNA, 22 nt, Human
ccagggccucguguucugagug

SEQ ID NO: 424115 - RNA, 22 nt, Human
ucauuuuucacacagggucacc

SEQ ID NO: 424116 - RNA, 22 nt, Human
uuucccaaguguaaacauggca

SEQ ID NO: 424117 - RNA, 22 nt, Human
cucuccagaucugcugagccag

SEQ ID NO: 424118 - RNA, 22 nt, Human
gagugcaguuggggugagggga

SEQ ID NO: 424119 - RNA, 22 nt, Human
agaugcugugucuguucccuug

SEQ ID NO: 424120 - RNA, 22 nt, Human
ggaggcugcugccucacguggg

SEQ ID NO: 424121 - RNA, 18 nt, Human
accugccuguucuucucu

SEQ ID NO: 424122 - RNA, 22 nt, Human
acuguggccugcuguaugggcu

SEQ ID NO: 424123 - RNA, 22 nt, Human
ucucuggaauuggcugaggcaa

SEQ ID NO: 424124 - RNA, 16 nt, Human
gcaggcagaucacaug

SEQ ID NO: 424125 - RNA, 22 nt, Human
gagccuggagcuggaacgaagc

SEQ ID NO: 424126 - RNA, 22 nt, Human
agggcuagaguugagaugggga

SEQ ID NO: 424127 - RNA, 22 nt, Human
caucacagauguuguguggagu

SEQ ID NO: 424128 - RNA, 22 nt, Human
ccagcuuuaucaagucugagcu

SEQ ID NO: 424129 - RNA, 22 nt, Human
aacauuuaugguagucauugca

SEQ ID NO: 424130 - RNA, 21 nt, Human
ccagccucagaucagggagcu

SEQ ID NO: 424131 - RNA, 22 nt, Human
agccuggacagcuacggagaac

SEQ ID NO: 424132 - RNA, 22 nt, Human
ugcauaaacagauacuucaugu

SEQ ID NO: 424133 - RNA, 22 nt, Human
ucuuugcauggacauguguuuu

SEQ ID NO: 424134 - RNA, 19 nt, Human
caguggccuggaggucucu

SEQ ID NO: 424135 - RNA, 22 nt, Human
cugaagaugucugagaugcuca

SEQ ID NO: 424136 - RNA, 22 nt, Human
caccaggugcuggaggacauca

SEQ ID NO: 424137 - RNA, 22 nt, Human
ggcugcaguuugucuuuugcuu

SEQ ID NO: 424138 - RNA, 21 nt, Human
cugguguagcacucaggugcu

SEQ ID NO: 424139 - RNA, 22 nt, Human
ccucccagugccuccagagcag

SEQ ID NO: 424140 - RNA, 22 nt, Human
cugagcugacaucuuccucuuu

SEQ ID NO: 424141 - RNA, 22 nt, Human
cagggcuguaaauuagugcuga

SEQ ID NO: 424142 - RNA, 22 nt, Human
uccaggagagguguggggacug

SEQ ID NO: 424143 - RNA, 22 nt, Human
acccaggggcagccuugcugug

SEQ ID NO: 424144 - RNA, 22 nt, Human
caggagccgccaggcacguugg

SEQ ID NO: 424145 - RNA, 22 nt, Human
cugcagcuccccugagaucaag

SEQ ID NO: 424146 - RNA, 22 nt, Human
ucuuuauugcuacugguuuguc

SEQ ID NO: 424147 - RNA, 19 nt, Human
acaaacugaguacacuugu

SEQ ID NO: 424148 - RNA, 21 nt, Human
ugacauuuccaauauaaagcc

SEQ ID NO: 424149 - RNA, 22 nt, Human
agcaguccaacugagguggcau

SEQ ID NO: 424150 - RNA, 22 nt, Human
aagauuuacuagcauaauagcu

SEQ ID NO: 424151 - RNA, 22 nt, Human
ugccuggcaaugccagaagcca

SEQ ID NO: 424152 - RNA, 22 nt, Human
aagacugucugggacaagauga

SEQ ID NO: 424153 - RNA, 22 nt, Human
ucacaggcuccagggccuggau

SEQ ID NO: 424154 - RNA, 22 nt, Human
uugauacauagcacaguuuagg

SEQ ID NO: 424155 - RNA, 22 nt, Human
uaaugcacauagaaguacuuag

SEQ ID NO: 424156 - RNA, 22 nt, Human
agcuguggaguaggggguugga

SEQ ID NO: 424157 - RNA, 22 nt, Human
ggugggugagcccugggagcug

SEQ ID NO: 424158 - RNA, 22 nt, Human
ucaagcaggguagcaagcuggu

SEQ ID NO: 424159 - RNA, 22 nt, Human
cauugcacagcccuguggugau

SEQ ID NO: 424160 - RNA, 22 nt, Human
accagagcuggcucugagcacc

SEQ ID NO: 424161 - RNA, 22 nt, Human
uccaguucuaggucacucucug

SEQ ID NO: 424162 - RNA, 22 nt, Human
uggcucuggauuaaucuaggaa

SEQ ID NO: 424163 - RNA, 22 nt, Human
cccuccagccauggacccaggu

SEQ ID NO: 424164 - RNA, 22 nt, Human
agucccagaucuacaggaggga

SEQ ID NO: 424165 - RNA, 22 nt, Human
guggcugcucgggcuccggccc

SEQ ID NO: 424166 - RNA, 21 nt, Human
uguuuauggaaaagagacaaa

SEQ ID NO: 424167 - RNA, 22 nt, Human
guugaaaguggagaaccugguu

SEQ ID NO: 424168 - RNA, 22 nt, Human
uggagggaacccaggcugcucu

SEQ ID NO: 424169 - RNA, 22 nt, Human
ugggauggcauccugggccuug

SEQ ID NO: 424170 - RNA, 22 nt, Human
acaugauuuuaguaucauaaua

SEQ ID NO: 424171 - RNA, 20 nt, Human
gcauugaguauagacagaug

SEQ ID NO: 424172 - RNA, 22 nt, Human
ucagagagguuaaauaucuugu

SEQ ID NO: 424173 - RNA, 22 nt, Human
ugugaaggagcaugcagagggg

SEQ ID NO: 424174 - RNA, 22 nt, Human
gccauuuagggaggcaagguga

SEQ ID NO: 424175 - RNA, 22 nt, Human
gcagagcugggucuguauccaa

SEQ ID NO: 424176 - RNA, 22 nt, Human
uagaaaugcccagauucugcua

SEQ ID NO: 424177 - RNA, 22 nt, Human
cacugagaggucucauuuccaa

SEQ ID NO: 424178 - RNA, 20 nt, Human
ugcuguaagauuagagagcu

SEQ ID NO: 424179 - RNA, 22 nt, Human
ggaggggccggcugccugccac

SEQ ID NO: 424180 - RNA, 22 nt, Human
cacaggcugcccgcagcuggga

SEQ ID NO: 424181 - RNA, 22 nt, Human
acugaaggaaagccuuugcaug

SEQ ID NO: 424182 - RNA, 22 nt, Human
aaacuguaaauacuaguaagug

SEQ ID NO: 424183 - RNA, 22 nt, Human
gcacagaacagagaaauagcca

SEQ ID NO: 424184 - RNA, 22 nt, Human
caggggcuagcacuuaauguuu

SEQ ID NO: 424185 - RNA, 23 nt, Human
aggcccugccugucccucuuuuu

SEQ ID NO: 424186 - RNA, 22 nt, Human
uaaauguguaaaccuccauuac

SEQ ID NO: 424187 - RNA, 22 nt, Human
caaaagaagcucuuggggcuag

SEQ ID NO: 424188 - RNA, 22 nt, Human
aguguccccuccaagggccugg

SEQ ID NO: 424189 - RNA, 22 nt, Human
ggccaggcugcugggaccccgc

SEQ ID NO: 424190 - RNA, 22 nt, Human
ggcacugggagaggugagacgg

SEQ ID NO: 424191 - RNA, 19 nt, Human
ugaagcaggcagagaagau

SEQ ID NO: 424192 - RNA, 22 nt, Human
caauguaucaaccagaaaguuc

SEQ ID NO: 424193 - RNA, 19 nt, Human
ccaggccugcgggcguugg

SEQ ID NO: 424194 - RNA, 22 nt, Human
cugucagguuggucucagagcu

SEQ ID NO: 424195 - RNA, 20 nt, Human
ugggcugaggaucaggugcc

SEQ ID NO: 424196 - RNA, 22 nt, Human
ucucagagaucuuucugcaugu

SEQ ID NO: 424197 - RNA, 22 nt, Human
aggcucaggugccucauucaca

SEQ ID NO: 424198 - RNA, 22 nt, Human
cacguuuuaugacagaagaagc

SEQ ID NO: 424199 - RNA, 22 nt, Human
ugucucaucucuuaaccccacu

SEQ ID NO: 424200 - RNA, 22 nt, Human
cagcucccgccaucgggaggca

SEQ ID NO: 424201 - RNA, 22 nt, Human
ccugccagucacuaugucaccu

SEQ ID NO: 424202 - RNA, 22 nt, Human
aggcaguguguagcuggaagag

SEQ ID NO: 424203 - RNA, 22 nt, Human
uucucacuauguauguagauug

SEQ ID NO: 424204 - RNA, 22 nt, Human
ugcaggugugguuccucagcca

SEQ ID NO: 424205 - RNA, 22 nt, Human
ggaggcucgcuggucgcacagc

SEQ ID NO: 424206 - RNA, 22 nt, Human
ucacuuauugcucaucucaugc

SEQ ID NO: 424207 - RNA, 22 nt, Human
cagggccuccuaaggcaucuaa

SEQ ID NO: 424208 - RNA, 22 nt, Human
gagccagcgccuugccucuggg

SEQ ID NO: 424209 - RNA, 23 nt, Human
agaugaaagcuucccaucacagu

SEQ ID NO: 424210 - RNA, 18 nt, Human
uucacaggaaaugucuuu

SEQ ID NO: 424211 - RNA, 22 nt, Human
ugacauuuaucuucuacaauga

SEQ ID NO: 424212 - RNA, 22 nt, Human
gagugagggcagcaggggcugc

SEQ ID NO: 424213 - RNA, 22 nt, Human
gggcugaaaggccgccucagau

SEQ ID NO: 424214 - RNA, 22 nt, Human
aggcaggugcuuaugacuugcu

SEQ ID NO: 424215 - RNA, 22 nt, Human
uacauuccacuagugacuggcg

SEQ ID NO: 424216 - RNA, 21 nt, Human
ccacaggggcuccccugucag

SEQ ID NO: 424217 - RNA, 22 nt, Human
uucaagaucuggguuuucagcu

SEQ ID NO: 424218 - RNA, 22 nt, Human
cagcugcccaagccccagaugu

SEQ ID NO: 424219 - RNA, 20 nt, Human
accagguggcugaugacacc

SEQ ID NO: 424220 - RNA, 22 nt, Human
aaggccugcucagcugucugug

SEQ ID NO: 424221 - RNA, 22 nt, Human
uagaggugucacuuugggaagu

SEQ ID NO: 424222 - RNA, 22 nt, Human
cccaccccuggacaggugagug

SEQ ID NO: 424223 - RNA, 22 nt, Human
gccuuugccugcgacguggcug

SEQ ID NO: 424224 - RNA, 22 nt, Human
gagcacagggaauagacagaua

SEQ ID NO: 424225 - RNA, 22 nt, Human
ccugggcaauauagugaggccc

SEQ ID NO: 424226 - RNA, 22 nt, Human
agagccuggaccugagcuacaa

SEQ ID NO: 424227 - RNA, 22 nt, Human
gaaggagagggucaaggauaau

SEQ ID NO: 424228 - RNA, 21 nt, Human
uccagggaacuucucaggaau

SEQ ID NO: 424229 - RNA, 22 nt, Human
ucaucucaaaacccaaggggca

SEQ ID NO: 424230 - RNA, 22 nt, Human
aagccacuauggugauucucaa

SEQ ID NO: 424231 - RNA, 22 nt, Human
gaagggugcauggagggaaguc

SEQ ID NO: 424232 - RNA, 22 nt, Human
agaggccuaauugcuacccuuu

SEQ ID NO: 424233 - RNA, 22 nt, Human
aacuuucuuucacagaaguauc

SEQ ID NO: 424234 - RNA, 22 nt, Human
aaggcagaaagggaugugagug

SEQ ID NO: 424235 - RNA, 22 nt, Human
acuuugcugcagguuuaaagag

SEQ ID NO: 424236 - RNA, 21 nt, Human
auccuugaucagaagagugcu

SEQ ID NO: 424237 - RNA, 22 nt, Human
aagagcugcacauauuuauauc

SEQ ID NO: 424238 - RNA, 22 nt, Human
guaacugaggcagcuuuuaaga

SEQ ID NO: 424239 - RNA, 22 nt, Human
ggcgugggaaguggggcuucug

SEQ ID NO: 424240 - RNA, 22 nt, Human
ccagguguagcacugcucacag

SEQ ID NO: 424241 - RNA, 22 nt, Human
aaggguugaagauaaauaaggu

SEQ ID NO: 424242 - RNA, 22 nt, Human
cugccuugaggagguuguggga

SEQ ID NO: 424243 - RNA, 22 nt, Human
cuggcucaggguggucuggguc

SEQ ID NO: 424244 - RNA, 22 nt, Human
agagcuuagaauuucagaugau

SEQ ID NO: 424245 - RNA, 23 nt, Human
aguuuguaaagaaauauuugcac

SEQ ID NO: 424246 - RNA, 22 nt, Human
gacaagacauugguaaagauau

SEQ ID NO: 424247 - RNA, 22 nt, Human
guacucaguaauauaacauauu

SEQ ID NO: 424248 - RNA, 22 nt, Human
uugcauaaaugcuuaaaauuug

SEQ ID NO: 424249 - RNA, 21 nt, Human
ugugucacuaacuagaggcua

SEQ ID NO: 424250 - RNA, 20 nt, Human
ucucaggguucagcaaagua

SEQ ID NO: 424251 - RNA, 22 nt, Human
gaggcugcugagagcccuguuu

SEQ ID NO: 424252 - RNA, 22 nt, Human
aaaauuuccaccaucuuugugu

SEQ ID NO: 424253 - RNA, 22 nt, Human
uuuacauggaauauugucuugu

SEQ ID NO: 424254 - RNA, 22 nt, Human
gggccaugagagguucaucaac

SEQ ID NO: 424255 - RNA, 22 nt, Human
agggaccugcucacugccuggc

SEQ ID NO: 424256 - RNA, 22 nt, Human
aagucagcacuccaggaagcca

SEQ ID NO: 424257 - RNA, 21 nt, Human
augggcagaggcagagaggcu

SEQ ID NO: 424258 - RNA, 22 nt, Human
acagauugaucuugagaauuau

SEQ ID NO: 424259 - RNA, 21 nt, Human
ucagagagucacagugaacug

SEQ ID NO: 424260 - RNA, 22 nt, Human
ucagggcagaauccaaagaauu

SEQ ID NO: 424261 - RNA, 22 nt, Human
acuguacaugcaucuugucuau

SEQ ID NO: 424262 - RNA, 20 nt, Human
ucucccaggcucagggaaga

SEQ ID NO: 424263 - RNA, 22 nt, Human
cugccugcuucugagccagagg

SEQ ID NO: 424264 - RNA, 22 nt, Human
uguacaaugccagggaacacca

SEQ ID NO: 424265 - RNA, 23 nt, Human
acagacaacacugaugagagaaa

SEQ ID NO: 424266 - RNA, 22 nt, Human
ccugucugaaggcagggggaug

SEQ ID NO: 424267 - RNA, 22 nt, Human
uaguccagccuuggguguagcc

SEQ ID NO: 424268 - RNA, 22 nt, Human
gagggcagugaauuuugaagcu

SEQ ID NO: 424269 - RNA, 22 nt, Human
aagaggucauaccagauaaggg

SEQ ID NO: 424270 - RNA, 20 nt, Human
cuccaggggaagagccuucc

SEQ ID NO: 424271 - RNA, 22 nt, Human
auccugggcagugugucacucu

SEQ ID NO: 424272 - RNA, 22 nt, Human
ucacuugccuagcccaguucag

SEQ ID NO: 424273 - RNA, 22 nt, Human
gauccuugcaacucugugaggu

SEQ ID NO: 424274 - RNA, 19 nt, Human
cccagagcauccugaacuu

SEQ ID NO: 424275 - RNA, 21 nt, Human
ucuccaguauccuucucugag

SEQ ID NO: 424276 - RNA, 19 nt, Human
ugcauaaauuauauacuuu

SEQ ID NO: 424277 - RNA, 22 nt, Human
acacugaaugcuguuuagaaau

SEQ ID NO: 424278 - RNA, 20 nt, Human
aacacugugcgugguaggug

SEQ ID NO: 424279 - RNA, 17 nt, Human
ugaaggaaggaugaugu

SEQ ID NO: 424280 - RNA, 22 nt, Human
uccugccucuccaugcuaacua

SEQ ID NO: 424281 - RNA, 22 nt, Human
agaagccauucccuguaggcuc

SEQ ID NO: 424282 - RNA, 22 nt, Human
ucacauuugcaauugcauuguu

SEQ ID NO: 424283 - RNA, 19 nt, Human
agggcugcucuggccuggg

SEQ ID NO: 424284 - RNA, 22 nt, Human
uggcugagccuuuggggcuuuc

SEQ ID NO: 424285 - RNA, 22 nt, Human
gggaaggagguggcuugaagug

SEQ ID NO: 424286 - RNA, 22 nt, Human
cacagaggcaaccuucuggggu

SEQ ID NO: 424287 - RNA, 21 nt, Human
aacauuucugggagaacucac

SEQ ID NO: 424288 - RNA, 22 nt, Human
ggggcaggagcccuucuucagc

SEQ ID NO: 424289 - RNA, 22 nt, Human
uggcucagugaagagauaacuu

SEQ ID NO: 424290 - RNA, 18 nt, Human
aggcccuggccucgaaca

SEQ ID NO: 424291 - RNA, 22 nt, Human
uauuccuauuucuaaacauaug

SEQ ID NO: 424292 - RNA, 22 nt, Human
agugaggcuaauaggcaauggu

SEQ ID NO: 424293 - RNA, 19 nt, Human
ccuuccuccccagggccau

SEQ ID NO: 424294 - RNA, 21 nt, Human
ggauggauagggaagagauuu

SEQ ID NO: 424295 - RNA, 22 nt, Human
aaauauguaagauuagcacuag

SEQ ID NO: 424296 - RNA, 20 nt, Human
gcagcugaaaguaugacacc

SEQ ID NO: 424297 - RNA, 22 nt, Human
agcuuuauauguuguuucucca

SEQ ID NO: 424298 - RNA, 22 nt, Human
aacucaguguguuucuuaguau

SEQ ID NO: 424299 - RNA, 22 nt, Human
gaaucucaguggaagcaggaag

SEQ ID NO: 424300 - RNA, 23 nt, Human
uggcagugaucaaaagcuuacau

SEQ ID NO: 424301 - RNA, 22 nt, Human
gagaggcuaugagguucugugu

SEQ ID NO: 424302 - RNA, 23 nt, Human
ucacaggggccagcgcucugugg

SEQ ID NO: 424303 - RNA, 22 nt, Human
gaggccagcgcgcagcacuuuu

SEQ ID NO: 424304 - RNA, 22 nt, Human
gagccuucaucgcagccuuguu

SEQ ID NO: 424305 - RNA, 22 nt, Human
gccaccagcagaaaaggggcca

SEQ ID NO: 424306 - RNA, 22 nt, Human
agggaagaagcugguaguaggu

SEQ ID NO: 424307 - RNA, 22 nt, Human
ugcaauaaagugcuauaaaucc

SEQ ID NO: 424308 - RNA, 22 nt, Human
gcauggcauuaacaagauggaa

SEQ ID NO: 424309 - RNA, 22 nt, Human
agccaggcagggcucucgcucu

SEQ ID NO: 424310 - RNA, 21 nt, Human
guccagagagccggcuccuga

SEQ ID NO: 424311 - RNA, 18 nt, Human
gugccaggaggcgcagcc

SEQ ID NO: 424312 - RNA, 22 nt, Human
aaguuauugcagcaauccaagu

SEQ ID NO: 424313 - RNA, 18 nt, Human
gaaaugugauucuagggc

SEQ ID NO: 424314 - RNA, 22 nt, Human
aagggcugaaugaaggguugaa

SEQ ID NO: 424315 - RNA, 22 nt, Human
ccucaggauccgcaggugcagu

SEQ ID NO: 424316 - RNA, 22 nt, Human
uuauuaggaacucaggauuuuu

SEQ ID NO: 424317 - RNA, 22 nt, Human
ggcugccugccuccaagccggg

SEQ ID NO: 424318 - RNA, 22 nt, Human
uggcagagagagugcagucgac

SEQ ID NO: 424319 - RNA, 22 nt, Human
cuguuuauuacacuggauagca

SEQ ID NO: 424320 - RNA, 22 nt, Human
gugcuuaauacaugucaauaac

SEQ ID NO: 424321 - RNA, 22 nt, Human
agauuucucuuucccuggcuga

SEQ ID NO: 424322 - RNA, 22 nt, Human
acuguccaagcaugccuggcuu

SEQ ID NO: 424323 - RNA, 22 nt, Human
uaccugcacagccagccaugug

SEQ ID NO: 424324 - RNA, 19 nt, Human
acaggcagaauugggugug

SEQ ID NO: 424325 - RNA, 22 nt, Human
cccagcccugaccuauuggaaa

SEQ ID NO: 424326 - RNA, 22 nt, Human
cagggccagcgucucgggcuau

SEQ ID NO: 424327 - RNA, 22 nt, Human
agccacagugcaagagagaaaa

SEQ ID NO: 424328 - RNA, 22 nt, Human
uuuuccuuucaucaggacaaag

SEQ ID NO: 424329 - RNA, 22 nt, Human
agucauauguggcauuuucuaa

SEQ ID NO: 424330 - RNA, 22 nt, Human
aaaaguucccugguuagaaaag

SEQ ID NO: 424331 - RNA, 22 nt, Human
ucagagcuuuggagaccaggaa

SEQ ID NO: 424332 - RNA, 22 nt, Human
cugggagcuagcucugagcuga

SEQ ID NO: 424333 - RNA, 20 nt, Human
aguagcagugugacauugac

SEQ ID NO: 424334 - RNA, 22 nt, Human
uugcucaggcuuagagcuacua

SEQ ID NO: 424335 - RNA, 22 nt, Human
accaggggaugguuggcacugu

SEQ ID NO: 424336 - RNA, 22 nt, Human
agaguggagagaaacaacucug

SEQ ID NO: 424337 - RNA, 22 nt, Human
ucugggcugggagcguguggac

SEQ ID NO: 424338 - RNA, 20 nt, Human
cucucuggaaggugggagcc

SEQ ID NO: 424339 - RNA, 22 nt, Human
cugugcuugcggguguggagcc

SEQ ID NO: 424340 - RNA, 22 nt, Human
cucugaagggagggccaagccc

SEQ ID NO: 424341 - RNA, 22 nt, Human
ccaggccugugcaaggagggag

SEQ ID NO: 424342 - RNA, 22 nt, Human
augaagcugaccuugucuugcu

SEQ ID NO: 424343 - RNA, 22 nt, Human
cugagauggaguuucgcucuuc

SEQ ID NO: 424344 - RNA, 22 nt, Human
cugggcagcuaccaccacugcu

SEQ ID NO: 424345 - RNA, 22 nt, Human
acaggcugacuuccugccaugu

SEQ ID NO: 424346 - RNA, 22 nt, Human
cauuacauuucaaaauguuucc

SEQ ID NO: 424347 - RNA, 22 nt, Human
guugaaagagcauggacuugaa

SEQ ID NO: 424348 - RNA, 22 nt, Human
gagagcugugguuugaccaggc

SEQ ID NO: 424349 - RNA, 22 nt, Human
caccagggcucugagcucugaa

SEQ ID NO: 424350 - RNA, 22 nt, Human
uacccaggagaaacagcagggc

SEQ ID NO: 424351 - RNA, 22 nt, Human
agaggaugguugaggaagaccu

SEQ ID NO: 424352 - RNA, 22 nt, Human
uagauuucgcugcaucucaauc

SEQ ID NO: 424353 - RNA, 22 nt, Human
agagaaaagaguucaggcuuug

SEQ ID NO: 424354 - RNA, 21 nt, Human
ggucuuccaaauaaggagaaa

SEQ ID NO: 424355 - RNA, 22 nt, Human
ccagcugauucgguggugguug

SEQ ID NO: 424356 - RNA, 22 nt, Human
cagcucccagagugaccagcag

SEQ ID NO: 424357 - RNA, 22 nt, Human
uggggcuguccuuagucugaga

SEQ ID NO: 424358 - RNA, 22 nt, Human
gacauucacagguaaacauucc

SEQ ID NO: 424359 - RNA, 22 nt, Human
aaauguguuucgaaaacuggug

SEQ ID NO: 424360 - RNA, 22 nt, Human
acagauuuauugaagcugcugc

SEQ ID NO: 424361 - RNA, 22 nt, Human
auauauuugagaauauucauga

SEQ ID NO: 424362 - RNA, 22 nt, Human
ugggcagacuaaggucaaagcu

SEQ ID NO: 424363 - RNA, 22 nt, Human
uagaggcagaagaaauugacaa

SEQ ID NO: 424364 - RNA, 22 nt, Human
gagcuggcuaauacugacuuau

SEQ ID NO: 424365 - RNA, 22 nt, Human
uccugucagugaggcagaugaa

SEQ ID NO: 424366 - RNA, 22 nt, Human
cuugaaagcacuccuuugacug

SEQ ID NO: 424367 - RNA, 22 nt, Human
gccaguggcuugccaggcagga

SEQ ID NO: 424368 - RNA, 22 nt, Human
uccuuugguuguagacaggaau

SEQ ID NO: 424369 - RNA, 22 nt, Human
gggcacugaaugccaagcuagg

SEQ ID NO: 424370 - RNA, 22 nt, Human
aaggagcuuguucgccuuccuc

SEQ ID NO: 424371 - RNA, 21 nt, Human
agggccugugcucuccagguc

SEQ ID NO: 424372 - RNA, 22 nt, Human
cagagccaacgccaccugccca

SEQ ID NO: 424373 - RNA, 22 nt, Human
caccagguggaaaugucacagc

SEQ ID NO: 424374 - RNA, 22 nt, Human
ugucccagacauaaguggacau

SEQ ID NO: 424375 - RNA, 20 nt, Human
gcuuuuucuaauagcagucc

SEQ ID NO: 424376 - RNA, 22 nt, Human
agggccagaggcaccuugcagc

SEQ ID NO: 424377 - RNA, 22 nt, Human
uuugcauugcauacaaggaacu

SEQ ID NO: 424378 - RNA, 20 nt, Human
aagaaacuugaaaguacaag

SEQ ID NO: 424379 - RNA, 22 nt, Human
caguuucuguuuuaaauagcag

SEQ ID NO: 424380 - RNA, 22 nt, Human
cucugcauuuuaacagaugauu

SEQ ID NO: 424381 - RNA, 23 nt, Human
cauguacagaguuugauaaagug

SEQ ID NO: 424382 - RNA, 22 nt, Human
uggcugagguuaugcugguugu

SEQ ID NO: 424383 - RNA, 22 nt, Human
ccugcccagcuucccgagugca

SEQ ID NO: 424384 - RNA, 22 nt, Human
gccuggagaauuaaaaggaagg

SEQ ID NO: 424385 - RNA, 22 nt, Human
cagcugaguguuggcauguuca

SEQ ID NO: 424386 - RNA, 22 nt, Human
uaggggaacuggcacagggcag

SEQ ID NO: 424387 - RNA, 22 nt, Human
cagugauguuucugcaucagag

SEQ ID NO: 424388 - RNA, 22 nt, Human
cacauugaaaugacccaauaau

SEQ ID NO: 424389 - RNA, 22 nt, Human
ucccuccuggugagcaggggcu

SEQ ID NO: 424390 - RNA, 21 nt, Human
uggagcugccacuuguccucc

SEQ ID NO: 424391 - RNA, 22 nt, Human
gcacacacuguuuuccucacau

SEQ ID NO: 424392 - RNA, 22 nt, Human
gaagccaagugcaaaugccuua

SEQ ID NO: 424393 - RNA, 22 nt, Human
gcugaguguaaugauggcagag

SEQ ID NO: 424394 - RNA, 19 nt, Human
ucacaggcaucuccccaga

SEQ ID NO: 424395 - RNA, 22 nt, Human
gaggccugaaaggggaccuaug

SEQ ID NO: 424396 - RNA, 22 nt, Human
augggcuguccuaguccagccc

SEQ ID NO: 424397 - RNA, 22 nt, Human
acccaggccugagagacaggag

SEQ ID NO: 424398 - RNA, 22 nt, Human
gccaggcacugcucuaagcccu

SEQ ID NO: 424399 - RNA, 22 nt, Human
agugaaauugcuguaagaggaa

SEQ ID NO: 424400 - RNA, 22 nt, Human
gaagccagcaguggagaaagga

SEQ ID NO: 424401 - RNA, 22 nt, Human
gagcacccuuugcacaucaguc

SEQ ID NO: 424402 - RNA, 22 nt, Human
acagagagaaacaaucagcagc

SEQ ID NO: 424403 - RNA, 22 nt, Human
gaggaagcagggcuuggcugag

SEQ ID NO: 424404 - RNA, 22 nt, Human
uccuguggucuggaaggaaugg

SEQ ID NO: 424405 - RNA, 22 nt, Human
ggggauggaauguaguagugau

SEQ ID NO: 424406 - RNA, 22 nt, Human
ugcugugcuggcggcagaggcc

SEQ ID NO: 424407 - RNA, 22 nt, Human
gagaggcauggaacagauucuu

SEQ ID NO: 424408 - RNA, 22 nt, Human
aaguguuuacuuaaagucaugg

SEQ ID NO: 424409 - RNA, 22 nt, Human
acaaagucucuaauaaucuucu

SEQ ID NO: 424410 - RNA, 22 nt, Human
gucagcagugucagcucugggg

SEQ ID NO: 424411 - RNA, 22 nt, Human
ggccugagcuugggcagcguau

SEQ ID NO: 424412 - RNA, 22 nt, Human
uagaacagaggguugcccagau

SEQ ID NO: 424413 - RNA, 22 nt, Human
agugaaaugacugaaucagaua

SEQ ID NO: 424414 - RNA, 22 nt, Human
uccugcagagccgcccucaggu

SEQ ID NO: 424415 - RNA, 22 nt, Human
agcagggcucugccaugggccc

SEQ ID NO: 424416 - RNA, 22 nt, Human
gcugccagcucacucuccugag

SEQ ID NO: 424417 - RNA, 22 nt, Human
uccuuuguuaaggagguuuguu

SEQ ID NO: 424418 - RNA, 22 nt, Human
uccagggagauacuggcugcca

SEQ ID NO: 424419 - RNA, 22 nt, Human
acagccagguaaaggcauggca

SEQ ID NO: 424420 - RNA, 22 nt, Human
ucuggagauaagacagacagau

SEQ ID NO: 424421 - RNA, 22 nt, Human
gcuggcaucacuggcuucggug

SEQ ID NO: 424422 - RNA, 22 nt, Human
agcauugccugccuauugcuaa

SEQ ID NO: 424423 - RNA, 19 nt, Human
gcuggcagauguggccgug

SEQ ID NO: 424424 - RNA, 22 nt, Human
aaaaguauaggguuuggaguca

SEQ ID NO: 424425 - RNA, 22 nt, Human
gagcagcuggacaggccucccu

SEQ ID NO: 424426 - RNA, 22 nt, Human
cccaggucugugccagcucuga

SEQ ID NO: 424427 - RNA, 22 nt, Human
guuuuauaauugcuucauaaga

SEQ ID NO: 424428 - RNA, 22 nt, Human
agaaauuccuaagguacacaag

SEQ ID NO: 424429 - RNA, 22 nt, Human
gaaggcuggcuuucugagagca

SEQ ID NO: 424430 - RNA, 22 nt, Human
uaaaucacuccuaauaaucagu

SEQ ID NO: 424431 - RNA, 22 nt, Human
gacccaggcccaaggcugccag

SEQ ID NO: 424432 - RNA, 22 nt, Human
uuauuuaggagaaggaacccug

SEQ ID NO: 424433 - RNA, 22 nt, Human
ggggcagagcauagcuccaauu

SEQ ID NO: 424434 - RNA, 23 nt, Human
aaggccagaauuucaauggugcc

SEQ ID NO: 424435 - RNA, 22 nt, Human
cauaucauaggucuuggauaau

SEQ ID NO: 424436 - RNA, 22 nt, Human
ggagcugcauuuagggagccuu

SEQ ID NO: 424437 - RNA, 22 nt, Human
ggcuccagggaguggagagaag

SEQ ID NO: 424438 - RNA, 22 nt, Human
cacugggcaauucugagccuaa

SEQ ID NO: 424439 - RNA, 22 nt, Human
cauuauggcagccaggauauug

SEQ ID NO: 424440 - RNA, 22 nt, Human
caggugccgggaaugcagcaau

SEQ ID NO: 424441 - RNA, 22 nt, Human
ucuggcuccugaguccaugcuc

SEQ ID NO: 424442 - RNA, 22 nt, Human
cagcuguggagauggggugcau

SEQ ID NO: 424443 - RNA, 22 nt, Human
gccaggcagcugggagggugcc

SEQ ID NO: 424444 - RNA, 20 nt, Human
uccaggcagcucagaguguc

SEQ ID NO: 424445 - RNA, 22 nt, Human
ugugccuucucaguccugcuca

SEQ ID NO: 424446 - RNA, 22 nt, Human
aucagaagcuuguagucucucu

SEQ ID NO: 424447 - RNA, 22 nt, Human
ugggcacuguagcuggugcugg

SEQ ID NO: 424448 - RNA, 22 nt, Human
caggagacuauggcccaaggcc

SEQ ID NO: 424449 - RNA, 22 nt, Human
cagucccagcugcucagaaggc

SEQ ID NO: 424450 - RNA, 22 nt, Human
cugcugcauuccucuuuaugag

SEQ ID NO: 424451 - RNA, 22 nt, Human
cuuucuuauaccugucagggcc

SEQ ID NO: 424452 - RNA, 22 nt, Human
cuggcugcaggaugaggcugcc

SEQ ID NO: 424453 - RNA, 21 nt, Human
agugaaauugcaucagaggga

SEQ ID NO: 424454 - RNA, 22 nt, Human
caagagcugcaaauagcgugac

SEQ ID NO: 424455 - RNA, 22 nt, Human
uuugcauuugcaaauaaugaaa

SEQ ID NO: 424456 - RNA, 20 nt, Human
ggcucugcuugugagcagcc

SEQ ID NO: 424457 - RNA, 22 nt, Human
cucagagucccuucccucgugg

SEQ ID NO: 424458 - RNA, 22 nt, Human
cuuggcagauccaaaaaugaca

SEQ ID NO: 424459 - RNA, 22 nt, Human
acaguggauauauuaaaugaga

SEQ ID NO: 424460 - RNA, 22 nt, Human
aaguucaaggaagccuccaguu

SEQ ID NO: 424461 - RNA, 22 nt, Human
guccucuuagccacuuaauuau

SEQ ID NO: 424462 - RNA, 22 nt, Human
gcuucuauuauuuggagcugag

SEQ ID NO: 424463 - RNA, 22 nt, Human
ccugccugucaucgccugcgcc

SEQ ID NO: 424464 - RNA, 22 nt, Human
uggccaccccuuucucugcacu

SEQ ID NO: 424465 - RNA, 22 nt, Human
guggagcaaucagagggucagu

SEQ ID NO: 424466 - RNA, 22 nt, Human
aggccaggaccauuagcccaga

SEQ ID NO: 424467 - RNA, 20 nt, Human
gcuguugccaguacagaugg

SEQ ID NO: 424468 - RNA, 22 nt, Human
uuuuccucugcaauaaaagcag

SEQ ID NO: 424469 - RNA, 22 nt, Human
agcagccauuuaaaaugaauug

SEQ ID NO: 424470 - RNA, 22 nt, Human
uugugaaacauucauggauuug

SEQ ID NO: 424471 - RNA, 22 nt, Human
uucaaaacagcuagauauugga

SEQ ID NO: 424472 - RNA, 22 nt, Human
gcccugagacugagcauggguu

SEQ ID NO: 424473 - RNA, 23 nt, Human
ucucaggacacacaugucuauca

SEQ ID NO: 424474 - RNA, 22 nt, Human
caagggcuucaaguggccaaga

SEQ ID NO: 424475 - RNA, 22 nt, Human
caaagggcucuagacucagcag

SEQ ID NO: 424476 - RNA, 22 nt, Human
uuucugcucgcucucaaucagg

SEQ ID NO: 424477 - RNA, 22 nt, Human
gcuggcuuugcacugggugcau

SEQ ID NO: 424478 - RNA, 22 nt, Human
gcucccagggcagcgcagaaga

SEQ ID NO: 424479 - RNA, 22 nt, Human
cauuuaaucuggcucaugagca

SEQ ID NO: 424480 - RNA, 22 nt, Human
gcuuuuauugucuuuacgacga

SEQ ID NO: 424481 - RNA, 22 nt, Human
cugaaggauucaaaauggcagg

SEQ ID NO: 424482 - RNA, 22 nt, Human
ugaggcagggaguuuaauuguc

SEQ ID NO: 424483 - RNA, 22 nt, Human
ccugggcucaagugauccuccu

SEQ ID NO: 424484 - RNA, 22 nt, Human
acacaguaccccaaggcugggc

SEQ ID NO: 424485 - RNA, 22 nt, Human
gcagccacugggagugcuuaua

SEQ ID NO: 424486 - RNA, 19 nt, Human
auagucuuuccaauuauac

SEQ ID NO: 424487 - RNA, 22 nt, Human
uuaugacauaugaguacaagua

SEQ ID NO: 424488 - RNA, 19 nt, Human
aggcagucauuggaauaua

SEQ ID NO: 424489 - RNA, 22 nt, Human
augaagcuaaacccugcagcca

SEQ ID NO: 424490 - RNA, 22 nt, Human
caucagagugguggccuggugu

SEQ ID NO: 424491 - RNA, 22 nt, Human
uggccugcagaggcuguggggc

SEQ ID NO: 424492 - RNA, 20 nt, Human
cucaggauacugcaaaguug

SEQ ID NO: 424493 - RNA, 19 nt, Human
cuggugcuugagugaguca

SEQ ID NO: 424494 - RNA, 22 nt, Human
cauuucuacagcuucuucagaa

SEQ ID NO: 424495 - RNA, 22 nt, Human
uuguuuucacagcuuugcccgg

SEQ ID NO: 424496 - RNA, 22 nt, Human
gcugaguugaaagcagaggaua

SEQ ID NO: 424497 - RNA, 22 nt, Human
cucaggauucucgacacucaca

SEQ ID NO: 424498 - RNA, 22 nt, Human
cucccugggccucaguuucucu

SEQ ID NO: 424499 - RNA, 22 nt, Human
agcugccuccauggucaaagau

SEQ ID NO: 424500 - RNA, 22 nt, Human
agaagcagcuuucaaggugauu

SEQ ID NO: 424501 - RNA, 22 nt, Human
gaggccuggcugggaggaggug

SEQ ID NO: 424502 - RNA, 22 nt, Human
uuugaaagcaggugugggaggg

SEQ ID NO: 424503 - RNA, 22 nt, Human
aagagcuggaagugaagauaac

SEQ ID NO: 424504 - RNA, 22 nt, Human
uuaaacaguguuucaugugggg

SEQ ID NO: 424505 - RNA, 22 nt, Human
uucaaguucauguguagucagu

SEQ ID NO: 424506 - RNA, 22 nt, Human
caaaguucucggcucaaguccu

SEQ ID NO: 424507 - RNA, 23 nt, Human
agaggcaggaguggcuugcccgg

SEQ ID NO: 424508 - RNA, 22 nt, Human
uacauaguauucacauuguuuu

SEQ ID NO: 424509 - RNA, 22 nt, Human
aggcagguguuaacccucugag

SEQ ID NO: 424510 - RNA, 22 nt, Human
acauuucuaucauccuguaaug

SEQ ID NO: 424511 - RNA, 17 nt, Human
aguguuuccuuaucauu

SEQ ID NO: 424512 - RNA, 22 nt, Human
aggcuucagaugaccuuagcau

SEQ ID NO: 424513 - RNA, 22 nt, Human
gcagacuguaucaaugucagua

SEQ ID NO: 424514 - RNA, 22 nt, Human
guggccuggaguuugauguagg

SEQ ID NO: 424515 - RNA, 22 nt, Human
ggcugggagcuggacaggccgg

SEQ ID NO: 424516 - RNA, 22 nt, Human
ggcagcuguaagaugagugaau

SEQ ID NO: 424517 - RNA, 22 nt, Human
aggagccaguuccaccccagga

SEQ ID NO: 424518 - RNA, 22 nt, Human
agggcagcacagcugugcuccu

SEQ ID NO: 424519 - RNA, 22 nt, Human
uuuccaaagguggcaggaacaa

SEQ ID NO: 424520 - RNA, 22 nt, Human
ccagggcauguccaagacuuag

SEQ ID NO: 424521 - RNA, 22 nt, Human
acagaguauuggaaaggcagug

SEQ ID NO: 424522 - RNA, 22 nt, Human
augaaacugggauaacuauagc

SEQ ID NO: 424523 - RNA, 22 nt, Human
gcagggaccugccacugcuguc

SEQ ID NO: 424524 - RNA, 22 nt, Human
gcaggaagaugagcucagguaa

SEQ ID NO: 424525 - RNA, 19 nt, Human
acagagcucucugcuucug

SEQ ID NO: 424526 - RNA, 22 nt, Human
auguccagaguaaagcacauuc

SEQ ID NO: 424527 - RNA, 21 nt, Human
uuucacaaaaguaugugacaa

SEQ ID NO: 424528 - RNA, 19 nt, Human
agcuggggcgguguguguu

SEQ ID NO: 424529 - RNA, 22 nt, Human
auuguacagaugagguaaguga

SEQ ID NO: 424530 - RNA, 22 nt, Human
gguggggucacgacagagggaa

SEQ ID NO: 424531 - RNA, 20 nt, Human
uccuuuggccuuagagcugu

SEQ ID NO: 424532 - RNA, 22 nt, Human
uuauuuucagcuaggaaagcca

SEQ ID NO: 424533 - RNA, 21 nt, Human
cagugcucaaucugacagugg

SEQ ID NO: 424534 - RNA, 22 nt, Human
uaaguaaauuuauaaugugauu

SEQ ID NO: 424535 - RNA, 22 nt, Human
gccuuccuuacaccugcucagc

SEQ ID NO: 424536 - RNA, 22 nt, Human
uggccucugcaauggauucacc

SEQ ID NO: 424537 - RNA, 22 nt, Human
cuguauuuguccucuauuuauu

SEQ ID NO: 424538 - RNA, 22 nt, Human
ugggcuggcguggagaguuuag

SEQ ID NO: 424539 - RNA, 22 nt, Human
aaggccauuauucugauauauu

SEQ ID NO: 424540 - RNA, 22 nt, Human
ccaucccuccuccaccagcuag

SEQ ID NO: 424541 - RNA, 22 nt, Human
aaaaguuuaagacucauucuag

SEQ ID NO: 424542 - RNA, 22 nt, Human
cucucugagugagggacaagcu

SEQ ID NO: 424543 - RNA, 22 nt, Human
aauauaauuuuauuccuagagu

SEQ ID NO: 424544 - RNA, 22 nt, Human
aaguccaucucugccccacaca

SEQ ID NO: 424545 - RNA, 22 nt, Human
ucggagcuguagaugaaacccu

SEQ ID NO: 424546 - RNA, 22 nt, Human
cccuggccagcucaugucugag

SEQ ID NO: 424547 - RNA, 22 nt, Human
ccucaggcuuacgggcaaugga

SEQ ID NO: 424548 - RNA, 19 nt, Human
ucugucacuggggguauuc

SEQ ID NO: 424549 - RNA, 22 nt, Human
gaagagcugacagugucauccu

SEQ ID NO: 424550 - RNA, 22 nt, Human
gggcaguggguggcugcagccu

SEQ ID NO: 424551 - RNA, 22 nt, Human
aaagucugagcagaauuucuca

SEQ ID NO: 424552 - RNA, 22 nt, Human
ucucagugacacucuucauaca

SEQ ID NO: 424553 - RNA, 22 nt, Human
agggaguguaaauggugcucag

SEQ ID NO: 424554 - RNA, 22 nt, Human
ugggcagauguccucugaagug

SEQ ID NO: 424555 - RNA, 21 nt, Human
ugcaggagucugugagucagg

SEQ ID NO: 424556 - RNA, 22 nt, Human
gauggcacacagacauccccgc

SEQ ID NO: 424557 - RNA, 22 nt, Human
agcugaagaaaugggaagcauu

SEQ ID NO: 424558 - RNA, 22 nt, Human
ucccagccuuccuuguggugaa

SEQ ID NO: 424559 - RNA, 22 nt, Human
cuuccaaagcacuuuauggacc

SEQ ID NO: 424560 - RNA, 21 nt, Human
ugggcagauggcaguguggcu

SEQ ID NO: 424561 - RNA, 21 nt, Human
uggcccuggccacggcugcca

SEQ ID NO: 424562 - RNA, 22 nt, Human
gcagaggacagggauuuagauu

SEQ ID NO: 424563 - RNA, 22 nt, Human
uaauguguccugaaagcuucug

SEQ ID NO: 424564 - RNA, 22 nt, Human
aaaguggucaccuucucauuuc

SEQ ID NO: 424565 - RNA, 22 nt, Human
uuaguaauguguuaauaugaau

SEQ ID NO: 424566 - RNA, 22 nt, Human
aagcaggcauuccagagacaau

SEQ ID NO: 424567 - RNA, 22 nt, Human
gccaccuguuucgcuugcccag

SEQ ID NO: 424568 - RNA, 22 nt, Human
uaaaggcucacuggcuuggggu

SEQ ID NO: 424569 - RNA, 22 nt, Human
uagagcugggcagugcucugag

SEQ ID NO: 424570 - RNA, 22 nt, Human
ccagggcaauaggaacacuuuu

SEQ ID NO: 424571 - RNA, 22 nt, Human
cuccagugggggugagccuaga

SEQ ID NO: 424572 - RNA, 22 nt, Human
agcaggugacccaagcaggcug

SEQ ID NO: 424573 - RNA, 22 nt, Human
gggagggaggugaugcuuggcu

SEQ ID NO: 424574 - RNA, 22 nt, Human
aaguccagacuccuuugcgugg

SEQ ID NO: 424575 - RNA, 22 nt, Human
uucuaccagaccccagacuugu

SEQ ID NO: 424576 - RNA, 22 nt, Human
ugcaauaaggaguaauaguaaa

SEQ ID NO: 424577 - RNA, 22 nt, Human
uggcugaggcuggagugcagug

SEQ ID NO: 424578 - RNA, 22 nt, Human
gccugaagaacagcugugagga

SEQ ID NO: 424579 - RNA, 22 nt, Human
augaaggcuguguggagccccc

SEQ ID NO: 424580 - RNA, 22 nt, Human
aagcugcccaagacugaagcau

SEQ ID NO: 424581 - RNA, 19 nt, Human
ccagguggaacugagguag

SEQ ID NO: 424582 - RNA, 22 nt, Human
aauuagagaucaguucuuugac

SEQ ID NO: 424583 - RNA, 22 nt, Human
gccugcuggcuguccauugcag

SEQ ID NO: 424584 - RNA, 22 nt, Human
uacagaguggugagaucuuuug

SEQ ID NO: 424585 - RNA, 22 nt, Human
uggcugaguucuccaggaguag

SEQ ID NO: 424586 - RNA, 22 nt, Human
gggcucucaaggcagggcccca

SEQ ID NO: 424587 - RNA, 22 nt, Human
ucaggagcagcaugggugagag

SEQ ID NO: 424588 - RNA, 22 nt, Human
gcucugaggcugugaggugcug

SEQ ID NO: 424589 - RNA, 22 nt, Human
uccaugggaagauuuugagugg

SEQ ID NO: 424590 - RNA, 22 nt, Human
ucaaucacguguuccauguucu

SEQ ID NO: 424591 - RNA, 22 nt, Human
agaagccaaucagcucucugcu

SEQ ID NO: 424592 - RNA, 22 nt, Human
cuaguggaaacuaacuggaauu

SEQ ID NO: 424593 - RNA, 22 nt, Human
auuaauuuuaccuuuguaaaca

SEQ ID NO: 424594 - RNA, 22 nt, Human
aagaaauauugggccuuauaaa

SEQ ID NO: 424595 - RNA, 22 nt, Human
caugagcugcugggagccuguc

SEQ ID NO: 424596 - RNA, 22 nt, Human
gggugggagucuggcccucaaa

SEQ ID NO: 424597 - RNA, 22 nt, Human
uuccaggggcagcagugauggu

SEQ ID NO: 424598 - RNA, 22 nt, Human
auaguacacauccuacaauguu

SEQ ID NO: 424599 - RNA, 22 nt, Human
ggauggagguucucagaugcuc

SEQ ID NO: 424600 - RNA, 22 nt, Human
caggaggccaacugugggacuu

SEQ ID NO: 424601 - RNA, 22 nt, Human
gaggagcacaugaggcugaggg

SEQ ID NO: 424602 - RNA, 21 nt, Human
uuacuuuugcagcaaccuaau

SEQ ID NO: 424603 - RNA, 22 nt, Human
uauuugaagggagaaagugcca

SEQ ID NO: 424604 - RNA, 22 nt, Human
gccuggccgcuccgagcuccgc

SEQ ID NO: 424605 - RNA, 22 nt, Human
aggcgcagaaggccaggggccu

SEQ ID NO: 424606 - RNA, 22 nt, Human
ugugccagccucuggcuguguc

SEQ ID NO: 424607 - RNA, 22 nt, Human
acaucacagagcccagauaaag

SEQ ID NO: 424608 - RNA, 22 nt, Human
guggaggagaggcgccuugcgg

SEQ ID NO: 424609 - RNA, 20 nt, Human
gcugaggucauuaugccuca

SEQ ID NO: 424610 - RNA, 22 nt, Human
uuauuauugugaccugagaaug

SEQ ID NO: 424611 - RNA, 21 nt, Human
uacaagaccggauucgggccc

SEQ ID NO: 424612 - RNA, 22 nt, Human
ugaggcaggacugagcgggaug

SEQ ID NO: 424613 - RNA, 22 nt, Human
cuccaggcucguccaagaucga

SEQ ID NO: 424614 - RNA, 22 nt, Human
cagcauuuucuuaauguaggug

SEQ ID NO: 424615 - RNA, 22 nt, Human
auggcagccugagcagaggaau

SEQ ID NO: 424616 - RNA, 22 nt, Human
gcuggccauauauuuugcuguu

SEQ ID NO: 424617 - RNA, 22 nt, Human
cucugguucagggcucccuggc

SEQ ID NO: 424618 - RNA, 22 nt, Human
ggcugcagagcugggugggccu

SEQ ID NO: 424619 - RNA, 22 nt, Human
gaaguggaauuacugggucaua

SEQ ID NO: 424620 - RNA, 22 nt, Human
ggcugagccuggagcaucuggu

SEQ ID NO: 424621 - RNA, 22 nt, Human
gugccugguuuggggaguguuc

SEQ ID NO: 424622 - RNA, 22 nt, Human
caagggcagcagccucaagcgg

SEQ ID NO: 424623 - RNA, 22 nt, Human
agagcaggcauaaagcuuugaa

SEQ ID NO: 424624 - RNA, 22 nt, Human
uuugacaaaggaaaaaugcaca

SEQ ID NO: 424625 - RNA, 22 nt, Human
ccugggugaugugcugcccucg

SEQ ID NO: 424626 - RNA, 22 nt, Human
aggggcugcuggguccgccccu

SEQ ID NO: 424627 - RNA, 18 nt, Human
gccugccuagagcuugcc

SEQ ID NO: 424628 - RNA, 22 nt, Human
aaugaacaggugaaugucagau

SEQ ID NO: 424629 - RNA, 22 nt, Human
cagcagggggcagcgcagauca

SEQ ID NO: 424630 - RNA, 22 nt, Human
cuggaagaggaagccagcugga

SEQ ID NO: 424631 - RNA, 22 nt, Human
cuuuggaacauacugcugagcu

SEQ ID NO: 424632 - RNA, 21 nt, Human
ugaggccucuccugggcuggc

SEQ ID NO: 424633 - RNA, 22 nt, Human
cccugcagaucagugagaacuu

SEQ ID NO: 424634 - RNA, 22 nt, Human
cuggccagacuacacaugugug

SEQ ID NO: 424635 - RNA, 22 nt, Human
aagccagguguuuaggccagcg

SEQ ID NO: 424636 - RNA, 22 nt, Human
ggcaggagauaaaauauuaguu

SEQ ID NO: 424637 - RNA, 22 nt, Human
uaguuucauaugcaaaauagua

SEQ ID NO: 424638 - RNA, 22 nt, Human
aaugggaggauuuucucucuug

SEQ ID NO: 424639 - RNA, 22 nt, Human
aaggcacuugcccagagcugca

SEQ ID NO: 424640 - RNA, 22 nt, Human
agcagcuccugccaugagugcu

SEQ ID NO: 424641 - RNA, 22 nt, Human
ucagcauaucuugagcuucaug

SEQ ID NO: 424642 - RNA, 22 nt, Human
ggcagcaaauauugucagcugu

SEQ ID NO: 424643 - RNA, 22 nt, Human
gagcuuuaggagaaggagguca

SEQ ID NO: 424644 - RNA, 22 nt, Human
uggggacauagccagucuggcu

SEQ ID NO: 424645 - RNA, 22 nt, Human
ccuggcugggccugauuucuca

SEQ ID NO: 424646 - RNA, 22 nt, Human
agaggcaguauacaauccgagc

SEQ ID NO: 424647 - RNA, 22 nt, Human
auuauuagugauguuguuacug

SEQ ID NO: 424648 - RNA, 22 nt, Human
cagcucuggcgucagggagcga

SEQ ID NO: 424649 - RNA, 22 nt, Human
gacagccucaugaggagcaaaa

SEQ ID NO: 424650 - RNA, 22 nt, Human
ccugaggggcugcaggccagcu

SEQ ID NO: 424651 - RNA, 22 nt, Human
caggugcuguccugcacauguc

SEQ ID NO: 424652 - RNA, 22 nt, Human
guauuuuacuuacgcaugacuu

SEQ ID NO: 424653 - RNA, 22 nt, Human
cuggggcugcggacgggagccc

SEQ ID NO: 424654 - RNA, 22 nt, Human
ccagcagaggggcggagugcag

SEQ ID NO: 424655 - RNA, 22 nt, Human
uuuaaauucugucugccgcuua

SEQ ID NO: 424656 - RNA, 18 nt, Human
aggccagcccugcuacug

SEQ ID NO: 424657 - RNA, 22 nt, Human
gggcugcuuccuggggaaugcu

SEQ ID NO: 424658 - RNA, 22 nt, Human
gaaggccuagggaugcucugcg

SEQ ID NO: 424659 - RNA, 22 nt, Human
gugcugagcugcagaugcgcuc

SEQ ID NO: 424660 - RNA, 22 nt, Human
ucacauuuuaucuauuuuaagu

SEQ ID NO: 424661 - RNA, 22 nt, Human
uggcuucuugggaugggucauu

SEQ ID NO: 424662 - RNA, 22 nt, Human
caggguggcacucagcgcaucu

SEQ ID NO: 424663 - RNA, 22 nt, Human
cugucuuugguccugucuguua

SEQ ID NO: 424664 - RNA, 18 nt, Human
cuuucagauggauaugcu

SEQ ID NO: 424665 - RNA, 22 nt, Human
augcaguaaauguucuaguuug

SEQ ID NO: 424666 - RNA, 22 nt, Human
ccaggcucugucuggucagaag

SEQ ID NO: 424667 - RNA, 22 nt, Human
ucaaugauaucagcaggaugug

SEQ ID NO: 424668 - RNA, 22 nt, Human
caucacugacgcugagauucca

SEQ ID NO: 424669 - RNA, 22 nt, Human
uguuaaauguuccuuuacugga

SEQ ID NO: 424670 - RNA, 22 nt, Human
gaggcugaggguuagagaguca

SEQ ID NO: 424671 - RNA, 22 nt, Human
gaggucagucagaccaggguuu

SEQ ID NO: 424672 - RNA, 22 nt, Human
cagggcccaagacacaaugagg

SEQ ID NO: 424673 - RNA, 22 nt, Human
ggaagccagaaagugagaauau

SEQ ID NO: 424674 - RNA, 22 nt, Human
ggagccaggcaaucuguacuuu

SEQ ID NO: 424675 - RNA, 21 nt, Human
uggcugagccaggugugugga

SEQ ID NO: 424676 - RNA, 22 nt, Human
uccuucaguuaaagaucucaca

SEQ ID NO: 424677 - RNA, 19 nt, Human
acagaagcauagaaaagga

SEQ ID NO: 424678 - RNA, 19 nt, Human
ucccuggcgccucucgggc

SEQ ID NO: 424679 - RNA, 22 nt, Human
gcagaggcuccauuuuacagau

SEQ ID NO: 424680 - RNA, 22 nt, Human
gcagugguggagcuuacauauc

SEQ ID NO: 424681 - RNA, 22 nt, Human
gggcagcagcaggaggucucug

SEQ ID NO: 424682 - RNA, 22 nt, Human
ucucagugcagagaggcuaucu

SEQ ID NO: 424683 - RNA, 22 nt, Human
cagguccuggcaucaggcaggu

SEQ ID NO: 424684 - RNA, 22 nt, Human
gggucccaggaaggagcagugu

SEQ ID NO: 424685 - RNA, 22 nt, Human
ggauccuuaacuaucacaguga

SEQ ID NO: 424686 - RNA, 22 nt, Human
uaggcaggcugaauguagauuu

SEQ ID NO: 424687 - RNA, 22 nt, Human
ugggcagagaucuggaucaaac

SEQ ID NO: 424688 - RNA, 22 nt, Human
acaaacuucccagacaagcucc

SEQ ID NO: 424689 - RNA, 22 nt, Human
aagccaguguccagaaugggca

SEQ ID NO: 424690 - RNA, 22 nt, Human
cagcaggguagguuguaucagu

SEQ ID NO: 424691 - RNA, 22 nt, Human
uagggcucugcucaucaguugu

SEQ ID NO: 424692 - RNA, 22 nt, Human
acuccugguuuguguccuggcu

SEQ ID NO: 424693 - RNA, 22 nt, Human
aaacagaaggguagguaaacau

SEQ ID NO: 424694 - RNA, 22 nt, Human
ugucuguaagguguuuauguua

SEQ ID NO: 424695 - RNA, 22 nt, Human
ucagcagggccuccuugugcag

SEQ ID NO: 424696 - RNA, 22 nt, Human
gcugucugagaacaugguggaa

SEQ ID NO: 424697 - RNA, 22 nt, Human
ccaguccuggccaguaacauga

SEQ ID NO: 424698 - RNA, 23 nt, Human
acagcaagaggaccagaugugag

SEQ ID NO: 424699 - RNA, 22 nt, Human
uacauguuuacuccaagucagg

SEQ ID NO: 424700 - RNA, 22 nt, Human
augagcugugggauuccagagg

SEQ ID NO: 424701 - RNA, 22 nt, Human
uaggcugggaagaaagauucuc

SEQ ID NO: 424702 - RNA, 22 nt, Human
guguuuccucacuucucugacu

SEQ ID NO: 424703 - RNA, 22 nt, Human
uagucucugcuuugcccuuggc

SEQ ID NO: 424704 - RNA, 22 nt, Human
ucuccucaccaccagcagcaga

SEQ ID NO: 424705 - RNA, 22 nt, Human
cuguaaaacugcuuaaguaugc

SEQ ID NO: 424706 - RNA, 20 nt, Human
cacugaagacuucuugcuca

SEQ ID NO: 424707 - RNA, 22 nt, Human
gguggggccugcuccagcggcc

SEQ ID NO: 424708 - RNA, 22 nt, Human
aacuguaaugaauuguucauga

SEQ ID NO: 424709 - RNA, 22 nt, Human
ucacuguaucauguugcacuua

SEQ ID NO: 424710 - RNA, 22 nt, Human
uuuuccucugcagagcaguuag

SEQ ID NO: 424711 - RNA, 22 nt, Human
aggcucagucccggcccgcgcc

SEQ ID NO: 424712 - RNA, 22 nt, Human
acacagggggcauucuaggagu

SEQ ID NO: 424713 - RNA, 19 nt, Human
ugcagaggguaggaaggcc

SEQ ID NO: 424714 - RNA, 22 nt, Human
ugcugccaaaugcgagcucugu

SEQ ID NO: 424715 - RNA, 21 nt, Human
uaagccaccaugugaaaccag

SEQ ID NO: 424716 - RNA, 22 nt, Human
ugggacugcucuugcugggguc

SEQ ID NO: 424717 - RNA, 22 nt, Human
ucuuuugagggccagaggaaga

SEQ ID NO: 424718 - RNA, 22 nt, Human
ugugcaguuucuauguugucca

SEQ ID NO: 424719 - RNA, 22 nt, Human
gaagaaggugcuacacagggca

SEQ ID NO: 424720 - RNA, 22 nt, Human
aaugaugguuucaucacuugaa

SEQ ID NO: 424721 - RNA, 22 nt, Human
acacaugcugauaagaauauaa

SEQ ID NO: 424722 - RNA, 22 nt, Human
cacugaagccugggaguaagac

SEQ ID NO: 424723 - RNA, 22 nt, Human
cucacugcaaguuccaccuacc

SEQ ID NO: 424724 - RNA, 22 nt, Human
agaggccuaaccaagauguccu

SEQ ID NO: 424725 - RNA, 22 nt, Human
gccagcaguauguccuggcagu

SEQ ID NO: 424726 - RNA, 22 nt, Human
gcaggcaguuugcuuuucccuc

SEQ ID NO: 424727 - RNA, 22 nt, Human
gagaaggggugauguggguaau

SEQ ID NO: 424728 - RNA, 22 nt, Human
gcuguggccgucagggaaaugg

SEQ ID NO: 424729 - RNA, 22 nt, Human
ucacagcaaaagugugcagagc

SEQ ID NO: 424730 - RNA, 22 nt, Human
gagcucugggaaacaaagugua

SEQ ID NO: 424731 - RNA, 22 nt, Human
augugucaauuuucaaaugcuu

SEQ ID NO: 424732 - RNA, 22 nt, Human
uacaggaagcacucaagaaaug

SEQ ID NO: 424733 - RNA, 17 nt, Human
auuucacuuagcaugag

SEQ ID NO: 424734 - RNA, 22 nt, Human
gugucauguagaaauugaugaa

SEQ ID NO: 424735 - RNA, 20 nt, Human
aaaauauguauaacucuucu

SEQ ID NO: 424736 - RNA, 22 nt, Human
ccugccagcccgcguucaugcc

SEQ ID NO: 424737 - RNA, 22 nt, Human
guuguacaaaauaucagugagg

SEQ ID NO: 424738 - RNA, 22 nt, Human
ugcugaggucaccuugcugcua

SEQ ID NO: 424739 - RNA, 22 nt, Human
gccugggugucgaucacuagug

SEQ ID NO: 424740 - RNA, 22 nt, Human
uggccugcccagagcagcucug

SEQ ID NO: 424741 - RNA, 22 nt, Human
aggguggagggagucccugagc

SEQ ID NO: 424742 - RNA, 22 nt, Human
auuauguauuugguauaguuug

SEQ ID NO: 424743 - RNA, 22 nt, Human
augaaaacuuuagccucauuag

SEQ ID NO: 424744 - RNA, 22 nt, Human
uuugacagauccuuaacucagc

SEQ ID NO: 424745 - RNA, 22 nt, Human
aaagaacaaauuagcuguuuua

SEQ ID NO: 424746 - RNA, 23 nt, Human
cacuccuguuucuaagccagcau

SEQ ID NO: 424747 - RNA, 23 nt, Human
ugcuucucugcuugacaguucug

SEQ ID NO: 424748 - RNA, 22 nt, Human
uuguauuugauugucauaucgu

SEQ ID NO: 424749 - RNA, 22 nt, Human
gccugguggugugcucaagugg

SEQ ID NO: 424750 - RNA, 22 nt, Human
cccaggcauuuucaacuuuagu

SEQ ID NO: 424751 - RNA, 22 nt, Human
agagugauucuaguuagggaau

SEQ ID NO: 424752 - RNA, 22 nt, Human
gggccccuuguaucucuggcuc

SEQ ID NO: 424753 - RNA, 22 nt, Human
gugauuucagguuuuucauacu

SEQ ID NO: 424754 - RNA, 22 nt, Human
aggcugagccugggcguggugg

SEQ ID NO: 424755 - RNA, 22 nt, Human
gaggaaccacucugagaagcca

SEQ ID NO: 424756 - RNA, 22 nt, Human
ggaggccaucagggagggcauu

SEQ ID NO: 424757 - RNA, 22 nt, Human
ggcugccucuggaagcuggaga

SEQ ID NO: 424758 - RNA, 22 nt, Human
cucaggauuuaaaggggcacuc

SEQ ID NO: 424759 - RNA, 22 nt, Human
auucaaguccagcuucucuaca

SEQ ID NO: 424760 - RNA, 22 nt, Human
aguauacauauauuagccuucg

SEQ ID NO: 424761 - RNA, 22 nt, Human
cugugucccuugucccagagcc

SEQ ID NO: 424762 - RNA, 23 nt, Human
uggggccaagugaggaagggucu

SEQ ID NO: 424763 - RNA, 21 nt, Human
guauucuuuaugaagugaaaa

SEQ ID NO: 424764 - RNA, 22 nt, Human
gagagugucgggggccccagga

SEQ ID NO: 424765 - RNA, 22 nt, Human
uagaaaagauaacauucugugc

SEQ ID NO: 424766 - RNA, 22 nt, Human
ccucagggccaucucugucccu

SEQ ID NO: 424767 - RNA, 22 nt, Human
uauguagaagcugcucaaagaa

SEQ ID NO: 424768 - RNA, 22 nt, Human
uggcucaguuucaguccugguu

SEQ ID NO: 424769 - RNA, 22 nt, Human
aucacuguguauguauaugcag

SEQ ID NO: 424770 - RNA, 22 nt, Human
agucccagagaggucggggcca

SEQ ID NO: 424771 - RNA, 22 nt, Human
ugcauuugucuugucucaugaa

SEQ ID NO: 424772 - RNA, 22 nt, Human
ggcagauggagaagcagcaggu

SEQ ID NO: 424773 - RNA, 22 nt, Human
agucucuuggcauucugaaaca

SEQ ID NO: 424774 - RNA, 22 nt, Human
auguaguauuuggaaauguaaa

SEQ ID NO: 424775 - RNA, 22 nt, Human
uacuuuuagccuauuugauucu

SEQ ID NO: 424776 - RNA, 22 nt, Human
acacugaauauacaaugaauau

SEQ ID NO: 424777 - RNA, 22 nt, Human
cuucuuaaucccuuauauauuu

SEQ ID NO: 424778 - RNA, 22 nt, Human
agggcucugagcuggaccaccu

SEQ ID NO: 424779 - RNA, 22 nt, Human
ucccaggguuacagccagggca

SEQ ID NO: 424780 - RNA, 22 nt, Human
cuuccaguaguaucauucucau

SEQ ID NO: 424781 - RNA, 22 nt, Human
aggcuuccuggaggaagaggua

SEQ ID NO: 424782 - RNA, 22 nt, Human
acauccagaucucagcauggcu

SEQ ID NO: 424783 - RNA, 20 nt, Human
cccugagacaaaggaggggc

SEQ ID NO: 424784 - RNA, 22 nt, Human
agaaguaggcagggcuguauca

SEQ ID NO: 424785 - RNA, 22 nt, Human
uagggcuccacucccagagauu

SEQ ID NO: 424786 - RNA, 21 nt, Human
ggcuuuaugcucacccagccu

SEQ ID NO: 424787 - RNA, 22 nt, Human
agagcuggauggucaagauggc

SEQ ID NO: 424788 - RNA, 22 nt, Human
ugagcagggacuuugaguguag

SEQ ID NO: 424789 - RNA, 22 nt, Human
uacagauugagguuuuuaauau

SEQ ID NO: 424790 - RNA, 23 nt, Human
uggcagcagaucuuaaagugacc

SEQ ID NO: 424791 - RNA, 22 nt, Human
aacaugaaguuuucuauaguga

SEQ ID NO: 424792 - RNA, 22 nt, Human
agucuucccugugccagagugu

SEQ ID NO: 424793 - RNA, 22 nt, Human
gacuucuauuaauaccucuacu

SEQ ID NO: 424794 - RNA, 22 nt, Human
ucuccugugcacccucccugug

SEQ ID NO: 424795 - RNA, 22 nt, Human
ucugucaggagauuggcagcug

SEQ ID NO: 424796 - RNA, 22 nt, Human
ggccugucucacccccgggugc

SEQ ID NO: 424797 - RNA, 22 nt, Human
aaauguuccauuauuguguaau

SEQ ID NO: 424798 - RNA, 22 nt, Human
ccugagugccaugagagcaccc

SEQ ID NO: 424799 - RNA, 22 nt, Human
uguguuccugccuggcucuggu

SEQ ID NO: 424800 - RNA, 19 nt, Human
agggaguuuauauuugcac

SEQ ID NO: 424801 - RNA, 22 nt, Human
ccagcugcuugggaaaaugucu

SEQ ID NO: 424802 - RNA, 22 nt, Human
uccucaugccgggucucacgcu

SEQ ID NO: 424803 - RNA, 22 nt, Human
ugggaccugcccuggccccauc

SEQ ID NO: 424804 - RNA, 22 nt, Human
cuggugucugcucccucacagc

SEQ ID NO: 424805 - RNA, 21 nt, Human
ggcuguggagccaugacucac

SEQ ID NO: 424806 - RNA, 22 nt, Human
uggagcuggcuuguggaaguug

SEQ ID NO: 424807 - RNA, 22 nt, Human
aauuuuaucucuaagcaggcuu

SEQ ID NO: 424808 - RNA, 22 nt, Human
cagggccucuccuccaggaacu

SEQ ID NO: 424809 - RNA, 22 nt, Human
cccaggagagaggccaguuggc

SEQ ID NO: 424810 - RNA, 22 nt, Human
aaggcuuuuguuccuauuuagu

SEQ ID NO: 424811 - RNA, 22 nt, Human
ugccugaguuuaacccucagag

SEQ ID NO: 424812 - RNA, 22 nt, Human
agcagcucuggcacuguagcau

SEQ ID NO: 424813 - RNA, 22 nt, Human
caccaggcuggagugcagaggu

SEQ ID NO: 424814 - RNA, 22 nt, Human
gucagaggggcagcugccaggc

SEQ ID NO: 424815 - RNA, 22 nt, Human
aaccccgcucaggcugggugag

SEQ ID NO: 424816 - RNA, 22 nt, Human
gugaaaucugaggcccaugaug

SEQ ID NO: 424817 - RNA, 22 nt, Human
ucagaggaauaaugcugcauuu

SEQ ID NO: 424818 - RNA, 22 nt, Human
guguaauugaaauugagaacca

SEQ ID NO: 424819 - RNA, 22 nt, Human
aggacuucuccgauaagucaga

SEQ ID NO: 424820 - RNA, 22 nt, Human
ucccugggccacagcugugagc

SEQ ID NO: 424821 - RNA, 22 nt, Human
acuacuuugggccauuuguuua

SEQ ID NO: 424822 - RNA, 22 nt, Human
ugcaggcaggggaugagcagcc

SEQ ID NO: 424823 - RNA, 22 nt, Human
uagucuuuugagaaguauaucu

SEQ ID NO: 424824 - RNA, 22 nt, Human
uacuuuaaaaacugauaauuca

SEQ ID NO: 424825 - RNA, 22 nt, Human
uuucucaucuggaaacagugcu

SEQ ID NO: 424826 - RNA, 22 nt, Human
uggccuugggcagguggccugc

SEQ ID NO: 424827 - RNA, 22 nt, Human
gggcuucucuuaugcuaacugg

SEQ ID NO: 424828 - RNA, 22 nt, Human
uaagauaugguaggaaguuugg

SEQ ID NO: 424829 - RNA, 22 nt, Human
aaugucugagucucuguauccc

SEQ ID NO: 424830 - RNA, 22 nt, Human
uuagucuucuuccuuauauguu

SEQ ID NO: 424831 - RNA, 22 nt, Human
uaacagaaauauuuccagguga

SEQ ID NO: 424832 - RNA, 22 nt, Human
agcagcuguacuuucaucuguu

SEQ ID NO: 424833 - RNA, 22 nt, Human
ucugggcagcagcagcuaguag

SEQ ID NO: 424834 - RNA, 22 nt, Human
gcagggcacagacagugccaag

SEQ ID NO: 424835 - RNA, 22 nt, Human
uguguacauaucuauccuagau

SEQ ID NO: 424836 - RNA, 22 nt, Human
cagugucuccagaugcuccaau

SEQ ID NO: 424837 - RNA, 22 nt, Human
uucuaugccauguucagcuacu

SEQ ID NO: 424838 - RNA, 22 nt, Human
caggcagcucgaugccuuguug

SEQ ID NO: 424839 - RNA, 22 nt, Human
gugcagggagcccagaaggucc

SEQ ID NO: 424840 - RNA, 22 nt, Human
aaugcacaaaaauuguauguaa

SEQ ID NO: 424841 - RNA, 22 nt, Human
cagcugucuaaguugagcagga

SEQ ID NO: 424842 - RNA, 22 nt, Human
cacagggcagugcugcccacuc

SEQ ID NO: 424843 - RNA, 22 nt, Human
gagauucuguagucaggcaucu

SEQ ID NO: 424844 - RNA, 19 nt, Human
uaaaaacugaaggaagcag

SEQ ID NO: 424845 - RNA, 22 nt, Human
acagccugcugccugcuucuug

SEQ ID NO: 424846 - RNA, 22 nt, Human
gugugcagugagcaaaagaucu

SEQ ID NO: 424847 - RNA, 22 nt, Human
gugccagggaguggaggagcuu

SEQ ID NO: 424848 - RNA, 22 nt, Human
ccugccucaucaacuugucgug

SEQ ID NO: 424849 - RNA, 22 nt, Human
gccaggcuggaaagaacagaca

SEQ ID NO: 424850 - RNA, 22 nt, Human
ucugaggcccugcaggcagugu

SEQ ID NO: 424851 - RNA, 22 nt, Human
aguggcaguggcugggcagagc

SEQ ID NO: 424852 - RNA, 22 nt, Human
gccugugguuugauuaagcauu

SEQ ID NO: 424853 - RNA, 22 nt, Human
gcaguaggagaagaggaugcuu

SEQ ID NO: 424854 - RNA, 22 nt, Human
auacaucucauguaagagauaa

SEQ ID NO: 424855 - RNA, 22 nt, Human
acuaaaaacuacugccaauagc

SEQ ID NO: 424856 - RNA, 22 nt, Human
agcugcucuugggugacuucaa

SEQ ID NO: 424857 - RNA, 22 nt, Human
cagcaggcguugggagaaagac

SEQ ID NO: 424858 - RNA, 22 nt, Human
ugggcuccagcaccugugcucu

SEQ ID NO: 424859 - RNA, 22 nt, Human
uaaaauagcaugugcagugaaa

SEQ ID NO: 424860 - RNA, 22 nt, Human
aaaugaccagaauacaggcuuc

SEQ ID NO: 424861 - RNA, 22 nt, Human
cagugcaguuucccagaugcug

SEQ ID NO: 424862 - RNA, 22 nt, Human
ggagugacucucggggccacua

SEQ ID NO: 424863 - RNA, 22 nt, Human
aguggcaguggggcagggcccu

SEQ ID NO: 424864 - RNA, 22 nt, Human
agccuggcuaaauucucccaug

SEQ ID NO: 424865 - RNA, 22 nt, Human
guauucuugguuaucaaaauac

SEQ ID NO: 424866 - RNA, 22 nt, Human
agaaaaggcuugaagagguuuu

SEQ ID NO: 424867 - RNA, 22 nt, Human
aggcaggaacccugugugcgcc

SEQ ID NO: 424868 - RNA, 22 nt, Human
gcuguggaugcuauggaucauc

SEQ ID NO: 424869 - RNA, 22 nt, Human
ucagaaauguaagcugaugacu

SEQ ID NO: 424870 - RNA, 22 nt, Human
cugcaagauuggaagaugcaau

SEQ ID NO: 424871 - RNA, 22 nt, Human
aaggcacuagcagaauuaguga

SEQ ID NO: 424872 - RNA, 22 nt, Human
agcacaggaccaaggaagcugu

SEQ ID NO: 424873 - RNA, 22 nt, Human
cugccucuggccucaggcccag

SEQ ID NO: 424874 - RNA, 22 nt, Human
caaaauuagggagugagcugga

SEQ ID NO: 424875 - RNA, 22 nt, Human
ugugccuuaugaauucuuucug

SEQ ID NO: 424876 - RNA, 21 nt, Human
acagccugucaucucaugguc

SEQ ID NO: 424877 - RNA, 22 nt, Human
uggcagugccccuugaccagug

SEQ ID NO: 424878 - RNA, 23 nt, Human
agacagaggcugaggcuggccgc

SEQ ID NO: 424879 - RNA, 22 nt, Human
ccucugcagcagagagccagag

SEQ ID NO: 424880 - RNA, 22 nt, Human
cugguuccaggauggaucuuuc

SEQ ID NO: 424881 - RNA, 22 nt, Human
ugcagcuguaacagaggccuca

SEQ ID NO: 424882 - RNA, 22 nt, Human
agggaggaaggauguuccaaag

SEQ ID NO: 424883 - RNA, 22 nt, Human
cugucaccuguucacugcagca

SEQ ID NO: 424884 - RNA, 22 nt, Human
ucccagcauuaaugccugucag

SEQ ID NO: 424885 - RNA, 22 nt, Human
gcugucugucuucacaucucgc

SEQ ID NO: 424886 - RNA, 22 nt, Human
ugaggcuggcaaggcugguauu

SEQ ID NO: 424887 - RNA, 22 nt, Human
cagggcagagggaaacuccuuu

SEQ ID NO: 424888 - RNA, 22 nt, Human
ugucccaguuuaucugggacug

SEQ ID NO: 424889 - RNA, 22 nt, Human
ggcucaggacugcagcguagag

SEQ ID NO: 424890 - RNA, 22 nt, Human
gucccagggagguucagggcuu

SEQ ID NO: 424891 - RNA, 22 nt, Human
agauacaugucaagagacuuau

SEQ ID NO: 424892 - RNA, 22 nt, Human
aauuagggagagguagcuaggu

SEQ ID NO: 424893 - RNA, 22 nt, Human
agaagccauagucugggaggca

SEQ ID NO: 424894 - RNA, 22 nt, Human
guuugcauguguacuuaauugg

SEQ ID NO: 424895 - RNA, 21 nt, Human
ucccugcuuucuggcccaguc

SEQ ID NO: 424896 - RNA, 22 nt, Human
augaggcaugugaggagaaggg

SEQ ID NO: 424897 - RNA, 22 nt, Human
aaaguucagauuagacucaaga

SEQ ID NO: 424898 - RNA, 22 nt, Human
auucuuggagcagucaaagaag

SEQ ID NO: 424899 - RNA, 22 nt, Human
cugucccagauguucucagcac

SEQ ID NO: 424900 - RNA, 22 nt, Human
ugaaggagggaagaaggcucug

SEQ ID NO: 424901 - RNA, 22 nt, Human
ccucagcugcuucccuggagcc

SEQ ID NO: 424902 - RNA, 22 nt, Human
uuugcuauuuuucugugcagcu

SEQ ID NO: 424903 - RNA, 22 nt, Human
ggcugugcgggcagccguggga

SEQ ID NO: 424904 - RNA, 22 nt, Human
aaucaguuaggguguuaaugag

SEQ ID NO: 424905 - RNA, 22 nt, Human
ugcauuccuccaccuccugcac

SEQ ID NO: 424906 - RNA, 22 nt, Human
acuggcugaaguuuacuuuuug

SEQ ID NO: 424907 - RNA, 22 nt, Human
agcuggccuguuagagcugagu

SEQ ID NO: 424908 - RNA, 22 nt, Human
uggcucagagccuugagagcug

SEQ ID NO: 424909 - RNA, 23 nt, Human
ggcucugugcugggccugcagga

SEQ ID NO: 424910 - RNA, 22 nt, Human
ucaggauggcuucugcaucaaa

SEQ ID NO: 424911 - RNA, 20 nt, Human
ccugaggguuuguguucuuu

SEQ ID NO: 424912 - RNA, 22 nt, Human
ugguugccucucagagauuccg

SEQ ID NO: 424913 - RNA, 22 nt, Human
aaacuguauauuuauggcaugu

SEQ ID NO: 424914 - RNA, 22 nt, Human
augaagcugguuuuggcuuggg

SEQ ID NO: 424915 - RNA, 22 nt, Human
agaaggaguguacaggucaugc

SEQ ID NO: 424916 - RNA, 23 nt, Human
ugagcccaggaggucaaggcugc

SEQ ID NO: 424917 - RNA, 22 nt, Human
aggcucugcagugcuggaggac

SEQ ID NO: 424918 - RNA, 22 nt, Human
ccagcagcgauagggugagugc

SEQ ID NO: 424919 - RNA, 22 nt, Human
agguuauaugucauacugaagu

SEQ ID NO: 424920 - RNA, 22 nt, Human
aggugcagcugguggagucugg

SEQ ID NO: 424921 - RNA, 19 nt, Human
aggugcaggucacagggga

SEQ ID NO: 424922 - RNA, 22 nt, Human
cugggacagcugagacaggaga

SEQ ID NO: 424923 - RNA, 22 nt, Human
ugaagccacacuagcuuguccu

SEQ ID NO: 424924 - RNA, 22 nt, Human
cccaaggccucuccuuggcuug

SEQ ID NO: 424925 - RNA, 22 nt, Human
gggcacuguggggcccaugcug

SEQ ID NO: 424926 - RNA, 22 nt, Human
cagcucugcugggaggaugcag

SEQ ID NO: 424927 - RNA, 23 nt, Human
aucaaacuggugagaaugucagu

SEQ ID NO: 424928 - RNA, 22 nt, Human
gcucugcuguguuuguucagca

SEQ ID NO: 424929 - RNA, 22 nt, Human
uuucuuauauucugucauuguu

SEQ ID NO: 424930 - RNA, 23 nt, Human
cuguggcugaguccuguuggagu

SEQ ID NO: 424931 - RNA, 20 nt, Human
gcugccuuguccugcuuggu

SEQ ID NO: 424932 - RNA, 22 nt, Human
guucacaucacuucacugaacc

SEQ ID NO: 424933 - RNA, 21 nt, Human
cauuagggcagaagcaggaag

SEQ ID NO: 424934 - RNA, 19 nt, Human
cagaguacaccagauagga

SEQ ID NO: 424935 - RNA, 22 nt, Human
guuacaaaggaagcuucacugc

SEQ ID NO: 424936 - RNA, 22 nt, Human
acuuuugguucuguaacuguga

SEQ ID NO: 424937 - RNA, 22 nt, Human
cauccugcggggagcagagggc

SEQ ID NO: 424938 - RNA, 23 nt, Human
aggagaagagauuuccacaugca

SEQ ID NO: 424939 - RNA, 22 nt, Human
ccucccugcgcuccugcggcgg

SEQ ID NO: 424940 - RNA, 22 nt, Human
auucacagggacaaugggagag

SEQ ID NO: 424941 - RNA, 22 nt, Human
uggcuggcgccgggcuagccac

SEQ ID NO: 424942 - RNA, 22 nt, Human
ucaucugucccaggcuuuuuuc

SEQ ID NO: 424943 - RNA, 22 nt, Human
aagggcucucugcauugaaauu

SEQ ID NO: 424944 - RNA, 22 nt, Human
auggaaagccaguguuccauca

SEQ ID NO: 424945 - RNA, 22 nt, Human
ugaguccaagagccagugggaa

SEQ ID NO: 424946 - RNA, 22 nt, Human
ugagguggcuagggaggcacuc

SEQ ID NO: 424947 - RNA, 22 nt, Human
uguagcacagagcuuugacacu

SEQ ID NO: 424948 - RNA, 22 nt, Human
cuauuacauuucuggacauuca

SEQ ID NO: 424949 - RNA, 22 nt, Human
ggcaguagccagggacuggcag

SEQ ID NO: 424950 - RNA, 22 nt, Human
gucaccagugcuaagaggugga

SEQ ID NO: 424951 - RNA, 22 nt, Human
accagcucagaagccagaaaga

SEQ ID NO: 424952 - RNA, 20 nt, Human
agccugccagcuggcccaga

SEQ ID NO: 424953 - RNA, 22 nt, Human
ucagggcaagucucagaagguu

SEQ ID NO: 424954 - RNA, 20 nt, Human
ccucaggaugagggugagca

SEQ ID NO: 424955 - RNA, 22 nt, Human
aguaggaggcgggagcaugaag

SEQ ID NO: 424956 - RNA, 22 nt, Human
uacuguacauuccguuuguugc

SEQ ID NO: 424957 - RNA, 22 nt, Human
ucccacucccaggcaggccucu

SEQ ID NO: 424958 - RNA, 22 nt, Human
acucaggaauggggcugggacu

SEQ ID NO: 424959 - RNA, 22 nt, Human
uggcagagguaauucaaauccc

SEQ ID NO: 424960 - RNA, 22 nt, Human
cacagcugugagaagggagccu

SEQ ID NO: 424961 - RNA, 21 nt, Human
agcagcagaucuggugagggc

SEQ ID NO: 424962 - RNA, 22 nt, Human
gccuggucucuuucaugucagu

SEQ ID NO: 424963 - RNA, 22 nt, Human
cagcucugaagaaaggugucua

SEQ ID NO: 424964 - RNA, 22 nt, Human
cucagcagcagggaagagguca

SEQ ID NO: 424965 - RNA, 21 nt, Human
ugcaggaaagugcugcgaccc

SEQ ID NO: 424966 - RNA, 22 nt, Human
cucugagaaagcugugagcuaa

SEQ ID NO: 424967 - RNA, 22 nt, Human
aggcucaggcaggaauggcgga

SEQ ID NO: 424968 - RNA, 22 nt, Human
auuccauuguguaaggauaucg

SEQ ID NO: 424969 - RNA, 22 nt, Human
cugggcugcaggaguggggcaa

SEQ ID NO: 424970 - RNA, 21 nt, Human
uuguucuuccagaagcaaagu

SEQ ID NO: 424971 - RNA, 22 nt, Human
gagggggcgugcaaggcuccgc

SEQ ID NO: 424972 - RNA, 22 nt, Human
cuugaaagucagcagaguggau

SEQ ID NO: 424973 - RNA, 22 nt, Human
uacaggcauguagcauggugau

SEQ ID NO: 424974 - RNA, 22 nt, Human
gccuuccuuuuaccaccagcca

SEQ ID NO: 424975 - RNA, 22 nt, Human
gcuggcugcgucaucacagggc

SEQ ID NO: 424976 - RNA, 22 nt, Human
auagcagaaaccaagcuucuuc

SEQ ID NO: 424977 - RNA, 22 nt, Human
agagccuugaagaucuggaaaa

SEQ ID NO: 424978 - RNA, 22 nt, Human
cugcccugggauggucugugcg

SEQ ID NO: 424979 - RNA, 22 nt, Human
caggucagagucccccuguccu

SEQ ID NO: 424980 - RNA, 22 nt, Human
uggcagcacaagguggcccaug

SEQ ID NO: 424981 - RNA, 22 nt, Human
gggaguggagagcaauggauga

SEQ ID NO: 424982 - RNA, 22 nt, Human
agcugugggauuugggugugcc

SEQ ID NO: 424983 - RNA, 22 nt, Human
cacccagggcugugccugccca

SEQ ID NO: 424984 - RNA, 22 nt, Human
ucugucauaaacacacacaagc

SEQ ID NO: 424985 - RNA, 22 nt, Human
gcagggcuaauggggcaaguag

SEQ ID NO: 424986 - RNA, 22 nt, Human
auucuggccuuggcucugucac

SEQ ID NO: 424987 - RNA, 22 nt, Human
cagugcccuuccaggacugcag

SEQ ID NO: 424988 - RNA, 22 nt, Human
ggcucagacucccaggcccucu

SEQ ID NO: 424989 - RNA, 22 nt, Human
aggcaugugacccuggacucag

SEQ ID NO: 424990 - RNA, 22 nt, Human
gcuuugcauuguuuaaucagga

SEQ ID NO: 424991 - RNA, 22 nt, Human
acagggcagugucuugaaaaau

SEQ ID NO: 424992 - RNA, 22 nt, Human
gaagcagcugccagagaugucu

SEQ ID NO: 424993 - RNA, 22 nt, Human
cucuccagaauaugccgccgug

SEQ ID NO: 424994 - RNA, 22 nt, Human
gggggcuguccugugcauugua

SEQ ID NO: 424995 - RNA, 20 nt, Human
acagaaagagagaaugucag

SEQ ID NO: 424996 - RNA, 22 nt, Human
ucuuaaaccacaaaauucagag

SEQ ID NO: 424997 - RNA, 21 nt, Human
gccaaggggguagcuauuccu

SEQ ID NO: 424998 - RNA, 22 nt, Human
acuuucucaggaauucacagac

SEQ ID NO: 424999 - RNA, 21 nt, Human
gcaaguacuaucaucauuauc

SEQ ID NO: 425000 - RNA, 22 nt, Human
gcucaggacuggaggagcgggg

SEQ ID NO: 425001 - RNA, 22 nt, Human
auugucugaauccaaagcucug

SEQ ID NO: 425002 - RNA, 22 nt, Human
ucaggcugcagcugucagcagc

SEQ ID NO: 425003 - RNA, 22 nt, Human
ugcauuguaggauguuuagcag

SEQ ID NO: 425004 - RNA, 22 nt, Human
aaaucugggagcagcucggcca

SEQ ID NO: 425005 - RNA, 22 nt, Human
auuuucuauucugcugguuuag

SEQ ID NO: 425006 - RNA, 22 nt, Human
uuauuuaauuuucucacucaga

SEQ ID NO: 425007 - RNA, 22 nt, Human
aagacaaagggguccuuggaug

SEQ ID NO: 425008 - RNA, 22 nt, Human
uugagaagaaauaguuugcaau

SEQ ID NO: 425009 - RNA, 22 nt, Human
ucaggauguuaauauagcauua

SEQ ID NO: 425010 - RNA, 22 nt, Human
ugauggcuaucccuggaagggc

SEQ ID NO: 425011 - RNA, 22 nt, Human
cagcuugggucaggugccugcu

SEQ ID NO: 425012 - RNA, 22 nt, Human
uuuaccaagcuuuaauuacaua

SEQ ID NO: 425013 - RNA, 22 nt, Human
cagagcuguauuuaucuuucca

SEQ ID NO: 425014 - RNA, 22 nt, Human
augcuuuuccuaaaaugaugcc

SEQ ID NO: 425015 - RNA, 22 nt, Human
accaggcagcugggggugaugu

SEQ ID NO: 425016 - RNA, 22 nt, Human
gcuggggaggcagcagagaaca

SEQ ID NO: 425017 - RNA, 22 nt, Human
cagagccagcaguggggacagg

SEQ ID NO: 425018 - RNA, 22 nt, Human
agggcccuccccgcucagggca

SEQ ID NO: 425019 - RNA, 22 nt, Human
ccacugcccccugaagaccagg

SEQ ID NO: 425020 - RNA, 22 nt, Human
agcuggggcugcagagaacagg

SEQ ID NO: 425021 - RNA, 22 nt, Human
uagggcaguuucauguuaucuu

SEQ ID NO: 425022 - RNA, 22 nt, Human
ggcuucauggaggaggugaguc

SEQ ID NO: 425023 - RNA, 22 nt, Human
uuuaccauccucuuuuagaauu

SEQ ID NO: 425024 - RNA, 22 nt, Human
agcagggcugugcuccuuccga

SEQ ID NO: 425025 - RNA, 22 nt, Human
ucagccagugccuugaucuugc

SEQ ID NO: 425026 - RNA, 22 nt, Human
cagcuggcagcccuggcccugc

SEQ ID NO: 425027 - RNA, 22 nt, Human
uacuguacugucuuuuuugcug

SEQ ID NO: 425028 - RNA, 20 nt, Human
ucuuacaaucguuacaucca

SEQ ID NO: 425029 - RNA, 22 nt, Human
gggugcugacuggggccugaaa

SEQ ID NO: 425030 - RNA, 22 nt, Human
ugggacacccucacgccugcac

SEQ ID NO: 425031 - RNA, 17 nt, Human
cauuuguugaucaguug

SEQ ID NO: 425032 - RNA, 22 nt, Human
uggaguucucaggugagggcuu

SEQ ID NO: 425033 - RNA, 22 nt, Human
acacaucucaggggacacucuc

SEQ ID NO: 425034 - RNA, 22 nt, Human
aagagggcugcaaucuuauugc

SEQ ID NO: 425035 - RNA, 22 nt, Human
cuucaagauccauagauauugc

SEQ ID NO: 425036 - RNA, 22 nt, Human
ucaguuuuucuauacuuuguag

SEQ ID NO: 425037 - RNA, 22 nt, Human
aggcugcuuccuuacguggcug

SEQ ID NO: 425038 - RNA, 22 nt, Human
aguguuucuggcaaaugaaagu

SEQ ID NO: 425039 - RNA, 22 nt, Human
acuuuuaugauaaucaauguuc

SEQ ID NO: 425040 - RNA, 22 nt, Human
uuuauauagagauuugugcaug

SEQ ID NO: 425041 - RNA, 22 nt, Human
cugaaggacuuggugauaguug

SEQ ID NO: 425042 - RNA, 23 nt, Human
aaaaaaccauguaggcacucagu

SEQ ID NO: 425043 - RNA, 22 nt, Human
gggccccaaaaugccaggcucu

SEQ ID NO: 425044 - RNA, 22 nt, Human
gcugccugccuugccuggagga

SEQ ID NO: 425045 - RNA, 22 nt, Human
cuauuagguaugugguugcuau

SEQ ID NO: 425046 - RNA, 22 nt, Human
uggcaguggcucagagugcaga

SEQ ID NO: 425047 - RNA, 22 nt, Human
gaaaggcaguacagcugagccu

SEQ ID NO: 425048 - RNA, 22 nt, Human
cugggccagcaacugcaaugga

SEQ ID NO: 425049 - RNA, 19 nt, Human
gcaugcuugguggcuucug

SEQ ID NO: 425050 - RNA, 22 nt, Human
ucugagagcuguagaagccuau

SEQ ID NO: 425051 - RNA, 22 nt, Human
cccuggcaugcaugucccuggc

SEQ ID NO: 425052 - RNA, 22 nt, Human
gcagcuuucuuuuugcaugucu

SEQ ID NO: 425053 - RNA, 22 nt, Human
uccugccuaccuugcggaggug

SEQ ID NO: 425054 - RNA, 22 nt, Human
agugcuccuauggaucaguugu

SEQ ID NO: 425055 - RNA, 22 nt, Human
ugccaggcucaggaugucccug

SEQ ID NO: 425056 - RNA, 22 nt, Human
gucccuuggcucacaaacagcu

SEQ ID NO: 425057 - RNA, 22 nt, Human
gccaggcauuuguuaggugcug

SEQ ID NO: 425058 - RNA, 22 nt, Human
auguuuuauauuuugcagcagu

SEQ ID NO: 425059 - RNA, 22 nt, Human
gggugggccacugagcagcgug

SEQ ID NO: 425060 - RNA, 22 nt, Human
gggagcugagcuggaagagaau

SEQ ID NO: 425061 - RNA, 22 nt, Human
caggggcagucugugugcgugg

SEQ ID NO: 425062 - RNA, 22 nt, Human
agccagugggauuagagccucu

SEQ ID NO: 425063 - RNA, 22 nt, Human
gaggcucaaaccuggacagagc

SEQ ID NO: 425064 - RNA, 22 nt, Human
gcagcaggagaguuuguccugc

SEQ ID NO: 425065 - RNA, 22 nt, Human
acauuucuuagccuaguuccag

SEQ ID NO: 425066 - RNA, 22 nt, Human
agagcuguggauaguccuggau

SEQ ID NO: 425067 - RNA, 22 nt, Human
ucuacugugguccuuguaacca

SEQ ID NO: 425068 - RNA, 18 nt, Human
cagcugccagcucaugga

SEQ ID NO: 425069 - RNA, 22 nt, Human
gucaaguuuauccgcucauuca

SEQ ID NO: 425070 - RNA, 22 nt, Human
agcugaguuaauucaucacuua

SEQ ID NO: 425071 - RNA, 22 nt, Human
ucaugacaucuguuuaucucaa

SEQ ID NO: 425072 - RNA, 22 nt, Human
ggcugcuguuucagagacuguu

SEQ ID NO: 425073 - RNA, 20 nt, Human
aagagcauaguacaggaaga

SEQ ID NO: 425074 - RNA, 22 nt, Human
gggcacugugcuaggugcugag

SEQ ID NO: 425075 - RNA, 22 nt, Human
ugagccuggggccugggcagcg

SEQ ID NO: 425076 - RNA, 19 nt, Human
ggagaagcaucuagaaaua

SEQ ID NO: 425077 - RNA, 22 nt, Human
aaaggugacacucugccagcug

SEQ ID NO: 425078 - RNA, 22 nt, Human
ggcugugagcaggcagaaugcu

SEQ ID NO: 425079 - RNA, 22 nt, Human
aaguuugacagaaguuucuaau

SEQ ID NO: 425080 - RNA, 22 nt, Human
cagcuuuagagaaaacauauuu

SEQ ID NO: 425081 - RNA, 22 nt, Human
ucaggcagaggauggggagcgu

SEQ ID NO: 425082 - RNA, 22 nt, Human
aaauguguauaugaaacaugau

SEQ ID NO: 425083 - RNA, 22 nt, Human
gcaggugauucacccugggccu

SEQ ID NO: 425084 - RNA, 22 nt, Human
gccuccugagaagccacaggcu

SEQ ID NO: 425085 - RNA, 22 nt, Human
gggguggauuccuacaggucca

SEQ ID NO: 425086 - RNA, 22 nt, Human
cuggcugcaggaaggagugggc

SEQ ID NO: 425087 - RNA, 22 nt, Human
uuugaaaggaaguuaauacuuu

SEQ ID NO: 425088 - RNA, 22 nt, Human
uaaaugcaguuaguacuugcca

SEQ ID NO: 425089 - RNA, 21 nt, Human
uuacaaagcaagugcuguguc

SEQ ID NO: 425090 - RNA, 22 nt, Human
accagcuguguccuggcugcag

SEQ ID NO: 425091 - RNA, 22 nt, Human
gcccagaguucaaggcugcagu

SEQ ID NO: 425092 - RNA, 22 nt, Human
aaagcagggaugaggcuagagg

SEQ ID NO: 425093 - RNA, 22 nt, Human
ggaggugggagacauaggcggc

SEQ ID NO: 425094 - RNA, 22 nt, Human
cuggggaggcagggcugccccu

SEQ ID NO: 425095 - RNA, 22 nt, Human
agggcagccugagugcuggccc

SEQ ID NO: 425096 - RNA, 22 nt, Human
ccugggagguggagguugcagu

SEQ ID NO: 425097 - RNA, 19 nt, Human
agggagaauuccaagagga

SEQ ID NO: 425098 - RNA, 22 nt, Human
ugggcaaguaucggacucugag

SEQ ID NO: 425099 - RNA, 22 nt, Human
gccaggcagagccccgugcagc

SEQ ID NO: 425100 - RNA, 22 nt, Human
guuuacaaauauuuuaaauggu

SEQ ID NO: 425101 - RNA, 22 nt, Human
aagugagugguaaggagcaugg

SEQ ID NO: 425102 - RNA, 22 nt, Human
cagggagcuggugccagccgac

SEQ ID NO: 425103 - RNA, 22 nt, Human
ucacauuuguuccucugcacuu

SEQ ID NO: 425104 - RNA, 22 nt, Human
aaucaagaaaaugaggauucuu

SEQ ID NO: 425105 - RNA, 22 nt, Human
ccaggaaugaaauguagauaaa

SEQ ID NO: 425106 - RNA, 22 nt, Human
gcucagagcaucccagugaaug

SEQ ID NO: 425107 - RNA, 22 nt, Human
ugggugagugggaaaagcccag

SEQ ID NO: 425108 - RNA, 22 nt, Human
uaugugaauacagcaguggaug

SEQ ID NO: 425109 - RNA, 22 nt, Human
ggagcagggaauuacagcgcag

SEQ ID NO: 425110 - RNA, 18 nt, Human
uuucacaaccuccagagg

SEQ ID NO: 425111 - RNA, 22 nt, Human
caguggccugagccaggcuucc

SEQ ID NO: 425112 - RNA, 22 nt, Human
caaggccaagguuuugugaacu

SEQ ID NO: 425113 - RNA, 18 nt, Human
uggccuggagacaacucu

SEQ ID NO: 425114 - RNA, 21 nt, Human
uucagcaguccucuagagaua

SEQ ID NO: 425115 - RNA, 22 nt, Human
cagaggaaggcucugggaaugu

SEQ ID NO: 425116 - RNA, 22 nt, Human
acaggcuguugggguccagggu

SEQ ID NO: 425117 - RNA, 22 nt, Human
cuccagggaggagcacggguuc

SEQ ID NO: 425118 - RNA, 22 nt, Human
gcucccaccuccagccugaguu

SEQ ID NO: 425119 - RNA, 22 nt, Human
cugcugugcagacagacucucu

SEQ ID NO: 425120 - RNA, 22 nt, Human
cugggaggauucauugagguga

SEQ ID NO: 425121 - RNA, 22 nt, Human
aucugguuuggggauccuugug

SEQ ID NO: 425122 - RNA, 22 nt, Human
ugcagggcccuugggguugaac

SEQ ID NO: 425123 - RNA, 22 nt, Human
agggcuacugccugccuucagg

SEQ ID NO: 425124 - RNA, 22 nt, Human
agcccaagcuaugaggugaccu

SEQ ID NO: 425125 - RNA, 22 nt, Human
gggugacauuucccaaugagcc

SEQ ID NO: 425126 - RNA, 22 nt, Human
gagcucuggcagggcaggucug

SEQ ID NO: 425127 - RNA, 22 nt, Human
uucaagauggccccagugagcc

SEQ ID NO: 425128 - RNA, 22 nt, Human
aggcugcguuagccucacuccc

SEQ ID NO: 425129 - RNA, 21 nt, Human
agcagaggcagaauguaugca

SEQ ID NO: 425130 - RNA, 22 nt, Human
uuaacagagugccuggcaugua

SEQ ID NO: 425131 - RNA, 22 nt, Human
agugaaauggaugcugcuacug

SEQ ID NO: 425132 - RNA, 22 nt, Human
acccagcaaagauaaacuuaug

SEQ ID NO: 425133 - RNA, 22 nt, Human
ggcaggguggcagaggcucaga

SEQ ID NO: 425134 - RNA, 22 nt, Human
cagcugcaggaacaaaaaugug

SEQ ID NO: 425135 - RNA, 22 nt, Human
agcagaggaggauuuaguuagg

SEQ ID NO: 425136 - RNA, 19 nt, Human
agcaccugugagagccugg

SEQ ID NO: 425137 - RNA, 22 nt, Human
acccagaggugucuagcaagcu

SEQ ID NO: 425138 - RNA, 22 nt, Human
uauuugcaacauaaaacucuga

SEQ ID NO: 425139 - RNA, 22 nt, Human
cuacccaggcuggagugcagua

SEQ ID NO: 425140 - RNA, 22 nt, Human
caagagcauuuaguuagcuggu

SEQ ID NO: 425141 - RNA, 22 nt, Human
accccagcucugagccacacca

SEQ ID NO: 425142 - RNA, 19 nt, Human
cagauguuuucaguucauu

SEQ ID NO: 425143 - RNA, 22 nt, Human
aagcugccaaugguaagcugcu

SEQ ID NO: 425144 - RNA, 22 nt, Human
gggcaguuuauucuagaugguu

SEQ ID NO: 425145 - RNA, 21 nt, Human
guuuuaagggagaaaaccuag

SEQ ID NO: 425146 - RNA, 22 nt, Human
gaagcagcaaguauaggacagg

SEQ ID NO: 425147 - RNA, 22 nt, Human
gccuucugaucgcuggacugac

SEQ ID NO: 425148 - RNA, 22 nt, Human
cugucaucacaguugagcagcc

SEQ ID NO: 425149 - RNA, 22 nt, Human
uguccuuuuggcugucuauggu

SEQ ID NO: 425150 - RNA, 22 nt, Human
auuuuagagaaacaaacguagg

SEQ ID NO: 425151 - RNA, 22 nt, Human
ggucccugguucccucugagcu

SEQ ID NO: 425152 - RNA, 22 nt, Human
gcccucagaugggaaaggaggg

SEQ ID NO: 425153 - RNA, 22 nt, Human
cuguucucuggcgguggcuguu

SEQ ID NO: 425154 - RNA, 22 nt, Human
aauaauuuugagagccuggaaa

SEQ ID NO: 425155 - RNA, 22 nt, Human
uauuacaguucgaguuucuagg

SEQ ID NO: 425156 - RNA, 22 nt, Human
gcugugcagguccccacugccu

SEQ ID NO: 425157 - RNA, 22 nt, Human
uuccuguaugucagugaagagc

SEQ ID NO: 425158 - RNA, 22 nt, Human
guccucagucaguuuggugggg

SEQ ID NO: 425159 - RNA, 22 nt, Human
accccagcccugcuucugggag

SEQ ID NO: 425160 - RNA, 22 nt, Human
caagcuccuuacauccacaggg

SEQ ID NO: 425161 - RNA, 22 nt, Human
uccuguggaagacaguguuggg

SEQ ID NO: 425162 - RNA, 21 nt, Human
aagaacuauugagguacacag

SEQ ID NO: 425163 - RNA, 22 nt, Human
cacugcuuauaaauucuaggca

SEQ ID NO: 425164 - RNA, 22 nt, Human
gaggcagcaucuauggugggaa

SEQ ID NO: 425165 - RNA, 22 nt, Human
augagacuaccuguaauguggc

SEQ ID NO: 425166 - RNA, 22 nt, Human
ucagaggucacacagcaaguuu

SEQ ID NO: 425167 - RNA, 22 nt, Human
gagggaccccaggcuggcccuu

SEQ ID NO: 425168 - RNA, 22 nt, Human
ccugggcaaaugccagagacaa

SEQ ID NO: 425169 - RNA, 22 nt, Human
ccuggagcacucucccuggcug

SEQ ID NO: 425170 - RNA, 22 nt, Human
uuaugcuaagugcaacaagcca

SEQ ID NO: 425171 - RNA, 22 nt, Human
agagcugugaaaaugagguuug

SEQ ID NO: 425172 - RNA, 22 nt, Human
ggcagagguagcuggaaccagg

SEQ ID NO: 425173 - RNA, 21 nt, Human
ccagacuggccuaugugguag

SEQ ID NO: 425174 - RNA, 22 nt, Human
acagcaagccagcuugucacug

SEQ ID NO: 425175 - RNA, 22 nt, Human
cagcuucugagcaagccagggg

SEQ ID NO: 425176 - RNA, 22 nt, Human
cccucuacagggaagcgcuuuc

SEQ ID NO: 425177 - RNA, 19 nt, Human
ccucuccgcccaccagccc

SEQ ID NO: 425178 - RNA, 22 nt, Human
cuguggcuaggaagcuguggga

SEQ ID NO: 425179 - RNA, 22 nt, Human
ugaggcucaaggucugguggag

SEQ ID NO: 425180 - RNA, 22 nt, Human
gcccugugccagucacgcugug

SEQ ID NO: 425181 - RNA, 22 nt, Human
ccuggcugccgagugugcagcg

SEQ ID NO: 425182 - RNA, 23 nt, Human
agugagcagcuguagggcaagga

SEQ ID NO: 425183 - RNA, 22 nt, Human
cagcaguggccaucuguguggu

SEQ ID NO: 425184 - RNA, 21 nt, Human
accucaagcaacaaccaaggu

SEQ ID NO: 425185 - RNA, 22 nt, Human
agaaagcacucugucuuuuacc

SEQ ID NO: 425186 - RNA, 22 nt, Human
gagggagugccagagggccagc

SEQ ID NO: 425187 - RNA, 22 nt, Human
uuuccucuuuguaccuugacua

SEQ ID NO: 425188 - RNA, 22 nt, Human
gugcagugaaaaaagaaugucc

SEQ ID NO: 425189 - RNA, 22 nt, Human
uuugaaguccaucuggcccagu

SEQ ID NO: 425190 - RNA, 22 nt, Human
gccagagcacaggcugguagua

SEQ ID NO: 425191 - RNA, 22 nt, Human
uugcauugaaaauauauuuuaa

SEQ ID NO: 425192 - RNA, 22 nt, Human
agccuggagaagauguguauug

SEQ ID NO: 425193 - RNA, 22 nt, Human
aggcugagucgggaggaucacu

SEQ ID NO: 425194 - RNA, 22 nt, Human
ggcuggucacaccacugcaggg

SEQ ID NO: 425195 - RNA, 22 nt, Human
uccuccaggucuaggguggcuu

SEQ ID NO: 425196 - RNA, 22 nt, Human
cucagggccaaggaugcuguug

SEQ ID NO: 425197 - RNA, 20 nt, Human
auaaaauaacugccacaaga

SEQ ID NO: 425198 - RNA, 22 nt, Human
acuguaaauuuugguugcaggu

SEQ ID NO: 425199 - RNA, 22 nt, Human
aaguuuuaacaaguacuuacua

SEQ ID NO: 425200 - RNA, 22 nt, Human
cccaggcacaccccgaacggaa

SEQ ID NO: 425201 - RNA, 22 nt, Human
ugaccaaaggugguuuauuugg

SEQ ID NO: 425202 - RNA, 22 nt, Human
aggccagguuccucaaucuuga

SEQ ID NO: 425203 - RNA, 22 nt, Human
gugucauuaaccaccaugcaaa

SEQ ID NO: 425204 - RNA, 22 nt, Human
uggagcaggaagucuauggcug

SEQ ID NO: 425205 - RNA, 20 nt, Human
uuuuuccuucucuacaggca

SEQ ID NO: 425206 - RNA, 22 nt, Human
aggagugaguguccucagcaga

SEQ ID NO: 425207 - RNA, 20 nt, Human
auugucagccuucagaggag

SEQ ID NO: 425208 - RNA, 22 nt, Human
aaauccuaccaagaaauucccu

SEQ ID NO: 425209 - RNA, 22 nt, Human
gaugggggccagggccugcuuu

SEQ ID NO: 425210 - RNA, 22 nt, Human
aggcuuccgaguagcugggacu

SEQ ID NO: 425211 - RNA, 21 nt, Human
ucugucucuccacugcccugc

SEQ ID NO: 425212 - RNA, 20 nt, Human
caggcacacucauuccugcu

SEQ ID NO: 425213 - RNA, 22 nt, Human
uguuuuucaaauauugcucugu

SEQ ID NO: 425214 - RNA, 22 nt, Human
ggcuucugaaaucucugugcgu

SEQ ID NO: 425215 - RNA, 22 nt, Human
ggcuuccuggagaaggucugag

SEQ ID NO: 425216 - RNA, 22 nt, Human
ugggugggagcacccugucugg

SEQ ID NO: 425217 - RNA, 22 nt, Human
gugugccaccagucaaggugaa

SEQ ID NO: 425218 - RNA, 22 nt, Human
guggcagagggugagcuggacu

SEQ ID NO: 425219 - RNA, 22 nt, Human
ccuuggagcggucagcacuggu

SEQ ID NO: 425220 - RNA, 21 nt, Human
agagaagaggacuuucucaca

SEQ ID NO: 425221 - RNA, 18 nt, Human
uggcagccagcugcuccu

SEQ ID NO: 425222 - RNA, 21 nt, Human
agagaagggacucuuccaguc

SEQ ID NO: 425223 - RNA, 22 nt, Human
cauuucugauuacagaauacua

SEQ ID NO: 425224 - RNA, 23 nt, Human
acaaaugcccauacaucuaguuc

SEQ ID NO: 425225 - RNA, 22 nt, Human
uggguacuccuauuaguucagu

SEQ ID NO: 425226 - RNA, 22 nt, Human
ucagggcacugucaccugauau

SEQ ID NO: 425227 - RNA, 22 nt, Human
aggccugggucucgugccuacc

SEQ ID NO: 425228 - RNA, 22 nt, Human
cugcuguguuggcauuggauag

SEQ ID NO: 425229 - RNA, 22 nt, Human
ucuccuucgaggcccagcuccc

SEQ ID NO: 425230 - RNA, 21 nt, Human
agcugagcccagaagacuggu

SEQ ID NO: 425231 - RNA, 22 nt, Human
uggagcucaaaggccuguggga

SEQ ID NO: 425232 - RNA, 22 nt, Human
cagaagcacuaggaggaaacgu

SEQ ID NO: 425233 - RNA, 22 nt, Human
aauugugcuaugauuaugaaag

SEQ ID NO: 425234 - RNA, 22 nt, Human
gaaugaauucagcacauggaau

SEQ ID NO: 425235 - RNA, 20 nt, Human
gugaccagaagacagugggu

SEQ ID NO: 425236 - RNA, 22 nt, Human
guguuuccuaguuuaaugaaug

SEQ ID NO: 425237 - RNA, 22 nt, Human
ucugagagguuaagcaauuuga

SEQ ID NO: 425238 - RNA, 22 nt, Human
cugcuuuggcucagugacauca

SEQ ID NO: 425239 - RNA, 23 nt, Human
uuuauuuauuuaggcugagggau

SEQ ID NO: 425240 - RNA, 17 nt, Human
gugcagggaugaaggau

SEQ ID NO: 425241 - RNA, 22 nt, Human
uccaggcacagaguuggucagu

SEQ ID NO: 425242 - RNA, 20 nt, Human
cugcagggugagugggcgau

SEQ ID NO: 425243 - RNA, 18 nt, Human
cugaggcuuagagagguu

SEQ ID NO: 425244 - RNA, 22 nt, Human
accuuuuuucagaacucuaaag

SEQ ID NO: 425245 - RNA, 22 nt, Human
ucucugauguauaucagagaac

SEQ ID NO: 425246 - RNA, 22 nt, Human
ucagcccugggacccagggaug

SEQ ID NO: 425247 - RNA, 22 nt, Human
uguggccaccagagcugcuauu

SEQ ID NO: 425248 - RNA, 22 nt, Human
uccugccucuuuucuuauucca

SEQ ID NO: 425249 - RNA, 22 nt, Human
ugacaaaacugcaauuacuuuu

SEQ ID NO: 425250 - RNA, 22 nt, Human
agaagccaugguaugcaacuac

SEQ ID NO: 425251 - RNA, 22 nt, Human
uggagaaggacagccugagaaa

SEQ ID NO: 425252 - RNA, 22 nt, Human
gcaggagccacuucagggaugc

SEQ ID NO: 425253 - RNA, 22 nt, Human
cuggggugucucgucugccauu

SEQ ID NO: 425254 - RNA, 22 nt, Human
gcagggcaugggcccugucugc

SEQ ID NO: 425255 - RNA, 22 nt, Human
ccacagagacagagcccagggu

SEQ ID NO: 425256 - RNA, 20 nt, Human
ccagagaguagguuagugau

SEQ ID NO: 425257 - RNA, 22 nt, Human
ugggaggcuuccagaccuugcu

SEQ ID NO: 425258 - RNA, 22 nt, Human
ggcuggccucaggguccucgcu

SEQ ID NO: 425259 - RNA, 22 nt, Human
agccuggccaggccugcccagg

SEQ ID NO: 425260 - RNA, 22 nt, Human
gcuggcuccucuguccucacgg

SEQ ID NO: 425261 - RNA, 22 nt, Human
agccuucaguaaauccacugug

SEQ ID NO: 425262 - RNA, 22 nt, Human
caguggaggccuugggaccuuu

SEQ ID NO: 425263 - RNA, 22 nt, Human
acagcagccugcagcccugugu

SEQ ID NO: 425264 - RNA, 22 nt, Human
gcagcuggggaggucgugggga

SEQ ID NO: 425265 - RNA, 22 nt, Human
ucccagagcucuggagguugga

SEQ ID NO: 425266 - RNA, 22 nt, Human
gucccaggcagagucaggaggg

SEQ ID NO: 425267 - RNA, 22 nt, Human
ggccagaggccacagcuguguc

SEQ ID NO: 425268 - RNA, 22 nt, Human
ucacauuuauuucaaaguuacu

SEQ ID NO: 425269 - RNA, 22 nt, Human
aauggcugccagggcaggaggu

SEQ ID NO: 425270 - RNA, 22 nt, Human
agagaagggccuguauguaauc

SEQ ID NO: 425271 - RNA, 22 nt, Human
cugccaucugagccaaaagugc

SEQ ID NO: 425272 - RNA, 22 nt, Human
acucugaaugugcauguaaauc

SEQ ID NO: 425273 - RNA, 22 nt, Human
ugcagcauugcaaagcagucuu

SEQ ID NO: 425274 - RNA, 22 nt, Human
auggggcucugcggcugcuccc

SEQ ID NO: 425275 - RNA, 22 nt, Human
uuuuauuaucuuugaaugggac

SEQ ID NO: 425276 - RNA, 22 nt, Human
uuucagaugugugucucugaag

SEQ ID NO: 425277 - RNA, 22 nt, Human
uagagcuggaaaacugcaggua

SEQ ID NO: 425278 - RNA, 22 nt, Human
gcagucaguaaggcagccagaa

SEQ ID NO: 425279 - RNA, 22 nt, Human
uggcuuccugcauggauccucu

SEQ ID NO: 425280 - RNA, 22 nt, Human
auggggagagaagggcugagcu

SEQ ID NO: 425281 - RNA, 22 nt, Human
ccagcagcccacaggcgucccu

SEQ ID NO: 425282 - RNA, 22 nt, Human
gaaaucugaacucuguauccuu

SEQ ID NO: 425283 - RNA, 22 nt, Human
augaggcuaugaauggggagau

SEQ ID NO: 425284 - RNA, 22 nt, Human
ucaaaugcucuuugcagagagg

SEQ ID NO: 425285 - RNA, 22 nt, Human
aaguucaaggcucuagaguucc

SEQ ID NO: 425286 - RNA, 22 nt, Human
ggccugugucugugccuguccu

SEQ ID NO: 425287 - RNA, 22 nt, Human
gcccaugcucucaggcgggccu

SEQ ID NO: 425288 - RNA, 18 nt, Human
uccauuguucuacuguga

SEQ ID NO: 425289 - RNA, 22 nt, Human
gcccagcacauugcugaggacc

SEQ ID NO: 425290 - RNA, 22 nt, Human
gcccagagagaugcuguagacc

SEQ ID NO: 425291 - RNA, 22 nt, Human
aaugcugcucucauaauuauag

SEQ ID NO: 425292 - RNA, 22 nt, Human
accaaggaagaaucuauuugag

SEQ ID NO: 425293 - RNA, 22 nt, Human
caaaugaagaaccuucucaccu

SEQ ID NO: 425294 - RNA, 22 nt, Human
agucacuguucugucaugucaa

SEQ ID NO: 425295 - RNA, 22 nt, Human
uucacaauagcuggcaucaucu

SEQ ID NO: 425296 - RNA, 22 nt, Human
ucagauggcacacagagccugc

SEQ ID NO: 425297 - RNA, 22 nt, Human
ugaaggaauggaggaucagagc

SEQ ID NO: 425298 - RNA, 20 nt, Human
ggaccagguggggcgguggc

SEQ ID NO: 425299 - RNA, 22 nt, Human
cagucccacaagaucuccacaa

SEQ ID NO: 425300 - RNA, 22 nt, Human
gauuuauuuuuaaucagcaggg

SEQ ID NO: 425301 - RNA, 22 nt, Human
acuaagaccuagauacuagggg

SEQ ID NO: 425302 - RNA, 22 nt, Human
gcagggcucaacaggacacccc

SEQ ID NO: 425303 - RNA, 22 nt, Human
uggaccugagccuggcccugcc

SEQ ID NO: 425304 - RNA, 22 nt, Human
gaggcugggaaguccaagacca

SEQ ID NO: 425305 - RNA, 19 nt, Human
aucugaaguaggugcagcu

SEQ ID NO: 425306 - RNA, 22 nt, Human
cucaggagcuuccucagcccau

SEQ ID NO: 425307 - RNA, 22 nt, Human
aauuaacaaauguagcugugau

SEQ ID NO: 425308 - RNA, 22 nt, Human
ggcugccaggagggaggccagu

SEQ ID NO: 425309 - RNA, 22 nt, Human
gagagguccauuccccugucag

SEQ ID NO: 425310 - RNA, 17 nt, Human
acaggcagaucaccuga

SEQ ID NO: 425311 - RNA, 22 nt, Human
caaagcucaugcucuuagccau

SEQ ID NO: 425312 - RNA, 22 nt, Human
caggagaagguuuggagugcag

SEQ ID NO: 425313 - RNA, 22 nt, Human
cacagguggcuccaaguuagag

SEQ ID NO: 425314 - RNA, 22 nt, Human
cagaguggcagucccaggccca

SEQ ID NO: 425315 - RNA, 22 nt, Human
agccuccacagaugcaaagggc

SEQ ID NO: 425316 - RNA, 22 nt, Human
uccauggggcccaggaugagag

SEQ ID NO: 425317 - RNA, 22 nt, Human
gggcaggugcccagggccagag

SEQ ID NO: 425318 - RNA, 22 nt, Human
accaaagggcagaacaugagca

SEQ ID NO: 425319 - RNA, 23 nt, Human
uggugccucagaagcagugggcu

SEQ ID NO: 425320 - RNA, 22 nt, Human
ccagaggacuugggggcugaau

SEQ ID NO: 425321 - RNA, 20 nt, Human
uuggcucugaucaguggagc

SEQ ID NO: 425322 - RNA, 20 nt, Human
ccugucuccucuuaccuggc

SEQ ID NO: 425323 - RNA, 22 nt, Human
cuguggugagcaacugacugaa

SEQ ID NO: 425324 - RNA, 22 nt, Human
uuugaaaauuuaagugcuacac

SEQ ID NO: 425325 - RNA, 22 nt, Human
agggggcccuugcaggugagcg

SEQ ID NO: 425326 - RNA, 22 nt, Human
caccaggcugcccaggacaggg

SEQ ID NO: 425327 - RNA, 22 nt, Human
gagccaggcccguacuugcugu

SEQ ID NO: 425328 - RNA, 22 nt, Human
uggccuggggaccugugagacc

SEQ ID NO: 425329 - RNA, 22 nt, Human
ccauaagguuuggggccaugca

SEQ ID NO: 425330 - RNA, 20 nt, Human
ucugcucagcccucaguggc

SEQ ID NO: 425331 - RNA, 22 nt, Human
agcaucuggucaugagugagaa

SEQ ID NO: 425332 - RNA, 22 nt, Human
ggccagagagccgcuguuagga

SEQ ID NO: 425333 - RNA, 22 nt, Human
ccacucugauuuuggcuccacu

SEQ ID NO: 425334 - RNA, 20 nt, Human
gcagagccucacugcaaggg

SEQ ID NO: 425335 - RNA, 22 nt, Human
caucagcagucacaugaugcug

SEQ ID NO: 425336 - RNA, 22 nt, Human
caggaagcugugaaggagacgg

SEQ ID NO: 425337 - RNA, 22 nt, Human
gucagaggaggcugaguaggaa

SEQ ID NO: 425338 - RNA, 20 nt, Human
caccaggcgcucugagaaca

SEQ ID NO: 425339 - RNA, 22 nt, Human
ccauuugucaccucugcacucc

SEQ ID NO: 425340 - RNA, 22 nt, Human
gaaucauuggaaccacauccaa

SEQ ID NO: 425341 - RNA, 20 nt, Human
aauaaaagaagccuucaccc

SEQ ID NO: 425342 - RNA, 22 nt, Human
aggcucaguucacgucaacuuu

SEQ ID NO: 425343 - RNA, 22 nt, Human
ggcucccugccuguccucaguc

SEQ ID NO: 425344 - RNA, 22 nt, Human
gcagaggacacaggagggcaag

SEQ ID NO: 425345 - RNA, 22 nt, Human
gcacagagggcagugagccucu

SEQ ID NO: 425346 - RNA, 22 nt, Human
uccaggaggccucauuuccugu

SEQ ID NO: 425347 - RNA, 22 nt, Human
gccucgaggcugagaaggcaca

SEQ ID NO: 425348 - RNA, 22 nt, Human
uuuaacuugaucaguagagcau

SEQ ID NO: 425349 - RNA, 22 nt, Human
auccacagucuuagccaucaaa

SEQ ID NO: 425350 - RNA, 22 nt, Human
gcaagcaagcagguagagcuga

SEQ ID NO: 425351 - RNA, 22 nt, Human
ggcugccugaggcagugagaga

SEQ ID NO: 425352 - RNA, 22 nt, Human
gugcgccagcucaaggggaggc

SEQ ID NO: 425353 - RNA, 20 nt, Human
cccugagaccagagagcagc

SEQ ID NO: 425354 - RNA, 22 nt, Human
gaagcaaagagcuagugccgcu

SEQ ID NO: 425355 - RNA, 22 nt, Human
ccugacgaaaggcgugcuggag

SEQ ID NO: 425356 - RNA, 22 nt, Human
caggugggagcgaggagcuacu

SEQ ID NO: 425357 - RNA, 22 nt, Human
uuuucauuguuccucgagcauu

SEQ ID NO: 425358 - RNA, 22 nt, Human
agagucugaggcagcugcagcc

SEQ ID NO: 425359 - RNA, 22 nt, Human
gggcuggugaggcugcccugca

SEQ ID NO: 425360 - RNA, 22 nt, Human
ugccagcuccgaggagcugcag

SEQ ID NO: 425361 - RNA, 22 nt, Human
uccaggcaaagugcugggcugc

SEQ ID NO: 425362 - RNA, 22 nt, Human
cuacaagauuuuuaaaacugua

SEQ ID NO: 425363 - RNA, 22 nt, Human
agagcccugaagcagagcuaaa

SEQ ID NO: 425364 - RNA, 22 nt, Human
ucagaggaacacuguuucaugc

SEQ ID NO: 425365 - RNA, 22 nt, Human
caggagcuacucagguuggguu

SEQ ID NO: 425366 - RNA, 19 nt, Human
uuggaaggagccagagugg

SEQ ID NO: 425367 - RNA, 22 nt, Human
augcaacaaaugcuacgaaucg

SEQ ID NO: 425368 - RNA, 22 nt, Human
ucaccagggcuccagccagccu

SEQ ID NO: 425369 - RNA, 22 nt, Human
ugcuggcucaguuugcagacuc

SEQ ID NO: 425370 - RNA, 22 nt, Human
uucacauuagugguucuauaua

SEQ ID NO: 425371 - RNA, 22 nt, Human
caguacuugggaaugcugggga

SEQ ID NO: 425372 - RNA, 22 nt, Human
uagcauuuggcaccaguuauuu

SEQ ID NO: 425373 - RNA, 22 nt, Human
uuucccaagaaaaauaauugga

SEQ ID NO: 425374 - RNA, 22 nt, Human
guggguggaucaccugagguca

SEQ ID NO: 425375 - RNA, 22 nt, Human
cugggccucaaucucagaguuu

SEQ ID NO: 425376 - RNA, 22 nt, Human
uccagccuuucuacucacugag

SEQ ID NO: 425377 - RNA, 22 nt, Human
ggcuucaccgcgggguugcagg

SEQ ID NO: 425378 - RNA, 22 nt, Human
ugugaugguucacugggcauga

SEQ ID NO: 425379 - RNA, 22 nt, Human
ccugggcagugcuggaguugaa

SEQ ID NO: 425380 - RNA, 22 nt, Human
uauucacagcugccgcacucag

SEQ ID NO: 425381 - RNA, 21 nt, Human
ucucuggaguuagcagagaga

SEQ ID NO: 425382 - RNA, 22 nt, Human
gccagcagccacagaagucacu

SEQ ID NO: 425383 - RNA, 22 nt, Human
uguacauagaucuugaaaauua

SEQ ID NO: 425384 - RNA, 22 nt, Human
aaguggagagcccuggaggucu

SEQ ID NO: 425385 - RNA, 22 nt, Human
ugaaaaggagccuuagguaggu

SEQ ID NO: 425386 - RNA, 22 nt, Human
cugguccuugacgcgugggagg

SEQ ID NO: 425387 - RNA, 22 nt, Human
acacaguaugaaaagucuaguu

SEQ ID NO: 425388 - RNA, 22 nt, Human
ugaggcagccugcauuaaagag

SEQ ID NO: 425389 - RNA, 18 nt, Human
uggagcagguaggcauga

SEQ ID NO: 425390 - RNA, 22 nt, Human
gugcagagaaaugagaagucga

SEQ ID NO: 425391 - RNA, 22 nt, Human
aggagaaguaaggcuagaugau

SEQ ID NO: 425392 - RNA, 22 nt, Human
gaggaggcacuaguuagugaca

SEQ ID NO: 425393 - RNA, 22 nt, Human
aggagcagaccguaguccugca

SEQ ID NO: 425394 - RNA, 22 nt, Human
cccagcccagcguucgaggggu

SEQ ID NO: 425395 - RNA, 22 nt, Human
ugucccagauacuggacauaga

SEQ ID NO: 425396 - RNA, 20 nt, Human
guaaaauauggucuuugggu

SEQ ID NO: 425397 - RNA, 22 nt, Human
gcugcccugucugcagcaggac

SEQ ID NO: 425398 - RNA, 22 nt, Human
gccgaagcugccgucugguccu

SEQ ID NO: 425399 - RNA, 22 nt, Human
gaaggccacggaauggagcugg

SEQ ID NO: 425400 - RNA, 22 nt, Human
ggaggcacuucccgucucagcc

SEQ ID NO: 425401 - RNA, 22 nt, Human
ucaguggauugacaugaaaaag

SEQ ID NO: 425402 - RNA, 22 nt, Human
uauacuuuccugcaacuuugau

SEQ ID NO: 425403 - RNA, 22 nt, Human
cucagggggaaucaggucacag

SEQ ID NO: 425404 - RNA, 22 nt, Human
agaacagaagggaggaaggccu

SEQ ID NO: 425405 - RNA, 22 nt, Human
ugggccugggcuccuguccucu

SEQ ID NO: 425406 - RNA, 22 nt, Human
agcuccuccugugccaggccag

SEQ ID NO: 425407 - RNA, 22 nt, Human
aaugcacaugucuuggccucac

SEQ ID NO: 425408 - RNA, 23 nt, Human
gcaggugguucgaacagaaguuu

SEQ ID NO: 425409 - RNA, 22 nt, Human
gggcccacuggcugucugaccc

SEQ ID NO: 425410 - RNA, 22 nt, Human
ugaugggaaaaugaggccuggg

SEQ ID NO: 425411 - RNA, 22 nt, Human
agcaccuguggcucaugcucgu

SEQ ID NO: 425412 - RNA, 22 nt, Human
caggcugggaacgccacccgcu

SEQ ID NO: 425413 - RNA, 22 nt, Human
uugaagcaaggcgaaucuugug

SEQ ID NO: 425414 - RNA, 22 nt, Human
auuuugaaaccaaguuauuucc

SEQ ID NO: 425415 - RNA, 22 nt, Human
agcauaaaggucaacguuuuag

SEQ ID NO: 425416 - RNA, 22 nt, Human
aguauuucugcucaugaaagag

SEQ ID NO: 425417 - RNA, 22 nt, Human
acagguggaggcuuuaggaggu

SEQ ID NO: 425418 - RNA, 22 nt, Human
aaaugcuguguuuuaacauaga

SEQ ID NO: 425419 - RNA, 22 nt, Human
ccaaagagcuagaauuauaggc

SEQ ID NO: 425420 - RNA, 20 nt, Human
ugggcagcacugcuggcugg

SEQ ID NO: 425421 - RNA, 23 nt, Human
agccuucaggcaaugucaguaga

SEQ ID NO: 425422 - RNA, 22 nt, Human
gcacugcagguggguggagagg

SEQ ID NO: 425423 - RNA, 22 nt, Human
agguggagugaaggaaaggcag

SEQ ID NO: 425424 - RNA, 22 nt, Human
ugcagaggagucagccugggca

SEQ ID NO: 425425 - RNA, 20 nt, Human
gggugagauguaggagaggg

SEQ ID NO: 425426 - RNA, 22 nt, Human
cauaucccauuggccaggacau

SEQ ID NO: 425427 - RNA, 22 nt, Human
agggacuugaugucagggagau

SEQ ID NO: 425428 - RNA, 22 nt, Human
ggccugggcccacugucaagag

SEQ ID NO: 425429 - RNA, 21 nt, Human
gcaggggauagaaauggucug

SEQ ID NO: 425430 - RNA, 22 nt, Human
uacaggcacugaaaugcuuauu

SEQ ID NO: 425431 - RNA, 22 nt, Human
cagaggcuaagaugagugggug

SEQ ID NO: 425432 - RNA, 22 nt, Human
gcugcucugcuguguaagcagg

SEQ ID NO: 425433 - RNA, 22 nt, Human
cuggagcuaauaauccaucuga

SEQ ID NO: 425434 - RNA, 22 nt, Human
aucagucuguguuagaaaagag

SEQ ID NO: 425435 - RNA, 22 nt, Human
aggccuggcuuugguuugcuga

SEQ ID NO: 425436 - RNA, 22 nt, Human
gcuguauuuaacaacuggcuca

SEQ ID NO: 425437 - RNA, 22 nt, Human
gucaggaugcuauuguuauuaa

SEQ ID NO: 425438 - RNA, 22 nt, Human
cauuuauuggcauguaguaggu

SEQ ID NO: 425439 - RNA, 22 nt, Human
ucauccaguuguggagagggaa

SEQ ID NO: 425440 - RNA, 22 nt, Human
uaacagaaacagauaaguguaa

SEQ ID NO: 425441 - RNA, 22 nt, Human
ggcauggcuggguucuggugag

SEQ ID NO: 425442 - RNA, 22 nt, Human
ucaaagucauggcuaguaauga

SEQ ID NO: 425443 - RNA, 22 nt, Human
ucaggcugaggucaucugcauc

SEQ ID NO: 425444 - RNA, 22 nt, Human
ggagcagccacgucucagggca

SEQ ID NO: 425445 - RNA, 23 nt, Human
cccagagcacagccuccagaugc

SEQ ID NO: 425446 - RNA, 22 nt, Human
gccaccagccccaugcgcugug

SEQ ID NO: 425447 - RNA, 22 nt, Human
cacuguacugugaauaaggagg

SEQ ID NO: 425448 - RNA, 22 nt, Human
gauuucaaccuaacaguaugac

SEQ ID NO: 425449 - RNA, 22 nt, Human
cauuuacuuaaaucuuuacaag

SEQ ID NO: 425450 - RNA, 22 nt, Human
gagaggagucccuaucacaguu

SEQ ID NO: 425451 - RNA, 22 nt, Human
guuauaaauaccuaauaggauu

SEQ ID NO: 425452 - RNA, 22 nt, Human
aggcccagagagccaguuagug

SEQ ID NO: 425453 - RNA, 22 nt, Human
agaaaucaauaucuauauguug

SEQ ID NO: 425454 - RNA, 22 nt, Human
gagccuggauagccuuguucca

SEQ ID NO: 425455 - RNA, 22 nt, Human
ugcagggcuaagucagagccug

SEQ ID NO: 425456 - RNA, 22 nt, Human
ugcaggccucacaccuggcacc

SEQ ID NO: 425457 - RNA, 22 nt, Human
ucucugggauaaacugggccag

SEQ ID NO: 425458 - RNA, 22 nt, Human
uacaaagauaguguuagaguaa

SEQ ID NO: 425459 - RNA, 19 nt, Human
acagaaauuaguuauuuuc

SEQ ID NO: 425460 - RNA, 19 nt, Human
ucugaaguccagggcauac

SEQ ID NO: 425461 - RNA, 22 nt, Human
uagaaaggauauugagaugaau

SEQ ID NO: 425462 - RNA, 22 nt, Human
acacuacaaucucagaacuaua

SEQ ID NO: 425463 - RNA, 22 nt, Human
cuuuccaacucuagugaaauuu

SEQ ID NO: 425464 - RNA, 22 nt, Human
ucugguuagccaauaaugccaa

SEQ ID NO: 425465 - RNA, 22 nt, Human
gggagcugaauggcaauggaga

SEQ ID NO: 425466 - RNA, 19 nt, Human
uccugcagguggcuugcag

SEQ ID NO: 425467 - RNA, 22 nt, Human
augcuuuacaguuuuccaaaca

SEQ ID NO: 425468 - RNA, 22 nt, Human
uccuuuuuaagucguuguggua

SEQ ID NO: 425469 - RNA, 22 nt, Human
ugaagcaacuggacaaguuggc

SEQ ID NO: 425470 - RNA, 22 nt, Human
uggcugcagaucaagggcaggc

SEQ ID NO: 425471 - RNA, 22 nt, Human
uccuugaaaggggcugcagggc

SEQ ID NO: 425472 - RNA, 22 nt, Human
ucugggcucugucagcaccucu

SEQ ID NO: 425473 - RNA, 22 nt, Human
agcuguguguuuccacugagcu

SEQ ID NO: 425474 - RNA, 22 nt, Human
cucuggaguucuucaagcuacu

SEQ ID NO: 425475 - RNA, 22 nt, Human
acacagaaccucauagccucuc

SEQ ID NO: 425476 - RNA, 22 nt, Human
uuuagggaaauugaggguuaag

SEQ ID NO: 425477 - RNA, 19 nt, Human
cagagccucagagcuagaa

SEQ ID NO: 425478 - RNA, 20 nt, Human
uccugcaguuccuaggaggg

SEQ ID NO: 425479 - RNA, 22 nt, Human
aaaguuugcaauuuauguuaau

SEQ ID NO: 425480 - RNA, 22 nt, Human
cucaggcuugggaggaggccca

SEQ ID NO: 425481 - RNA, 21 nt, Human
ugucagagcuuguaggacauu

SEQ ID NO: 425482 - RNA, 22 nt, Human
cagggccagcgcccaggcccag

SEQ ID NO: 425483 - RNA, 22 nt, Human
uacaaaugaguuguaugaacca

SEQ ID NO: 425484 - RNA, 22 nt, Human
ugucucugguauuaggugaaaa

SEQ ID NO: 425485 - RNA, 22 nt, Human
gcagcugguuaaugggagaauu

SEQ ID NO: 425486 - RNA, 22 nt, Human
cuguugucuucauugucauauc

SEQ ID NO: 425487 - RNA, 22 nt, Human
agcugucugucuccugaggaga

SEQ ID NO: 425488 - RNA, 22 nt, Human
ucucagucuuugcaaggaugcu

SEQ ID NO: 425489 - RNA, 22 nt, Human
ugauugaagaggugaggaaguu

SEQ ID NO: 425490 - RNA, 22 nt, Human
agggcagagggugccucaccug

SEQ ID NO: 425491 - RNA, 22 nt, Human
uaggcucagggcugggugacgg

SEQ ID NO: 425492 - RNA, 22 nt, Human
augcaguaaauguuaagaaaaa

SEQ ID NO: 425493 - RNA, 22 nt, Human
gacccugccaugagugacaggg

SEQ ID NO: 425494 - RNA, 19 nt, Human
acauuuagaauguacuugc

SEQ ID NO: 425495 - RNA, 22 nt, Human
ggagcugggaauuggaucaucu

SEQ ID NO: 425496 - RNA, 22 nt, Human
uucacauuugcccuuaugugug

SEQ ID NO: 425497 - RNA, 22 nt, Human
ucauaaaacacaccagguaguu

SEQ ID NO: 425498 - RNA, 22 nt, Human
cgcugggcgccgaccugcuggc

SEQ ID NO: 425499 - RNA, 22 nt, Human
acaggagugaaucuggcacuua

SEQ ID NO: 425500 - RNA, 22 nt, Human
aagaaauguagagccuaguaaa

SEQ ID NO: 425501 - RNA, 22 nt, Human
gggcuagaaauucugcagugga

SEQ ID NO: 425502 - RNA, 18 nt, Human
gugacagcugcuagcuca

SEQ ID NO: 425503 - RNA, 22 nt, Human
agcuguucccucacugcaguca

SEQ ID NO: 425504 - RNA, 21 nt, Human
gggugcuguggucaugcagga

SEQ ID NO: 425505 - RNA, 22 nt, Human
uugaagcaugguacuuguucaa

SEQ ID NO: 425506 - RNA, 22 nt, Human
gcucuccaaacccuguggcuuu

SEQ ID NO: 425507 - RNA, 22 nt, Human
acagagcuguacuacuuacuga

SEQ ID NO: 425508 - RNA, 20 nt, Human
cagagaccaggccagguguc

SEQ ID NO: 425509 - RNA, 22 nt, Human
ugggagaagcagcagccaagug

SEQ ID NO: 425510 - RNA, 22 nt, Human
uugggggaagaggauagacagu

SEQ ID NO: 425511 - RNA, 22 nt, Human
auacaaaauauauacuggagac

SEQ ID NO: 425512 - RNA, 22 nt, Human
aguaucaaggaucuccagcacc

SEQ ID NO: 425513 - RNA, 22 nt, Human
ggccucugggguccugagccca

SEQ ID NO: 425514 - RNA, 22 nt, Human
aggcaagcauugggaacagggc

SEQ ID NO: 425515 - RNA, 22 nt, Human
cccagcucugcagaccugcccu

SEQ ID NO: 425516 - RNA, 22 nt, Human
aagggcucugggcuacgcacug

SEQ ID NO: 425517 - RNA, 22 nt, Human
ucuggcucuuugggugauugua

SEQ ID NO: 425518 - RNA, 22 nt, Human
guuugcauaucugugaaaugga

SEQ ID NO: 425519 - RNA, 22 nt, Human
gggcuggaggaccggccucgga

SEQ ID NO: 425520 - RNA, 22 nt, Human
ucccugcucagcucaccuggca

SEQ ID NO: 425521 - RNA, 22 nt, Human
ugccaggccaauucuauuugac

SEQ ID NO: 425522 - RNA, 20 nt, Human
auacacauauucuugcaacu

SEQ ID NO: 425523 - RNA, 22 nt, Human
aaaugucuuucuucugcuacgu

SEQ ID NO: 425524 - RNA, 22 nt, Human
aggacccugagcgggcaugccg

SEQ ID NO: 425525 - RNA, 23 nt, Human
ucagcugcuuccuccugccugcc

SEQ ID NO: 425526 - RNA, 22 nt, Human
uaaauguaccuucugccuuacu

SEQ ID NO: 425527 - RNA, 20 nt, Human
gucuccacuggggguuaacc

SEQ ID NO: 425528 - RNA, 22 nt, Human
uagauuuccucuuccucauucc

SEQ ID NO: 425529 - RNA, 22 nt, Human
ucacaugcuugaggaaagaaaa

SEQ ID NO: 425530 - RNA, 22 nt, Human
gcuggcaggguucucacugaaa

SEQ ID NO: 425531 - RNA, 22 nt, Human
uuuccucugagugagcugggag

SEQ ID NO: 425532 - RNA, 22 nt, Human
cuuacagagaagaaaauguagu

SEQ ID NO: 425533 - RNA, 23 nt, Human
uccuuugucuuugcauagauggu

SEQ ID NO: 425534 - RNA, 18 nt, Human
gggcaagcggcugucacc

SEQ ID NO: 425535 - RNA, 22 nt, Human
gaaaugcaaauucucucucgcu

SEQ ID NO: 425536 - RNA, 22 nt, Human
gaccaaggaagaggggagccag

SEQ ID NO: 425537 - RNA, 22 nt, Human
uaauaaaugaaagugcuggcau

SEQ ID NO: 425538 - RNA, 22 nt, Human
aggcccugggcaguucuguagc

SEQ ID NO: 425539 - RNA, 22 nt, Human
uccugccucuugccuucuucac

SEQ ID NO: 425540 - RNA, 22 nt, Human
gcagcuggggccacacuuaggc

SEQ ID NO: 425541 - RNA, 19 nt, Human
ugucucugaaagaugagcu

SEQ ID NO: 425542 - RNA, 22 nt, Human
ccugauggagcccugcugcaug

SEQ ID NO: 425543 - RNA, 22 nt, Human
auauacuuggagacuaucauug

SEQ ID NO: 425544 - RNA, 22 nt, Human
ggccagaaguuggaaaagagcc

SEQ ID NO: 425545 - RNA, 22 nt, Human
gccuggagugcaguggcgugau

SEQ ID NO: 425546 - RNA, 22 nt, Human
auucuucauguugaagcuguca

SEQ ID NO: 425547 - RNA, 22 nt, Human
uuccucaggcuucccuuugucc

SEQ ID NO: 425548 - RNA, 22 nt, Human
aggcuucccagcugagcucagc

SEQ ID NO: 425549 - RNA, 22 nt, Human
aaguggugguaugaaccgaggg

SEQ ID NO: 425550 - RNA, 20 nt, Human
agcaccagugggggcagccc

SEQ ID NO: 425551 - RNA, 22 nt, Human
acucacauuucaucaggccaag

SEQ ID NO: 425552 - RNA, 22 nt, Human
gacauucacaguuuccgauggu

SEQ ID NO: 425553 - RNA, 22 nt, Human
ucccagauuguugauggcuuaa

SEQ ID NO: 425554 - RNA, 22 nt, Human
cagaacauuccaugugcccugc

SEQ ID NO: 425555 - RNA, 22 nt, Human
ccugucagaugaaguaauugug

SEQ ID NO: 425556 - RNA, 22 nt, Human
ucugagaguagagcugccucuu

SEQ ID NO: 425557 - RNA, 22 nt, Human
uccaggacuagcauuucugaua

SEQ ID NO: 425558 - RNA, 22 nt, Human
cuaucuuuuguucauuuugagu

SEQ ID NO: 425559 - RNA, 17 nt, Human
cucacggaggaugaauc

SEQ ID NO: 425560 - RNA, 20 nt, Human
ugugaaagcaguagaaugac

SEQ ID NO: 425561 - RNA, 22 nt, Human
agcagggcagugaucagaaagg

SEQ ID NO: 425562 - RNA, 18 nt, Human
caggagcaggaguugaac

SEQ ID NO: 425563 - RNA, 22 nt, Human
guuuaauuuuagguugucaagc

SEQ ID NO: 425564 - RNA, 22 nt, Human
gcuggcucccauugguccuucc

SEQ ID NO: 425565 - RNA, 22 nt, Human
gccucccugagucacccaagca

SEQ ID NO: 425566 - RNA, 22 nt, Human
agcaaucaccaccucuauauuu

SEQ ID NO: 425567 - RNA, 18 nt, Human
ggcuuugcugggguuucu

SEQ ID NO: 425568 - RNA, 22 nt, Human
ccaucccuucaccacagcagua

SEQ ID NO: 425569 - RNA, 22 nt, Human
aaaaaugcuuggacuuaauaaa

SEQ ID NO: 425570 - RNA, 22 nt, Human
ggcagcacgacaggaguggaag

SEQ ID NO: 425571 - RNA, 22 nt, Human
uucuuuccacagaggggaugau

SEQ ID NO: 425572 - RNA, 22 nt, Human
aggccagagaggggaccagccu

SEQ ID NO: 425573 - RNA, 22 nt, Human
uuccucugaaauggcuuggaaa

SEQ ID NO: 425574 - RNA, 22 nt, Human
gagcucaggagcaucagaagaa

SEQ ID NO: 425575 - RNA, 22 nt, Human
acauuucucaucuaguagagua

SEQ ID NO: 425576 - RNA, 22 nt, Human
caugagauaauuuuucuccagu

SEQ ID NO: 425577 - RNA, 22 nt, Human
uggcaggaggaugaggcggcua

SEQ ID NO: 425578 - RNA, 18 nt, Human
aggaaagaaaggcaggug

SEQ ID NO: 425579 - RNA, 22 nt, Human
gcacagggagcaggucucuggu

SEQ ID NO: 425580 - RNA, 22 nt, Human
aaaguguaaaagcauguuaggg

SEQ ID NO: 425581 - RNA, 22 nt, Human
uggccuggaaccuggcagggac

SEQ ID NO: 425582 - RNA, 22 nt, Human
ccuggccucgugcucacggcuc

SEQ ID NO: 425583 - RNA, 22 nt, Human
guaggaagcucugaggcuaguu

SEQ ID NO: 425584 - RNA, 22 nt, Human
gacaagacaccucucuccaucc

SEQ ID NO: 425585 - RNA, 22 nt, Human
uuucuauuuacagugcuaggua

SEQ ID NO: 425586 - RNA, 19 nt, Human
ucaggacugacuugaaguc

SEQ ID NO: 425587 - RNA, 22 nt, Human
guagggacaauauguuauuaga

SEQ ID NO: 425588 - RNA, 22 nt, Human
uggcacugagcagccgcggcag

SEQ ID NO: 425589 - RNA, 22 nt, Human
gugucccaggagaggagacaau

SEQ ID NO: 425590 - RNA, 22 nt, Human
aauuagggaaguauuuaguagu

SEQ ID NO: 425591 - RNA, 22 nt, Human
aaguccaguuuuuccagguggu

SEQ ID NO: 425592 - RNA, 18 nt, Human
ugaccugcgcuucacggu

SEQ ID NO: 425593 - RNA, 22 nt, Human
uuagccauggacugaauugacu

SEQ ID NO: 425594 - RNA, 22 nt, Human
ugccugucuuggaguccuggcc

SEQ ID NO: 425595 - RNA, 22 nt, Human
aagcugaggcccauggcaaggu

SEQ ID NO: 425596 - RNA, 22 nt, Human
aggcugagauagguggaucauu

SEQ ID NO: 425597 - RNA, 22 nt, Human
acugggaggcaucuggagcuga

SEQ ID NO: 425598 - RNA, 19 nt, Human
cuggcucuuggguggagga

SEQ ID NO: 425599 - RNA, 22 nt, Human
uacauuguuuuuucuugccauc

SEQ ID NO: 425600 - RNA, 22 nt, Human
gcaggccuuggcaaugagccug

SEQ ID NO: 425601 - RNA, 22 nt, Human
uggaggaaaaaaccaggcagag

SEQ ID NO: 425602 - RNA, 22 nt, Human
aucagcaagcauuuauugagug

SEQ ID NO: 425603 - RNA, 22 nt, Human
ugcuaucucuauauccauuuau

SEQ ID NO: 425604 - RNA, 22 nt, Human
uggggacaggagacuuacagcu

SEQ ID NO: 425605 - RNA, 22 nt, Human
ugccagcccaccuuggggccuc

SEQ ID NO: 425606 - RNA, 22 nt, Human
caggaggcagagguugcagcga

SEQ ID NO: 425607 - RNA, 22 nt, Human
aagggcagaauagagaagaugg

SEQ ID NO: 425608 - RNA, 22 nt, Human
uggcagcuugaaugcagucuuu

SEQ ID NO: 425609 - RNA, 22 nt, Human
cucuggccgcagcucagcucug

SEQ ID NO: 425610 - RNA, 22 nt, Human
uuucuauucuggaucuguggca

SEQ ID NO: 425611 - RNA, 22 nt, Human
ugggcacuauggcucugugcac

SEQ ID NO: 425612 - RNA, 22 nt, Human
cuggagcugcuguccuugggug

SEQ ID NO: 425613 - RNA, 22 nt, Human
cuccaggccagggaaguggaca

SEQ ID NO: 425614 - RNA, 22 nt, Human
ccacauuuuugauacucucacu

SEQ ID NO: 425615 - RNA, 19 nt, Human
uacauuuguguacacuugu

SEQ ID NO: 425616 - RNA, 22 nt, Human
cagcugugagcagccaguugcc

SEQ ID NO: 425617 - RNA, 22 nt, Human
uccuggaguugugcagugcaca

SEQ ID NO: 425618 - RNA, 22 nt, Human
acaguaauuaaaauggaucugc

SEQ ID NO: 425619 - RNA, 22 nt, Human
ggugcagugguguggcaaaggg

SEQ ID NO: 425620 - RNA, 18 nt, Human
cucugcuaaugggcagcu

SEQ ID NO: 425621 - RNA, 22 nt, Human
auuauguagcuaaaaauugugu

SEQ ID NO: 425622 - RNA, 22 nt, Human
ugcagggaacuuggacagcuag

SEQ ID NO: 425623 - RNA, 19 nt, Human
aguggcagaucuggaagua

SEQ ID NO: 425624 - RNA, 22 nt, Human
aacaguaaugugguguuggguu

SEQ ID NO: 425625 - RNA, 22 nt, Human
ccaggacucaguggggaaaggg

SEQ ID NO: 425626 - RNA, 22 nt, Human
ugcucugguccucccucggcgc

SEQ ID NO: 425627 - RNA, 22 nt, Human
gaagccaacauuccaaguagaa

SEQ ID NO: 425628 - RNA, 22 nt, Human
ugggcugcugucugcacaugcu

SEQ ID NO: 425629 - RNA, 22 nt, Human
ccagaccacccuggccaugcac

SEQ ID NO: 425630 - RNA, 22 nt, Human
cagacuggccacaucugcacug

SEQ ID NO: 425631 - RNA, 22 nt, Human
aguggcagggcuggcugcugca

SEQ ID NO: 425632 - RNA, 20 nt, Human
gugcaauggcucagucucag

SEQ ID NO: 425633 - RNA, 22 nt, Human
ucacugcaaccucugccuuccg

SEQ ID NO: 425634 - RNA, 19 nt, Human
ggccaggcugacugugguc

SEQ ID NO: 425635 - RNA, 22 nt, Human
uuucacacuagucagaauacca

SEQ ID NO: 425636 - RNA, 22 nt, Human
accagagauggggcuucucugu

SEQ ID NO: 425637 - RNA, 18 nt, Human
gggcuguguucaugccca

SEQ ID NO: 425638 - RNA, 22 nt, Human
acaaggaggucuggggggcccu

SEQ ID NO: 425639 - RNA, 22 nt, Human
gcuucuaucccuccacugcacu

SEQ ID NO: 425640 - RNA, 22 nt, Human
uccuggugucgccuggucaguu

SEQ ID NO: 425641 - RNA, 22 nt, Human
uccauucuaugcuuacauuuau

SEQ ID NO: 425642 - RNA, 23 nt, Human
aagcuuccuucacgucuccuggg

SEQ ID NO: 425643 - RNA, 22 nt, Human
augcaguauaaaucauuucugg

SEQ ID NO: 425644 - RNA, 21 nt, Human
gagcugggcgaggcuccgggg

SEQ ID NO: 425645 - RNA, 22 nt, Human
uaaguucauuagacuacagaua

SEQ ID NO: 425646 - RNA, 22 nt, Human
gccaggcagcuagcaaccccug

SEQ ID NO: 425647 - RNA, 22 nt, Human
ugcccagggauaagccuagaga

SEQ ID NO: 425648 - RNA, 22 nt, Human
uaaaacugcuugguauggucua

SEQ ID NO: 425649 - RNA, 22 nt, Human
gccucugcugacaagauggaca

SEQ ID NO: 425650 - RNA, 22 nt, Human
gcaggcugugaggcucagaugg

SEQ ID NO: 425651 - RNA, 22 nt, Human
aaaugcacagaaaggaugugga

SEQ ID NO: 425652 - RNA, 22 nt, Human
accaucagucauugucaguggg

SEQ ID NO: 425653 - RNA, 22 nt, Human
cagggcuguggaaaacuggugc

SEQ ID NO: 425654 - RNA, 22 nt, Human
cuggcaggucucgcugacgugu

SEQ ID NO: 425655 - RNA, 22 nt, Human
aaaacucugcaguuaguuucua

SEQ ID NO: 425656 - RNA, 22 nt, Human
caggagcaguuagaagcccacu

SEQ ID NO: 425657 - RNA, 22 nt, Human
cuccagcuuuuucccaguuggc

SEQ ID NO: 425658 - RNA, 22 nt, Human
cccagcugcaccucuauggccu

SEQ ID NO: 425659 - RNA, 22 nt, Human
cccagacucaucccugggagcu

SEQ ID NO: 425660 - RNA, 19 nt, Human
aaaguuuuauucucauuug

SEQ ID NO: 425661 - RNA, 22 nt, Human
ugguggcuguugcagaacugag

SEQ ID NO: 425662 - RNA, 22 nt, Human
cucacuguccaacaggcuuuac

SEQ ID NO: 425663 - RNA, 22 nt, Human
aggccaaguagcuagcauugaa

SEQ ID NO: 425664 - RNA, 22 nt, Human
ugggaggacuugugggcuucau

SEQ ID NO: 425665 - RNA, 22 nt, Human
ugcucccaggcucuguggucug

SEQ ID NO: 425666 - RNA, 21 nt, Human
agaaauguaucauucuuuucc

SEQ ID NO: 425667 - RNA, 22 nt, Human
aguaaacauaauuuaccuguag

SEQ ID NO: 425668 - RNA, 22 nt, Human
gaauuucuggacccuuugagaa

SEQ ID NO: 425669 - RNA, 21 nt, Human
uggagcugaauuuuuggcauc

SEQ ID NO: 425670 - RNA, 22 nt, Human
agcaggcuuucaagagucuucu

SEQ ID NO: 425671 - RNA, 19 nt, Human
ugaggggcucacagucuca

SEQ ID NO: 425672 - RNA, 22 nt, Human
gcccagcuccucugcagacccu

SEQ ID NO: 425673 - RNA, 18 nt, Human
uguagagccagguuugcc

SEQ ID NO: 425674 - RNA, 22 nt, Human
agggcugcuauguugauucaga

SEQ ID NO: 425675 - RNA, 22 nt, Human
aaggcagcaccgccuccugaaa

SEQ ID NO: 425676 - RNA, 22 nt, Human
ccaggguuuaaauucugacuau

SEQ ID NO: 425677 - RNA, 22 nt, Human
gggcugacaccacccaggcgca

SEQ ID NO: 425678 - RNA, 22 nt, Human
cugucuccagggcaggugcagg

SEQ ID NO: 425679 - RNA, 22 nt, Human
agaggccacuuugccugugaug

SEQ ID NO: 425680 - RNA, 22 nt, Human
aggcuuccucgugccuuagaua

SEQ ID NO: 425681 - RNA, 22 nt, Human
agggucagcuggcugucagggg

SEQ ID NO: 425682 - RNA, 22 nt, Human
aaaaagguugauccagauuagg

SEQ ID NO: 425683 - RNA, 21 nt, Human
gcugccaccgcgugcuccagg

SEQ ID NO: 425684 - RNA, 20 nt, Human
gcagggcaucuuggccccca

SEQ ID NO: 425685 - RNA, 22 nt, Human
uguacuugaacuugacuguaga

SEQ ID NO: 425686 - RNA, 22 nt, Human
uggggcugugagacuacaggau

SEQ ID NO: 425687 - RNA, 22 nt, Human
aggggugaaagagggcccucaa

SEQ ID NO: 425688 - RNA, 22 nt, Human
cuuauguacacacauauauugu

SEQ ID NO: 425689 - RNA, 22 nt, Human
agggcugggcugcuuguuguca

SEQ ID NO: 425690 - RNA, 22 nt, Human
aggagggcuaggaaaaccagga

SEQ ID NO: 425691 - RNA, 22 nt, Human
gggcugcugccaccagguggau

SEQ ID NO: 425692 - RNA, 22 nt, Human
ugcuggccgugagcucucggga

SEQ ID NO: 425693 - RNA, 22 nt, Human
uggcuccaucauccaugcaaga

SEQ ID NO: 425694 - RNA, 20 nt, Human
uccaugaguuagagacuaua

SEQ ID NO: 425695 - RNA, 22 nt, Human
uugauacaggccuucuagauga

SEQ ID NO: 425696 - RNA, 20 nt, Human
cagagccaagagcagcaucu

SEQ ID NO: 425697 - RNA, 22 nt, Human
agggcugagugggagagaguug

SEQ ID NO: 425698 - RNA, 22 nt, Human
uaagcuauuccugaagaagguu

SEQ ID NO: 425699 - RNA, 22 nt, Human
uucaaugaggauagaacuggau

SEQ ID NO: 425700 - RNA, 22 nt, Human
aagaacaguugggaggugagcc

SEQ ID NO: 425701 - RNA, 22 nt, Human
cccugccuuguuggagccuaug

SEQ ID NO: 425702 - RNA, 22 nt, Human
ccugggcuugcaucugugcugg

SEQ ID NO: 425703 - RNA, 22 nt, Human
agccacagggggugagggacaa

SEQ ID NO: 425704 - RNA, 22 nt, Human
uucuucaauuauuggaaagaaa

SEQ ID NO: 425705 - RNA, 22 nt, Human
ugccagugggugugcagagacu

SEQ ID NO: 425706 - RNA, 18 nt, Human
agcagggcauuuugccau

SEQ ID NO: 425707 - RNA, 22 nt, Human
aaggcuuuuaacuacuguuuua

SEQ ID NO: 425708 - RNA, 22 nt, Human
gaggaggcuaagugggcucugg

SEQ ID NO: 425709 - RNA, 22 nt, Human
ggggauggaggcgugugguccu

SEQ ID NO: 425710 - RNA, 22 nt, Human
ggggagugacgcagggccauag

SEQ ID NO: 425711 - RNA, 22 nt, Human
uggcugggcccccaccugccuc

SEQ ID NO: 425712 - RNA, 22 nt, Human
aauguguacuuuuucaugcuca

SEQ ID NO: 425713 - RNA, 22 nt, Human
ucaccugggagggcugugguag

SEQ ID NO: 425714 - RNA, 22 nt, Human
ggccugaggcgucccagcugug

SEQ ID NO: 425715 - RNA, 22 nt, Human
ugcaauaacccaguaucuguga

SEQ ID NO: 425716 - RNA, 20 nt, Human
agugacagagacuguguggc

SEQ ID NO: 425717 - RNA, 21 nt, Human
gcagaggaaugguauacauaa

SEQ ID NO: 425718 - RNA, 22 nt, Human
ucuuauuauuguuguaaaagca

SEQ ID NO: 425719 - RNA, 22 nt, Human
ggcugccauaacagaguaccac

SEQ ID NO: 425720 - RNA, 22 nt, Human
ucagaggagaccaaggggaaua

SEQ ID NO: 425721 - RNA, 22 nt, Human
ucagauggguuuugaaggaugu

SEQ ID NO: 425722 - RNA, 22 nt, Human
ugaaccagagucuccagugguu

SEQ ID NO: 425723 - RNA, 22 nt, Human
cauggcagagaaggggaacugg

SEQ ID NO: 425724 - RNA, 22 nt, Human
uccuguggagaggacuggaggu

SEQ ID NO: 425725 - RNA, 22 nt, Human
gcagagcacccugcagugguau

SEQ ID NO: 425726 - RNA, 22 nt, Human
cucccacuccuggcucaccaca

SEQ ID NO: 425727 - RNA, 22 nt, Human
gagcagcuagauaaagcccuuc

SEQ ID NO: 425728 - RNA, 22 nt, Human
gccacaggcacuuaagggcugg

SEQ ID NO: 425729 - RNA, 22 nt, Human
ugaacagauggcccagcagagg

SEQ ID NO: 425730 - RNA, 22 nt, Human
aaaagcaguuaucugggaggaa

SEQ ID NO: 425731 - RNA, 21 nt, Human
aauaaaacaguuggugucaau

SEQ ID NO: 425732 - RNA, 22 nt, Human
auaaagauuucuuuuucucuac

SEQ ID NO: 425733 - RNA, 22 nt, Human
uggaggaaaauuacuggggucu

SEQ ID NO: 425734 - RNA, 22 nt, Human
aaagccacguggccuggggagc

SEQ ID NO: 425735 - RNA, 22 nt, Human
uccaggcuccccugcgugcucc

SEQ ID NO: 425736 - RNA, 18 nt, Human
gccugcaggcacgggggu

SEQ ID NO: 425737 - RNA, 22 nt, Human
ggggaccugggcuucaaggguu

SEQ ID NO: 425738 - RNA, 22 nt, Human
caauuucucgaacucuaaucca

SEQ ID NO: 425739 - RNA, 22 nt, Human
ggaggccaucuggcuggaggcu

SEQ ID NO: 425740 - RNA, 20 nt, Human
cagccuccacucacucagcu

SEQ ID NO: 425741 - RNA, 22 nt, Human
agagcuguucaacguagcaaug

SEQ ID NO: 425742 - RNA, 22 nt, Human
gcaaggcugugcacuuugcauu

SEQ ID NO: 425743 - RNA, 22 nt, Human
ugaaaucuuauacuuugguagu

SEQ ID NO: 425744 - RNA, 22 nt, Human
ugugggcaggcccgggucugag

SEQ ID NO: 425745 - RNA, 22 nt, Human
agugcagagagcaauacucuac

SEQ ID NO: 425746 - RNA, 22 nt, Human
augaugguaaauucaguauccg

SEQ ID NO: 425747 - RNA, 22 nt, Human
uggcucagaugcucuuccagug

SEQ ID NO: 425748 - RNA, 22 nt, Human
uccugccuguuuaccuguacuu

SEQ ID NO: 425749 - RNA, 22 nt, Human
caaaguuuaaaguagauuucag

SEQ ID NO: 425750 - RNA, 22 nt, Human
agcaggcuaagggaccuguuua

SEQ ID NO: 425751 - RNA, 22 nt, Human
auuauauugaguauaaccagag

SEQ ID NO: 425752 - RNA, 22 nt, Human
gcuggagcugaguucccugggc

SEQ ID NO: 425753 - RNA, 22 nt, Human
caguagcauguaauaaagacag

SEQ ID NO: 425754 - RNA, 22 nt, Human
agccaggaaugcaugcucugcu

SEQ ID NO: 425755 - RNA, 22 nt, Human
ugucucugcuuuccuugcaggg

SEQ ID NO: 425756 - RNA, 22 nt, Human
ugcuuuauuuuaaauaugccau

SEQ ID NO: 425757 - RNA, 22 nt, Human
aggucacacaacugucagaggc

SEQ ID NO: 425758 - RNA, 22 nt, Human
aaggcacuuuuccugagaugau

SEQ ID NO: 425759 - RNA, 22 nt, Human
uggcugaggcuuuucuuaaaga

SEQ ID NO: 425760 - RNA, 22 nt, Human
aguuacaaacacuaucaguucu

SEQ ID NO: 425761 - RNA, 22 nt, Human
ccuguauuagguagacaacuau

SEQ ID NO: 425762 - RNA, 22 nt, Human
auggcagauggcuggagcaggu

SEQ ID NO: 425763 - RNA, 19 nt, Human
agaaucaggucaggugaca

SEQ ID NO: 425764 - RNA, 22 nt, Human
uccugcagcugaagcucaugug

SEQ ID NO: 425765 - RNA, 22 nt, Human
uucagagccacuucaagucuaa

SEQ ID NO: 425766 - RNA, 22 nt, Human
ggcuguggccagcggggcugag

SEQ ID NO: 425767 - RNA, 22 nt, Human
agccucugcuggcccuggcacu

SEQ ID NO: 425768 - RNA, 22 nt, Human
ccucgcggcacucgggccggau

SEQ ID NO: 425769 - RNA, 22 nt, Human
gccaguuccuguggagucagag

SEQ ID NO: 425770 - RNA, 22 nt, Human
uagaaacauguucuguucuguu

SEQ ID NO: 425771 - RNA, 22 nt, Human
aguguuucccaguaggaugaaa

SEQ ID NO: 425772 - RNA, 22 nt, Human
ggccaagauggaaggagagaug

SEQ ID NO: 425773 - RNA, 22 nt, Human
cugagcacugggcacauagcug

SEQ ID NO: 425774 - RNA, 23 nt, Human
ccagcuccgugagccucgggcuc

SEQ ID NO: 425775 - RNA, 22 nt, Human
gccaggggacgcggagcgacga

SEQ ID NO: 425776 - RNA, 22 nt, Human
ugaccaaagaguugcuuguauu

SEQ ID NO: 425777 - RNA, 22 nt, Human
aaguucaagagugacauauuag

SEQ ID NO: 425778 - RNA, 22 nt, Human
agguaaagacugcaaggagaau

SEQ ID NO: 425779 - RNA, 22 nt, Human
ugggggagccuucacaguagcu

SEQ ID NO: 425780 - RNA, 22 nt, Human
guuauaaaggugauaaugguca

SEQ ID NO: 425781 - RNA, 22 nt, Human
caguacuuaacuuauaggagag

SEQ ID NO: 425782 - RNA, 22 nt, Human
cugggagcccugacuagccugg

SEQ ID NO: 425783 - RNA, 22 nt, Human
caggcccagcccagcccuucga

SEQ ID NO: 425784 - RNA, 22 nt, Human
acaugauucuugauaggcauug

SEQ ID NO: 425785 - RNA, 22 nt, Human
guggugaagccccaucucugcu

SEQ ID NO: 425786 - RNA, 22 nt, Human
gugcaugucggggugcauguca

SEQ ID NO: 425787 - RNA, 19 nt, Human
agcauuuggaauucuacac

SEQ ID NO: 425788 - RNA, 22 nt, Human
cccauuuagauaacaguucaaa

SEQ ID NO: 425789 - RNA, 22 nt, Human
ugagcuggucacuccuucugaa

SEQ ID NO: 425790 - RNA, 22 nt, Human
agggucagugaugagggagccc

SEQ ID NO: 425791 - RNA, 22 nt, Human
ggccagagucuauaugcagaca

SEQ ID NO: 425792 - RNA, 22 nt, Human
ugccuucaaucaggauggucuc

SEQ ID NO: 425793 - RNA, 22 nt, Human
aaaugucuuuaucucauguaac

SEQ ID NO: 425794 - RNA, 20 nt, Human
uaggcagagcugugcagccu

SEQ ID NO: 425795 - RNA, 19 nt, Human
ggcuggcaagugacagugu

SEQ ID NO: 425796 - RNA, 22 nt, Human
auaaggcaagcugucaguuugu

SEQ ID NO: 425797 - RNA, 21 nt, Human
guuauuuuaagugagcuuugc

SEQ ID NO: 425798 - RNA, 22 nt, Human
ggagggcucaauugacuccuga

SEQ ID NO: 425799 - RNA, 19 nt, Human
ucuggcuccgccucuuagu

SEQ ID NO: 425800 - RNA, 22 nt, Human
ucagaggugguaaaggacagca

SEQ ID NO: 425801 - RNA, 22 nt, Human
aggagcuggguuccuuuggugg

SEQ ID NO: 425802 - RNA, 22 nt, Human
gugcaggggaucagguugcagc

SEQ ID NO: 425803 - RNA, 22 nt, Human
ugaagccaaucugccaggcaga

SEQ ID NO: 425804 - RNA, 18 nt, Human
aucuuuccauagcauguu

SEQ ID NO: 425805 - RNA, 22 nt, Human
aagaugauagaucugucaaugu

SEQ ID NO: 425806 - RNA, 22 nt, Human
gaggcccuccagcugucagcug

SEQ ID NO: 425807 - RNA, 22 nt, Human
uucuaguguccuuggacuugcu

SEQ ID NO: 425808 - RNA, 22 nt, Human
uuacaguauuguuaaacucuuu

SEQ ID NO: 425809 - RNA, 22 nt, Human
ugcuguggcaguuuauguauag

SEQ ID NO: 425810 - RNA, 22 nt, Human
agcccaagcauaggagggaggc

SEQ ID NO: 425811 - RNA, 22 nt, Human
gaaugaauagguguccagaugg

SEQ ID NO: 425812 - RNA, 22 nt, Human
gccaugcuugguaugcugugag

SEQ ID NO: 425813 - RNA, 23 nt, Human
gggagaauaugaggaugauggug

SEQ ID NO: 425814 - RNA, 22 nt, Human
gugggccuugcagggugcaggg

SEQ ID NO: 425815 - RNA, 17 nt, Human
gacaagacagaauucau

SEQ ID NO: 425816 - RNA, 19 nt, Human
gaguuauugccagggcaug

SEQ ID NO: 425817 - RNA, 22 nt, Human
gcaggguaggugacagguaguc

SEQ ID NO: 425818 - RNA, 22 nt, Human
uggagcccagggugagaaggag

SEQ ID NO: 425819 - RNA, 22 nt, Human
ugaagcugugggcaguggagcc

SEQ ID NO: 425820 - RNA, 22 nt, Human
auuaaauuagcaaacugugaaa

SEQ ID NO: 425821 - RNA, 22 nt, Human
cuuaaauuggaugaguuaaguu

SEQ ID NO: 425822 - RNA, 22 nt, Human
gcagccagggagagaaccaggg

SEQ ID NO: 425823 - RNA, 20 nt, Human
gacaucauguacacauugcc

SEQ ID NO: 425824 - RNA, 22 nt, Human
ccuccagcugccucagucucuu

SEQ ID NO: 425825 - RNA, 22 nt, Human
ucaggcugugggcacuggccau

SEQ ID NO: 425826 - RNA, 22 nt, Human
ugaaacaaaccaguaauuuugu

SEQ ID NO: 425827 - RNA, 22 nt, Human
aguggcagagguugacugcagu

SEQ ID NO: 425828 - RNA, 22 nt, Human
uauuuucuguggaggaccagau

SEQ ID NO: 425829 - RNA, 22 nt, Human
uagagcuauuuagagcauuuua

SEQ ID NO: 425830 - RNA, 22 nt, Human
aaagaacaucggagugggcggg

SEQ ID NO: 425831 - RNA, 22 nt, Human
ucaaugauuagaguuuagugug

SEQ ID NO: 425832 - RNA, 22 nt, Human
cuggcccauggugagcucuggg

SEQ ID NO: 425833 - RNA, 22 nt, Human
uuuagggaugucagaacaggga

SEQ ID NO: 425834 - RNA, 22 nt, Human
caguacuuuucaaccaguauga

SEQ ID NO: 425835 - RNA, 22 nt, Human
gcuccucugucaaaugagagug

SEQ ID NO: 425836 - RNA, 22 nt, Human
augucuuuuaugauuacgggau

SEQ ID NO: 425837 - RNA, 22 nt, Human
uugaauaguguuuucaguauac

SEQ ID NO: 425838 - RNA, 19 nt, Human
uccugggcugggccagguc

SEQ ID NO: 425839 - RNA, 22 nt, Human
aaaaguauuuugagcacuuuau

SEQ ID NO: 425840 - RNA, 22 nt, Human
ucugagcauugaauuuucuucc

SEQ ID NO: 425841 - RNA, 22 nt, Human
aagacauuuauuugaaucaauu

SEQ ID NO: 425842 - RNA, 22 nt, Human
uucucauggugucuuuauacau

SEQ ID NO: 425843 - RNA, 22 nt, Human
auuauuucucacucacauaaua

SEQ ID NO: 425844 - RNA, 22 nt, Human
ggagccuguggcugcuugaagc

SEQ ID NO: 425845 - RNA, 22 nt, Human
gcagccacuaguuuuccuguuu

SEQ ID NO: 425846 - RNA, 22 nt, Human
gcagggcaggauuugaacccag

SEQ ID NO: 425847 - RNA, 22 nt, Human
acagcuguggucuccuuagugu

SEQ ID NO: 425848 - RNA, 22 nt, Human
ccagagccucaacacagguccu

SEQ ID NO: 425849 - RNA, 22 nt, Human
ccuggcugaaccaaugaagugg

SEQ ID NO: 425850 - RNA, 22 nt, Human
cagcuggcguggagugauugca

SEQ ID NO: 425851 - RNA, 22 nt, Human
agaggggcucaagcaguggucu

SEQ ID NO: 425852 - RNA, 20 nt, Human
caccacagaauuggggacag

SEQ ID NO: 425853 - RNA, 22 nt, Human
ugcagggcauaggguccaguuu

SEQ ID NO: 425854 - RNA, 22 nt, Human
agacagggucuugaucagagcu

SEQ ID NO: 425855 - RNA, 22 nt, Human
cagcagagcugugugggaaggg

SEQ ID NO: 425856 - RNA, 22 nt, Human
agaaaugugagccccuuaucaa

SEQ ID NO: 425857 - RNA, 22 nt, Human
aguccaaagcagaugagggcca

SEQ ID NO: 425858 - RNA, 22 nt, Human
ugcugagcgcauccggcggccg

SEQ ID NO: 425859 - RNA, 22 nt, Human
uuuuaauccucuugguaucuua

SEQ ID NO: 425860 - RNA, 22 nt, Human
cuggccacaugugugcugagca

SEQ ID NO: 425861 - RNA, 22 nt, Human
cacugaagguaggaccaaggcu

SEQ ID NO: 425862 - RNA, 22 nt, Human
acaguguccuuguggucccugu

SEQ ID NO: 425863 - RNA, 22 nt, Human
ugagcuggaaucuucuugacug

SEQ ID NO: 425864 - RNA, 22 nt, Human
aggcgcagacauacagggucug

SEQ ID NO: 425865 - RNA, 22 nt, Human
gggcuggcucccagguguugaa

SEQ ID NO: 425866 - RNA, 22 nt, Human
gcaaaaaccacaauuacuuuua

SEQ ID NO: 425867 - RNA, 22 nt, Human
uguaauggaagugggauugcau

SEQ ID NO: 425868 - RNA, 22 nt, Human
agauguggccggcuagggagag

SEQ ID NO: 425869 - RNA, 22 nt, Human
ggugaggaaagauggugacagu

SEQ ID NO: 425870 - RNA, 22 nt, Human
cugaggcauguuacaggacaua

SEQ ID NO: 425871 - RNA, 20 nt, Human
gagccuuccccucaccacug

SEQ ID NO: 425872 - RNA, 22 nt, Human
ucuucauuccguagauauuuau

SEQ ID NO: 425873 - RNA, 22 nt, Human
aagagcaucgguggagccccca

SEQ ID NO: 425874 - RNA, 21 nt, Human
ggcaggauggcaguggacccc

SEQ ID NO: 425875 - RNA, 22 nt, Human
cacccaggcuagagugcagugg

SEQ ID NO: 425876 - RNA, 22 nt, Human
agcugcagucaagcugggccac

SEQ ID NO: 425877 - RNA, 22 nt, Human
cugccuguuuucugauagauuu

SEQ ID NO: 425878 - RNA, 22 nt, Human
acaaaugccauauauaaauucu

SEQ ID NO: 425879 - RNA, 17 nt, Human
aaaauucuguaaagagg

SEQ ID NO: 425880 - RNA, 18 nt, Human
gcagugaagaaagagcuu

SEQ ID NO: 425881 - RNA, 22 nt, Human
ccugccaggccagugagcuucc

SEQ ID NO: 425882 - RNA, 22 nt, Human
cagcuuuggcccagucgggagg

SEQ ID NO: 425883 - RNA, 22 nt, Human
ucucugagcccaauguagcaau

SEQ ID NO: 425884 - RNA, 18 nt, Human
aggcagcagcaucuucuc

SEQ ID NO: 425885 - RNA, 22 nt, Human
uagacagauuucuuguuagaca

SEQ ID NO: 425886 - RNA, 22 nt, Human
ccucaggauacaggagccacag

SEQ ID NO: 425887 - RNA, 19 nt, Human
cugcagggaugugcagagu

SEQ ID NO: 425888 - RNA, 22 nt, Human
acugggccuggauuggcguguc

SEQ ID NO: 425889 - RNA, 22 nt, Human
ucuggagcaacagagcaggaca

SEQ ID NO: 425890 - RNA, 20 nt, Human
auuccauaguuggcacuuuu

SEQ ID NO: 425891 - RNA, 22 nt, Human
uuucucauagucaugccucuua

SEQ ID NO: 425892 - RNA, 22 nt, Human
cuggagagauccuccugaaaaa

SEQ ID NO: 425893 - RNA, 22 nt, Human
ggagcugaaggggugggcucag

SEQ ID NO: 425894 - RNA, 22 nt, Human
ggcauggcucggagucagaaca

SEQ ID NO: 425895 - RNA, 19 nt, Human
aggcucugagcuccuggag

SEQ ID NO: 425896 - RNA, 22 nt, Human
cagugaaguuuaaaguguagau

SEQ ID NO: 425897 - RNA, 22 nt, Human
gggggcucugacucccucagcu

SEQ ID NO: 425898 - RNA, 21 nt, Human
auuuucauuaauucagugugg

SEQ ID NO: 425899 - RNA, 22 nt, Human
caccagguuccgggcagagcug

SEQ ID NO: 425900 - RNA, 22 nt, Human
gcagauggacuguaugaccuga

SEQ ID NO: 425901 - RNA, 22 nt, Human
uggggacacagagguucguugg

SEQ ID NO: 425902 - RNA, 22 nt, Human
cuggcaggaagaggaaagguca

SEQ ID NO: 425903 - RNA, 17 nt, Human
cucugcagugcauggcu

SEQ ID NO: 425904 - RNA, 22 nt, Human
acacagggcagagagcuggcuc

SEQ ID NO: 425905 - RNA, 22 nt, Human
ggcuccuguccccucagcugcu

SEQ ID NO: 425906 - RNA, 22 nt, Human
cagguggaucucuaaggacuga

SEQ ID NO: 425907 - RNA, 22 nt, Human
gaguucaguguuucuaguagug

SEQ ID NO: 425908 - RNA, 22 nt, Human
ccagagccuggcaucugcauaa

SEQ ID NO: 425909 - RNA, 22 nt, Human
ugcccaaguguuuggcugaguc

SEQ ID NO: 425910 - RNA, 18 nt, Human
ugcccagaaaagcaggga

SEQ ID NO: 425911 - RNA, 22 nt, Human
aggucagaagugccagggaauu

SEQ ID NO: 425912 - RNA, 22 nt, Human
agcgugaaggcgggcagucggc

SEQ ID NO: 425913 - RNA, 20 nt, Human
ccagaagagaugaucaucca

SEQ ID NO: 425914 - RNA, 22 nt, Human
cugcuuuguaaaauagacauaa

SEQ ID NO: 425915 - RNA, 22 nt, Human
aaacucuuuccacgauuacuuu

SEQ ID NO: 425916 - RNA, 22 nt, Human
ggcugagcccccucugcguagg

SEQ ID NO: 425917 - RNA, 22 nt, Human
ugcagugggccggaggccaggg

SEQ ID NO: 425918 - RNA, 22 nt, Human
ugaggccaaugacccugggcag

SEQ ID NO: 425919 - RNA, 22 nt, Human
guggauggacaugggcaagagg

SEQ ID NO: 425920 - RNA, 22 nt, Human
aacagcagggggaccugcuggu

SEQ ID NO: 425921 - RNA, 20 nt, Human
aucagcaacugccacucagu

SEQ ID NO: 425922 - RNA, 22 nt, Human
cauguacaaaaggcaaaugccu

SEQ ID NO: 425923 - RNA, 22 nt, Human
aaguuuaagguggaaguggugg

SEQ ID NO: 425924 - RNA, 22 nt, Human
ucagugcuucggcgagcaccua

SEQ ID NO: 425925 - RNA, 22 nt, Human
uuccagagaaaagguuuauuuc

SEQ ID NO: 425926 - RNA, 22 nt, Human
aggagcuggaguccaggcaagu

SEQ ID NO: 425927 - RNA, 22 nt, Human
auuuucauggcuucugcucagu

SEQ ID NO: 425928 - RNA, 22 nt, Human
ugccaggcacgugagaguggcc

SEQ ID NO: 425929 - RNA, 22 nt, Human
gaaaaaugagcugaugucaggg

SEQ ID NO: 425930 - RNA, 22 nt, Human
ugcauuaugcuugugcuguaua

SEQ ID NO: 425931 - RNA, 22 nt, Human
ucacauuuguguuuuauuagag

SEQ ID NO: 425932 - RNA, 19 nt, Human
ucccagagucuagagguug

SEQ ID NO: 425933 - RNA, 19 nt, Human
guuuuucccagacgaggca

SEQ ID NO: 425934 - RNA, 22 nt, Human
ccugggagagccaucuguggcc

SEQ ID NO: 425935 - RNA, 18 nt, Human
aggcacuggaauuaaggg

SEQ ID NO: 425936 - RNA, 22 nt, Human
agccuggcccugcugaacucug

SEQ ID NO: 425937 - RNA, 21 nt, Human
ucacuagugccuucugucauu

SEQ ID NO: 425938 - RNA, 22 nt, Human
ucugaaggucugagaaccagga

SEQ ID NO: 425939 - RNA, 21 nt, Human
uaaauaauaaguugcugagau

SEQ ID NO: 425940 - RNA, 22 nt, Human
aggacugggugcagagggcauc

SEQ ID NO: 425941 - RNA, 22 nt, Human
uuccagaauuuuguucugcuug

SEQ ID NO: 425942 - RNA, 20 nt, Human
cagagcugggauuugaacac

SEQ ID NO: 425943 - RNA, 22 nt, Human
uugaggagucaggggcacggaa

SEQ ID NO: 425944 - RNA, 23 nt, Human
aaauuauugcucuucaauugccu

SEQ ID NO: 425945 - RNA, 22 nt, Human
ggccucugcaacuggcuguggc

SEQ ID NO: 425946 - RNA, 22 nt, Human
ggcacugagaacaggcugacuu

SEQ ID NO: 425947 - RNA, 22 nt, Human
gcugggagcaaguacucaucuu

SEQ ID NO: 425948 - RNA, 22 nt, Human
gcucccagcauugcuucccagg

SEQ ID NO: 425949 - RNA, 22 nt, Human
ggcccacacugacagcugagcu

SEQ ID NO: 425950 - RNA, 22 nt, Human
cugguucauccccuuccaggaa

SEQ ID NO: 425951 - RNA, 22 nt, Human
agcuuuaucccuugcccaucga

SEQ ID NO: 425952 - RNA, 22 nt, Human
gacccuguuucuacaaauaauu

SEQ ID NO: 425953 - RNA, 22 nt, Human
aaucagucauuagcucugaccu

SEQ ID NO: 425954 - RNA, 22 nt, Human
uggaagagggagcuggguggcc

SEQ ID NO: 425955 - RNA, 22 nt, Human
gccuaauaacuagcuguguaac

SEQ ID NO: 425956 - RNA, 22 nt, Human
agggauggaagcucgucugcaa

SEQ ID NO: 425957 - RNA, 22 nt, Human
gcaggcagagucaauuugaucc

SEQ ID NO: 425958 - RNA, 22 nt, Human
ugccucugggugaccaaggagc

SEQ ID NO: 425959 - RNA, 22 nt, Human
uuauuguuuacuaguuugcaga

SEQ ID NO: 425960 - RNA, 21 nt, Human
acucaggagacuaacuauguc

SEQ ID NO: 425961 - RNA, 22 nt, Human
aguaaaaucuuaagcacagugg

SEQ ID NO: 425962 - RNA, 22 nt, Human
uucuggagcuaaaguccacucu

SEQ ID NO: 425963 - RNA, 22 nt, Human
ccagcuccagguagaugggcag

SEQ ID NO: 425964 - RNA, 18 nt, Human
ugggauggagaguaacug

SEQ ID NO: 425965 - RNA, 22 nt, Human
gcaaaaaccacaauuacuuuug

SEQ ID NO: 425966 - RNA, 22 nt, Human
acagcuuuaucucagggaucag

SEQ ID NO: 425967 - RNA, 22 nt, Human
gaggcugggaaguccaagauca

SEQ ID NO: 425968 - RNA, 22 nt, Human
agcagagcuauucuugugcaau

SEQ ID NO: 425969 - RNA, 22 nt, Human
agggcacaagacucugagcccc

SEQ ID NO: 425970 - RNA, 22 nt, Human
gcuggccugcaaagcccggcug

SEQ ID NO: 425971 - RNA, 22 nt, Human
agaaggcagaugggacggagca

SEQ ID NO: 425972 - RNA, 22 nt, Human
gcagaugguggggcaggaaaau

SEQ ID NO: 425973 - RNA, 22 nt, Human
aucugccugagucuagguuuuc

SEQ ID NO: 425974 - RNA, 19 nt, Human
uguuuuguuaaagcagucc

SEQ ID NO: 425975 - RNA, 22 nt, Human
cuuaggaacgcucugccuagug

SEQ ID NO: 425976 - RNA, 22 nt, Human
cccagacugcagagcgggcaga

SEQ ID NO: 425977 - RNA, 22 nt, Human
cagcuggcuccaccucugggcu

SEQ ID NO: 425978 - RNA, 22 nt, Human
ugggccaggauuucaagacccu

SEQ ID NO: 425979 - RNA, 22 nt, Human
ugcaggugcguuuucaagccuc

SEQ ID NO: 425980 - RNA, 22 nt, Human
ugggccaggcaugugaucagca

SEQ ID NO: 425981 - RNA, 22 nt, Human
uggggcagaguaggauuuuggc

SEQ ID NO: 425982 - RNA, 22 nt, Human
cuguggcuaugguguacauacu

SEQ ID NO: 425983 - RNA, 22 nt, Human
uacauguuugguaaaugauggc

SEQ ID NO: 425984 - RNA, 22 nt, Human
ugauuuuuagcuauucugaaga

SEQ ID NO: 425985 - RNA, 22 nt, Human
gggagaaggagcuaguucuuga

SEQ ID NO: 425986 - RNA, 22 nt, Human
aaaagcagagacucuggagcua

SEQ ID NO: 425987 - RNA, 22 nt, Human
cauuugcaagagauaaauguuu

SEQ ID NO: 425988 - RNA, 22 nt, Human
gggagagagaaaacguggcgca

SEQ ID NO: 425989 - RNA, 22 nt, Human
ugggcucucuggcaggaaggcu

SEQ ID NO: 425990 - RNA, 22 nt, Human
ugcagggcaguuuguuucggca

SEQ ID NO: 425991 - RNA, 22 nt, Human
auagucuuagucuauaguuuug

SEQ ID NO: 425992 - RNA, 22 nt, Human
gccuucaguagugucagcugua

SEQ ID NO: 425993 - RNA, 22 nt, Human
agccaggauggucucgaucggc

SEQ ID NO: 425994 - RNA, 22 nt, Human
agacuguagggauagaggucuu

SEQ ID NO: 425995 - RNA, 23 nt, Human
ugaguucucaucuuggcuucuau

SEQ ID NO: 425996 - RNA, 22 nt, Human
uaggggugaggccaggcaucag

SEQ ID NO: 425997 - RNA, 20 nt, Human
gcugccuguuucuguaagua

SEQ ID NO: 425998 - RNA, 22 nt, Human
aaacagcugucauuguuuuaaa

SEQ ID NO: 425999 - RNA, 22 nt, Human
ucuguacauuuggggaccccag

SEQ ID NO: 426000 - RNA, 22 nt, Human
guacauguugguuguuuccagu

SEQ ID NO: 426001 - RNA, 22 nt, Human
ugauuucccucaucauaacaga

SEQ ID NO: 426002 - RNA, 22 nt, Human
gcccucugcacagcucugagca

SEQ ID NO: 426003 - RNA, 22 nt, Human
guuugcauauuugcacaggaau

SEQ ID NO: 426004 - RNA, 22 nt, Human
cugccuguuagucuagcaguua

SEQ ID NO: 426005 - RNA, 22 nt, Human
uauuagguaaaggacuugcagg

SEQ ID NO: 426006 - RNA, 22 nt, Human
aaaugaacucuuccugcauccc

SEQ ID NO: 426007 - RNA, 22 nt, Human
gcuggggagcaagaguagugag

SEQ ID NO: 426008 - RNA, 22 nt, Human
cgagaguuagcuaggagucaca

SEQ ID NO: 426009 - RNA, 22 nt, Human
ccaggccuagccccugagggua

SEQ ID NO: 426010 - RNA, 22 nt, Human
cugaagagcucuccuguccccu

SEQ ID NO: 426011 - RNA, 22 nt, Human
gcuaccugagcaagagcuucaa

SEQ ID NO: 426012 - RNA, 22 nt, Human
aguacuuuacuucuuacaguuu

SEQ ID NO: 426013 - RNA, 22 nt, Human
gcagugaagccagaucugaaau

SEQ ID NO: 426014 - RNA, 22 nt, Human
ugucucugagaugacucccacc

SEQ ID NO: 426015 - RNA, 22 nt, Human
uugcagagcaguaggaauauag

SEQ ID NO: 426016 - RNA, 22 nt, Human
agcuggccuccgggugccuggg

SEQ ID NO: 426017 - RNA, 22 nt, Human
agccucucuuuauucccagcua

SEQ ID NO: 426018 - RNA, 22 nt, Human
ccacagaaaguugucuagagua

SEQ ID NO: 426019 - RNA, 22 nt, Human
agccagcagggcuuagaggaca

SEQ ID NO: 426020 - RNA, 22 nt, Human
uguacuuccccaaugacagcac

SEQ ID NO: 426021 - RNA, 22 nt, Human
cugcagcugucucuacugggca

SEQ ID NO: 426022 - RNA, 22 nt, Human
auuagggaaggauuuggccuga

SEQ ID NO: 426023 - RNA, 22 nt, Human
acagaggccccgugggagagcc

SEQ ID NO: 426024 - RNA, 22 nt, Human
ggccugagucacaucaggagag

SEQ ID NO: 426025 - RNA, 20 nt, Human
gcaggcagggaaugggggug

SEQ ID NO: 426026 - RNA, 22 nt, Human
ggaagggccucgggcgugggac

SEQ ID NO: 426027 - RNA, 22 nt, Human
ggacucagcagccaggaguggc

SEQ ID NO: 426028 - RNA, 22 nt, Human
cugagaauuacucugaugagua

SEQ ID NO: 426029 - RNA, 22 nt, Human
gaaaaaugcuccaaaucugugg

SEQ ID NO: 426030 - RNA, 20 nt, Human
uguuaaaggacacuugcuuu

SEQ ID NO: 426031 - RNA, 22 nt, Human
uauagagguggaaacugagguu

SEQ ID NO: 426032 - RNA, 22 nt, Human
ucucaagagggaggcaaucaug

SEQ ID NO: 426033 - RNA, 22 nt, Human
ggucacaggggagaagagugau

SEQ ID NO: 426034 - RNA, 22 nt, Human
gggagaaggaggacugugcugu

SEQ ID NO: 426035 - RNA, 22 nt, Human
ugccaggcaacugcccagccau

SEQ ID NO: 426036 - RNA, 22 nt, Human
caacagaaggaagcagggucag

SEQ ID NO: 426037 - RNA, 22 nt, Human
ucuggagaacuugcaagaggau

SEQ ID NO: 426038 - RNA, 20 nt, Human
uccaguggccugaaucugga

SEQ ID NO: 426039 - RNA, 22 nt, Human
cugggcugugguguggcccaaa

SEQ ID NO: 426040 - RNA, 22 nt, Human
gcaggugaaugauggacuagga

SEQ ID NO: 426041 - RNA, 22 nt, Human
agcugccacaugcccaagggca

SEQ ID NO: 426042 - RNA, 22 nt, Human
ccugccuguaagauggguacaa

SEQ ID NO: 426043 - RNA, 22 nt, Human
ggcccugugguuuugcaaaguc

SEQ ID NO: 426044 - RNA, 22 nt, Human
caggcagcgcucguggccuggc

SEQ ID NO: 426045 - RNA, 22 nt, Human
gggcugcugcccaggaggcacc

SEQ ID NO: 426046 - RNA, 22 nt, Human
guuguacagcauccagugcaga

SEQ ID NO: 426047 - RNA, 22 nt, Human
uugguuuagagagugugguuac

SEQ ID NO: 426048 - RNA, 22 nt, Human
cagagcugguguuacaagucca

SEQ ID NO: 426049 - RNA, 22 nt, Human
ccuggccagccagggcuggggu

SEQ ID NO: 426050 - RNA, 22 nt, Human
ucacagacaauuguuuuggugu

SEQ ID NO: 426051 - RNA, 22 nt, Human
gcggcaggaagagcgcagcccc

SEQ ID NO: 426052 - RNA, 22 nt, Human
ugcagaagcagagaguugccaa

SEQ ID NO: 426053 - RNA, 22 nt, Human
uuuuuaagagauucuccagucu

SEQ ID NO: 426054 - RNA, 22 nt, Human
ccggggacuuaaagugaaggaa

SEQ ID NO: 426055 - RNA, 22 nt, Human
gucuccugagacugcagucacc

SEQ ID NO: 426056 - RNA, 19 nt, Human
ggccuggauuuagggcucc

SEQ ID NO: 426057 - RNA, 22 nt, Human
gcucuggacccuggaguggcug

SEQ ID NO: 426058 - RNA, 22 nt, Human
gguggaaggccuggaaggaggc

SEQ ID NO: 426059 - RNA, 22 nt, Human
aagaauuuuccagcaugucagu

SEQ ID NO: 426060 - RNA, 22 nt, Human
aacuguaaagguugagugguaa

SEQ ID NO: 426061 - RNA, 21 nt, Human
ugcuggccucaagggugacuu

SEQ ID NO: 426062 - RNA, 22 nt, Human
cauugaaauauggaaacugaug

SEQ ID NO: 426063 - RNA, 22 nt, Human
aaaugcacucugcuucugugac

SEQ ID NO: 426064 - RNA, 22 nt, Human
guuugaaaaaagcaguauguaa

SEQ ID NO: 426065 - RNA, 22 nt, Human
cuggacuuuggcccaucugcca

SEQ ID NO: 426066 - RNA, 21 nt, Human
ugaggcuguuguaccagggag

SEQ ID NO: 426067 - RNA, 22 nt, Human
ugacagaaauaguucuuaauuu

SEQ ID NO: 426068 - RNA, 22 nt, Human
gggcugcugccaaucacagccu

SEQ ID NO: 426069 - RNA, 22 nt, Human
agauacaucauuuauaccuuca

SEQ ID NO: 426070 - RNA, 22 nt, Human
gcagaagcugggcagcgaggug

SEQ ID NO: 426071 - RNA, 22 nt, Human
aaacauugcuaaauaaugcugc

SEQ ID NO: 426072 - RNA, 22 nt, Human
acuuuguauaagacaauaaaga

SEQ ID NO: 426073 - RNA, 22 nt, Human
uggcugaguuacgaacagagca

SEQ ID NO: 426074 - RNA, 22 nt, Human
uccagugguacauggagacacu

SEQ ID NO: 426075 - RNA, 22 nt, Human
ucuuuacaguccucugucaauc

SEQ ID NO: 426076 - RNA, 22 nt, Human
gucaggaucaaauugaaguuau

SEQ ID NO: 426077 - RNA, 22 nt, Human
acugcagccuagggaccacagu

SEQ ID NO: 426078 - RNA, 22 nt, Human
cuucuugcugggggccucagug

SEQ ID NO: 426079 - RNA, 22 nt, Human
ucauuucucugagucugauaau

SEQ ID NO: 426080 - RNA, 22 nt, Human
uccaggcacuauauauacuuuu

SEQ ID NO: 426081 - RNA, 20 nt, Human
ugccaggcacggagugcaug

SEQ ID NO: 426082 - RNA, 22 nt, Human
gcucucagguacaaagcugugu

SEQ ID NO: 426083 - RNA, 22 nt, Human
ugcugucuguuuacuggcuaua

SEQ ID NO: 426084 - RNA, 22 nt, Human
aaaucaguucacguucugaggu

SEQ ID NO: 426085 - RNA, 22 nt, Human
ucauguaaguauagaaagcagu

SEQ ID NO: 426086 - RNA, 22 nt, Human
uuugucauaucacacaauuuug

SEQ ID NO: 426087 - RNA, 22 nt, Human
cccagcuccuuggaugggcagg

SEQ ID NO: 426088 - RNA, 22 nt, Human
cccaaggccuucaagccagcuc

SEQ ID NO: 426089 - RNA, 23 nt, Human
agagcuuagggaauucacaugag

SEQ ID NO: 426090 - RNA, 22 nt, Human
acuccugggugcugaccagcgu

SEQ ID NO: 426091 - RNA, 23 nt, Human
gaguguucauagcaggcucuugc

SEQ ID NO: 426092 - RNA, 22 nt, Human
ggcugagggccagggcuagucu

SEQ ID NO: 426093 - RNA, 22 nt, Human
uggggagugaugccucggauaa

SEQ ID NO: 426094 - RNA, 22 nt, Human
cgagcaugaugacggcuguggc

SEQ ID NO: 426095 - RNA, 22 nt, Human
agccccaguaagggagggccug

SEQ ID NO: 426096 - RNA, 22 nt, Human
ggcugggcaaacaagacucuuc

SEQ ID NO: 426097 - RNA, 20 nt, Human
ucccaggcuccacccuagac

SEQ ID NO: 426098 - RNA, 22 nt, Human
ucugaaauguucucuuguuuug

SEQ ID NO: 426099 - RNA, 22 nt, Human
ucuuccagcaaugugaaaucac

SEQ ID NO: 426100 - RNA, 22 nt, Human
ugcauuauuugcaugugccugu

SEQ ID NO: 426101 - RNA, 22 nt, Human
cugugggcugaaagugcucccg

SEQ ID NO: 426102 - RNA, 22 nt, Human
auugaaagauaggcuacugugg

SEQ ID NO: 426103 - RNA, 22 nt, Human
aggcugaaaacgagauggcaau

SEQ ID NO: 426104 - RNA, 22 nt, Human
guggcugguuuccugcaugcaa

SEQ ID NO: 426105 - RNA, 22 nt, Human
augguuuguaacccaauacucc

SEQ ID NO: 426106 - RNA, 22 nt, Human
cucucugcuguauccuuaggcu

SEQ ID NO: 426107 - RNA, 22 nt, Human
ugagcagaacacgggauccaug

SEQ ID NO: 426108 - RNA, 22 nt, Human
uugcacuccagcccgagcaaca

SEQ ID NO: 426109 - RNA, 22 nt, Human
accugcaggggugcucucuggg

SEQ ID NO: 426110 - RNA, 16 nt, Human
ggcaccagugaacaca

SEQ ID NO: 426111 - RNA, 22 nt, Human
acuguggcgucaggaagaaauu

SEQ ID NO: 426112 - RNA, 22 nt, Human
gugcauuugacgaauacucacu

SEQ ID NO: 426113 - RNA, 22 nt, Human
gagucacaaagccuuucuuauu

SEQ ID NO: 426114 - RNA, 22 nt, Human
ucaggaaagaguguauccauca

SEQ ID NO: 426115 - RNA, 22 nt, Human
ugcauugcaguuaacucaguau

SEQ ID NO: 426116 - RNA, 22 nt, Human
uccuuccuggggucucugcugc

SEQ ID NO: 426117 - RNA, 22 nt, Human
uagcacauaacuuagaauaguu

SEQ ID NO: 426118 - RNA, 22 nt, Human
cccugcagccggccagcucauu

SEQ ID NO: 426119 - RNA, 22 nt, Human
aggagaguaccauugggccgca

SEQ ID NO: 426120 - RNA, 22 nt, Human
gcccugggauuggguggaggcu

SEQ ID NO: 426121 - RNA, 22 nt, Human
aaagauucgagcgauguauaaa

SEQ ID NO: 426122 - RNA, 22 nt, Human
uccucaggaugugggguagaau

SEQ ID NO: 426123 - RNA, 21 nt, Human
aggagcuguguuagcuggucg

SEQ ID NO: 426124 - RNA, 22 nt, Human
acuguacuuuucuuggcuagau

SEQ ID NO: 426125 - RNA, 22 nt, Human
acgcagaagggccuggcgugcc

SEQ ID NO: 426126 - RNA, 22 nt, Human
ugcuuuauggagcccaucucau

SEQ ID NO: 426127 - RNA, 22 nt, Human
ugggcuggagcuuguugcuucc

SEQ ID NO: 426128 - RNA, 22 nt, Human
uggcccucagucuugcuccugc

SEQ ID NO: 426129 - RNA, 22 nt, Human
aguuucuauuuucaugucuguu

SEQ ID NO: 426130 - RNA, 22 nt, Human
gagccugaaauacaggucacug

SEQ ID NO: 426131 - RNA, 22 nt, Human
aguauggggcugugugugcaca

SEQ ID NO: 426132 - RNA, 22 nt, Human
agaagugccauacuguggucca

SEQ ID NO: 426133 - RNA, 22 nt, Human
aagaacauguuaaaagauucac

SEQ ID NO: 426134 - RNA, 22 nt, Human
cauuagggacugaggaauaagg

SEQ ID NO: 426135 - RNA, 22 nt, Human
uggaaguggcagaaaaugaaca

SEQ ID NO: 426136 - RNA, 22 nt, Human
cacauuuaauccuuuauaagua

SEQ ID NO: 426137 - RNA, 22 nt, Human
cuucaucaacucuaacaaaugu

SEQ ID NO: 426138 - RNA, 22 nt, Human
caggccuggcugcagcucgccu

SEQ ID NO: 426139 - RNA, 22 nt, Human
gaaggccuaggaaggaagccuu

SEQ ID NO: 426140 - RNA, 22 nt, Human
uauauguguggauucuuguaga

SEQ ID NO: 426141 - RNA, 22 nt, Human
caggaaggcgcggcugugccug

SEQ ID NO: 426142 - RNA, 22 nt, Human
ccagcaugagacgaugaugaag

SEQ ID NO: 426143 - RNA, 22 nt, Human
gcucacuggccugaagaggacg

SEQ ID NO: 426144 - RNA, 22 nt, Human
uccaggcaugguguaauuuugc

SEQ ID NO: 426145 - RNA, 22 nt, Human
ccucaggggucacugugaggag

SEQ ID NO: 426146 - RNA, 22 nt, Human
cagcuggaggagcagcuuccag

SEQ ID NO: 426147 - RNA, 22 nt, Human
agauggggcucaguguggaggc

SEQ ID NO: 426148 - RNA, 22 nt, Human
aaagaagguagggcuggugacu

SEQ ID NO: 426149 - RNA, 22 nt, Human
ugcuagaaaucugaaacuagca

SEQ ID NO: 426150 - RNA, 22 nt, Human
ggcucugcuucagaaggcucau

SEQ ID NO: 426151 - RNA, 22 nt, Human
auauuugucaauucacuguuca

SEQ ID NO: 426152 - RNA, 22 nt, Human
auacaaaguauuaauccuggau

SEQ ID NO: 426153 - RNA, 22 nt, Human
agucugcacucagguggagguc

SEQ ID NO: 426154 - RNA, 22 nt, Human
gcucugugcaguucagggacac

SEQ ID NO: 426155 - RNA, 22 nt, Human
aaaguucaugguguuauagaaa

SEQ ID NO: 426156 - RNA, 22 nt, Human
ggagaaggaagaaagcuacuau

SEQ ID NO: 426157 - RNA, 22 nt, Human
agggacuggcucucugagcagg

SEQ ID NO: 426158 - RNA, 22 nt, Human
uagcagugccaggauuuugcug

SEQ ID NO: 426159 - RNA, 22 nt, Human
agaguuaagacguacaugagug

SEQ ID NO: 426160 - RNA, 21 nt, Human
agccuggcccagggggaggcu

SEQ ID NO: 426161 - RNA, 22 nt, Human
cagggacaugacuggucucugu

SEQ ID NO: 426162 - RNA, 22 nt, Human
cagccagguaugggcgugcggg

SEQ ID NO: 426163 - RNA, 22 nt, Human
cuguccuugcuggccagguaug

SEQ ID NO: 426164 - RNA, 22 nt, Human
ucacacacauuugcugucugau

SEQ ID NO: 426165 - RNA, 22 nt, Human
gcaggcuccaggccggccccuu

SEQ ID NO: 426166 - RNA, 22 nt, Human
aggugagguuugggagguguca

SEQ ID NO: 426167 - RNA, 22 nt, Human
uaaugcaguacugauauaaaca

SEQ ID NO: 426168 - RNA, 22 nt, Human
uuccaggacaagauguuucagg

SEQ ID NO: 426169 - RNA, 22 nt, Human
ugcugccacaaauucagcugcc

SEQ ID NO: 426170 - RNA, 22 nt, Human
gcagggcugcugaaacuuguuu

SEQ ID NO: 426171 - RNA, 22 nt, Human
ucuuggagaauggcagagaagc

SEQ ID NO: 426172 - RNA, 22 nt, Human
aucaggauccaccuugagccug

SEQ ID NO: 426173 - RNA, 22 nt, Human
agcaggugacagggcuguggug

SEQ ID NO: 426174 - RNA, 22 nt, Human
acaggcaggcuucggccagagc

SEQ ID NO: 426175 - RNA, 22 nt, Human
gggcugagacgauggggucuuc

SEQ ID NO: 426176 - RNA, 22 nt, Human
aguugaagguuggcugauccau

SEQ ID NO: 426177 - RNA, 22 nt, Human
ucuuugcaggagcccuuugaac

SEQ ID NO: 426178 - RNA, 22 nt, Human
agccuucagcaguucaggugcc

SEQ ID NO: 426179 - RNA, 22 nt, Human
ucucuggaagcgcagaucuguu

SEQ ID NO: 426180 - RNA, 22 nt, Human
ggcagcucacugauuagcaauu

SEQ ID NO: 426181 - RNA, 22 nt, Human
cagccaggagccucugcaacua

SEQ ID NO: 426182 - RNA, 22 nt, Human
gcagagcucaugccugcaccuc

SEQ ID NO: 426183 - RNA, 22 nt, Human
gugcugcucacaucuggaggua

SEQ ID NO: 426184 - RNA, 23 nt, Human
cccagcagagaugaggagggguc

SEQ ID NO: 426185 - RNA, 22 nt, Human
ggguggaggagaacaggcccca

SEQ ID NO: 426186 - RNA, 22 nt, Human
cauccaggcaccacaaccagcu

SEQ ID NO: 426187 - RNA, 19 nt, Human
ggaaacaggggccagagga

SEQ ID NO: 426188 - RNA, 22 nt, Human
caacauuucaaggucuuuagga

SEQ ID NO: 426189 - RNA, 22 nt, Human
cccugcagccuugcaugccuuc

SEQ ID NO: 426190 - RNA, 22 nt, Human
uuucuagaggcuccaggggagu

SEQ ID NO: 426191 - RNA, 22 nt, Human
gacccaggguuucugcacaggg

SEQ ID NO: 426192 - RNA, 19 nt, Human
acaaagcugugagcagcuu

SEQ ID NO: 426193 - RNA, 22 nt, Human
uccauugucuuugguccuagcc

SEQ ID NO: 426194 - RNA, 22 nt, Human
agggcuccgggcaggcgaugga

SEQ ID NO: 426195 - RNA, 22 nt, Human
gaggcuggcagaaaagcacagg

SEQ ID NO: 426196 - RNA, 22 nt, Human
cagucccaugagcccagaacau

SEQ ID NO: 426197 - RNA, 22 nt, Human
gggagccuugggagugccagcc

SEQ ID NO: 426198 - RNA, 22 nt, Human
caaagccaggcuuucuaaugua

SEQ ID NO: 426199 - RNA, 22 nt, Human
uccugcagccaagggucaucga

SEQ ID NO: 426200 - RNA, 22 nt, Human
gcugucuccauagcuguguguc

SEQ ID NO: 426201 - RNA, 22 nt, Human
aggagucacucagggcuucauc

SEQ ID NO: 426202 - RNA, 22 nt, Human
agcuggguggagggcccacggu

SEQ ID NO: 426203 - RNA, 22 nt, Human
uagaaacacagaucugguguca

SEQ ID NO: 426204 - RNA, 22 nt, Human
gcucucuguuauuaagaucuuu

SEQ ID NO: 426205 - RNA, 22 nt, Human
gcagcuuucugcaaugucaucc

SEQ ID NO: 426206 - RNA, 22 nt, Human
agggccuggcuucacuuucuca

SEQ ID NO: 426207 - RNA, 22 nt, Human
gcugcagcuguaggacacaauu

SEQ ID NO: 426208 - RNA, 22 nt, Human
aggugcagcaugaguccaacgg

SEQ ID NO: 426209 - RNA, 22 nt, Human
gcaagcaguuguggcuucugag

SEQ ID NO: 426210 - RNA, 22 nt, Human
aaaaugaacagaacaaugggga

SEQ ID NO: 426211 - RNA, 22 nt, Human
auuucacaucuaucucagauuu

SEQ ID NO: 426212 - RNA, 22 nt, Human
agagcuguuuggacaucugagu

SEQ ID NO: 426213 - RNA, 22 nt, Human
gucaaacaaauuaacauaucca

SEQ ID NO: 426214 - RNA, 17 nt, Human
uuugaaaggaugucagu

SEQ ID NO: 426215 - RNA, 22 nt, Human
cagggcagaacauauagauagu

SEQ ID NO: 426216 - RNA, 22 nt, Human
gacccagaaggagugcccuaga

SEQ ID NO: 426217 - RNA, 22 nt, Human
gaggcccaguccugcaagcacg

SEQ ID NO: 426218 - RNA, 22 nt, Human
aagggaggccagagguuuugca

SEQ ID NO: 426219 - RNA, 22 nt, Human
gaaaucugucuuuguuugaaua

SEQ ID NO: 426220 - RNA, 22 nt, Human
cagguggggcagcugugggagc

SEQ ID NO: 426221 - RNA, 22 nt, Human
uagaaauguuagauguauugag

SEQ ID NO: 426222 - RNA, 22 nt, Human
gaucauuugcaggaaacauuaa

SEQ ID NO: 426223 - RNA, 20 nt, Human
cagaggcaaggagacuugga

SEQ ID NO: 426224 - RNA, 21 nt, Human
cauuucuauugaugagaaaag

SEQ ID NO: 426225 - RNA, 22 nt, Human
auguguagaacuguaaugccca

SEQ ID NO: 426226 - RNA, 22 nt, Human
cuggagccccaggcugugcaga

SEQ ID NO: 426227 - RNA, 22 nt, Human
cacccagccuucacacaggagu

SEQ ID NO: 426228 - RNA, 22 nt, Human
aaaaguguccagauuaugaaga

SEQ ID NO: 426229 - RNA, 20 nt, Human
ccuggcugcauucaggacgg

SEQ ID NO: 426230 - RNA, 22 nt, Human
uaaggcaccauaauauauuuaa

SEQ ID NO: 426231 - RNA, 22 nt, Human
ucucuuccaguaagagucuuua

SEQ ID NO: 426232 - RNA, 22 nt, Human
gccaggcauuauuccgaucccu

SEQ ID NO: 426233 - RNA, 22 nt, Human
cuggugcaggaaggagcuggca

SEQ ID NO: 426234 - RNA, 22 nt, Human
uccuuucccuuuccauccuggc

SEQ ID NO: 426235 - RNA, 22 nt, Human
gaaaggucaguuccacuuccau

SEQ ID NO: 426236 - RNA, 22 nt, Human
ggguccagaguugaagagguua

SEQ ID NO: 426237 - RNA, 22 nt, Human
uggcaccugaacuuagaggugu

SEQ ID NO: 426238 - RNA, 22 nt, Human
ccagggcuccauugcucauccu

SEQ ID NO: 426239 - RNA, 22 nt, Human
ccagugcccagcugcccaggca

SEQ ID NO: 426240 - RNA, 22 nt, Human
cccaggccccagggcuugucag

SEQ ID NO: 426241 - RNA, 22 nt, Human
agggugcauguuugcaagagug

SEQ ID NO: 426242 - RNA, 22 nt, Human
acaaagucuuuuacaacaguca

SEQ ID NO: 426243 - RNA, 21 nt, Human
aucaccagcagaagcugcaga

SEQ ID NO: 426244 - RNA, 22 nt, Human
ggcuuccuggggccuccugcaa

SEQ ID NO: 426245 - RNA, 22 nt, Human
ucucugagacaguagccucugc

SEQ ID NO: 426246 - RNA, 22 nt, Human
guauuaggaggaacacaggccu

SEQ ID NO: 426247 - RNA, 19 nt, Human
gacucacaccuuccgcugu

SEQ ID NO: 426248 - RNA, 22 nt, Human
cuccucacuuuccagacugggc

SEQ ID NO: 426249 - RNA, 22 nt, Human
ggaaggaggaugcucuggccuu

SEQ ID NO: 426250 - RNA, 22 nt, Human
gacagggcgcccagccuguuuc

SEQ ID NO: 426251 - RNA, 22 nt, Human
auauguguacgugcaguauaua

SEQ ID NO: 426252 - RNA, 22 nt, Human
cacagcugaaguagccaugugg

SEQ ID NO: 426253 - RNA, 22 nt, Human
ucagccugcuccaagugcugcc

SEQ ID NO: 426254 - RNA, 22 nt, Human
uggcugagaccuucccaaauuc

SEQ ID NO: 426255 - RNA, 22 nt, Human
cauuuguagcuauuuacuguau

SEQ ID NO: 426256 - RNA, 22 nt, Human
uggcaagagggaugcaagguuu

SEQ ID NO: 426257 - RNA, 22 nt, Human
agaaaaaucuuggcgcuugucu

SEQ ID NO: 426258 - RNA, 22 nt, Human
ucuggauggucagcucuuccug

SEQ ID NO: 426259 - RNA, 22 nt, Human
gcagagccaugggagguuuuug

SEQ ID NO: 426260 - RNA, 22 nt, Human
uggcacauagcagguacucagu

SEQ ID NO: 426261 - RNA, 22 nt, Human
aagccaggggcugcuuaggaga

SEQ ID NO: 426262 - RNA, 22 nt, Human
gcucugugccacaugcaguguu

SEQ ID NO: 426263 - RNA, 18 nt, Human
aaaaugcaggcgacaugg

SEQ ID NO: 426264 - RNA, 18 nt, Human
ggaaaaggagugucuagc

SEQ ID NO: 426265 - RNA, 22 nt, Human
uagggcaggggaggaaucugaa

SEQ ID NO: 426266 - RNA, 22 nt, Human
ggagugucagaaacaguguccu

SEQ ID NO: 426267 - RNA, 22 nt, Human
aaucuguucuacucuauucaga

SEQ ID NO: 426268 - RNA, 22 nt, Human
cuggccucauagccaagcugug

SEQ ID NO: 426269 - RNA, 22 nt, Human
ugggaauggaugcuaagugcua

SEQ ID NO: 426270 - RNA, 22 nt, Human
accugccuauggagccacaugg

SEQ ID NO: 426271 - RNA, 22 nt, Human
aauguacaaaagucagccaacu

SEQ ID NO: 426272 - RNA, 22 nt, Human
gggcugacaaccaucugacaag

SEQ ID NO: 426273 - RNA, 22 nt, Human
aagggcucugcugucucucccc

SEQ ID NO: 426274 - RNA, 20 nt, Human
uggagcuguaaucuugucug

SEQ ID NO: 426275 - RNA, 22 nt, Human
cuucccagaccuuagagugcag

SEQ ID NO: 426276 - RNA, 22 nt, Human
aaugucugccugaacuuuauau

SEQ ID NO: 426277 - RNA, 18 nt, Human
ucugucucuguccuugcu

SEQ ID NO: 426278 - RNA, 22 nt, Human
aggaccagccuccaggucucuu

SEQ ID NO: 426279 - RNA, 22 nt, Human
gccaggcuguuuuuauuacugu

SEQ ID NO: 426280 - RNA, 22 nt, Human
ggccuugggaggagggucagaa

SEQ ID NO: 426281 - RNA, 22 nt, Human
agagcugccgagcuggggccau

SEQ ID NO: 426282 - RNA, 22 nt, Human
aaggccaacuaggaugagcuag

SEQ ID NO: 426283 - RNA, 22 nt, Human
ugcugggggcuuucuggauacc

SEQ ID NO: 426284 - RNA, 22 nt, Human
gcagcuggacccacacggcuua

SEQ ID NO: 426285 - RNA, 22 nt, Human
acuguacacagugguguacugu

SEQ ID NO: 426286 - RNA, 22 nt, Human
uggggguguccuggugcacaca

SEQ ID NO: 426287 - RNA, 22 nt, Human
gugccucagcaccgccugcagc

SEQ ID NO: 426288 - RNA, 22 nt, Human
gagggcaguagccucguacccu

SEQ ID NO: 426289 - RNA, 22 nt, Human
ugaguagcggcuauguguaacu

SEQ ID NO: 426290 - RNA, 22 nt, Human
ucacauuuuaucugagauugac

SEQ ID NO: 426291 - RNA, 22 nt, Human
gcugucagugaggugagacaug

SEQ ID NO: 426292 - RNA, 22 nt, Human
ggagcugugcugggugaucagg

SEQ ID NO: 426293 - RNA, 22 nt, Human
agggccagcccauaaugccaaa

SEQ ID NO: 426294 - RNA, 22 nt, Human
gccugcagccucaagggcugag

SEQ ID NO: 426295 - RNA, 22 nt, Human
acaaaguccugguguauggcca

SEQ ID NO: 426296 - RNA, 22 nt, Human
guccucugcccaggucaagguu

SEQ ID NO: 426297 - RNA, 22 nt, Human
uugaagcagcucaggaggcuua

SEQ ID NO: 426298 - RNA, 20 nt, Human
cugugcuuuggaaccuggaa

SEQ ID NO: 426299 - RNA, 22 nt, Human
agacuuugagcucuuagagaag

SEQ ID NO: 426300 - RNA, 21 nt, Human
agaaaaguagaguuuucagag

SEQ ID NO: 426301 - RNA, 22 nt, Human
agccacagcuccuugguggaga

SEQ ID NO: 426302 - RNA, 22 nt, Human
uaaagguagugugacauauugu

SEQ ID NO: 426303 - RNA, 22 nt, Human
gcuggcucuucaguggagauag

SEQ ID NO: 426304 - RNA, 22 nt, Human
gggcugaggaacauauuuuguu

SEQ ID NO: 426305 - RNA, 23 nt, Human
cuuucauugugguuucacagagc

SEQ ID NO: 426306 - RNA, 22 nt, Human
ccugggcaacauagugagaccc

SEQ ID NO: 426307 - RNA, 22 nt, Human
gagccugccucuagucucuaga

SEQ ID NO: 426308 - RNA, 22 nt, Human
ggcauguuucaucacaucaaga

SEQ ID NO: 426309 - RNA, 22 nt, Human
ccugucuguaucgguucagagu

SEQ ID NO: 426310 - RNA, 22 nt, Human
ucaaaggcaccaaggucacugc

SEQ ID NO: 426311 - RNA, 22 nt, Human
ggcugccugcuccuccugcacg

SEQ ID NO: 426312 - RNA, 22 nt, Human
auucucugaagucaauggaaau

SEQ ID NO: 426313 - RNA, 22 nt, Human
cuuguaauuauaauguacuguu

SEQ ID NO: 426314 - RNA, 22 nt, Human
cagcaggcucugaguggcugcc

SEQ ID NO: 426315 - RNA, 22 nt, Human
gcagcuggugcaaaugucacuc

SEQ ID NO: 426316 - RNA, 22 nt, Human
uucaagauggcaccagugagug

SEQ ID NO: 426317 - RNA, 22 nt, Human
agcagccagaaauccagaggug

SEQ ID NO: 426318 - RNA, 22 nt, Human
ugagggaguuggguguauagga

SEQ ID NO: 426319 - RNA, 22 nt, Human
uugcagagagguuaggaacuca

SEQ ID NO: 426320 - RNA, 22 nt, Human
ccaguggaauuaaaaauaagug

SEQ ID NO: 426321 - RNA, 22 nt, Human
ucugccuuggcaaccacagcuu

SEQ ID NO: 426322 - RNA, 23 nt, Human
gggagccaggaccucgcgcccca

SEQ ID NO: 426323 - RNA, 22 nt, Human
uuuauugcauacacaaauguca

SEQ ID NO: 426324 - RNA, 22 nt, Human
aggaccauccuaagguaggcaa

SEQ ID NO: 426325 - RNA, 22 nt, Human
gagcacaggcuuugguggacac

SEQ ID NO: 426326 - RNA, 22 nt, Human
gggugggccugucuggccaugu

SEQ ID NO: 426327 - RNA, 22 nt, Human
auuuccaaaaccacuuauugcc

SEQ ID NO: 426328 - RNA, 22 nt, Human
cuugaaagaagggucuuuuaau

SEQ ID NO: 426329 - RNA, 22 nt, Human
acuucucuucauagguggcaau

SEQ ID NO: 426330 - RNA, 22 nt, Human
uggccagguguggguucucaga

SEQ ID NO: 426331 - RNA, 22 nt, Human
gauuuccucacuaacauccauc

SEQ ID NO: 426332 - RNA, 22 nt, Human
ugacucuguaccugucugccuu

SEQ ID NO: 426333 - RNA, 22 nt, Human
gaagcagcuuucuggugaggag

SEQ ID NO: 426334 - RNA, 22 nt, Human
gguucacacuuucaugauuuca

SEQ ID NO: 426335 - RNA, 22 nt, Human
gaggucaauaauaugugcuuua

SEQ ID NO: 426336 - RNA, 22 nt, Human
aggcacugacagauucuguguc

SEQ ID NO: 426337 - RNA, 22 nt, Human
ucucugagcccagugucccccu

SEQ ID NO: 426338 - RNA, 19 nt, Human
cagcugccuuuucuuugca

SEQ ID NO: 426339 - RNA, 22 nt, Human
aagagcugugggugguaguccu

SEQ ID NO: 426340 - RNA, 22 nt, Human
ugaggcucuccaagcagaugag

SEQ ID NO: 426341 - RNA, 22 nt, Human
agaggccuccgaaaggugggcu

SEQ ID NO: 426342 - RNA, 22 nt, Human
gaugauggacaaagcauuggug

SEQ ID NO: 426343 - RNA, 22 nt, Human
ugcucuggguccugggccuccu

SEQ ID NO: 426344 - RNA, 22 nt, Human
aagugaguggccuggagaggug

SEQ ID NO: 426345 - RNA, 22 nt, Human
agcuggaggggccagcaggugu

SEQ ID NO: 426346 - RNA, 22 nt, Human
ggugggcaggucacucugccuc

SEQ ID NO: 426347 - RNA, 22 nt, Human
uaguuaggguucugcagagaca

SEQ ID NO: 426348 - RNA, 22 nt, Human
uguacaguguagucaugagguu

SEQ ID NO: 426349 - RNA, 22 nt, Human
cauaacuagagugaaauguuga

SEQ ID NO: 426350 - RNA, 22 nt, Human
agacuguacuuucugcagcucu

SEQ ID NO: 426351 - RNA, 22 nt, Human
cagcccuggcuagggcgagggc

SEQ ID NO: 426352 - RNA, 22 nt, Human
gcugaaggcccggaggacaggg

SEQ ID NO: 426353 - RNA, 22 nt, Human
uauuagggaacugcaagacuaa

SEQ ID NO: 426354 - RNA, 22 nt, Human
uucuuucagaacacaagugauu

SEQ ID NO: 426355 - RNA, 22 nt, Human
uuucuaguucucugccaaaaaa

SEQ ID NO: 426356 - RNA, 22 nt, Human
uuagagaaauucugguaaugua

SEQ ID NO: 426357 - RNA, 22 nt, Human
guggcagcugguaugcagacag

SEQ ID NO: 426358 - RNA, 19 nt, Human
agcuccugggcucugggcc

SEQ ID NO: 426359 - RNA, 22 nt, Human
uuaaauuagucaagcuucucug

SEQ ID NO: 426360 - RNA, 22 nt, Human
gccagagccggcuucacaggau

SEQ ID NO: 426361 - RNA, 21 nt, Human
agcuuccugcagugggagguc

SEQ ID NO: 426362 - RNA, 17 nt, Human
gagugcugguggagcuc

SEQ ID NO: 426363 - RNA, 18 nt, Human
cccacggugcuguagggc

SEQ ID NO: 426364 - RNA, 22 nt, Human
aaaaugugaucuacaaaugcaa

SEQ ID NO: 426365 - RNA, 22 nt, Human
cagauccacccuuguagugaca

SEQ ID NO: 426366 - RNA, 22 nt, Human
auguauguuaguguauuaucua

SEQ ID NO: 426367 - RNA, 22 nt, Human
gauuuccuugcauauugguaau

SEQ ID NO: 426368 - RNA, 22 nt, Human
gaaggcugcgaggggagugccg

SEQ ID NO: 426369 - RNA, 22 nt, Human
cagagccucagaauccugugga

SEQ ID NO: 426370 - RNA, 22 nt, Human
aucaaaguuucccagaaguugu

SEQ ID NO: 426371 - RNA, 23 nt, Human
agcagccagagauccucggcccu

SEQ ID NO: 426372 - RNA, 22 nt, Human
uagcuuuagaaauauucucaga

SEQ ID NO: 426373 - RNA, 22 nt, Human
gguggcagcgucuaucugacau

SEQ ID NO: 426374 - RNA, 22 nt, Human
uuggaaagcaagcuggacauac

SEQ ID NO: 426375 - RNA, 22 nt, Human
uggagccagcccaggccccucu

SEQ ID NO: 426376 - RNA, 22 nt, Human
gauuucuguaacacuucagaua

SEQ ID NO: 426377 - RNA, 22 nt, Human
gcugucugcaucucuagagcuu

SEQ ID NO: 426378 - RNA, 22 nt, Human
ccugagugcuuccagagucaug

SEQ ID NO: 426379 - RNA, 22 nt, Human
ugaggccugcccuggggaaguu

SEQ ID NO: 426380 - RNA, 22 nt, Human
ugcagugguguccagguguacu

SEQ ID NO: 426381 - RNA, 22 nt, Human
aucuggcugacuuugugggaca

SEQ ID NO: 426382 - RNA, 18 nt, Human
gagcugccauauuuaguu

SEQ ID NO: 426383 - RNA, 22 nt, Human
ucagcuuuuaaaaacaagaagu

SEQ ID NO: 426384 - RNA, 22 nt, Human
acacagccgugaaucugcuucu

SEQ ID NO: 426385 - RNA, 23 nt, Human
uggcugagauccuacuguuugcu

SEQ ID NO: 426386 - RNA, 22 nt, Human
uucuaguuaaaguauguauuag

SEQ ID NO: 426387 - RNA, 22 nt, Human
ggcuggaaguccaagaucaaga

SEQ ID NO: 426388 - RNA, 22 nt, Human
cucaggaggaugacugccuugg

SEQ ID NO: 426389 - RNA, 22 nt, Human
uuuagaguugaguauucauugg

SEQ ID NO: 426390 - RNA, 22 nt, Human
gucuugaucuccugaccuugug

SEQ ID NO: 426391 - RNA, 22 nt, Human
aguaaaauuucugcugaggaga

SEQ ID NO: 426392 - RNA, 22 nt, Human
aguggcagagcaggugcuggaa

SEQ ID NO: 426393 - RNA, 22 nt, Human
agcagugagugggaggaccaug

SEQ ID NO: 426394 - RNA, 22 nt, Human
gcagguggcagaggugggaucu

SEQ ID NO: 426395 - RNA, 22 nt, Human
cucuccaggacuuuggcccaau

SEQ ID NO: 426396 - RNA, 22 nt, Human
aggaagcucggagagggcaaau

SEQ ID NO: 426397 - RNA, 22 nt, Human
ugagguaggugguaagagauac

SEQ ID NO: 426398 - RNA, 22 nt, Human
cucuuaaauaacaucauugcuu

SEQ ID NO: 426399 - RNA, 19 nt, Human
ucaaggcucccugagggau

SEQ ID NO: 426400 - RNA, 22 nt, Human
auucuccaucaccacuggcacu

SEQ ID NO: 426401 - RNA, 22 nt, Human
ccugccugcaccuucucugggg

SEQ ID NO: 426402 - RNA, 22 nt, Human
cccaguuguugccggcucugga

SEQ ID NO: 426403 - RNA, 19 nt, Human
agacacacuugauaugugu

SEQ ID NO: 426404 - RNA, 22 nt, Human
cagaaguggccucagagggagu

SEQ ID NO: 426405 - RNA, 21 nt, Human
ucaggcagugcaaauacaugg

SEQ ID NO: 426406 - RNA, 22 nt, Human
ccagccagcugcccuuggggcc

SEQ ID NO: 426407 - RNA, 22 nt, Human
ggcucaggcuggagugcagugg

SEQ ID NO: 426408 - RNA, 22 nt, Human
ucgccagggaugcuguaaggaa

SEQ ID NO: 426409 - RNA, 20 nt, Human
ggccugagcauggcuggcag

SEQ ID NO: 426410 - RNA, 22 nt, Human
cugccacuuucacccagugcuc

SEQ ID NO: 426411 - RNA, 22 nt, Human
ccugucugaggaggugcucuuu

SEQ ID NO: 426412 - RNA, 22 nt, Human
cuggggugagcagaaacagggg

SEQ ID NO: 426413 - RNA, 22 nt, Human
uccucccacauaggacaauggg

SEQ ID NO: 426414 - RNA, 22 nt, Human
gcagugggcaacaagagcugga

SEQ ID NO: 426415 - RNA, 22 nt, Human
ucaggcagcauuaaacuucagc

SEQ ID NO: 426416 - RNA, 19 nt, Human
gcagccaggugcucuaccu

SEQ ID NO: 426417 - RNA, 22 nt, Human
cucuggccagagccugcgggaa

SEQ ID NO: 426418 - RNA, 22 nt, Human
aggcagagagcaguggccgucu

SEQ ID NO: 426419 - RNA, 22 nt, Human
agggagcuguggucagcucagu

SEQ ID NO: 426420 - RNA, 19 nt, Human
agaaaucucgagauuuguu

SEQ ID NO: 426421 - RNA, 22 nt, Human
acauuuguaugcguuuuuacug

SEQ ID NO: 426422 - RNA, 20 nt, Human
agaaggcuccuuuugccaag

SEQ ID NO: 426423 - RNA, 22 nt, Human
cuggagcucuguguguuccuga

SEQ ID NO: 426424 - RNA, 22 nt, Human
uaagaacaguagaacaguaggu

SEQ ID NO: 426425 - RNA, 22 nt, Human
gaaagccaucuggcugcuggga

SEQ ID NO: 426426 - RNA, 19 nt, Human
cucuuaaauugucucuugc

SEQ ID NO: 426427 - RNA, 22 nt, Human
ugcuuuggccacuagaauucag

SEQ ID NO: 426428 - RNA, 22 nt, Human
ccucucuguguggccucuccau

SEQ ID NO: 426429 - RNA, 22 nt, Human
guaacaaaguuucuaggugcug

SEQ ID NO: 426430 - RNA, 22 nt, Human
cucagggcaguauggcugagag

SEQ ID NO: 426431 - RNA, 22 nt, Human
agggucagguuaagggagucau

SEQ ID NO: 426432 - RNA, 22 nt, Human
ugagagugauugguucgaaugu

SEQ ID NO: 426433 - RNA, 19 nt, Human
gcauaaaaugucaaugugu

SEQ ID NO: 426434 - RNA, 22 nt, Human
uuuacuuugugucaagucaaga

SEQ ID NO: 426435 - RNA, 22 nt, Human
ugcaggaauuuuuugcagaaag

SEQ ID NO: 426436 - RNA, 22 nt, Human
aucccugcccucauggagcuua

SEQ ID NO: 426437 - RNA, 22 nt, Human
uccuggagagugggcgagcaca

SEQ ID NO: 426438 - RNA, 22 nt, Human
gauuuucauuauagcuaguuuc

SEQ ID NO: 426439 - RNA, 22 nt, Human
aguucuagaagacuuuuccauu

SEQ ID NO: 426440 - RNA, 22 nt, Human
cugggcagugguggcaucuuug

SEQ ID NO: 426441 - RNA, 22 nt, Human
ugugccauuucuauucugcagc

SEQ ID NO: 426442 - RNA, 22 nt, Human
ugagcccaggaguaugaggcug

SEQ ID NO: 426443 - RNA, 22 nt, Human
cagaaauguuuauauguggugu

SEQ ID NO: 426444 - RNA, 22 nt, Human
uaaaugugcacagguuagaagg

SEQ ID NO: 426445 - RNA, 19 nt, Human
acacagggaucagaggguu

SEQ ID NO: 426446 - RNA, 22 nt, Human
uuacaguaugaucaacuuuuca

SEQ ID NO: 426447 - RNA, 22 nt, Human
agccucuggcccuagacugcuu

SEQ ID NO: 426448 - RNA, 22 nt, Human
ggcaguggugggaggcucgcuc

SEQ ID NO: 426449 - RNA, 22 nt, Human
cccaagggagugccuggucaac

SEQ ID NO: 426450 - RNA, 22 nt, Human
agggaguuccgaucugugcacc

SEQ ID NO: 426451 - RNA, 22 nt, Human
caggcacuagcagaaugaggcu

SEQ ID NO: 426452 - RNA, 22 nt, Human
auugacaaauggauguugacau

SEQ ID NO: 426453 - RNA, 22 nt, Human
cacagaaguuucauagucucga

SEQ ID NO: 426454 - RNA, 20 nt, Human
cuguggcaucugucauggug

SEQ ID NO: 426455 - RNA, 22 nt, Human
gcagaggagcaaguugcuacag

SEQ ID NO: 426456 - RNA, 22 nt, Human
aagauuuccuucaguagagcua

SEQ ID NO: 426457 - RNA, 22 nt, Human
uuuuauucucaagacaauggga

SEQ ID NO: 426458 - RNA, 22 nt, Human
ucagggcagccuaaggcaccuc

SEQ ID NO: 426459 - RNA, 22 nt, Human
ggccucucuggcauggcugccc

SEQ ID NO: 426460 - RNA, 22 nt, Human
uggagcugggaguccugggcug

SEQ ID NO: 426461 - RNA, 22 nt, Human
uggcacugggacagaugcucuc

SEQ ID NO: 426462 - RNA, 22 nt, Human
cugcucugagaggcucuuccua

SEQ ID NO: 426463 - RNA, 17 nt, Human
agggucaggugaaguuc

SEQ ID NO: 426464 - RNA, 22 nt, Human
agcugggagcagagccacagcc

SEQ ID NO: 426465 - RNA, 22 nt, Human
gcaaagcugggugugaaugcac

SEQ ID NO: 426466 - RNA, 20 nt, Human
cugcugugauucccuccucc

SEQ ID NO: 426467 - RNA, 22 nt, Human
cuccagggaugagacagaguag

SEQ ID NO: 426468 - RNA, 22 nt, Human
cauuucauaguugucacaauaa

SEQ ID NO: 426469 - RNA, 22 nt, Human
aggaauucaagaccagcugggc

SEQ ID NO: 426470 - RNA, 22 nt, Human
ugcuuuuaagaacaaugcugcu

SEQ ID NO: 426471 - RNA, 22 nt, Human
gguacaaggagugaagguuugg

SEQ ID NO: 426472 - RNA, 22 nt, Human
gggugggaacaggaugccagga

SEQ ID NO: 426473 - RNA, 22 nt, Human
uggcagaguuauggguauuuau

SEQ ID NO: 426474 - RNA, 22 nt, Human
ucacaugcccuguauuuaccag

SEQ ID NO: 426475 - RNA, 20 nt, Human
gcccaagguccagaaggggg

SEQ ID NO: 426476 - RNA, 22 nt, Human
augugguugaagaauuacaucu

SEQ ID NO: 426477 - RNA, 22 nt, Human
agagaauuuuaaaagccuugaa

SEQ ID NO: 426478 - RNA, 22 nt, Human
gaguguuccagaaacuggcccu

SEQ ID NO: 426479 - RNA, 22 nt, Human
cuggccuuggugcuugcagaca

SEQ ID NO: 426480 - RNA, 22 nt, Human
acaggcugcugagccauuugcu

SEQ ID NO: 426481 - RNA, 22 nt, Human
auaaagaggauguauuuacagc

SEQ ID NO: 426482 - RNA, 22 nt, Human
ucagaacauugacauucuuauu

SEQ ID NO: 426483 - RNA, 22 nt, Human
uagcugccagaccauucuuacu

SEQ ID NO: 426484 - RNA, 17 nt, Human
ugaaggccaugaccacg

SEQ ID NO: 426485 - RNA, 22 nt, Human
ugaguccaucgcagggaagugg

SEQ ID NO: 426486 - RNA, 22 nt, Human
gagcaggccagcaauggaaggg

SEQ ID NO: 426487 - RNA, 23 nt, Human
gguggcaggaguggaugcugagc

SEQ ID NO: 426488 - RNA, 22 nt, Human
uguuuuauuucuccaagaggga

SEQ ID NO: 426489 - RNA, 17 nt, Human
ccagagaguaguuagga

SEQ ID NO: 426490 - RNA, 22 nt, Human
aaggcugagagucacaguccua

SEQ ID NO: 426491 - RNA, 22 nt, Human
aucagugcuaaagcaaaugccc

SEQ ID NO: 426492 - RNA, 19 nt, Human
gguaaaagugagcuucagg

SEQ ID NO: 426493 - RNA, 22 nt, Human
aaagaacaaaugauauaugguu

SEQ ID NO: 426494 - RNA, 22 nt, Human
gcugcucuacccaugcaucugu

SEQ ID NO: 426495 - RNA, 22 nt, Human
aggaggggcauagaaauguaau

SEQ ID NO: 426496 - RNA, 22 nt, Human
gccucccuguucuuccacaaua

SEQ ID NO: 426497 - RNA, 22 nt, Human
acagaauauugguuacuguugc

SEQ ID NO: 426498 - RNA, 22 nt, Human
uugaagcacaaugucuuuuauc

SEQ ID NO: 426499 - RNA, 22 nt, Human
gagcuuccauggacgccaucug

SEQ ID NO: 426500 - RNA, 22 nt, Human
ugaggcucaagaauagacagua

SEQ ID NO: 426501 - RNA, 22 nt, Human
agcagggcuuugcagacuuggg

SEQ ID NO: 426502 - RNA, 22 nt, Human
aaaucaguuaagaugaggccau

SEQ ID NO: 426503 - RNA, 22 nt, Human
ggugaaggcacaagagggcaag

SEQ ID NO: 426504 - RNA, 22 nt, Human
ucagaggacuaccuucuccagu

SEQ ID NO: 426505 - RNA, 22 nt, Human
ugcucuggggagcuccucugcg

SEQ ID NO: 426506 - RNA, 22 nt, Human
gggcugacucaaccuugcaaag

SEQ ID NO: 426507 - RNA, 15 nt, Human
uccaggcauucauuc

SEQ ID NO: 426508 - RNA, 22 nt, Human
aaggcccuggccccagcuucuu

SEQ ID NO: 426509 - RNA, 22 nt, Human
ugccaggcuccggaacgacagu

SEQ ID NO: 426510 - RNA, 22 nt, Human
aguuuagaguucaaauuaguuc

SEQ ID NO: 426511 - RNA, 22 nt, Human
caucagcacuaugauuaaagua

SEQ ID NO: 426512 - RNA, 22 nt, Human
uuugaaagggaaauaaacuccu

SEQ ID NO: 426513 - RNA, 22 nt, Human
gagagucacugucugcauuucc

SEQ ID NO: 426514 - RNA, 22 nt, Human
cccagagcugagucugauauau

SEQ ID NO: 426515 - RNA, 22 nt, Human
aggccagaaauuuggaguaugu

SEQ ID NO: 426516 - RNA, 22 nt, Human
uagggcuauaagagaauaagac

SEQ ID NO: 426517 - RNA, 22 nt, Human
aguggcagccgagcaggagaug

SEQ ID NO: 426518 - RNA, 22 nt, Human
caggauccccaggucgccgucc

SEQ ID NO: 426519 - RNA, 22 nt, Human
ugggccacggggguggagagcu

SEQ ID NO: 426520 - RNA, 22 nt, Human
cacuguguaagaagaugggcuu

SEQ ID NO: 426521 - RNA, 22 nt, Human
ucuggcccagccccugagguca

SEQ ID NO: 426522 - RNA, 22 nt, Human
guccugucccccaaggcugugg

SEQ ID NO: 426523 - RNA, 22 nt, Human
uucuggaggccccuuccuucuc

SEQ ID NO: 426524 - RNA, 22 nt, Human
cacaaaaucuuucucgauuauu

SEQ ID NO: 426525 - RNA, 22 nt, Human
cugggagauugcuagagaugca

SEQ ID NO: 426526 - RNA, 22 nt, Human
cugugcuucgcaacuccaaggu

SEQ ID NO: 426527 - RNA, 22 nt, Human
acugccauuggucaaaugagug

SEQ ID NO: 426528 - RNA, 22 nt, Human
ggagcugcuccuucagccaagu

SEQ ID NO: 426529 - RNA, 22 nt, Human
gggaguguugagcgcccugcca

SEQ ID NO: 426530 - RNA, 22 nt, Human
uuccaguuaaggaagcuauucu

SEQ ID NO: 426531 - RNA, 22 nt, Human
uggcagcagggaggccaguguu

SEQ ID NO: 426532 - RNA, 22 nt, Human
gaggaaccaaucugugauauuc

SEQ ID NO: 426533 - RNA, 22 nt, Human
uaaaaguuuuaguuguacauaa

SEQ ID NO: 426534 - RNA, 22 nt, Human
acagagaaagugggcugaagau

SEQ ID NO: 426535 - RNA, 20 nt, Human
ugugcccaauguccagguuc

SEQ ID NO: 426536 - RNA, 22 nt, Human
aggccaggcaacauucugaagu

SEQ ID NO: 426537 - RNA, 22 nt, Human
guccucuggccuuucccaggac

SEQ ID NO: 426538 - RNA, 22 nt, Human
cugaaggaagcagguggccugu

SEQ ID NO: 426539 - RNA, 22 nt, Human
uuaaauuuuagaaacagacucu

SEQ ID NO: 426540 - RNA, 22 nt, Human
uggagccugagucagcggaggc

SEQ ID NO: 426541 - RNA, 22 nt, Human
uuuauucugugcuacaugaaga

SEQ ID NO: 426542 - RNA, 22 nt, Human
gagcuuuagcugagaccugcuu

SEQ ID NO: 426543 - RNA, 22 nt, Human
gagccagggcugugagcugagc

SEQ ID NO: 426544 - RNA, 22 nt, Human
cagucccaccaggaucgcucuu

SEQ ID NO: 426545 - RNA, 22 nt, Human
aaugauuggcacuagauacaca

SEQ ID NO: 426546 - RNA, 22 nt, Human
uuagccauuaauguccugugca

SEQ ID NO: 426547 - RNA, 22 nt, Human
agcuuuauauaaaagaguacau

SEQ ID NO: 426548 - RNA, 22 nt, Human
ggagauggcucugcaaggucua

SEQ ID NO: 426549 - RNA, 22 nt, Human
cuccugggaauuuaguugugag

SEQ ID NO: 426550 - RNA, 22 nt, Human
uuagaaacccagacucuuaggu

SEQ ID NO: 426551 - RNA, 22 nt, Human
agccuggccacucagggccuga

SEQ ID NO: 426552 - RNA, 22 nt, Human
ccuuuauucaauuaguccuaau

SEQ ID NO: 426553 - RNA, 22 nt, Human
uaugacaagguggaguaugagu

SEQ ID NO: 426554 - RNA, 22 nt, Human
ugccugucuuaauaucuggaaa

SEQ ID NO: 426555 - RNA, 22 nt, Human
uccgccaggacugagggcccau

SEQ ID NO: 426556 - RNA, 22 nt, Human
cagagccaggguugcaccccug

SEQ ID NO: 426557 - RNA, 22 nt, Human
gcccccucuuuggagccagcca

SEQ ID NO: 426558 - RNA, 22 nt, Human
gagagaagaauguuccgaggcc

SEQ ID NO: 426559 - RNA, 22 nt, Human
gcagcugaaagggaucucuaca

SEQ ID NO: 426560 - RNA, 22 nt, Human
acagagccuccaggagugcugg

SEQ ID NO: 426561 - RNA, 22 nt, Human
uucagucagugacuaagcaguu

SEQ ID NO: 426562 - RNA, 22 nt, Human
agggagguccaucccugcagag

SEQ ID NO: 426563 - RNA, 22 nt, Human
gcagggucuugagaggcagcca

SEQ ID NO: 426564 - RNA, 16 nt, Human
ugggaccuguggccaa

SEQ ID NO: 426565 - RNA, 22 nt, Human
augauacaucuucaugucagug

SEQ ID NO: 426566 - RNA, 22 nt, Human
gcugccucaggcaccuccuggc

SEQ ID NO: 426567 - RNA, 22 nt, Human
ucugucacuauuggccagaaca

SEQ ID NO: 426568 - RNA, 22 nt, Human
ugcuuuauguuaucagaagggu

SEQ ID NO: 426569 - RNA, 22 nt, Human
augggagugacagggccacugg

SEQ ID NO: 426570 - RNA, 22 nt, Human
aaaucaguaaauguucauuaac

SEQ ID NO: 426571 - RNA, 22 nt, Human
uaaaugugucuauggacccgcc

SEQ ID NO: 426572 - RNA, 19 nt, Human
gcugcucugggucucaucu

SEQ ID NO: 426573 - RNA, 22 nt, Human
caguggaauauauaggggauuu

SEQ ID NO: 426574 - RNA, 22 nt, Human
aaggugucaccagauuggcagg

SEQ ID NO: 426575 - RNA, 22 nt, Human
uggugcugauaauggcaggauu

SEQ ID NO: 426576 - RNA, 22 nt, Human
ucugcagaauucgaggaagaaa

SEQ ID NO: 426577 - RNA, 22 nt, Human
ggcagggcagcgcugauuaggg

SEQ ID NO: 426578 - RNA, 22 nt, Human
gauuucaaggauguuagaggug

SEQ ID NO: 426579 - RNA, 17 nt, Human
agguggguggaucaccu

SEQ ID NO: 426580 - RNA, 22 nt, Human
cagagccuuccuagcagacucu

SEQ ID NO: 426581 - RNA, 22 nt, Human
agggccagaaucccucagucua

SEQ ID NO: 426582 - RNA, 22 nt, Human
agccuggaccaggggccucaga

SEQ ID NO: 426583 - RNA, 22 nt, Human
ggcuuuauuuugcaugaaugcu

SEQ ID NO: 426584 - RNA, 21 nt, Human
aggugcaggccucaagcccca

SEQ ID NO: 426585 - RNA, 17 nt, Human
cugcuuugugcaacgcu

SEQ ID NO: 426586 - RNA, 22 nt, Human
gaaaguuucuucauuaagaugu

SEQ ID NO: 426587 - RNA, 22 nt, Human
aucagcaaaaaugccuucagaa

SEQ ID NO: 426588 - RNA, 22 nt, Human
agcccagccggauucccaguuc

SEQ ID NO: 426589 - RNA, 22 nt, Human
uggcucagcgcggccuggucuu

SEQ ID NO: 426590 - RNA, 22 nt, Human
ucacugcaaucucugccuucca

SEQ ID NO: 426591 - RNA, 22 nt, Human
ucaggcugcaucuguaagggug

SEQ ID NO: 426592 - RNA, 22 nt, Human
ucugucucaaguucuugcacuc

SEQ ID NO: 426593 - RNA, 22 nt, Human
acucugagcaucccaagucuua

SEQ ID NO: 426594 - RNA, 22 nt, Human
cuggcuuucauuucaagcacgu

SEQ ID NO: 426595 - RNA, 22 nt, Human
auaaaagaaguuuugguacuug

SEQ ID NO: 426596 - RNA, 22 nt, Human
cccuccagcucaaagcaaccgg

SEQ ID NO: 426597 - RNA, 22 nt, Human
cccaggaccgcgcggcugagcg

SEQ ID NO: 426598 - RNA, 22 nt, Human
cuacauuuugugauuaugaaau

SEQ ID NO: 426599 - RNA, 22 nt, Human
ggcuuuauauuguuugagcaga

SEQ ID NO: 426600 - RNA, 22 nt, Human
gggcagguuauuggaguaggga

SEQ ID NO: 426601 - RNA, 20 nt, Human
cagagacccaggcuucagcu

SEQ ID NO: 426602 - RNA, 22 nt, Human
cauuagggucucucagcugaau

SEQ ID NO: 426603 - RNA, 22 nt, Human
aagaaauuaaggaaugcaacga

SEQ ID NO: 426604 - RNA, 22 nt, Human
agcagcuuacauguggccuauc

SEQ ID NO: 426605 - RNA, 22 nt, Human
caagccugucucaccagugcua

SEQ ID NO: 426606 - RNA, 22 nt, Human
uacaaagagguaauugcauaua

SEQ ID NO: 426607 - RNA, 22 nt, Human
cuccuugguguaguacugagca

SEQ ID NO: 426608 - RNA, 22 nt, Human
cuauugaauagcccaaaucauu

SEQ ID NO: 426609 - RNA, 22 nt, Human
auguaucaugcaggguccauga

SEQ ID NO: 426610 - RNA, 22 nt, Human
gccugggugaauuugauccuaa

SEQ ID NO: 426611 - RNA, 22 nt, Human
ggguaccaagcugcuugggggc

SEQ ID NO: 426612 - RNA, 22 nt, Human
aaggcucuuggagugaaugcag

SEQ ID NO: 426613 - RNA, 22 nt, Human
uggcucagcgguggcagcagac

SEQ ID NO: 426614 - RNA, 22 nt, Human
ucuccaagcagggcugcaaggc

SEQ ID NO: 426615 - RNA, 22 nt, Human
aagggcaggcacccacccucac

SEQ ID NO: 426616 - RNA, 22 nt, Human
guuacaaauguaaauucugggg

SEQ ID NO: 426617 - RNA, 19 nt, Human
gcugugggacagcagggug

SEQ ID NO: 426618 - RNA, 22 nt, Human
cagacagacagccguggccacc

SEQ ID NO: 426619 - RNA, 22 nt, Human
aggcagcaaagaaaugaugcug

SEQ ID NO: 426620 - RNA, 22 nt, Human
uucuuuccaaccagauauuggu

SEQ ID NO: 426621 - RNA, 22 nt, Human
agagcugaaaaagcugacccgg

SEQ ID NO: 426622 - RNA, 22 nt, Human
caccugcaaggagcuuucauuu

SEQ ID NO: 426623 - RNA, 22 nt, Human
gccuuaggggucagacagagcu

SEQ ID NO: 426624 - RNA, 22 nt, Human
aucaggauguuuggcugucaua

SEQ ID NO: 426625 - RNA, 22 nt, Human
aaggcacugagccagccgucuc

SEQ ID NO: 426626 - RNA, 22 nt, Human
aaguuauaucaucucauugacg

SEQ ID NO: 426627 - RNA, 22 nt, Human
acuuccaaauaccaucacauug

SEQ ID NO: 426628 - RNA, 22 nt, Human
agagauguucauucagcauguu

SEQ ID NO: 426629 - RNA, 22 nt, Human
gaaaauguuuguccggagcuga

SEQ ID NO: 426630 - RNA, 22 nt, Human
aggcucagcugguggugaucgc

SEQ ID NO: 426631 - RNA, 22 nt, Human
guuuuauaggugaaauauuacu

SEQ ID NO: 426632 - RNA, 20 nt, Human
ggggcagguuuuuauggcua

SEQ ID NO: 426633 - RNA, 22 nt, Human
gagggguguggagccaucaguu

SEQ ID NO: 426634 - RNA, 22 nt, Human
agcauuuaguuaguaaauguuu

SEQ ID NO: 426635 - RNA, 22 nt, Human
uugggcugaacccugcagcuga

SEQ ID NO: 426636 - RNA, 22 nt, Human
augaguaagaccauaauuuuug

SEQ ID NO: 426637 - RNA, 22 nt, Human
ggccagaggugguacauagcuu

SEQ ID NO: 426638 - RNA, 22 nt, Human
agggaggugguuccccagugga

SEQ ID NO: 426639 - RNA, 22 nt, Human
aggaccugacauuguguuuucu

SEQ ID NO: 426640 - RNA, 18 nt, Human
gcugucugaggucugagg

SEQ ID NO: 426641 - RNA, 22 nt, Human
agcugcaggcccaugcucaguc

SEQ ID NO: 426642 - RNA, 22 nt, Human
ugagagucucagaccuccuggu

SEQ ID NO: 426643 - RNA, 22 nt, Human
ucccuggcugggggcugccuug

SEQ ID NO: 426644 - RNA, 22 nt, Human
uuauuuuaccuuccucugagcu

SEQ ID NO: 426645 - RNA, 22 nt, Human
cagagcaguaaaucuggggcac

SEQ ID NO: 426646 - RNA, 22 nt, Human
aggcucugugacaaucaagcug

SEQ ID NO: 426647 - RNA, 22 nt, Human
caguuuauuuccaagaugacaa

SEQ ID NO: 426648 - RNA, 22 nt, Human
cccaggcagcccuucugacgca

SEQ ID NO: 426649 - RNA, 22 nt, Human
uuugcauucuagaaaaauuucu

SEQ ID NO: 426650 - RNA, 22 nt, Human
ugcaguggaaucuggagagcag

SEQ ID NO: 426651 - RNA, 21 nt, Human
uuuaauuugcauguaugacgc

SEQ ID NO: 426652 - RNA, 22 nt, Human
gucccuggaucugggacagcug

SEQ ID NO: 426653 - RNA, 22 nt, Human
gagcugccuacauugccaagag

SEQ ID NO: 426654 - RNA, 18 nt, Human
ugagagugugugcucuug

SEQ ID NO: 426655 - RNA, 22 nt, Human
agucucuuuugcgaagaguguu

SEQ ID NO: 426656 - RNA, 22 nt, Human
guauuuuauggcaugcaguggc

SEQ ID NO: 426657 - RNA, 22 nt, Human
acagggcagaaauguugcaucu

SEQ ID NO: 426658 - RNA, 22 nt, Human
ggauggagaugaccauggugac

SEQ ID NO: 426659 - RNA, 22 nt, Human
guggccugccagcagauggcgc

SEQ ID NO: 426660 - RNA, 22 nt, Human
caggauggugugagugugagga

SEQ ID NO: 426661 - RNA, 22 nt, Human
uuagaaaucugcugccaugcaa

SEQ ID NO: 426662 - RNA, 22 nt, Human
gguggagcuggaccaggagagg

SEQ ID NO: 426663 - RNA, 22 nt, Human
ggcuucccaaggagccaggaug

SEQ ID NO: 426664 - RNA, 22 nt, Human
uugacagcaaagauugugccua

SEQ ID NO: 426665 - RNA, 22 nt, Human
aggcacuguggguguggccgga

SEQ ID NO: 426666 - RNA, 22 nt, Human
gagggcucuacucaccacccug

SEQ ID NO: 426667 - RNA, 22 nt, Human
uucugucugauggugccagaac

SEQ ID NO: 426668 - RNA, 22 nt, Human
gaagccaggggccugacaggca

SEQ ID NO: 426669 - RNA, 22 nt, Human
augcuuuuaugucacaugguca

SEQ ID NO: 426670 - RNA, 22 nt, Human
aaaggccauuacuugcuuuuag

SEQ ID NO: 426671 - RNA, 20 nt, Human
gccagcacagggagcaguuc

SEQ ID NO: 426672 - RNA, 22 nt, Human
auuuaucaccaguuagcugacu

SEQ ID NO: 426673 - RNA, 22 nt, Human
gggaccugaggcccugcuccac

SEQ ID NO: 426674 - RNA, 22 nt, Human
gaguuguucaacgugugugaaa

SEQ ID NO: 426675 - RNA, 20 nt, Human
agcagcuguguuuucauccu

SEQ ID NO: 426676 - RNA, 22 nt, Human
cacugcaggucugagauggggg

SEQ ID NO: 426677 - RNA, 22 nt, Human
agucaguggcuccgagccuggu

SEQ ID NO: 426678 - RNA, 18 nt, Human
aaguaacagaagagcaca

SEQ ID NO: 426679 - RNA, 22 nt, Human
aggaagcccaagucucaucuuc

SEQ ID NO: 426680 - RNA, 22 nt, Human
caggaggcaucauggagcggac

SEQ ID NO: 426681 - RNA, 22 nt, Human
auauuaggugcucaauacaugc

SEQ ID NO: 426682 - RNA, 22 nt, Human
aucuucaacuugaucauuugaa

SEQ ID NO: 426683 - RNA, 22 nt, Human
ugaagcaguucucagaaguggg

SEQ ID NO: 426684 - RNA, 22 nt, Human
gucaggaugggcagccaaacua

SEQ ID NO: 426685 - RNA, 22 nt, Human
gugcuuuccauccucccugcug

SEQ ID NO: 426686 - RNA, 22 nt, Human
uauaucuuauaugugcagguac

SEQ ID NO: 426687 - RNA, 22 nt, Human
aaugaugggaaggagaaaagca

SEQ ID NO: 426688 - RNA, 22 nt, Human
ccugugucagccccugccucca

SEQ ID NO: 426689 - RNA, 22 nt, Human
cuggccagcauuuuugcuuuag

SEQ ID NO: 426690 - RNA, 22 nt, Human
aaguuucauguggagguagacu

SEQ ID NO: 426691 - RNA, 22 nt, Human
cuaauacucauuucuguaacuc

SEQ ID NO: 426692 - RNA, 22 nt, Human
ccagggugugagaaggaaguag

SEQ ID NO: 426693 - RNA, 23 nt, Human
ggggccugcaccggucugcgcgg

SEQ ID NO: 426694 - RNA, 22 nt, Human
uuuccucugucaugacagcuga

SEQ ID NO: 426695 - RNA, 22 nt, Human
acacauuucucuuuuuguaagu

SEQ ID NO: 426696 - RNA, 22 nt, Human
ccagaggaugcuggucagccuc

SEQ ID NO: 426697 - RNA, 22 nt, Human
guuguauucuucaauaucagag

SEQ ID NO: 426698 - RNA, 22 nt, Human
uagggcuauucugaguaauaau

SEQ ID NO: 426699 - RNA, 22 nt, Human
uucaagaugccagggacgcggc

SEQ ID NO: 426700 - RNA, 22 nt, Human
agcuucucaggagucugaggca

SEQ ID NO: 426701 - RNA, 22 nt, Human
uauauuaacacccacuugccuc

SEQ ID NO: 426702 - RNA, 22 nt, Human
cagcuguggagggaggaaaugc

SEQ ID NO: 426703 - RNA, 21 nt, Human
agaggccuuacaggauagacc

SEQ ID NO: 426704 - RNA, 22 nt, Human
agugugggugagggaggcccuc

SEQ ID NO: 426705 - RNA, 22 nt, Human
uauuuccugcauggugauguaa

SEQ ID NO: 426706 - RNA, 22 nt, Human
ucugucuuuagaggccugugcu

SEQ ID NO: 426707 - RNA, 22 nt, Human
caaaugcagauucaggaguucu

SEQ ID NO: 426708 - RNA, 22 nt, Human
ggagugacucacagcugggaca

SEQ ID NO: 426709 - RNA, 22 nt, Human
ggaggguuagcaaaggcacaga

SEQ ID NO: 426710 - RNA, 19 nt, Human
agcagcuggagguggagug

SEQ ID NO: 426711 - RNA, 22 nt, Human
ccacucugcugugcuccaugau

SEQ ID NO: 426712 - RNA, 22 nt, Human
ccacccuggacaggccucugag

SEQ ID NO: 426713 - RNA, 22 nt, Human
ccugggaggcggagguugcagu

SEQ ID NO: 426714 - RNA, 21 nt, Human
gggcaggucucugaugucaac

SEQ ID NO: 426715 - RNA, 22 nt, Human
ggcuggcaagugucugcucaug

SEQ ID NO: 426716 - RNA, 21 nt, Human
ggagggcagcccagacuggcu

SEQ ID NO: 426717 - RNA, 22 nt, Human
uugcauguguaauuuuucuaaa

SEQ ID NO: 426718 - RNA, 17 nt, Human
agaggcagauacuugga

SEQ ID NO: 426719 - RNA, 22 nt, Human
gcucagagaugucugcugccuu

SEQ ID NO: 426720 - RNA, 20 nt, Human
ugugugcacacaugacauuc

SEQ ID NO: 426721 - RNA, 22 nt, Human
uggaggcauaggccugggcccu

SEQ ID NO: 426722 - RNA, 22 nt, Human
agccauccuacuaccucagcau

SEQ ID NO: 426723 - RNA, 22 nt, Human
ucucagagaggggccgggccuu

SEQ ID NO: 426724 - RNA, 22 nt, Human
ggacacaagcuccggggcugca

SEQ ID NO: 426725 - RNA, 22 nt, Human
cagucccacuagugccaauacc

SEQ ID NO: 426726 - RNA, 22 nt, Human
uguaaguaguaauggaaggaca

SEQ ID NO: 426727 - RNA, 22 nt, Human
gccugggagugcacagugaggu

SEQ ID NO: 426728 - RNA, 22 nt, Human
cuacccagcaccuaggcugccu

SEQ ID NO: 426729 - RNA, 20 nt, Human
cagcaguggaugagaguuuu

SEQ ID NO: 426730 - RNA, 22 nt, Human
gccuaggagacaagcgugaaag

SEQ ID NO: 426731 - RNA, 22 nt, Human
gcaggcugauagaggauuccau

SEQ ID NO: 426732 - RNA, 22 nt, Human
cugccaggcacgugcagcauca

SEQ ID NO: 426733 - RNA, 22 nt, Human
uuuaccaaauagauuaugucag

SEQ ID NO: 426734 - RNA, 22 nt, Human
aaucaguuguccaaaguucaca

SEQ ID NO: 426735 - RNA, 22 nt, Human
aagacauugucauuuuauaauu

SEQ ID NO: 426736 - RNA, 22 nt, Human
agcagccaggaaucugcagagc

SEQ ID NO: 426737 - RNA, 22 nt, Human
ugguacuuggaggcagaaaaau

SEQ ID NO: 426738 - RNA, 22 nt, Human
aagggcagaaagggacgcuuug

SEQ ID NO: 426739 - RNA, 22 nt, Human
gcuugaaaauucauagguauuu

SEQ ID NO: 426740 - RNA, 22 nt, Human
ugggccuggacaaggccacuag

SEQ ID NO: 426741 - RNA, 22 nt, Human
ucagggaccccucugaguggag

SEQ ID NO: 426742 - RNA, 22 nt, Human
cuugcugggguaagucugugcu

SEQ ID NO: 426743 - RNA, 18 nt, Human
ccauuucaugauuauuac

SEQ ID NO: 426744 - RNA, 22 nt, Human
caggcacagaguuauucauuua

SEQ ID NO: 426745 - RNA, 22 nt, Human
caagccucagaaucuucuccau

SEQ ID NO: 426746 - RNA, 22 nt, Human
cugcccugcccaggccuugggc

SEQ ID NO: 426747 - RNA, 22 nt, Human
guccugggccugcugaggcuga

SEQ ID NO: 426748 - RNA, 22 nt, Human
gaaauucacuguauuucuuggg

SEQ ID NO: 426749 - RNA, 22 nt, Human
ugcauacacaugugcacauacg

SEQ ID NO: 426750 - RNA, 22 nt, Human
agcagccaagguaaccugugcu

SEQ ID NO: 426751 - RNA, 22 nt, Human
cagcaggcagccauuucacugu

SEQ ID NO: 426752 - RNA, 22 nt, Human
ugaaggcagcaugcacacuagu

SEQ ID NO: 426753 - RNA, 22 nt, Human
agugggaggcggcugacgggcg

SEQ ID NO: 426754 - RNA, 22 nt, Human
ucauacaucuuguauaucuauc

SEQ ID NO: 426755 - RNA, 22 nt, Human
caugggaggucugcaaggugcu

SEQ ID NO: 426756 - RNA, 22 nt, Human
uguucuugggaaucuuacaguu

SEQ ID NO: 426757 - RNA, 22 nt, Human
agugaaauuccuggucuuuguu

SEQ ID NO: 426758 - RNA, 22 nt, Human
ucucugcugagaagggcuggca

SEQ ID NO: 426759 - RNA, 22 nt, Human
aaacuguaaagcaggugaguag

SEQ ID NO: 426760 - RNA, 22 nt, Human
gcugccugguuucucagcugca

SEQ ID NO: 426761 - RNA, 22 nt, Human
uaaaggcuuuuagugaugguaa

SEQ ID NO: 426762 - RNA, 22 nt, Human
aaaugcacacaccaggaaacua

SEQ ID NO: 426763 - RNA, 22 nt, Human
cccagccagccucuucccauau

SEQ ID NO: 426764 - RNA, 22 nt, Human
uccauuuuagaagaaaauccac

SEQ ID NO: 426765 - RNA, 22 nt, Human
ucugaacagaaaagaugcacaa

SEQ ID NO: 426766 - RNA, 22 nt, Human
acauuugagaugccuuuuaggu

SEQ ID NO: 426767 - RNA, 22 nt, Human
guagccauuggcaaugaagccu

SEQ ID NO: 426768 - RNA, 22 nt, Human
ggccuuggggaggauggugucc

SEQ ID NO: 426769 - RNA, 22 nt, Human
gaaugcacucacccaucacuca

SEQ ID NO: 426770 - RNA, 22 nt, Human
auuugucugcuugcugccuucc

SEQ ID NO: 426771 - RNA, 22 nt, Human
cugggggcaagcagacagcugu

SEQ ID NO: 426772 - RNA, 22 nt, Human
agcagugggggaguguuaguuu

SEQ ID NO: 426773 - RNA, 22 nt, Human
uucuaacucuguuauguguuuc

SEQ ID NO: 426774 - RNA, 22 nt, Human
cagggcugaaaucaagguguag

SEQ ID NO: 426775 - RNA, 22 nt, Human
agcagcugaccagugaguccug

SEQ ID NO: 426776 - RNA, 21 nt, Human
gcaggaugcaucuuggugucu

SEQ ID NO: 426777 - RNA, 22 nt, Human
gaaggccucacucugcagcaua

SEQ ID NO: 426778 - RNA, 22 nt, Human
auacuuuggggguuaguguaga

SEQ ID NO: 426779 - RNA, 22 nt, Human
caggguggggaaauagcgcccu

SEQ ID NO: 426780 - RNA, 22 nt, Human
ccagagcuucggggcggcugua

SEQ ID NO: 426781 - RNA, 22 nt, Human
uuuaauuugaaaugaguaaccc

SEQ ID NO: 426782 - RNA, 22 nt, Human
ccuugcaggggaacaggcagug

SEQ ID NO: 426783 - RNA, 22 nt, Human
aaaggagacuucagaucuccuu

SEQ ID NO: 426784 - RNA, 22 nt, Human
uggccuguggcuuaaggucugu

SEQ ID NO: 426785 - RNA, 22 nt, Human
ucugucugcgcuugcccuggug

SEQ ID NO: 426786 - RNA, 22 nt, Human
uuauucagucugucuagggagu

SEQ ID NO: 426787 - RNA, 22 nt, Human
aggcugcuuucauggccgcccc

SEQ ID NO: 426788 - RNA, 22 nt, Human
aacucaguuacauauuagaaua

SEQ ID NO: 426789 - RNA, 22 nt, Human
aagagcuggcccaaucugagca

SEQ ID NO: 426790 - RNA, 20 nt, Human
ugcagcuucaccugugucau

SEQ ID NO: 426791 - RNA, 19 nt, Human
uccaaaggacccaccucca

SEQ ID NO: 426792 - RNA, 22 nt, Human
gagacugauggggcucccagaa

SEQ ID NO: 426793 - RNA, 22 nt, Human
gaaggcuugcagcucuguggca

SEQ ID NO: 426794 - RNA, 22 nt, Human
gcugcagcuuuaggauccagug

SEQ ID NO: 426795 - RNA, 22 nt, Human
gucaggauguuuauucuccagu

SEQ ID NO: 426796 - RNA, 22 nt, Human
gcagggaccuugcccacccucc

SEQ ID NO: 426797 - RNA, 22 nt, Human
cauuccuuaacguggggagucu

SEQ ID NO: 426798 - RNA, 22 nt, Human
uaguggagguggucugugaacu

SEQ ID NO: 426799 - RNA, 22 nt, Human
cagcaggcccaggugcugguga

SEQ ID NO: 426800 - RNA, 22 nt, Human
agaagcaguuauuuuuugcaca

SEQ ID NO: 426801 - RNA, 21 nt, Human
aguguccuugaucuugccuug

SEQ ID NO: 426802 - RNA, 22 nt, Human
uuuuccuauaugcaaagaaugc

SEQ ID NO: 426803 - RNA, 22 nt, Human
ucagugucuugaccugggugug

SEQ ID NO: 426804 - RNA, 22 nt, Human
ugccucuguugagccuuggcug

SEQ ID NO: 426805 - RNA, 22 nt, Human
gcucaggaucagccaccucuuu

SEQ ID NO: 426806 - RNA, 22 nt, Human
cccugcagagggaugggggcag

SEQ ID NO: 426807 - RNA, 22 nt, Human
cuaggaggcgggggcugcagua

SEQ ID NO: 426808 - RNA, 21 nt, Human
gggugggaggacacagcaggc

SEQ ID NO: 426809 - RNA, 22 nt, Human
aggucacauggauaaugaucag

SEQ ID NO: 426810 - RNA, 22 nt, Human
caguggauuagccagagcugga

SEQ ID NO: 426811 - RNA, 22 nt, Human
cagugcagguggcagaggacag

SEQ ID NO: 426812 - RNA, 22 nt, Human
aauacagauauucagugguacu

SEQ ID NO: 426813 - RNA, 22 nt, Human
uucaaucauuagaaucucaggc

SEQ ID NO: 426814 - RNA, 22 nt, Human
uggccugccccgagauccuggc

SEQ ID NO: 426815 - RNA, 22 nt, Human
gugagcaggauuucauggugua

SEQ ID NO: 426816 - RNA, 22 nt, Human
gaggaaggcuaaggggcuuaga

SEQ ID NO: 426817 - RNA, 22 nt, Human
ugauuuccaguugcugggugcu

SEQ ID NO: 426818 - RNA, 22 nt, Human
acccucccauuuccauguagca

SEQ ID NO: 426819 - RNA, 22 nt, Human
ugaaugaguuuggcugcuguuc

SEQ ID NO: 426820 - RNA, 22 nt, Human
uugcagggaccugcagaaagcu

SEQ ID NO: 426821 - RNA, 22 nt, Human
cuggcuggccggagcgaggcgg

SEQ ID NO: 426822 - RNA, 22 nt, Human
gggcaugagagggcagcuggca

SEQ ID NO: 426823 - RNA, 22 nt, Human
augaagauaagaccaggcugga

SEQ ID NO: 426824 - RNA, 22 nt, Human
cucucuggaagggggagcugau

SEQ ID NO: 426825 - RNA, 22 nt, Human
ggcugcugaguuggccaggaga

SEQ ID NO: 426826 - RNA, 22 nt, Human
gcccaugcacuuucugugaugg

SEQ ID NO: 426827 - RNA, 22 nt, Human
gcuggagcugcagccugggccu

SEQ ID NO: 426828 - RNA, 22 nt, Human
cuggcucauagagcagcuccaa

SEQ ID NO: 426829 - RNA, 22 nt, Human
gccaccaggagcccaguccaaa

SEQ ID NO: 426830 - RNA, 22 nt, Human
uuuaguaaguucacugcaaagc

SEQ ID NO: 426831 - RNA, 22 nt, Human
aauuagggaaaauuuacuugua

SEQ ID NO: 426832 - RNA, 22 nt, Human
agugggcaugaucuggugucug

SEQ ID NO: 426833 - RNA, 22 nt, Human
guggcccugucccaggccuccu

SEQ ID NO: 426834 - RNA, 22 nt, Human
uggcugcucaagggaggaggcu

SEQ ID NO: 426835 - RNA, 22 nt, Human
cuuggcagagggcugggcucag

SEQ ID NO: 426836 - RNA, 22 nt, Human
ggggaccuggccacccauccuu

SEQ ID NO: 426837 - RNA, 22 nt, Human
uuaguaaauaaagucuacuuuc

SEQ ID NO: 426838 - RNA, 22 nt, Human
augugacaauauuuggucuuau

SEQ ID NO: 426839 - RNA, 22 nt, Human
uguuuucauuugauguaacaaa

SEQ ID NO: 426840 - RNA, 22 nt, Human
gcaggcagguggcaucuuguga

SEQ ID NO: 426841 - RNA, 22 nt, Human
uggccugccuucgcugagcuga

SEQ ID NO: 426842 - RNA, 22 nt, Human
gcccucagaggacagcugacuu

SEQ ID NO: 426843 - RNA, 22 nt, Human
uuuuaucagcagggauaacaag

SEQ ID NO: 426844 - RNA, 22 nt, Human
ccagcagagcauggggaggaag

SEQ ID NO: 426845 - RNA, 22 nt, Human
gccucugcucggacuuugccuc

SEQ ID NO: 426846 - RNA, 22 nt, Human
ggggcagauggaacagagcaca

SEQ ID NO: 426847 - RNA, 22 nt, Human
aucuggcuggauucuuagcguu

SEQ ID NO: 426848 - RNA, 23 nt, Human
aucaagauaauccagaugaccua

SEQ ID NO: 426849 - RNA, 22 nt, Human
ccucucucuccugcacacacac

SEQ ID NO: 426850 - RNA, 19 nt, Human
accaggccucagaggcccu

SEQ ID NO: 426851 - RNA, 22 nt, Human
ucagagugcagggaguagcagc

SEQ ID NO: 426852 - RNA, 21 nt, Human
ugcagagauaucugaagcaga

SEQ ID NO: 426853 - RNA, 19 nt, Human
auaaggcaauuggauuugg

SEQ ID NO: 426854 - RNA, 22 nt, Human
gcaguaaaaaaggauaugugca

SEQ ID NO: 426855 - RNA, 22 nt, Human
gaggcugcaggcaaugcugccc

SEQ ID NO: 426856 - RNA, 22 nt, Human
gggggcaguaaccucaaagugu

SEQ ID NO: 426857 - RNA, 22 nt, Human
uuguuuuggagaugagcuaaaa

SEQ ID NO: 426858 - RNA, 18 nt, Human
ugagaggcuauuuuuugc

SEQ ID NO: 426859 - RNA, 18 nt, Human
gaagggagcuggaaugca

SEQ ID NO: 426860 - RNA, 22 nt, Human
gugugcagucugcuaggcaggg

SEQ ID NO: 426861 - RNA, 22 nt, Human
ggcugccucaaagcucaagcuc

SEQ ID NO: 426862 - RNA, 22 nt, Human
uccuuggcagcagggagcauga

SEQ ID NO: 426863 - RNA, 22 nt, Human
augcuguguuuuaaauggaaau

SEQ ID NO: 426864 - RNA, 22 nt, Human
guuagguagaaguuuacuuuga

SEQ ID NO: 426865 - RNA, 20 nt, Human
agugucuggugcagggccuc

SEQ ID NO: 426866 - RNA, 22 nt, Human
ccuggcagcagcacaugccuuc

SEQ ID NO: 426867 - RNA, 22 nt, Human
cauugcacuuuggguccaggac

SEQ ID NO: 426868 - RNA, 22 nt, Human
cagaagcaaaugccuugcugag

SEQ ID NO: 426869 - RNA, 20 nt, Human
agccaggcucaagcuccccc

SEQ ID NO: 426870 - RNA, 22 nt, Human
gcuccagaugaaaggccagagg

SEQ ID NO: 426871 - RNA, 22 nt, Human
uggcuggacagugggcagugga

SEQ ID NO: 426872 - RNA, 22 nt, Human
uuuaugagcaaugcugagggga

SEQ ID NO: 426873 - RNA, 22 nt, Human
ccacuugugaaauaaucaaaua

SEQ ID NO: 426874 - RNA, 22 nt, Human
aucagagaaauggagggcgcuu

SEQ ID NO: 426875 - RNA, 22 nt, Human
uaguggaggguguagcugcugg

SEQ ID NO: 426876 - RNA, 22 nt, Human
aguguuccacacaucuggggaa

SEQ ID NO: 426877 - RNA, 22 nt, Human
cagucccaguuugagacucugg

SEQ ID NO: 426878 - RNA, 22 nt, Human
ggucucagcccucgccagcagc

SEQ ID NO: 426879 - RNA, 22 nt, Human
gcuggcccagggucaccuagga

SEQ ID NO: 426880 - RNA, 22 nt, Human
ucacuuauaaaaugcaagaucu

SEQ ID NO: 426881 - RNA, 16 nt, Human
gagccaggugccuuga

SEQ ID NO: 426882 - RNA, 22 nt, Human
cagcugccccauaaaucacagu

SEQ ID NO: 426883 - RNA, 22 nt, Human
ucuagaaacaugacauugaucu

SEQ ID NO: 426884 - RNA, 22 nt, Human
cagcuccagcccaggcagcucc

SEQ ID NO: 426885 - RNA, 22 nt, Human
uggcagcacuagguacugagcu

SEQ ID NO: 426886 - RNA, 22 nt, Human
gccuggagcucuccacuugggg

SEQ ID NO: 426887 - RNA, 19 nt, Human
ugcaggaggacugagcaga

SEQ ID NO: 426888 - RNA, 22 nt, Human
acaguggaauuuguagaugugu

SEQ ID NO: 426889 - RNA, 22 nt, Human
ucagaggauagaaauacuuauu

SEQ ID NO: 426890 - RNA, 22 nt, Human
gccaggcagcaggaagccagug

SEQ ID NO: 426891 - RNA, 22 nt, Human
gcagcagaguuugggagauggu

SEQ ID NO: 426892 - RNA, 22 nt, Human
ugggcagacauugaguuuguuc

SEQ ID NO: 426893 - RNA, 22 nt, Human
gaggggcagaaugugaucaggg

SEQ ID NO: 426894 - RNA, 22 nt, Human
gccagguguaguggccacaccu

SEQ ID NO: 426895 - RNA, 21 nt, Human
auggagucaggggaaugggcc

SEQ ID NO: 426896 - RNA, 21 nt, Human
cacaggugggucagugaggcc

SEQ ID NO: 426897 - RNA, 22 nt, Human
acaaaauuuuuagacaaggcuu

SEQ ID NO: 426898 - RNA, 22 nt, Human
gcuggccucgcaggcaggaugu

SEQ ID NO: 426899 - RNA, 22 nt, Human
acagaggccgccucucucacgg

SEQ ID NO: 426900 - RNA, 23 nt, Human
aucagucuugguagcugugccca

SEQ ID NO: 426901 - RNA, 22 nt, Human
ucaccaggcaacuauguacucc

SEQ ID NO: 426902 - RNA, 22 nt, Human
ccugaggcccuggcugugcuga

SEQ ID NO: 426903 - RNA, 22 nt, Human
aagcuuuaugaucucucagcua

SEQ ID NO: 426904 - RNA, 23 nt, Human
uuucuguuggguauauauccaag

SEQ ID NO: 426905 - RNA, 22 nt, Human
ggcucugccugcccagcagcac

SEQ ID NO: 426906 - RNA, 22 nt, Human
ucuguuccauguuuuguuccau

SEQ ID NO: 426907 - RNA, 22 nt, Human
guuuacaugcagaaaaucaaug

SEQ ID NO: 426908 - RNA, 22 nt, Human
gaaggccacaaaaaaugucaua

SEQ ID NO: 426909 - RNA, 22 nt, Human
caagcagagacuagauagcugu

SEQ ID NO: 426910 - RNA, 22 nt, Human
gagcugucucuauaugaaugcu

SEQ ID NO: 426911 - RNA, 22 nt, Human
aagggcugcaauccaaaacacu

SEQ ID NO: 426912 - RNA, 19 nt, Human
aggcagcauucuggggcuu

SEQ ID NO: 426913 - RNA, 22 nt, Human
cccuggaggaaaaucugaggcu

SEQ ID NO: 426914 - RNA, 22 nt, Human
agcuggagaugcccagcaccgg

SEQ ID NO: 426915 - RNA, 22 nt, Human
ggcuguggcagcuggaaguggu

SEQ ID NO: 426916 - RNA, 22 nt, Human
ucuggcucucucaucacccaau

SEQ ID NO: 426917 - RNA, 22 nt, Human
gcugucacacauggccccagcu

SEQ ID NO: 426918 - RNA, 22 nt, Human
cauuucuguucucuuccuguac

SEQ ID NO: 426919 - RNA, 22 nt, Human
auuuguacaaauuuauguuagu

SEQ ID NO: 426920 - RNA, 21 nt, Human
auacuuugaauuacagccuug

SEQ ID NO: 426921 - RNA, 22 nt, Human
uggagcagggcaucacugugcg

SEQ ID NO: 426922 - RNA, 22 nt, Human
ccaaaguccauaguuuacuuua

SEQ ID NO: 426923 - RNA, 22 nt, Human
uugaagaggacuuugcagcugu

SEQ ID NO: 426924 - RNA, 22 nt, Human
uuugaaaggguuaugagacuga

SEQ ID NO: 426925 - RNA, 22 nt, Human
uggagcauauucuggagcuugg

SEQ ID NO: 426926 - RNA, 22 nt, Human
cagggagaagucuggucagucc

SEQ ID NO: 426927 - RNA, 22 nt, Human
agggcagagacaugcuuccuga

SEQ ID NO: 426928 - RNA, 22 nt, Human
gguuuauuaaugugaacuguau

SEQ ID NO: 426929 - RNA, 22 nt, Human
gaaggagggugcggaucugagc

SEQ ID NO: 426930 - RNA, 22 nt, Human
uacaucuuugucuaugaccagc

SEQ ID NO: 426931 - RNA, 21 nt, Human
uucuccccagcgaauccucgg

SEQ ID NO: 426932 - RNA, 21 nt, Human
cucacaggaugcaguguuacu

SEQ ID NO: 426933 - RNA, 22 nt, Human
cuuccugguuugaagcucgccg

SEQ ID NO: 426934 - RNA, 22 nt, Human
uccugucugucuuuggucccuu

SEQ ID NO: 426935 - RNA, 22 nt, Human
accaugaugcauccuuaaggaa

SEQ ID NO: 426936 - RNA, 19 nt, Human
agcaaauauaauaguguuc

SEQ ID NO: 426937 - RNA, 22 nt, Human
uaucuauuccaaauaucagcgu

SEQ ID NO: 426938 - RNA, 22 nt, Human
ugauuucccuguagccucugaa

SEQ ID NO: 426939 - RNA, 22 nt, Human
cugcccugagggccuguguguu

SEQ ID NO: 426940 - RNA, 22 nt, Human
gcagccuguuguaccagccugu

SEQ ID NO: 426941 - RNA, 22 nt, Human
acagaagagcacauuuaguaug

SEQ ID NO: 426942 - RNA, 22 nt, Human
ggagaaggaauauuggaguagg

SEQ ID NO: 426943 - RNA, 22 nt, Human
aggauccuccuuagaaaagacc

SEQ ID NO: 426944 - RNA, 22 nt, Human
ccuggggagaagagcuuccccc

SEQ ID NO: 426945 - RNA, 22 nt, Human
ucaguuuuguauguuguaaguc

SEQ ID NO: 426946 - RNA, 22 nt, Human
gaggagcuggcagcgucuccgc

SEQ ID NO: 426947 - RNA, 22 nt, Human
uccucagacacccugcuggcuu

SEQ ID NO: 426948 - RNA, 22 nt, Human
acuucauuguaauauuauagca

SEQ ID NO: 426949 - RNA, 21 nt, Human
ucacagacuggucagugaggc

SEQ ID NO: 426950 - RNA, 22 nt, Human
gcucucugggugugucuagaua

SEQ ID NO: 426951 - RNA, 22 nt, Human
cugagccaaaaagcagagcuug

SEQ ID NO: 426952 - RNA, 22 nt, Human
ugugaagguaaggaggggcaag

SEQ ID NO: 426953 - RNA, 22 nt, Human
uugaaaguagcagcugcauaug

SEQ ID NO: 426954 - RNA, 22 nt, Human
agcuugauuucucugcagugug

SEQ ID NO: 426955 - RNA, 22 nt, Human
gucaggauuuuaaaaucccagu

SEQ ID NO: 426956 - RNA, 22 nt, Human
uacauguaggugacauuuuaau

SEQ ID NO: 426957 - RNA, 22 nt, Human
cauugcacuucugcuuuuccuc

SEQ ID NO: 426958 - RNA, 22 nt, Human
ccaggagcaacuugaaggcaag

SEQ ID NO: 426959 - RNA, 22 nt, Human
uuuccuuccaaaugcccgggag

SEQ ID NO: 426960 - RNA, 22 nt, Human
augucacagucugacucaguga

SEQ ID NO: 426961 - RNA, 22 nt, Human
uuugcauuuguuuagaaccuga

SEQ ID NO: 426962 - RNA, 22 nt, Human
agggacaguuacaucaucagac

SEQ ID NO: 426963 - RNA, 22 nt, Human
ccagggugugggcgucggcacg

SEQ ID NO: 426964 - RNA, 22 nt, Human
cugaaugaggaaaagagugagg

SEQ ID NO: 426965 - RNA, 22 nt, Human
ugugcuucagguugucgccacg

SEQ ID NO: 426966 - RNA, 21 nt, Human
agugaaaugaaguguaugcuc

SEQ ID NO: 426967 - RNA, 22 nt, Human
agugacucacuagcucucagug

SEQ ID NO: 426968 - RNA, 22 nt, Human
ugaggcucagugagcccugcag

SEQ ID NO: 426969 - RNA, 22 nt, Human
uuguuucagcuguaugcuaugu

SEQ ID NO: 426970 - RNA, 22 nt, Human
uucugucacuuaggaggucaua

SEQ ID NO: 426971 - RNA, 22 nt, Human
cuugccuguggcuaguuggcuc

SEQ ID NO: 426972 - RNA, 22 nt, Human
acauguguggacaugaaucuac

SEQ ID NO: 426973 - RNA, 22 nt, Human
gagccauacaaccuauaaagug

SEQ ID NO: 426974 - RNA, 22 nt, Human
ugcugccaccccucaccagagc

SEQ ID NO: 426975 - RNA, 22 nt, Human
agggcugaugcaccauguagcc

SEQ ID NO: 426976 - RNA, 22 nt, Human
caugcuccaaaaacaagagaau

SEQ ID NO: 426977 - RNA, 22 nt, Human
cccaggagguggagcuugcagu

SEQ ID NO: 426978 - RNA, 22 nt, Human
ccagagucuuuauauuccugaa

SEQ ID NO: 426979 - RNA, 22 nt, Human
guuaauaaagguauagaaucag

SEQ ID NO: 426980 - RNA, 18 nt, Human
ucaaagucuggcuccacu

SEQ ID NO: 426981 - RNA, 22 nt, Human
uuugaaaggugucgagaugugu

SEQ ID NO: 426982 - RNA, 17 nt, Human
ucaggauguagcaguag

SEQ ID NO: 426983 - RNA, 22 nt, Human
agggccugcaucaggagcuugg

SEQ ID NO: 426984 - RNA, 22 nt, Human
gcagccugaugaucuggguugu

SEQ ID NO: 426985 - RNA, 22 nt, Human
auuucacucucccugccacuua

SEQ ID NO: 426986 - RNA, 22 nt, Human
accagcagaguugaggaggaca

SEQ ID NO: 426987 - RNA, 22 nt, Human
cucaggcccacagcagacccac

SEQ ID NO: 426988 - RNA, 22 nt, Human
aucuauuucugcuaauaacaau

SEQ ID NO: 426989 - RNA, 22 nt, Human
uuugugaaaugaagucacaacu

SEQ ID NO: 426990 - RNA, 22 nt, Human
gggagcuguaguccagauaccg

SEQ ID NO: 426991 - RNA, 17 nt, Human
gccuggcccagccuggc

SEQ ID NO: 426992 - RNA, 20 nt, Human
gcaaauggaucccacaagcc

SEQ ID NO: 426993 - RNA, 22 nt, Human
uuucuuagcgaugcuugauaaa

SEQ ID NO: 426994 - RNA, 22 nt, Human
ucaguggaacugucugggugag

SEQ ID NO: 426995 - RNA, 22 nt, Human
gccaguggucacugaggaagaa

SEQ ID NO: 426996 - RNA, 19 nt, Human
gggcaguggcacuagggag

SEQ ID NO: 426997 - RNA, 22 nt, Human
cuucagaggggacucaaaguca

SEQ ID NO: 426998 - RNA, 21 nt, Human
cucaaagaccaaaaguguaga

SEQ ID NO: 426999 - RNA, 22 nt, Human
ggucccagguugacagggagac

SEQ ID NO: 427000 - RNA, 22 nt, Human
cagcagagguuggaacaguucu

SEQ ID NO: 427001 - RNA, 22 nt, Human
ucaugcccagagcaguaaauua

SEQ ID NO: 427002 - RNA, 22 nt, Human
caggcugcagugcaguggcuau

SEQ ID NO: 427003 - RNA, 22 nt, Human
cugcugugugaccauggacagg

SEQ ID NO: 427004 - RNA, 22 nt, Human
ucccggcgcugggagguggguc

SEQ ID NO: 427005 - RNA, 22 nt, Human
aaguucaaguaguguuacaugg

SEQ ID NO: 427006 - RNA, 22 nt, Human
agccccucuguggcucugccuc

SEQ ID NO: 427007 - RNA, 22 nt, Human
gcuccuggucuggagcuucaag

SEQ ID NO: 427008 - RNA, 22 nt, Human
cagauaaaggcuuacuaguagu

SEQ ID NO: 427009 - RNA, 22 nt, Human
gcugucugucucugugacuuaa

SEQ ID NO: 427010 - RNA, 22 nt, Human
uggagcugaacuuugaggccag

SEQ ID NO: 427011 - RNA, 22 nt, Human
cacagguguucuugcagugaaa

SEQ ID NO: 427012 - RNA, 22 nt, Human
ccagggcaucacauccaguguu

SEQ ID NO: 427013 - RNA, 22 nt, Human
cuguacaggugaggagggggcu

SEQ ID NO: 427014 - RNA, 22 nt, Human
ugcaucuuacguuuugaaaggg

SEQ ID NO: 427015 - RNA, 22 nt, Human
aaaaaccuuucccauacuaaga

SEQ ID NO: 427016 - RNA, 22 nt, Human
aucaguuuuguucacuacuaua

SEQ ID NO: 427017 - RNA, 22 nt, Human
auccaguuuaugucauauucuu

SEQ ID NO: 427018 - RNA, 22 nt, Human
agcccagguugaggcugcagug

SEQ ID NO: 427019 - RNA, 22 nt, Human
aggcacugaccugcuuccuuga

SEQ ID NO: 427020 - RNA, 22 nt, Human
cuggagccacuuuuuauccuuu

SEQ ID NO: 427021 - RNA, 22 nt, Human
guucccauacaguaucagugcu

SEQ ID NO: 427022 - RNA, 21 nt, Human
uguaugcacgcacaugcacac

SEQ ID NO: 427023 - RNA, 22 nt, Human
cugccucuguugggcauggucu

SEQ ID NO: 427024 - RNA, 22 nt, Human
uuaguuaguggggcugucaguc

SEQ ID NO: 427025 - RNA, 22 nt, Human
cagugcuccugauguacccuug

SEQ ID NO: 427026 - RNA, 18 nt, Human
uggagcugagugcugugc

SEQ ID NO: 427027 - RNA, 23 nt, Human
aggcagcagguuguccaggguga

SEQ ID NO: 427028 - RNA, 20 nt, Human
uccagccacuuccgcugguc

SEQ ID NO: 427029 - RNA, 22 nt, Human
cuuaauuuaaaauaguucaggc

SEQ ID NO: 427030 - RNA, 22 nt, Human
uucacaaaacacuauuuucugg

SEQ ID NO: 427031 - RNA, 22 nt, Human
auuauaggcuugagccaccgug

SEQ ID NO: 427032 - RNA, 22 nt, Human
uaaggcacccuucugaguagag

SEQ ID NO: 427033 - RNA, 22 nt, Human
cugucucucuaggacacugggg

SEQ ID NO: 427034 - RNA, 22 nt, Human
uuacaaagagaaguuguagaau

SEQ ID NO: 427035 - RNA, 22 nt, Human
aaaugcauugguuucuacuugu

SEQ ID NO: 427036 - RNA, 22 nt, Human
ugcacacacgcggcacaucugu

SEQ ID NO: 427037 - RNA, 18 nt, Human
ccugccagucuggagcag

SEQ ID NO: 427038 - RNA, 22 nt, Human
ucuccuuuaagauuuccucagg

SEQ ID NO: 427039 - RNA, 22 nt, Human
acaaaguuaacaguuggauagu

SEQ ID NO: 427040 - RNA, 22 nt, Human
cgcugggggaacagcgagggug

SEQ ID NO: 427041 - RNA, 22 nt, Human
cuuauucuacuccacaagcucu

SEQ ID NO: 427042 - RNA, 22 nt, Human
augggaguuuucucugaugcuc

SEQ ID NO: 427043 - RNA, 22 nt, Human
cuggcagcuucaggacacucgg

SEQ ID NO: 427044 - RNA, 22 nt, Human
auauuagguuggugcaaaagua

SEQ ID NO: 427045 - RNA, 22 nt, Human
caguaugucuacuggacaaagu

SEQ ID NO: 427046 - RNA, 19 nt, Human
guaagggcuaauggacuau

SEQ ID NO: 427047 - RNA, 22 nt, Human
ccagagaggccaaggucguggu

SEQ ID NO: 427048 - RNA, 22 nt, Human
agaaaauuagauuuuacugugu

SEQ ID NO: 427049 - RNA, 22 nt, Human
uuuucucuacaaaauaaccagc

SEQ ID NO: 427050 - RNA, 22 nt, Human
aagggcuccauccuuauaaaug

SEQ ID NO: 427051 - RNA, 22 nt, Human
aaugucugccagaacugaucau

SEQ ID NO: 427052 - RNA, 22 nt, Human
agugagggaugaagaacugcgg

SEQ ID NO: 427053 - RNA, 22 nt, Human
ccaggaggcagaaguugcagug

SEQ ID NO: 427054 - RNA, 22 nt, Human
ccagccugaaaugccucauccu

SEQ ID NO: 427055 - RNA, 22 nt, Human
gccagagguucaacaacugucu

SEQ ID NO: 427056 - RNA, 22 nt, Human
agucucugucguagaucagcgu

SEQ ID NO: 427057 - RNA, 22 nt, Human
cugcagcuuuggaaaccuguuu

SEQ ID NO: 427058 - RNA, 22 nt, Human
gcugccugauuuacauagugaa

SEQ ID NO: 427059 - RNA, 22 nt, Human
agaaaugugaauuucauuuccu

SEQ ID NO: 427060 - RNA, 22 nt, Human
cuagaaaugcucaagagaaagu

SEQ ID NO: 427061 - RNA, 22 nt, Human
uuucauaaacaguagaagacua

SEQ ID NO: 427062 - RNA, 22 nt, Human
gcuuggaaguaggauugggaga

SEQ ID NO: 427063 - RNA, 22 nt, Human
uuuuuguagucauuagaagagg

SEQ ID NO: 427064 - RNA, 18 nt, Human
acagacaaaauggaaaug

SEQ ID NO: 427065 - RNA, 22 nt, Human
uggugcugacaguucugagugc

SEQ ID NO: 427066 - RNA, 21 nt, Human
gggcgaggccugauguggcuc

SEQ ID NO: 427067 - RNA, 22 nt, Human
uuguuuugcuaaagggucauca

SEQ ID NO: 427068 - RNA, 22 nt, Human
agugaaauaaagcugccuaugg

SEQ ID NO: 427069 - RNA, 22 nt, Human
agguauuauuagcaucucuauu

SEQ ID NO: 427070 - RNA, 22 nt, Human
auguccagaguguccuggaaag

SEQ ID NO: 427071 - RNA, 22 nt, Human
cuuauuauaaaauccuguuuga

SEQ ID NO: 427072 - RNA, 22 nt, Human
ccaggcaggcagcguucucagg

SEQ ID NO: 427073 - RNA, 22 nt, Human
gcuggccugggcagaggcuaug

SEQ ID NO: 427074 - RNA, 22 nt, Human
cuggcaggagcauucacagagg

SEQ ID NO: 427075 - RNA, 22 nt, Human
uuccauaacugaccgaaugcau

SEQ ID NO: 427076 - RNA, 22 nt, Human
auugauaucaguuugcugauug

SEQ ID NO: 427077 - RNA, 22 nt, Human
agucaguuaaccucacagcauc

SEQ ID NO: 427078 - RNA, 22 nt, Human
uagaacagaguuccagugauca

SEQ ID NO: 427079 - RNA, 22 nt, Human
caggaccccauauucacugaac

SEQ ID NO: 427080 - RNA, 22 nt, Human
uccaggcaaaaggaacugcuug

SEQ ID NO: 427081 - RNA, 22 nt, Human
uacauaauuaaucuuuaaguuc

SEQ ID NO: 427082 - RNA, 22 nt, Human
gcagggcaaauguggaaaggag

SEQ ID NO: 427083 - RNA, 22 nt, Human
cagcaaaauuugaggauugccu

SEQ ID NO: 427084 - RNA, 22 nt, Human
cagggcucaccacugggauccu

SEQ ID NO: 427085 - RNA, 22 nt, Human
ccugaagaugcuguggccuggu

SEQ ID NO: 427086 - RNA, 22 nt, Human
uucagcagucguccaggaaaag

SEQ ID NO: 427087 - RNA, 22 nt, Human
cagugcccaagaugugccaugc

SEQ ID NO: 427088 - RNA, 22 nt, Human
aggcucugcagaccccagcugu

SEQ ID NO: 427089 - RNA, 22 nt, Human
guuauuuuaacuucucaguaau

SEQ ID NO: 427090 - RNA, 22 nt, Human
uggcacugccaaccugcuaggu

SEQ ID NO: 427091 - RNA, 22 nt, Human
aagccaagaguuaacuauuugu

SEQ ID NO: 427092 - RNA, 18 nt, Human
ugucucaggcugaaacag

SEQ ID NO: 427093 - RNA, 22 nt, Human
uuccauuguuucugucuucacu

SEQ ID NO: 427094 - RNA, 22 nt, Human
gagucaguaauggauaugucau

SEQ ID NO: 427095 - RNA, 22 nt, Human
ccagaggucuccugcacgggau

SEQ ID NO: 427096 - RNA, 22 nt, Human
uucugucucccugauguagagc

SEQ ID NO: 427097 - RNA, 22 nt, Human
aauuaaaagauaacccaugagu

SEQ ID NO: 427098 - RNA, 22 nt, Human
aggcagugcagaguccucuucu

SEQ ID NO: 427099 - RNA, 20 nt, Human
agacccucuggacugggccc

SEQ ID NO: 427100 - RNA, 22 nt, Human
caggcacugugcuagauccuug

SEQ ID NO: 427101 - RNA, 22 nt, Human
ugucucaggggcauugaaauaa

SEQ ID NO: 427102 - RNA, 22 nt, Human
agcagggcagcugaugcgcacg

SEQ ID NO: 427103 - RNA, 22 nt, Human
cucaaguaagaaacagaauugg

SEQ ID NO: 427104 - RNA, 22 nt, Human
uguguacaggccuugcuagacu

SEQ ID NO: 427105 - RNA, 22 nt, Human
ggcucugguugaccaugauggc

SEQ ID NO: 427106 - RNA, 18 nt, Human
agugugugcccuuucagg

SEQ ID NO: 427107 - RNA, 22 nt, Human
uaggccaguggcagguugugug

SEQ ID NO: 427108 - RNA, 19 nt, Human
ccaguagagacagcugcag

SEQ ID NO: 427109 - RNA, 22 nt, Human
gcagcuuucugggacagaaagg

SEQ ID NO: 427110 - RNA, 22 nt, Human
ugaagcaaacgcuucuguuccu

SEQ ID NO: 427111 - RNA, 22 nt, Human
acaguucccgucuugcacagcu

SEQ ID NO: 427112 - RNA, 22 nt, Human
aggugcuggagucugggcagga

SEQ ID NO: 427113 - RNA, 19 nt, Human
ggccccucucacaggaguu

SEQ ID NO: 427114 - RNA, 22 nt, Human
uuuauucuugagagugagaaga

SEQ ID NO: 427115 - RNA, 22 nt, Human
ugcuuaaaauaguucauuuuug

SEQ ID NO: 427116 - RNA, 22 nt, Human
gcugagagugggugcagugcuu

SEQ ID NO: 427117 - RNA, 22 nt, Human
caggagaaacauaauuuucugg

SEQ ID NO: 427118 - RNA, 22 nt, Human
uugcuuccucgaggccagcgug

SEQ ID NO: 427119 - RNA, 22 nt, Human
cuguccuggagggcauaggacg

SEQ ID NO: 427120 - RNA, 22 nt, Human
uggaccugcuggaugggcaggu

SEQ ID NO: 427121 - RNA, 22 nt, Human
gauuuccuaauguggaucucug

SEQ ID NO: 427122 - RNA, 20 nt, Human
gagccugggaagucuaaggu

SEQ ID NO: 427123 - RNA, 22 nt, Human
uaccugagcccagugcagcaua

SEQ ID NO: 427124 - RNA, 22 nt, Human
ucacugcugcugccaugaugga

SEQ ID NO: 427125 - RNA, 22 nt, Human
aaagagcccuuccaugacucuu

SEQ ID NO: 427126 - RNA, 22 nt, Human
gggagucugggcuagacuccuu

SEQ ID NO: 427127 - RNA, 19 nt, Human
acacugaauguagaauugg

SEQ ID NO: 427128 - RNA, 22 nt, Human
ucauuucuguugugcaucacug

SEQ ID NO: 427129 - RNA, 22 nt, Human
uaugcacauugguuuccucauu

SEQ ID NO: 427130 - RNA, 22 nt, Human
caggcaggagccagggauucca

SEQ ID NO: 427131 - RNA, 20 nt, Human
uucacagaggacucagguca

SEQ ID NO: 427132 - RNA, 22 nt, Human
uguccuuuucuuuagugcagcu

SEQ ID NO: 427133 - RNA, 22 nt, Human
ggggcugguggugguuucucca

SEQ ID NO: 427134 - RNA, 22 nt, Human
cagagacagggcagggagugug

SEQ ID NO: 427135 - RNA, 22 nt, Human
cucucuguuaugcuuucaugaa

SEQ ID NO: 427136 - RNA, 22 nt, Human
gcacccaggcuugggcagcaac

SEQ ID NO: 427137 - RNA, 22 nt, Human
agggaccucauguaaguggauu

SEQ ID NO: 427138 - RNA, 22 nt, Human
ccagccuggguguuagaagaca

SEQ ID NO: 427139 - RNA, 22 nt, Human
agguacagaugaaagucuaguu

SEQ ID NO: 427140 - RNA, 22 nt, Human
aggggagcuaacaccagagccc

SEQ ID NO: 427141 - RNA, 22 nt, Human
agagagcauggcacagaggggu

SEQ ID NO: 427142 - RNA, 18 nt, Human
gagaggcccggcugugcc

SEQ ID NO: 427143 - RNA, 22 nt, Human
gcugucugcugggucgcucagg

SEQ ID NO: 427144 - RNA, 17 nt, Human
aggaaacauuuucuuuc

SEQ ID NO: 427145 - RNA, 22 nt, Human
acugccuugaaagauuguugag

SEQ ID NO: 427146 - RNA, 22 nt, Human
ccugcuuaacauugccaugaca

SEQ ID NO: 427147 - RNA, 22 nt, Human
aggagcuguuuuguucagcaaa

SEQ ID NO: 427148 - RNA, 20 nt, Human
gcagcugcccccagucccug

SEQ ID NO: 427149 - RNA, 22 nt, Human
uccagucaggcugaauucaagg

SEQ ID NO: 427150 - RNA, 21 nt, Human
ucacuuauaauguauuugcug

SEQ ID NO: 427151 - RNA, 22 nt, Human
gcagggcauagaggcacggagg

SEQ ID NO: 427152 - RNA, 22 nt, Human
uagaaaucagguuuuuagaaag

SEQ ID NO: 427153 - RNA, 22 nt, Human
ccugccugggcucacuugccag

SEQ ID NO: 427154 - RNA, 21 nt, Human
ucauuugugaucugauuucca

SEQ ID NO: 427155 - RNA, 22 nt, Human
uuuauuagauuaucaaagaggu

SEQ ID NO: 427156 - RNA, 17 nt, Human
uggcaagaauggaaaug

SEQ ID NO: 427157 - RNA, 22 nt, Human
ugaaguccuagaacuccuggua

SEQ ID NO: 427158 - RNA, 22 nt, Human
gcucuccacugaccacggggca

SEQ ID NO: 427159 - RNA, 23 nt, Human
agagcaucaugaugcuaagucug

SEQ ID NO: 427160 - RNA, 22 nt, Human
uggugccuugggccuacagcgc

SEQ ID NO: 427161 - RNA, 17 nt, Human
ccugucuuguuucugcc

SEQ ID NO: 427162 - RNA, 22 nt, Human
ccagcgcuucccaucagggagg

SEQ ID NO: 427163 - RNA, 22 nt, Human
cuggccugaucucaugcugucc

SEQ ID NO: 427164 - RNA, 22 nt, Human
acauuucuaauuuaauguaaca

SEQ ID NO: 427165 - RNA, 23 nt, Human
acagggcauugcuggccucgagg

SEQ ID NO: 427166 - RNA, 17 nt, Human
cccugccaccaggaagc

SEQ ID NO: 427167 - RNA, 22 nt, Human
uaauuucuucaucucugcagcu

SEQ ID NO: 427168 - RNA, 22 nt, Human
gggcucucaugaguguguggua

SEQ ID NO: 427169 - RNA, 21 nt, Human
ugcugccauagaccugaggga

SEQ ID NO: 427170 - RNA, 22 nt, Human
gaagagcuccaaaaacagugag

SEQ ID NO: 427171 - RNA, 22 nt, Human
ugaggcaguugagcuuccugag

SEQ ID NO: 427172 - RNA, 22 nt, Human
ugucuccuacugccuguggauc

SEQ ID NO: 427173 - RNA, 22 nt, Human
agaugcugucacacacacuguu

SEQ ID NO: 427174 - RNA, 22 nt, Human
guccagagauggacgagcagau

SEQ ID NO: 427175 - RNA, 22 nt, Human
ugugcuucugcagagacuauuu

SEQ ID NO: 427176 - RNA, 22 nt, Human
gccagguggucuggcuccagag

SEQ ID NO: 427177 - RNA, 22 nt, Human
ccugugugucugucacugcaca

SEQ ID NO: 427178 - RNA, 22 nt, Human
ccagagacgucggucagggcgc

SEQ ID NO: 427179 - RNA, 22 nt, Human
uacaguuuguuacauuguuagu

SEQ ID NO: 427180 - RNA, 22 nt, Human
ggcagcugauuagcaucaagga

SEQ ID NO: 427181 - RNA, 21 nt, Human
ggagucauuagucauuuccuu

SEQ ID NO: 427182 - RNA, 22 nt, Human
ccugugaggucaucugugguaa

SEQ ID NO: 427183 - RNA, 22 nt, Human
acagcagcuggguucccaccau

SEQ ID NO: 427184 - RNA, 22 nt, Human
ucccagagaaagucaaggucuu

SEQ ID NO: 427185 - RNA, 22 nt, Human
caguggucugugcuucuguaca

SEQ ID NO: 427186 - RNA, 22 nt, Human
ugggcagaguugugaugaacug

SEQ ID NO: 427187 - RNA, 22 nt, Human
ccugagaggcccucucacuguc

SEQ ID NO: 427188 - RNA, 22 nt, Human
agcagccaguucucugugguag

SEQ ID NO: 427189 - RNA, 22 nt, Human
augaggcagcugcuggagaacg

SEQ ID NO: 427190 - RNA, 21 nt, Human
ccuggccaaucugauaggguu

SEQ ID NO: 427191 - RNA, 22 nt, Human
gcaaaggccacuggggcgaugg

SEQ ID NO: 427192 - RNA, 22 nt, Human
agucagcagugaaagcacagcc

SEQ ID NO: 427193 - RNA, 22 nt, Human
cacagggcagagaccugggugc

SEQ ID NO: 427194 - RNA, 22 nt, Human
auguuucaucaguaagguuuug

SEQ ID NO: 427195 - RNA, 19 nt, Human
ucaaaggcaaggaggaacu

SEQ ID NO: 427196 - RNA, 22 nt, Human
gcccaggcuggagugcaguagc

SEQ ID NO: 427197 - RNA, 22 nt, Human
ugggcagcauccuccacaguca

SEQ ID NO: 427198 - RNA, 22 nt, Human
augauacaagcaaaacuaauca

SEQ ID NO: 427199 - RNA, 19 nt, Human
cagcugcaccgugaccauc

SEQ ID NO: 427200 - RNA, 22 nt, Human
ucccagaguucaaugggaaggu

SEQ ID NO: 427201 - RNA, 21 nt, Human
ucagcagcaucugccuagagu

SEQ ID NO: 427202 - RNA, 22 nt, Human
caggcuggagugcaguugugca

SEQ ID NO: 427203 - RNA, 22 nt, Human
agcaggagcccuuaucaccagg

SEQ ID NO: 427204 - RNA, 22 nt, Human
ucaggcagaauuaucaaaagau

SEQ ID NO: 427205 - RNA, 22 nt, Human
aaggcacuagcaagcugccugg

SEQ ID NO: 427206 - RNA, 22 nt, Human
auaacagauacucucugugagg

SEQ ID NO: 427207 - RNA, 22 nt, Human
cugcugugugcuuacuuggguu

SEQ ID NO: 427208 - RNA, 22 nt, Human
acaucucaugaaugauaaauca

SEQ ID NO: 427209 - RNA, 19 nt, Human
gcacacccugcaccaccau

SEQ ID NO: 427210 - RNA, 22 nt, Human
gagaccaggaaguacagcagcc

SEQ ID NO: 427211 - RNA, 22 nt, Human
ccaggagguggagauugcagug

SEQ ID NO: 427212 - RNA, 23 nt, Human
uugaaagguagcuggcagcuaga

SEQ ID NO: 427213 - RNA, 22 nt, Human
cacuguacccauuuaaauaaau

SEQ ID NO: 427214 - RNA, 22 nt, Human
guccucuguuagaaaugugcuu

SEQ ID NO: 427215 - RNA, 22 nt, Human
ucucccacuggccuuguaugau

SEQ ID NO: 427216 - RNA, 22 nt, Human
ucaggaguccugccugcagccu

SEQ ID NO: 427217 - RNA, 22 nt, Human
augcugagacuggagcagcugg

SEQ ID NO: 427218 - RNA, 22 nt, Human
uauaauccauucauugauuucu

SEQ ID NO: 427219 - RNA, 22 nt, Human
gccugagauucccggagccgug

SEQ ID NO: 427220 - RNA, 22 nt, Human
gccagaaagaggaggaccuggg

SEQ ID NO: 427221 - RNA, 22 nt, Human
uccuucagugucccgcucaggu

SEQ ID NO: 427222 - RNA, 22 nt, Human
ugaaaaggguagaucccuaagu

SEQ ID NO: 427223 - RNA, 22 nt, Human
ccagaagggcuauugcagugac

SEQ ID NO: 427224 - RNA, 22 nt, Human
ggcagggcuugucucugugaug

SEQ ID NO: 427225 - RNA, 20 nt, Human
cucaguguggccugaguguu

SEQ ID NO: 427226 - RNA, 22 nt, Human
gggccuggugcuucugacuccu

SEQ ID NO: 427227 - RNA, 22 nt, Human
cauuuauugguuaggccagcag

SEQ ID NO: 427228 - RNA, 22 nt, Human
uccugagggcgauucagcaggu

SEQ ID NO: 427229 - RNA, 22 nt, Human
uggucaguugcaucagagaagu

SEQ ID NO: 427230 - RNA, 22 nt, Human
agaggcaggagguugacuugag

SEQ ID NO: 427231 - RNA, 22 nt, Human
ccagucagccaagcugcagcgg

SEQ ID NO: 427232 - RNA, 22 nt, Human
uggccucugugggagcugagca

SEQ ID NO: 427233 - RNA, 22 nt, Human
aaaaguaauugaugcaaucgua

SEQ ID NO: 427234 - RNA, 19 nt, Human
aagggcugggcaccucacu

SEQ ID NO: 427235 - RNA, 20 nt, Human
ugucagugccugaggcacag

SEQ ID NO: 427236 - RNA, 22 nt, Human
aucuacaggauuuuacagaguu

SEQ ID NO: 427237 - RNA, 22 nt, Human
uuuauuauucucuggagaaugu

SEQ ID NO: 427238 - RNA, 18 nt, Human
gaaaggagagacaguagg

SEQ ID NO: 427239 - RNA, 18 nt, Human
agcagcugugccacacug

SEQ ID NO: 427240 - RNA, 22 nt, Human
aucaaaguaggcauauguuuuu

SEQ ID NO: 427241 - RNA, 22 nt, Human
auuucucaucaagugccaacuc

SEQ ID NO: 427242 - RNA, 22 nt, Human
aggagcugaagucucugcacuc

SEQ ID NO: 427243 - RNA, 22 nt, Human
uuuucauuuuuguagaugcaag

SEQ ID NO: 427244 - RNA, 22 nt, Human
acauguguauagccuguauaga

SEQ ID NO: 427245 - RNA, 22 nt, Human
ggcugcuguacugaugucaguu

SEQ ID NO: 427246 - RNA, 22 nt, Human
cuuacauuuaaucaugugucau

SEQ ID NO: 427247 - RNA, 22 nt, Human
cuggagccaugucuugacugcu

SEQ ID NO: 427248 - RNA, 22 nt, Human
ggagccagagggaugcaguuga

SEQ ID NO: 427249 - RNA, 22 nt, Human
cuuucacagcugugcuuaugau

SEQ ID NO: 427250 - RNA, 21 nt, Human
uuuuuucuugcgugaggccug

SEQ ID NO: 427251 - RNA, 22 nt, Human
aguccaggaguugggugacauu

SEQ ID NO: 427252 - RNA, 22 nt, Human
ucacaggagggagagacaccca

SEQ ID NO: 427253 - RNA, 22 nt, Human
uaaaaucauucuggugucagua

SEQ ID NO: 427254 - RNA, 22 nt, Human
uucacaaagcuggagcauuucc

SEQ ID NO: 427255 - RNA, 22 nt, Human
agcuggagaucaugcugauacu

SEQ ID NO: 427256 - RNA, 23 nt, Human
augcaguauaugucaguaguuua

SEQ ID NO: 427257 - RNA, 22 nt, Human
gaggcuccccaugaggccccag

SEQ ID NO: 427258 - RNA, 22 nt, Human
gugccugcagcaauccauggca

SEQ ID NO: 427259 - RNA, 22 nt, Human
ucagcugccucucccuggaaga

SEQ ID NO: 427260 - RNA, 22 nt, Human
aucaggauagucuguaaauugu

SEQ ID NO: 427261 - RNA, 22 nt, Human
uggcugaauaaaauaugguguu

SEQ ID NO: 427262 - RNA, 22 nt, Human
uuuguggcaggagcggagaccg

SEQ ID NO: 427263 - RNA, 21 nt, Human
uuuagggaccaggucauaggc

SEQ ID NO: 427264 - RNA, 22 nt, Human
cagcuuugccaaguaaggucuu

SEQ ID NO: 427265 - RNA, 22 nt, Human
cuucaagagaaugcagggaugu

SEQ ID NO: 427266 - RNA, 22 nt, Human
gucccagaggcuuuggccacag

SEQ ID NO: 427267 - RNA, 22 nt, Human
uucauguaauuccauaagguaa

SEQ ID NO: 427268 - RNA, 22 nt, Human
gaaaucugcggugaggccugag

SEQ ID NO: 427269 - RNA, 23 nt, Human
auucuucauuaucuucuagaaaa

SEQ ID NO: 427270 - RNA, 22 nt, Human
ugccagcacaaguuaagagauc

SEQ ID NO: 427271 - RNA, 22 nt, Human
ugcaugcagcuggugauaagaa

SEQ ID NO: 427272 - RNA, 22 nt, Human
ccugagagcagcuuccugcuua

SEQ ID NO: 427273 - RNA, 22 nt, Human
accugaggccuccccagcagac

SEQ ID NO: 427274 - RNA, 22 nt, Human
uuauuacacugaaagaauugcg

SEQ ID NO: 427275 - RNA, 22 nt, Human
accaucaguacuggaugcugac

SEQ ID NO: 427276 - RNA, 19 nt, Human
ucccuuccugucgggcucc

SEQ ID NO: 427277 - RNA, 22 nt, Human
agucccaggcagccgagccggu

SEQ ID NO: 427278 - RNA, 22 nt, Human
ugccucuguggaaauggugguc

SEQ ID NO: 427279 - RNA, 18 nt, Human
cuccagggaacucaguca

SEQ ID NO: 427280 - RNA, 21 nt, Human
aggaggaacccguggcugggc

SEQ ID NO: 427281 - RNA, 22 nt, Human
agggccuggugaccuggguccu

SEQ ID NO: 427282 - RNA, 22 nt, Human
agccauugaguuuuaugugcua

SEQ ID NO: 427283 - RNA, 22 nt, Human
gcaaaugaguuguaacauaaaa

SEQ ID NO: 427284 - RNA, 20 nt, Human
cugugccuaaaccuccgggu

SEQ ID NO: 427285 - RNA, 22 nt, Human
gggauggcucaaaggagucagg

SEQ ID NO: 427286 - RNA, 22 nt, Human
uccuggccgccgcguggggccg

SEQ ID NO: 427287 - RNA, 22 nt, Human
cugagcugcuuugcuuuugggg

SEQ ID NO: 427288 - RNA, 20 nt, Human
gagauggcuaagugcugaac

SEQ ID NO: 427289 - RNA, 22 nt, Human
cuccagaagacccauccucaug

SEQ ID NO: 427290 - RNA, 22 nt, Human
agucaccaacaugguucccagg

SEQ ID NO: 427291 - RNA, 22 nt, Human
gcucugagcacugugcggcugg

SEQ ID NO: 427292 - RNA, 22 nt, Human
ucccuggcuguguucaggugcg

SEQ ID NO: 427293 - RNA, 22 nt, Human
aaaaaugcugugguagcugugu

SEQ ID NO: 427294 - RNA, 22 nt, Human
aggucccaggcauagcuggucu

SEQ ID NO: 427295 - RNA, 22 nt, Human
ggaggagacggagugauuagug

SEQ ID NO: 427296 - RNA, 22 nt, Human
ugcccaggcuccucgcagccuu

SEQ ID NO: 427297 - RNA, 22 nt, Human
caaggcaguuccccagagggcu

SEQ ID NO: 427298 - RNA, 22 nt, Human
agaaauguuuauggcugccuau

SEQ ID NO: 427299 - RNA, 22 nt, Human
ggagccuguuaguugagugcuc

SEQ ID NO: 427300 - RNA, 22 nt, Human
ucuuaagcagagaagaaguuga

SEQ ID NO: 427301 - RNA, 22 nt, Human
gucucagauucagacaucuaca

SEQ ID NO: 427302 - RNA, 21 nt, Human
cucaggauggcggccuggugg

SEQ ID NO: 427303 - RNA, 22 nt, Human
cuggguggaaagugcugagaau

SEQ ID NO: 427304 - RNA, 22 nt, Human
ucuuuccuguaacugcuguuca

SEQ ID NO: 427305 - RNA, 22 nt, Human
agacagcaggggagucugguuu

SEQ ID NO: 427306 - RNA, 22 nt, Human
aaguucaauggaaaagcuuuag

SEQ ID NO: 427307 - RNA, 22 nt, Human
gccagccugugggggcucugug

SEQ ID NO: 427308 - RNA, 22 nt, Human
gcucaggagcucuugguggcgc

SEQ ID NO: 427309 - RNA, 23 nt, Human
agguucaggagauggaggaacaa

SEQ ID NO: 427310 - RNA, 18 nt, Human
cuucagugacagucuggc

SEQ ID NO: 427311 - RNA, 19 nt, Human
ucgagucaagacacuaggc

SEQ ID NO: 427312 - RNA, 22 nt, Human
cccaggaguaagugacauuguu

SEQ ID NO: 427313 - RNA, 22 nt, Human
uuccucucgcucuccggggccc

SEQ ID NO: 427314 - RNA, 22 nt, Human
cggcuggugucgggcacagcaa

SEQ ID NO: 427315 - RNA, 22 nt, Human
cuuuuaaugggagcaguauuug

SEQ ID NO: 427316 - RNA, 22 nt, Human
gucucuuuuauggugaguugau

SEQ ID NO: 427317 - RNA, 22 nt, Human
ucucugaguucuccuccagccc

SEQ ID NO: 427318 - RNA, 22 nt, Human
cagagcuggagcuugaauggag

SEQ ID NO: 427319 - RNA, 22 nt, Human
cagcuugcaguacuuguuuuug

SEQ ID NO: 427320 - RNA, 17 nt, Human
cugagcauccgugcucu

SEQ ID NO: 427321 - RNA, 22 nt, Human
acccagccacagcauugaggga

SEQ ID NO: 427322 - RNA, 22 nt, Human
ucuugcacuucaugaauauguu

SEQ ID NO: 427323 - RNA, 22 nt, Human
acaggggauugauuggaagucu

SEQ ID NO: 427324 - RNA, 20 nt, Human
auacaaagagauugauguau

SEQ ID NO: 427325 - RNA, 22 nt, Human
ugcagggcuauaacuccauucu

SEQ ID NO: 427326 - RNA, 22 nt, Human
ugcaauaacuacuuuaauguug

SEQ ID NO: 427327 - RNA, 22 nt, Human
auacuguaucacuugugaguga

SEQ ID NO: 427328 - RNA, 22 nt, Human
agggcgacaauggagagcguuu

SEQ ID NO: 427329 - RNA, 22 nt, Human
cuguuuucaaagagagagaaug

SEQ ID NO: 427330 - RNA, 22 nt, Human
cugcugccggcgagccucccuu

SEQ ID NO: 427331 - RNA, 18 nt, Human
uccugccugcgggcuccc

SEQ ID NO: 427332 - RNA, 19 nt, Human
accaggcuuauggucagug

SEQ ID NO: 427333 - RNA, 22 nt, Human
uggagcaggugcucaggguaau

SEQ ID NO: 427334 - RNA, 22 nt, Human
ugcagugccucggcagugcagc

SEQ ID NO: 427335 - RNA, 22 nt, Human
ugaaaggugacauuucuuggau

SEQ ID NO: 427336 - RNA, 22 nt, Human
gaggaaaauggaguguaauuaa

SEQ ID NO: 427337 - RNA, 22 nt, Human
aagggcagcuauuaucgucauc

SEQ ID NO: 427338 - RNA, 23 nt, Human
ucccagggaaggugagcgaggcu

SEQ ID NO: 427339 - RNA, 22 nt, Human
aucuggcuuggguguggguagc

SEQ ID NO: 427340 - RNA, 22 nt, Human
accauguuggccaagcuggucu

SEQ ID NO: 427341 - RNA, 22 nt, Human
gaggaagggcugccugccgggc

SEQ ID NO: 427342 - RNA, 22 nt, Human
uacccagggcuuuucugaugca

SEQ ID NO: 427343 - RNA, 22 nt, Human
acaaagugaauugcaucgaguu

SEQ ID NO: 427344 - RNA, 22 nt, Human
uauuacugagguuuuauggagu

SEQ ID NO: 427345 - RNA, 20 nt, Human
gcucccugguagaaauguuu

SEQ ID NO: 427346 - RNA, 22 nt, Human
cacagggccacuuucccaguaa

SEQ ID NO: 427347 - RNA, 22 nt, Human
aaaugugcuugugaucagcugu

SEQ ID NO: 427348 - RNA, 21 nt, Human
cgcagagcgaacuugcggcgc

SEQ ID NO: 427349 - RNA, 21 nt, Human
cugcuuuacuucagaggaucu

SEQ ID NO: 427350 - RNA, 22 nt, Human
guccagugucuucuacauaaca

SEQ ID NO: 427351 - RNA, 22 nt, Human
ccugccaggcuuugggcuucug

SEQ ID NO: 427352 - RNA, 22 nt, Human
acaaagcuagagaagagaauug

SEQ ID NO: 427353 - RNA, 20 nt, Human
ccagguggugccuggagagg

SEQ ID NO: 427354 - RNA, 22 nt, Human
cuguguccugcgucaagccaau

SEQ ID NO: 427355 - RNA, 22 nt, Human
ggcagggaguggagacucccua

SEQ ID NO: 427356 - RNA, 22 nt, Human
aagcagccuggcaugaugcuuu

SEQ ID NO: 427357 - RNA, 22 nt, Human
cuuccucccccacacacucacu

SEQ ID NO: 427358 - RNA, 22 nt, Human
ugcugccaccugguggcugaag

SEQ ID NO: 427359 - RNA, 19 nt, Human
auuuacugccuaaaaucuc

SEQ ID NO: 427360 - RNA, 22 nt, Human
aauuuuauuaacuggauguagc

SEQ ID NO: 427361 - RNA, 22 nt, Human
ccagggugagaaaaggcuggau

SEQ ID NO: 427362 - RNA, 22 nt, Human
ccuggcagcuccuccccggcgg

SEQ ID NO: 427363 - RNA, 22 nt, Human
uacaaaguuugggguccucaaa

SEQ ID NO: 427364 - RNA, 22 nt, Human
acacaucuuagacugaaauaug

SEQ ID NO: 427365 - RNA, 22 nt, Human
agcucccagcagagcuggccac

SEQ ID NO: 427366 - RNA, 22 nt, Human
uugcaaaggggaauaaagcaau

SEQ ID NO: 427367 - RNA, 22 nt, Human
acccaggguagagugcaguggc

SEQ ID NO: 427368 - RNA, 22 nt, Human
ggaaggucgagcugcaucuggc

SEQ ID NO: 427369 - RNA, 22 nt, Human
uagugcacacgcauguagcagu

SEQ ID NO: 427370 - RNA, 22 nt, Human
ucugcagcgugcaggcuggugc

SEQ ID NO: 427371 - RNA, 22 nt, Human
cggucaggugcagcguuggcac

SEQ ID NO: 427372 - RNA, 22 nt, Human
augcuauacauaugacaucaca

SEQ ID NO: 427373 - RNA, 22 nt, Human
aguguccaacucagcuugucaa

SEQ ID NO: 427374 - RNA, 22 nt, Human
cugggagucaccaggagcaagg

SEQ ID NO: 427375 - RNA, 22 nt, Human
acagaauucuaguauguggcuu

SEQ ID NO: 427376 - RNA, 22 nt, Human
uccaggcaugucccaagccgga

SEQ ID NO: 427377 - RNA, 22 nt, Human
aggcugaggagggauguugcuu

SEQ ID NO: 427378 - RNA, 22 nt, Human
caagaacaguuugccaaauugg

SEQ ID NO: 427379 - RNA, 22 nt, Human
auguacauuuagaucauuucug

SEQ ID NO: 427380 - RNA, 22 nt, Human
gggccuguguguucaggagccu

SEQ ID NO: 427381 - RNA, 23 nt, Human
guggccuccccggaaugccucgc

SEQ ID NO: 427382 - RNA, 21 nt, Human
ugccaggccugagcugggguc

SEQ ID NO: 427383 - RNA, 22 nt, Human
aggccagaaaugucagggagug

SEQ ID NO: 427384 - RNA, 21 nt, Human
agagagaaggccauauggucc

SEQ ID NO: 427385 - RNA, 22 nt, Human
agcugcuaugacaacaccagcc

SEQ ID NO: 427386 - RNA, 22 nt, Human
agccaggcugcaguuggcuggc

SEQ ID NO: 427387 - RNA, 19 nt, Human
auagaaaggguuaaagaca

SEQ ID NO: 427388 - RNA, 22 nt, Human
uuuucuaacaucuaguaauuug

SEQ ID NO: 427389 - RNA, 22 nt, Human
gagaggaguagacacuuugguu

SEQ ID NO: 427390 - RNA, 22 nt, Human
aucugccuccaaguccaugugu

SEQ ID NO: 427391 - RNA, 22 nt, Human
cuggaaggucuguccccacugc

SEQ ID NO: 427392 - RNA, 22 nt, Human
ggcuccuguggcaagacagcuu

SEQ ID NO: 427393 - RNA, 23 nt, Human
agaguccacaagauuuuccagug

SEQ ID NO: 427394 - RNA, 22 nt, Human
gaaaggugccccauaggcagga

SEQ ID NO: 427395 - RNA, 22 nt, Human
aagggcuggcccugggaagagu

SEQ ID NO: 427396 - RNA, 18 nt, Human
ggcugugcguggaggcug

SEQ ID NO: 427397 - RNA, 21 nt, Human
gcagaugggagucaucaggcu

SEQ ID NO: 427398 - RNA, 20 nt, Human
ugaaaggugggaauuguggg

SEQ ID NO: 427399 - RNA, 22 nt, Human
ucccagggugcgccugcccucg

SEQ ID NO: 427400 - RNA, 22 nt, Human
gcagagugaggaagagcuucca

SEQ ID NO: 427401 - RNA, 22 nt, Human
cucacugucuguacuagcugau

SEQ ID NO: 427402 - RNA, 22 nt, Human
ccugggcagguguggcuucccc

SEQ ID NO: 427403 - RNA, 22 nt, Human
cagcaguguacaaggugucaga

SEQ ID NO: 427404 - RNA, 22 nt, Human
cucuggcuuugcucaugcaucc

SEQ ID NO: 427405 - RNA, 20 nt, Human
ggaagcagagaacuguuuuc

SEQ ID NO: 427406 - RNA, 22 nt, Human
gcccacagcucguuccucuccu

SEQ ID NO: 427407 - RNA, 22 nt, Human
gcagcccaauggacugagacag

SEQ ID NO: 427408 - RNA, 22 nt, Human
cacauguuuggcaugucaccaa

SEQ ID NO: 427409 - RNA, 22 nt, Human
acaagaauuauuucuaguuaac

SEQ ID NO: 427410 - RNA, 22 nt, Human
cagucuucuaaccuagcagccu

SEQ ID NO: 427411 - RNA, 18 nt, Human
acaguaaagaaaggaauu

SEQ ID NO: 427412 - RNA, 22 nt, Human
cccaaggcugcagugagcauga

SEQ ID NO: 427413 - RNA, 22 nt, Human
augacagaaggccucccugaca

SEQ ID NO: 427414 - RNA, 22 nt, Human
auuagagguacaaaccuucacu

SEQ ID NO: 427415 - RNA, 21 nt, Human
gcaggguccuuuccauuccua

SEQ ID NO: 427416 - RNA, 22 nt, Human
aggcagcagggccacuggcuga

SEQ ID NO: 427417 - RNA, 22 nt, Human
ggcuuuaucaaaugagacccug

SEQ ID NO: 427418 - RNA, 21 nt, Human
ucccagagugcuugggacugc

SEQ ID NO: 427419 - RNA, 22 nt, Human
uguucauuuggcccuuuuguau

SEQ ID NO: 427420 - RNA, 22 nt, Human
aaguugaaugcguacgugacau

SEQ ID NO: 427421 - RNA, 22 nt, Human
acagaggaagcauauagcacaa

SEQ ID NO: 427422 - RNA, 16 nt, Human
cagaguguaaacagga

SEQ ID NO: 427423 - RNA, 22 nt, Human
auugaaaggcaaaguaggaagc

SEQ ID NO: 427424 - RNA, 22 nt, Human
acagggcagagaggcaggcuug

SEQ ID NO: 427425 - RNA, 22 nt, Human
uuucacaaguaaaguccuaagu

SEQ ID NO: 427426 - RNA, 22 nt, Human
uggccuuccuggugacucauga

SEQ ID NO: 427427 - RNA, 22 nt, Human
accaucuuaaggggacuucuua

SEQ ID NO: 427428 - RNA, 22 nt, Human
ugggccuguugggguugaguua

SEQ ID NO: 427429 - RNA, 22 nt, Human
aggcugagcuggcccuugaaau

SEQ ID NO: 427430 - RNA, 22 nt, Human
gugccuggagcuaauguguaua

SEQ ID NO: 427431 - RNA, 22 nt, Human
caaaguuaugaaugauaagauu

SEQ ID NO: 427432 - RNA, 22 nt, Human
ugaugaaaauaugauucugagg

SEQ ID NO: 427433 - RNA, 22 nt, Human
ugcuggcccaugaagacgcagu

SEQ ID NO: 427434 - RNA, 22 nt, Human
uuccucucaacaugccugccgg

SEQ ID NO: 427435 - RNA, 22 nt, Human
uccucccugaguggggacagcu

SEQ ID NO: 427436 - RNA, 22 nt, Human
ucuucaaacugaaaauuuagaa

SEQ ID NO: 427437 - RNA, 22 nt, Human
cuggagccauguauagccuaug

SEQ ID NO: 427438 - RNA, 22 nt, Human
agauuuccaucuuuuucaugug

SEQ ID NO: 427439 - RNA, 22 nt, Human
cuggagagaccgaaagaggcug

SEQ ID NO: 427440 - RNA, 22 nt, Human
agggcucugggguggcagagau

SEQ ID NO: 427441 - RNA, 22 nt, Human
uuucauaauagugcaguuuguu

SEQ ID NO: 427442 - RNA, 22 nt, Human
gaaaucugcccagugcacuggu

SEQ ID NO: 427443 - RNA, 22 nt, Human
caggaggcagaggaugcccagu

SEQ ID NO: 427444 - RNA, 22 nt, Human
cggcuggguagaggugccgggu

SEQ ID NO: 427445 - RNA, 22 nt, Human
ucccagggacucucugccuucc

SEQ ID NO: 427446 - RNA, 19 nt, Human
cugucaggggcuggauguu

SEQ ID NO: 427447 - RNA, 22 nt, Human
aucuggaauccuuguggacaau

SEQ ID NO: 427448 - RNA, 22 nt, Human
aggcugaguuucucauucucgc

SEQ ID NO: 427449 - RNA, 22 nt, Human
ggcugaaguguaguggcucacu

SEQ ID NO: 427450 - RNA, 22 nt, Human
cagggcucagaagacagaccuc

SEQ ID NO: 427451 - RNA, 22 nt, Human
gccucugcaccaguacugugcc

SEQ ID NO: 427452 - RNA, 22 nt, Human
guucagcccacagagggggccg

SEQ ID NO: 427453 - RNA, 22 nt, Human
uuauuagcugggcuucagggug

SEQ ID NO: 427454 - RNA, 22 nt, Human
ugcaguggaagagguggagauc

SEQ ID NO: 427455 - RNA, 22 nt, Human
acagaggcagugugagauacug

SEQ ID NO: 427456 - RNA, 22 nt, Human
cauuucugcagaauugcucuuc

SEQ ID NO: 427457 - RNA, 22 nt, Human
aagauuucuuacuuauugaugc

SEQ ID NO: 427458 - RNA, 22 nt, Human
ggucccugcugaagccuuggug

SEQ ID NO: 427459 - RNA, 22 nt, Human
caggccagguggcaggcaaaac

SEQ ID NO: 427460 - RNA, 23 nt, Human
cuccucguaacucuguggugggu

SEQ ID NO: 427461 - RNA, 22 nt, Human
caaggccauauugccuguaugu

SEQ ID NO: 427462 - RNA, 22 nt, Human
uagcugccuagacagcuauagc

SEQ ID NO: 427463 - RNA, 23 nt, Human
gaggcagcuccugcagugcccug

SEQ ID NO: 427464 - RNA, 22 nt, Human
acauucuguuuccccaaagaga

SEQ ID NO: 427465 - RNA, 22 nt, Human
agugucugaaccaccggggcau

SEQ ID NO: 427466 - RNA, 22 nt, Human
agcugaggcucugagagggaag

SEQ ID NO: 427467 - RNA, 22 nt, Human
gcagcuuuagaaacaagggcug

SEQ ID NO: 427468 - RNA, 22 nt, Human
cagucccagacccagaaggugg

SEQ ID NO: 427469 - RNA, 22 nt, Human
aggcugagcggggucccagagc

SEQ ID NO: 427470 - RNA, 22 nt, Human
auucauucugaccucaagagaa

SEQ ID NO: 427471 - RNA, 22 nt, Human
gagagggccgggggccagcucc

SEQ ID NO: 427472 - RNA, 22 nt, Human
caugggcuuuggaggcuggagg

SEQ ID NO: 427473 - RNA, 22 nt, Human
ugcauauuauguguaucugucu

SEQ ID NO: 427474 - RNA, 22 nt, Human
ccuuuuucccuggagggacagc

SEQ ID NO: 427475 - RNA, 22 nt, Human
cucuggacacuggcaugggguc

SEQ ID NO: 427476 - RNA, 22 nt, Human
caguuucuauggcugggcucug

SEQ ID NO: 427477 - RNA, 23 nt, Human
cuagggcaguauuucacagacac

SEQ ID NO: 427478 - RNA, 22 nt, Human
ugaguccacuuuaaaaugucag

SEQ ID NO: 427479 - RNA, 22 nt, Human
gcuggccagggcugcucgcgga

SEQ ID NO: 427480 - RNA, 22 nt, Human
uguaggccuauguccagcaauu

SEQ ID NO: 427481 - RNA, 22 nt, Human
agccccaguccgcugcgggcgg

SEQ ID NO: 427482 - RNA, 22 nt, Human
uuucuauuggcgucacuguugu

SEQ ID NO: 427483 - RNA, 22 nt, Human
ccacccagcagaggaggcaaga

SEQ ID NO: 427484 - RNA, 22 nt, Human
cuguuaaucugcuugcaugaug

SEQ ID NO: 427485 - RNA, 22 nt, Human
auuucuucaggucagaaauaga

SEQ ID NO: 427486 - RNA, 22 nt, Human
gguguccuugcagaaggcggcg

SEQ ID NO: 427487 - RNA, 22 nt, Human
ugaaagguuaaaaguaguauug

SEQ ID NO: 427488 - RNA, 22 nt, Human
uucuuguauguaugcaaaauca

SEQ ID NO: 427489 - RNA, 19 nt, Human
ucucaauguucagaaagcu

SEQ ID NO: 427490 - RNA, 22 nt, Human
ugagccaguggaagauggcagu

SEQ ID NO: 427491 - RNA, 22 nt, Human
agggagagguugaaaccucagu

SEQ ID NO: 427492 - RNA, 22 nt, Human
uacaguaacauguuguacaagc

SEQ ID NO: 427493 - RNA, 22 nt, Human
agcccuccucacaucagcgucc

SEQ ID NO: 427494 - RNA, 22 nt, Human
cuccucuuuacccgcauggucu

SEQ ID NO: 427495 - RNA, 22 nt, Human
gagggcuccacacgggcccagc

SEQ ID NO: 427496 - RNA, 23 nt, Human
agcuggaggcugucuacucccaa

SEQ ID NO: 427497 - RNA, 22 nt, Human
ugaagccagcuuuggaagacac

SEQ ID NO: 427498 - RNA, 19 nt, Human
aggcugugagggaggacuc

SEQ ID NO: 427499 - RNA, 22 nt, Human
agugcagugguuaggagccagg

SEQ ID NO: 427500 - RNA, 23 nt, Human
gaagcagaugucugaguaggcag

SEQ ID NO: 427501 - RNA, 22 nt, Human
uugaagcaaauucugugcagua

SEQ ID NO: 427502 - RNA, 21 nt, Human
cccaagggaggcaggauaagg

SEQ ID NO: 427503 - RNA, 22 nt, Human
agcagcaggagccgugggguga

SEQ ID NO: 427504 - RNA, 22 nt, Human
accacccucagcagagcugaaa

SEQ ID NO: 427505 - RNA, 22 nt, Human
gugcuuccaucuagagggucac

SEQ ID NO: 427506 - RNA, 22 nt, Human
cuccagugagcgcggggcaugg

SEQ ID NO: 427507 - RNA, 22 nt, Human
caguauuuauggcuugaguauu

SEQ ID NO: 427508 - RNA, 22 nt, Human
agaaaucuaagaugcucaagga

SEQ ID NO: 427509 - RNA, 22 nt, Human
gccuggagcccaguguggggcu

SEQ ID NO: 427510 - RNA, 22 nt, Human
uuuaaauuuguguuuagagggu

SEQ ID NO: 427511 - RNA, 22 nt, Human
ccagcugcccaagaggcauccu

SEQ ID NO: 427512 - RNA, 23 nt, Human
acacauuuuucccguucugaggu

SEQ ID NO: 427513 - RNA, 22 nt, Human
cagaaugcaaauuuuauaauau

SEQ ID NO: 427514 - RNA, 22 nt, Human
ccaggccuuccaguacgcagaa

SEQ ID NO: 427515 - RNA, 22 nt, Human
ugcacagcgggugucugucagg

SEQ ID NO: 427516 - RNA, 22 nt, Human
ucaggaauccagacagggcaca

SEQ ID NO: 427517 - RNA, 19 nt, Human
uggcuucuguuuucauguu

SEQ ID NO: 427518 - RNA, 22 nt, Human
uggcuggcaaggcuggagucag

SEQ ID NO: 427519 - RNA, 22 nt, Human
ugguccagaugccuuggcuuua

SEQ ID NO: 427520 - RNA, 22 nt, Human
gguggcagaggugcaucagccc

SEQ ID NO: 427521 - RNA, 22 nt, Human
cagcagcaaaucuagaagagga

SEQ ID NO: 427522 - RNA, 18 nt, Human
agacccucuaagggcagu

SEQ ID NO: 427523 - RNA, 22 nt, Human
ggcagccaugucccagggcuuc

SEQ ID NO: 427524 - RNA, 19 nt, Human
agcagagcagggccguggg

SEQ ID NO: 427525 - RNA, 22 nt, Human
aggcugaggcggguagaucacc

SEQ ID NO: 427526 - RNA, 22 nt, Human
aacaaauguaaaaugcagaugc

SEQ ID NO: 427527 - RNA, 22 nt, Human
uagauaaauuagaaaguuuacu

SEQ ID NO: 427528 - RNA, 22 nt, Human
guuauguacuuuuuaaaucuug

SEQ ID NO: 427529 - RNA, 22 nt, Human
cccaggaggcagaaguugcagu

SEQ ID NO: 427530 - RNA, 22 nt, Human
cccaggcagcggggucuccuug

SEQ ID NO: 427531 - RNA, 22 nt, Human
uucagagacagcaaccaggaca

SEQ ID NO: 427532 - RNA, 21 nt, Human
ugaggcucuguugugccugca

SEQ ID NO: 427533 - RNA, 22 nt, Human
uccucagaaaccccugugaggu

SEQ ID NO: 427534 - RNA, 22 nt, Human
ggcagggaaacagcugauccca

SEQ ID NO: 427535 - RNA, 22 nt, Human
aggaccugagaguuggaaaucc

SEQ ID NO: 427536 - RNA, 22 nt, Human
cucuggagguugagcccagcaa

SEQ ID NO: 427537 - RNA, 22 nt, Human
gcagugcuuuagucuguccuuu

SEQ ID NO: 427538 - RNA, 22 nt, Human
accucugcucaagaccccuccg

SEQ ID NO: 427539 - RNA, 22 nt, Human
accuuucauuaaagucuguagu

SEQ ID NO: 427540 - RNA, 20 nt, Human
cccaggcagagcuagcggca

SEQ ID NO: 427541 - RNA, 22 nt, Human
uuccauaaaggugauaguauac

SEQ ID NO: 427542 - RNA, 22 nt, Human
gcuggucacucugggagcugcu

SEQ ID NO: 427543 - RNA, 22 nt, Human
cugggcagcugugcaaacaaua

SEQ ID NO: 427544 - RNA, 22 nt, Human
cccaggucccgccccagcucua

SEQ ID NO: 427545 - RNA, 17 nt, Human
gagagcugcugcuuccg

SEQ ID NO: 427546 - RNA, 22 nt, Human
caugcuuugggucagaaaugcc

SEQ ID NO: 427547 - RNA, 22 nt, Human
guuuuauaugucucugcugaca

SEQ ID NO: 427548 - RNA, 22 nt, Human
ugcagcugcuugauucaucuug

SEQ ID NO: 427549 - RNA, 22 nt, Human
gcagugaaucuggcaagaauuu

SEQ ID NO: 427550 - RNA, 22 nt, Human
ucaggagcugcacugggcccac

SEQ ID NO: 427551 - RNA, 22 nt, Human
agagcugagcaccaagcauggu

SEQ ID NO: 427552 - RNA, 22 nt, Human
aaguugagaugucauaggagac

SEQ ID NO: 427553 - RNA, 22 nt, Human
gaggcagagacuccaccuucag

SEQ ID NO: 427554 - RNA, 20 nt, Human
acagccagaggaggcagaca

SEQ ID NO: 427555 - RNA, 22 nt, Human
aagaacugugcuccaggcucca

SEQ ID NO: 427556 - RNA, 22 nt, Human
gaugccugcauuucaggagagu

SEQ ID NO: 427557 - RNA, 22 nt, Human
cugggcucagcccaugcugucc

SEQ ID NO: 427558 - RNA, 22 nt, Human
gagcugccuguugcauagcaac

SEQ ID NO: 427559 - RNA, 22 nt, Human
guauuaggaaauaugaagaaag

SEQ ID NO: 427560 - RNA, 19 nt, Human
cucuggagcagacacugga

SEQ ID NO: 427561 - RNA, 22 nt, Human
agaggcaggaagagcugauuuu

SEQ ID NO: 427562 - RNA, 22 nt, Human
aggagguggcugaacuugaggg

SEQ ID NO: 427563 - RNA, 22 nt, Human
ugcaggugaaaauuaugaggau

SEQ ID NO: 427564 - RNA, 21 nt, Human
aggagggcacaaggccaggaa

SEQ ID NO: 427565 - RNA, 20 nt, Human
ccagcuuucccugcagcauc

SEQ ID NO: 427566 - RNA, 22 nt, Human
acagggccucagccagggcaga

SEQ ID NO: 427567 - RNA, 19 nt, Human
guggccagggcaggggcug

SEQ ID NO: 427568 - RNA, 22 nt, Human
ggaggaugagcuacgaggagcu

SEQ ID NO: 427569 - RNA, 22 nt, Human
agccaggaaccagcuacagucu

SEQ ID NO: 427570 - RNA, 22 nt, Human
aaggccaggacaccaggggacu

SEQ ID NO: 427571 - RNA, 22 nt, Human
uacauauuugucuuuguacugu

SEQ ID NO: 427572 - RNA, 22 nt, Human
acagucuugagcaucagccaga

SEQ ID NO: 427573 - RNA, 22 nt, Human
auguucaaacuuuuuacacacc

SEQ ID NO: 427574 - RNA, 22 nt, Human
caguguuuguauagaauaugca

SEQ ID NO: 427575 - RNA, 22 nt, Human
uuuuccuacugauaaacaguua

SEQ ID NO: 427576 - RNA, 22 nt, Human
ucccagcccagauuugugugac

SEQ ID NO: 427577 - RNA, 22 nt, Human
gaugguuuaugauagaugggaa

SEQ ID NO: 427578 - RNA, 22 nt, Human
auuucauugaaguuaauucuuc

SEQ ID NO: 427579 - RNA, 22 nt, Human
aucaggaaugaauacuuuugga

SEQ ID NO: 427580 - RNA, 22 nt, Human
cccaggaggcagagguugcagu

SEQ ID NO: 427581 - RNA, 22 nt, Human
ugucuacuugggcucuacagca

SEQ ID NO: 427582 - RNA, 22 nt, Human
aacaugaagguaggaugguuuu

SEQ ID NO: 427583 - RNA, 22 nt, Human
aagcaagacagaaguuacugcc

SEQ ID NO: 427584 - RNA, 22 nt, Human
guguacauagaauugugcuuug

SEQ ID NO: 427585 - RNA, 22 nt, Human
uccagccaugcaugacaaucac

SEQ ID NO: 427586 - RNA, 21 nt, Human
uuagcuuucuagaaucuuugu

SEQ ID NO: 427587 - RNA, 22 nt, Human
caguguuugcuuaaguuauaug

SEQ ID NO: 427588 - RNA, 22 nt, Human
cccccaggcucugacacaggag

SEQ ID NO: 427589 - RNA, 20 nt, Human
uacagucagggcacaggcag

SEQ ID NO: 427590 - RNA, 22 nt, Human
ugcuggcccuggcucagggaac

SEQ ID NO: 427591 - RNA, 21 nt, Human
ccagcagcucaaggaucucuu

SEQ ID NO: 427592 - RNA, 22 nt, Human
cucugugggggagaggcagcug

SEQ ID NO: 427593 - RNA, 22 nt, Human
gaggggcucuugggcaugaagg

SEQ ID NO: 427594 - RNA, 22 nt, Human
gugugcaggugucagugcagcu

SEQ ID NO: 427595 - RNA, 22 nt, Human
gcugucugucucugucccacca

SEQ ID NO: 427596 - RNA, 22 nt, Human
gcugugugaaaacugggccugg

SEQ ID NO: 427597 - RNA, 22 nt, Human
ccaggguaccccaagggcaggu

SEQ ID NO: 427598 - RNA, 19 nt, Human
cagucccaaauucuuguca

SEQ ID NO: 427599 - RNA, 22 nt, Human
ccagggcagugggagaaggugc

SEQ ID NO: 427600 - RNA, 22 nt, Human
gaccauuugcuaguaaauugca

SEQ ID NO: 427601 - RNA, 22 nt, Human
uggcugagguaacuaugaauaa

SEQ ID NO: 427602 - RNA, 22 nt, Human
uuagccauugucagcacauggc

SEQ ID NO: 427603 - RNA, 22 nt, Human
agaggccaugcuagaggccugg

SEQ ID NO: 427604 - RNA, 22 nt, Human
aaggccaugaccacuugcugug

SEQ ID NO: 427605 - RNA, 22 nt, Human
aggcugagcugaccugguuugg

SEQ ID NO: 427606 - RNA, 22 nt, Human
uuuaaauuuagaagaaacacug

SEQ ID NO: 427607 - RNA, 22 nt, Human
agcuuuaucagaggagucucua

SEQ ID NO: 427608 - RNA, 22 nt, Human
ucauggagacuuugagccuguu

SEQ ID NO: 427609 - RNA, 22 nt, Human
uuucauaaccucaagcuacagu

SEQ ID NO: 427610 - RNA, 22 nt, Human
gggugggaucuguggagccuca

SEQ ID NO: 427611 - RNA, 22 nt, Human
ucaggcagaaaaaucacuaauu

SEQ ID NO: 427612 - RNA, 22 nt, Human
uagggaccuuagaauuguaugu

SEQ ID NO: 427613 - RNA, 22 nt, Human
gccaggccugcaagugcuggug

SEQ ID NO: 427614 - RNA, 22 nt, Human
uuucacaucagagguagauuag

SEQ ID NO: 427615 - RNA, 22 nt, Human
gcaggguccauggaggcagccc

SEQ ID NO: 427616 - RNA, 22 nt, Human
acugggaggcaaagagcaagga

SEQ ID NO: 427617 - RNA, 22 nt, Human
aggaggcccuagagcucuagag

SEQ ID NO: 427618 - RNA, 22 nt, Human
gaggaagaaagcauaggugggg

SEQ ID NO: 427619 - RNA, 23 nt, Human
uagggcagcugggagggacaugc

SEQ ID NO: 427620 - RNA, 22 nt, Human
cccagcuaccucugcuaggaga

SEQ ID NO: 427621 - RNA, 22 nt, Human
cagacacagcaauucuguguug

SEQ ID NO: 427622 - RNA, 21 nt, Human
uccuucaguucugcacuuucu

SEQ ID NO: 427623 - RNA, 22 nt, Human
acugaaggaaacuuuuguguuu

SEQ ID NO: 427624 - RNA, 22 nt, Human
augaggcacaucacagccaaug

SEQ ID NO: 427625 - RNA, 22 nt, Human
ugaaagcacucacuucugcucu

SEQ ID NO: 427626 - RNA, 22 nt, Human
caggccugaguguggaagucuu

SEQ ID NO: 427627 - RNA, 22 nt, Human
ggagccugugggaugagaugug

SEQ ID NO: 427628 - RNA, 22 nt, Human
uuugaaagcuacuuucggguca

SEQ ID NO: 427629 - RNA, 22 nt, Human
uauuuguugaguuguuaugucu

SEQ ID NO: 427630 - RNA, 22 nt, Human
uaguuaggaauagcagcgacuc

SEQ ID NO: 427631 - RNA, 22 nt, Human
ggucccagcuggucacugucag

SEQ ID NO: 427632 - RNA, 20 nt, Human
gggcuagaccagggcagagg

SEQ ID NO: 427633 - RNA, 22 nt, Human
ccuggccuccuggccuucucau

SEQ ID NO: 427634 - RNA, 20 nt, Human
gccaacgcgcuggggcugcc

SEQ ID NO: 427635 - RNA, 22 nt, Human
caggcagaaauuuuguuucauu

SEQ ID NO: 427636 - RNA, 20 nt, Human
ucacaggggaccaggagcag

SEQ ID NO: 427637 - RNA, 22 nt, Human
ggaagagagggcugggccucaa

SEQ ID NO: 427638 - RNA, 21 nt, Human
aaaguucaugcuuuaauauuc

SEQ ID NO: 427639 - RNA, 22 nt, Human
ugucauugaggaaaacuaggug

SEQ ID NO: 427640 - RNA, 22 nt, Human
gagccaggguuugaaacuagac

SEQ ID NO: 427641 - RNA, 22 nt, Human
agccaggccuuagggagaggca

SEQ ID NO: 427642 - RNA, 22 nt, Human
uccucagggggccaacccagcc

SEQ ID NO: 427643 - RNA, 22 nt, Human
uugccaggagcucaucugaggg

SEQ ID NO: 427644 - RNA, 22 nt, Human
ugggcugcggauaggccucgga

SEQ ID NO: 427645 - RNA, 23 nt, Human
ucuuuccucagcacacaccaaga

SEQ ID NO: 427646 - RNA, 20 nt, Human
caguagcaauaauuagaagc

SEQ ID NO: 427647 - RNA, 22 nt, Human
gugcuucucuucacacccaacu

SEQ ID NO: 427648 - RNA, 22 nt, Human
auggcagggaccaagcugucau

SEQ ID NO: 427649 - RNA, 22 nt, Human
ucucccaguggugcagaaagca

SEQ ID NO: 427650 - RNA, 22 nt, Human
aauggacaggagagcauaguca

SEQ ID NO: 427651 - RNA, 22 nt, Human
ucuacaaagaagaauuaauguc

SEQ ID NO: 427652 - RNA, 21 nt, Human
ccagcuuucccaagucccuuu

SEQ ID NO: 427653 - RNA, 22 nt, Human
agaaacauuuagauuauauguc

SEQ ID NO: 427654 - RNA, 22 nt, Human
cugucugcuagaacaucuauac

SEQ ID NO: 427655 - RNA, 22 nt, Human
gcugccaauccagcugugggag

SEQ ID NO: 427656 - RNA, 22 nt, Human
uaauacuuuugccuuguauuca

SEQ ID NO: 427657 - RNA, 22 nt, Human
acagaaauauagaagguaggaa

SEQ ID NO: 427658 - RNA, 19 nt, Human
ugaggccaaggucacagau

SEQ ID NO: 427659 - RNA, 22 nt, Human
agggagguaggagcuucuagcu

SEQ ID NO: 427660 - RNA, 22 nt, Human
gaaggcugaguggguacggagg

SEQ ID NO: 427661 - RNA, 22 nt, Human
cuugugcauuucauuccucagg

SEQ ID NO: 427662 - RNA, 22 nt, Human
agcaccuucacaggcucucagg

SEQ ID NO: 427663 - RNA, 22 nt, Human
uucagugugugauaccugcugu

SEQ ID NO: 427664 - RNA, 22 nt, Human
ucaugaaaauagaucagaaauu

SEQ ID NO: 427665 - RNA, 22 nt, Human
ucagccugcgucauggugacac

SEQ ID NO: 427666 - RNA, 17 nt, Human
uguuccauuugaccacc

SEQ ID NO: 427667 - RNA, 22 nt, Human
agcagccacccagcugcucauu

SEQ ID NO: 427668 - RNA, 22 nt, Human
gcugggcaccggagagacccca

SEQ ID NO: 427669 - RNA, 22 nt, Human
aggaguguggccagggcucugg

SEQ ID NO: 427670 - RNA, 22 nt, Human
caucacuguccaaaguucaguu

SEQ ID NO: 427671 - RNA, 22 nt, Human
gaacccaggcuuuugaggcugu

SEQ ID NO: 427672 - RNA, 22 nt, Human
ugaaggcacuugccuaggggca

SEQ ID NO: 427673 - RNA, 22 nt, Human
ggccuagggaguggccaugccu

SEQ ID NO: 427674 - RNA, 22 nt, Human
ggccucggcccacugcugcggu

SEQ ID NO: 427675 - RNA, 22 nt, Human
cagggguguuuuuggccaggag

SEQ ID NO: 427676 - RNA, 22 nt, Human
aucuuucagagcuccaucaggg

SEQ ID NO: 427677 - RNA, 22 nt, Human
cagauuuaccuaacuccaaguu

SEQ ID NO: 427678 - RNA, 22 nt, Human
guccucugcuucaugcccugau

SEQ ID NO: 427679 - RNA, 22 nt, Human
cagccagggagcaaagaguuga

SEQ ID NO: 427680 - RNA, 22 nt, Human
ugcaggccggcccuaggccuca

SEQ ID NO: 427681 - RNA, 22 nt, Human
uugaggcugcacaguacaggcu

SEQ ID NO: 427682 - RNA, 22 nt, Human
cggcagcuccgcgccguaggac

SEQ ID NO: 427683 - RNA, 22 nt, Human
cuggcagguggauggggacucc

SEQ ID NO: 427684 - RNA, 22 nt, Human
aaauguguuugauaggaauauu

SEQ ID NO: 427685 - RNA, 22 nt, Human
cugcccugggaguaccuguccu

SEQ ID NO: 427686 - RNA, 17 nt, Human
uucaagauauugaaaug

SEQ ID NO: 427687 - RNA, 22 nt, Human
uggcugagagaagacggggaag

SEQ ID NO: 427688 - RNA, 22 nt, Human
uaaaugcaagugcuccugggag

SEQ ID NO: 427689 - RNA, 22 nt, Human
aguguuucucagaagggccuau

SEQ ID NO: 427690 - RNA, 16 nt, Human
gggcugggggauucug

SEQ ID NO: 427691 - RNA, 22 nt, Human
uucugcaucugaauuuaaguac

SEQ ID NO: 427692 - RNA, 22 nt, Human
agaggcagccguauuucaaagg

SEQ ID NO: 427693 - RNA, 22 nt, Human
ggcagauggaagaggcuggguc

SEQ ID NO: 427694 - RNA, 22 nt, Human
uuccauaauuaaguggagagaa

SEQ ID NO: 427695 - RNA, 22 nt, Human
gaggaaaagagacagguuauug

SEQ ID NO: 427696 - RNA, 22 nt, Human
cuccaggguuccccgauccacu

SEQ ID NO: 427697 - RNA, 22 nt, Human
aguggcagaucucuggucugga

SEQ ID NO: 427698 - RNA, 22 nt, Human
cccagcuugcgggcggcaggag

SEQ ID NO: 427699 - RNA, 22 nt, Human
ccaaaggccaggcacugagguu

SEQ ID NO: 427700 - RNA, 22 nt, Human
guuauauauaguauuucucuga

SEQ ID NO: 427701 - RNA, 20 nt, Human
uagaaaucuuauaaaagacu

SEQ ID NO: 427702 - RNA, 22 nt, Human
ucucucugccaacucacagcca

SEQ ID NO: 427703 - RNA, 22 nt, Human
agcuggcagagcauuuguggcc

SEQ ID NO: 427704 - RNA, 23 nt, Human
aaaguugauuugcaguuuaagag

SEQ ID NO: 427705 - RNA, 22 nt, Human
aagauuucucuccuggaaagca

SEQ ID NO: 427706 - RNA, 22 nt, Human
ccuggcugggguagaagugagg

SEQ ID NO: 427707 - RNA, 19 nt, Human
agcagccaucgaccaugga

SEQ ID NO: 427708 - RNA, 17 nt, Human
aagacagaagccaugag

SEQ ID NO: 427709 - RNA, 22 nt, Human
cagagcaucgcgcagagagccu

SEQ ID NO: 427710 - RNA, 22 nt, Human
ucagagugugacuuggucauga

SEQ ID NO: 427711 - RNA, 20 nt, Human
ggcugcugugggcagagagg

SEQ ID NO: 427712 - RNA, 22 nt, Human
ugggcagaggcagcagaaaccu

SEQ ID NO: 427713 - RNA, 21 nt, Human
gcacagugccaggcacacagu

SEQ ID NO: 427714 - RNA, 22 nt, Human
cugggagucuggccucuggucc

SEQ ID NO: 427715 - RNA, 22 nt, Human
aggggugauuugggacaggaca

SEQ ID NO: 427716 - RNA, 18 nt, Human
gagaggagccagaauuuu

SEQ ID NO: 427717 - RNA, 22 nt, Human
ccacugggcguuucuguccaau

SEQ ID NO: 427718 - RNA, 22 nt, Human
cacaaaugacugaaacgacugu

SEQ ID NO: 427719 - RNA, 22 nt, Human
aggcacaguggcucacaccugu

SEQ ID NO: 427720 - RNA, 22 nt, Human
gcugggcugagcuagacuuggc

SEQ ID NO: 427721 - RNA, 19 nt, Human
augagcuggcauuucaggu

SEQ ID NO: 427722 - RNA, 22 nt, Human
cagaggcaaaagagguggaggu

SEQ ID NO: 427723 - RNA, 22 nt, Human
uacaaaugaaccaacuuugaug

SEQ ID NO: 427724 - RNA, 21 nt, Human
aguuugaugcaauuucugaga

SEQ ID NO: 427725 - RNA, 22 nt, Human
caggaaagaaaugagaacacca

SEQ ID NO: 427726 - RNA, 22 nt, Human
cugucaggggcggguggagcgg

SEQ ID NO: 427727 - RNA, 19 nt, Human
agccagugagccucugggu

SEQ ID NO: 427728 - RNA, 22 nt, Human
gccagguguccucacagugagg

SEQ ID NO: 427729 - RNA, 22 nt, Human
aguggcagaagucacuggguag

SEQ ID NO: 427730 - RNA, 22 nt, Human
ccaggcuggauuuugcaguuca

SEQ ID NO: 427731 - RNA, 21 nt, Human
ucucugggaggacuugugaga

SEQ ID NO: 427732 - RNA, 22 nt, Human
ccuggcacgaagggcugagguu

SEQ ID NO: 427733 - RNA, 17 nt, Human
gaaagguccuagaaauc

SEQ ID NO: 427734 - RNA, 22 nt, Human
uggcuggcaguaggcuaguggc

SEQ ID NO: 427735 - RNA, 22 nt, Human
uagccaggcgaggucagugucg

SEQ ID NO: 427736 - RNA, 22 nt, Human
aaggccagcuuguagggcuggu

SEQ ID NO: 427737 - RNA, 16 nt, Human
uggaaggggucuccgg

SEQ ID NO: 427738 - RNA, 22 nt, Human
ccacacagggggaugaguuauu

SEQ ID NO: 427739 - RNA, 22 nt, Human
gcaccuggcugcccagguggag

SEQ ID NO: 427740 - RNA, 22 nt, Human
gugcaugugucuuuauaguaga

SEQ ID NO: 427741 - RNA, 23 nt, Human
ucagaggaucaucaaacguuuuc

SEQ ID NO: 427742 - RNA, 22 nt, Human
gggcugagggguaucucauggg

SEQ ID NO: 427743 - RNA, 22 nt, Human
ggggaccuaggcucugucucuu

SEQ ID NO: 427744 - RNA, 22 nt, Human
uacaaaugaccauagccacuua

SEQ ID NO: 427745 - RNA, 22 nt, Human
ucagccuggcaggauggccugg

SEQ ID NO: 427746 - RNA, 22 nt, Human
acuuuguuuggcuauuagaguc

SEQ ID NO: 427747 - RNA, 22 nt, Human
cugcugugagugguucuugccu

SEQ ID NO: 427748 - RNA, 22 nt, Human
caggacagagcccagacugugu

SEQ ID NO: 427749 - RNA, 22 nt, Human
uuuucauuguaaaucaggaaac

SEQ ID NO: 427750 - RNA, 22 nt, Human
aagcugccuuccaugugaggaa

SEQ ID NO: 427751 - RNA, 22 nt, Human
cuauuaggcuuccauuucaugc

SEQ ID NO: 427752 - RNA, 22 nt, Human
gaaaugcaggcuuggauucagc

SEQ ID NO: 427753 - RNA, 22 nt, Human
cugggccuagaggaagcugaca

SEQ ID NO: 427754 - RNA, 22 nt, Human
ugcaggggcuugucugggccug

SEQ ID NO: 427755 - RNA, 22 nt, Human
cugccuccugccgugcagcuuc

SEQ ID NO: 427756 - RNA, 22 nt, Human
cuagggacugggaccuuaguua

SEQ ID NO: 427757 - RNA, 22 nt, Human
caguuuuucaaaauuacaugau

SEQ ID NO: 427758 - RNA, 22 nt, Human
agaugaaaagauaagcagcaau

SEQ ID NO: 427759 - RNA, 22 nt, Human
cagcaggaccauugaggcauca

SEQ ID NO: 427760 - RNA, 22 nt, Human
aggcgugggaggaucugaggcc

SEQ ID NO: 427761 - RNA, 22 nt, Human
agugcagaguacauuuguggca

SEQ ID NO: 427762 - RNA, 22 nt, Human
uucuuucccaguagaugugaaa

SEQ ID NO: 427763 - RNA, 22 nt, Human
gcaggugguccccguggagugg

SEQ ID NO: 427764 - RNA, 22 nt, Human
ggucccaggaagugcggcggcg

SEQ ID NO: 427765 - RNA, 22 nt, Human
agguaggguuaauggagauaua

SEQ ID NO: 427766 - RNA, 22 nt, Human
uccugccuagcaggugaccuau

SEQ ID NO: 427767 - RNA, 22 nt, Human
ucucugagguuguuuccagcac

SEQ ID NO: 427768 - RNA, 17 nt, Human
ggccuuggggccucagu

SEQ ID NO: 427769 - RNA, 22 nt, Human
cuacauuuuaauaagcugcuua

SEQ ID NO: 427770 - RNA, 22 nt, Human
ccccagcugcauacuugccaag

SEQ ID NO: 427771 - RNA, 22 nt, Human
gaggcagaaguugcagugagca

SEQ ID NO: 427772 - RNA, 22 nt, Human
ggagaaggugcuggucacugug

SEQ ID NO: 427773 - RNA, 22 nt, Human
ucagaggacagcagcuaaauaa

SEQ ID NO: 427774 - RNA, 21 nt, Human
gugcucugggcagcagagggc

SEQ ID NO: 427775 - RNA, 22 nt, Human
uaagaacagugucugucucaca

SEQ ID NO: 427776 - RNA, 22 nt, Human
ggaagccaguugcuuggugugg

SEQ ID NO: 427777 - RNA, 22 nt, Human
cccaggagguggagguugcagc

SEQ ID NO: 427778 - RNA, 19 nt, Human
auuugaaagcugugcuugc

SEQ ID NO: 427779 - RNA, 19 nt, Human
uagcagcugccaaaggaga

SEQ ID NO: 427780 - RNA, 21 nt, Human
uuucugucucugccacuaguu

SEQ ID NO: 427781 - RNA, 22 nt, Human
uggcagagaacacacaugauuc

SEQ ID NO: 427782 - RNA, 22 nt, Human
uuuguacauccuaauucugagu

SEQ ID NO: 427783 - RNA, 22 nt, Human
aaguggagucccuacaaccagc

SEQ ID NO: 427784 - RNA, 22 nt, Human
ggacacaguggaagacagcuug

SEQ ID NO: 427785 - RNA, 22 nt, Human
agccucugauggcucccaagga

SEQ ID NO: 427786 - RNA, 18 nt, Human
acagaaauagcugugccu

SEQ ID NO: 427787 - RNA, 22 nt, Human
ucagagaguuagugucuuagcu

SEQ ID NO: 427788 - RNA, 22 nt, Human
ucaggggaaaucucucagcgaa

SEQ ID NO: 427789 - RNA, 22 nt, Human
ccaaggcuggagugcaguggcg

SEQ ID NO: 427790 - RNA, 22 nt, Human
agaagggccagcuggacaccug

SEQ ID NO: 427791 - RNA, 22 nt, Human
cucucugggggccaugccaaga

SEQ ID NO: 427792 - RNA, 22 nt, Human
gucaggggccaugggccaagga

SEQ ID NO: 427793 - RNA, 22 nt, Human
cuaguucuuaacuguuaugauu

SEQ ID NO: 427794 - RNA, 22 nt, Human
gcagggccagggcucaggcugu

SEQ ID NO: 427795 - RNA, 22 nt, Human
uggccuggaagagaggucgagg

SEQ ID NO: 427796 - RNA, 22 nt, Human
caugggagcuaucuccaucacu

SEQ ID NO: 427797 - RNA, 22 nt, Human
auucagugugagguuuucaagu

SEQ ID NO: 427798 - RNA, 16 nt, Human
uagggcugggaaggag

SEQ ID NO: 427799 - RNA, 22 nt, Human
auccugggaagcugacauugaa

SEQ ID NO: 427800 - RNA, 22 nt, Human
agccacagagcaggagaccuuu

SEQ ID NO: 427801 - RNA, 22 nt, Human
caggcagccugagggaucuggg

SEQ ID NO: 427802 - RNA, 22 nt, Human
gaagggagaagguugggugacg

SEQ ID NO: 427803 - RNA, 22 nt, Human
agcaggguauguuagagcugua

SEQ ID NO: 427804 - RNA, 22 nt, Human
uacagauacagaucuagauaca

SEQ ID NO: 427805 - RNA, 22 nt, Human
cccugcagacgucuugaugccu

SEQ ID NO: 427806 - RNA, 22 nt, Human
uuaaagggccgauuuccaggcc

SEQ ID NO: 427807 - RNA, 22 nt, Human
cugggccagauccagccucaca

SEQ ID NO: 427808 - RNA, 22 nt, Human
ucaguguaaguuauguagaugu

SEQ ID NO: 427809 - RNA, 22 nt, Human
aguggagacaggacagucgaua

SEQ ID NO: 427810 - RNA, 22 nt, Human
agaaugcauuuuguguagcuau

SEQ ID NO: 427811 - RNA, 22 nt, Human
uucuuucacucaagaaggaucu

SEQ ID NO: 427812 - RNA, 22 nt, Human
acaggugugagaacaugccuug

SEQ ID NO: 427813 - RNA, 22 nt, Human
ccagugcauaaucaauacagcc

SEQ ID NO: 427814 - RNA, 22 nt, Human
ccuguacaagcucuuggugaca

SEQ ID NO: 427815 - RNA, 22 nt, Human
aaagccuugcccgucacuggga

SEQ ID NO: 427816 - RNA, 23 nt, Human
guggagccacaucacaggcuccu

SEQ ID NO: 427817 - RNA, 22 nt, Human
ucucagagcaucauuuucuuag

SEQ ID NO: 427818 - RNA, 22 nt, Human
uguacauuuagagcucaauaga

SEQ ID NO: 427819 - RNA, 22 nt, Human
auaauuuaaauuaguaugugau

SEQ ID NO: 427820 - RNA, 22 nt, Human
agaagcugacagaugcagcagg

SEQ ID NO: 427821 - RNA, 22 nt, Human
gaggcucaguuaugucaucagg

SEQ ID NO: 427822 - RNA, 23 nt, Human
uugucugugcuuuuccaguugcu

SEQ ID NO: 427823 - RNA, 22 nt, Human
cagggaguuuuuguuccucuag

SEQ ID NO: 427824 - RNA, 22 nt, Human
cuacuucugugaugaaacuaca

SEQ ID NO: 427825 - RNA, 22 nt, Human
aucacauucuuucaaagcaguc

SEQ ID NO: 427826 - RNA, 22 nt, Human
auugacaagacaauggcucuua

SEQ ID NO: 427827 - RNA, 22 nt, Human
uucacagaauggcaaguuaugg

SEQ ID NO: 427828 - RNA, 22 nt, Human
gcagauggcucagacacugggg

SEQ ID NO: 427829 - RNA, 22 nt, Human
uggcagagagacucuccuugau

SEQ ID NO: 427830 - RNA, 22 nt, Human
cccaggcagucuggcucuaaag

SEQ ID NO: 427831 - RNA, 22 nt, Human
gaggcgagaagcuggagauggu

SEQ ID NO: 427832 - RNA, 22 nt, Human
aggagggcaggcuggcugccua

SEQ ID NO: 427833 - RNA, 23 nt, Human
agcagggccagaauacuugcugu

SEQ ID NO: 427834 - RNA, 22 nt, Human
ccaggccagcaggcacaccugc

SEQ ID NO: 427835 - RNA, 22 nt, Human
ugggcuggugagggaucauuua

SEQ ID NO: 427836 - RNA, 22 nt, Human
gccuucaguaguauccucauga

SEQ ID NO: 427837 - RNA, 22 nt, Human
caagagcuggguggcaagcuag

SEQ ID NO: 427838 - RNA, 22 nt, Human
cccucccaagcacucugacaua

SEQ ID NO: 427839 - RNA, 22 nt, Human
cugccacuagcuuucacaucuu

SEQ ID NO: 427840 - RNA, 22 nt, Human
uggaggagaauuuauggucgaa

SEQ ID NO: 427841 - RNA, 22 nt, Human
uugaaggacauccuauuucuag

SEQ ID NO: 427842 - RNA, 22 nt, Human
ucagaggagccaaaguucugag

SEQ ID NO: 427843 - RNA, 22 nt, Human
ugauuuccaauaaggagaaugu

SEQ ID NO: 427844 - RNA, 22 nt, Human
agagccugggcagcuccucugg

SEQ ID NO: 427845 - RNA, 22 nt, Human
auaaacaguagagaaagguggu

SEQ ID NO: 427846 - RNA, 22 nt, Human
guuugauucaagaacaaagagu

SEQ ID NO: 427847 - RNA, 21 nt, Human
ccugcagcaccagaaggagau

SEQ ID NO: 427848 - RNA, 22 nt, Human
cagcucaaguuucccaggucag

SEQ ID NO: 427849 - RNA, 17 nt, Human
aggcagcucagaacauc

SEQ ID NO: 427850 - RNA, 22 nt, Human
uccucagugcuagccaacugcc

SEQ ID NO: 427851 - RNA, 22 nt, Human
cuugucugugucggauaaaacu

SEQ ID NO: 427852 - RNA, 22 nt, Human
ucagcuggagaugagaaccgaa

SEQ ID NO: 427853 - RNA, 22 nt, Human
aagcagggugucuugacccaug

SEQ ID NO: 427854 - RNA, 22 nt, Human
ucuuuccuacuuuauugugaac

SEQ ID NO: 427855 - RNA, 22 nt, Human
ucacagaaggcaucacagaaga

SEQ ID NO: 427856 - RNA, 22 nt, Human
ucaggcagguuggcugcagguc

SEQ ID NO: 427857 - RNA, 22 nt, Human
ugaagcaggugaauggaugucg

SEQ ID NO: 427858 - RNA, 22 nt, Human
ggaggccaaggugggcggauca

SEQ ID NO: 427859 - RNA, 22 nt, Human
cuugccuucuuuuccuauagaa

SEQ ID NO: 427860 - RNA, 22 nt, Human
aucaaguuuucuuaguugacug

SEQ ID NO: 427861 - RNA, 22 nt, Human
uggcucaguaaucgagucuccu

SEQ ID NO: 427862 - RNA, 22 nt, Human
aggaccugcuaaugugccaagu

SEQ ID NO: 427863 - RNA, 21 nt, Human
gcagcaguguucuagaauacu

SEQ ID NO: 427864 - RNA, 22 nt, Human
uuagaaaggaaucuucauuuca

SEQ ID NO: 427865 - RNA, 22 nt, Human
ucugcagcuuuuugguggggug

SEQ ID NO: 427866 - RNA, 22 nt, Human
agugaaauuuguuuagauaggu

SEQ ID NO: 427867 - RNA, 22 nt, Human
gcagaagaccaugguggaaaga

SEQ ID NO: 427868 - RNA, 22 nt, Human
caggccugauacacugaacucu

SEQ ID NO: 427869 - RNA, 22 nt, Human
agccuccaguagcugaagagac

SEQ ID NO: 427870 - RNA, 22 nt, Human
cugagcgcaugguugcugggga

SEQ ID NO: 427871 - RNA, 22 nt, Human
aggcagcaugcucugcuucuac

SEQ ID NO: 427872 - RNA, 19 nt, Human
gcuucccaccagccagccc

SEQ ID NO: 427873 - RNA, 22 nt, Human
uacauuaucuuguuaucuuuca

SEQ ID NO: 427874 - RNA, 22 nt, Human
cauugcaccacauugcaucccu

SEQ ID NO: 427875 - RNA, 22 nt, Human
caggcacucauucagagaggug

SEQ ID NO: 427876 - RNA, 22 nt, Human
aggauccuuuuucugcuguuug

SEQ ID NO: 427877 - RNA, 22 nt, Human
auguuucagauacagaucaaau

SEQ ID NO: 427878 - RNA, 22 nt, Human
cacaccuguaauaccagcuacu

SEQ ID NO: 427879 - RNA, 22 nt, Human
uacauggugguggcacuugacu

SEQ ID NO: 427880 - RNA, 22 nt, Human
cucagcuggcaauucuggcucc

SEQ ID NO: 427881 - RNA, 23 nt, Human
gucagggcuggggucagagugac

SEQ ID NO: 427882 - RNA, 22 nt, Human
ccagggcaacgcugucucagag

SEQ ID NO: 427883 - RNA, 22 nt, Human
caugaagcauguuuugucauga

SEQ ID NO: 427884 - RNA, 22 nt, Human
agucccagugagaugaaccagg

SEQ ID NO: 427885 - RNA, 20 nt, Human
ccuccuggucaggugugcag

SEQ ID NO: 427886 - RNA, 22 nt, Human
cugcucugacccuuucaccuuc

SEQ ID NO: 427887 - RNA, 22 nt, Human
ucaguuuuaagguuugagaauu

SEQ ID NO: 427888 - RNA, 22 nt, Human
uaucuuugcaaauaucucuaag

SEQ ID NO: 427889 - RNA, 17 nt, Human
gguguauggggagggaa

SEQ ID NO: 427890 - RNA, 22 nt, Human
ggcagcucugugucugggaagc

SEQ ID NO: 427891 - RNA, 22 nt, Human
cugccaggccucaucccagcca

SEQ ID NO: 427892 - RNA, 22 nt, Human
acuuugcaauacuuaauacaaa

SEQ ID NO: 427893 - RNA, 22 nt, Human
cuuuucaugagucuguuauggg

SEQ ID NO: 427894 - RNA, 22 nt, Human
aggaaacagugaacuuggcagg

SEQ ID NO: 427895 - RNA, 22 nt, Human
gcagaagcuguucgaaggccgc

SEQ ID NO: 427896 - RNA, 22 nt, Human
cccagccucagcuuuacuucca

SEQ ID NO: 427897 - RNA, 22 nt, Human
gaagccacagagauuguggggg

SEQ ID NO: 427898 - RNA, 22 nt, Human
acauaccauacauggugagaug

SEQ ID NO: 427899 - RNA, 22 nt, Human
cuacuucuaaguacauggugau

SEQ ID NO: 427900 - RNA, 22 nt, Human
uccugcaggccagaggggugag

SEQ ID NO: 427901 - RNA, 22 nt, Human
gccaggcagauaugugagcuua

SEQ ID NO: 427902 - RNA, 22 nt, Human
aacagaauaguugauguacagu

SEQ ID NO: 427903 - RNA, 22 nt, Human
gaggggcuggcacgauggcugc

SEQ ID NO: 427904 - RNA, 21 nt, Human
uggcaggcagcuggaagcuug

SEQ ID NO: 427905 - RNA, 19 nt, Human
ugcaagugucuuggacaag

SEQ ID NO: 427906 - RNA, 22 nt, Human
cugccucuugacagaucguggc

SEQ ID NO: 427907 - RNA, 22 nt, Human
cucugggcaccaaagagcagcu

SEQ ID NO: 427908 - RNA, 22 nt, Human
uggcacuggaaucguagccuug

SEQ ID NO: 427909 - RNA, 22 nt, Human
guugacagcuggugagcugcua

SEQ ID NO: 427910 - RNA, 22 nt, Human
cccagcucucugcucuuagccu

SEQ ID NO: 427911 - RNA, 22 nt, Human
caagucaaagacuagaacuagu

SEQ ID NO: 427912 - RNA, 22 nt, Human
ccaaggagcucauauucuuguu

SEQ ID NO: 427913 - RNA, 20 nt, Human
auguagaugaaagcaaaggc

SEQ ID NO: 427914 - RNA, 22 nt, Human
aagagcuggucacagguccauu

SEQ ID NO: 427915 - RNA, 22 nt, Human
uccaggcagcccuuccugacuc

SEQ ID NO: 427916 - RNA, 22 nt, Human
ugcagccaccaccucugcugaa

SEQ ID NO: 427917 - RNA, 22 nt, Human
agugaccaaucaugguuagauu

SEQ ID NO: 427918 - RNA, 21 nt, Human
aggugggagaccauguagguc

SEQ ID NO: 427919 - RNA, 22 nt, Human
cucacaggcaucucaucaggcu

SEQ ID NO: 427920 - RNA, 20 nt, Human
uucauucauuccacaacuuc

SEQ ID NO: 427921 - RNA, 22 nt, Human
aauauaaauuccugggcccagc

SEQ ID NO: 427922 - RNA, 22 nt, Human
gaggcuggugguuaguuccauu

SEQ ID NO: 427923 - RNA, 22 nt, Human
ggcuggagugggcuccagaguu

SEQ ID NO: 427924 - RNA, 22 nt, Human
cuuuguuuauauuucuccucga

SEQ ID NO: 427925 - RNA, 22 nt, Human
ucaaagucuaucuguaauuacu

SEQ ID NO: 427926 - RNA, 22 nt, Human
uggagccaugccuggccuuucc

SEQ ID NO: 427927 - RNA, 22 nt, Human
uauccuuguacuauaguauuua

SEQ ID NO: 427928 - RNA, 22 nt, Human
ugcuggcuacugauggcaggcc

SEQ ID NO: 427929 - RNA, 22 nt, Human
acaggcagggaccuuggcuaag

SEQ ID NO: 427930 - RNA, 22 nt, Human
cugggcuguucugccccugggu

SEQ ID NO: 427931 - RNA, 22 nt, Human
aagaaaguggguaauaugauuu

SEQ ID NO: 427932 - RNA, 22 nt, Human
gcaaggacucccugggucauuc

SEQ ID NO: 427933 - RNA, 22 nt, Human
cugagccaguagucagggacaa

SEQ ID NO: 427934 - RNA, 22 nt, Human
acucaggaagaaagcagcuggu

SEQ ID NO: 427935 - RNA, 22 nt, Human
agcugcaggccucuccugggga

SEQ ID NO: 427936 - RNA, 22 nt, Human
aggcaggcaaccaccugggaag

SEQ ID NO: 427937 - RNA, 22 nt, Human
cugagaaggaagccuccacucu

SEQ ID NO: 427938 - RNA, 22 nt, Human
cauuacaugguccaggauauau

SEQ ID NO: 427939 - RNA, 22 nt, Human
ccuggaaguuggagguugcagu

SEQ ID NO: 427940 - RNA, 22 nt, Human
gaggccacagcuaucagggaca

SEQ ID NO: 427941 - RNA, 22 nt, Human
gcccucagcuccuggacacaug

SEQ ID NO: 427942 - RNA, 22 nt, Human
gagucugaugucccccaggcca

SEQ ID NO: 427943 - RNA, 20 nt, Human
acaugaaaggaaacaggaaa

SEQ ID NO: 427944 - RNA, 22 nt, Human
aggcaggggagcuggaagggua

SEQ ID NO: 427945 - RNA, 23 nt, Human
ggagugcaauggcgccaucucgg

SEQ ID NO: 427946 - RNA, 22 nt, Human
cagugagggcauucagugcugg

SEQ ID NO: 427947 - RNA, 22 nt, Human
uuuaaauaggacuccugggggu

SEQ ID NO: 427948 - RNA, 22 nt, Human
uaaggguucagaaugcaguggu

SEQ ID NO: 427949 - RNA, 22 nt, Human
cccaugccuucugacucacagg

SEQ ID NO: 427950 - RNA, 22 nt, Human
uaaugaauaaacuugagaguca

SEQ ID NO: 427951 - RNA, 22 nt, Human
gccaaagcagucuugccucugc

SEQ ID NO: 427952 - RNA, 22 nt, Human
ucuggcuccguguccgcuccca

SEQ ID NO: 427953 - RNA, 22 nt, Human
ugcagcagcagggaggaggcuc

SEQ ID NO: 427954 - RNA, 22 nt, Human
uccucugccaaagggaguugcc

SEQ ID NO: 427955 - RNA, 21 nt, Human
ugggaugggucugggaccagc

SEQ ID NO: 427956 - RNA, 22 nt, Human
ccagagagauugcuucuaaaga

SEQ ID NO: 427957 - RNA, 22 nt, Human
caugcuuuaccaaagcagugau

SEQ ID NO: 427958 - RNA, 22 nt, Human
ucagcaaugugauacugugcaa

SEQ ID NO: 427959 - RNA, 22 nt, Human
ugccaggcgugguggugcgcac

SEQ ID NO: 427960 - RNA, 22 nt, Human
gcaggguauaauacuuagguga

SEQ ID NO: 427961 - RNA, 22 nt, Human
uucaggauccccuugaugggcu

SEQ ID NO: 427962 - RNA, 22 nt, Human
cugggcuucucccccuggcaga

SEQ ID NO: 427963 - RNA, 22 nt, Human
acaaggcugaacagugaagccg

SEQ ID NO: 427964 - RNA, 22 nt, Human
uugcauugaugucuauacgcug

SEQ ID NO: 427965 - RNA, 22 nt, Human
agcugcucuuugaaggacacuu

SEQ ID NO: 427966 - RNA, 22 nt, Human
uggccugggucacaccaggguc

SEQ ID NO: 427967 - RNA, 18 nt, Human
ggagccagucugucucug

SEQ ID NO: 427968 - RNA, 22 nt, Human
guagcccaccuggggagggcga

SEQ ID NO: 427969 - RNA, 22 nt, Human
caagaugccccugguagggauc

SEQ ID NO: 427970 - RNA, 22 nt, Human
agagcugagaauguggcuuccu

SEQ ID NO: 427971 - RNA, 22 nt, Human
uggagcugagaaguggagcucu

SEQ ID NO: 427972 - RNA, 22 nt, Human
uuuccuuccagguuccuaaggc

SEQ ID NO: 427973 - RNA, 22 nt, Human
gcugggaggaucucucccuguc

SEQ ID NO: 427974 - RNA, 22 nt, Human
agccccugggaguagcugcugc

SEQ ID NO: 427975 - RNA, 22 nt, Human
ccuggcuggcaagaucgugaag

SEQ ID NO: 427976 - RNA, 22 nt, Human
cuggguggcgucuggggccagu

SEQ ID NO: 427977 - RNA, 22 nt, Human
ccauguggugggaaggagaaug

SEQ ID NO: 427978 - RNA, 22 nt, Human
cugcuucuaagaaccugcagcu

SEQ ID NO: 427979 - RNA, 22 nt, Human
cacagcuuccauuagaaugaga

SEQ ID NO: 427980 - RNA, 22 nt, Human
ccagggcuggugggagaugcug

SEQ ID NO: 427981 - RNA, 22 nt, Human
uuaauuuucucaucugugaaau

SEQ ID NO: 427982 - RNA, 22 nt, Human
guaucuuuccacaucuucagua

SEQ ID NO: 427983 - RNA, 22 nt, Human
uauguacacacacaugcaugua

SEQ ID NO: 427984 - RNA, 22 nt, Human
agggcagcacaaggcauggacu

SEQ ID NO: 427985 - RNA, 22 nt, Human
uguaggauuuucaccagaccuu

SEQ ID NO: 427986 - RNA, 22 nt, Human
agcacagaguugcagagagcgu

SEQ ID NO: 427987 - RNA, 22 nt, Human
aagagagagcauucuucuguua

SEQ ID NO: 427988 - RNA, 22 nt, Human
ugagccagauaagggcucacgc

SEQ ID NO: 427989 - RNA, 22 nt, Human
agcugcucugauaaaccuacuu

SEQ ID NO: 427990 - RNA, 22 nt, Human
gaaagaggaaggagauguauua

SEQ ID NO: 427991 - RNA, 22 nt, Human
ucuggcucugaauucacuucug

SEQ ID NO: 427992 - RNA, 22 nt, Human
gagacaaaaguuggagugcaag

SEQ ID NO: 427993 - RNA, 22 nt, Human
cagcuggccugaucccuguggc

SEQ ID NO: 427994 - RNA, 22 nt, Human
cucaguuucugacauuaaaauc

SEQ ID NO: 427995 - RNA, 22 nt, Human
aaaaaaucagaucuuugguuaa

SEQ ID NO: 427996 - RNA, 22 nt, Human
aggguauaaagagcaagcagaa

SEQ ID NO: 427997 - RNA, 22 nt, Human
accacuguaucuccagcacauu

SEQ ID NO: 427998 - RNA, 22 nt, Human
gugcucuguguauuaggauguc

SEQ ID NO: 427999 - RNA, 18 nt, Human
gccugggaggaggaaaug

SEQ ID NO: 428000 - RNA, 22 nt, Human
ucaggggacuuaggagagaagu

SEQ ID NO: 428001 - RNA, 22 nt, Human
cucaggaguuggaggcuacagu

SEQ ID NO: 428002 - RNA, 22 nt, Human
uaugaagauauaucugaucucu

SEQ ID NO: 428003 - RNA, 20 nt, Human
aagagcugacucacaguggu

SEQ ID NO: 428004 - RNA, 22 nt, Human
ggcaggaggaagaguuagcacc

SEQ ID NO: 428005 - RNA, 22 nt, Human
agggcagcagcggcccaggccu

SEQ ID NO: 428006 - RNA, 19 nt, Human
gcucagagggcccugugcu

SEQ ID NO: 428007 - RNA, 22 nt, Human
cagggagcuggcuggcgugagu

SEQ ID NO: 428008 - RNA, 22 nt, Human
ucagagugaggcgucaacauga

SEQ ID NO: 428009 - RNA, 22 nt, Human
gagacagcagggccagggccug

SEQ ID NO: 428010 - RNA, 22 nt, Human
uccugcagagucccacugauuu

SEQ ID NO: 428011 - RNA, 23 nt, Human
gcauugucuccccacuucugggc

SEQ ID NO: 428012 - RNA, 18 nt, Human
ggaaaccacaggguucug

SEQ ID NO: 428013 - RNA, 22 nt, Human
gggaagcagcauugugcuggcu

SEQ ID NO: 428014 - RNA, 22 nt, Human
cauacauuuugcauauuuacca

SEQ ID NO: 428015 - RNA, 22 nt, Human
uuauuaaugaguacaaguuauu

SEQ ID NO: 428016 - RNA, 22 nt, Human
ucaccccuacauuucccuugcu

SEQ ID NO: 428017 - RNA, 22 nt, Human
caguugaugggacucauguggg

SEQ ID NO: 428018 - RNA, 22 nt, Human
ucugggcccuaaaccagcucua

SEQ ID NO: 428019 - RNA, 22 nt, Human
uaaguucaguuggucgaaguag

SEQ ID NO: 428020 - RNA, 22 nt, Human
aagccaggaagagagccuucac

SEQ ID NO: 428021 - RNA, 22 nt, Human
uaacugauauugaaaaacauca

SEQ ID NO: 428022 - RNA, 22 nt, Human
ugaggcaggaauggggaaaagu

SEQ ID NO: 428023 - RNA, 22 nt, Human
uacuuuuugucucuuugaaugu

SEQ ID NO: 428024 - RNA, 22 nt, Human
caguauguuugggagacaugac

SEQ ID NO: 428025 - RNA, 22 nt, Human
gcaccacaucaaugaggggagc

SEQ ID NO: 428026 - RNA, 22 nt, Human
uauagaagagacaugugcauag

SEQ ID NO: 428027 - RNA, 21 nt, Human
aggcagccagucaugcucccu

SEQ ID NO: 428028 - RNA, 22 nt, Human
cagcauggcuugaguguuuccu

SEQ ID NO: 428029 - RNA, 22 nt, Human
ucugaggcuaagagacagaggc

SEQ ID NO: 428030 - RNA, 20 nt, Human
ucagguagaucuuugagguc

SEQ ID NO: 428031 - RNA, 22 nt, Human
ucagcuuuccugcagcuaaggg

SEQ ID NO: 428032 - RNA, 22 nt, Human
gcacagaacuucucuuaguagg

SEQ ID NO: 428033 - RNA, 22 nt, Human
cgaggcagggaagcugcaaaag

SEQ ID NO: 428034 - RNA, 22 nt, Human
uagacacaagagaaggguauaa

SEQ ID NO: 428035 - RNA, 22 nt, Human
ccuggauucaagucuuucuuuc

SEQ ID NO: 428036 - RNA, 23 nt, Human
aggaggaaaaguuaucugcugag

SEQ ID NO: 428037 - RNA, 22 nt, Human
aagccagccagugccagucuua

SEQ ID NO: 428038 - RNA, 22 nt, Human
uccucugcucagcauuccucac

SEQ ID NO: 428039 - RNA, 22 nt, Human
ccaggacuuuaaguccagcacu

SEQ ID NO: 428040 - RNA, 22 nt, Human
uuagcugcauuaucaaaguuau

SEQ ID NO: 428041 - RNA, 22 nt, Human
gaggacaggagacucacuguuu

SEQ ID NO: 428042 - RNA, 22 nt, Human
cugggcagugcagcuauagaac

SEQ ID NO: 428043 - RNA, 22 nt, Human
ucagaagcauguggggagccug

SEQ ID NO: 428044 - RNA, 22 nt, Human
ugggcucugaagucagucugcu

SEQ ID NO: 428045 - RNA, 22 nt, Human
ggcugagcacuuuaggcaggag

SEQ ID NO: 428046 - RNA, 22 nt, Human
cagcaguggaacuacccaggga

SEQ ID NO: 428047 - RNA, 22 nt, Human
uggagcccagacacuggcauug

SEQ ID NO: 428048 - RNA, 22 nt, Human
gauggcagguaguggucucauc

SEQ ID NO: 428049 - RNA, 22 nt, Human
ugcuuuauucccuucugaugug

SEQ ID NO: 428050 - RNA, 22 nt, Human
gggccagguggaccccagccuc

SEQ ID NO: 428051 - RNA, 19 nt, Human
uccugcagaccagaccugu

SEQ ID NO: 428052 - RNA, 22 nt, Human
gcccauggcagaacugugagca

SEQ ID NO: 428053 - RNA, 22 nt, Human
ggggcagcuaccggaaguaggg

SEQ ID NO: 428054 - RNA, 22 nt, Human
caguggaauacgagcagauguc

SEQ ID NO: 428055 - RNA, 20 nt, Human
aacuuuagacauaaucucuu

SEQ ID NO: 428056 - RNA, 22 nt, Human
agcuucuguucaucuuccaggc

SEQ ID NO: 428057 - RNA, 22 nt, Human
acaaaugcagcauaaagugaac

SEQ ID NO: 428058 - RNA, 22 nt, Human
cccaguggagauaggagugugg

SEQ ID NO: 428059 - RNA, 22 nt, Human
cugaggucuagacaccccaggg

SEQ ID NO: 428060 - RNA, 22 nt, Human
cucugugccucaguuuucuucu

SEQ ID NO: 428061 - RNA, 21 nt, Human
uuuucccacugaaagcuccca

SEQ ID NO: 428062 - RNA, 22 nt, Human
caaugauugcuauuuacauaaa

SEQ ID NO: 428063 - RNA, 22 nt, Human
ccuucccuaaagcgucgcuuag

SEQ ID NO: 428064 - RNA, 22 nt, Human
cugaagcaaaggaucgagcuaa

SEQ ID NO: 428065 - RNA, 22 nt, Human
uagauuucaggcuggcuugcgg

SEQ ID NO: 428066 - RNA, 22 nt, Human
uucuuuuacauuaagauuucag

SEQ ID NO: 428067 - RNA, 22 nt, Human
gaggccacgguuuuccuugggg

SEQ ID NO: 428068 - RNA, 22 nt, Human
ccagagagggcgccaccuggag

SEQ ID NO: 428069 - RNA, 22 nt, Human
ccacagggaacaugacagccuu

SEQ ID NO: 428070 - RNA, 22 nt, Human
ucuggccauggcaagccgagug

SEQ ID NO: 428071 - RNA, 22 nt, Human
cacugaaggcugcagcucagcc

SEQ ID NO: 428072 - RNA, 22 nt, Human
uccaggcugggcugaagggugc

SEQ ID NO: 428073 - RNA, 22 nt, Human
aaguuugagagccuuuaguaua

SEQ ID NO: 428074 - RNA, 22 nt, Human
agcgggugcugugucagcccuc

SEQ ID NO: 428075 - RNA, 22 nt, Human
ucuggcugcugcgugagugcuu

SEQ ID NO: 428076 - RNA, 22 nt, Human
uuucuacauucaaaaacuacca

SEQ ID NO: 428077 - RNA, 22 nt, Human
agggugccugcugcagguucag

SEQ ID NO: 428078 - RNA, 22 nt, Human
ccagagagguagcuuacccucu

SEQ ID NO: 428079 - RNA, 22 nt, Human
gcugcucuuuucagagaugaga

SEQ ID NO: 428080 - RNA, 22 nt, Human
uccagccaagccuugguagcug

SEQ ID NO: 428081 - RNA, 22 nt, Human
cagcaggcugcgauugcucauu

SEQ ID NO: 428082 - RNA, 22 nt, Human
uguacaugugucuguauaucuu

SEQ ID NO: 428083 - RNA, 22 nt, Human
cccaggaggucgaagcugcagu

SEQ ID NO: 428084 - RNA, 22 nt, Human
ccuccuagaggaaccccagggc

SEQ ID NO: 428085 - RNA, 22 nt, Human
cccagaaggucgaggcugcagu

SEQ ID NO: 428086 - RNA, 22 nt, Human
guggcagugugaggauccugcu

SEQ ID NO: 428087 - RNA, 22 nt, Human
gggcagcugccaagugcaucgc

SEQ ID NO: 428088 - RNA, 22 nt, Human
agcugcagagguuugugcaaca

SEQ ID NO: 428089 - RNA, 22 nt, Human
gcugggagugggcaagaugaga

SEQ ID NO: 428090 - RNA, 22 nt, Human
aggcugucucaccucaggaggg

SEQ ID NO: 428091 - RNA, 22 nt, Human
gggcaugccugcgcagugcaug

SEQ ID NO: 428092 - RNA, 22 nt, Human
cagggcugagaauuuagagaca

SEQ ID NO: 428093 - RNA, 22 nt, Human
cacauguacagaagcaggcugg

SEQ ID NO: 428094 - RNA, 22 nt, Human
ggcaggcaggucuucauggccc

SEQ ID NO: 428095 - RNA, 22 nt, Human
ccaggagcagauauggacauaa

SEQ ID NO: 428096 - RNA, 22 nt, Human
gcagccagaagacucagaacaa

SEQ ID NO: 428097 - RNA, 22 nt, Human
agcagcugccagagagaguucc

SEQ ID NO: 428098 - RNA, 22 nt, Human
aaaguucucuaugguguaaaaa

SEQ ID NO: 428099 - RNA, 22 nt, Human
cgcaccacugaauuccagccug

SEQ ID NO: 428100 - RNA, 22 nt, Human
uccagggcuuggcugggacggu

SEQ ID NO: 428101 - RNA, 21 nt, Human
gcucucugcaugguggcucag

SEQ ID NO: 428102 - RNA, 22 nt, Human
aucaaaguccaucagaagguag

SEQ ID NO: 428103 - RNA, 22 nt, Human
guagggacccacagucuauauu

SEQ ID NO: 428104 - RNA, 22 nt, Human
ggagcacuauaauagagauuuu

SEQ ID NO: 428105 - RNA, 20 nt, Human
uacauucaaaacaaacucug

SEQ ID NO: 428106 - RNA, 22 nt, Human
cagcaauaaugucuacaaaucu

SEQ ID NO: 428107 - RNA, 22 nt, Human
uguucccauuuucugcauaauc

SEQ ID NO: 428108 - RNA, 22 nt, Human
ucuaccacuuauuagcucugug

SEQ ID NO: 428109 - RNA, 22 nt, Human
uacaguaaccuuauuugucauu

SEQ ID NO: 428110 - RNA, 21 nt, Human
aacugcuggucuuuucugucu

SEQ ID NO: 428111 - RNA, 22 nt, Human
caagcuggaguuccucagagug

SEQ ID NO: 428112 - RNA, 22 nt, Human
uggcagcaguagccaccccagc

SEQ ID NO: 428113 - RNA, 22 nt, Human
gaggccaggagugcuguaaguu

SEQ ID NO: 428114 - RNA, 20 nt, Human
ccugggcuccaggagccccg

SEQ ID NO: 428115 - RNA, 22 nt, Human
ggcagcugaccuagcaccaucc

SEQ ID NO: 428116 - RNA, 22 nt, Human
gcuggccugggcagccugucgg

SEQ ID NO: 428117 - RNA, 22 nt, Human
guuagaaacacauucuuauuga

SEQ ID NO: 428118 - RNA, 22 nt, Human
ucagaggagaugguuaccaggg

SEQ ID NO: 428119 - RNA, 22 nt, Human
agggcugguauguccaugaaag

SEQ ID NO: 428120 - RNA, 22 nt, Human
ggcagaguugguggagucaguu

SEQ ID NO: 428121 - RNA, 22 nt, Human
guacauuggcaacucucuuaga

SEQ ID NO: 428122 - RNA, 22 nt, Human
gcucuugucaaaaauuaguuga

SEQ ID NO: 428123 - RNA, 22 nt, Human
gagaaccucuccacaagucugg

SEQ ID NO: 428124 - RNA, 22 nt, Human
uccagugguaguaaagaggucu

SEQ ID NO: 428125 - RNA, 20 nt, Human
ucagggcaugggacagcccc

SEQ ID NO: 428126 - RNA, 22 nt, Human
gcagggcagaaggugcugagga

SEQ ID NO: 428127 - RNA, 22 nt, Human
gagcugccugugugccaugaug

SEQ ID NO: 428128 - RNA, 19 nt, Human
ccaggccucuggggccugu

SEQ ID NO: 428129 - RNA, 17 nt, Human
ucugucuugacugucac

SEQ ID NO: 428130 - RNA, 22 nt, Human
uccucacauggugagccacaca

SEQ ID NO: 428131 - RNA, 20 nt, Human
uacuugaauguugcagcagu

SEQ ID NO: 428132 - RNA, 22 nt, Human
cugggcuguaauguggcacuga

SEQ ID NO: 428133 - RNA, 22 nt, Human
acaguaauaaguguuggugagg

SEQ ID NO: 428134 - RNA, 22 nt, Human
uagugaaacaguuaucaaucug

SEQ ID NO: 428135 - RNA, 22 nt, Human
ugagccagaggaggcugugugg

SEQ ID NO: 428136 - RNA, 22 nt, Human
cuagaaauauuuuacagucaag

SEQ ID NO: 428137 - RNA, 21 nt, Human
aaggagccuaggaggcucagg

SEQ ID NO: 428138 - RNA, 22 nt, Human
gccaggcaggccacgcuguguu

SEQ ID NO: 428139 - RNA, 22 nt, Human
auguacauuuguaguaauauca

SEQ ID NO: 428140 - RNA, 22 nt, Human
gaagcagcucagauugacugaa

SEQ ID NO: 428141 - RNA, 22 nt, Human
uggcugaauaauauucuguugu

SEQ ID NO: 428142 - RNA, 22 nt, Human
cugccagccaggccagguaggc

SEQ ID NO: 428143 - RNA, 22 nt, Human
agccccacacucucucugagaa

SEQ ID NO: 428144 - RNA, 22 nt, Human
gaggccugggagccuguccucc

SEQ ID NO: 428145 - RNA, 22 nt, Human
gcaggaaagguugagacuuugc

SEQ ID NO: 428146 - RNA, 22 nt, Human
cccaggcuggauuucgguggca

SEQ ID NO: 428147 - RNA, 22 nt, Human
cucucugguacauagaguuugg

SEQ ID NO: 428148 - RNA, 22 nt, Human
uguauacaggauuacucauagc

SEQ ID NO: 428149 - RNA, 22 nt, Human
ugggcagagaguagaggcaacg

SEQ ID NO: 428150 - RNA, 22 nt, Human
agcaguggagcgagauguuuaa

SEQ ID NO: 428151 - RNA, 22 nt, Human
aggucauuuccuuagaggcaga

SEQ ID NO: 428152 - RNA, 22 nt, Human
aucaggauucaguaucuccagc

SEQ ID NO: 428153 - RNA, 22 nt, Human
uacauuaacuuacguccacaug

SEQ ID NO: 428154 - RNA, 22 nt, Human
agcucugggccaggaacccuaa

SEQ ID NO: 428155 - RNA, 22 nt, Human
aucuuugaagaggacuugaagu

SEQ ID NO: 428156 - RNA, 22 nt, Human
cccaguccuaaagcagacgcca

SEQ ID NO: 428157 - RNA, 22 nt, Human
gcaggaugggagcuucacuuug

SEQ ID NO: 428158 - RNA, 22 nt, Human
cggcugagacggccauagacac

SEQ ID NO: 428159 - RNA, 22 nt, Human
caggguggaauggaaugcuggc

SEQ ID NO: 428160 - RNA, 20 nt, Human
agguggcuccugcugggggu

SEQ ID NO: 428161 - RNA, 22 nt, Human
cugcagcuauauuuucccacag

SEQ ID NO: 428162 - RNA, 22 nt, Human
uucuuguauauaaaaaucauuu

SEQ ID NO: 428163 - RNA, 22 nt, Human
agagaaaacucauugagguguc

SEQ ID NO: 428164 - RNA, 22 nt, Human
uccaugugccaaggggcagagg

SEQ ID NO: 428165 - RNA, 22 nt, Human
aggcaggcucaggcccaugcuu

SEQ ID NO: 428166 - RNA, 22 nt, Human
cagcaagauuuuuaaagcaagg

SEQ ID NO: 428167 - RNA, 22 nt, Human
uguggccuggaaggggcugcuc

SEQ ID NO: 428168 - RNA, 22 nt, Human
uucauucccuuauauuagcauu

SEQ ID NO: 428169 - RNA, 22 nt, Human
ugcauacacaagcauacaugua

SEQ ID NO: 428170 - RNA, 22 nt, Human
ccugccugcguccucugagggc

SEQ ID NO: 428171 - RNA, 20 nt, Human
ccagagcugauggcugcccg

SEQ ID NO: 428172 - RNA, 22 nt, Human
uggcacugaccccaggccugug

SEQ ID NO: 428173 - RNA, 22 nt, Human
gguagcagggcugugagucaga

SEQ ID NO: 428174 - RNA, 22 nt, Human
cccagggucccugcucucugug

SEQ ID NO: 428175 - RNA, 22 nt, Human
aagggcucccaacucaucuuuu

SEQ ID NO: 428176 - RNA, 22 nt, Human
ugcuuuauaacuuaguuuaugg

SEQ ID NO: 428177 - RNA, 22 nt, Human
aaaugugucauauucaaaguca

SEQ ID NO: 428178 - RNA, 22 nt, Human
uuaaugcagaaaucaaacugac

SEQ ID NO: 428179 - RNA, 22 nt, Human
agucaacaaaaauguggagccu

SEQ ID NO: 428180 - RNA, 22 nt, Human
ccacagggugucaucagcuuga

SEQ ID NO: 428181 - RNA, 22 nt, Human
auugaaaguccuaucuaaggga

SEQ ID NO: 428182 - RNA, 22 nt, Human
gggucucucucggcuccacgcg

SEQ ID NO: 428183 - RNA, 22 nt, Human
ggguguccugugccaagcuggg

SEQ ID NO: 428184 - RNA, 22 nt, Human
agcagagccagaauuggaccag

SEQ ID NO: 428185 - RNA, 22 nt, Human
acuuccugcaaucguccacucc

SEQ ID NO: 428186 - RNA, 22 nt, Human
acaggugauucaggcucuggga

SEQ ID NO: 428187 - RNA, 22 nt, Human
ggaugcugggagacagcaggca

SEQ ID NO: 428188 - RNA, 22 nt, Human
aauguguacaugacagauagaa

SEQ ID NO: 428189 - RNA, 22 nt, Human
ccuggccucagacagagggugg

SEQ ID NO: 428190 - RNA, 22 nt, Human
cugccucugcgucccacagagu

SEQ ID NO: 428191 - RNA, 21 nt, Human
aggcucagagaucaaacagua

SEQ ID NO: 428192 - RNA, 22 nt, Human
gcaaaaacugcaauuacuuuug

SEQ ID NO: 428193 - RNA, 22 nt, Human
gugugcaguagagaaagagcag

SEQ ID NO: 428194 - RNA, 22 nt, Human
ggcucagaccucccagcuccag

SEQ ID NO: 428195 - RNA, 22 nt, Human
cauauuucagucuaagaugugu

SEQ ID NO: 428196 - RNA, 22 nt, Human
ggggcagggagguuaucgccga

SEQ ID NO: 428197 - RNA, 22 nt, Human
ggcugccuugacccuggcuccg

SEQ ID NO: 428198 - RNA, 22 nt, Human
ugguuacacagcauguggacuu

SEQ ID NO: 428199 - RNA, 22 nt, Human
ggcaggagaauggcgugaacuc

SEQ ID NO: 428200 - RNA, 22 nt, Human
cauuuguuuagaagucuuuaua

SEQ ID NO: 428201 - RNA, 22 nt, Human
gcaccugggcaaggauucagag

SEQ ID NO: 428202 - RNA, 22 nt, Human
aaagaacagauguguggugcau

SEQ ID NO: 428203 - RNA, 22 nt, Human
gagggcugccacguugggcgag

SEQ ID NO: 428204 - RNA, 22 nt, Human
auguaacauugaauuauauagu

SEQ ID NO: 428205 - RNA, 22 nt, Human
uucccaugccuggccccuaucc

SEQ ID NO: 428206 - RNA, 22 nt, Human
aggcagcccacaggacacagga

SEQ ID NO: 428207 - RNA, 21 nt, Human
ucucacaauaugaugccagau

SEQ ID NO: 428208 - RNA, 21 nt, Human
ugcugccaucaugcagagaug

SEQ ID NO: 428209 - RNA, 22 nt, Human
uccagucaagcuugagaauuuc

SEQ ID NO: 428210 - RNA, 22 nt, Human
uggcagcaaaaccagaaucaga

SEQ ID NO: 428211 - RNA, 22 nt, Human
acaaaugcuuaguucaccaaaa

SEQ ID NO: 428212 - RNA, 22 nt, Human
ccagaagacaagaauguucuua

SEQ ID NO: 428213 - RNA, 22 nt, Human
gccuuugcaccaucagugcaau

SEQ ID NO: 428214 - RNA, 22 nt, Human
gcguccagggaaggcccagcug

SEQ ID NO: 428215 - RNA, 23 nt, Human
cagugugacgaggugaggcaggc

SEQ ID NO: 428216 - RNA, 22 nt, Human
ugaagcaggaaccagcagcauu

SEQ ID NO: 428217 - RNA, 22 nt, Human
uucuccgcuaaguucucugcag

SEQ ID NO: 428218 - RNA, 22 nt, Human
uauaauuuggggaaaguggugu

SEQ ID NO: 428219 - RNA, 22 nt, Human
cagggcacggagaagucacccc

SEQ ID NO: 428220 - RNA, 22 nt, Human
aagauucucagagugaaagaau

SEQ ID NO: 428221 - RNA, 22 nt, Human
aaguucaaggcagguccugagg

SEQ ID NO: 428222 - RNA, 22 nt, Human
uggggcucaccuaggcuggaag

SEQ ID NO: 428223 - RNA, 22 nt, Human
cccagcauccucagggagcggg

SEQ ID NO: 428224 - RNA, 20 nt, Human
gcugaagauucccaugcaag

SEQ ID NO: 428225 - RNA, 22 nt, Human
cuuuucauuguuuguacaugca

SEQ ID NO: 428226 - RNA, 22 nt, Human
gaggagaaauuuggggaccuga

SEQ ID NO: 428227 - RNA, 22 nt, Human
auaugaagucagacaaacuggg

SEQ ID NO: 428228 - RNA, 22 nt, Human
ccaaagucugcauuuuaacaug

SEQ ID NO: 428229 - RNA, 22 nt, Human
gggcugcuuuuuucuuagcaga

SEQ ID NO: 428230 - RNA, 22 nt, Human
cagggcugaagaaauucaaaag

SEQ ID NO: 428231 - RNA, 23 nt, Human
ggaaagagaggaguugugcauag

SEQ ID NO: 428232 - RNA, 22 nt, Human
cugccugugugugccugcagaa

SEQ ID NO: 428233 - RNA, 22 nt, Human
uugucccaggacuugcauagau

SEQ ID NO: 428234 - RNA, 22 nt, Human
uucuaguuuucaguccaccagg

SEQ ID NO: 428235 - RNA, 22 nt, Human
ggcuggcacucuguccaguguc

SEQ ID NO: 428236 - RNA, 22 nt, Human
caggagugagaugcgaucacuu

SEQ ID NO: 428237 - RNA, 22 nt, Human
aucaggaucugggagccugaaa

SEQ ID NO: 428238 - RNA, 22 nt, Human
aggcagcauuucugcuuaucca

SEQ ID NO: 428239 - RNA, 22 nt, Human
uggaagccaggcccgcuccuaa

SEQ ID NO: 428240 - RNA, 22 nt, Human
ggccuggccuccagaugugggc

SEQ ID NO: 428241 - RNA, 22 nt, Human
augucccaagauacagcuagag

SEQ ID NO: 428242 - RNA, 19 nt, Human
ccuggguccacucagacua

SEQ ID NO: 428243 - RNA, 22 nt, Human
gaaaauuauugaaaauggcucu

SEQ ID NO: 428244 - RNA, 22 nt, Human
agggccugucagcgguguccug

SEQ ID NO: 428245 - RNA, 22 nt, Human
uucuugcaggucacucacugag

SEQ ID NO: 428246 - RNA, 22 nt, Human
accccaagacaguagaagagaa

SEQ ID NO: 428247 - RNA, 22 nt, Human
uggagcuggaauuucugggccu

SEQ ID NO: 428248 - RNA, 22 nt, Human
acagugugugcuuucccuuacg

SEQ ID NO: 428249 - RNA, 22 nt, Human
ccagggugaccagcuggccuag

SEQ ID NO: 428250 - RNA, 22 nt, Human
gcagagaccccgcagugaggcc

SEQ ID NO: 428251 - RNA, 22 nt, Human
ugugaagcuggauccuggagcu

SEQ ID NO: 428252 - RNA, 22 nt, Human
ugaccugcagucaagaggggaa

SEQ ID NO: 428253 - RNA, 22 nt, Human
gccagcugcuggaacagcgcga

SEQ ID NO: 428254 - RNA, 22 nt, Human
auugucuucuggucuuaucuuu

SEQ ID NO: 428255 - RNA, 22 nt, Human
agaacagcaguuaugguucauu

SEQ ID NO: 428256 - RNA, 22 nt, Human
ccaggcagccaagugugugugu

SEQ ID NO: 428257 - RNA, 22 nt, Human
gaggaagccccauugaagccag

SEQ ID NO: 428258 - RNA, 22 nt, Human
agaagccaacagggcaggagag

SEQ ID NO: 428259 - RNA, 17 nt, Human
cagacagauauccuggg

SEQ ID NO: 428260 - RNA, 22 nt, Human
cucuucagauaaaagggauauu

SEQ ID NO: 428261 - RNA, 23 nt, Human
ccuccugggcacaggccugaugg

SEQ ID NO: 428262 - RNA, 22 nt, Human
uaauguguugaauauuuguaca

SEQ ID NO: 428263 - RNA, 22 nt, Human
aggaggggcaaugauagucugg

SEQ ID NO: 428264 - RNA, 22 nt, Human
ugggagcaagcuggugcuggag

SEQ ID NO: 428265 - RNA, 22 nt, Human
cuguaaauaugaagaauauaug

SEQ ID NO: 428266 - RNA, 22 nt, Human
uuucacaaacugaggagacaau

SEQ ID NO: 428267 - RNA, 23 nt, Human
agcagcaaaaauuuaucuuucug

SEQ ID NO: 428268 - RNA, 20 nt, Human
uauaacaguguugggugugu

SEQ ID NO: 428269 - RNA, 22 nt, Human
gcccagccuccaagcuccaagg

SEQ ID NO: 428270 - RNA, 22 nt, Human
auuagggcuggaugcaaggaaa

SEQ ID NO: 428271 - RNA, 22 nt, Human
aaggagaguacaggaguuggua

SEQ ID NO: 428272 - RNA, 22 nt, Human
accugcagccacuucucuccuu

SEQ ID NO: 428273 - RNA, 20 nt, Human
ucaggcaguggggaaaggca

SEQ ID NO: 428274 - RNA, 22 nt, Human
gguggccucugcaggccucgac

SEQ ID NO: 428275 - RNA, 22 nt, Human
cuaaaauuaucaagauaauucc

SEQ ID NO: 428276 - RNA, 22 nt, Human
ggcagugaacagaaaugcagaa

SEQ ID NO: 428277 - RNA, 19 nt, Human
uccaggcauccuucaggcu

SEQ ID NO: 428278 - RNA, 22 nt, Human
gcagccccaggagacgcccagg

SEQ ID NO: 428279 - RNA, 20 nt, Human
gaggcugcggacugcuggac

SEQ ID NO: 428280 - RNA, 22 nt, Human
uagaaaugcaguguacuguguc

SEQ ID NO: 428281 - RNA, 22 nt, Human
ugcaggcuuuagccccauggcu

SEQ ID NO: 428282 - RNA, 22 nt, Human
gguuggaggugggaauagcuag

SEQ ID NO: 428283 - RNA, 22 nt, Human
ggagcagacauaaccuuacaga

SEQ ID NO: 428284 - RNA, 22 nt, Human
cuggguggaucgcagccccagg

SEQ ID NO: 428285 - RNA, 22 nt, Human
aggagcagcccacuccuguccu

SEQ ID NO: 428286 - RNA, 22 nt, Human
auuauuaggacuacugggguug

SEQ ID NO: 428287 - RNA, 22 nt, Human
caucuggcuagcuaucauugug

SEQ ID NO: 428288 - RNA, 20 nt, Human
ccaccuggccaaggcugugc

SEQ ID NO: 428289 - RNA, 19 nt, Human
agccuggcuuugcucugcu

SEQ ID NO: 428290 - RNA, 22 nt, Human
uggcuucagacuucugcuacgu

SEQ ID NO: 428291 - RNA, 22 nt, Human
caggcagcugacugucagauau

SEQ ID NO: 428292 - RNA, 22 nt, Human
gcagauggugccaugucuugug

SEQ ID NO: 428293 - RNA, 20 nt, Human
ccacaggaguccagucgacc

SEQ ID NO: 428294 - RNA, 22 nt, Human
gggcugagucaucuggggccuc

SEQ ID NO: 428295 - RNA, 22 nt, Human
uuacuucuuacaaaagaaauau

SEQ ID NO: 428296 - RNA, 21 nt, Human
cgggcuggccgggcccucacc

SEQ ID NO: 428297 - RNA, 22 nt, Human
ggcuuuauuauguggccaugug

SEQ ID NO: 428298 - RNA, 22 nt, Human
ugcuggagaggaaggugggguc

SEQ ID NO: 428299 - RNA, 22 nt, Human
aauaguguuguucacucaggag

SEQ ID NO: 428300 - RNA, 22 nt, Human
cacagcuggugacagagcccag

SEQ ID NO: 428301 - RNA, 22 nt, Human
acugccaaugguaguuugaugg

SEQ ID NO: 428302 - RNA, 22 nt, Human
uccaguggugguuugaagggca

SEQ ID NO: 428303 - RNA, 22 nt, Human
cauacuuuugcccugacauucu

SEQ ID NO: 428304 - RNA, 22 nt, Human
uacaagaugacaggugcaugau

SEQ ID NO: 428305 - RNA, 22 nt, Human
cuguggcauugccgaggcuggc

SEQ ID NO: 428306 - RNA, 22 nt, Human
ugguggccuugauggcaucugc

SEQ ID NO: 428307 - RNA, 22 nt, Human
ugucccagaucacaggagggga

SEQ ID NO: 428308 - RNA, 22 nt, Human
acuccuggggcugccaucacag

SEQ ID NO: 428309 - RNA, 22 nt, Human
acugucuuccaggucuggaggu

SEQ ID NO: 428310 - RNA, 22 nt, Human
auuuuuccaauuaggauaaaga

SEQ ID NO: 428311 - RNA, 20 nt, Human
gggcuggcgcauggggaaag

SEQ ID NO: 428312 - RNA, 22 nt, Human
acaguggaggccauaugguccu

SEQ ID NO: 428313 - RNA, 22 nt, Human
aggcugaggcuuuccuuggaga

SEQ ID NO: 428314 - RNA, 22 nt, Human
aacuagaaaacaagaugcugau

SEQ ID NO: 428315 - RNA, 22 nt, Human
auuucuacaguacacaugcauu

SEQ ID NO: 428316 - RNA, 22 nt, Human
ucaucacauguguagucauccc

SEQ ID NO: 428317 - RNA, 22 nt, Human
uacacauguuuggcaaguaugu

SEQ ID NO: 428318 - RNA, 22 nt, Human
gggcugacucugcacugagcca

SEQ ID NO: 428319 - RNA, 22 nt, Human
agugugaguaauucagggaggg

SEQ ID NO: 428320 - RNA, 22 nt, Human
acuggcagccacaacuggcagg

SEQ ID NO: 428321 - RNA, 22 nt, Human
acugucuuguguuaaagaacca

SEQ ID NO: 428322 - RNA, 22 nt, Human
gggcugagugaccucaggccaa

SEQ ID NO: 428323 - RNA, 22 nt, Human
auacaucuuccuuuuaaaaugc

SEQ ID NO: 428324 - RNA, 22 nt, Human
ccagagccggauugugaagugc

SEQ ID NO: 428325 - RNA, 20 nt, Human
cccaggagugagcagcuuua

SEQ ID NO: 428326 - RNA, 22 nt, Human
ggugggcaggcgaggcccaggu

SEQ ID NO: 428327 - RNA, 22 nt, Human
ccaggccugcaucugcugcgca

SEQ ID NO: 428328 - RNA, 22 nt, Human
ugaguucuaguggcugcagauu

SEQ ID NO: 428329 - RNA, 22 nt, Human
gaaucucaaggcuugugaggau

SEQ ID NO: 428330 - RNA, 22 nt, Human
gacaagacuauguagaaaguau

SEQ ID NO: 428331 - RNA, 22 nt, Human
uugcaucuagggcaacccagag

SEQ ID NO: 428332 - RNA, 22 nt, Human
gccuuucaguuccaucaaagga

SEQ ID NO: 428333 - RNA, 23 nt, Human
uugauacagaagaaucaguuugu

SEQ ID NO: 428334 - RNA, 22 nt, Human
cagaccagaaggaagccgacaa

SEQ ID NO: 428335 - RNA, 22 nt, Human
ucuggccugaaaguccaugcuu

SEQ ID NO: 428336 - RNA, 22 nt, Human
cugagccacugcuuguucagug

SEQ ID NO: 428337 - RNA, 18 nt, Human
acauuucuaggugaaagc

SEQ ID NO: 428338 - RNA, 22 nt, Human
gcugugcaguaguagguacagu

SEQ ID NO: 428339 - RNA, 22 nt, Human
ugugugcagccucugucuuugg

SEQ ID NO: 428340 - RNA, 22 nt, Human
aagucauuaucucuucuaaucu

SEQ ID NO: 428341 - RNA, 22 nt, Human
aaaggucagcugccaucguucu

SEQ ID NO: 428342 - RNA, 22 nt, Human
guucucucugcuuccaagaugg

SEQ ID NO: 428343 - RNA, 17 nt, Human
accagccucuccugggg

SEQ ID NO: 428344 - RNA, 22 nt, Human
aguaauaauuuauauuagggag

SEQ ID NO: 428345 - RNA, 22 nt, Human
caggaacacaaugagucucaaa

SEQ ID NO: 428346 - RNA, 22 nt, Human
aaaugcagauugucauucagga

SEQ ID NO: 428347 - RNA, 20 nt, Human
gagauuuccaaucaugccca

SEQ ID NO: 428348 - RNA, 21 nt, Human
aagcaggacauaugaugcccu

SEQ ID NO: 428349 - RNA, 22 nt, Human
ugaggcaggaguucaggcugcg

SEQ ID NO: 428350 - RNA, 22 nt, Human
ugcugccucagcuuccugggcu

SEQ ID NO: 428351 - RNA, 19 nt, Human
uagucuuuauucuuaauuu

SEQ ID NO: 428352 - RNA, 22 nt, Human
aggggccucgcaggaccgcucc

SEQ ID NO: 428353 - RNA, 17 nt, Human
cccagagaugcugccuu

SEQ ID NO: 428354 - RNA, 22 nt, Human
uaagaacagugacagccaacau

SEQ ID NO: 428355 - RNA, 22 nt, Human
ugcagccaauucauucauucuu

SEQ ID NO: 428356 - RNA, 22 nt, Human
agcugagcuaguaguuccagug

SEQ ID NO: 428357 - RNA, 22 nt, Human
augcacccagugucuggacuau

SEQ ID NO: 428358 - RNA, 22 nt, Human
uacaugcuccacuuucuccugu

SEQ ID NO: 428359 - RNA, 22 nt, Human
caguggcgugaucucugcucac

SEQ ID NO: 428360 - RNA, 22 nt, Human
ggcagcucaccucugguccagg

SEQ ID NO: 428361 - RNA, 22 nt, Human
aaacuagagcaugugaguggga

SEQ ID NO: 428362 - RNA, 22 nt, Human
aaaaugaauaaguuaacccagg

SEQ ID NO: 428363 - RNA, 22 nt, Human
ucacugcagacaaccucaguca

SEQ ID NO: 428364 - RNA, 22 nt, Human
cccucugcugccuggcuggguc

SEQ ID NO: 428365 - RNA, 22 nt, Human
cugcagggcagggccuccuggc

SEQ ID NO: 428366 - RNA, 22 nt, Human
uuuuugaaggcugaugugauua

SEQ ID NO: 428367 - RNA, 22 nt, Human
gggauggggagcuggaaagggg

SEQ ID NO: 428368 - RNA, 22 nt, Human
cugcagagcuaggcugagugaa

SEQ ID NO: 428369 - RNA, 22 nt, Human
aaguccagcucuaaauaucuga

SEQ ID NO: 428370 - RNA, 22 nt, Human
ccuggcagguggcgcccucggc

SEQ ID NO: 428371 - RNA, 22 nt, Human
ugagccugguugcagugucugg

SEQ ID NO: 428372 - RNA, 18 nt, Human
ugcucuguuuaaugauuu

SEQ ID NO: 428373 - RNA, 22 nt, Human
aagacuguaugagacaauauaa

SEQ ID NO: 428374 - RNA, 22 nt, Human
aaaggccacugcaagggaaggu

SEQ ID NO: 428375 - RNA, 22 nt, Human
agggggcaucagguccuggcuc

SEQ ID NO: 428376 - RNA, 23 nt, Human
acuuaaaugguucuuuaucucag

SEQ ID NO: 428377 - RNA, 22 nt, Human
agcagggcaugaauaaggguuu

SEQ ID NO: 428378 - RNA, 19 nt, Human
caggccagugucagggggc

SEQ ID NO: 428379 - RNA, 23 nt, Human
ugucauugugacuacagaaccag

SEQ ID NO: 428380 - RNA, 22 nt, Human
cugcugggaaggucugcucagu

SEQ ID NO: 428381 - RNA, 22 nt, Human
ccaccagcuucagcagccgcgg

SEQ ID NO: 428382 - RNA, 22 nt, Human
ucagaggagggacucagaccca

SEQ ID NO: 428383 - RNA, 22 nt, Human
uuuuauuggagugauaccaagc

SEQ ID NO: 428384 - RNA, 22 nt, Human
uacauugugauguuucaauaca

SEQ ID NO: 428385 - RNA, 19 nt, Human
caaggccaccauuucuccg

SEQ ID NO: 428386 - RNA, 22 nt, Human
ggucucagacuggcaggcagug

SEQ ID NO: 428387 - RNA, 22 nt, Human
caggggcucugagauugucuaa

SEQ ID NO: 428388 - RNA, 22 nt, Human
caggagugucuccacacagcaa

SEQ ID NO: 428389 - RNA, 22 nt, Human
gcagugguccaguucacaccca

SEQ ID NO: 428390 - RNA, 22 nt, Human
ugucuccucauacugucauauu

SEQ ID NO: 428391 - RNA, 22 nt, Human
uauucacaguugauuuacaguu

SEQ ID NO: 428392 - RNA, 22 nt, Human
agggccugggccagcacccuuu

SEQ ID NO: 428393 - RNA, 22 nt, Human
cucccaggcacagggaggagcc

SEQ ID NO: 428394 - RNA, 22 nt, Human
cagggcucacucggcuggcguc

SEQ ID NO: 428395 - RNA, 22 nt, Human
aaaugucugagacuucugaacu

SEQ ID NO: 428396 - RNA, 22 nt, Human
cagcuuuccagagaccugcccc

SEQ ID NO: 428397 - RNA, 22 nt, Human
uuauacauguguuuugagauga

SEQ ID NO: 428398 - RNA, 22 nt, Human
ccagagugacgugaagugugaa

SEQ ID NO: 428399 - RNA, 22 nt, Human
ggucccaggcucccucuugucc

SEQ ID NO: 428400 - RNA, 19 nt, Human
gcgaggaagucacuguggu

SEQ ID NO: 428401 - RNA, 20 nt, Human
agaagcugauacugauggaa

SEQ ID NO: 428402 - RNA, 22 nt, Human
ggagcugaugacgucaccaugg

SEQ ID NO: 428403 - RNA, 22 nt, Human
ccaggcugggcuacaaguugag

SEQ ID NO: 428404 - RNA, 22 nt, Human
ucucacuuuccagacuuuucaa

SEQ ID NO: 428405 - RNA, 22 nt, Human
gaauucuuuucuuucugaaagu

SEQ ID NO: 428406 - RNA, 22 nt, Human
uuuaugaacuacagauauaacu

SEQ ID NO: 428407 - RNA, 22 nt, Human
gcugcucuugaggggcucacug

SEQ ID NO: 428408 - RNA, 22 nt, Human
acuuuuuuauaaggaagaagau

SEQ ID NO: 428409 - RNA, 22 nt, Human
agugugagcccuggaguggugc

SEQ ID NO: 428410 - RNA, 19 nt, Human
caggaugaucccaugacac

SEQ ID NO: 428411 - RNA, 22 nt, Human
auuuauuaagcaucugcuaugu

SEQ ID NO: 428412 - RNA, 22 nt, Human
acagagcacauagauuggaguu

SEQ ID NO: 428413 - RNA, 22 nt, Human
uggcccugacacgugguacugg

SEQ ID NO: 428414 - RNA, 22 nt, Human
gagcagagacaguacaacuggc

SEQ ID NO: 428415 - RNA, 22 nt, Human
agauacauagcugugagcacac

SEQ ID NO: 428416 - RNA, 22 nt, Human
uccaggcaaagccuuguagacg

SEQ ID NO: 428417 - RNA, 22 nt, Human
gcucagagauguucaguagcuu

SEQ ID NO: 428418 - RNA, 22 nt, Human
uggguggcacuucuggggucca

SEQ ID NO: 428419 - RNA, 22 nt, Human
agggcccuagggaaugagacau

SEQ ID NO: 428420 - RNA, 22 nt, Human
uuucauaugggcauuggcaaua

SEQ ID NO: 428421 - RNA, 22 nt, Human
acaggugguaaaauggacuguc

SEQ ID NO: 428422 - RNA, 20 nt, Human
aggagaaauucgggacaccu

SEQ ID NO: 428423 - RNA, 21 nt, Human
gccagggaagagaguuggcug

SEQ ID NO: 428424 - RNA, 22 nt, Human
gccugugcuuaacugacgugag

SEQ ID NO: 428425 - RNA, 22 nt, Human
agcugcugugugcucaggcagg

SEQ ID NO: 428426 - RNA, 22 nt, Human
caggguccaucuuucaucacug

SEQ ID NO: 428427 - RNA, 22 nt, Human
aagauuucugcuccugagagaa

SEQ ID NO: 428428 - RNA, 22 nt, Human
cauuguauugaggauacuuaag

SEQ ID NO: 428429 - RNA, 22 nt, Human
agccaugcaccuuacucuugcu

SEQ ID NO: 428430 - RNA, 22 nt, Human
aggucacacuuggaucauagaa

SEQ ID NO: 428431 - RNA, 22 nt, Human
cuggggccacaacggcgcacgc

SEQ ID NO: 428432 - RNA, 22 nt, Human
ggcugugaacccuggcagugug

SEQ ID NO: 428433 - RNA, 22 nt, Human
cuccucugucuggcccugagcc

SEQ ID NO: 428434 - RNA, 22 nt, Human
aaaucagugcucauuugaaagg

SEQ ID NO: 428435 - RNA, 22 nt, Human
ucccaggaucugagggcagaga

SEQ ID NO: 428436 - RNA, 22 nt, Human
uugaagauggaucgccacucuc

SEQ ID NO: 428437 - RNA, 22 nt, Human
agguauauauucugguccuuau

SEQ ID NO: 428438 - RNA, 22 nt, Human
gccuggagcuacuggacacuga

SEQ ID NO: 428439 - RNA, 22 nt, Human
ucucuucuugauuuucacugga

SEQ ID NO: 428440 - RNA, 22 nt, Human
gaugcagaaaguagacaccauc

SEQ ID NO: 428441 - RNA, 22 nt, Human
cagaagcauugacuccuugcuc

SEQ ID NO: 428442 - RNA, 22 nt, Human
ugaggcaggaguuaaugugcuc

SEQ ID NO: 428443 - RNA, 22 nt, Human
gucauugcaguggcaaaucaca

SEQ ID NO: 428444 - RNA, 22 nt, Human
gcugucaccaaagcaggcacug

SEQ ID NO: 428445 - RNA, 22 nt, Human
auuucucaguguacauuauguu

SEQ ID NO: 428446 - RNA, 22 nt, Human
gggcuggcucugucuagaaagg

SEQ ID NO: 428447 - RNA, 22 nt, Human
aagagcugcccaaggugaacag

SEQ ID NO: 428448 - RNA, 22 nt, Human
ccaggcugcuguugguguccgc

SEQ ID NO: 428449 - RNA, 22 nt, Human
agaguguuucagucuuccuaga

SEQ ID NO: 428450 - RNA, 20 nt, Human
guugaaaguaauaugaugcu

SEQ ID NO: 428451 - RNA, 22 nt, Human
ccagucccaggcagaaauccag

SEQ ID NO: 428452 - RNA, 22 nt, Human
cugcucugcagcuuggacuccc

SEQ ID NO: 428453 - RNA, 17 nt, Human
ugagaaguaggcaucau

SEQ ID NO: 428454 - RNA, 22 nt, Human
caagaugaucccugaaggcagc

SEQ ID NO: 428455 - RNA, 22 nt, Human
acagagagguaaaauauauagu

SEQ ID NO: 428456 - RNA, 15 nt, Human
ugauuuccuacuaac

SEQ ID NO: 428457 - RNA, 22 nt, Human
acauuaucccuggcacaacugc

SEQ ID NO: 428458 - RNA, 22 nt, Human
cucugcaugccuugcucagaca

SEQ ID NO: 428459 - RNA, 22 nt, Human
cguagguggcucagcaccuggg

SEQ ID NO: 428460 - RNA, 22 nt, Human
uuggcuucucuuaacccuaaag

SEQ ID NO: 428461 - RNA, 22 nt, Human
uuuccucuuccgagggggaggc

SEQ ID NO: 428462 - RNA, 22 nt, Human
uuaccaaaucccgugcacauuc

SEQ ID NO: 428463 - RNA, 22 nt, Human
uauuucuaagcuguaagucuga

SEQ ID NO: 428464 - RNA, 22 nt, Human
gggacuggaacuacuggugcag

SEQ ID NO: 428465 - RNA, 22 nt, Human
uaguuuuuucaacaaauggugc

SEQ ID NO: 428466 - RNA, 19 nt, Human
ugccuggcaccagcuccac

SEQ ID NO: 428467 - RNA, 22 nt, Human
cgaggcagaggcugaaacggcu

SEQ ID NO: 428468 - RNA, 22 nt, Human
acaaagucaaauugcagccgcc

SEQ ID NO: 428469 - RNA, 21 nt, Human
cagaggcugagagggcaaucu

SEQ ID NO: 428470 - RNA, 22 nt, Human
ugccaggagagugcaugcaggg

SEQ ID NO: 428471 - RNA, 22 nt, Human
agucccagcucagaaccacuag

SEQ ID NO: 428472 - RNA, 22 nt, Human
cuaucuuucgauucuagcuuaa

SEQ ID NO: 428473 - RNA, 22 nt, Human
ugaaggagcucaaugaugaugc

SEQ ID NO: 428474 - RNA, 22 nt, Human
ggcugcucuucuuggcgaccuc

SEQ ID NO: 428475 - RNA, 22 nt, Human
aagaugcuuauugcuccugcag

SEQ ID NO: 428476 - RNA, 22 nt, Human
ggucacugcucuaaacaaaagu

SEQ ID NO: 428477 - RNA, 22 nt, Human
ccagaggugcugggagaggucu

SEQ ID NO: 428478 - RNA, 22 nt, Human
auuaaauuggaucugcauaguu

SEQ ID NO: 428479 - RNA, 22 nt, Human
ccugccuggaucagccauccug

SEQ ID NO: 428480 - RNA, 22 nt, Human
ucagaggucccuagcaggagug

SEQ ID NO: 428481 - RNA, 22 nt, Human
ucugucugagggagugacauuu

SEQ ID NO: 428482 - RNA, 22 nt, Human
acagguggcauaggcaguuuga

SEQ ID NO: 428483 - RNA, 22 nt, Human
uuacuuuggauggucaagaaag

SEQ ID NO: 428484 - RNA, 22 nt, Human
gcacacagauuaggaaacagaa

SEQ ID NO: 428485 - RNA, 22 nt, Human
cccaagcagggugcagaggcau

SEQ ID NO: 428486 - RNA, 22 nt, Human
gggccagugaacaaugagggaa

SEQ ID NO: 428487 - RNA, 22 nt, Human
aggaagccuggggcugcccucg

SEQ ID NO: 428488 - RNA, 22 nt, Human
uucauuaguucugaagaugucu

SEQ ID NO: 428489 - RNA, 22 nt, Human
cugugcaagcccaagauaaaac

SEQ ID NO: 428490 - RNA, 22 nt, Human
uccaggcaugucugaguccuuc

SEQ ID NO: 428491 - RNA, 22 nt, Human
gcaaagguagccaaggagcuca

SEQ ID NO: 428492 - RNA, 22 nt, Human
aagcaaagaguuuaguggguga

SEQ ID NO: 428493 - RNA, 22 nt, Human
uggcugcugcuuggucuucuuc

SEQ ID NO: 428494 - RNA, 22 nt, Human
uguaggacauguacuuguaaca

SEQ ID NO: 428495 - RNA, 22 nt, Human
gcagagccaggagagacccuug

SEQ ID NO: 428496 - RNA, 19 nt, Human
ugaaacaaacuuaaaagga

SEQ ID NO: 428497 - RNA, 22 nt, Human
ucaggagagaaagaauacaauu

SEQ ID NO: 428498 - RNA, 17 nt, Human
cucuccuuccucugagg

SEQ ID NO: 428499 - RNA, 22 nt, Human
uagggcucagagaaguggggcc

SEQ ID NO: 428500 - RNA, 21 nt, Human
caugaagccgguucccuguuu

SEQ ID NO: 428501 - RNA, 18 nt, Human
cugcugugucgucugggc

SEQ ID NO: 428502 - RNA, 22 nt, Human
gccuucaggaaaucaguccuug

SEQ ID NO: 428503 - RNA, 22 nt, Human
ucucaccaaagccuugaccaua

SEQ ID NO: 428504 - RNA, 22 nt, Human
agagucugaaugcucagaguug

SEQ ID NO: 428505 - RNA, 22 nt, Human
ucuucuccagugcuucugcaca

SEQ ID NO: 428506 - RNA, 23 nt, Human
cugcagucgccggccugggugcc

SEQ ID NO: 428507 - RNA, 22 nt, Human
gguggccuuucaguggaucagg

SEQ ID NO: 428508 - RNA, 22 nt, Human
uggcagcaaguucuugggaggu

SEQ ID NO: 428509 - RNA, 22 nt, Human
ggccucucuccagucagugcag

SEQ ID NO: 428510 - RNA, 22 nt, Human
ucagcuccucaugcaggggaua

SEQ ID NO: 428511 - RNA, 22 nt, Human
auacauuagaaucugguacuca

SEQ ID NO: 428512 - RNA, 22 nt, Human
cacagacccagaagggaugaag

SEQ ID NO: 428513 - RNA, 22 nt, Human
agcugcagauucuaucuagaag

SEQ ID NO: 428514 - RNA, 22 nt, Human
auaucacaaacaagucuguacu

SEQ ID NO: 428515 - RNA, 22 nt, Human
cagguggggagaguguggagca

SEQ ID NO: 428516 - RNA, 22 nt, Human
ggcacugagaggcucuuccuaa

SEQ ID NO: 428517 - RNA, 22 nt, Human
ccagaagucaggaaugagucuu

SEQ ID NO: 428518 - RNA, 22 nt, Human
guugaaugaaucauucuaugua

SEQ ID NO: 428519 - RNA, 22 nt, Human
auucucuguuuccaagaugaaa

SEQ ID NO: 428520 - RNA, 19 nt, Human
augucccaccgccccugag

SEQ ID NO: 428521 - RNA, 22 nt, Human
uuuaauuuuccugguaggccug

SEQ ID NO: 428522 - RNA, 22 nt, Human
uggcacagacagaucaggaguc

SEQ ID NO: 428523 - RNA, 22 nt, Human
ugagccagucugucugggugaa

SEQ ID NO: 428524 - RNA, 22 nt, Human
ggucauugaaaucagaaggguu

SEQ ID NO: 428525 - RNA, 22 nt, Human
uagauuuuacuucugucauuac

SEQ ID NO: 428526 - RNA, 22 nt, Human
caggaugugaggaggccauuug

SEQ ID NO: 428527 - RNA, 20 nt, Human
caguccaaucagaggccacc

SEQ ID NO: 428528 - RNA, 22 nt, Human
ugcccuguuaucuuggaagagu

SEQ ID NO: 428529 - RNA, 22 nt, Human
ugccucugcugcuguggcauca

SEQ ID NO: 428530 - RNA, 22 nt, Human
ucuucauuuuauagcaucugug

SEQ ID NO: 428531 - RNA, 22 nt, Human
uggggugguaauacaccguucu

SEQ ID NO: 428532 - RNA, 22 nt, Human
guauuagguuggugcaaaagua

SEQ ID NO: 428533 - RNA, 22 nt, Human
auugaaagaguuuucugcugca

SEQ ID NO: 428534 - RNA, 22 nt, Human
gggagagaugcugauugccaau

SEQ ID NO: 428535 - RNA, 22 nt, Human
uggccugguuauauugcuauca

SEQ ID NO: 428536 - RNA, 22 nt, Human
uagaauaugugguaggaucugg

SEQ ID NO: 428537 - RNA, 22 nt, Human
acacacuucacccuugagcuaa

SEQ ID NO: 428538 - RNA, 22 nt, Human
uauugucuguccgggucaaagc

SEQ ID NO: 428539 - RNA, 22 nt, Human
uacauuugcuuugauuuucagc

SEQ ID NO: 428540 - RNA, 22 nt, Human
caagggccuccaccuugcucgu

SEQ ID NO: 428541 - RNA, 22 nt, Human
gacauaauccuccucaccuacu

SEQ ID NO: 428542 - RNA, 22 nt, Human
cagcaggguauacagggaauuu

SEQ ID NO: 428543 - RNA, 22 nt, Human
agagaacaaauuaaaggugguu

SEQ ID NO: 428544 - RNA, 22 nt, Human
aaagaguucuaugaucuuucca

SEQ ID NO: 428545 - RNA, 22 nt, Human
ugccucagcugaggccgcucca

SEQ ID NO: 428546 - RNA, 22 nt, Human
ucccagagacagagccuccucc

SEQ ID NO: 428547 - RNA, 18 nt, Human
gagcccugagucugcaca

SEQ ID NO: 428548 - RNA, 22 nt, Human
gggggcaguaaggauauggaaa

SEQ ID NO: 428549 - RNA, 22 nt, Human
gaugggcguggcgcguuuggug

SEQ ID NO: 428550 - RNA, 22 nt, Human
ggagacaguauggcuuguagcu

SEQ ID NO: 428551 - RNA, 22 nt, Human
aaaggcuaugagauagaagaua

SEQ ID NO: 428552 - RNA, 22 nt, Human
gaauuugaaaagugaugggaau

SEQ ID NO: 428553 - RNA, 22 nt, Human
agaggcugagaaacccucuucu

SEQ ID NO: 428554 - RNA, 22 nt, Human
uccuguggcguuaucaugugau

SEQ ID NO: 428555 - RNA, 22 nt, Human
uggcuggcuagugggcaggauu

SEQ ID NO: 428556 - RNA, 22 nt, Human
cagcagugcuucagugugagau

SEQ ID NO: 428557 - RNA, 22 nt, Human
gugccugccccacuccucagca

SEQ ID NO: 428558 - RNA, 22 nt, Human
ugcauuauacuuuuagaaauuu

SEQ ID NO: 428559 - RNA, 20 nt, Human
gucaucgccggcagcaaaga

SEQ ID NO: 428560 - RNA, 22 nt, Human
aagcugccaccagcccagggca

SEQ ID NO: 428561 - RNA, 22 nt, Human
agaggcagaaguguucaaaccc

SEQ ID NO: 428562 - RNA, 22 nt, Human
uuccaguugguagaauguaagg

SEQ ID NO: 428563 - RNA, 22 nt, Human
cccagcucuuuuagcggcaucu

SEQ ID NO: 428564 - RNA, 22 nt, Human
acauuucuccuugcaggaguca

SEQ ID NO: 428565 - RNA, 22 nt, Human
ucugagccaauuucugugucca

SEQ ID NO: 428566 - RNA, 22 nt, Human
ggccagaaaguuaagcuguggc

SEQ ID NO: 428567 - RNA, 22 nt, Human
uuuugucuaagaacuuugcaaa

SEQ ID NO: 428568 - RNA, 22 nt, Human
auucacaauuagaaguagauaa

SEQ ID NO: 428569 - RNA, 22 nt, Human
acagcagcuaaccccugggcca

SEQ ID NO: 428570 - RNA, 21 nt, Human
acaguucaugauaacuccauc

SEQ ID NO: 428571 - RNA, 19 nt, Human
ggaggccuggguauuugcc

SEQ ID NO: 428572 - RNA, 22 nt, Human
gcucccaccaggcagaccuacc

SEQ ID NO: 428573 - RNA, 22 nt, Human
ucagcaauccucccacaggugg

SEQ ID NO: 428574 - RNA, 20 nt, Human
ugucaugcauuagaugaaga

SEQ ID NO: 428575 - RNA, 22 nt, Human
gagagugaggccugggaaucua

SEQ ID NO: 428576 - RNA, 22 nt, Human
uagcagcuuaaguaauuagaau

SEQ ID NO: 428577 - RNA, 22 nt, Human
cagaagagaugaaauaguauua

SEQ ID NO: 428578 - RNA, 22 nt, Human
acagcacaaucugagucccaga

SEQ ID NO: 428579 - RNA, 22 nt, Human
uuuccacugggcacggggccag

SEQ ID NO: 428580 - RNA, 22 nt, Human
uagccuucucaagacaaaguug

SEQ ID NO: 428581 - RNA, 20 nt, Human
gccugagcuauugccaggau

SEQ ID NO: 428582 - RNA, 22 nt, Human
gugcauugcgaugcagacgacc

SEQ ID NO: 428583 - RNA, 22 nt, Human
gguuggggcgagcuggaggccc

SEQ ID NO: 428584 - RNA, 22 nt, Human
aggccugucuggggcucagcca

SEQ ID NO: 428585 - RNA, 22 nt, Human
auuugucucugcacuuuacuca

SEQ ID NO: 428586 - RNA, 22 nt, Human
acagauauaugauuguguaaau

SEQ ID NO: 428587 - RNA, 22 nt, Human
gccccuggcuggccagcuccuc

SEQ ID NO: 428588 - RNA, 22 nt, Human
ucauugaauuucacagcuuuau

SEQ ID NO: 428589 - RNA, 22 nt, Human
cuuccugaacaaugccaucaau

SEQ ID NO: 428590 - RNA, 22 nt, Human
agcugcuacugcucugccagag

SEQ ID NO: 428591 - RNA, 22 nt, Human
ugguaauuuacgcauuucugua

SEQ ID NO: 428592 - RNA, 17 nt, Human
uuucagauucacuuucu

SEQ ID NO: 428593 - RNA, 22 nt, Human
auguuucaugacugagcaaaau

SEQ ID NO: 428594 - RNA, 22 nt, Human
agcugaggcauggacaggcugc

SEQ ID NO: 428595 - RNA, 22 nt, Human
ccaggcuuucccagccucucca

SEQ ID NO: 428596 - RNA, 22 nt, Human
cagcugcccugccuugcccuua

SEQ ID NO: 428597 - RNA, 22 nt, Human
gaggcucagagugguuaaauaa

SEQ ID NO: 428598 - RNA, 22 nt, Human
ccaggcugggcggggaaccugg

SEQ ID NO: 428599 - RNA, 22 nt, Human
ucauugcagacuaacaaucuca

SEQ ID NO: 428600 - RNA, 22 nt, Human
cagggcagggagcuuagaauga

SEQ ID NO: 428601 - RNA, 22 nt, Human
agcagggcagcuuuuuucagaa

SEQ ID NO: 428602 - RNA, 22 nt, Human
aucaaaguucguaacugauaac

SEQ ID NO: 428603 - RNA, 22 nt, Human
cagcagcuggugagacacagcc

SEQ ID NO: 428604 - RNA, 22 nt, Human
caagcccaggauuccccaguua

SEQ ID NO: 428605 - RNA, 22 nt, Human
acaggacaggcugggcuagacu

SEQ ID NO: 428606 - RNA, 22 nt, Human
gaguccaguguuuaccaggggu

SEQ ID NO: 428607 - RNA, 22 nt, Human
gaauacaagccugccaccugga

SEQ ID NO: 428608 - RNA, 22 nt, Human
agccaggcggggcagguuuccu

SEQ ID NO: 428609 - RNA, 22 nt, Human
gcagagccccucaagccagccu

SEQ ID NO: 428610 - RNA, 23 nt, Human
gcccaugcuguugggcccgagca

SEQ ID NO: 428611 - RNA, 22 nt, Human
cagaaggcaaacaaaaggauuu

SEQ ID NO: 428612 - RNA, 18 nt, Human
uggcucugcagccagaug

SEQ ID NO: 428613 - RNA, 22 nt, Human
ggacucuguuuuccugaucacu

SEQ ID NO: 428614 - RNA, 22 nt, Human
uaacagaaaagaacugaguuug

SEQ ID NO: 428615 - RNA, 22 nt, Human
uggccuggugucugcgaggccu

SEQ ID NO: 428616 - RNA, 22 nt, Human
gagcagggccacuucuguaccu

SEQ ID NO: 428617 - RNA, 22 nt, Human
gggcagagagcuggaacuccuu

SEQ ID NO: 428618 - RNA, 22 nt, Human
gcacagaaguaaaauacaaguc

SEQ ID NO: 428619 - RNA, 22 nt, Human
cuuagggagaaugccucugcag

SEQ ID NO: 428620 - RNA, 19 nt, Human
ugcagggcugcgccugggg

SEQ ID NO: 428621 - RNA, 22 nt, Human
guuucauuuacaucuguaggua

SEQ ID NO: 428622 - RNA, 22 nt, Human
ucacagcuaagcuuggucacug

SEQ ID NO: 428623 - RNA, 22 nt, Human
auaauucagguuuucuggcaca

SEQ ID NO: 428624 - RNA, 22 nt, Human
cugggccugucagggcuuuuug

SEQ ID NO: 428625 - RNA, 23 nt, Human
agggcaugaagcagaggacgugg

SEQ ID NO: 428626 - RNA, 22 nt, Human
auucaguucuaaggucagugcc

SEQ ID NO: 428627 - RNA, 22 nt, Human
ggccugagcucuggggaggcaa

SEQ ID NO: 428628 - RNA, 22 nt, Human
ggccuggaaugcuuuccuacca

SEQ ID NO: 428629 - RNA, 22 nt, Human
gcccagcugcacccuggugggu

SEQ ID NO: 428630 - RNA, 22 nt, Human
cuuccugcauugugccagaguu

SEQ ID NO: 428631 - RNA, 22 nt, Human
ggccagggggcuucagacucca

SEQ ID NO: 428632 - RNA, 22 nt, Human
uuucauuacguguuugacuugu

SEQ ID NO: 428633 - RNA, 22 nt, Human
ugagcuucuuuauuuggccaga

SEQ ID NO: 428634 - RNA, 22 nt, Human
ugggggugaaagucuggacagu

SEQ ID NO: 428635 - RNA, 21 nt, Human
gcuuccaagauggcaccuuga

SEQ ID NO: 428636 - RNA, 22 nt, Human
ggcacagagcccagcuuccuag

SEQ ID NO: 428637 - RNA, 22 nt, Human
aggcucagugauguaaaauaua

SEQ ID NO: 428638 - RNA, 22 nt, Human
gaggggcagagguagagaacaa

SEQ ID NO: 428639 - RNA, 22 nt, Human
aguuucuguuaccauauuugac

SEQ ID NO: 428640 - RNA, 18 nt, Human
ugagaggcagguagagga

SEQ ID NO: 428641 - RNA, 23 nt, Human
ucucaagaggaagcagggcucau

SEQ ID NO: 428642 - RNA, 22 nt, Human
aaggaagauauaucaagcuuaa

SEQ ID NO: 428643 - RNA, 22 nt, Human
cccacacauuuuucacuuaccg

SEQ ID NO: 428644 - RNA, 22 nt, Human
cuguguccucccgcugcaccca

SEQ ID NO: 428645 - RNA, 22 nt, Human
cccagagcuccgguccugccca

SEQ ID NO: 428646 - RNA, 22 nt, Human
cagugcagaggugcaagcaugu

SEQ ID NO: 428647 - RNA, 22 nt, Human
uugcagcuucuaccacuguuuc

SEQ ID NO: 428648 - RNA, 22 nt, Human
gcuguucccauguggggcucag

SEQ ID NO: 428649 - RNA, 21 nt, Human
uaaaucucuguauucuucagu

SEQ ID NO: 428650 - RNA, 17 nt, Human
gccuuccuuccuccaca

SEQ ID NO: 428651 - RNA, 20 nt, Human
uacugggcaagcccacagac

SEQ ID NO: 428652 - RNA, 22 nt, Human
uguuuuuccaugugcagaacaa

SEQ ID NO: 428653 - RNA, 22 nt, Human
uaauuauaacaguuacaucuua

SEQ ID NO: 428654 - RNA, 22 nt, Human
gggcugcacagaucuucaaggg

SEQ ID NO: 428655 - RNA, 22 nt, Human
caggugggcuugggagaacacu

SEQ ID NO: 428656 - RNA, 22 nt, Human
gcuccugucuuggggcacuggc

SEQ ID NO: 428657 - RNA, 22 nt, Human
ggccaggagauggacaccacau

SEQ ID NO: 428658 - RNA, 22 nt, Human
agggcagagaaauguaguugag

SEQ ID NO: 428659 - RNA, 22 nt, Human
uggcagcauguuauguaaggaa

SEQ ID NO: 428660 - RNA, 22 nt, Human
gaagaagguggcccagggguag

SEQ ID NO: 428661 - RNA, 22 nt, Human
uccaggcagucauuaaucucua

SEQ ID NO: 428662 - RNA, 23 nt, Human
ugcugguguuuuugggaccaggg

SEQ ID NO: 428663 - RNA, 22 nt, Human
ggggacugccuuccacagacac

SEQ ID NO: 428664 - RNA, 22 nt, Human
augcugaggacaaagagaucaa

SEQ ID NO: 428665 - RNA, 22 nt, Human
auguuuaaucggcugccuuucc

SEQ ID NO: 428666 - RNA, 22 nt, Human
cauuuguuaaccaguguggauu

SEQ ID NO: 428667 - RNA, 22 nt, Human
gcagggcagcucacugugguuc

SEQ ID NO: 428668 - RNA, 22 nt, Human
aaugggaagucacuacuguuac

SEQ ID NO: 428669 - RNA, 22 nt, Human
agccagcuggagaccacuguuu

SEQ ID NO: 428670 - RNA, 22 nt, Human
cacauaauaaauguuccugaug

SEQ ID NO: 428671 - RNA, 22 nt, Human
uguucaauccccagguccugaa

SEQ ID NO: 428672 - RNA, 22 nt, Human
aagggaggggauguaagccugg

SEQ ID NO: 428673 - RNA, 22 nt, Human
ggccugcuucucagugagcuug

SEQ ID NO: 428674 - RNA, 22 nt, Human
gcagcccagagcgcaggacccc

SEQ ID NO: 428675 - RNA, 22 nt, Human
cucugagagcggucuguggcuu

SEQ ID NO: 428676 - RNA, 20 nt, Human
ggcaccaggcuaggauugga

SEQ ID NO: 428677 - RNA, 19 nt, Human
ggcucagggcgcugccgcc

SEQ ID NO: 428678 - RNA, 22 nt, Human
ugaugcugcugggaguggugcu

SEQ ID NO: 428679 - RNA, 22 nt, Human
agucaguguucuccggagaggc

SEQ ID NO: 428680 - RNA, 22 nt, Human
ggcugccucugaugugcagacg

SEQ ID NO: 428681 - RNA, 22 nt, Human
guacaguuuucaguguucacug

SEQ ID NO: 428682 - RNA, 22 nt, Human
agaugggcgcccuggacugagg

SEQ ID NO: 428683 - RNA, 20 nt, Human
acaauauguagaugaauagc

SEQ ID NO: 428684 - RNA, 22 nt, Human
ggcugccugugcccaggcacac

SEQ ID NO: 428685 - RNA, 22 nt, Human
cccagcaguuguuggugcacau

SEQ ID NO: 428686 - RNA, 22 nt, Human
uggcucaguagcagugugguca

SEQ ID NO: 428687 - RNA, 22 nt, Human
cugcagggaccacaagcagguu

SEQ ID NO: 428688 - RNA, 22 nt, Human
gaaaggagaggguuaaggagcu

SEQ ID NO: 428689 - RNA, 22 nt, Human
ucauugucuugauaugauuguc

SEQ ID NO: 428690 - RNA, 22 nt, Human
agaagugagugugacucagcag

SEQ ID NO: 428691 - RNA, 22 nt, Human
agucucagaguaccugagggac

SEQ ID NO: 428692 - RNA, 19 nt, Human
ccucugcgcuguccugcuc

SEQ ID NO: 428693 - RNA, 22 nt, Human
gcucccugaaaagaacaaaguc

SEQ ID NO: 428694 - RNA, 20 nt, Human
ugaaaaggucaggagacaug

SEQ ID NO: 428695 - RNA, 22 nt, Human
cagagcucagagcugccaggca

SEQ ID NO: 428696 - RNA, 22 nt, Human
gggcugagugggccucuuacuu

SEQ ID NO: 428697 - RNA, 21 nt, Human
gcagcuggucucagagcuugc

SEQ ID NO: 428698 - RNA, 19 nt, Human
aggagaagacucucucccc

SEQ ID NO: 428699 - RNA, 22 nt, Human
ggugcagaggagccagcugggg

SEQ ID NO: 428700 - RNA, 22 nt, Human
agggagaaugaccaagguauau

SEQ ID NO: 428701 - RNA, 22 nt, Human
acagcagagacacucaggaggc

SEQ ID NO: 428702 - RNA, 22 nt, Human
caagagcuuuagaaaugcucau

SEQ ID NO: 428703 - RNA, 22 nt, Human
uccucuggggcgugguccugga

SEQ ID NO: 428704 - RNA, 22 nt, Human
aaguggagccagggaaacugaa

SEQ ID NO: 428705 - RNA, 22 nt, Human
ugcagagaaaccaguggaggac

SEQ ID NO: 428706 - RNA, 22 nt, Human
gaaggcaacaccaggaugcacu

SEQ ID NO: 428707 - RNA, 22 nt, Human
caggguggcacaucacagcauu

SEQ ID NO: 428708 - RNA, 20 nt, Human
cagcucugggaaagaggcca

SEQ ID NO: 428709 - RNA, 22 nt, Human
ugaagccacagagcaucugccu

SEQ ID NO: 428710 - RNA, 22 nt, Human
acaauucucucauaucuuauua

SEQ ID NO: 428711 - RNA, 22 nt, Human
gcucugggaacugacugccuuc

SEQ ID NO: 428712 - RNA, 22 nt, Human
ugaggaagaacaagaauuuaga

SEQ ID NO: 428713 - RNA, 22 nt, Human
acccagagcugggcuuggcaaa

SEQ ID NO: 428714 - RNA, 20 nt, Human
cagcugccuggcucugggau

SEQ ID NO: 428715 - RNA, 22 nt, Human
acuugauuuugaaccuuucuac

SEQ ID NO: 428716 - RNA, 22 nt, Human
ccagagccccugagcuucccug

SEQ ID NO: 428717 - RNA, 22 nt, Human
gaagagcugugauucaggcuua

SEQ ID NO: 428718 - RNA, 22 nt, Human
agucugucucugcuaaucacua

SEQ ID NO: 428719 - RNA, 22 nt, Human
auguacacaugcaugcaugugc

SEQ ID NO: 428720 - RNA, 20 nt, Human
ugcagggccuaaaaagggaa

SEQ ID NO: 428721 - RNA, 20 nt, Human
gugcauuucaccuguacugu

SEQ ID NO: 428722 - RNA, 22 nt, Human
aguuucuaacauauagcauugg

SEQ ID NO: 428723 - RNA, 22 nt, Human
ugcagcccuuccuuccucuggg

SEQ ID NO: 428724 - RNA, 22 nt, Human
cauugcccaguaggaucaccag

SEQ ID NO: 428725 - RNA, 22 nt, Human
cccacucuggcucccuucuagu

SEQ ID NO: 428726 - RNA, 22 nt, Human
gcugggagucgcgucuguggcc

SEQ ID NO: 428727 - RNA, 22 nt, Human
ucuuuccagaggaauuuuuaga

SEQ ID NO: 428728 - RNA, 22 nt, Human
uuuacaaccucauauucugaug

SEQ ID NO: 428729 - RNA, 22 nt, Human
uaauuuaauuucaugccagccu

SEQ ID NO: 428730 - RNA, 22 nt, Human
ucccaggguccucuucuggaau

SEQ ID NO: 428731 - RNA, 21 nt, Human
ccugagccuguuuauccagaa

SEQ ID NO: 428732 - RNA, 22 nt, Human
agagccagccuucucagcuuac

SEQ ID NO: 428733 - RNA, 22 nt, Human
agccauggcgccacuagaggga

SEQ ID NO: 428734 - RNA, 22 nt, Human
uuacauuagacccacuuucaug

SEQ ID NO: 428735 - RNA, 22 nt, Human
uggcuggcuuguucacugacug

SEQ ID NO: 428736 - RNA, 22 nt, Human
gccuugccucagccauggaaac

SEQ ID NO: 428737 - RNA, 22 nt, Human
ucccaaggcacagggcagggac

SEQ ID NO: 428738 - RNA, 22 nt, Human
auuucugugcaguaaaugguga

SEQ ID NO: 428739 - RNA, 22 nt, Human
uccagggguaccggccaggcag

SEQ ID NO: 428740 - RNA, 22 nt, Human
uacuguauuugauaagugaagu

SEQ ID NO: 428741 - RNA, 22 nt, Human
ucuggcucuguguccucaccca

SEQ ID NO: 428742 - RNA, 22 nt, Human
cugaguccagggacagaggcgu

SEQ ID NO: 428743 - RNA, 22 nt, Human
agucucugggcaugguugugac

SEQ ID NO: 428744 - RNA, 22 nt, Human
agcucagcuuccucuccaugcu

SEQ ID NO: 428745 - RNA, 22 nt, Human
gagggcugaugcuuacuuauuu

SEQ ID NO: 428746 - RNA, 22 nt, Human
cucaggggaccuggcuccgagu

SEQ ID NO: 428747 - RNA, 22 nt, Human
agucucagccacacagaccuau

SEQ ID NO: 428748 - RNA, 22 nt, Human
cagccucucuguaucucaggau

SEQ ID NO: 428749 - RNA, 22 nt, Human
accuggcacuacaggcaccugu

SEQ ID NO: 428750 - RNA, 22 nt, Human
cuucucucugcauaggcauggg

SEQ ID NO: 428751 - RNA, 22 nt, Human
aaaaagauguccugaaguuuag

SEQ ID NO: 428752 - RNA, 22 nt, Human
acugucuguccugcucuccgug

SEQ ID NO: 428753 - RNA, 22 nt, Human
gugggcugcccuugaggucagc

SEQ ID NO: 428754 - RNA, 22 nt, Human
gcugucagcgcccaaggagcuc

SEQ ID NO: 428755 - RNA, 22 nt, Human
gcagaggauagcauaugaaccu

SEQ ID NO: 428756 - RNA, 22 nt, Human
agucccagcuucccccaugcag

SEQ ID NO: 428757 - RNA, 22 nt, Human
ucacuguugaccuggaaguggg

SEQ ID NO: 428758 - RNA, 22 nt, Human
cagcucccuauggugaggcgac

SEQ ID NO: 428759 - RNA, 22 nt, Human
ucccagcgcggggggaggaucc

SEQ ID NO: 428760 - RNA, 21 nt, Human
ccugccaggaaacugaguguc

SEQ ID NO: 428761 - RNA, 16 nt, Human
uggcagagguucagcc

SEQ ID NO: 428762 - RNA, 22 nt, Human
cagacccucgggugaguuggcc

SEQ ID NO: 428763 - RNA, 22 nt, Human
uuccucagaaaauacuguccaa

SEQ ID NO: 428764 - RNA, 22 nt, Human
uggcugucagcugccuggugcg

SEQ ID NO: 428765 - RNA, 22 nt, Human
ggaguuggugagcaccaggcuu

SEQ ID NO: 428766 - RNA, 22 nt, Human
ugggcugcuucuauuggugguc

SEQ ID NO: 428767 - RNA, 22 nt, Human
gagauuuccauauuuuguaaca

SEQ ID NO: 428768 - RNA, 19 nt, Human
gccagcagaaugaugaggc

SEQ ID NO: 428769 - RNA, 22 nt, Human
gcagcugggacacugaggccag

SEQ ID NO: 428770 - RNA, 22 nt, Human
gaccauuuuuacagagcauuca

SEQ ID NO: 428771 - RNA, 22 nt, Human
agggcccauagaucgucagcuu

SEQ ID NO: 428772 - RNA, 22 nt, Human
cagcaucaccgccauuucugau

SEQ ID NO: 428773 - RNA, 22 nt, Human
agguguguauaaacauacauau

SEQ ID NO: 428774 - RNA, 22 nt, Human
uauuucugaauccaaaagguca

SEQ ID NO: 428775 - RNA, 22 nt, Human
aagggcucgguagcaguccuga

SEQ ID NO: 428776 - RNA, 22 nt, Human
cagaggcaggauaagaacugcg

SEQ ID NO: 428777 - RNA, 22 nt, Human
cacaggagagcugggaggugcc

SEQ ID NO: 428778 - RNA, 20 nt, Human
ugcuggggacauacagggug

SEQ ID NO: 428779 - RNA, 19 nt, Human
cuggggcuuugguacugcc

SEQ ID NO: 428780 - RNA, 22 nt, Human
agggagacacaugaggaaguca

SEQ ID NO: 428781 - RNA, 22 nt, Human
guugaaagaucauguggcugcc

SEQ ID NO: 428782 - RNA, 22 nt, Human
uguaguaagugcgcaauaaaua

SEQ ID NO: 428783 - RNA, 22 nt, Human
ggagaugcuuuccaguggggau

SEQ ID NO: 428784 - RNA, 23 nt, Human
cuggccuccgacacuggccaaga

SEQ ID NO: 428785 - RNA, 21 nt, Human
gccuggcagguggaagggcuc

SEQ ID NO: 428786 - RNA, 22 nt, Human
ucagggcucaccagccucugcc

SEQ ID NO: 428787 - RNA, 16 nt, Human
ccuuucucugccuucc

SEQ ID NO: 428788 - RNA, 22 nt, Human
aggcaguggagcuggaauaggc

SEQ ID NO: 428789 - RNA, 18 nt, Human
uggcucuggacuugcucc

SEQ ID NO: 428790 - RNA, 22 nt, Human
aaugcuagugugauauguaagg

SEQ ID NO: 428791 - RNA, 22 nt, Human
agaggaggcuggguccagauaa

SEQ ID NO: 428792 - RNA, 22 nt, Human
acugugugcccugacgccaggg

SEQ ID NO: 428793 - RNA, 22 nt, Human
cuuacauugucuuaguuuucaa

SEQ ID NO: 428794 - RNA, 22 nt, Human
uguggcucucaugcacucccag

SEQ ID NO: 428795 - RNA, 22 nt, Human
gguggcagaauaauugaagguc

SEQ ID NO: 428796 - RNA, 20 nt, Human
acugcuucuuucucugaccu

SEQ ID NO: 428797 - RNA, 22 nt, Human
uucacagggcagcagcugagcc

SEQ ID NO: 428798 - RNA, 22 nt, Human
gagaggagguggcuaugacagc

SEQ ID NO: 428799 - RNA, 22 nt, Human
cugcccugcuugaugacagcga

SEQ ID NO: 428800 - RNA, 17 nt, Human
uggcucugaggcugaau

SEQ ID NO: 428801 - RNA, 22 nt, Human
ccagcuuuuggggugacaauuu

SEQ ID NO: 428802 - RNA, 22 nt, Human
ugugugccagccuacgaggagc

SEQ ID NO: 428803 - RNA, 22 nt, Human
guggugcaggccagcaggggcg

SEQ ID NO: 428804 - RNA, 22 nt, Human
uucauuacugcgguagucacac

SEQ ID NO: 428805 - RNA, 22 nt, Human
ccucauggaccucagacugucc

SEQ ID NO: 428806 - RNA, 22 nt, Human
acuuucucccacccacccgucu

SEQ ID NO: 428807 - RNA, 22 nt, Human
augaagucugcacaugcaugug

SEQ ID NO: 428808 - RNA, 22 nt, Human
uggagcagcuaagccucugaga

SEQ ID NO: 428809 - RNA, 22 nt, Human
caaaggcaacauauacuuguuu

SEQ ID NO: 428810 - RNA, 22 nt, Human
uugucuguaaagacggccacca

SEQ ID NO: 428811 - RNA, 22 nt, Human
gagcuucccucugcagucccug

SEQ ID NO: 428812 - RNA, 22 nt, Human
auauuaggcaaggagauuauuu

SEQ ID NO: 428813 - RNA, 22 nt, Human
acacauaugguugcugcaguga

SEQ ID NO: 428814 - RNA, 22 nt, Human
caguggcagagaacagagaccu

SEQ ID NO: 428815 - RNA, 22 nt, Human
caggggccggcuguccgugccc

SEQ ID NO: 428816 - RNA, 22 nt, Human
agggccuggaacuggagaccac

SEQ ID NO: 428817 - RNA, 22 nt, Human
cagaggaagcuggguguggagu

SEQ ID NO: 428818 - RNA, 20 nt, Human
cagagaccugucuucacaga

SEQ ID NO: 428819 - RNA, 19 nt, Human
augucuguugaauuucaua

SEQ ID NO: 428820 - RNA, 22 nt, Human
ugaugaaacugagguuccaaga

SEQ ID NO: 428821 - RNA, 22 nt, Human
aggccugaggaccuucuggagg

SEQ ID NO: 428822 - RNA, 22 nt, Human
caguccugugucccuugguggg

SEQ ID NO: 428823 - RNA, 22 nt, Human
ucuuucucucuaaucaagcaca

SEQ ID NO: 428824 - RNA, 22 nt, Human
cagaguguaucuguguaagcau

SEQ ID NO: 428825 - RNA, 22 nt, Human
aguuuaugaaacacagauuuga

SEQ ID NO: 428826 - RNA, 22 nt, Human
ucuucaaagaauuuuaguaauu

SEQ ID NO: 428827 - RNA, 22 nt, Human
cagaguguuucuuugggugggu

SEQ ID NO: 428828 - RNA, 23 nt, Human
uggcuucugccccauucucucca

SEQ ID NO: 428829 - RNA, 17 nt, Human
aggugcagaggcagagc

SEQ ID NO: 428830 - RNA, 22 nt, Human
aaucaguucuacaucuuaucca

SEQ ID NO: 428831 - RNA, 19 nt, Human
ggaagagaggaaaggugga

SEQ ID NO: 428832 - RNA, 22 nt, Human
ucugccuggguguggagcagag

SEQ ID NO: 428833 - RNA, 22 nt, Human
ugaggcagcccacuuuccuuag

SEQ ID NO: 428834 - RNA, 21 nt, Human
gaugaagcaaucuuucuguug

SEQ ID NO: 428835 - RNA, 22 nt, Human
cuugcuuuguccagaaauucag

SEQ ID NO: 428836 - RNA, 22 nt, Human
ugaggccagucucaucacaggc

SEQ ID NO: 428837 - RNA, 22 nt, Human
cauugcuuugugcauauuuaaa

SEQ ID NO: 428838 - RNA, 20 nt, Human
cacagcuugccuuuuaugac

SEQ ID NO: 428839 - RNA, 22 nt, Human
cucucugaggcaggccuguggg

SEQ ID NO: 428840 - RNA, 22 nt, Human
uaaagguacgaagugagggauu

SEQ ID NO: 428841 - RNA, 21 nt, Human
gcagagccggggcgagaaggc

SEQ ID NO: 428842 - RNA, 22 nt, Human
aggcugggaagguaaaguugua

SEQ ID NO: 428843 - RNA, 22 nt, Human
ugacuucaaaggcucuacuccu

SEQ ID NO: 428844 - RNA, 22 nt, Human
uguauuccaaaaugcugaggau

SEQ ID NO: 428845 - RNA, 22 nt, Human
acagagcaauucuuggguguuu

SEQ ID NO: 428846 - RNA, 22 nt, Human
agcagggcagugcuucagcucu

SEQ ID NO: 428847 - RNA, 23 nt, Human
auaauaacgucugucuugucucu

SEQ ID NO: 428848 - RNA, 22 nt, Human
acuugguuggucucacccuguu

SEQ ID NO: 428849 - RNA, 22 nt, Human
cccugccuugggguccacaccg

SEQ ID NO: 428850 - RNA, 22 nt, Human
gcugccuguguggccacucacu

SEQ ID NO: 428851 - RNA, 21 nt, Human
uccuuccuugagguccuuucc

SEQ ID NO: 428852 - RNA, 22 nt, Human
aauaaacugcucaauugcauca

SEQ ID NO: 428853 - RNA, 22 nt, Human
cagugaggugcccagccugccc

SEQ ID NO: 428854 - RNA, 22 nt, Human
cugguacaaaaugcugauauca

SEQ ID NO: 428855 - RNA, 22 nt, Human
aggcagcaugggccccagcucc

SEQ ID NO: 428856 - RNA, 22 nt, Human
gcagagaguugggcugcgccag

SEQ ID NO: 428857 - RNA, 20 nt, Human
ugaaggccauuuguuccaga

SEQ ID NO: 428858 - RNA, 22 nt, Human
ugaggcagguggauuacaaggu

SEQ ID NO: 428859 - RNA, 22 nt, Human
agagccuggucugagauaggac

SEQ ID NO: 428860 - RNA, 19 nt, Human
auaaggcagugacuuuuuu

SEQ ID NO: 428861 - RNA, 22 nt, Human
acacagggucuagaguuaggcc

SEQ ID NO: 428862 - RNA, 22 nt, Human
cccagguguuuguggcagaggu

SEQ ID NO: 428863 - RNA, 22 nt, Human
aggcagcagucaugaggaaaga

SEQ ID NO: 428864 - RNA, 22 nt, Human
cugagaggaugcugcaguggag

SEQ ID NO: 428865 - RNA, 22 nt, Human
ggcacugauaauguccucucuc

SEQ ID NO: 428866 - RNA, 17 nt, Human
ugcauguccuuuguucc

SEQ ID NO: 428867 - RNA, 22 nt, Human
ucugucaccgagggcauccaaa

SEQ ID NO: 428868 - RNA, 22 nt, Human
agaaauacuuuguaaaucucac

SEQ ID NO: 428869 - RNA, 22 nt, Human
cuucucuucccagggacacagg

SEQ ID NO: 428870 - RNA, 22 nt, Human
cccagcuccaagggacagcgaa

SEQ ID NO: 428871 - RNA, 22 nt, Human
cuccucccugcgauugcucugc

SEQ ID NO: 428872 - RNA, 22 nt, Human
uacaagauaagaauuggcaagg

SEQ ID NO: 428873 - RNA, 22 nt, Human
guguggcugauugacaugguca

SEQ ID NO: 428874 - RNA, 22 nt, Human
uggaggccagagguacugggac

SEQ ID NO: 428875 - RNA, 18 nt, Human
cagagcagagguggagcg

SEQ ID NO: 428876 - RNA, 22 nt, Human
cccugcagcauucucuaacugg

SEQ ID NO: 428877 - RNA, 22 nt, Human
cucaggauagauuguccucuca

SEQ ID NO: 428878 - RNA, 22 nt, Human
gcucccagucugauggaggaga

SEQ ID NO: 428879 - RNA, 22 nt, Human
gguuucaacuaaaucaagaagg

SEQ ID NO: 428880 - RNA, 22 nt, Human
gggagcugguuccugcccucca

SEQ ID NO: 428881 - RNA, 22 nt, Human
gaguccuucuggcuggcaggau

SEQ ID NO: 428882 - RNA, 22 nt, Human
gugugccagacaugaugcuaug

SEQ ID NO: 428883 - RNA, 22 nt, Human
gcaggcagagguggaggagaca

SEQ ID NO: 428884 - RNA, 22 nt, Human
guccucagcaccagaacuaggg

SEQ ID NO: 428885 - RNA, 22 nt, Human
acuguguggaccacucugaggc

SEQ ID NO: 428886 - RNA, 22 nt, Human
gugcauuucucauacacuaaau

SEQ ID NO: 428887 - RNA, 22 nt, Human
ugcauaaagugccauaguauua

SEQ ID NO: 428888 - RNA, 22 nt, Human
uuuccaaaggcuaaacucaguu

SEQ ID NO: 428889 - RNA, 22 nt, Human
uuucauuauucaugcuaguuau

SEQ ID NO: 428890 - RNA, 22 nt, Human
ggagaaagcuguaguggaaugu

SEQ ID NO: 428891 - RNA, 23 nt, Human
cagguggcuccacgagggguggg

SEQ ID NO: 428892 - RNA, 22 nt, Human
ggacagagcccugguggccuaa

SEQ ID NO: 428893 - RNA, 22 nt, Human
ugcagggacacgaagacaaaua

SEQ ID NO: 428894 - RNA, 22 nt, Human
ccaggcucugcgcuggacaugg

SEQ ID NO: 428895 - RNA, 22 nt, Human
uggaaggagcuaaggaccuggg

SEQ ID NO: 428896 - RNA, 22 nt, Human
cacacauugaauucauucuugu

SEQ ID NO: 428897 - RNA, 22 nt, Human
ucccuuaaaacucauguguugu

SEQ ID NO: 428898 - RNA, 21 nt, Human
aaaaagcuggggcaugcaugc

SEQ ID NO: 428899 - RNA, 22 nt, Human
ucaagagaaggggaaauagacu

SEQ ID NO: 428900 - RNA, 22 nt, Human
agagcccucuucacugccccuu

SEQ ID NO: 428901 - RNA, 22 nt, Human
ucuggagagucacagugccaga

SEQ ID NO: 428902 - RNA, 22 nt, Human
acuccuggguugcaguccucaa

SEQ ID NO: 428903 - RNA, 20 nt, Human
agccaggccucaaguuaagu

SEQ ID NO: 428904 - RNA, 22 nt, Human
agcuggagcuucaagcagguaa

SEQ ID NO: 428905 - RNA, 22 nt, Human
uggccuugcccagcgccuaggu

SEQ ID NO: 428906 - RNA, 22 nt, Human
gaguuucuucauggugcagagg

SEQ ID NO: 428907 - RNA, 22 nt, Human
cuggcuuuuuucccauuaugca

SEQ ID NO: 428908 - RNA, 22 nt, Human
gccccgucguggggccagggau

SEQ ID NO: 428909 - RNA, 22 nt, Human
aaucuguugucaggaauccaca

SEQ ID NO: 428910 - RNA, 23 nt, Human
ugucuggauucgacugugguugg

SEQ ID NO: 428911 - RNA, 22 nt, Human
ugggggagccuucacaguagcu

SEQ ID NO: 428912 - RNA, 22 nt, Human
aagggccagggcucuagagaua

SEQ ID NO: 428913 - RNA, 19 nt, Human
gagcagcuuccuaucuggu

SEQ ID NO: 428914 - RNA, 19 nt, Human
acccagcccaggaguggca

SEQ ID NO: 428915 - RNA, 22 nt, Human
aggccagggcacugcucuuuag

SEQ ID NO: 428916 - RNA, 22 nt, Human
cuggcagcugcccgagaugccc

SEQ ID NO: 428917 - RNA, 22 nt, Human
ggcucucuuaacuggccauccu

SEQ ID NO: 428918 - RNA, 22 nt, Human
ccugcgcgucugggucugucuc

SEQ ID NO: 428919 - RNA, 22 nt, Human
gcaguggccacauggaggagga

SEQ ID NO: 428920 - RNA, 22 nt, Human
caugcaugccgggcugacagag

SEQ ID NO: 428921 - RNA, 22 nt, Human
aaagaggcucaaggugggccag

SEQ ID NO: 428922 - RNA, 22 nt, Human
uucugugcucaaaacuuuccaa

SEQ ID NO: 428923 - RNA, 20 nt, Human
gggcucugcauccaucagcc

SEQ ID NO: 428924 - RNA, 22 nt, Human
gaugcgggcccgcuccacugcc

SEQ ID NO: 428925 - RNA, 22 nt, Human
cauuuugugcuagacacuaugg

SEQ ID NO: 428926 - RNA, 22 nt, Human
ggcggcacgcaggcugcugucg

SEQ ID NO: 428927 - RNA, 22 nt, Human
ggccagccuggggcucccagac

SEQ ID NO: 428928 - RNA, 22 nt, Human
ucggugcgcgaggcgcgguccc

SEQ ID NO: 428929 - RNA, 22 nt, Human
ggugugggucagcuuuauuaau

SEQ ID NO: 428930 - RNA, 22 nt, Human
aggacugggugcagagggcauc

SEQ ID NO: 428931 - RNA, 22 nt, Human
ccuggggagaagagcuuccccc

SEQ ID NO: 428932 - RNA, 22 nt, Human
gggagccccaccucggugcccg

SEQ ID NO: 428933 - RNA, 22 nt, Human
cucccagggucuaggcugcugg

SEQ ID NO: 428934 - RNA, 22 nt, Human
augcuuucucuuaguucauuga

SEQ ID NO: 428935 - RNA, 22 nt, Human
ggcucugcugguaagaugccuc

SEQ ID NO: 428936 - RNA, 22 nt, Human
agccaggucaggaaagguccca

SEQ ID NO: 428937 - RNA, 21 nt, Human
cccagaaguuccauggggggc

SEQ ID NO: 428938 - RNA, 22 nt, Human
guggcauuugggagaugcgugg

SEQ ID NO: 428939 - RNA, 20 nt, Human
ccacccuguccggggcggag

SEQ ID NO: 428940 - RNA, 22 nt, Human
ucuccacaccagaaggagcuga

SEQ ID NO: 428941 - RNA, 22 nt, Human
aggggagccagggcugcgaguu

SEQ ID NO: 428942 - RNA, 22 nt, Human
gucugugcaguuacuagcuggu

SEQ ID NO: 428943 - RNA, 22 nt, Human
caggugggagccacagcguaca

SEQ ID NO: 428944 - RNA, 22 nt, Human
ugaauaaucuuggguauuaaua

SEQ ID NO: 428945 - RNA, 22 nt, Human
uggcccagcucagggugggcgg

SEQ ID NO: 428946 - RNA, 22 nt, Human
ggaguagcugcauuccgagcac

SEQ ID NO: 428947 - RNA, 22 nt, Human
uggagcugguucuggggaagcu

SEQ ID NO: 428948 - RNA, 22 nt, Human
ucccugagugggcugguaguau

SEQ ID NO: 428949 - RNA, 23 nt, Human
uuaacaggaucucgggcaagagg

SEQ ID NO: 428950 - RNA, 22 nt, Human
ugguuggauggcucuuguggcu

SEQ ID NO: 428951 - RNA, 22 nt, Human
gacggagcugguugcugcggcu

SEQ ID NO: 428952 - RNA, 22 nt, Human
agcuggguacacguugucacaa

SEQ ID NO: 428953 - RNA, 22 nt, Human
gaagcgcggcgucggcgugggu

SEQ ID NO: 428954 - RNA, 22 nt, Human
ggggcccagcaccccuccucgc

SEQ ID NO: 428955 - RNA, 20 nt, Human
ugagccugcuguaggaggcc

SEQ ID NO: 428956 - RNA, 19 nt, Human
ucuggcugccaaggauuga

SEQ ID NO: 428957 - RNA, 22 nt, Human
uuccuggggacuuaccgucauu

SEQ ID NO: 428958 - RNA, 22 nt, Human
aguuuccacuggagacacugug

SEQ ID NO: 428959 - RNA, 22 nt, Human
aggggcuuguggaguugcuggu

SEQ ID NO: 428960 - RNA, 22 nt, Human
auuuggucuacauuuuccaaau

SEQ ID NO: 428961 - RNA, 22 nt, Human
caggggacacuccugcuugggc

SEQ ID NO: 428962 - RNA, 19 nt, Human
cuucaguguucaccuggcc

SEQ ID NO: 428963 - RNA, 22 nt, Human
gcacagagagcagugggggaca

SEQ ID NO: 428964 - RNA, 22 nt, Human
uugauucugcugaucucggacg

SEQ ID NO: 428965 - RNA, 22 nt, Human
cugggguccuugccauguguca

SEQ ID NO: 428966 - RNA, 22 nt, Human
aggcagugguguuugcuggugg

SEQ ID NO: 428967 - RNA, 22 nt, Human
ugggaaggggagcuggaaagga

SEQ ID NO: 428968 - RNA, 21 nt, Human
gcuccuggugcugcguggcgc

SEQ ID NO: 428969 - RNA, 22 nt, Human
agguggagaagagaugggcagu

SEQ ID NO: 428970 - RNA, 21 nt, Human
uaaacauaaccuuguauggcu

SEQ ID NO: 428971 - RNA, 22 nt, Human
ugcugcucuucaccauggccuc

SEQ ID NO: 428972 - RNA, 22 nt, Human
uuuacuguuuacagcuaaugca

SEQ ID NO: 428973 - RNA, 22 nt, Human
agcaccaggucgcuggcacgcu

SEQ ID NO: 428974 - RNA, 22 nt, Human
uggccuuggcagugagaagagu

SEQ ID NO: 428975 - RNA, 22 nt, Human
gugccuccaggcucgacuaguc

SEQ ID NO: 428976 - RNA, 23 nt, Human
acucguggaauucucugcgaucg

SEQ ID NO: 428977 - RNA, 22 nt, Human
ucccugggguaucgcugaggca

SEQ ID NO: 428978 - RNA, 22 nt, Human
aaaucccacucacgaguuuugc

SEQ ID NO: 428979 - RNA, 22 nt, Human
cccacucccugcacgccugccg

SEQ ID NO: 428980 - RNA, 22 nt, Human
gugcagcugugguggagccagg

SEQ ID NO: 428981 - RNA, 22 nt, Human
aucccuggccacgaagcugccc

SEQ ID NO: 428982 - RNA, 22 nt, Human
gcggccuuguggcggagcaggc

SEQ ID NO: 428983 - RNA, 22 nt, Human
ggcgcucaguguugccccagag

SEQ ID NO: 428984 - RNA, 20 nt, Human
cuguuugcuaucaugagcug

SEQ ID NO: 428985 - RNA, 22 nt, Human
cgaggagugugaaggcuugucg

SEQ ID NO: 428986 - RNA, 22 nt, Human
uccacagguccucuuugcaaag

SEQ ID NO: 428987 - RNA, 22 nt, Human
cccagcugaacuugcauuccaa

SEQ ID NO: 428988 - RNA, 20 nt, Human
agcuuugguuaagccagugg

SEQ ID NO: 428989 - RNA, 22 nt, Human
ggcggcgcguagccggagacuu

SEQ ID NO: 428990 - RNA, 22 nt, Human
aggcccugcugaggccucccuc

SEQ ID NO: 428991 - RNA, 22 nt, Human
ugggagcaagcuggugcuggag

SEQ ID NO: 428992 - RNA, 22 nt, Human
uugaggagucaggggcacggaa

SEQ ID NO: 428993 - RNA, 21 nt, Human
ucagagggcccuggaggcuca

SEQ ID NO: 428994 - RNA, 22 nt, Human
uggccccugaggagcgucagcc

SEQ ID NO: 428995 - RNA, 22 nt, Human
ucccggcgcugggagguggguc

SEQ ID NO: 428996 - RNA, 22 nt, Human
uucuguuuauaauuugcaguug

SEQ ID NO: 428997 - RNA, 22 nt, Human
gcccagggcugcaaguggacgc

SEQ ID NO: 428998 - RNA, 22 nt, Human
gaccacaguccagucaucaugg

SEQ ID NO: 428999 - RNA, 22 nt, Human
uuccccuugcacuaucacccug

SEQ ID NO: 429000 - RNA, 22 nt, Human
gcacugggagucuguggggguu

SEQ ID NO: 429001 - RNA, 20 nt, Human
caucaacaccuugucagccu

SEQ ID NO: 429002 - RNA, 19 nt, Human
aggugaugugacucuagaa

SEQ ID NO: 429003 - RNA, 22 nt, Human
gagcuccugaaacguuccugcc

SEQ ID NO: 429004 - RNA, 22 nt, Human
augcugugccuggaaagcggcu

SEQ ID NO: 429005 - RNA, 22 nt, Human
ucugggagaguagauaaaggaa

SEQ ID NO: 429006 - RNA, 22 nt, Human
uuagggacagcucuguagguga

SEQ ID NO: 429007 - RNA, 22 nt, Human
gaccacuggggugagggccauc

SEQ ID NO: 429008 - RNA, 22 nt, Human
uccagugguggcucccggaccu

SEQ ID NO: 429009 - RNA, 22 nt, Human
uagauaccugcuggaccucauu

SEQ ID NO: 429010 - RNA, 22 nt, Human
ugccagagaggagaaagcauuu

SEQ ID NO: 429011 - RNA, 22 nt, Human
gauuccugcuauucacagggcu

SEQ ID NO: 429012 - RNA, 20 nt, Human
ucuggggaugaggucuagga

SEQ ID NO: 429013 - RNA, 22 nt, Human
cugugugcagggcacaauggaa

SEQ ID NO: 429014 - RNA, 22 nt, Human
uggcuccaggggacacgcagua

SEQ ID NO: 429015 - RNA, 22 nt, Human
aauggcuguucucugugauugg

SEQ ID NO: 429016 - RNA, 18 nt, Human
agguguguuucuaggagc

SEQ ID NO: 429017 - RNA, 22 nt, Human
gcggcccgagcaggacgggugg

SEQ ID NO: 429018 - RNA, 22 nt, Human
augugagcuggggcccggccag

SEQ ID NO: 429019 - RNA, 22 nt, Human
cauaaauuguacccauuccaac

SEQ ID NO: 429020 - RNA, 22 nt, Human
ucuuauugugaugaugaagaac

SEQ ID NO: 429021 - RNA, 22 nt, Human
cgugcggccucggggcccggcu

SEQ ID NO: 429022 - RNA, 21 nt, Human
agaugcaguuugcaggugggu

SEQ ID NO: 429023 - RNA, 22 nt, Human
aggagcggauguguccugccag

SEQ ID NO: 429024 - RNA, 23 nt, Human
agguggagcugugcagccggggc

SEQ ID NO: 429025 - RNA, 22 nt, Human
aagggggaaauccuagcgccgc

SEQ ID NO: 429026 - RNA, 21 nt, Human
aggcaugagcccugcauggac

SEQ ID NO: 429027 - RNA, 22 nt, Human
gccagaggggcucgaaggcgcg

SEQ ID NO: 429028 - RNA, 22 nt, Human
caguguuuagcacagugcuugg

SEQ ID NO: 429029 - RNA, 22 nt, Human
ggagaagggaacugaguuuuug

SEQ ID NO: 429030 - RNA, 22 nt, Human
cagaggaccauuguauguauug

SEQ ID NO: 429031 - RNA, 22 nt, Human
caggacccaucagccaggcacu

SEQ ID NO: 429032 - RNA, 19 nt, Human
ucaaagucugagucacuuu

SEQ ID NO: 429033 - RNA, 22 nt, Human
uuauugagcacauaguaugugg

SEQ ID NO: 429034 - RNA, 19 nt, Human
aggaaggcggcggcugccc

SEQ ID NO: 429035 - RNA, 22 nt, Human
agccagucggggccaugcuggg

SEQ ID NO: 429036 - RNA, 22 nt, Human
ucuguuauaaaucacacugcau

SEQ ID NO: 429037 - RNA, 22 nt, Human
cagcccacugccucugugguag

SEQ ID NO: 429038 - RNA, 22 nt, Human
gagcaccgccuccacgaugccc

SEQ ID NO: 429039 - RNA, 23 nt, Human
cguguccuucagggagagugugg

SEQ ID NO: 429040 - RNA, 22 nt, Human
auccaggcgaaugcagaaggcc

SEQ ID NO: 429041 - RNA, 19 nt, Human
ugcuccaggccuugccgca

SEQ ID NO: 429042 - RNA, 22 nt, Human
ggguuguagagcuggaagggga

SEQ ID NO: 429043 - RNA, 22 nt, Human
ggcagguguggugaccagagau

SEQ ID NO: 429044 - RNA, 22 nt, Human
guuuauuggguauuguggagcc

SEQ ID NO: 429045 - RNA, 22 nt, Human
uggcugaguuacgaacagagca

SEQ ID NO: 429046 - RNA, 23 nt, Human
uggcucugagcuuccugguggcc

SEQ ID NO: 429047 - RNA, 20 nt, Human
ucccuggggcccuacuuccu

SEQ ID NO: 429048 - RNA, 22 nt, Human
aggccgugugagcaugugugag

SEQ ID NO: 429049 - RNA, 22 nt, Human
gugggggcaggcagugcuagga

SEQ ID NO: 429050 - RNA, 22 nt, Human
gacauacagcccucucccuggu

SEQ ID NO: 429051 - RNA, 22 nt, Human
agagcgagucuggggcucggau

SEQ ID NO: 429052 - RNA, 22 nt, Human
cuguguacccacgugggcaccc

SEQ ID NO: 429053 - RNA, 22 nt, Human
acacggcacuuuaggaaggggc

SEQ ID NO: 429054 - RNA, 22 nt, Human
ucgcuugaacccaggaagugga

SEQ ID NO: 429055 - RNA, 22 nt, Human
aacccuggggcugcucugccug

SEQ ID NO: 429056 - RNA, 22 nt, Human
uucuccccgucucucugaggcc

SEQ ID NO: 429057 - RNA, 22 nt, Human
gcacccagggcaggaagugagg

SEQ ID NO: 429058 - RNA, 22 nt, Human
acgccucugcagcugccgggcc

SEQ ID NO: 429059 - RNA, 22 nt, Human
ucccugccuccuggcagugcca

SEQ ID NO: 429060 - RNA, 22 nt, Human
ggccgcggauuuucccgcuggc

SEQ ID NO: 429061 - RNA, 22 nt, Human
uggcugaggucuggggcuucug

SEQ ID NO: 429062 - RNA, 22 nt, Human
ggugugucugccaggaacugca

SEQ ID NO: 429063 - RNA, 22 nt, Human
acccaggucucucgacuucugg

SEQ ID NO: 429064 - RNA, 22 nt, Human
cuccuuggguucuuucgguucc

SEQ ID NO: 429065 - RNA, 22 nt, Human
gcugcccauugcucucccacuc

SEQ ID NO: 429066 - RNA, 22 nt, Human
aagggccacaugccauuuaaaa

SEQ ID NO: 429067 - RNA, 22 nt, Human
gccuggcgccgggcugccuguc

SEQ ID NO: 429068 - RNA, 22 nt, Human
gugcuuccuguauugauuccau

SEQ ID NO: 429069 - RNA, 22 nt, Human
ccagagagggcgccaccuggag

SEQ ID NO: 429070 - RNA, 22 nt, Human
ggagugggaacaaugacauggu

SEQ ID NO: 429071 - RNA, 22 nt, Human
gagggcugccacguugggcgag

SEQ ID NO: 429072 - RNA, 21 nt, Human
ggcagcucagcagauggggac

SEQ ID NO: 429073 - RNA, 22 nt, Human
ucgauuuguuugggggagaagu

SEQ ID NO: 429074 - RNA, 22 nt, Human
cagugcugcaggcgccugcggu

SEQ ID NO: 429075 - RNA, 22 nt, Human
agggagcugcucugcuuccgug

SEQ ID NO: 429076 - RNA, 22 nt, Human
cugggaguugacgaggcuugua

SEQ ID NO: 429077 - RNA, 22 nt, Human
uacucuggaguugagaugcgag

SEQ ID NO: 429078 - RNA, 22 nt, Human
ugggugccaaccucugguggcc

SEQ ID NO: 429079 - RNA, 22 nt, Human
ccagcaggaaagugacguuuga

SEQ ID NO: 429080 - RNA, 22 nt, Human
aggccaagcucccagagaagcu

SEQ ID NO: 429081 - RNA, 22 nt, Human
uguguccuucugggagucccag

SEQ ID NO: 429082 - RNA, 22 nt, Human
cuggcccagguggucguugagg

SEQ ID NO: 429083 - RNA, 22 nt, Human
aggggcagccucacaauccucu

SEQ ID NO: 429084 - RNA, 22 nt, Human
agugauguagguggauucuggc

SEQ ID NO: 429085 - RNA, 22 nt, Human
ggccauggcgggagccggcguc

SEQ ID NO: 429086 - RNA, 22 nt, Human
uugcacgcuugcgguuccugcc

SEQ ID NO: 429087 - RNA, 22 nt, Human
ggucagugccuaucaugugggc

SEQ ID NO: 429088 - RNA, 22 nt, Human
gaugugucccuuucaacucaga

SEQ ID NO: 429089 - RNA, 22 nt, Human
uggcccgggaguuuugaagagu

SEQ ID NO: 429090 - RNA, 22 nt, Human
uccggcggccggccugagcccg

SEQ ID NO: 429091 - RNA, 22 nt, Human
agggggcuccuuggugugcaga

SEQ ID NO: 429092 - RNA, 22 nt, Human
ugucuuuagccacuugccucuu

SEQ ID NO: 429093 - RNA, 21 nt, Human
uaggugggagccccaguaugc

SEQ ID NO: 429094 - RNA, 22 nt, Human
ccaggaggaaagaccagcccau

SEQ ID NO: 429095 - RNA, 22 nt, Human
gagacagagagguacucaacau

SEQ ID NO: 429096 - RNA, 22 nt, Human
caggguggcaggcaccauggcc

SEQ ID NO: 429097 - RNA, 22 nt, Human
uguuaguauuggcaaauuuguu

SEQ ID NO: 429098 - RNA, 22 nt, Human
gggucagggaggccccaccaug

SEQ ID NO: 429099 - RNA, 22 nt, Human
guuuccaggcuuugguaugguu

SEQ ID NO: 429100 - RNA, 22 nt, Human
ugcccacaggaagacaccagcg

SEQ ID NO: 429101 - RNA, 22 nt, Human
cuggagcagcagguggccaggg

SEQ ID NO: 429102 - RNA, 22 nt, Human
ccuggccauagggcccaggaaa

SEQ ID NO: 429103 - RNA, 22 nt, Human
uuauugcuaugaugauguguag

SEQ ID NO: 429104 - RNA, 22 nt, Human
ugcacgugugagcauucacaug

SEQ ID NO: 429105 - RNA, 22 nt, Human
acagggagucugaggggauagu

SEQ ID NO: 429106 - RNA, 16 nt, Human
uugccgcacaggucgc

SEQ ID NO: 429107 - RNA, 22 nt, Human
cugcggcuggggacagcuguug

SEQ ID NO: 429108 - RNA, 22 nt, Human
caggcccuuuccugggcauagg

SEQ ID NO: 429109 - RNA, 22 nt, Human
ugccuguggaaaggcuggugcu

SEQ ID NO: 429110 - RNA, 22 nt, Human
cuggaaggagcccgggcggauc

SEQ ID NO: 429111 - RNA, 22 nt, Human
ugcuugcugaaaggcauuuaga

SEQ ID NO: 429112 - RNA, 22 nt, Human
acagagggucugggcacaggac

SEQ ID NO: 429113 - RNA, 22 nt, Human
caaugggccuggagagagcugg

SEQ ID NO: 429114 - RNA, 22 nt, Human
ggcagguguuuuuauauuaaag

SEQ ID NO: 429115 - RNA, 22 nt, Human
gagaggaagccuucuguacuug

SEQ ID NO: 429116 - RNA, 22 nt, Human
gcccagcaccucucucaggguu

SEQ ID NO: 429117 - RNA, 22 nt, Human
uccugcagccauuagaggucaa

SEQ ID NO: 429118 - RNA, 22 nt, Human
cccucucccugcagaauguggc

SEQ ID NO: 429119 - RNA, 22 nt, Human
accaagaguccaagugagguug

SEQ ID NO: 429120 - RNA, 17 nt, Human
ugggggcccuguguaga

SEQ ID NO: 429121 - RNA, 22 nt, Human
gcagggcugauggcuucccuca

SEQ ID NO: 429122 - RNA, 22 nt, Human
cucuauucuaauggauucuggg

SEQ ID NO: 429123 - RNA, 17 nt, Human
ggugaguguccaggugg

SEQ ID NO: 429124 - RNA, 22 nt, Human
aaggugccacuucccucagacu

SEQ ID NO: 429125 - RNA, 22 nt, Human
cuccccuagcccguugggaggu

SEQ ID NO: 429126 - RNA, 22 nt, Human
acgcggugcggcaaguucaugg

SEQ ID NO: 429127 - RNA, 22 nt, Human
uaaugccuuucuguacuauaug

SEQ ID NO: 429128 - RNA, 22 nt, Human
ucugggugucacuccugccugc

SEQ ID NO: 429129 - RNA, 22 nt, Human
acaagcgggccacagugcuggu

SEQ ID NO: 429130 - RNA, 22 nt, Human
cuguggcugcgcccugggggag

SEQ ID NO: 429131 - RNA, 22 nt, Human
uggcuuccagaacugagcaaca

SEQ ID NO: 429132 - RNA, 22 nt, Human
caggacccaaccucccugcucu

SEQ ID NO: 429133 - RNA, 22 nt, Human
uugaacaguccuaagagacccu

SEQ ID NO: 429134 - RNA, 22 nt, Human
agcuuugggcagaagaggauuc

SEQ ID NO: 429135 - RNA, 22 nt, Human
cuccagcagaaagggcgagugg

SEQ ID NO: 429136 - RNA, 22 nt, Human
aggugcugccccgagaaggaug

SEQ ID NO: 429137 - RNA, 23 nt, Human
ugggcagcuucugcaugcccacc

SEQ ID NO: 429138 - RNA, 22 nt, Human
cugagcagucuagccagguguu

SEQ ID NO: 429139 - RNA, 22 nt, Human
aggagacaguuuggacguguag

SEQ ID NO: 429140 - RNA, 22 nt, Human
aggcucccaagcacugacccca

SEQ ID NO: 429141 - RNA, 22 nt, Human
cccucuggcucuucucaggccg

SEQ ID NO: 429142 - RNA, 20 nt, Human
ggccggggagcucuccaggg

SEQ ID NO: 429143 - RNA, 22 nt, Human
ggaggugacuggaucaugggca

SEQ ID NO: 429144 - RNA, 22 nt, Human
uuauuuuguagcucugaucuuu

SEQ ID NO: 429145 - RNA, 22 nt, Human
ugcccguggccuggggcagcuu

SEQ ID NO: 429146 - RNA, 22 nt, Human
cuggcuccauccuugagcucug

SEQ ID NO: 429147 - RNA, 22 nt, Human
gaggggccuggcgaggacaugu

SEQ ID NO: 429148 - RNA, 22 nt, Human
aucaagggcgcgugguucggcg

SEQ ID NO: 429149 - RNA, 20 nt, Human
uguauuuaaugaaggcuuuu

SEQ ID NO: 429150 - RNA, 22 nt, Human
uggaaggggccaggcgcggagu

SEQ ID NO: 429151 - RNA, 22 nt, Human
gaccuccguguacaccucccag

SEQ ID NO: 429152 - RNA, 22 nt, Human
gccagccccagacauccuaucg

SEQ ID NO: 429153 - RNA, 22 nt, Human
cagugccaaggauggccuggga

SEQ ID NO: 429154 - RNA, 22 nt, Human
cggggccuagucuaccucggca

SEQ ID NO: 429155 - RNA, 22 nt, Human
cagaggccuggcuuggacaccu

SEQ ID NO: 429156 - RNA, 22 nt, Human
gggaggugauuaggaccaugua

SEQ ID NO: 429157 - RNA, 22 nt, Human
gaaggagaggauugugaggcug

SEQ ID NO: 429158 - RNA, 22 nt, Human
gguguggcaguggaccugugaa

SEQ ID NO: 429159 - RNA, 22 nt, Human
gggcaugguggcaggcaccugu

SEQ ID NO: 429160 - RNA, 22 nt, Human
cugggccacaagccugugugau

SEQ ID NO: 429161 - RNA, 22 nt, Human
ucccaggauguuuauggcuggu

SEQ ID NO: 429162 - RNA, 22 nt, Human
cgcggucucuuuaaggcggguc

SEQ ID NO: 429163 - RNA, 22 nt, Human
gacagcagccacagggagaggg

SEQ ID NO: 429164 - RNA, 22 nt, Human
ggcuguggucauuaggagguug

SEQ ID NO: 429165 - RNA, 22 nt, Human
uuuggauugcuuggaugcuucg

SEQ ID NO: 429166 - RNA, 22 nt, Human
auccugggaaguggccuccucc

SEQ ID NO: 429167 - RNA, 22 nt, Human
ugacaagagaccccuccgcagg

SEQ ID NO: 429168 - RNA, 22 nt, Human
gcugccuggaauaacggcuggc

SEQ ID NO: 429169 - RNA, 22 nt, Human
uggcccugccgccacgacgucu

SEQ ID NO: 429170 - RNA, 22 nt, Human
cucugcaggcacccaggguggg

SEQ ID NO: 429171 - RNA, 22 nt, Human
gggacuggaguagaggccggug

SEQ ID NO: 429172 - RNA, 22 nt, Human
ucuggcuucaguaggguucacu

SEQ ID NO: 429173 - RNA, 22 nt, Human
gggggacaggaugaauaucugu

SEQ ID NO: 429174 - RNA, 22 nt, Human
gggagccagcagggcauggagc

SEQ ID NO: 429175 - RNA, 22 nt, Human
gggcugaauuuguugcauguaa

SEQ ID NO: 429176 - RNA, 22 nt, Human
gagcugagggucuaggaggguu

SEQ ID NO: 429177 - RNA, 22 nt, Human
cagcgguggcaaggugacugug

SEQ ID NO: 429178 - RNA, 22 nt, Human
gggagagcgcgcuagggccgag

SEQ ID NO: 429179 - RNA, 22 nt, Human
ggcagccagagggcagcuggau

SEQ ID NO: 429180 - RNA, 22 nt, Human
ugaaaacacuuuaguuuagguc

SEQ ID NO: 429181 - RNA, 22 nt, Human
cucgcggcgcccgaagcccuug

SEQ ID NO: 429182 - RNA, 22 nt, Human
ggucuccugaccuuuagucccu

SEQ ID NO: 429183 - RNA, 18 nt, Human
gguguguaacguguuuuc

SEQ ID NO: 429184 - RNA, 22 nt, Human
cugggcuguuuguucuggucuc

SEQ ID NO: 429185 - RNA, 22 nt, Human
uggcugggagcuggaacugggc

SEQ ID NO: 429186 - RNA, 22 nt, Human
ugggagagauaggcuucuggac

SEQ ID NO: 429187 - RNA, 22 nt, Human
guggccaucuuuggcccugacu

SEQ ID NO: 429188 - RNA, 22 nt, Human
agguggaguuaagugugaacug

SEQ ID NO: 429189 - RNA, 22 nt, Human
ugucugccugcgggccggcaca

SEQ ID NO: 429190 - RNA, 22 nt, Human
gcggcccggguccccagcagca

SEQ ID NO: 429191 - RNA, 21 nt, Human
ugcuggguuugcccaucaggc

SEQ ID NO: 429192 - RNA, 22 nt, Human
ccagaucccuguuugccucugg

SEQ ID NO: 429193 - RNA, 22 nt, Human
ucuccaggggcagggucuggag

SEQ ID NO: 429194 - RNA, 22 nt, Human
gccugagccgccugagcggcgg

SEQ ID NO: 429195 - RNA, 22 nt, Human
ucacaggagcccaggggagcug

SEQ ID NO: 429196 - RNA, 22 nt, Human
acucgcggcggacggcggccag

SEQ ID NO: 429197 - RNA, 22 nt, Human
acuguagucuaaauauagucuu

SEQ ID NO: 429198 - RNA, 17 nt, Human
gccuggcccagccuggc

SEQ ID NO: 429199 - RNA, 19 nt, Human
uuuaaugugugcugcaauc

SEQ ID NO: 429200 - RNA, 22 nt, Human
uggcaugcaagaggaggcuccc

SEQ ID NO: 429201 - RNA, 22 nt, Human
uccgcgcucucacccgcucccg

SEQ ID NO: 429202 - RNA, 21 nt, Human
gcaggguuugugcugugaguu

SEQ ID NO: 429203 - RNA, 22 nt, Human
agccagcauauauauaguugaa

SEQ ID NO: 429204 - RNA, 22 nt, Human
ugaccguuuuggcacccaugcu

SEQ ID NO: 429205 - RNA, 22 nt, Human
ugaguccagaugggccagcagg

SEQ ID NO: 429206 - RNA, 18 nt, Human
uccaggcuccaggcuaac

SEQ ID NO: 429207 - RNA, 22 nt, Human
guggcagcggcccaggccgucu

SEQ ID NO: 429208 - RNA, 22 nt, Human
cugggccucacccuagaccaau

SEQ ID NO: 429209 - RNA, 22 nt, Human
caugccugccuggugggcgugg

SEQ ID NO: 429210 - RNA, 22 nt, Human
uggccagaacucagacaugugg

SEQ ID NO: 429211 - RNA, 22 nt, Human
ucggagcgucacuggcuggagg

SEQ ID NO: 429212 - RNA, 22 nt, Human
ggagaggguguggaaaguuauc

SEQ ID NO: 429213 - RNA, 19 nt, Human
cugggacaaugaaagcauc

SEQ ID NO: 429214 - RNA, 22 nt, Human
ugguaaaugucuaacaaucacu

SEQ ID NO: 429215 - RNA, 22 nt, Human
cagugcccuuccaggacugcag

SEQ ID NO: 429216 - RNA, 22 nt, Human
aggcugucucaccucaggaggg

SEQ ID NO: 429217 - RNA, 22 nt, Human
auucccagauuuauauugauag

SEQ ID NO: 429218 - RNA, 22 nt, Human
ugcauuucccauuguguggcuc

SEQ ID NO: 429219 - RNA, 22 nt, Human
ucagccaggccaggcauucaca

SEQ ID NO: 429220 - RNA, 19 nt, Human
gaugcucauucagguggaa

SEQ ID NO: 429221 - RNA, 23 nt, Human
ugacagagcacagugggggagau

SEQ ID NO: 429222 - RNA, 22 nt, Human
guaggggccagaaagacuuaga

SEQ ID NO: 429223 - RNA, 22 nt, Human
acccacagccgcugugcguccc

SEQ ID NO: 429224 - RNA, 22 nt, Human
guugggcugaagugugugcuua

SEQ ID NO: 429225 - RNA, 22 nt, Human
cugcacagccugucugggggcc

SEQ ID NO: 429226 - RNA, 22 nt, Human
caauuaccaguaauugagguuu

SEQ ID NO: 429227 - RNA, 15 nt, Human
uggugguguugagac

SEQ ID NO: 429228 - RNA, 22 nt, Human
uguuaccauaggucagaacguu

SEQ ID NO: 429229 - RNA, 22 nt, Human
ugggcaaggcuggagccugcag

SEQ ID NO: 429230 - RNA, 22 nt, Human
cuuuggucuccgucaucaauca

SEQ ID NO: 429231 - RNA, 22 nt, Human
uuuguugguugcacuggugggu

SEQ ID NO: 429232 - RNA, 22 nt, Human
cugggaggcccacguugggaag

SEQ ID NO: 429233 - RNA, 22 nt, Human
ugggcccaucauugcugugggc

SEQ ID NO: 429234 - RNA, 22 nt, Human
aacagaaaucauuuagggcucu

SEQ ID NO: 429235 - RNA, 22 nt, Human
caugaccagagaggacggccag

SEQ ID NO: 429236 - RNA, 22 nt, Human
ggaaacugcuuacacuagaggg

SEQ ID NO: 429237 - RNA, 22 nt, Human
ugucuggauagagccuaggccc

SEQ ID NO: 429238 - RNA, 22 nt, Human
gaggagaggcuggacgcgguga

SEQ ID NO: 429239 - RNA, 22 nt, Human
uaaugccuuaugucaaauguaa

SEQ ID NO: 429240 - RNA, 20 nt, Human
cagagcagugcccaggcggc

SEQ ID NO: 429241 - RNA, 22 nt, Human
uuaauggauuggagguuucaau

SEQ ID NO: 429242 - RNA, 17 nt, Human
uuuguucguuaguccgg

SEQ ID NO: 429243 - RNA, 22 nt, Human
ccaggaggcggaagguacagug

SEQ ID NO: 429244 - RNA, 20 nt, Human
augucaggaagggagucagg

SEQ ID NO: 429245 - RNA, 22 nt, Human
gggccccaagaaccuccuccug

SEQ ID NO: 429246 - RNA, 22 nt, Human
ugccuaggcuggaaugcagugg

SEQ ID NO: 429247 - RNA, 22 nt, Human
augugggccgugcggguguccu

SEQ ID NO: 429248 - RNA, 22 nt, Human
uuuaacccaaauaaccacagga

SEQ ID NO: 429249 - RNA, 22 nt, Human
uggcuccguuguacaggcugga

SEQ ID NO: 429250 - RNA, 22 nt, Human
cuggagggcugcagcgaggcug

SEQ ID NO: 429251 - RNA, 22 nt, Human
agggaugcaguaaaaacuguag

SEQ ID NO: 429252 - RNA, 22 nt, Human
guccacauaggaacccagcuuc

SEQ ID NO: 429253 - RNA, 22 nt, Human
caauaauugcuuuccagaguua

SEQ ID NO: 429254 - RNA, 22 nt, Human
cccuugggcuucagcccuaccg

SEQ ID NO: 429255 - RNA, 22 nt, Human
gcguggcuuagagugggguacc

SEQ ID NO: 429256 - RNA, 22 nt, Human
uuucugugauaggcugcgacgc

SEQ ID NO: 429257 - RNA, 22 nt, Human
acaacuuuaauggguuucagcu

SEQ ID NO: 429258 - RNA, 22 nt, Human
gguguuguacauucuguggauu

SEQ ID NO: 429259 - RNA, 23 nt, Human
agccucuuguggauggucagcga

SEQ ID NO: 429260 - RNA, 22 nt, Human
ggugcccaaggaagguugccgu

SEQ ID NO: 429261 - RNA, 22 nt, Human
aggcggcuccgggagugugggc

SEQ ID NO: 429262 - RNA, 22 nt, Human
uccuggcccuguggccugcagu

SEQ ID NO: 429263 - RNA, 19 nt, Human
acugcagggaggaggugug

SEQ ID NO: 429264 - RNA, 22 nt, Human
cuggcuuucauggcgcaguuga

SEQ ID NO: 429265 - RNA, 22 nt, Human
uauggauauaaucagacuggaa

SEQ ID NO: 429266 - RNA, 22 nt, Human
ugcagaauauucuggugacaau

SEQ ID NO: 429267 - RNA, 22 nt, Human
gaaggacccucuggggucucag

SEQ ID NO: 429268 - RNA, 22 nt, Human
acuggcaguagagggagcgcau

SEQ ID NO: 429269 - RNA, 22 nt, Human
cccaggaacagcacagaacagc

SEQ ID NO: 429270 - RNA, 22 nt, Human
agcuggugauguggucccucac

SEQ ID NO: 429271 - RNA, 22 nt, Human
aggcugagccugggcguggugg

SEQ ID NO: 429272 - RNA, 22 nt, Human
uccaggagcucauccacgucaa

SEQ ID NO: 429273 - RNA, 22 nt, Human
cugggcuuucaggcccuaaggc

SEQ ID NO: 429274 - RNA, 19 nt, Human
uccuggggaggggcauggc

SEQ ID NO: 429275 - RNA, 22 nt, Human
ggccugcuucucugggcuuucu

SEQ ID NO: 429276 - RNA, 22 nt, Human
gcagcagaaggccaaggggagc

SEQ ID NO: 429277 - RNA, 22 nt, Human
agccacauggaccugaugcuag

SEQ ID NO: 429278 - RNA, 22 nt, Human
ugagccuggagucguggagggg

SEQ ID NO: 429279 - RNA, 22 nt, Human
ucaccggcagacguggccugau

SEQ ID NO: 429280 - RNA, 19 nt, Human
ugccuggcaccagcuccac

SEQ ID NO: 429281 - RNA, 22 nt, Human
aaggcccacagaacugucucca

SEQ ID NO: 429282 - RNA, 22 nt, Human
guucucucagcgauagugaugg

SEQ ID NO: 429283 - RNA, 22 nt, Human
cccaggacucugacacccccaa

SEQ ID NO: 429284 - RNA, 22 nt, Human
agauguuuuuccaggucuaauu

SEQ ID NO: 429285 - RNA, 22 nt, Human
cccaggaguaagugacauuguu

SEQ ID NO: 429286 - RNA, 22 nt, Human
aggcagccuauggggagcucag

SEQ ID NO: 429287 - RNA, 22 nt, Human
cgccguccccuaggaaagagcu

SEQ ID NO: 429288 - RNA, 22 nt, Human
cuccugcagcccucagcagcca

SEQ ID NO: 429289 - RNA, 22 nt, Human
uuugcaaaguccauugaaguua

SEQ ID NO: 429290 - RNA, 22 nt, Human
uuggaggaagcucaugggggau

SEQ ID NO: 429291 - RNA, 18 nt, Human
uggcagccagcugcuccu

SEQ ID NO: 429292 - RNA, 22 nt, Human
ucuggcccaucuucugccacca

SEQ ID NO: 429293 - RNA, 22 nt, Human
ucaggccccaucccagacuuau

SEQ ID NO: 429294 - RNA, 22 nt, Human
gcugggugauucauuuccauaa

SEQ ID NO: 429295 - RNA, 21 nt, Human
ccuguggugccagaucgccag

SEQ ID NO: 429296 - RNA, 22 nt, Human
gcugggcaggccucgugagggc

SEQ ID NO: 429297 - RNA, 22 nt, Human
ucucagggaugggaggccccag

SEQ ID NO: 429298 - RNA, 22 nt, Human
uauugccaaaugucugcuggaa

SEQ ID NO: 429299 - RNA, 18 nt, Human
gccuggcuucggagccgc

SEQ ID NO: 429300 - RNA, 22 nt, Human
ggugacgaauccauagcaucga

SEQ ID NO: 429301 - RNA, 21 nt, Human
ggccuuggcgggggccgaauu

SEQ ID NO: 429302 - RNA, 22 nt, Human
gccagagaggccuuagaaucca

SEQ ID NO: 429303 - RNA, 22 nt, Human
gcugauggcuugcuggcugaca

SEQ ID NO: 429304 - RNA, 22 nt, Human
agaggaaguaaucaggaccugc

SEQ ID NO: 429305 - RNA, 22 nt, Human
ugccagcaguagcaguaggcca

SEQ ID NO: 429306 - RNA, 22 nt, Human
cagggcucacucggcuggcguc

SEQ ID NO: 429307 - RNA, 22 nt, Human
cugucacagcccgcgucuccuc

SEQ ID NO: 429308 - RNA, 22 nt, Human
agugggagcggcagucggggac

SEQ ID NO: 429309 - RNA, 22 nt, Human
cugggguuggccagggcccuag

SEQ ID NO: 429310 - RNA, 22 nt, Human
gucuggagccacugcugcugcu

SEQ ID NO: 429311 - RNA, 22 nt, Human
gcugcuccgcagagugugugug

SEQ ID NO: 429312 - RNA, 22 nt, Human
ucguggaugcgcagggcggccu

SEQ ID NO: 429313 - RNA, 19 nt, Human
auacacguguauacauaca

SEQ ID NO: 429314 - RNA, 22 nt, Human
augaggagucaaggagucggag

SEQ ID NO: 429315 - RNA, 22 nt, Human
uccaggagugauaaggccacug

SEQ ID NO: 429316 - RNA, 22 nt, Human
auagacacagcuaugauuugag

SEQ ID NO: 429317 - RNA, 22 nt, Human
cggcagcgguuggagguuguag

SEQ ID NO: 429318 - RNA, 22 nt, Human
acucagaguuugcguuccauac

SEQ ID NO: 429319 - RNA, 22 nt, Human
aggcucagcaucugauucauau

SEQ ID NO: 429320 - RNA, 22 nt, Human
agagcggggauaguuaauauuc

SEQ ID NO: 429321 - RNA, 22 nt, Human
cugggaccugugugccugggcc

SEQ ID NO: 429322 - RNA, 22 nt, Human
caucagucugaaagccagggag

SEQ ID NO: 429323 - RNA, 22 nt, Human
aggcaguuguugcugagcagcu

SEQ ID NO: 429324 - RNA, 22 nt, Human
gugggccugaugcugccaugag

SEQ ID NO: 429325 - RNA, 22 nt, Human
ggcuagggaucuagaccaggac

SEQ ID NO: 429326 - RNA, 22 nt, Human
ccccagcagacucagggcaggu

SEQ ID NO: 429327 - RNA, 19 nt, Human
gggucccacugcccgucug

SEQ ID NO: 429328 - RNA, 22 nt, Human
gcugggcugcgucggggaagcc

SEQ ID NO: 429329 - RNA, 22 nt, Human
cuccagagagaaaggaggccgc

SEQ ID NO: 429330 - RNA, 22 nt, Human
gagguccacugaggcaacaggg

SEQ ID NO: 429331 - RNA, 23 nt, Human
gggugcugccuguagucaugcug

SEQ ID NO: 429332 - RNA, 22 nt, Human
acagagacaauauuuguaaagu

SEQ ID NO: 429333 - RNA, 22 nt, Human
caacuuuagaccccaaguagcu

SEQ ID NO: 429334 - RNA, 22 nt, Human
ggcagcaggguagccauuucuc

SEQ ID NO: 429335 - RNA, 22 nt, Human
aagucuucagacuggagagauu

SEQ ID NO: 429336 - RNA, 17 nt, Human
uuucugcaugauuggac

SEQ ID NO: 429337 - RNA, 22 nt, Human
ugggugguugcugaggcuccuu

SEQ ID NO: 429338 - RNA, 22 nt, Human
ccagagacaaggagcuggaguc

SEQ ID NO: 429339 - RNA, 22 nt, Human
uggcuggggccugaauccugca

SEQ ID NO: 429340 - RNA, 22 nt, Human
ccagcugggucccugcuggggc

SEQ ID NO: 429341 - RNA, 22 nt, Human
uguccuguccuuccuggaaguc

SEQ ID NO: 429342 - RNA, 22 nt, Human
ucgucugugaaauugggauaag

SEQ ID NO: 429343 - RNA, 22 nt, Human
cuccaggacugaggacagagcu

SEQ ID NO: 429344 - RNA, 22 nt, Human
uuuccaaagguggcaggaacaa

SEQ ID NO: 429345 - RNA, 22 nt, Human
ggugcggagacuccaugaggcc

SEQ ID NO: 429346 - RNA, 22 nt, Human
gcggcgccugggacccgccagc

SEQ ID NO: 429347 - RNA, 22 nt, Human
gugcuccaggucgcucagagag

SEQ ID NO: 429348 - RNA, 22 nt, Human
ugacucacuuaauuuacaaguc

SEQ ID NO: 429349 - RNA, 22 nt, Human
augggucccuggccgcccucgg

SEQ ID NO: 429350 - RNA, 22 nt, Human
uccagcucugcugugcgccggu

SEQ ID NO: 429351 - RNA, 22 nt, Human
cagcuccagcccaggcagcucc

SEQ ID NO: 429352 - RNA, 22 nt, Human
ggcucuccacuauggaugagaa

SEQ ID NO: 429353 - RNA, 22 nt, Human
gggcagcaaaucugagucuggu

SEQ ID NO: 429354 - RNA, 22 nt, Human
gauugcugccagcguguccgug

SEQ ID NO: 429355 - RNA, 22 nt, Human
caggcuacauuugcucugagaa

SEQ ID NO: 429356 - RNA, 22 nt, Human
ggcccucucuacauguuagacg

SEQ ID NO: 429357 - RNA, 22 nt, Human
uccagcugugcuccaggaggug

SEQ ID NO: 429358 - RNA, 22 nt, Human
guggccuuuucaaguaggguau

SEQ ID NO: 429359 - RNA, 22 nt, Human
aggccagugguucucugugucc

SEQ ID NO: 429360 - RNA, 22 nt, Human
ccuggccgacauggugaaacgc

SEQ ID NO: 429361 - RNA, 22 nt, Human
gacaggugcuaagggaccuggc

SEQ ID NO: 429362 - RNA, 21 nt, Human
uggcccuggccacggcugcca

SEQ ID NO: 429363 - RNA, 22 nt, Human
acugagcaggguuccgcaugga

SEQ ID NO: 429364 - RNA, 16 nt, Human
ucucuggguugcacag

SEQ ID NO: 429365 - RNA, 22 nt, Human
aguguucuagcgcugugcuugu

SEQ ID NO: 429366 - RNA, 22 nt, Human
ggaaggggagcuaaaucuacug

SEQ ID NO: 429367 - RNA, 22 nt, Human
agcagcaggagccgugggguga

SEQ ID NO: 429368 - RNA, 22 nt, Human
ggcuuuggggguguccaagaaa

SEQ ID NO: 429369 - RNA, 22 nt, Human
agcuggguguagggcuggacaa

SEQ ID NO: 429370 - RNA, 22 nt, Human
ugaggucuguccugucuuugga

SEQ ID NO: 429371 - RNA, 22 nt, Human
gggacaaccaacuuagcauuac

SEQ ID NO: 429372 - RNA, 22 nt, Human
ucaauuuauguggcuauucauu

SEQ ID NO: 429373 - RNA, 18 nt, Human
uggggggcuugucugaag

SEQ ID NO: 429374 - RNA, 22 nt, Human
gcuagggagacuugugucauca

SEQ ID NO: 429375 - RNA, 22 nt, Human
auguccagaguaaagcacauuc

SEQ ID NO: 429376 - RNA, 23 nt, Human
gguuggcuguacccaggcucccu

SEQ ID NO: 429377 - RNA, 22 nt, Human
caccugagcaacccugugcggg

SEQ ID NO: 429378 - RNA, 23 nt, Human
ucucaggguggcugggcccaucc

SEQ ID NO: 429379 - RNA, 19 nt, Human
ggaggcuucuuggggucgg

SEQ ID NO: 429380 - RNA, 22 nt, Human
ccagcagccaccuucucgaaau

SEQ ID NO: 429381 - RNA, 22 nt, Human
ggaccugaacauaaaacgaggc

SEQ ID NO: 429382 - RNA, 22 nt, Human
uaaaaguuagcuaggacaaagu

SEQ ID NO: 429383 - RNA, 22 nt, Human
uggcugagugaacauguccauu

SEQ ID NO: 429384 - RNA, 22 nt, Human
acgugcaggaucugguuggcga

SEQ ID NO: 429385 - RNA, 22 nt, Human
ggcagcagaacuggcccuguau

SEQ ID NO: 429386 - RNA, 22 nt, Human
caucaggaauaaaugaggcugu

SEQ ID NO: 429387 - RNA, 22 nt, Human
aggcucaguauagcuggcaagu

SEQ ID NO: 429388 - RNA, 22 nt, Human
ugcccuccacaguggcuccacc

SEQ ID NO: 429389 - RNA, 22 nt, Human
ugugagacguaggccaucgagg

SEQ ID NO: 429390 - RNA, 22 nt, Human
acuggcccuggcugcuaggcug

SEQ ID NO: 429391 - RNA, 22 nt, Human
gggcugacaccacccaggcgca

SEQ ID NO: 429392 - RNA, 22 nt, Human
uugggucaugggaucccagcau

SEQ ID NO: 429393 - RNA, 22 nt, Human
cuggcuccucaggacugcggga

SEQ ID NO: 429394 - RNA, 22 nt, Human
gcccacagucuaucaguuugcg

SEQ ID NO: 429395 - RNA, 22 nt, Human
ugcaggccuggacugauguggu

SEQ ID NO: 429396 - RNA, 22 nt, Human
ugcuggcugggcugcuggagac

SEQ ID NO: 429397 - RNA, 22 nt, Human
agcgggucugcaagccuucccu

SEQ ID NO: 429398 - RNA, 22 nt, Human
ggccuugggauguggcugcagc

SEQ ID NO: 429399 - RNA, 22 nt, Human
gagguggcugcuugcugggaaa

SEQ ID NO: 429400 - RNA, 22 nt, Human
uggggucagcaggccuggccug

SEQ ID NO: 429401 - RNA, 22 nt, Human
ggggaggaagcuggaacacggg

SEQ ID NO: 429402 - RNA, 22 nt, Human
caggcgaccccuaggagcaaca

SEQ ID NO: 429403 - RNA, 22 nt, Human
agcaggugucacuuucacucca

SEQ ID NO: 429404 - RNA, 18 nt, Human
agggagagaccgcggguc

SEQ ID NO: 429405 - RNA, 22 nt, Human
ucuccccaguauggauucucug

SEQ ID NO: 429406 - RNA, 22 nt, Human
gugagguccucccugcugggag

SEQ ID NO: 429407 - RNA, 22 nt, Human
gccagcagcucuugggcgggca

SEQ ID NO: 429408 - RNA, 22 nt, Human
cuucuccgacaaccgacgccgg

SEQ ID NO: 429409 - RNA, 22 nt, Human
cauugggcggggaccucggcug

SEQ ID NO: 429410 - RNA, 22 nt, Human
cgaggaggaaacgcggagaacu

SEQ ID NO: 429411 - RNA, 22 nt, Human
ugcccagucuccgggccagccc

SEQ ID NO: 429412 - RNA, 17 nt, Human
gugcuggccuggggcuc

SEQ ID NO: 429413 - RNA, 22 nt, Human
agguucccagagauagagcugu

SEQ ID NO: 429414 - RNA, 22 nt, Human
agaaucugcauuuuaacaagau

SEQ ID NO: 429415 - RNA, 22 nt, Human
acaggaaaugaaaugguaucua

SEQ ID NO: 429416 - RNA, 18 nt, Human
gaucgggggcgccccaag

SEQ ID NO: 429417 - RNA, 22 nt, Human
agcggcgccggagggaggugcg

SEQ ID NO: 429418 - RNA, 22 nt, Human
agggcccaccuuggugcugagg

SEQ ID NO: 429419 - RNA, 22 nt, Human
cugggcccaggcggcucucgga

SEQ ID NO: 429420 - RNA, 22 nt, Human
uuauuuaaaauguagguuggga

SEQ ID NO: 429421 - RNA, 22 nt, Human
ggcggccugugggucggccuca

SEQ ID NO: 429422 - RNA, 22 nt, Human
cucgccccggcacaguguccgu

SEQ ID NO: 429423 - RNA, 21 nt, Human
agaugcagugacccacugggg

SEQ ID NO: 429424 - RNA, 22 nt, Human
cuccguggcuguggacgcagcc

SEQ ID NO: 429425 - RNA, 22 nt, Human
ugcgggucccagggucacaggc

SEQ ID NO: 429426 - RNA, 22 nt, Human
ccccacaccugccgggcagcag

SEQ ID NO: 429427 - RNA, 22 nt, Human
gggcugcacuagggcaagguga

SEQ ID NO: 429428 - RNA, 22 nt, Human
acccggaggcgggggaugcagu

SEQ ID NO: 429429 - RNA, 22 nt, Human
agugacagauuaccggcagagc

SEQ ID NO: 429430 - RNA, 22 nt, Human
auccaaggcgcaagauggcgcu

SEQ ID NO: 429431 - RNA, 22 nt, Human
agcauggccucccgggccuggc

SEQ ID NO: 429432 - RNA, 22 nt, Human
gacagucccccagcagcaaacc

SEQ ID NO: 429433 - RNA, 22 nt, Human
auguacauuauucgagugaugg

SEQ ID NO: 429434 - RNA, 22 nt, Human
aacaggcuaaauuguccauuuc

SEQ ID NO: 429435 - RNA, 22 nt, Human
uguaccgccuugugggguuggg

SEQ ID NO: 429436 - RNA, 22 nt, Human
gccugccuucggugcgcagcgg

SEQ ID NO: 429437 - RNA, 22 nt, Human
ugacaggcuugcuaagacauag

SEQ ID NO: 429438 - RNA, 22 nt, Human
uaucuguauucugacagucacu

SEQ ID NO: 429439 - RNA, 22 nt, Human
ucgggcucgcucuccuagcgga

SEQ ID NO: 429440 - RNA, 19 nt, Human
ugggcuuccccagggcaga

SEQ ID NO: 429441 - RNA, 22 nt, Human
aaaacuuucagggauacagaaa

SEQ ID NO: 429442 - RNA, 22 nt, Human
ccacccagccagaugcaggaag

SEQ ID NO: 429443 - RNA, 21 nt, Human
ugcauauauaagugcauacac

SEQ ID NO: 429444 - RNA, 22 nt, Human
gcgcuccucccggcccuggugg

SEQ ID NO: 429445 - RNA, 22 nt, Human
aguaaaaucaccaucucuuugu

SEQ ID NO: 429446 - RNA, 22 nt, Human
gccaggcaggccacgcuguguu

SEQ ID NO: 429447 - RNA, 22 nt, Human
gcccagaguuugaagauacagu

SEQ ID NO: 429448 - RNA, 22 nt, Human
ggguucagugaugccuucagga

SEQ ID NO: 429449 - RNA, 22 nt, Human
uuuacuuuugguaaggucauuu

SEQ ID NO: 429450 - RNA, 21 nt, Human
cagaggggcuagccuggcugc

SEQ ID NO: 429451 - RNA, 23 nt, Human
uggcucuguggaucccucaggag

SEQ ID NO: 429452 - RNA, 22 nt, Human
ugagucaccucucagaagccac

SEQ ID NO: 429453 - RNA, 22 nt, Human
accuggaggcagagguugcagu

SEQ ID NO: 429454 - RNA, 22 nt, Human
ccagacuggggcuccuugaggg

SEQ ID NO: 429455 - RNA, 22 nt, Human
ggcgagcaugagucacucuggg

SEQ ID NO: 429456 - RNA, 22 nt, Human
uccgggagcugaacgucuugcg

SEQ ID NO: 429457 - RNA, 22 nt, Human
aaaguaauugugguucuugcca

SEQ ID NO: 429458 - RNA, 22 nt, Human
gagagagacauguaaacgcggu

SEQ ID NO: 429459 - RNA, 22 nt, Human
ggagcagggaauuacagcgcag

SEQ ID NO: 429460 - RNA, 22 nt, Human
uuuggucuggaaucuucagggu

SEQ ID NO: 429461 - RNA, 22 nt, Human
cagaguccugcaccagcuccag

SEQ ID NO: 429462 - RNA, 22 nt, Human
cauggggcccaugugcuccaag

SEQ ID NO: 429463 - RNA, 22 nt, Human
ggggucccugcaccagcauguc

SEQ ID NO: 429464 - RNA, 22 nt, Human
uuacuguagcuugacauauguc

SEQ ID NO: 429465 - RNA, 22 nt, Human
ucuccuggcauuugguugagua

SEQ ID NO: 429466 - RNA, 22 nt, Human
ugaaagcucugucaucauuccu

SEQ ID NO: 429467 - RNA, 22 nt, Human
ccccaacccugguuccguggcg

SEQ ID NO: 429468 - RNA, 22 nt, Human
cagggacucgcuggacauaccg

SEQ ID NO: 429469 - RNA, 22 nt, Human
cuggccucacagaggcuaagcc

SEQ ID NO: 429470 - RNA, 22 nt, Human
uccuggccaaguagauguggcg

SEQ ID NO: 429471 - RNA, 22 nt, Human
agagaagagucuugucaaauua

SEQ ID NO: 429472 - RNA, 22 nt, Human
ggucuuucuuugauaguggaga

SEQ ID NO: 429473 - RNA, 22 nt, Human
ucgggguagacgccagcucgga

SEQ ID NO: 429474 - RNA, 22 nt, Human
ccagcagcgauagggugagugc

SEQ ID NO: 429475 - RNA, 22 nt, Human
uuccgagucuccaagggguugu

SEQ ID NO: 429476 - RNA, 22 nt, Human
gaggcuggacgugcauuucuac

SEQ ID NO: 429477 - RNA, 22 nt, Human
gaggcuggcagaaaagcacagg

SEQ ID NO: 429478 - RNA, 22 nt, Human
ccugaggaugccagcaugggug

SEQ ID NO: 429479 - RNA, 22 nt, Human
gugugcgccgacacagccaggu

SEQ ID NO: 429480 - RNA, 22 nt, Human
uccaggaggacugagggggcug

SEQ ID NO: 429481 - RNA, 22 nt, Human
ggggaagaaauagaacauuuug

SEQ ID NO: 429482 - RNA, 22 nt, Human
aacuuagagcucuccuaaauga

SEQ ID NO: 429483 - RNA, 22 nt, Human
auuggccagacuuauccuucag

SEQ ID NO: 429484 - RNA, 22 nt, Human
guccuggugccaccugcgggau

SEQ ID NO: 429485 - RNA, 22 nt, Human
ccugggaaggugaggcccugga

SEQ ID NO: 429486 - RNA, 22 nt, Human
cugggucccggcuucuauccac

SEQ ID NO: 429487 - RNA, 22 nt, Human
ggagaggguagggguccugccc

SEQ ID NO: 429488 - RNA, 22 nt, Human
cagagccaaaccucagggcccg

SEQ ID NO: 429489 - RNA, 22 nt, Human
auguaguauuuggaaauguaaa

SEQ ID NO: 429490 - RNA, 22 nt, Human
aaugaguuuguucuauuauuug

SEQ ID NO: 429491 - RNA, 22 nt, Human
guggccuccuccguccgccucu

SEQ ID NO: 429492 - RNA, 22 nt, Human
gggcucaucaagccucuccgcc

SEQ ID NO: 429493 - RNA, 17 nt, Human
uaagggggaaacggagc

SEQ ID NO: 429494 - RNA, 22 nt, Human
gguuuguugggguccaggccca

SEQ ID NO: 429495 - RNA, 22 nt, Human
agacacuguguacagaaaaaga

SEQ ID NO: 429496 - RNA, 22 nt, Human
ccugggacuuggucugggguuu

SEQ ID NO: 429497 - RNA, 22 nt, Human
uggcucaggccuacgacgccuu

SEQ ID NO: 429498 - RNA, 22 nt, Human
cuccccacgccuggacuaagag

SEQ ID NO: 429499 - RNA, 22 nt, Human
aucuguucuucaaaauauuaca

SEQ ID NO: 429500 - RNA, 23 nt, Human
agaagcagcuucuggaguaucgg

SEQ ID NO: 429501 - RNA, 22 nt, Human
agcaggccugccaccucggggu

SEQ ID NO: 429502 - RNA, 22 nt, Human
acucagugggcuugaugucgaa

SEQ ID NO: 429503 - RNA, 22 nt, Human
guccuggggauuauagaguguu

SEQ ID NO: 429504 - RNA, 22 nt, Human
uaauuuugucacagugacaugc

SEQ ID NO: 429505 - RNA, 22 nt, Human
uguguuucugagaaucccaccu

SEQ ID NO: 429506 - RNA, 22 nt, Human
agcgggcucacccgguuguugu

SEQ ID NO: 429507 - RNA, 22 nt, Human
ggucuggagcuaaucuuguugg

SEQ ID NO: 429508 - RNA, 20 nt, Human
ugggguccuggaggggaucc

SEQ ID NO: 429509 - RNA, 22 nt, Human
uuuaauuuucugggcccagcag

SEQ ID NO: 429510 - RNA, 22 nt, Human
uggguccuggaaggcgacaggu

SEQ ID NO: 429511 - RNA, 22 nt, Human
ucagagacaucagguuguagca

SEQ ID NO: 429512 - RNA, 22 nt, Human
gcggagaggcagagacuccgcg

SEQ ID NO: 429513 - RNA, 22 nt, Human
aagccgggccugagaaaugaca

SEQ ID NO: 429514 - RNA, 22 nt, Human
gggagggucugagagcugcacc

SEQ ID NO: 429515 - RNA, 22 nt, Human
agggccagcagcuuggccaacc

SEQ ID NO: 429516 - RNA, 22 nt, Human
uggccagucuuagcugugccug

SEQ ID NO: 429517 - RNA, 19 nt, Human
uggugcgcuguuccugagc

SEQ ID NO: 429518 - RNA, 22 nt, Human
cugggauccacgggcucccaag

SEQ ID NO: 429519 - RNA, 22 nt, Human
cugcauaucaaauuacuccugg

SEQ ID NO: 429520 - RNA, 18 nt, Human
ucugagggugcgggagcu

SEQ ID NO: 429521 - RNA, 18 nt, Human
uauaaacacacuuagguu

SEQ ID NO: 429522 - RNA, 19 nt, Human
caguuuguccagaggggac

SEQ ID NO: 429523 - RNA, 22 nt, Human
gcuggguggaucggaggcucug

SEQ ID NO: 429524 - RNA, 21 nt, Human
acaaauuguuuauauaggaag

SEQ ID NO: 429525 - RNA, 22 nt, Human
uuauuccauagaagucaaggaa

SEQ ID NO: 429526 - RNA, 22 nt, Human
uccaguggugguuugaagggca

SEQ ID NO: 429527 - RNA, 22 nt, Human
ucguuagccucgagaucuuugu

SEQ ID NO: 429528 - RNA, 22 nt, Human
gcugccauggcugggggccgug

SEQ ID NO: 429529 - RNA, 22 nt, Human
aacccaggguggagguugcagu

SEQ ID NO: 429530 - RNA, 22 nt, Human
cagggagcuggugccagccgac

SEQ ID NO: 429531 - RNA, 22 nt, Human
agggaggucuggcugcccugag

SEQ ID NO: 429532 - RNA, 21 nt, Human
ccaccaggucuucugcucggg

SEQ ID NO: 429533 - RNA, 22 nt, Human
guuugcaaauuguguuaaagcu

SEQ ID NO: 429534 - RNA, 22 nt, Human
gggacaauggaggccucucucc

SEQ ID NO: 429535 - RNA, 22 nt, Human
uucuuuuaauuucugucugcag

SEQ ID NO: 429536 - RNA, 22 nt, Human
agguggcuaugaggaugcaguc

SEQ ID NO: 429537 - RNA, 22 nt, Human
uccaggcugacgcagcuauuua

SEQ ID NO: 429538 - RNA, 17 nt, Human
uccuggccuggugugug

SEQ ID NO: 429539 - RNA, 22 nt, Human
gggcacagucugcagcccccca

SEQ ID NO: 429540 - RNA, 22 nt, Human
uguccagaucaaugcccacaug

SEQ ID NO: 429541 - RNA, 22 nt, Human
gcaggguaggugacagguaguc

SEQ ID NO: 429542 - RNA, 22 nt, Human
ucugcccaggaggucccauggg

SEQ ID NO: 429543 - RNA, 22 nt, Human
gcaggccugucuugcucgcccu

SEQ ID NO: 429544 - RNA, 22 nt, Human
uaucuguagucucaugguuccu

SEQ ID NO: 429545 - RNA, 22 nt, Human
ggaagaggcugaggccaugcug

SEQ ID NO: 429546 - RNA, 23 nt, Human
cagcugguugugggaguggcugc

SEQ ID NO: 429547 - RNA, 22 nt, Human
gccagguaugaauuacgcacga

SEQ ID NO: 429548 - RNA, 22 nt, Human
gggacagcuguagugcuuggcu

SEQ ID NO: 429549 - RNA, 22 nt, Human
uucuuugcccauguuuccuaag

SEQ ID NO: 429550 - RNA, 17 nt, Human
cucugggucuccugcuu

SEQ ID NO: 429551 - RNA, 22 nt, Human
agccacugugugaccagcuguc

SEQ ID NO: 429552 - RNA, 22 nt, Human
gagggccaaugugucccugagc

SEQ ID NO: 429553 - RNA, 22 nt, Human
gacggggcagccagcugguggc

SEQ ID NO: 429554 - RNA, 22 nt, Human
cuuuauguuggggugucuuagu

SEQ ID NO: 429555 - RNA, 22 nt, Human
ggcucuggcgagcuuuaguaca

SEQ ID NO: 429556 - RNA, 22 nt, Human
ggcuuccuccuuccugcuguca

SEQ ID NO: 429557 - RNA, 22 nt, Human
ggucauagagcuggaaauuggc

SEQ ID NO: 429558 - RNA, 22 nt, Human
ugguaugcuuauuaucuucaac

SEQ ID NO: 429559 - RNA, 22 nt, Human
gcagcugccgugagcucacgcc

SEQ ID NO: 429560 - RNA, 21 nt, Human
gcccacagugaggaggauccc

SEQ ID NO: 429561 - RNA, 20 nt, Human
ucagugggaaagugagagug

SEQ ID NO: 429562 - RNA, 19 nt, Human
cgcacagccugccaggcgc

SEQ ID NO: 429563 - RNA, 22 nt, Human
ggaaggggagcuggaaagggua

SEQ ID NO: 429564 - RNA, 18 nt, Human
ggugagggagcuggaagc

SEQ ID NO: 429565 - RNA, 22 nt, Human
cuggugcuguagccugauugag

SEQ ID NO: 429566 - RNA, 22 nt, Human
ggacagacuuuacagccccggg

SEQ ID NO: 429567 - RNA, 22 nt, Human
caggcgggcaggugcggccccu

SEQ ID NO: 429568 - RNA, 22 nt, Human
uuucacauacaguguauaguag

SEQ ID NO: 429569 - RNA, 22 nt, Human
gcccagcugagaagcgcggggc

SEQ ID NO: 429570 - RNA, 22 nt, Human
auggccuuucucaguggugcuu

SEQ ID NO: 429571 - RNA, 22 nt, Human
ucccagccugacagugcaucaa

SEQ ID NO: 429572 - RNA, 22 nt, Human
ucuuauugguaaugauggcauu

SEQ ID NO: 429573 - RNA, 22 nt, Human
gcucccugguauugcugccacu

SEQ ID NO: 429574 - RNA, 22 nt, Human
accuccuccaaggagccauagg

SEQ ID NO: 429575 - RNA, 22 nt, Human
gggugcaaacccguucugcacc

SEQ ID NO: 429576 - RNA, 22 nt, Human
auucccauagccauccggagag

SEQ ID NO: 429577 - RNA, 22 nt, Human
uccagagaacgaugaaagcugg

SEQ ID NO: 429578 - RNA, 23 nt, Human
uggggcugauggagacggaccag

SEQ ID NO: 429579 - RNA, 20 nt, Human
gcucagggccugggucugga

SEQ ID NO: 429580 - RNA, 22 nt, Human
uguagggaggaaggguuggaaa

SEQ ID NO: 429581 - RNA, 22 nt, Human
cacgcacgcuggguggaggcgc

SEQ ID NO: 429582 - RNA, 22 nt, Human
agcagccuugugacuccggggu

SEQ ID NO: 429583 - RNA, 22 nt, Human
cccagaggcugaguugggagca

SEQ ID NO: 429584 - RNA, 22 nt, Human
uucagguuuuuaaguucugccu

SEQ ID NO: 429585 - RNA, 22 nt, Human
ugcugguucuuaggagagagau

SEQ ID NO: 429586 - RNA, 22 nt, Human
uaaggcuguuaggaggauuaaa

SEQ ID NO: 429587 - RNA, 22 nt, Human
guuuccaagucucucaacaccc

SEQ ID NO: 429588 - RNA, 22 nt, Human
uggaagggguuacgcagcagga

SEQ ID NO: 429589 - RNA, 22 nt, Human
uuucauuauaaaaaguuggcuu

SEQ ID NO: 429590 - RNA, 22 nt, Human
cguggggcggguggacacuugc

SEQ ID NO: 429591 - RNA, 22 nt, Human
gccaggucgucuccauguccaa

SEQ ID NO: 429592 - RNA, 22 nt, Human
uauuaugguuguagguuaacaa

SEQ ID NO: 429593 - RNA, 22 nt, Human
aaggggggcaccugcaugcccg

SEQ ID NO: 429594 - RNA, 22 nt, Human
gagcugggaagauagcuugagc

SEQ ID NO: 429595 - RNA, 22 nt, Human
ucgggacgguggcauuugugcc

SEQ ID NO: 429596 - RNA, 22 nt, Human
aacccaggaguuggaggcugug

SEQ ID NO: 429597 - RNA, 20 nt, Human
cagcucugggcaggucgagg

SEQ ID NO: 429598 - RNA, 22 nt, Human
acggagcccgugucagguggga

SEQ ID NO: 429599 - RNA, 22 nt, Human
ggaccugcucucccaguucucu

SEQ ID NO: 429600 - RNA, 22 nt, Human
ucaggggacagccagcuggagg

SEQ ID NO: 429601 - RNA, 22 nt, Human
aagagagaacucccuucgccag

SEQ ID NO: 429602 - RNA, 22 nt, Human
uccugccaccggggguggcgau

SEQ ID NO: 429603 - RNA, 22 nt, Human
agccacagucuguagccagcuu

SEQ ID NO: 429604 - RNA, 22 nt, Human
aagcagccagccaucaugcccg

SEQ ID NO: 429605 - RNA, 22 nt, Human
uaggaaauaauucacucuggcu

SEQ ID NO: 429606 - RNA, 22 nt, Human
gcggcuccgaagccaggccgcg

SEQ ID NO: 429607 - RNA, 21 nt, Human
ugagcaccagcugcaugcccc

SEQ ID NO: 429608 - RNA, 22 nt, Human
cagggagaggccucuguugccc

SEQ ID NO: 429609 - RNA, 22 nt, Human
cucagugcuuaguguguuuugg

SEQ ID NO: 429610 - RNA, 22 nt, Human
aggugggacccguggggugcga

SEQ ID NO: 429611 - RNA, 22 nt, Human
ugacuuuggacuagugauuuaa

SEQ ID NO: 429612 - RNA, 22 nt, Human
ugugugcucgauggcccugcag

SEQ ID NO: 429613 - RNA, 20 nt, Human
cugcuccacccggcucucag

SEQ ID NO: 429614 - RNA, 22 nt, Human
gcagagcugucuaagucacuuc

SEQ ID NO: 429615 - RNA, 22 nt, Human
ugcugcgggacccacugugggc

SEQ ID NO: 429616 - RNA, 22 nt, Human
ggggagaguauuuuauucaagu

SEQ ID NO: 429617 - RNA, 22 nt, Human
cggagcagagccacucgggccg

SEQ ID NO: 429618 - RNA, 21 nt, Human
gcaaccagaccacagggcagu

SEQ ID NO: 429619 - RNA, 22 nt, Human
aggccacaggaguacugucggu

SEQ ID NO: 429620 - RNA, 22 nt, Human
gguccagcacaacacuggcaug

SEQ ID NO: 429621 - RNA, 18 nt, Human
ccucagggagagagacgc

SEQ ID NO: 429622 - RNA, 23 nt, Human
uggugggcccugcuugcucacug

SEQ ID NO: 429623 - RNA, 22 nt, Human
acccacgaagaugagcggcaug

SEQ ID NO: 429624 - RNA, 22 nt, Human
cgcaggugccggcagauggggu

SEQ ID NO: 429625 - RNA, 22 nt, Human
caggccgggcacugcgcuaggu

SEQ ID NO: 429626 - RNA, 22 nt, Human
gugacagguauacucaccauug

SEQ ID NO: 429627 - RNA, 22 nt, Human
cauuggcuccugugggacauga

SEQ ID NO: 429628 - RNA, 22 nt, Human
gucccuggucuaccguggcuuc

SEQ ID NO: 429629 - RNA, 22 nt, Human
ucaccgccuugcccggccgggc

SEQ ID NO: 429630 - RNA, 22 nt, Human
gcuguccugggaacaggcacua

SEQ ID NO: 429631 - RNA, 22 nt, Human
gggggcuggacuuucccacaca

SEQ ID NO: 429632 - RNA, 22 nt, Human
cuacauuauguuuauugggacu

SEQ ID NO: 429633 - RNA, 22 nt, Human
ggggucacacuguggugacugg

SEQ ID NO: 429634 - RNA, 22 nt, Human
uguguuuuggaaggaacaugca

SEQ ID NO: 429635 - RNA, 22 nt, Human
gagcuccuauggucgguggcuc

SEQ ID NO: 429636 - RNA, 22 nt, Human
gaggugggaugugugugcuacu

SEQ ID NO: 429637 - RNA, 22 nt, Human
gcuaagggauaggcugccuccu

SEQ ID NO: 429638 - RNA, 22 nt, Human
agcuccugaaaagcgcuugcuu

SEQ ID NO: 429639 - RNA, 22 nt, Human
caggucuucuucagcacuugga

SEQ ID NO: 429640 - RNA, 19 nt, Human
cugaaacacagagagggcu

SEQ ID NO: 429641 - RNA, 22 nt, Human
uggguucgauguauauguagcc

SEQ ID NO: 429642 - RNA, 22 nt, Human
cugcccaucuggccacacacag

SEQ ID NO: 429643 - RNA, 22 nt, Human
gggcucuguuuagaccagagau

SEQ ID NO: 429644 - RNA, 22 nt, Human
gugcucacugugagacguccug

SEQ ID NO: 429645 - RNA, 21 nt, Human
gccaccucaaucuucuagcgc

SEQ ID NO: 429646 - RNA, 22 nt, Human
aggcgaagggaccagacgguag

SEQ ID NO: 429647 - RNA, 22 nt, Human
auggccagcaagguagggcaau

SEQ ID NO: 429648 - RNA, 22 nt, Human
ccaagaggggcagagggcugca

SEQ ID NO: 429649 - RNA, 22 nt, Human
accuuuaugaaacagcugucgu

SEQ ID NO: 429650 - RNA, 22 nt, Human
gcuuggccagcagccgggaugc

SEQ ID NO: 429651 - RNA, 22 nt, Human
auggaguucugccagcgcugcu

SEQ ID NO: 429652 - RNA, 22 nt, Human
ccagguggacggcgaguacagg

SEQ ID NO: 429653 - RNA, 22 nt, Human
ucuuuuaucuguuguguaacaa

SEQ ID NO: 429654 - RNA, 22 nt, Human
gacuuugguucagggcucagag

SEQ ID NO: 429655 - RNA, 20 nt, Human
uuugacaccuugggagagac

SEQ ID NO: 429656 - RNA, 19 nt, Human
gggaaugauggaagacuuc

SEQ ID NO: 429657 - RNA, 22 nt, Human
cccaccagaccugcaccggcac

SEQ ID NO: 429658 - RNA, 23 nt, Human
guuauugcuggugcuggccagcc

SEQ ID NO: 429659 - RNA, 22 nt, Human
cuccagauuccguuuauucagg

SEQ ID NO: 429660 - RNA, 22 nt, Human
aggcucagugauguaaaauaua

SEQ ID NO: 429661 - RNA, 22 nt, Human
cgcccacgaaguagguggcauu

SEQ ID NO: 429662 - RNA, 22 nt, Human
aggcuccaugguucucccucag

SEQ ID NO: 429663 - RNA, 22 nt, Human
cuggcuaaagagcaagaagaug

SEQ ID NO: 429664 - RNA, 22 nt, Human
ugggugugagcccgggagccgc

SEQ ID NO: 429665 - RNA, 22 nt, Human
cuucagggaggagcauggguuc

SEQ ID NO: 429666 - RNA, 22 nt, Human
cugccaucugagccaaaagugc

SEQ ID NO: 429667 - RNA, 22 nt, Human
ggagggaaccuuggcuggauug

SEQ ID NO: 429668 - RNA, 22 nt, Human
ggacaucuguugugguagagga

SEQ ID NO: 429669 - RNA, 22 nt, Human
aggucccugcagcagacugcca

SEQ ID NO: 429670 - RNA, 22 nt, Human
gaguggggcccacugcugggug

SEQ ID NO: 429671 - RNA, 22 nt, Human
cccaggaggcagaaguugcagu

SEQ ID NO: 429672 - RNA, 22 nt, Human
ccugugguuuacucuguggcua

SEQ ID NO: 429673 - RNA, 22 nt, Human
auauguggcauuauuucugagg

SEQ ID NO: 429674 - RNA, 22 nt, Human
uuuauccaccuuacccuguucc

SEQ ID NO: 429675 - RNA, 22 nt, Human
cuugacacugucacucaggcca

SEQ ID NO: 429676 - RNA, 22 nt, Human
ggcugagcuuuucaugaugguu

SEQ ID NO: 429677 - RNA, 22 nt, Human
uggccaggcagguagaacggcc

SEQ ID NO: 429678 - RNA, 19 nt, Human
gcacacccugcaccaccau

SEQ ID NO: 429679 - RNA, 22 nt, Human
ucugggccggagccgacggcag

SEQ ID NO: 429680 - RNA, 20 nt, Human
gugugaccuccuguggaugc

SEQ ID NO: 429681 - RNA, 22 nt, Human
ccaggagaaugggauuacccua

SEQ ID NO: 429682 - RNA, 22 nt, Human
ggcuagggagacagagggcaug

SEQ ID NO: 429683 - RNA, 22 nt, Human
uguggugccgagagucuggacg

SEQ ID NO: 429684 - RNA, 22 nt, Human
uuguaacaguagcugucagcuc

SEQ ID NO: 429685 - RNA, 23 nt, Human
ucuggcugcuccuuucaaugcuc

SEQ ID NO: 429686 - RNA, 22 nt, Human
uugauggacagggaccacuguc

SEQ ID NO: 429687 - RNA, 22 nt, Human
uuaugggcgaugcaaaccugau

SEQ ID NO: 429688 - RNA, 22 nt, Human
aguuauguccucagcaaaucaa

SEQ ID NO: 429689 - RNA, 21 nt, Human
ccacaauucuaguuacauaug

SEQ ID NO: 429690 - RNA, 22 nt, Human
cgggaagguggagguugcagug

SEQ ID NO: 429691 - RNA, 22 nt, Human
gagcuuggugcugccuguuguc

SEQ ID NO: 429692 - RNA, 22 nt, Human
ugugucuuuggcgaugucugga

SEQ ID NO: 429693 - RNA, 15 nt, Human
gccccaggaaucaaa

SEQ ID NO: 429694 - RNA, 22 nt, Human
cucucugggcccaguuggcacc

SEQ ID NO: 429695 - RNA, 22 nt, Human
uagggcucugagaguucagccu

SEQ ID NO: 429696 - RNA, 22 nt, Human
ggagccaguuuagaccucaguu

SEQ ID NO: 429697 - RNA, 20 nt, Human
ggggcccaagcccucuugcc

SEQ ID NO: 429698 - RNA, 22 nt, Human
aaacccaggguuuugucuuccc

SEQ ID NO: 429699 - RNA, 22 nt, Human
ccagccagcugcccuuggggcc

SEQ ID NO: 429700 - RNA, 22 nt, Human
gagguuggagggcuggccugca

SEQ ID NO: 429701 - RNA, 22 nt, Human
gcccuguguguuugcacugauu

SEQ ID NO: 429702 - RNA, 15 nt, Human
gccuugaaugugaau

SEQ ID NO: 429703 - RNA, 22 nt, Human
acggccgaugacuccagcaugg

SEQ ID NO: 429704 - RNA, 22 nt, Human
cacugcccuggggguugccauc

SEQ ID NO: 429705 - RNA, 22 nt, Human
aaguccagguccucauuccauc

SEQ ID NO: 429706 - RNA, 22 nt, Human
aggugcccaugagcuccauggc

SEQ ID NO: 429707 - RNA, 22 nt, Human
gccuggggaacuugauccuguc

SEQ ID NO: 429708 - RNA, 20 nt, Human
ccagagcugauggcugcccg

SEQ ID NO: 429709 - RNA, 22 nt, Human
uggguguguccauauuuugacu

SEQ ID NO: 429710 - RNA, 22 nt, Human
agcuggugugccaguuccaguu

SEQ ID NO: 429711 - RNA, 22 nt, Human
ugguccucacccuacccagcug

SEQ ID NO: 429712 - RNA, 22 nt, Human
gcagcucucuggccugcccugg

SEQ ID NO: 429713 - RNA, 22 nt, Human
guguguggaaugcucauuuauu

SEQ ID NO: 429714 - RNA, 22 nt, Human
agggugugcuguugggucuuuc

SEQ ID NO: 429715 - RNA, 21 nt, Human
uccaaaggagacugagugugu

SEQ ID NO: 429716 - RNA, 22 nt, Human
ccugggugaugugcugcccucg

SEQ ID NO: 429717 - RNA, 22 nt, Human
ccagcuggaacggcagcccagc

SEQ ID NO: 429718 - RNA, 20 nt, Human
auuagcuuggagacaguggc

SEQ ID NO: 429719 - RNA, 22 nt, Human
gucugcacgugccagggagggg

SEQ ID NO: 429720 - RNA, 22 nt, Human
aggcggguuuaggacaaugcuu

SEQ ID NO: 429721 - RNA, 22 nt, Human
aaugcugugauuuauuaaguau

SEQ ID NO: 429722 - RNA, 22 nt, Human
aaugccuuggagagccuagagg

SEQ ID NO: 429723 - RNA, 22 nt, Human
ugccgcgcgcccagguuaggug

SEQ ID NO: 429724 - RNA, 22 nt, Human
gugcauauguguguauacaaac

SEQ ID NO: 429725 - RNA, 22 nt, Human
ggagagagaccuccaugcccag

SEQ ID NO: 429726 - RNA, 21 nt, Human
uugauuuagcagaucuagcug

SEQ ID NO: 429727 - RNA, 22 nt, Human
gcccagccccuggguggacgug

SEQ ID NO: 429728 - RNA, 22 nt, Human
agagaugcuguggguagaggca

SEQ ID NO: 429729 - RNA, 22 nt, Human
cagagccacugucugccaggca

SEQ ID NO: 429730 - RNA, 22 nt, Human
caggggcggguaaaaggccucc

SEQ ID NO: 429731 - RNA, 19 nt, Human
uccagaacugcccuggccu

SEQ ID NO: 429732 - RNA, 22 nt, Human
auggccugcagugcugccacag

SEQ ID NO: 429733 - RNA, 22 nt, Human
uggcccagaucucugaccuuga

SEQ ID NO: 429734 - RNA, 22 nt, Human
ggagcugcucagagccaguccc

SEQ ID NO: 429735 - RNA, 22 nt, Human
ucagacaccgucuauuuugccu

SEQ ID NO: 429736 - RNA, 22 nt, Human
acagacuccccagguuaucuca

SEQ ID NO: 429737 - RNA, 22 nt, Human
uccaggaguccuggguggcccc

SEQ ID NO: 429738 - RNA, 22 nt, Human
gggaagugcccucuucaggaga

SEQ ID NO: 429739 - RNA, 18 nt, Human
uccuuucaccccuucucu

SEQ ID NO: 429740 - RNA, 22 nt, Human
cuggccagggugcgaucguggu

SEQ ID NO: 429741 - RNA, 22 nt, Human
cacccucaagcaguggcacgug

SEQ ID NO: 429742 - RNA, 22 nt, Human
aguggcugugaaauacauggga

SEQ ID NO: 429743 - RNA, 22 nt, Human
ucccuggcacaagaaggcuguc

SEQ ID NO: 429744 - RNA, 22 nt, Human
gauggaggagauggcagggugc

SEQ ID NO: 429745 - RNA, 22 nt, Human
ugggcugcuucuauuggugguc

SEQ ID NO: 429746 - RNA, 19 nt, Human
cccagaggaaugccuggaa

SEQ ID NO: 429747 - RNA, 22 nt, Human
guugcaaaugggaagaugguua

SEQ ID NO: 429748 - RNA, 22 nt, Human
ggagaggggaacuuguugcuug

SEQ ID NO: 429749 - RNA, 22 nt, Human
cagcagcaacaacggaagccuu

SEQ ID NO: 429750 - RNA, 22 nt, Human
cuguucccgguggccgggccag

SEQ ID NO: 429751 - RNA, 22 nt, Human
agcugggcuggagcuccaagcg

SEQ ID NO: 429752 - RNA, 23 nt, Human
guguggccccagggccuccucgc

SEQ ID NO: 429753 - RNA, 22 nt, Human
agggaagcagcagccgccuguc

SEQ ID NO: 429754 - RNA, 22 nt, Human
uuggggccgggauaagguuguu

SEQ ID NO: 429755 - RNA, 20 nt, Human
gcagcagacagacaggggac

SEQ ID NO: 429756 - RNA, 22 nt, Human
guagcccaccuggggagggcga

SEQ ID NO: 429757 - RNA, 22 nt, Human
aggaggguggggucugccuguc

SEQ ID NO: 429758 - RNA, 22 nt, Human
auggugguagaagcacuaugug

SEQ ID NO: 429759 - RNA, 22 nt, Human
aggcuaggccuugcccuggaac

SEQ ID NO: 429760 - RNA, 22 nt, Human
uugaacaguuuugucagguuca

SEQ ID NO: 429761 - RNA, 18 nt, Human
acccauuauauuuguagc

SEQ ID NO: 429762 - RNA, 22 nt, Human
uggcugaggcacagcugccgcc

SEQ ID NO: 429763 - RNA, 22 nt, Human
ugggaagauaugagugaccaac

SEQ ID NO: 429764 - RNA, 22 nt, Human
gucugcccugcagacaugccuc

SEQ ID NO: 429765 - RNA, 20 nt, Human
ucuuuuauuggcagauccug

SEQ ID NO: 429766 - RNA, 22 nt, Human
uggggcuccuccuggcaggagg

SEQ ID NO: 429767 - RNA, 22 nt, Human
gccaugaacucgggcauggaga

SEQ ID NO: 429768 - RNA, 22 nt, Human
ggcggugguugagaggacggcg

SEQ ID NO: 429769 - RNA, 22 nt, Human
cagggaugggauggagucaguu

SEQ ID NO: 429770 - RNA, 22 nt, Human
acagggcugaggcuggcuucuu

SEQ ID NO: 429771 - RNA, 23 nt, Human
caccccacccugaggaggaggga

SEQ ID NO: 429772 - RNA, 22 nt, Human
uggccgggaagggacagugugg

SEQ ID NO: 429773 - RNA, 22 nt, Human
cgggcacucagggucgaggugg

SEQ ID NO: 429774 - RNA, 20 nt, Human
aucagguguucagccacugc

SEQ ID NO: 429775 - RNA, 23 nt, Human
uagauccuuccaacuacucuuac

SEQ ID NO: 429776 - RNA, 22 nt, Human
ucugugggcauuuauaaucugg

SEQ ID NO: 429777 - RNA, 18 nt, Human
gggguagaguguccuauu

SEQ ID NO: 429778 - RNA, 19 nt, Human
ugggcagugccagggcuua

SEQ ID NO: 429779 - RNA, 22 nt, Human
cugggugagcuggccagagggu

SEQ ID NO: 429780 - RNA, 19 nt, Human
cucugccauuugcugccug

SEQ ID NO: 429781 - RNA, 22 nt, Human
ggcagaggagcuggaaacaugg

SEQ ID NO: 429782 - RNA, 20 nt, Human
cgggacacucaagcucuggg

SEQ ID NO: 429783 - RNA, 22 nt, Human
uuccaggaagcucucggccucu

SEQ ID NO: 429784 - RNA, 22 nt, Human
uucccuggugggugagaaccug

SEQ ID NO: 429785 - RNA, 16 nt, Human
ugcggcaacuugcggc

SEQ ID NO: 429786 - RNA, 22 nt, Human
gcgagucgccgcugcagcccua

SEQ ID NO: 429787 - RNA, 22 nt, Human
cacggccacugcagcaccccag

SEQ ID NO: 429788 - RNA, 22 nt, Human
gggaagugagcuggaaucaagg

SEQ ID NO: 429789 - RNA, 22 nt, Human
caagcuuguuucuccugggggu

SEQ ID NO: 429790 - RNA, 22 nt, Human
aggagccauugcaggauggcag

SEQ ID NO: 429791 - RNA, 22 nt, Human
uauuuggugaaucuauggucag

SEQ ID NO: 429792 - RNA, 22 nt, Human
cacaggaagcaagccuggggcc

SEQ ID NO: 429793 - RNA, 22 nt, Human
aggguccugagccuggggcgca

SEQ ID NO: 429794 - RNA, 22 nt, Human
ccaggcccugccugugguuccu

SEQ ID NO: 429795 - RNA, 22 nt, Human
auuauugcaagcagugaaggga

SEQ ID NO: 429796 - RNA, 22 nt, Human
gcacaaaagguacuucauguag

SEQ ID NO: 429797 - RNA, 22 nt, Human
gcuugcuuuguaaauaucugug

SEQ ID NO: 429798 - RNA, 22 nt, Human
gccacguagaagugccgcgaga

SEQ ID NO: 429799 - RNA, 22 nt, Human
uguguccugugaucucuagggu

SEQ ID NO: 429800 - RNA, 22 nt, Human
uggcagcagggccccuggagga

SEQ ID NO: 429801 - RNA, 22 nt, Human
uggcugaggagagggcggaagu

SEQ ID NO: 429802 - RNA, 22 nt, Human
uggcuggcuguccagcugggca

SEQ ID NO: 429803 - RNA, 22 nt, Human
ugcccucagcagcagcuccugc

SEQ ID NO: 429804 - RNA, 23 nt, Human
agugaugucacccacagacaagg

SEQ ID NO: 429805 - RNA, 21 nt, Human
ugcuccaggagggggcagucc

SEQ ID NO: 429806 - RNA, 22 nt, Human
agccccaggcccggacgccucu

SEQ ID NO: 429807 - RNA, 22 nt, Human
gccagugccugcugcucagggc

SEQ ID NO: 429808 - RNA, 22 nt, Human
gggagacaaaggugagguucuu

SEQ ID NO: 429809 - RNA, 22 nt, Human
cgcuuuggagucccugcuuuac

SEQ ID NO: 429810 - RNA, 22 nt, Human
ggcuggccuguguggccgccac

SEQ ID NO: 429811 - RNA, 22 nt, Human
aaucuguuuuaaaguuugugcc

SEQ ID NO: 429812 - RNA, 18 nt, Human
ggguccccagcugcaggg

SEQ ID NO: 429813 - RNA, 22 nt, Human
ucccaaguagaugggaauacag

SEQ ID NO: 429814 - RNA, 22 nt, Human
aagcacagggacucaggaccgg

SEQ ID NO: 429815 - RNA, 22 nt, Human
ucuuuuccuugaugguuaaaua

SEQ ID NO: 429816 - RNA, 22 nt, Human
aauggcugccagggcaggaggu

SEQ ID NO: 429817 - RNA, 22 nt, Human
uuccggaauggcaggguagcuc

SEQ ID NO: 429818 - RNA, 22 nt, Human
gauggcgguggccaccuccuug

SEQ ID NO: 429819 - RNA, 22 nt, Human
cccagguaaggaugcuccucau

SEQ ID NO: 429820 - RNA, 22 nt, Human
agagaccuuccugacuccagag

SEQ ID NO: 429821 - RNA, 22 nt, Human
agucaggacagauuuucugggg

SEQ ID NO: 429822 - RNA, 22 nt, Human
gagggugguggcuuaaggugcu

SEQ ID NO: 429823 - RNA, 21 nt, Human
agggccucuguguacuggggg

SEQ ID NO: 429824 - RNA, 22 nt, Human
ccauggccaggaaagccaaggu

SEQ ID NO: 429825 - RNA, 22 nt, Human
uucuuuccucccagccuuugga

SEQ ID NO: 429826 - RNA, 22 nt, Human
gccaccagccccaugcgcugug

SEQ ID NO: 429827 - RNA, 22 nt, Human
uggccucuccuggcagcaucca

SEQ ID NO: 429828 - RNA, 22 nt, Human
guggauggagcuggaagccauu

SEQ ID NO: 429829 - RNA, 22 nt, Human
uggcggugacggcggcgccugg

SEQ ID NO: 429830 - RNA, 22 nt, Human
gggcauuucuugucaauguagg

SEQ ID NO: 429831 - RNA, 23 nt, Human
cagcacaguacauuuccugucuc

SEQ ID NO: 429832 - RNA, 22 nt, Human
uuguaagacuguagaaugcaaa

SEQ ID NO: 429833 - RNA, 22 nt, Human
uucgcuuugcccguugucauuu

SEQ ID NO: 429834 - RNA, 22 nt, Human
uugaguuuccugacagcgaagg

SEQ ID NO: 429835 - RNA, 22 nt, Human
gcccagcugcacccuggugggu

SEQ ID NO: 429836 - RNA, 22 nt, Human
cuccacagccccuccaguggca

SEQ ID NO: 429837 - RNA, 22 nt, Human
uggaaaauauuuaggugaauga

SEQ ID NO: 429838 - RNA, 22 nt, Human
agcuuuggcaucugacuagccg

SEQ ID NO: 429839 - RNA, 20 nt, Human
ugcuggaggcgccggcgcuc

SEQ ID NO: 429840 - RNA, 22 nt, Human
uccaugacagcgugagaguuug

SEQ ID NO: 429841 - RNA, 22 nt, Human
gggcggggcuuccguccuccac

SEQ ID NO: 429842 - RNA, 22 nt, Human
uacauguacaugcauagguaga

SEQ ID NO: 429843 - RNA, 18 nt, Human
agcucacagaucuguuuu

SEQ ID NO: 429844 - RNA, 22 nt, Human
acacacagaaggaagccccacu

SEQ ID NO: 429845 - RNA, 22 nt, Human
agacagcacuuuuguauggggg

SEQ ID NO: 429846 - RNA, 22 nt, Human
ggaaggcuuuaagcaccaaagc

SEQ ID NO: 429847 - RNA, 22 nt, Human
uugcccacuggcuguuggucag

SEQ ID NO: 429848 - RNA, 22 nt, Human
ugggcaaaugcuuuuuagucaa

SEQ ID NO: 429849 - RNA, 22 nt, Human
gugcuggggagauaggaagaga

SEQ ID NO: 429850 - RNA, 22 nt, Human
uggagugcaguugggaggacac

SEQ ID NO: 429851 - RNA, 22 nt, Human
cucccugggccucaguuucucu

SEQ ID NO: 429852 - RNA, 22 nt, Human
ugccuguguccccuucuuggca

SEQ ID NO: 429853 - RNA, 22 nt, Human
uggggugccgacagggagggca

SEQ ID NO: 429854 - RNA, 22 nt, Human
gccacccuggacgcacuguucg

SEQ ID NO: 429855 - RNA, 18 nt, Human
aaacauggcuuaaaggcu

SEQ ID NO: 429856 - RNA, 22 nt, Human
gcccucugguggccgccucggc

SEQ ID NO: 429857 - RNA, 22 nt, Human
ugguccagacuuugaccucuca

SEQ ID NO: 429858 - RNA, 22 nt, Human
cuggcuuuuggaggagggucag

SEQ ID NO: 429859 - RNA, 22 nt, Human
ccgggagguggagauugcggug

SEQ ID NO: 429860 - RNA, 22 nt, Human
gcggggggcagcagucgcucag

SEQ ID NO: 429861 - RNA, 22 nt, Human
gcucgguggccagccugaggcc

SEQ ID NO: 429862 - RNA, 22 nt, Human
gagcagcagcugggccagguuc

SEQ ID NO: 429863 - RNA, 22 nt, Human
ucccuggcugguguagagggau

SEQ ID NO: 429864 - RNA, 22 nt, Human
cauuuacauuuaagguuaauau

SEQ ID NO: 429865 - RNA, 22 nt, Human
gcaggggcugagcaccagcggg

SEQ ID NO: 429866 - RNA, 22 nt, Human
agacagcgaggacagaggggug

SEQ ID NO: 429867 - RNA, 22 nt, Human
gaggucaggggagaggcugaug

SEQ ID NO: 429868 - RNA, 22 nt, Human
cucugggguggaggaggcugac

SEQ ID NO: 429869 - RNA, 22 nt, Human
cccgggaggaggaaguugcagu

SEQ ID NO: 429870 - RNA, 22 nt, Human
guggcuaggcccaacggcagga

SEQ ID NO: 429871 - RNA, 22 nt, Human
ucuauuaaugauucaauagugu

SEQ ID NO: 429872 - RNA, 21 nt, Human
agaugaggauacugaggccua

SEQ ID NO: 429873 - RNA, 22 nt, Human
acuuuggugcgaagucacuuua

SEQ ID NO: 429874 - RNA, 22 nt, Human
cagggagaucuuggcuccuggu

SEQ ID NO: 429875 - RNA, 19 nt, Human
agcagccaucgaccaugga

SEQ ID NO: 429876 - RNA, 19 nt, Human
ccuggcccugcugcgcggg

SEQ ID NO: 429877 - RNA, 22 nt, Human
guguuuggucagacguccgggg

SEQ ID NO: 429878 - RNA, 22 nt, Human
gccuggcucugaguuucucucc

SEQ ID NO: 429879 - RNA, 22 nt, Human
uccagguccuacuggcccauag

SEQ ID NO: 429880 - RNA, 22 nt, Human
acagcuggccgaggcucaggga

SEQ ID NO: 429881 - RNA, 22 nt, Human
uauucacaaaaugagguccuca

SEQ ID NO: 429882 - RNA, 22 nt, Human
uggaagggagcuggaauuugga

SEQ ID NO: 429883 - RNA, 22 nt, Human
gugggcaucuccuuggaagcca

SEQ ID NO: 429884 - RNA, 22 nt, Human
uccuggggaggucgaggcugag

SEQ ID NO: 429885 - RNA, 22 nt, Human
cggcgcaggcagaccgcgggcu

SEQ ID NO: 429886 - RNA, 22 nt, Human
aggaagagcuggaccagaggac

SEQ ID NO: 429887 - RNA, 22 nt, Human
cugcugucuuuauuucacugcu

SEQ ID NO: 429888 - RNA, 22 nt, Human
ccuaggccgcccggugcguggg

SEQ ID NO: 429889 - RNA, 22 nt, Human
uugggugcugucauggggcacg

SEQ ID NO: 429890 - RNA, 22 nt, Human
cccgaccucgcaaagcgcacuc

SEQ ID NO: 429891 - RNA, 22 nt, Human
ggcugcccucggggucgcaggc

SEQ ID NO: 429892 - RNA, 20 nt, Human
gggugugggcccggccaggc

SEQ ID NO: 429893 - RNA, 22 nt, Human
cugggacacguugugcuuuaac

SEQ ID NO: 429894 - RNA, 22 nt, Human
acagcuggaggucugugagcac

SEQ ID NO: 429895 - RNA, 22 nt, Human
agagccuguucggaggcgcccc

SEQ ID NO: 429896 - RNA, 22 nt, Human
ggggugaagguuuucugaaagc

SEQ ID NO: 429897 - RNA, 22 nt, Human
ccucguccacaauccuugcaca

SEQ ID NO: 429898 - RNA, 22 nt, Human
caggguggaacaggcaauacuu

SEQ ID NO: 429899 - RNA, 22 nt, Human
caggccagcagggccuccgugg

SEQ ID NO: 429900 - RNA, 22 nt, Human
aggcuguccucucuugcucagu

SEQ ID NO: 429901 - RNA, 17 nt, Human
ucuggaugucauggaag

SEQ ID NO: 429902 - RNA, 22 nt, Human
gagggaaacagauggguugugg

SEQ ID NO: 429903 - RNA, 22 nt, Human
gucuuuuuuacaccuuacauca

SEQ ID NO: 429904 - RNA, 22 nt, Human
aggagggagcuuaagccaggca

SEQ ID NO: 429905 - RNA, 22 nt, Human
gcucguacaccagcguggaggu

SEQ ID NO: 429906 - RNA, 18 nt, Human
gccagcccuccaaccucc

SEQ ID NO: 429907 - RNA, 20 nt, Human
uggccucugagaugccacgg

SEQ ID NO: 429908 - RNA, 22 nt, Human
uguggguccuccugugugcccg

SEQ ID NO: 429909 - RNA, 22 nt, Human
cuguggccagagcgccguugac

SEQ ID NO: 429910 - RNA, 22 nt, Human
gucagaggggcagcugccaggc

SEQ ID NO: 429911 - RNA, 21 nt, Human
ucuuggggaggagggcugcac

SEQ ID NO: 429912 - RNA, 22 nt, Human
uccuccuuuccccgcuggagcc

SEQ ID NO: 429913 - RNA, 22 nt, Human
ccgcuguccuggagcugcugcu

SEQ ID NO: 429914 - RNA, 22 nt, Human
ggcagugaugucaaacagugaa

SEQ ID NO: 429915 - RNA, 22 nt, Human
uguucuggugaggccauggggu

SEQ ID NO: 429916 - RNA, 22 nt, Human
cugagguccucagagggaaagg

SEQ ID NO: 429917 - RNA, 17 nt, Human
gugagcugagucaggac

SEQ ID NO: 429918 - RNA, 21 nt, Human
cccuugccugcacuccucggc

SEQ ID NO: 429919 - RNA, 22 nt, Human
gcggggggcaggcaguacguug

SEQ ID NO: 429920 - RNA, 22 nt, Human
uuuccacacucacugcacucau

SEQ ID NO: 429921 - RNA, 22 nt, Human
uugcauauccuccaacacaugg

SEQ ID NO: 429922 - RNA, 22 nt, Human
gggcucggcaucuguggacucu

SEQ ID NO: 429923 - RNA, 22 nt, Human
gguuguaguuggagguuguaua

SEQ ID NO: 429924 - RNA, 22 nt, Human
cgcacuggagcuggaacgaguc

SEQ ID NO: 429925 - RNA, 22 nt, Human
gcagacccugaacugggcaugg

SEQ ID NO: 429926 - RNA, 22 nt, Human
gcaccgagaaggaagcaugccu

SEQ ID NO: 429927 - RNA, 17 nt, Human
uggcacagaggugcuau

SEQ ID NO: 429928 - RNA, 22 nt, Human
uccucuucaaaauagcucugaa

SEQ ID NO: 429929 - RNA, 22 nt, Human
cagacagagucuucccaucagu

SEQ ID NO: 429930 - RNA, 22 nt, Human
agauaaaguccaaacuguguag

SEQ ID NO: 429931 - RNA, 22 nt, Human
ccgcgagguggagguugcagug

SEQ ID NO: 429932 - RNA, 22 nt, Human
aguccgcgcuccaugggagucc

SEQ ID NO: 429933 - RNA, 19 nt, Human
cauaauacaguggaucuga

SEQ ID NO: 429934 - RNA, 22 nt, Human
agccccaguccgcugcgggcgg

SEQ ID NO: 429935 - RNA, 22 nt, Human
cacuguuuuacauguuauuuaa

SEQ ID NO: 429936 - RNA, 22 nt, Human
ucaggaugagucaucaagcugc

SEQ ID NO: 429937 - RNA, 22 nt, Human
gauguucgagcagaagaccagg

SEQ ID NO: 429938 - RNA, 22 nt, Human
agggcaguguggugggacugac

SEQ ID NO: 429939 - RNA, 18 nt, Human
gagaggagccagaauuuu

SEQ ID NO: 429940 - RNA, 19 nt, Human
ugcuugccugccuuuccca

SEQ ID NO: 429941 - RNA, 22 nt, Human
ccaggcagccaagugugugugu

SEQ ID NO: 429942 - RNA, 22 nt, Human
gcagcccaggaggcgggagccc

SEQ ID NO: 429943 - RNA, 18 nt, Human
ccucuggguuuuguuccc

SEQ ID NO: 429944 - RNA, 22 nt, Human
cagacaggguccuguccgucac

SEQ ID NO: 429945 - RNA, 22 nt, Human
uaccugggcccaccagugccug

SEQ ID NO: 429946 - RNA, 22 nt, Human
ccuccccacagcccaggagacu

SEQ ID NO: 429947 - RNA, 22 nt, Human
aggccagaacagcucugcacca

SEQ ID NO: 429948 - RNA, 22 nt, Human
gucgaucaccucguccuccgug

SEQ ID NO: 429949 - RNA, 22 nt, Human
gcuuuggaaauauagacucaag

SEQ ID NO: 429950 - RNA, 22 nt, Human
aagagcuggcucuugcagcagc

SEQ ID NO: 429951 - RNA, 22 nt, Human
gcagagcugguacuugagccug

SEQ ID NO: 429952 - RNA, 22 nt, Human
gcagccuccgcacugcgagucc

SEQ ID NO: 429953 - RNA, 22 nt, Human
gucacccguuugacuauccacc

SEQ ID NO: 429954 - RNA, 22 nt, Human
uggugaagucagcggagcccgg

SEQ ID NO: 429955 - RNA, 22 nt, Human
cagaggccccauuggcugugcg

SEQ ID NO: 429956 - RNA, 19 nt, Human
agcaguggagccaugccug

SEQ ID NO: 429957 - RNA, 19 nt, Human
cuccacagggauugugauu

SEQ ID NO: 429958 - RNA, 22 nt, Human
ugcuuuggcccaacauugaugc

SEQ ID NO: 429959 - RNA, 22 nt, Human
caggccugugacaccgugucug

SEQ ID NO: 429960 - RNA, 22 nt, Human
gcggaagcgguagucacccucg

SEQ ID NO: 429961 - RNA, 22 nt, Human
gccugcuuccuagccuuccaag

SEQ ID NO: 429962 - RNA, 22 nt, Human
agacgcgguggugcaugccugu

SEQ ID NO: 429963 - RNA, 22 nt, Human
ugccgcugucgccaccauggcu

SEQ ID NO: 429964 - RNA, 22 nt, Human
augcauaucuccuaucuccuca

SEQ ID NO: 429965 - RNA, 22 nt, Human
cgggagccucugggucacacug

SEQ ID NO: 429966 - RNA, 22 nt, Human
cuguggaguccuggggaaugga

SEQ ID NO: 429967 - RNA, 22 nt, Human
agcgcuggugaucucuauuuug

SEQ ID NO: 429968 - RNA, 22 nt, Human
cuggcuuugaucagagugaccu

SEQ ID NO: 429969 - RNA, 22 nt, Human
augaaaacagccuccugugaua

SEQ ID NO: 429970 - RNA, 22 nt, Human
acagauccugguuacagccauu

SEQ ID NO: 429971 - RNA, 22 nt, Human
uucuuuuaauagagauccugug

SEQ ID NO: 429972 - RNA, 22 nt, Human
ccugggacgacucuguacccuu

SEQ ID NO: 429973 - RNA, 23 nt, Human
ggacaugucucuggguauuuuga

SEQ ID NO: 429974 - RNA, 22 nt, Human
gggcuguuugcauauguuuaua

SEQ ID NO: 429975 - RNA, 22 nt, Human
ggccacuguuuccugggcaguu

SEQ ID NO: 429976 - RNA, 22 nt, Human
ggccgggcuguggagaaggggu

SEQ ID NO: 429977 - RNA, 22 nt, Human
ugggaugggaucucgcuguguc

SEQ ID NO: 429978 - RNA, 22 nt, Human
uuuguguuggaagaaaugcuac

SEQ ID NO: 429979 - RNA, 22 nt, Human
auggguggccccgugugcaguc

SEQ ID NO: 429980 - RNA, 22 nt, Human
uugucgggcuuacgcagggcca

SEQ ID NO: 429981 - RNA, 22 nt, Human
cagggccagggcuauggugaag

SEQ ID NO: 429982 - RNA, 22 nt, Human
acagagacacggaagcuaaaga

SEQ ID NO: 429983 - RNA, 22 nt, Human
aggcugcugccuuggagagugu

SEQ ID NO: 429984 - RNA, 18 nt, Human
ucugugggaucagugagg

SEQ ID NO: 429985 - RNA, 22 nt, Human
uugacccgaguccuucuugggg

SEQ ID NO: 429986 - RNA, 22 nt, Human
ccugguguuaucauaggucaug

SEQ ID NO: 429987 - RNA, 22 nt, Human
caggccuugaaggccugcggga

SEQ ID NO: 429988 - RNA, 22 nt, Human
aucccaggcggcacagguugca

SEQ ID NO: 429989 - RNA, 22 nt, Human
gcucguugaaccuguccccgag

SEQ ID NO: 429990 - RNA, 22 nt, Human
cccaggaguuagagguuguggu

SEQ ID NO: 429991 - RNA, 22 nt, Human
cuugcuuuaucugguuucucau

SEQ ID NO: 429992 - RNA, 22 nt, Human
ucuggggucaccuggggugcuu

SEQ ID NO: 429993 - RNA, 21 nt, Human
cacuccacuuagaacaggguu

SEQ ID NO: 429994 - RNA, 23 nt, Human
agcccagcagagaaccuaggucc

SEQ ID NO: 429995 - RNA, 22 nt, Human
ggcuaaggacgggcaaguccca

SEQ ID NO: 429996 - RNA, 22 nt, Human
uugaggucuucaggaucaggcu

SEQ ID NO: 429997 - RNA, 22 nt, Human
gucucuaucauagcugaacccu

SEQ ID NO: 429998 - RNA, 22 nt, Human
agaaggcaucagaaguguguag

SEQ ID NO: 429999 - RNA, 22 nt, Human
ugggguccucucacuuggaggg

SEQ ID NO: 430000 - RNA, 22 nt, Human
guuucuccucugugucuuguuu

SEQ ID NO: 430001 - RNA, 22 nt, Human
acccggagucggagguugcagu

SEQ ID NO: 430002 - RNA, 22 nt, Human
uuggccguuucacugggcaguu

SEQ ID NO: 430003 - RNA, 20 nt, Human
uggcccagcacgacgaggac

SEQ ID NO: 430004 - RNA, 22 nt, Human
gcucagagauguucaguagcuu

SEQ ID NO: 430005 - RNA, 22 nt, Human
gggagggcuuggacccagaugu

SEQ ID NO: 430006 - RNA, 22 nt, Human
gcguuggggaccccgaagcugg

SEQ ID NO: 430007 - RNA, 22 nt, Human
gggcccugcgacucgcggcgga

SEQ ID NO: 430008 - RNA, 22 nt, Human
agggccacgugcaccgcggucu

SEQ ID NO: 430009 - RNA, 22 nt, Human
cugaagcugggcacuuccuuuu

SEQ ID NO: 430010 - RNA, 21 nt, Human
agggaaaaggcugagugaggg

SEQ ID NO: 430011 - RNA, 18 nt, Human
ggcggguguuuuauucac

SEQ ID NO: 430012 - RNA, 22 nt, Human
ggcacagcugaugcagacacac

SEQ ID NO: 430013 - RNA, 22 nt, Human
uggcagcauuuuuuccagaaca

SEQ ID NO: 430014 - RNA, 20 nt, Human
ugggaucgaaucaagucugu

SEQ ID NO: 430015 - RNA, 22 nt, Human
uggaaggggagcuggaaagggg

SEQ ID NO: 430016 - RNA, 22 nt, Human
cucacaggguucuaucgaagag

SEQ ID NO: 430017 - RNA, 22 nt, Human
gguggcaccuuacccugcgcag

SEQ ID NO: 430018 - RNA, 22 nt, Human
agagggcgcccaggcccacgcc

SEQ ID NO: 430019 - RNA, 22 nt, Human
ugcaaauucuuuacucugugau

SEQ ID NO: 430020 - RNA, 22 nt, Human
accccagaggcggaggcugcag

SEQ ID NO: 430021 - RNA, 22 nt, Human
gagcagcuguucugacuugucu

SEQ ID NO: 430022 - RNA, 18 nt, Human
gagagcccagcagguggu

SEQ ID NO: 430023 - RNA, 23 nt, Human
ugacacccucauugugugucgca

SEQ ID NO: 430024 - RNA, 22 nt, Human
agcaggaggagagccuggcggu

SEQ ID NO: 430025 - RNA, 20 nt, Human
caauaauuuacuucccuauu

SEQ ID NO: 430026 - RNA, 22 nt, Human
ucccacacagcccgcucaccgg

SEQ ID NO: 430027 - RNA, 22 nt, Human
ugcugugcuggcggcagaggcc

SEQ ID NO: 430028 - RNA, 22 nt, Human
gaaggcaguaaauggcuguuuu

SEQ ID NO: 430029 - RNA, 22 nt, Human
ccugggcugcucauggggauga

SEQ ID NO: 430030 - RNA, 22 nt, Human
cagggcucgcucgcucgcucgc

SEQ ID NO: 430031 - RNA, 22 nt, Human
cgagagauggguuggcaggggc

SEQ ID NO: 430032 - RNA, 20 nt, Human
gggugugugcagggccuggu

SEQ ID NO: 430033 - RNA, 22 nt, Human
acggugcuggguauugggguuc

SEQ ID NO: 430034 - RNA, 22 nt, Human
aggggagguggcagaaaugugc

SEQ ID NO: 430035 - RNA, 21 nt, Human
gccaucaccaagcucuucccc

SEQ ID NO: 430036 - RNA, 22 nt, Human
ggcaguggugggaggcucgcuc

SEQ ID NO: 430037 - RNA, 22 nt, Human
gugcaggugguuggcccagccg

SEQ ID NO: 430038 - RNA, 22 nt, Human
cagggcuccccagagagccucu

SEQ ID NO: 430039 - RNA, 22 nt, Human
guguggcuaggauggcuuugcu

SEQ ID NO: 430040 - RNA, 22 nt, Human
ucugcuggaaaaccagggaauu

SEQ ID NO: 430041 - RNA, 19 nt, Human
ccgucauggagaguggggu

SEQ ID NO: 430042 - RNA, 18 nt, Human
acagggagggcgcugggg

SEQ ID NO: 430043 - RNA, 22 nt, Human
cugaggagauccccccagaagu

SEQ ID NO: 430044 - RNA, 22 nt, Human
agacaagagcugaggacauauu

SEQ ID NO: 430045 - RNA, 21 nt, Human
gcugcucgagauccagugcuu

SEQ ID NO: 430046 - RNA, 20 nt, Human
cugaccagcagccugucucc

SEQ ID NO: 430047 - RNA, 23 nt, Human
agugggcucaguccuccaacccc

SEQ ID NO: 430048 - RNA, 22 nt, Human
aggggcacgaguagagcucuag

SEQ ID NO: 430049 - RNA, 21 nt, Human
agggccagaucaccaaggagc

SEQ ID NO: 430050 - RNA, 22 nt, Human
ggcuacagcgggguggagacgg

SEQ ID NO: 430051 - RNA, 22 nt, Human
ccaugcccuugucaucuccagg

SEQ ID NO: 430052 - RNA, 18 nt, Human
cccacggugcuguagggc

SEQ ID NO: 430053 - RNA, 21 nt, Human
uccaggagcacgggacuagga

SEQ ID NO: 430054 - RNA, 22 nt, Human
gugcgccagcucaaggggaggc

SEQ ID NO: 430055 - RNA, 22 nt, Human
guggccaaggcagagaaagagc

SEQ ID NO: 430056 - RNA, 22 nt, Human
gucuguccacuuggaagcuccc

SEQ ID NO: 430057 - RNA, 22 nt, Human
ugggaagaguuagagacagcug

SEQ ID NO: 430058 - RNA, 22 nt, Human
aacccgggagguggagguuaug

SEQ ID NO: 430059 - RNA, 22 nt, Human
agugggaauuuucucccaggga

SEQ ID NO: 430060 - RNA, 22 nt, Human
gacagcaggaugugaggggaug

SEQ ID NO: 430061 - RNA, 19 nt, Human
gcuuccagcacugcaggag

SEQ ID NO: 430062 - RNA, 22 nt, Human
cccaggucgucagcaguguggu

SEQ ID NO: 430063 - RNA, 22 nt, Human
ccgcguggcacccuccuggagg

SEQ ID NO: 430064 - RNA, 22 nt, Human
gacagggacacagccagugagg

SEQ ID NO: 430065 - RNA, 22 nt, Human
gggagaguagcuggaagguucu

SEQ ID NO: 430066 - RNA, 22 nt, Human
gaaccuguccugagugaggagu

SEQ ID NO: 430067 - RNA, 22 nt, Human
caggccacagcuaaagaggauu

SEQ ID NO: 430068 - RNA, 19 nt, Human
cccuggaggaguguuggcu

SEQ ID NO: 430069 - RNA, 21 nt, Human
cuguccccagugagcaccccc

SEQ ID NO: 430070 - RNA, 22 nt, Human
uacagccuggcacuacccuggg

SEQ ID NO: 430071 - RNA, 22 nt, Human
agugccaaaucgagggcucuga

SEQ ID NO: 430072 - RNA, 22 nt, Human
aaacacaucauucaugucguca

SEQ ID NO: 430073 - RNA, 22 nt, Human
cugggaagggacgccagugccu

SEQ ID NO: 430074 - RNA, 22 nt, Human
gugcaggacagcacaucuccug

SEQ ID NO: 430075 - RNA, 22 nt, Human
uaguggggaaggaggacaagaa

SEQ ID NO: 430076 - RNA, 22 nt, Human
ggaaggguuuaagcaggagagu

SEQ ID NO: 430077 - RNA, 22 nt, Human
ccaggccuguguuguguggagg

SEQ ID NO: 430078 - RNA, 22 nt, Human
cuagggccaaaggcugugaugc

SEQ ID NO: 430079 - RNA, 22 nt, Human
ccugcucaacgaauauggcgau

SEQ ID NO: 430080 - RNA, 17 nt, Human
gcguguccccgcgucuc

SEQ ID NO: 430081 - RNA, 18 nt, Human
aggagcggcugcggcugc

SEQ ID NO: 430082 - RNA, 22 nt, Human
gccaagaaugcgacagccguca

SEQ ID NO: 430083 - RNA, 22 nt, Human
ggcucagaggagcuggaacggu

SEQ ID NO: 430084 - RNA, 22 nt, Human
auuuacagacguggauuagugc

SEQ ID NO: 430085 - RNA, 22 nt, Human
ugccaggcugcccuccagucug

SEQ ID NO: 430086 - RNA, 22 nt, Human
auccuggguaaguuccuuuuaa

SEQ ID NO: 430087 - RNA, 22 nt, Human
uguggagcccccaggagugggg

SEQ ID NO: 430088 - RNA, 22 nt, Human
cggcagagcccugagucagccu

SEQ ID NO: 430089 - RNA, 22 nt, Human
uggcccaggugcacccagaggc

SEQ ID NO: 430090 - RNA, 22 nt, Human
ucacccagacugucugacucuu

SEQ ID NO: 430091 - RNA, 22 nt, Human
uuugggcuguacaauuucugua

SEQ ID NO: 430092 - RNA, 22 nt, Human
uggcaaggccacaggugcaguu

SEQ ID NO: 430093 - RNA, 22 nt, Human
ucauuuacacuucacaaaugga

SEQ ID NO: 430094 - RNA, 22 nt, Human
gagaauacaaccagaagcugag

SEQ ID NO: 430095 - RNA, 22 nt, Human
uguaccacucuacuaaggguuc

SEQ ID NO: 430096 - RNA, 22 nt, Human
ugagucacuggcaaggcuuuga

SEQ ID NO: 430097 - RNA, 22 nt, Human
uggccuuggucacaaugcaaac

SEQ ID NO: 430098 - RNA, 20 nt, Human
gugcuaaguacugugaaggg

SEQ ID NO: 430099 - RNA, 22 nt, Human
accuggccaguggggccgcgcu

SEQ ID NO: 430100 - RNA, 22 nt, Human
aguggguguagucuuccuccug

SEQ ID NO: 430101 - RNA, 22 nt, Human
aggggagguguccccaaaucuc

SEQ ID NO: 430102 - RNA, 22 nt, Human
uuuucaguugugcucucuaguu

SEQ ID NO: 430103 - RNA, 22 nt, Human
ucucgugcaggccuugcucgga

SEQ ID NO: 430104 - RNA, 22 nt, Human
ggcuggcuggcuuagcagagga

SEQ ID NO: 430105 - RNA, 22 nt, Human
uaacacauagauauuuuaacuu

SEQ ID NO: 430106 - RNA, 22 nt, Human
gagccacaguggauugauucca

SEQ ID NO: 430107 - RNA, 22 nt, Human
ugcugcccacuguauuucucca

SEQ ID NO: 430108 - RNA, 22 nt, Human
gccugaucagguccucggcaua

SEQ ID NO: 430109 - RNA, 22 nt, Human
agcagcaggugaccucgaugcc

SEQ ID NO: 430110 - RNA, 22 nt, Human
gucccaggggagcucucugauu

SEQ ID NO: 430111 - RNA, 22 nt, Human
cagggucuuggcgccaucaccc

SEQ ID NO: 430112 - RNA, 22 nt, Human
uucucucaguuaaacuuuguga

SEQ ID NO: 430113 - RNA, 20 nt, Human
uuugauugccccucugacuu

SEQ ID NO: 430114 - RNA, 22 nt, Human
uguguggcaagcuguaugcuag

SEQ ID NO: 430115 - RNA, 22 nt, Human
uagcccauggacuggucagcug

SEQ ID NO: 430116 - RNA, 22 nt, Human
ugcgccugcgcaaagguuucug

SEQ ID NO: 430117 - RNA, 22 nt, Human
cuuauuggucccaggaggagaa

SEQ ID NO: 430118 - RNA, 22 nt, Human
ggcagaggaagcuggaaguggg

SEQ ID NO: 430119 - RNA, 22 nt, Human
aagcccgguugggaacguggug

SEQ ID NO: 430120 - RNA, 22 nt, Human
caggcucgguccaguggcaccc

SEQ ID NO: 430121 - RNA, 22 nt, Human
ccagcagcucccucaggguccg

SEQ ID NO: 430122 - RNA, 22 nt, Human
gagaaagggaacuuacagagug

SEQ ID NO: 430123 - RNA, 22 nt, Human
gagaugggcgagaagguggacu

SEQ ID NO: 430124 - RNA, 22 nt, Human
gcagcugcgcugguguggggca

SEQ ID NO: 430125 - RNA, 22 nt, Human
gaagaccccagagcgagguaag

SEQ ID NO: 430126 - RNA, 22 nt, Human
gugggccaguuccucacaggua

SEQ ID NO: 430127 - RNA, 22 nt, Human
guucucugccggcaccuacccg

SEQ ID NO: 430128 - RNA, 22 nt, Human
uaaaugaaaggguuuaauuuau

SEQ ID NO: 430129 - RNA, 22 nt, Human
acagccaggaauucuggagaag

SEQ ID NO: 430130 - RNA, 22 nt, Human
uggcagugugggaggaagguac

SEQ ID NO: 430131 - RNA, 22 nt, Human
ugggccagauccauggcaauaa

SEQ ID NO: 430132 - RNA, 22 nt, Human
uuuaauuauaucugggcaguua

SEQ ID NO: 430133 - RNA, 22 nt, Human
gcugcagggagcuggaaggcuc

SEQ ID NO: 430134 - RNA, 22 nt, Human
gugcgggccuggggguuucucu

SEQ ID NO: 430135 - RNA, 22 nt, Human
gggagcugaaggagccggcggg

SEQ ID NO: 430136 - RNA, 22 nt, Human
uggugcaggccaagcugcgagc

SEQ ID NO: 430137 - RNA, 22 nt, Human
ggugagaggcagugcuguggaa

SEQ ID NO: 430138 - RNA, 22 nt, Human
gaugugugugcccugggccugc

SEQ ID NO: 430139 - RNA, 22 nt, Human
ggggucugggcuuagcuggaau

SEQ ID NO: 430140 - RNA, 22 nt, Human
ccacuguuggcccgaagggguc

SEQ ID NO: 430141 - RNA, 22 nt, Human
ccucccugccggcuggacuagu

SEQ ID NO: 430142 - RNA, 22 nt, Human
gagugugucggucagcguggcg

SEQ ID NO: 430143 - RNA, 22 nt, Human
cauugagcgacccugcaugacu

SEQ ID NO: 430144 - RNA, 22 nt, Human
ccccagugguugcaacagcaga

SEQ ID NO: 430145 - RNA, 22 nt, Human
cucagagagacaaugugggaca

SEQ ID NO: 430146 - RNA, 22 nt, Human
gccccagcagcaaugcgguuga

SEQ ID NO: 430147 - RNA, 22 nt, Human
ugcagcugccuagggcuggcuu

SEQ ID NO: 430148 - RNA, 22 nt, Human
cagcugccuaugaccuagccuc

SEQ ID NO: 430149 - RNA, 22 nt, Human
cagcugccuguauuguccucau

SEQ ID NO: 430150 - RNA, 22 nt, Human
cgcugggcgcgcuccgaacccg

SEQ ID NO: 430151 - RNA, 22 nt, Human
gcggggacagaaggcgguucuc

SEQ ID NO: 430152 - RNA, 22 nt, Human
uuggaauuugagaccaagaaaa

SEQ ID NO: 430153 - RNA, 22 nt, Human
gggcagcaucaggaggggcuuu

SEQ ID NO: 430154 - RNA, 22 nt, Human
cccguguggaugcgcuggugcu

SEQ ID NO: 430155 - RNA, 23 nt, Human
uugggcaaaucacuaacgucucc

SEQ ID NO: 430156 - RNA, 22 nt, Human
gaggagagaagcuaacggugcu

SEQ ID NO: 430157 - RNA, 22 nt, Human
cuuuacuucagcaagcuuuccu

SEQ ID NO: 430158 - RNA, 22 nt, Human
guggcauuuuagaacagcugac

SEQ ID NO: 430159 - RNA, 22 nt, Human
uuauguauggauggcugaaagu

SEQ ID NO: 430160 - RNA, 21 nt, Human
uuggccgugcagaugaacagc

SEQ ID NO: 430161 - RNA, 22 nt, Human
gcuggccugcgagggcaggcug

SEQ ID NO: 430162 - RNA, 18 nt, Human
ggccucagccuggccgga

SEQ ID NO: 430163 - RNA, 21 nt, Human
uacaucaguuuucuuggcuca

SEQ ID NO: 430164 - RNA, 22 nt, Human
uuguccuuaccucaaucuggaa

SEQ ID NO: 430165 - RNA, 22 nt, Human
cgggcuccgggucuuugcaguc

SEQ ID NO: 430166 - RNA, 22 nt, Human
augcggagccccaagcuugaag

SEQ ID NO: 430167 - RNA, 23 nt, Human
cuguggaucuagagggggcccua

SEQ ID NO: 430168 - RNA, 22 nt, Human
aguggcuguuccaggugaggac

SEQ ID NO: 430169 - RNA, 22 nt, Human
ccaggcuccccaggaggcccuu

SEQ ID NO: 430170 - RNA, 19 nt, Human
uggcagcauugguaccuug

SEQ ID NO: 430171 - RNA, 22 nt, Human
gcgguauuugugugggugucga

SEQ ID NO: 430172 - RNA, 22 nt, Human
ggcgcaguugagcgugcuguuc

SEQ ID NO: 430173 - RNA, 22 nt, Human
cggucaggugcagcguuggcac

SEQ ID NO: 430174 - RNA, 22 nt, Human
uugaggucuggcaguagcguug

SEQ ID NO: 430175 - RNA, 22 nt, Human
ccauggccugaaggagugcauc

SEQ ID NO: 430176 - RNA, 22 nt, Human
uggcagccugcgugaaggagcu

SEQ ID NO: 430177 - RNA, 22 nt, Human
acaggcgcacaugagggccgug

SEQ ID NO: 430178 - RNA, 18 nt, Human
gguccugggccuggcuca

SEQ ID NO: 430179 - RNA, 22 nt, Human
aguggcaguagaugagcugguu

SEQ ID NO: 430180 - RNA, 22 nt, Human
gccuuuuaaggcagagggagau

SEQ ID NO: 430181 - RNA, 22 nt, Human
gcuggccugaccugaggcuggg

SEQ ID NO: 430182 - RNA, 22 nt, Human
uuggcgcccaggacgccgccgc

SEQ ID NO: 430183 - RNA, 22 nt, Human
cauugcaacuucaaacuccugg

SEQ ID NO: 430184 - RNA, 22 nt, Human
agacacauuuucagcucugcca

SEQ ID NO: 430185 - RNA, 22 nt, Human
agccagggacgcugcaggcuac

SEQ ID NO: 430186 - RNA, 22 nt, Human
cacagagagcuacgugcagcgu

SEQ ID NO: 430187 - RNA, 22 nt, Human
uggcuccacaggccagggugug

SEQ ID NO: 430188 - RNA, 22 nt, Human
ugaacaggugccuucagggagu

SEQ ID NO: 430189 - RNA, 18 nt, Human
uggguggcuagggaguuu

SEQ ID NO: 430190 - RNA, 22 nt, Human
gcugucaggaacaugccuuggu

SEQ ID NO: 430191 - RNA, 22 nt, Human
uccaggagggggagccgugccg

SEQ ID NO: 430192 - RNA, 18 nt, Human
ggaggcucugugguuucc

SEQ ID NO: 430193 - RNA, 16 nt, Human
ggcagcagcuccgugc

SEQ ID NO: 430194 - RNA, 22 nt, Human
aagguggugaucaucuugaagg

SEQ ID NO: 430195 - RNA, 22 nt, Human
uuuucaguuccaucucugcucu

SEQ ID NO: 430196 - RNA, 22 nt, Human
agguaagguuuggaggcagugg

SEQ ID NO: 430197 - RNA, 22 nt, Human
gccacaggucggcuagaggguc

SEQ ID NO: 430198 - RNA, 21 nt, Human
ucgaccugcugggcucgggcu

SEQ ID NO: 430199 - RNA, 22 nt, Human
gucaggggccaugggccaagga

SEQ ID NO: 430200 - RNA, 22 nt, Human
gcccagcgagcagagguggacg

SEQ ID NO: 430201 - RNA, 22 nt, Human
cuuccucuguggccagagugua

SEQ ID NO: 430202 - RNA, 22 nt, Human
cuguggguggcugugccccagg

SEQ ID NO: 430203 - RNA, 22 nt, Human
gcccuguuuucuggguuccuug

SEQ ID NO: 430204 - RNA, 22 nt, Human
uuugcuggagaugagcgugggu

SEQ ID NO: 430205 - RNA, 22 nt, Human
gggucugcuccaccugcagccc

SEQ ID NO: 430206 - RNA, 22 nt, Human
cugcaucaguggauaugauggu

SEQ ID NO: 430207 - RNA, 22 nt, Human
gcugugcagaggugagaaucca

SEQ ID NO: 430208 - RNA, 22 nt, Human
uggggugugcucagagcagggg

SEQ ID NO: 430209 - RNA, 20 nt, Human
gcugugccaugacccucgag

SEQ ID NO: 430210 - RNA, 22 nt, Human
gggggcgccgccgcucaucuca

SEQ ID NO: 430211 - RNA, 22 nt, Human
uggcucaucuuuuuagacuuau

SEQ ID NO: 430212 - RNA, 22 nt, Human
agcaccagcucaaggugcaccu

SEQ ID NO: 430213 - RNA, 22 nt, Human
uuuuuggguccaggcuguaucu

SEQ ID NO: 430214 - RNA, 22 nt, Human
agaagugaguugugacuauggg

SEQ ID NO: 430215 - RNA, 22 nt, Human
uugcaaauaauagccugaaacu

SEQ ID NO: 430216 - RNA, 22 nt, Human
gcccagcccagaaagguucgga

SEQ ID NO: 430217 - RNA, 19 nt, Human
ggggcccggggucugcgag

SEQ ID NO: 430218 - RNA, 20 nt, Human
aggcccuccccacuguugcu

SEQ ID NO: 430219 - RNA, 22 nt, Human
agcuccugaaaauccagacugg

SEQ ID NO: 430220 - RNA, 22 nt, Human
gggaggaaggcuugggugagua

SEQ ID NO: 430221 - RNA, 20 nt, Human
ucucccugcccaucucagau

SEQ ID NO: 430222 - RNA, 22 nt, Human
aagaggaggacgguucccagaa

SEQ ID NO: 430223 - RNA, 22 nt, Human
guggggacgggauggcucacug

SEQ ID NO: 430224 - RNA, 22 nt, Human
ccugguccccaucggcccagcg

SEQ ID NO: 430225 - RNA, 22 nt, Human
ugcagguggcagcggggcacca

SEQ ID NO: 430226 - RNA, 22 nt, Human
cuggagaggcugggaacagguu

SEQ ID NO: 430227 - RNA, 22 nt, Human
gagucgagcagaaagccgucgg

SEQ ID NO: 430228 - RNA, 21 nt, Human
gcuguucggcggcccucgcgc

SEQ ID NO: 430229 - RNA, 22 nt, Human
aggguccugggugcaguugcuu

SEQ ID NO: 430230 - RNA, 22 nt, Human
aucauuaacccuugaugcuggg

SEQ ID NO: 430231 - RNA, 22 nt, Human
ucagguccaagauggccaucca

SEQ ID NO: 430232 - RNA, 22 nt, Human
accaggcccuccagcugcgugg

SEQ ID NO: 430233 - RNA, 22 nt, Human
aggagccgggccugggcccugc

SEQ ID NO: 430234 - RNA, 22 nt, Human
cagggacugagauccagacugu

SEQ ID NO: 430235 - RNA, 22 nt, Human
gcgcugccucugcucuccccac

SEQ ID NO: 430236 - RNA, 22 nt, Human
gugcaugucuuuggaggccucc

SEQ ID NO: 430237 - RNA, 22 nt, Human
gugcugauugggagcugggauu

SEQ ID NO: 430238 - RNA, 22 nt, Human
gcagaggggaagcugaggaauu

SEQ ID NO: 430239 - RNA, 22 nt, Human
cucuggaucugcccugacgcca

SEQ ID NO: 430240 - RNA, 22 nt, Human
uccguggggccuguggcuuccg

SEQ ID NO: 430241 - RNA, 22 nt, Human
ccuuaauuucuguccuucagau

SEQ ID NO: 430242 - RNA, 22 nt, Human
cacauuuaaagguugaagcuga

SEQ ID NO: 430243 - RNA, 22 nt, Human
cuggccgcaguguggaguugug

SEQ ID NO: 430244 - RNA, 22 nt, Human
gccaggaccucagaugcagggc

SEQ ID NO: 430245 - RNA, 22 nt, Human
gcuagcaaaugucauuuggaag

SEQ ID NO: 430246 - RNA, 22 nt, Human
gggcccuggacguggcggcaga

SEQ ID NO: 430247 - RNA, 22 nt, Human
gagccaggcccguacuugcugu

SEQ ID NO: 430248 - RNA, 22 nt, Human
gaugggcaucaaacaugacgug

SEQ ID NO: 430249 - RNA, 22 nt, Human
ccaccgaaacgucugcggaucc

SEQ ID NO: 430250 - RNA, 21 nt, Human
agccaggcaagcacccccacu

SEQ ID NO: 430251 - RNA, 22 nt, Human
ccuuuuauauggcucaucacag

SEQ ID NO: 430252 - RNA, 22 nt, Human
gcugucucauacaaggcccugc

SEQ ID NO: 430253 - RNA, 22 nt, Human
gcugggucucucccugguccug

SEQ ID NO: 430254 - RNA, 22 nt, Human
auggucacuucacccaugagcu

SEQ ID NO: 430255 - RNA, 22 nt, Human
uucuguaauucuguuaguuuca

SEQ ID NO: 430256 - RNA, 22 nt, Human
uccagaugcugcacauuccuga

SEQ ID NO: 430257 - RNA, 22 nt, Human
uuuucuuggaguggcuguccuu

SEQ ID NO: 430258 - RNA, 22 nt, Human
gggcuaagcagagugggaacag

SEQ ID NO: 430259 - RNA, 22 nt, Human
agggcucacuacaacccuggga

SEQ ID NO: 430260 - RNA, 19 nt, Human
auucuucucuuccugcugu

SEQ ID NO: 430261 - RNA, 22 nt, Human
ggauguggaccuugccugguga

SEQ ID NO: 430262 - RNA, 22 nt, Human
uugagcugccuggcuguggcuc

SEQ ID NO: 430263 - RNA, 22 nt, Human
ugcgcaugcguggcucuccggc

SEQ ID NO: 430264 - RNA, 22 nt, Human
cgucaggguugagcagguagau

SEQ ID NO: 430265 - RNA, 22 nt, Human
ucugggaguuucugugggagcu

SEQ ID NO: 430266 - RNA, 22 nt, Human
uuagccaugcccuagaagagga

SEQ ID NO: 430267 - RNA, 19 nt, Human
ucuugaggaaaguaaggca

SEQ ID NO: 430268 - RNA, 22 nt, Human
gaaggaagcugucuggaugugu

SEQ ID NO: 430269 - RNA, 20 nt, Human
aggaaggagaaucugagcaa

SEQ ID NO: 430270 - RNA, 22 nt, Human
cuggaagcgucggaggaagggc

SEQ ID NO: 430271 - RNA, 22 nt, Human
ucaggggcuugaggugcauguc

SEQ ID NO: 430272 - RNA, 22 nt, Human
uggucaggcugcucugcggcgu

SEQ ID NO: 430273 - RNA, 21 nt, Human
cccgugccuucagcaguccug

SEQ ID NO: 430274 - RNA, 22 nt, Human
ucuugccgcgcaggcgcaguuc

SEQ ID NO: 430275 - RNA, 22 nt, Human
gggaccuggacaugugugugcu

SEQ ID NO: 430276 - RNA, 19 nt, Human
aacuacagcgcacuguccu

SEQ ID NO: 430277 - RNA, 22 nt, Human
gccacaggaaagcacccuggag

SEQ ID NO: 430278 - RNA, 22 nt, Human
cagcccaggacugcagguguuu

SEQ ID NO: 430279 - RNA, 22 nt, Human
uagggggcuuugcugcuugaca

SEQ ID NO: 430280 - RNA, 19 nt, Human
gggugaggaagagcguugc

SEQ ID NO: 430281 - RNA, 22 nt, Human
uaucuguuuuuacagugucuuu

SEQ ID NO: 430282 - RNA, 22 nt, Human
ggucuggccuccgggcaggugg

SEQ ID NO: 430283 - RNA, 22 nt, Human
cggagaggugggggcagcaucu

SEQ ID NO: 430284 - RNA, 22 nt, Human
cuggcagcucugagucccuucu

SEQ ID NO: 430285 - RNA, 22 nt, Human
cccuguccugcuaggcccuggu

SEQ ID NO: 430286 - RNA, 22 nt, Human
gggccuuggcgaaguguggugg

SEQ ID NO: 430287 - RNA, 22 nt, Human
uggcugagcugcagcguggcuu

SEQ ID NO: 430288 - RNA, 22 nt, Human
ggugggugagcccugggagcug

SEQ ID NO: 430289 - RNA, 18 nt, Human
uccaccgcgugcaccucu

SEQ ID NO: 430290 - RNA, 22 nt, Human
aguccggggucuggacaccugg

SEQ ID NO: 430291 - RNA, 22 nt, Human
gagagaagggggauaugagccu

SEQ ID NO: 430292 - RNA, 22 nt, Human
gccagcuggcugcaggucccag

SEQ ID NO: 430293 - RNA, 22 nt, Human
ugccuggcugggcugcucaugg

SEQ ID NO: 430294 - RNA, 22 nt, Human
ggguggaaaguauuuggggacc

SEQ ID NO: 430295 - RNA, 22 nt, Human
uccuuggcaugccgucuucucc

SEQ ID NO: 430296 - RNA, 22 nt, Human
ugggccaggauuucaagacccu

SEQ ID NO: 430297 - RNA, 22 nt, Human
ggacuggucugagagggauuca

SEQ ID NO: 430298 - RNA, 22 nt, Human
ccugugggagggagcggcugga

SEQ ID NO: 430299 - RNA, 22 nt, Human
guugugcaaacacuggggucug

SEQ ID NO: 430300 - RNA, 22 nt, Human
gccggggcuggggagagacaug

SEQ ID NO: 430301 - RNA, 22 nt, Human
caggcacaaugagcgccaucuu

SEQ ID NO: 430302 - RNA, 19 nt, Human
ugguggaggugcaccugac

SEQ ID NO: 430303 - RNA, 22 nt, Human
ugaggauggaaugcugugcaag

SEQ ID NO: 430304 - RNA, 16 nt, Human
aggcucagaggcugga

SEQ ID NO: 430305 - RNA, 22 nt, Human
gcacugccugugagcccugguu

SEQ ID NO: 430306 - RNA, 22 nt, Human
acuugguggcgaacgaggguca

SEQ ID NO: 430307 - RNA, 22 nt, Human
guggcccaggcuuggcgcuggc

SEQ ID NO: 430308 - RNA, 22 nt, Human
ccuggggaccugccucagcccu

SEQ ID NO: 430309 - RNA, 21 nt, Human
cugugauguugccgggguagg

SEQ ID NO: 430310 - RNA, 22 nt, Human
uugggacagcaacgguucuguu

SEQ ID NO: 430311 - RNA, 22 nt, Human
gagccucguggcggccacugcg

SEQ ID NO: 430312 - RNA, 22 nt, Human
cagguuccaguugcagggacuu

SEQ ID NO: 430313 - RNA, 22 nt, Human
agguggucuuguggaugccgca

SEQ ID NO: 430314 - RNA, 21 nt, Human
ggucaggcaugugcccugagc

SEQ ID NO: 430315 - RNA, 22 nt, Human
ggcucacgcaauuaucccggcc

SEQ ID NO: 430316 - RNA, 22 nt, Human
gggcuuggcuggggccaccaga

SEQ ID NO: 430317 - RNA, 22 nt, Human
ccaggcccugcuccucacacca

SEQ ID NO: 430318 - RNA, 22 nt, Human
cugagggagcugcuggccuugg

SEQ ID NO: 430319 - RNA, 22 nt, Human
agcucagggccaggcgcguuuc

SEQ ID NO: 430320 - RNA, 22 nt, Human
agucuggagugauuauguggga

SEQ ID NO: 430321 - RNA, 22 nt, Human
acaaaugcuuaguucaccaaaa

SEQ ID NO: 430322 - RNA, 22 nt, Human
aguuggcuucaaaggcagagag

SEQ ID NO: 430323 - RNA, 19 nt, Human
ggauaagguuggagugauc

SEQ ID NO: 430324 - RNA, 22 nt, Human
auggagcagcagaaggggcuug

SEQ ID NO: 430325 - RNA, 22 nt, Human
accaggaguuuugaccaggggc

SEQ ID NO: 430326 - RNA, 22 nt, Human
cugcaccgugucucgggcugcc

SEQ ID NO: 430327 - RNA, 22 nt, Human
uccaggcuccccugcgugcucc

SEQ ID NO: 430328 - RNA, 22 nt, Human
ggagguggagcuggaaguucca

SEQ ID NO: 430329 - RNA, 22 nt, Human
uuugacaacugugcaguuugua

SEQ ID NO: 430330 - RNA, 22 nt, Human
aagccagguguuuaggccagcg

SEQ ID NO: 430331 - RNA, 22 nt, Human
gugcuaaugaauuggagugccu

SEQ ID NO: 430332 - RNA, 22 nt, Human
cagcuccccucuguggggcagu

SEQ ID NO: 430333 - RNA, 22 nt, Human
gcugguggcagagcuccgcggc

SEQ ID NO: 430334 - RNA, 22 nt, Human
uuccaggacuggguguuugaag

SEQ ID NO: 430335 - RNA, 22 nt, Human
acuucccacugcagugacugag

SEQ ID NO: 430336 - RNA, 22 nt, Human
gcccaguggcaucuucacugcu

SEQ ID NO: 430337 - RNA, 22 nt, Human
gagcugcuggccuccugcggga

SEQ ID NO: 430338 - RNA, 22 nt, Human
caacccaagguuaguuggucuu

SEQ ID NO: 430339 - RNA, 22 nt, Human
auccgggguucauuuucacuga

SEQ ID NO: 430340 - RNA, 22 nt, Human
aggcaguugaguggcuuuuuca

SEQ ID NO: 430341 - RNA, 22 nt, Human
ucggggauggugucugagggag

SEQ ID NO: 430342 - RNA, 22 nt, Human
ugucuuacagcaaucuguucug

SEQ ID NO: 430343 - RNA, 22 nt, Human
cagggagccccaauuccaugcc

SEQ ID NO: 430344 - RNA, 20 nt, Human
gccaagaauaugcccgacuc

SEQ ID NO: 430345 - RNA, 22 nt, Human
uuuauucucuaguuggucagau

SEQ ID NO: 430346 - RNA, 22 nt, Human
guguggucgaaguucucccgga

SEQ ID NO: 430347 - RNA, 22 nt, Human
gcggggccauguccaacggccu

SEQ ID NO: 430348 - RNA, 22 nt, Human
gaagcgugcagguccguauacu

SEQ ID NO: 430349 - RNA, 22 nt, Human
uggugcagacaggagccccgcu

SEQ ID NO: 430350 - RNA, 22 nt, Human
gggaugagagcugggacagaag

SEQ ID NO: 430351 - RNA, 22 nt, Human
uggcugaggcuuuucuuaaaga

SEQ ID NO: 430352 - RNA, 22 nt, Human
aaaccggguccagaucuucagg

SEQ ID NO: 430353 - RNA, 22 nt, Human
uucccagauuggagggcagggg

SEQ ID NO: 430354 - RNA, 23 nt, Human
uccugcagauaagcugguugaca

SEQ ID NO: 430355 - RNA, 22 nt, Human
ggccccagggauuaggccaacc

SEQ ID NO: 430356 - RNA, 22 nt, Human
ggagacagugacuuagagacug

SEQ ID NO: 430357 - RNA, 19 nt, Human
uccugcccaccagccaggg

SEQ ID NO: 430358 - RNA, 22 nt, Human
cgcgcugcagacagcggaggcc

SEQ ID NO: 430359 - RNA, 22 nt, Human
gcucagguagaugggguugucc

SEQ ID NO: 430360 - RNA, 22 nt, Human
ccggcucggcgaccaggcugaa

SEQ ID NO: 430361 - RNA, 22 nt, Human
gccgugcgugcgcaggugcugu

SEQ ID NO: 430362 - RNA, 22 nt, Human
ucccuacuguuagggacucagc

SEQ ID NO: 430363 - RNA, 18 nt, Human
ggaaggugcuggagugca

SEQ ID NO: 430364 - RNA, 22 nt, Human
ccagugugcauuaucauguguc

SEQ ID NO: 430365 - RNA, 22 nt, Human
aggaagccuggaguccugccca

SEQ ID NO: 430366 - RNA, 22 nt, Human
ccaggagagcucucguucagug

SEQ ID NO: 430367 - RNA, 23 nt, Human
aaauugucguaagguggagaugu

SEQ ID NO: 430368 - RNA, 21 nt, Human
auacaagaagauggcagucug

SEQ ID NO: 430369 - RNA, 22 nt, Human
gaggcuguaacuugggcacugg

SEQ ID NO: 430370 - RNA, 22 nt, Human
gaccugugcagugacugguggc

SEQ ID NO: 430371 - RNA, 22 nt, Human
gucuagggcuccucagugacaa

SEQ ID NO: 430372 - RNA, 22 nt, Human
agccccaguucccuggaagucu

SEQ ID NO: 430373 - RNA, 20 nt, Human
guccugggagccacagcaca

SEQ ID NO: 430374 - RNA, 22 nt, Human
ucccagucuagagccggauugg

SEQ ID NO: 430375 - RNA, 22 nt, Human
caugugguauugugagauccac

SEQ ID NO: 430376 - RNA, 22 nt, Human
ugcuugucacccugccugagug

SEQ ID NO: 430377 - RNA, 22 nt, Human
ugguggggccagacuucagcuc

SEQ ID NO: 430378 - RNA, 22 nt, Human
gcucccuggaauguuggcugcc

SEQ ID NO: 430379 - RNA, 22 nt, Human
aauguuaaguuuagauuauaac

SEQ ID NO: 430380 - RNA, 22 nt, Human
augagugcuuagagaguaaucc

SEQ ID NO: 430381 - RNA, 22 nt, Human
aacccagaaacgcaggcgguca

SEQ ID NO: 430382 - RNA, 22 nt, Human
gaggaggcuuccgggaggcacg

SEQ ID NO: 430383 - RNA, 22 nt, Human
cuuggcugaacuccaggaugca

SEQ ID NO: 430384 - RNA, 22 nt, Human
aggaaagcucccaguagggcuc

SEQ ID NO: 430385 - RNA, 22 nt, Human
ucugcacccugugguccucuag

SEQ ID NO: 430386 - RNA, 22 nt, Human
guuucuuauuucaacuggaaca

SEQ ID NO: 430387 - RNA, 22 nt, Human
gggcagcaggcuccacguuccu

SEQ ID NO: 430388 - RNA, 22 nt, Human
auggaguugagcucuguugucc

SEQ ID NO: 430389 - RNA, 23 nt, Human
gccagagcugccugcccuugcug

SEQ ID NO: 430390 - RNA, 22 nt, Human
gauggugcaggugaagugcugg

SEQ ID NO: 430391 - RNA, 22 nt, Human
uaacauuucggugacaguggga

SEQ ID NO: 430392 - RNA, 22 nt, Human
ccugcgggcugugcugaagccu

SEQ ID NO: 430393 - RNA, 19 nt, Human
agcagggagugguuguggg

SEQ ID NO: 430394 - RNA, 22 nt, Human
guauuaugaaugccgaggcggc

SEQ ID NO: 430395 - RNA, 23 nt, Human
uuguucuuggaucuuccugaagc

SEQ ID NO: 430396 - RNA, 22 nt, Human
gauauucauaggcagguauuua

SEQ ID NO: 430397 - RNA, 22 nt, Human
cugggcuccuaaccauccaggu

SEQ ID NO: 430398 - RNA, 22 nt, Human
agggcuccuaugccccauggac

SEQ ID NO: 430399 - RNA, 22 nt, Human
ccagaacagaccugccugaccu

SEQ ID NO: 430400 - RNA, 20 nt, Human
uccugggguaagccaugguc

SEQ ID NO: 430401 - RNA, 22 nt, Human
ucugcuugugucuguccagccu

SEQ ID NO: 430402 - RNA, 22 nt, Human
caugggcucuucuggacugcac

SEQ ID NO: 430403 - RNA, 22 nt, Human
guuaaaugcagauucugacuca

SEQ ID NO: 430404 - RNA, 22 nt, Human
gcaggccuccccugcuggagcu

SEQ ID NO: 430405 - RNA, 22 nt, Human
augcaguuagguaauagucuca

SEQ ID NO: 430406 - RNA, 22 nt, Human
guacuuucaggcuuucccuuaa

SEQ ID NO: 430407 - RNA, 20 nt, Human
aggggcaccugcgacggggc

SEQ ID NO: 430408 - RNA, 22 nt, Human
caggcuguguuccuggaacccc

SEQ ID NO: 430409 - RNA, 20 nt, Human
uccagccacuuccgcugguc

SEQ ID NO: 430410 - RNA, 22 nt, Human
gcugggagucgcgucuguggcc

SEQ ID NO: 430411 - RNA, 23 nt, Human
ggucccaguggagaggccucacc

SEQ ID NO: 430412 - RNA, 22 nt, Human
ggugggucuuguggggcagcuu

SEQ ID NO: 430413 - RNA, 22 nt, Human
cugcgggcugucaggcgugcca

SEQ ID NO: 430414 - RNA, 21 nt, Human
ugggcucuuuaacccaggcac

SEQ ID NO: 430415 - RNA, 22 nt, Human
uggaagguguggcaggucuagu

SEQ ID NO: 430416 - RNA, 22 nt, Human
guggcauugccuucugcaggaa

SEQ ID NO: 430417 - RNA, 22 nt, Human
agcuccacucccugccuguuuc

SEQ ID NO: 430418 - RNA, 22 nt, Human
uccacagggaugccugcggcuu

SEQ ID NO: 430419 - RNA, 22 nt, Human
cccacaggcaggugcaugggcu

SEQ ID NO: 430420 - RNA, 22 nt, Human
auagucuuagaaucuugagugu

SEQ ID NO: 430421 - RNA, 22 nt, Human
ucaguguccuucguucuuguug

SEQ ID NO: 430422 - RNA, 22 nt, Human
gggcagagguucaacuucaaca

SEQ ID NO: 430423 - RNA, 22 nt, Human
cagggcacaguuauggaggugg

SEQ ID NO: 430424 - RNA, 22 nt, Human
agugcguggaccccuggcugcu

SEQ ID NO: 430425 - RNA, 22 nt, Human
ucagauggucauucacuagggu

SEQ ID NO: 430426 - RNA, 22 nt, Human
aggccugggacgggagccguga

SEQ ID NO: 430427 - RNA, 22 nt, Human
caguuaaacagauugaguguua

SEQ ID NO: 430428 - RNA, 22 nt, Human
ccaggagcccugccacaauggu

SEQ ID NO: 430429 - RNA, 22 nt, Human
caggcacaagaucggcuagaua

SEQ ID NO: 430430 - RNA, 19 nt, Human
augggaagcggccagcgga

SEQ ID NO: 430431 - RNA, 22 nt, Human
uuauuuaaaagugguaagauuc

SEQ ID NO: 430432 - RNA, 22 nt, Human
ccagagaggccuuggcaagaca

SEQ ID NO: 430433 - RNA, 22 nt, Human
gcuguggcuccaauggugagcc

SEQ ID NO: 430434 - RNA, 22 nt, Human
acccagcucuuugauggucuug

SEQ ID NO: 430435 - RNA, 22 nt, Human
gcuuuuauuucuucacaaaagu

SEQ ID NO: 430436 - RNA, 22 nt, Human
gaaaggcucagauucccccagg

SEQ ID NO: 430437 - RNA, 22 nt, Human
aaguuauugguggagagcacug

SEQ ID NO: 430438 - RNA, 22 nt, Human
aaccccgcucaggcugggugag

SEQ ID NO: 430439 - RNA, 22 nt, Human
uuccaggccgggcaggaaacac

SEQ ID NO: 430440 - RNA, 22 nt, Human
ggccucugccccgcggggcucg

SEQ ID NO: 430441 - RNA, 22 nt, Human
cgcugccuucaucccacgccua

SEQ ID NO: 430442 - RNA, 22 nt, Human
gugauuuucuccuccuagaagu

SEQ ID NO: 430443 - RNA, 22 nt, Human
aaggggaguuagugauaaaacc

SEQ ID NO: 430444 - RNA, 22 nt, Human
ucccgggcaggucgagcgagcc

SEQ ID NO: 430445 - RNA, 22 nt, Human
gacaaagcgccugcucgcgggc

SEQ ID NO: 430446 - RNA, 22 nt, Human
ggcgaggugucugccaucaagc

SEQ ID NO: 430447 - RNA, 22 nt, Human
uuugggaaacuuaggggucaga

SEQ ID NO: 430448 - RNA, 22 nt, Human
uccaagaagcuuacaaucuaau

SEQ ID NO: 430449 - RNA, 22 nt, Human
augccaggcuguuuggccucag

SEQ ID NO: 430450 - RNA, 23 nt, Human
agacagaggcugaggcuggccgc

SEQ ID NO: 430451 - RNA, 22 nt, Human
agcugggugcccgaagccacgu

SEQ ID NO: 430452 - RNA, 22 nt, Human
agauguuuauaacucaugagug

SEQ ID NO: 430453 - RNA, 22 nt, Human
ggacauggaaguauggagugga

SEQ ID NO: 430454 - RNA, 22 nt, Human
agcccgcaucucgcuaaagaua

SEQ ID NO: 430455 - RNA, 22 nt, Human
agagacuguaaugagagguaca

SEQ ID NO: 430456 - RNA, 19 nt, Human
ggguccauggugucaagga

SEQ ID NO: 430457 - RNA, 22 nt, Human
accgugucugacacuuugggcg

SEQ ID NO: 430458 - RNA, 22 nt, Human
aggcucucucugccagccgugc

SEQ ID NO: 430459 - RNA, 22 nt, Human
cagggccugccugguuccugga

SEQ ID NO: 430460 - RNA, 22 nt, Human
uuuugguaauuaaguagauauu

SEQ ID NO: 430461 - RNA, 22 nt, Human
ggagaugccuuguuucaggaac

SEQ ID NO: 430462 - RNA, 22 nt, Human
acagacacaggcguggagucgc

SEQ ID NO: 430463 - RNA, 17 nt, Human
gcaggcacugcugccug

SEQ ID NO: 430464 - RNA, 21 nt, Human
ccuggagacaaagacagggug

SEQ ID NO: 430465 - RNA, 22 nt, Human
cccccagcucugcugggucccg

SEQ ID NO: 430466 - RNA, 21 nt, Human
gccugggaagagaaagguaag

SEQ ID NO: 430467 - RNA, 22 nt, Human
ggacugucuccuugcugguagg

SEQ ID NO: 430468 - RNA, 22 nt, Human
gacaguggagccacguugggag

SEQ ID NO: 430469 - RNA, 22 nt, Human
cuuguuuucuucugcagucuau

SEQ ID NO: 430470 - RNA, 22 nt, Human
cgccccagccaguugagcggcg

SEQ ID NO: 430471 - RNA, 22 nt, Human
ugcuggccucggcgcugggccu

SEQ ID NO: 430472 - RNA, 22 nt, Human
ggggcuuccagcgcccgccggu

SEQ ID NO: 430473 - RNA, 22 nt, Human
ugugcugcucucagugacagcc

SEQ ID NO: 430474 - RNA, 17 nt, Human
gcccgugggcuacggua

SEQ ID NO: 430475 - RNA, 22 nt, Human
cagcuggcgacucuccucgaug

SEQ ID NO: 430476 - RNA, 22 nt, Human
ugcuuguauucauaucacagcu

SEQ ID NO: 430477 - RNA, 22 nt, Human
ugggucagauugagccccuggu

SEQ ID NO: 430478 - RNA, 22 nt, Human herpesvirus 1
cuccccugcggcguugcgacau

SEQ ID NO: 430479 - RNA, 22 nt, Human herpesvirus 1
ccucgagacggccgccagcgcu

SEQ ID NO: 430480 - RNA, 22 nt, Human herpesvirus 1
cgucccccgacgaccucuugca

SEQ ID NO: 430481 - RNA, 22 nt, Human herpesvirus 1
gcagccuucgcucuccauccug

SEQ ID NO: 430482 - RNA, 22 nt, Human herpesvirus 1
gccagggucgcgcggcccgaaa

SEQ ID NO: 430483 - RNA, 22 nt, Human herpesvirus 1
accccaggcgugccgggggaac

SEQ ID NO: 430484 - RNA, 22 nt, Human herpesvirus 1
ccauguccuuuugucaaucggu

SEQ ID NO: 430485 - RNA, 22 nt, Human herpesvirus 1
ccggagagcggcuuggugcgga

SEQ ID NO: 430486 - RNA, 22 nt, Human herpesvirus 1
gguguuuacgaacgaguuugac

SEQ ID NO: 430487 - RNA, 22 nt, Human herpesvirus 1
uccccugugguguuuuugguua

SEQ ID NO: 430488 - RNA, 22 nt, Human herpesvirus 1
ucgggggugccgacgcaggcgu

SEQ ID NO: 430489 - RNA, 22 nt, Human herpesvirus 1
gagugccagcccugggaccgaa

SEQ ID NO: 430490 - RNA, 22 nt, Human herpesvirus 1
ggcagggcguuguucuggucaa

SEQ ID NO: 430491 - RNA, 22 nt, Human herpesvirus 1
ggagcugugccgccagacacgc

SEQ ID NO: 430492 - RNA, 22 nt, Human herpesvirus 1
ggcugguucgcagcgaggugca

SEQ ID NO: 430493 - RNA, 22 nt, Human herpesvirus 1
gggcccggaacgggaggccaca

SEQ ID NO: 430494 - RNA, 17 nt, Human herpesvirus 1
gggggaagcgagauagg

SEQ ID NO: 430495 - RNA, 22 nt, Human herpesvirus 1
guccuuuggaucccgaccccuc

SEQ ID NO: 430496 - RNA, 22 nt, Human herpesvirus 1
gucucggggucagccucgagcu

SEQ ID NO: 430497 - RNA, 23 nt, Human herpesvirus 1
guggaccugggaccgcgccgccc

SEQ ID NO: 430498 - RNA, 21 nt, Human herpesvirus 1
uuuauaauagcggccacgccc

SEQ ID NO: 430499 - RNA, 22 nt, Human herpesvirus 1
uggguuccgggagcaggcgugg

SEQ ID NO: 430500 - RNA, 22 nt, Human herpesvirus 1
uggucccgacgccaacccaggc

SEQ ID NO: 430501 - RNA, 22 nt, Human herpesvirus 1
ucugucucgccaggggcuggcc

SEQ ID NO: 430502 - RNA, 16 nt, Human herpesvirus 1
gcuuggaggccggaug

SEQ ID NO: 430503 - RNA, 20 nt, Human herpesvirus 1
uagggcgaagugcgagcacu

SEQ ID NO: 430504 - RNA, 22 nt, Human herpesvirus 1
uacugggcguggugauggacga

SEQ ID NO: 430505 - RNA, 22 nt, Human herpesvirus 1
ggcccagacgccguacccggug

SEQ ID NO: 430506 - RNA, 22 nt, Human herpesvirus 1
ggcccgguuggcggcgacgcuu

SEQ ID NO: 430507 - RNA, 22 nt, Human herpesvirus 1
ggccggggcccgcgcgcugaug

SEQ ID NO: 430508 - RNA, 22 nt, Human herpesvirus 1
ggccuuguuugucuggcggauc

SEQ ID NO: 430509 - RNA, 22 nt, Human herpesvirus 1
ggcgcgacacgaacaccgggcg

SEQ ID NO: 430510 - RNA, 22 nt, Human herpesvirus 1
gggagugagggucgcgucgucu

SEQ ID NO: 430511 - RNA, 22 nt, Human herpesvirus 1
gggcucgaggucgcucgguggg

SEQ ID NO: 430512 - RNA, 22 nt, Human herpesvirus 1
ccggccuggccgcccugugucu

SEQ ID NO: 430513 - RNA, 22 nt, Human herpesvirus 1
cggugcagcggacuggcaccga

SEQ ID NO: 430514 - RNA, 22 nt, Human herpesvirus 1
agugcucgcacuucgcccuaau

SEQ ID NO: 430515 - RNA, 22 nt, Human herpesvirus 1
gugugcacggaugagaucgcgc

SEQ ID NO: 430516 - RNA, 22 nt, Human herpesvirus 1
gcagguugucguugccgcgggu

SEQ ID NO: 430517 - RNA, 22 nt, Human herpesvirus 1
ggacggccuggacguugcgagc

SEQ ID NO: 430518 - RNA, 22 nt, Human herpesvirus 1
gagcuuguuuucgugggggacg

SEQ ID NO: 430519 - RNA, 22 nt, Human herpesvirus 1
gcaggccgugugcaggcccugc

SEQ ID NO: 430520 - RNA, 20 nt, Human herpesvirus 1
uguggugccgccugugauac

SEQ ID NO: 430521 - RNA, 22 nt, Human herpesvirus 1
ccaacccuggguggucgcggaa

SEQ ID NO: 430522 - RNA, 22 nt, Human herpesvirus 1
cagucgcacucgucccuggcuc

SEQ ID NO: 430523 - RNA, 22 nt, Human herpesvirus 1
ccgggcaugaaaacgaccucca

SEQ ID NO: 430524 - RNA, 22 nt, Human herpesvirus 1
ccuuggccgccccggcugcagg

SEQ ID NO: 430525 - RNA, 23 nt, Human herpesvirus 1
cggccggccgccauggcguagcc

SEQ ID NO: 430526 - RNA, 22 nt, Human herpesvirus 1
cggggugaaugagcugggcggc

SEQ ID NO: 430527 - RNA, 22 nt, Human herpesvirus 1
gaaaggggucugcaaccaaagg

SEQ ID NO: 430528 - RNA, 22 nt, Human herpesvirus 1
cucgcugcgaaccagcccgggu

SEQ ID NO: 430529 - RNA, 22 nt, Human herpesvirus 1
ggucccggcgcuggcgguaagu

SEQ ID NO: 430530 - RNA, 22 nt, Human herpesvirus 1
uuggugccgguggggcguaccg

SEQ ID NO: 430531 - RNA, 22 nt, Human herpesvirus 1
gggcguggccgcuauuauaaaa

SEQ ID NO: 430532 - RNA, 22 nt, Human herpesvirus 1
ggggggugcucugauagucucg

SEQ ID NO: 430533 - RNA, 22 nt, Human herpesvirus 1
gugggggaguuugagacggccg

SEQ ID NO: 430534 - RNA, 22 nt, Human herpesvirus 1
uagcauaucacauaccccguuc

SEQ ID NO: 430535 - RNA, 22 nt, Human herpesvirus 1
uagggcgaagugcgagcacugg

SEQ ID NO: 430536 - RNA, 22 nt, Human herpesvirus 1
ugcccgggacccacguggcggc

SEQ ID NO: 430537 - RNA, 22 nt, Human herpesvirus 1
gcgccacggccuccgcguucuc

SEQ ID NO: 430538 - RNA, 22 nt, Human herpesvirus 1
uggacaggcucuggagcauccg

SEQ ID NO: 430539 - RNA, 22 nt, Human herpesvirus 1
uggguuuggcgcgcguaugcgu

SEQ ID NO: 430540 - RNA, 22 nt, Human herpesvirus 1
ugaauaucucguugcgauucac

SEQ ID NO: 430541 - RNA, 22 nt, Human herpesvirus 1
ggcccccguucgccgccugggu

SEQ ID NO: 430542 - RNA, 22 nt, Human herpesvirus 1
ggcucguguuguuuuccgagua

SEQ ID NO: 430543 - RNA, 22 nt, Human herpesvirus 1
gggcccagcgcgaucuacggga

SEQ ID NO: 430544 - RNA, 22 nt, Human herpesvirus 1
agaacagcgucacccgauuacu

SEQ ID NO: 430545 - RNA, 18 nt, Human herpesvirus 1
acgggcugucauuccucg

SEQ ID NO: 430546 - RNA, 22 nt, Human herpesvirus 1
agcugcucgagucccugccugu

SEQ ID NO: 430547 - RNA, 22 nt, Human herpesvirus 1
aaaggggucugcaaccaaaggu

SEQ ID NO: 430548 - RNA, 22 nt, Human herpesvirus 1
aagaagcucacauaguccccac

SEQ ID NO: 430549 - RNA, 22 nt, Human herpesvirus 1
agccccacgcagggucugcgag

SEQ ID NO: 430550 - RNA, 22 nt, Human herpesvirus 1
accugcagcaaacggcaccacg

SEQ ID NO: 430551 - RNA, 22 nt, Human herpesvirus 1
cagaggggcgagguccguuucg

SEQ ID NO: 430552 - RNA, 22 nt, Human herpesvirus 1
auaauuuuauuggugggucguu

SEQ ID NO: 430553 - RNA, 22 nt, Human herpesvirus 1
caucaacaggaggucagugucc

SEQ ID NO: 430554 - RNA, 22 nt, Human herpesvirus 1
ccacgggccgcagcggcaccgu

SEQ ID NO: 430555 - RNA, 22 nt, Human herpesvirus 1
caugcucacgcugcaggugcug

SEQ ID NO: 430556 - RNA, 22 nt, Human herpesvirus 1
cuggcgucggcgcguguggguc

SEQ ID NO: 430557 - RNA, 22 nt, Human herpesvirus 1
gaguuugacaggcaagcaugug

SEQ ID NO: 430558 - RNA, 22 nt, Human herpesvirus 1
acccaggcggcgaacgggggcc

SEQ ID NO: 430559 - RNA, 22 nt, Human herpesvirus 1
agaaccuccccggguugcucgu

SEQ ID NO: 430560 - RNA, 22 nt, Human herpesvirus 1
agaugggcugcgcugggcgcca

SEQ ID NO: 430561 - RNA, 22 nt, Human herpesvirus 1
agcgcuggcggccgucucgagg

SEQ ID NO: 430562 - RNA, 22 nt, Human herpesvirus 1
cgccggggcugcccggccguga

SEQ ID NO: 430563 - RNA, 15 nt, Human herpesvirus 1
cgccgcgcccgggcc

SEQ ID NO: 430564 - RNA, 22 nt, Human herpesvirus 1
ccuuggccgccccggcugcagg

SEQ ID NO: 430565 - RNA, 22 nt, Human herpesvirus 1
aggccccuaggucgcgacggcu

SEQ ID NO: 430566 - RNA, 22 nt, Human herpesvirus 1
cgcccccucccuguuugucgcc

SEQ ID NO: 430567 - RNA, 22 nt, Human herpesvirus 1
cgccccgacggccaggugcgug

SEQ ID NO: 430568 - RNA, 22 nt, Human herpesvirus 1
cgagucggauuaugcccucuac

SEQ ID NO: 430569 - RNA, 22 nt, Human herpesvirus 1
cgauagugccgaggcgccgccc

SEQ ID NO: 430570 - RNA, 22 nt, Human herpesvirus 1
cgaacgcacaacggcgcugcuc

SEQ ID NO: 430571 - RNA, 22 nt, Human herpesvirus 1
cgacaggauuugggaccuacca

SEQ ID NO: 430572 - RNA, 22 nt, Human herpesvirus 1
agaugggcugcgcugggcgcca

SEQ ID NO: 430573 - RNA, 22 nt, Human herpesvirus 1
agccccacgcagggucugcgag

SEQ ID NO: 430574 - RNA, 22 nt, Human herpesvirus 1
agaacagcgucacccgauuacu

SEQ ID NO: 430575 - RNA, 22 nt, Human herpesvirus 1
agaaccuccccggguugcucgu

SEQ ID NO: 430576 - RNA, 22 nt, Human herpesvirus 1
agcguucgcacuucgucccaau

SEQ ID NO: 430577 - RNA, 22 nt, Human herpesvirus 1
agcucauccaacgccgcauggg

SEQ ID NO: 430578 - RNA, 22 nt, Human herpesvirus 1
agcgcuggcggccgucucgagg

SEQ ID NO: 430579 - RNA, 22 nt, Human herpesvirus 1
agcgcgcucgucugacguuugg

SEQ ID NO: 430580 - RNA, 22 nt, Human herpesvirus 1
acggcccgaagaugcguggcua

SEQ ID NO: 430581 - RNA, 22 nt, Human herpesvirus 1
acgggcgcuuuggcacccaguc

SEQ ID NO: 430582 - RNA, 22 nt, Human herpesvirus 1
ggggcgagcugugcccgcguga

SEQ ID NO: 430583 - RNA, 22 nt, Human herpesvirus 1
ggggcggagcguugugugggcg

SEQ ID NO: 430584 - RNA, 17 nt, Human herpesvirus 1
gggggaagcgagauagg

SEQ ID NO: 430585 - RNA, 22 nt, Human herpesvirus 1
gggccuguucgguaucgucguu

SEQ ID NO: 430586 - RNA, 22 nt, Human herpesvirus 1
gggcccagcgcgaucuacggga

SEQ ID NO: 430587 - RNA, 22 nt, Human herpesvirus 1
gggcccggaacgggaggccaca

SEQ ID NO: 430588 - RNA, 22 nt, Human herpesvirus 1
gggccuaccguggacuccauuu

SEQ ID NO: 430589 - RNA, 22 nt, Human herpesvirus 1
gggcguggccgcuauuauaaaa

SEQ ID NO: 430590 - RNA, 22 nt, Human herpesvirus 1
ggcgcgacacgaacaccgggcg

SEQ ID NO: 430591 - RNA, 22 nt, Human herpesvirus 1
gggacgcgaguacccacguuaa

SEQ ID NO: 430592 - RNA, 22 nt, Human herpesvirus 1
gggagugagggucgcgucgucu

SEQ ID NO: 430593 - RNA, 22 nt, Human herpesvirus 1
ggcugguucgcagcgaggugca

SEQ ID NO: 430594 - RNA, 22 nt, Human herpesvirus 1
ggcucguguuguuuuccgagua

SEQ ID NO: 430595 - RNA, 22 nt, Human herpesvirus 1
ggcggacguggugccucagcgu

SEQ ID NO: 430596 - RNA, 22 nt, Human herpesvirus 1
ggcguuguugauggccacggug

SEQ ID NO: 430597 - RNA, 18 nt, Human herpesvirus 1
gcggggguggauacgcug

SEQ ID NO: 430598 - RNA, 22 nt, Human herpesvirus 1
gccguguccuucacggggcucu

SEQ ID NO: 430599 - RNA, 22 nt, Human herpesvirus 1
gcccggcucgcgccgugcugac

SEQ ID NO: 430600 - RNA, 22 nt, Human herpesvirus 1
gccagggucgcgcggcccgaaa

SEQ ID NO: 430601 - RNA, 19 nt, Human herpesvirus 1
gcacggccgacgccgcggu

SEQ ID NO: 430602 - RNA, 22 nt, Human herpesvirus 1
gcaccucgugguggacguauag

SEQ ID NO: 430603 - RNA, 22 nt, Human herpesvirus 1
gcagguugucguugccgcgggu

SEQ ID NO: 430604 - RNA, 22 nt, Human herpesvirus 1
gcagccuucgcucuccauccug

SEQ ID NO: 430605 - RNA, 22 nt, Human herpesvirus 1
gcaggccgugugcaggcccugc

SEQ ID NO: 430606 - RNA, 22 nt, Human herpesvirus 1
gcgugcaggaggcggacggccc

SEQ ID NO: 430607 - RNA, 22 nt, Human herpesvirus 1
gcggucccgcgucgggucgugg

SEQ ID NO: 430608 - RNA, 22 nt, Human herpesvirus 1
gcuggccgagggcuucgacggc

SEQ ID NO: 430609 - RNA, 19 nt, Human herpesvirus 1
gcucggcuugcgccugccc

SEQ ID NO: 430610 - RNA, 22 nt, Human herpesvirus 1
gaccaccggcgucggcgcccgg

SEQ ID NO: 430611 - RNA, 18 nt, Human herpesvirus 1
gacaacaacgcccauguu

SEQ ID NO: 430612 - RNA, 22 nt, Human herpesvirus 1
gaccgcgagggacacguggugc

SEQ ID NO: 430613 - RNA, 22 nt, Human herpesvirus 1
gaaaggggucugcaaccaaagg

SEQ ID NO: 430614 - RNA, 22 nt, Human herpesvirus 1
gaacuugggggucgugagcagg

SEQ ID NO: 430615 - RNA, 22 nt, Human herpesvirus 1
gaagaggggucgggauccaaag

SEQ ID NO: 430616 - RNA, 22 nt, Human herpesvirus 1
cuggcgucggcgcguguggguc

SEQ ID NO: 430617 - RNA, 22 nt, Human herpesvirus 1
cuugccgaauccagggagggua

SEQ ID NO: 430618 - RNA, 18 nt, Human herpesvirus 1
cuuuccgagggcgagcuc

SEQ ID NO: 430619 - RNA, 22 nt, Human herpesvirus 1
cuccccugcggcguugcgacau

SEQ ID NO: 430620 - RNA, 22 nt, Human herpesvirus 1
cucauggccacggcggccgccg

SEQ ID NO: 430621 - RNA, 22 nt, Human herpesvirus 1
cguugcggagcaucccgcgccu

SEQ ID NO: 430622 - RNA, 17 nt, Human herpesvirus 1
ucgggccgugggcgacc

SEQ ID NO: 430623 - RNA, 22 nt, Human herpesvirus 1
ucgggggugccgacgcaggcgu

SEQ ID NO: 430624 - RNA, 22 nt, Human herpesvirus 1
ucggugcucuccaaggggcugu

SEQ ID NO: 430625 - RNA, 22 nt, Human herpesvirus 1
ucgucgagcguaccgacgggcg

SEQ ID NO: 430626 - RNA, 22 nt, Human herpesvirus 1
ucgucgucagcaccgucaucca

SEQ ID NO: 430627 - RNA, 22 nt, Human herpesvirus 1
ucgcagcgauuuucguacgggg

SEQ ID NO: 430628 - RNA, 22 nt, Human herpesvirus 1
ucgaugugggggugaccuccgg

SEQ ID NO: 430629 - RNA, 22 nt, Human herpesvirus 1
ggucccggcgcuggcgguaagu

SEQ ID NO: 430630 - RNA, 22 nt, Human herpesvirus 1
gguccggagaucaugcgcgggu

SEQ ID NO: 430631 - RNA, 22 nt, Human herpesvirus 1
ggguggcagcagcgccgggucu

SEQ ID NO: 430632 - RNA, 22 nt, Human herpesvirus 1
gguggucagcacgcggcccccu

SEQ ID NO: 430633 - RNA, 22 nt, Human herpesvirus 1
gguguuuacgaacgaguuugac

SEQ ID NO: 430634 - RNA, 22 nt, Human herpesvirus 1
ggucgucggcgggcugacgauc

SEQ ID NO: 430635 - RNA, 22 nt, Human herpesvirus 1
ggucgaugcggcccgaggauug

SEQ ID NO: 430636 - RNA, 22 nt, Human herpesvirus 1
gucaagaaucccaucgcccgug

SEQ ID NO: 430637 - RNA, 22 nt, Human herpesvirus 1
guacgcgaccguguugguguga

SEQ ID NO: 430638 - RNA, 22 nt, Human herpesvirus 1
guauuggucccaauggggucuc

SEQ ID NO: 430639 - RNA, 22 nt, Human herpesvirus 1
ggacgaggcgucggcgggccuc

SEQ ID NO: 430640 - RNA, 22 nt, Human herpesvirus 1
ggacggccuggacguugcgagc

SEQ ID NO: 430641 - RNA, 22 nt, Human herpesvirus 1
ggggggccuccgacggugcguu

SEQ ID NO: 430642 - RNA, 22 nt, Human herpesvirus 1
ggggggugcucugauagucucg

SEQ ID NO: 430643 - RNA, 22 nt, Human herpesvirus 1
ggccggggcccgcgcgcugaug

SEQ ID NO: 430644 - RNA, 22 nt, Human herpesvirus 1
ggccgcuguucgagggccagga

SEQ ID NO: 430645 - RNA, 22 nt, Human herpesvirus 1
ggccuuguuugucuggcggauc

SEQ ID NO: 430646 - RNA, 22 nt, Human herpesvirus 1
ggcagggcguuguucuggucaa

SEQ ID NO: 430647 - RNA, 22 nt, Human herpesvirus 1
ggcccagacgccguacccggug

SEQ ID NO: 430648 - RNA, 22 nt, Human herpesvirus 1
ggcccccguucgccgccugggu

SEQ ID NO: 430649 - RNA, 22 nt, Human herpesvirus 1
ggcccgguuggcggcgacgcuu

SEQ ID NO: 430650 - RNA, 22 nt, Human herpesvirus 1
aaacgcgagcugcacgcggggc

SEQ ID NO: 430651 - RNA, 22 nt, Human herpesvirus 1
gcgccacggccuccgcguucuc

SEQ ID NO: 430652 - RNA, 22 nt, Human herpesvirus 1
gcgcccgaggccucgaaccggc

SEQ ID NO: 430653 - RNA, 22 nt, Human herpesvirus 1
gcgcagacugucgacggccccc

SEQ ID NO: 430654 - RNA, 21 nt, Human herpesvirus 1
gcgacaccuucccgugcaugc

SEQ ID NO: 430655 - RNA, 22 nt, Human herpesvirus 1
gcgcgugguccccggggacgug

SEQ ID NO: 430656 - RNA, 22 nt, Human herpesvirus 1
gcgcuguggccucccguuccgg

SEQ ID NO: 430657 - RNA, 22 nt, Human herpesvirus 1
gcgggccugucguguagauucg

SEQ ID NO: 430658 - RNA, 22 nt, Human herpesvirus 1
gcggggcccccgcuuccggaug

SEQ ID NO: 430659 - RNA, 22 nt, Human herpesvirus 1
uguaggcgaugcgggucccccg

SEQ ID NO: 430660 - RNA, 14 nt, Human herpesvirus 1
uggugcgauggcga

SEQ ID NO: 430661 - RNA, 22 nt, Human herpesvirus 1
uggggaccacgcccccaacacg

SEQ ID NO: 430662 - RNA, 22 nt, Human herpesvirus 1
ugggggugugcguucgaugcgg

SEQ ID NO: 430663 - RNA, 22 nt, Human herpesvirus 1
uggguuccgggagcaggcgugg

SEQ ID NO: 430664 - RNA, 22 nt, Human herpesvirus 1
uggguuuggcgcgcguaugcgu

SEQ ID NO: 430665 - RNA, 22 nt, Human herpesvirus 1
uggucccgacgccaacccaggc

SEQ ID NO: 430666 - RNA, 20 nt, Human herpesvirus 1
uguggugccgccugugauac

SEQ ID NO: 430667 - RNA, 20 nt, Human herpesvirus 1
ugugucgcagggcggcccgc

SEQ ID NO: 430668 - RNA, 22 nt, Human herpesvirus 1
uguggccucaccugaccaaccu

SEQ ID NO: 430669 - RNA, 22 nt, Human herpesvirus 1
cagaggggcgagguccguuucg

SEQ ID NO: 430670 - RNA, 22 nt, Human herpesvirus 1
ccaacccuggguggucgcggaa

SEQ ID NO: 430671 - RNA, 22 nt, Human herpesvirus 1
caucgggccagauucacgcuuc

SEQ ID NO: 430672 - RNA, 22 nt, Human herpesvirus 1
cagcggccggccggcgcuuagg

SEQ ID NO: 430673 - RNA, 22 nt, Human herpesvirus 1
caguuuggugggauuugcggcg

SEQ ID NO: 430674 - RNA, 22 nt, Human herpesvirus 1
uggccgucgagugccuggccgc

SEQ ID NO: 430675 - RNA, 22 nt, Human herpesvirus 1
uggccgucuuugacgagccgcc

SEQ ID NO: 430676 - RNA, 22 nt, Human herpesvirus 1
ccacaacauggagcauacgcuc

SEQ ID NO: 430677 - RNA, 22 nt, Human herpesvirus 1
ccacgggccgcagcggcaccgu

SEQ ID NO: 430678 - RNA, 22 nt, Human herpesvirus 1
uggcgcacccggacguggggcg

SEQ ID NO: 430679 - RNA, 22 nt, Human herpesvirus 1
uacugggcguggugauggacga

SEQ ID NO: 430680 - RNA, 22 nt, Human herpesvirus 1
uagcauaucacauaccccguuc

SEQ ID NO: 430681 - RNA, 18 nt, Human herpesvirus 1
uacucgcgagcgcggggg

SEQ ID NO: 430682 - RNA, 22 nt, Human herpesvirus 1
guucccccggcacgccuggggu

SEQ ID NO: 430683 - RNA, 22 nt, Human herpesvirus 1
guucggacggcaggcacacgua

SEQ ID NO: 430684 - RNA, 22 nt, Human herpesvirus 1
gugccgggcgcgugcgacggug

SEQ ID NO: 430685 - RNA, 23 nt, Human herpesvirus 1
guggaccugggaccgcgccgccc

SEQ ID NO: 430686 - RNA, 16 nt, Human herpesvirus 1
guggugcccggggcug

SEQ ID NO: 430687 - RNA, 22 nt, Human herpesvirus 1
gugggggaguuugagacggccg

SEQ ID NO: 430688 - RNA, 22 nt, Human herpesvirus 1
gucccgccgaacgcauacaugc

SEQ ID NO: 430689 - RNA, 22 nt, Human herpesvirus 1
gucucggggucagccucgagcu

SEQ ID NO: 430690 - RNA, 22 nt, Human herpesvirus 1
gucucguccguccggcaucuuc

SEQ ID NO: 430691 - RNA, 19 nt, Human herpesvirus 1
gucgacguagggggcgcgg

SEQ ID NO: 430692 - RNA, 22 nt, Human herpesvirus 1
gucgcggcguccuggaucgacg

SEQ ID NO: 430693 - RNA, 22 nt, Human herpesvirus 1
gucgcucgguauucgaggccac

SEQ ID NO: 430694 - RNA, 22 nt, Human herpesvirus 1
ccucgagacggccgccagcgcu

SEQ ID NO: 430695 - RNA, 22 nt, Human herpesvirus 1
ccgucccgggccuucgcggcca

SEQ ID NO: 430696 - RNA, 22 nt, Human herpesvirus 1
ccguccgccuucuccgugacau

SEQ ID NO: 430697 - RNA, 22 nt, Human herpesvirus 1
uugccgucgucguccucguccu

SEQ ID NO: 430698 - RNA, 22 nt, Human herpesvirus 1
uuggucaggugaggccacagcg

SEQ ID NO: 430699 - RNA, 22 nt, Human herpesvirus 1
uuggugccgguggggcguaccg

SEQ ID NO: 430700 - RNA, 22 nt, Human herpesvirus 1
cccaugcggcguuggaugagcu

SEQ ID NO: 430701 - RNA, 22 nt, Human herpesvirus 1
ccccagcgugcaggcugcggcc

SEQ ID NO: 430702 - RNA, 22 nt, Human herpesvirus 1
ccccaugggcgguggaggaguu

SEQ ID NO: 430703 - RNA, 22 nt, Human herpesvirus 1
cccccgagucggacccggaggc

SEQ ID NO: 430704 - RNA, 22 nt, Human herpesvirus 1
ccccgagccacgccagaaccuu

SEQ ID NO: 430705 - RNA, 22 nt, Human herpesvirus 1
ccggagagcggcuuggugcgga

SEQ ID NO: 430706 - RNA, 22 nt, Human herpesvirus 1
ccggagguuccggaggcgccgc

SEQ ID NO: 430707 - RNA, 22 nt, Human herpesvirus 1
ccggaucgagguaccgucggug

SEQ ID NO: 430708 - RNA, 22 nt, Human herpesvirus 1
ccggccuggccgcccugugucu

SEQ ID NO: 430709 - RNA, 22 nt, Human herpesvirus 1
ccgcgugggccccgcuggcguu

SEQ ID NO: 430710 - RNA, 22 nt, Human herpesvirus 1
ccgggcaugaaaacgaccucca

SEQ ID NO: 430711 - RNA, 22 nt, Human herpesvirus 1
ccgccgcuugaucauuaucacc

SEQ ID NO: 430712 - RNA, 22 nt, Human herpesvirus 1
cccgcgagucggagcuggagcu

SEQ ID NO: 430713 - RNA, 22 nt, Human herpesvirus 1
cccgcgcgucgacgggacccag

SEQ ID NO: 430714 - RNA, 22 nt, Human herpesvirus 1
auaauuuuauuggugggucguu

SEQ ID NO: 430715 - RNA, 22 nt, Human herpesvirus 1
agguggcgcacccggacguggg

SEQ ID NO: 430716 - RNA, 22 nt, Human herpesvirus 1
ugaucgggguacuucgccgccg

SEQ ID NO: 430717 - RNA, 22 nt, Human herpesvirus 1
ugacgacagcuuuguaaagacu

SEQ ID NO: 430718 - RNA, 23 nt, Human herpesvirus 1
ucccgaggcgucgcugccggccc

SEQ ID NO: 430719 - RNA, 22 nt, Human herpesvirus 1
uccgcggaagacccaggccgcc

SEQ ID NO: 430720 - RNA, 22 nt, Human herpesvirus 1
ucugucucgccaggggcuggcc

SEQ ID NO: 430721 - RNA, 22 nt, Human herpesvirus 1
ucucggcgggggccgucuggcc

SEQ ID NO: 430722 - RNA, 22 nt, Human herpesvirus 1
ucucgucgacaaacagggggaa

SEQ ID NO: 430723 - RNA, 22 nt, Human herpesvirus 1
gaucggugggcccgccgcggcc

SEQ ID NO: 430724 - RNA, 22 nt, Human herpesvirus 1
gagugccagcccugggaccgaa

SEQ ID NO: 430725 - RNA, 22 nt, Human herpesvirus 1
gaugugcgucgcguuguaccug

SEQ ID NO: 430726 - RNA, 22 nt, Human herpesvirus 1
cggggugaaugagcugggcggc

SEQ ID NO: 430727 - RNA, 22 nt, Human herpesvirus 1
cgguuccgcgguaccccgaguc

SEQ ID NO: 430728 - RNA, 22 nt, Human herpesvirus 1
cgucccccgacgaccucuugca

SEQ ID NO: 430729 - RNA, 23 nt, Human herpesvirus 1
cgucgacucuaucgcgcgugccg

SEQ ID NO: 430730 - RNA, 22 nt, Human herpesvirus 1
cgucgagcguaccgacgggcgg

SEQ ID NO: 430731 - RNA, 22 nt, Human herpesvirus 1
cgucgccugcacaggaaggacc

SEQ ID NO: 430732 - RNA, 18 nt, Human herpesvirus 1
cgugacgggcggggcguc

SEQ ID NO: 430733 - RNA, 22 nt, Human herpesvirus 1
cguggagucgaaggccagcgcc

SEQ ID NO: 430734 - RNA, 22 nt, Human herpesvirus 1
gacgucgacucuaucgcgcgca

SEQ ID NO: 430735 - RNA, 22 nt, Human herpesvirus 1
cgcgcgccaauggggucgggaa

SEQ ID NO: 430736 - RNA, 22 nt, Human herpesvirus 1
cgcggccggggccucgaugugg

SEQ ID NO: 430737 - RNA, 22 nt, Human herpesvirus 1
cggacgucuucggaggccccgc

SEQ ID NO: 430738 - RNA, 20 nt, Human herpesvirus 1
cgcggggugguuccgucacg

SEQ ID NO: 430739 - RNA, 22 nt, Human herpesvirus 1
cgcucacgcgcaugcccgccac

SEQ ID NO: 430740 - RNA, 22 nt, Human herpesvirus 1
cggugcagcggacuggcaccga

SEQ ID NO: 430741 - RNA, 23 nt, Human herpesvirus 1
cgguccauggcgucgcgggcguc

SEQ ID NO: 430742 - RNA, 17 nt, Human herpesvirus 1
cggccggccgccauggc

SEQ ID NO: 430743 - RNA, 23 nt, Human herpesvirus 1
cggccggccgccauggcguagcc

SEQ ID NO: 430744 - RNA, 22 nt, Human herpesvirus 1
cggaacagcaucguaccggggc

SEQ ID NO: 430745 - RNA, 20 nt, Human herpesvirus 1
uggccgucaggagcucggcg

SEQ ID NO: 430746 - RNA, 23 nt, Human herpesvirus 1
uggccgucaggagcucggcgcag

SEQ ID NO: 430747 - RNA, 18 nt, Human herpesvirus 1
ugcuugccugucaaacuc

SEQ ID NO: 430748 - RNA, 22 nt, Human herpesvirus 1
uggacaggcucuggagcauccg

SEQ ID NO: 430749 - RNA, 20 nt, Human herpesvirus 1
ugcgucgcccgcgucuggac

SEQ ID NO: 430750 - RNA, 22 nt, Human herpesvirus 1
ugccccccggccucgucgaggu

SEQ ID NO: 430751 - RNA, 22 nt, Human herpesvirus 1
ugcccgggacccacguggcggc

SEQ ID NO: 430752 - RNA, 22 nt, Human herpesvirus 1
ugccggacacccaggggcgauu

SEQ ID NO: 430753 - RNA, 22 nt, Human herpesvirus 1
ugcgcaggugcaugccccaggu

SEQ ID NO: 430754 - RNA, 19 nt, Human herpesvirus 1
acgcaggcgcccccggcga

SEQ ID NO: 430755 - RNA, 22 nt, Human herpesvirus 1
acgccgccaucgcgcccuuucg

SEQ ID NO: 430756 - RNA, 22 nt, Human herpesvirus 1
acgcgcgauagagucgacgacc

SEQ ID NO: 430757 - RNA, 22 nt, Human herpesvirus 1
ugcaggucguacguggcccccg

SEQ ID NO: 430758 - RNA, 22 nt, Human herpesvirus 1
acccaggcggcgaacgggggcc

SEQ ID NO: 430759 - RNA, 22 nt, Human herpesvirus 1
accccaggcgugccgggggaac

SEQ ID NO: 430760 - RNA, 22 nt, Human herpesvirus 1
accgggucucgagguaucgguu

SEQ ID NO: 430761 - RNA, 22 nt, Human herpesvirus 1
acacgcgggacaucgcgcagcg

SEQ ID NO: 430762 - RNA, 22 nt, Human herpesvirus 1
aaugcgcgcgauagagucgacg

SEQ ID NO: 430763 - RNA, 22 nt, Human
uggcaggguuggccaccuuacc

SEQ ID NO: 430764 - RNA, 22 nt, Human
ggcagucaagagggagucugaa

SEQ ID NO: 430765 - RNA, 22 nt, Human
aggcagccagauggcagccugc

SEQ ID NO: 430766 - RNA, 22 nt, Human
uucacaugaaaguaggaaagga

SEQ ID NO: 430767 - RNA, 22 nt, Human
uggcagaguucgcugugccuuu

SEQ ID NO: 430768 - RNA, 22 nt, Human
ggcagacacaaaaacauaaggu

SEQ ID NO: 430769 - RNA, 22 nt, Human
aaacugcacaugaggcuggugc

SEQ ID NO: 430770 - RNA, 22 nt, Human
aucagcugaaaaacaggcagca

SEQ ID NO: 430771 - RNA, 22 nt, Human
cccuucuuuguaauaaagauua

SEQ ID NO: 430772 - RNA, 22 nt, Human
gaguagaaggaaguuaucuacc

SEQ ID NO: 430773 - RNA, 22 nt, Human
ggagcugggacccugucaucug

SEQ ID NO: 430774 - RNA, 22 nt, Human
aguguccccuacagaggcauuc

SEQ ID NO: 430775 - RNA, 22 nt, Human
aggcuugguuuauagaaguaau

SEQ ID NO: 430776 - RNA, 22 nt, Human
acacaaugucaucauaauguca

SEQ ID NO: 430777 - RNA, 22 nt, Human
uugcagcugcuguuccucaugg

SEQ ID NO: 430778 - RNA, 22 nt, Human
aacaaguuguugaaaauaauua

SEQ ID NO: 430779 - RNA, 22 nt, Human
gacagcaggagaucaugauaga

SEQ ID NO: 430780 - RNA, 22 nt, Human
guuuacaaauauuuuaaauggu

SEQ ID NO: 430781 - RNA, 22 nt, Human
aggaaacaacuuggcaugagcc

SEQ ID NO: 430782 - RNA, 22 nt, Human
aagcaggcccugggccagggga

SEQ ID NO: 430783 - RNA, 22 nt, Human
cuggggagaagcgacucggcug

SEQ ID NO: 430784 - RNA, 22 nt, Human
ugcagcugaggccagcuaugcc

SEQ ID NO: 430785 - RNA, 22 nt, Human
aaggcacacaguuagauagagc

SEQ ID NO: 430786 - RNA, 22 nt, Human
uaagacaaauacuauuucaaga

SEQ ID NO: 430787 - RNA, 22 nt, Human
uaggccaggacagagcuuccag

SEQ ID NO: 430788 - RNA, 21 nt, Human
caagacauaugaguacucugg

SEQ ID NO: 430789 - RNA, 19 nt, Human
ccucuuccucugacacuau

SEQ ID NO: 430790 - RNA, 22 nt, Human
ccugaagcucuuaagaccuuua

SEQ ID NO: 430791 - RNA, 22 nt, Human
aggcagagcugauguucuguga

SEQ ID NO: 430792 - RNA, 22 nt, Human
ugacagcugccacaaaggccau

SEQ ID NO: 430793 - RNA, 22 nt, Human
uugcauuucacuuucaguaggc

SEQ ID NO: 430794 - RNA, 22 nt, Human
uaacacagacagccacuaguaa

SEQ ID NO: 430795 - RNA, 22 nt, Human
gcagcugcaggcaggcuugcug

SEQ ID NO: 430796 - RNA, 22 nt, Human
cugccuguuuucugauagauuu

SEQ ID NO: 430797 - RNA, 22 nt, Human
ggcuagggaucuagaccaggac

SEQ ID NO: 430798 - RNA, 22 nt, Human
gaaugcaugugaagcaaagaau

SEQ ID NO: 430799 - RNA, 22 nt, Human
cuggcucccguuguccuugaag

SEQ ID NO: 430800 - RNA, 22 nt, Human
agaagcaguuauuuuuugcaca

SEQ ID NO: 430801 - RNA, 22 nt, Human
agggagcccugaaccagagggu

SEQ ID NO: 430802 - RNA, 22 nt, Human
cccuggaggucagaggccuggg

SEQ ID NO: 430803 - RNA, 22 nt, Human
ggcagcugaccuagcaccaucc

SEQ ID NO: 430804 - RNA, 22 nt, Human
gaggcugggaaguccaagacca

SEQ ID NO: 430805 - RNA, 22 nt, Human
ugcaaacaguuaagaugcaggc

SEQ ID NO: 430806 - RNA, 22 nt, Human
cuguguccugcgucaagccaau

SEQ ID NO: 430807 - RNA, 23 nt, Human
agacucugagagugugcuuugca

SEQ ID NO: 430808 - RNA, 22 nt, Human
aauagauggguuaaacagcaaa

SEQ ID NO: 430809 - RNA, 19 nt, Human
ggcaggcuggauagagagg

SEQ ID NO: 430810 - RNA, 22 nt, Human
agagacuguguccaucgugccu

SEQ ID NO: 430811 - RNA, 22 nt, Human
cacaguacccagcacuacugag

SEQ ID NO: 430812 - RNA, 20 nt, Human
uuugagaccagucugcccaa

SEQ ID NO: 430813 - RNA, 22 nt, Human
cucagggagagccaagaguucc

SEQ ID NO: 430814 - RNA, 22 nt, Human
uucauuacugaauucucacuac

SEQ ID NO: 430815 - RNA, 22 nt, Human
cugcagccuccugggguacaug

SEQ ID NO: 430816 - RNA, 17 nt, Human
acagggcagaaacagcu

SEQ ID NO: 430817 - RNA, 22 nt, Human
cacauuuagguuccuauagcca

SEQ ID NO: 430818 - RNA, 22 nt, Human
acaggacugugauccaguaacc

SEQ ID NO: 430819 - RNA, 22 nt, Human
augcuuuaaaacguauguguaa

SEQ ID NO: 430820 - RNA, 19 nt, Human
acuuucuccaggaccuguu

SEQ ID NO: 430821 - RNA, 22 nt, Human
agaggaugguugaggaagaccu

SEQ ID NO: 430822 - RNA, 20 nt, Human
cagagccaagagcagcaucu

SEQ ID NO: 430823 - RNA, 22 nt, Human
gugaagaugccucaggugaccc

SEQ ID NO: 430824 - RNA, 22 nt, Human
cuggaagggucuacuuagcaga

SEQ ID NO: 430825 - RNA, 22 nt, Human
gccggggcuggggagagacaug

SEQ ID NO: 430826 - RNA, 22 nt, Human
ucaacuuuaguguagcuauuua

SEQ ID NO: 430827 - RNA, 21 nt, Human
agagcugggacuugccugaga

SEQ ID NO: 430828 - RNA, 22 nt, Human
ccucugagaacaccuggcgucc

SEQ ID NO: 430829 - RNA, 22 nt, Human
gcccucuggugggugagccccg

SEQ ID NO: 430830 - RNA, 22 nt, Human
cucccuggaggcccagaccugg

SEQ ID NO: 430831 - RNA, 22 nt, Human
aggaggccgauuucagaggucg

SEQ ID NO: 430832 - RNA, 22 nt, Human
aaauaagaaauucuucuuugca

SEQ ID NO: 430833 - RNA, 22 nt, Human
caauaugcaagcuauuaaguau

SEQ ID NO: 430834 - RNA, 22 nt, Human
ucaggccugcuguaugauggau

SEQ ID NO: 430835 - RNA, 22 nt, Human
aaguccugugugcuuacacuug

SEQ ID NO: 430836 - RNA, 20 nt, Human
ggcaccaggcuaggauugga

SEQ ID NO: 430837 - RNA, 22 nt, Human
gcacaaguuucuucauuguuca

SEQ ID NO: 430838 - RNA, 22 nt, Human
auucucuuuguauaacaucuug

SEQ ID NO: 430839 - RNA, 22 nt, Human
uugauacaggccuucuagauga

SEQ ID NO: 430840 - RNA, 22 nt, Human
ugcaucauauaaugucuaugga

SEQ ID NO: 430841 - RNA, 22 nt, Human
gcggggggaggaacaucuugca

SEQ ID NO: 430842 - RNA, 22 nt, Human
ugguaauugagaugucuuuucu

SEQ ID NO: 430843 - RNA, 22 nt, Human
cuuggcugucuauaggaaagag

SEQ ID NO: 430844 - RNA, 22 nt, Human
aauaugcacucugauuuagcag

SEQ ID NO: 430845 - RNA, 19 nt, Human
aguuuauuauaggugauuc

SEQ ID NO: 430846 - RNA, 22 nt, Human
uccaacuuucuccuccggcuug

SEQ ID NO: 430847 - RNA, 22 nt, Human
aacacuuuuuccuccugucugg

SEQ ID NO: 430848 - RNA, 23 nt, Human
agcugggaauuuucugaagcuuu

SEQ ID NO: 430849 - RNA, 22 nt, Human
ucaggaaauacaagugacauca

SEQ ID NO: 430850 - RNA, 22 nt, Human
ggucccagguugacagggagac

SEQ ID NO: 430851 - RNA, 22 nt, Human
ugagacaggagaggccccuccu

SEQ ID NO: 430852 - RNA, 22 nt, Human
ugauuguuuccuauguacaccu

SEQ ID NO: 430853 - RNA, 22 nt, Human
ccagcagcugcaaagccugggu

SEQ ID NO: 430854 - RNA, 22 nt, Human
aaaugcauugguuucuacuugu

SEQ ID NO: 430855 - RNA, 22 nt, Human
agacagcauuucuagcaccagg

SEQ ID NO: 430856 - RNA, 22 nt, Human
uucucacaggaaguaggacuuu

SEQ ID NO: 430857 - RNA, 22 nt, Human
ucagugucuugggcuugaaugc

SEQ ID NO: 430858 - RNA, 22 nt, Human
ccugggaggcuguuuccagccu

SEQ ID NO: 430859 - RNA, 22 nt, Human
cacagcagagggagccauugaa

SEQ ID NO: 430860 - RNA, 22 nt, Human
acaggacuguggaaggaucucu

SEQ ID NO: 430861 - RNA, 22 nt, Human
ugucaguuuggcucuaaaguuu

SEQ ID NO: 430862 - RNA, 22 nt, Human
gcugagcugaggcagggcuggg

SEQ ID NO: 430863 - RNA, 22 nt, Human
gcucccugaaaagaacaaaguc

SEQ ID NO: 430864 - RNA, 22 nt, Human
gcuuugcuagcacugcgcuucc

SEQ ID NO: 430865 - RNA, 23 nt, Human
uaggccagggugaccuggggaga

SEQ ID NO: 430866 - RNA, 22 nt, Human
auggaagugcaacuugcucauc

SEQ ID NO: 430867 - RNA, 19 nt, Human
ugaagcagcaaacucucag

SEQ ID NO: 430868 - RNA, 23 nt, Human
aggcaggcaguucagcuguuguu

SEQ ID NO: 430869 - RNA, 22 nt, Human
aucacaguggcagggauuuggg

SEQ ID NO: 430870 - RNA, 22 nt, Human
uggaagaugaauaaagauucua

SEQ ID NO: 430871 - RNA, 23 nt, Human
uggucccugagagcuggggaggg

SEQ ID NO: 430872 - RNA, 19 nt, Human
cgccuggcaggcccugcgc

SEQ ID NO: 430873 - RNA, 22 nt, Human
aagcacaugagcuauucaugcu

SEQ ID NO: 430874 - RNA, 23 nt, Human
ggcucugugcugggccugcagga

SEQ ID NO: 430875 - RNA, 22 nt, Human
uuggaaggauuuagagaugucu

SEQ ID NO: 430876 - RNA, 20 nt, Human
ugcccagcaagagugcaguu

SEQ ID NO: 430877 - RNA, 22 nt, Human
acacagaguauuuagaaggggu

SEQ ID NO: 430878 - RNA, 22 nt, Human
ucuuugcaugugcuucuuggcc

SEQ ID NO: 430879 - RNA, 22 nt, Human
agcagcagauucagcaggaaug

SEQ ID NO: 430880 - RNA, 22 nt, Human
gccugagaaggacacagcaggu

SEQ ID NO: 430881 - RNA, 22 nt, Human
cagcauggggaucacuguaggc

SEQ ID NO: 430882 - RNA, 22 nt, Human
uccagccaugcaugacaaucac

SEQ ID NO: 430883 - RNA, 21 nt, Human
gauuuuaaagagacugccaca

SEQ ID NO: 430884 - RNA, 22 nt, Human
guguccacggcugagaaugauu

SEQ ID NO: 430885 - RNA, 22 nt, Human
gcuaauacuuuggaaagaaugu

SEQ ID NO: 430886 - RNA, 22 nt, Human
aagggcaggcagagaucauaua

SEQ ID NO: 430887 - RNA, 22 nt, Human
ugagaaggaaacaauggcuuuu

SEQ ID NO: 430888 - RNA, 22 nt, Human
uuugggcauguuguggccagcu

SEQ ID NO: 430889 - RNA, 22 nt, Human
uccagcaguccaugugagacac

SEQ ID NO: 430890 - RNA, 22 nt, Human
uuguacaaguuuugagcuuaag

SEQ ID NO: 430891 - RNA, 22 nt, Human
ggcucuucuguggcagccaagg

SEQ ID NO: 430892 - RNA, 21 nt, Human
acagacagggccagugucccc

SEQ ID NO: 430893 - RNA, 22 nt, Human
aaggcccacagaacugucucca

SEQ ID NO: 430894 - RNA, 20 nt, Human
agcagcagauguuggaggug

SEQ ID NO: 430895 - RNA, 22 nt, Human
aguggcagagaccccagccagc

SEQ ID NO: 430896 - RNA, 22 nt, Human
ugaaacagucuccagacuugga

SEQ ID NO: 430897 - RNA, 22 nt, Human
uucuucuuuccuauaauuaauu

SEQ ID NO: 430898 - RNA, 22 nt, Human
caaggaaaaagcgagcucgggg

SEQ ID NO: 430899 - RNA, 22 nt, Human
caggccagugugcuucccaggc

SEQ ID NO: 430900 - RNA, 22 nt, Human
caaggcugagaaauucugcccu

SEQ ID NO: 430901 - RNA, 22 nt, Human
cauuuaaugcacggauguagcc

SEQ ID NO: 430902 - RNA, 19 nt, Human
uucagaauugggaggugau

SEQ ID NO: 430903 - RNA, 22 nt, Human
ucucauuuggcuuuguuuuaaa

SEQ ID NO: 430904 - RNA, 22 nt, Human
gcugcauugcuauaaaauacaa

SEQ ID NO: 430905 - RNA, 22 nt, Human
agcaacaggaaauagcugauua

SEQ ID NO: 430906 - RNA, 22 nt, Human
ccuuuucuauccuucuagguuc

SEQ ID NO: 430907 - RNA, 22 nt, Human
guucacaauggcuuuaccuaag

SEQ ID NO: 430908 - RNA, 22 nt, Human
gcugagagcacauagaaggggc

SEQ ID NO: 430909 - RNA, 22 nt, Human
cagccugagccuucuguagcaa

SEQ ID NO: 430910 - RNA, 22 nt, Human
cuggcuccaucuuugcuuccug

SEQ ID NO: 430911 - RNA, 22 nt, Human
ugaaaagugaucauggauuagg

SEQ ID NO: 430912 - RNA, 22 nt, Human
ugggggcugugcacaggcucac

SEQ ID NO: 430913 - RNA, 22 nt, Human
cccuggcagaagguguagaagc

SEQ ID NO: 430914 - RNA, 22 nt, Human
uggcagcuuuuuguuucaggcu

SEQ ID NO: 430915 - RNA, 22 nt, Human
ggcaggugcucugugggccugg

SEQ ID NO: 430916 - RNA, 22 nt, Human
uggcuccucaucacaguuggug

SEQ ID NO: 430917 - RNA, 22 nt, Human
cagagggcuguguaaggauguu

SEQ ID NO: 430918 - RNA, 22 nt, Human
uucuugauuagucucaugccaa

SEQ ID NO: 430919 - RNA, 22 nt, Human
aauguauucugggaaaauguua

SEQ ID NO: 430920 - RNA, 22 nt, Human
uggugagaccuuguuccuuaug

SEQ ID NO: 430921 - RNA, 22 nt, Human
uuccugaauauaaagacacuag

SEQ ID NO: 430922 - RNA, 23 nt, Human
agaggggagcaucugcuggcuga

SEQ ID NO: 430923 - RNA, 23 nt, Human
uucaaagaucuucugaaaucugu

SEQ ID NO: 430924 - RNA, 22 nt, Human
gaugauuugaggauuucaugag

SEQ ID NO: 430925 - RNA, 22 nt, Human
ugcaggcuuuagccccauggcu

SEQ ID NO: 430926 - RNA, 22 nt, Human
uuuucuccuuucaagauagcau

SEQ ID NO: 430927 - RNA, 23 nt, Human
ccuccugggcacaggccugaugg

SEQ ID NO: 430928 - RNA, 22 nt, Human
cuuagcagaagcuucagcuuca

SEQ ID NO: 430929 - RNA, 23 nt, Human
ugauucagcaaguccacuucugg

SEQ ID NO: 430930 - RNA, 22 nt, Human
ccugugucuuccccacuggugu

SEQ ID NO: 430931 - RNA, 22 nt, Human
gaggcaggguguugauuacaga

SEQ ID NO: 430932 - RNA, 22 nt, Human
cugcagcuccuucuggcaugug

SEQ ID NO: 430933 - RNA, 22 nt, Human
gcuccaggugucccagguaaaa

SEQ ID NO: 430934 - RNA, 22 nt, Human
cuaaagacacaauaaguagcuu

SEQ ID NO: 430935 - RNA, 22 nt, Human
ugucccucauugacgcugugcc

SEQ ID NO: 430936 - RNA, 22 nt, Human
ugcauguuugugucugagaacu

SEQ ID NO: 430937 - RNA, 19 nt, Human
caugugcaugagcacagga

SEQ ID NO: 430938 - RNA, 22 nt, Human
ugcccuggugaagugcucuccu

SEQ ID NO: 430939 - RNA, 22 nt, Human
aggccuggccccaguugcuagg

SEQ ID NO: 430940 - RNA, 22 nt, Human
caguccugucuuuaugacuuca

SEQ ID NO: 430941 - RNA, 22 nt, Human
acagggccauuggaggauuaua

SEQ ID NO: 430942 - RNA, 22 nt, Human
gcugguccacauccugguacgu

SEQ ID NO: 430943 - RNA, 22 nt, Human
agagggagugaaauggaauaga

SEQ ID NO: 430944 - RNA, 22 nt, Human
uauugcuuauucuugagaguca

SEQ ID NO: 430945 - RNA, 22 nt, Human
acuuagcaaaucuuuuggauuc

SEQ ID NO: 430946 - RNA, 19 nt, Human
auuugaaagcugugcuugc

SEQ ID NO: 430947 - RNA, 22 nt, Human
aggcuggagacccgccaagaaa

SEQ ID NO: 430948 - RNA, 22 nt, Human
uacaagagguauauagaaacag

SEQ ID NO: 430949 - RNA, 20 nt, Human
gcuuagcaggcauaguagcu

SEQ ID NO: 430950 - RNA, 19 nt, Human
gcacugaagaguuggucac

SEQ ID NO: 430951 - RNA, 22 nt, Human
acacaguaccccaaggcugggc

SEQ ID NO: 430952 - RNA, 22 nt, Human
aaacuucaaggauuugcaaauc

SEQ ID NO: 430953 - RNA, 22 nt, Human
agggcagagagaugaaugggau

SEQ ID NO: 430954 - RNA, 22 nt, Human
auaauaucgcuccuuuuuuuga

SEQ ID NO: 430955 - RNA, 22 nt, Human
uauaggaauaaagugggguaua

SEQ ID NO: 430956 - RNA, 22 nt, Human
aggcugagaaagugggaagaug

SEQ ID NO: 430957 - RNA, 19 nt, Human
agccagaguggcccagggg

SEQ ID NO: 430958 - RNA, 22 nt, Human
ccucugaggucauggacuuggc

SEQ ID NO: 430959 - RNA, 22 nt, Human
ccaggaaauggcuugcuucuuu

SEQ ID NO: 430960 - RNA, 22 nt, Human
ccugagggaaggaugcuaccca

SEQ ID NO: 430961 - RNA, 22 nt, Human
auugaauagaugcauuauacua

SEQ ID NO: 430962 - RNA, 22 nt, Human
cuguaaauaugaagaauauaug

SEQ ID NO: 430963 - RNA, 22 nt, Human
accacugggcgggcagccugcu

SEQ ID NO: 430964 - RNA, 22 nt, Human
guggccagcaagugcugccucu

SEQ ID NO: 430965 - RNA, 22 nt, Human
guauuuucaagagcaguaguau

SEQ ID NO: 430966 - RNA, 22 nt, Human
gcugcuuuagaauugaaacaga

SEQ ID NO: 430967 - RNA, 22 nt, Human
ggaagagagggcugggccucaa

SEQ ID NO: 430968 - RNA, 22 nt, Human
uggcccugacacgugguacugg

SEQ ID NO: 430969 - RNA, 22 nt, Human
uggcagauaaaauaauagggaa

SEQ ID NO: 430970 - RNA, 21 nt, Human
ggccuuccccugcagucuccg

SEQ ID NO: 430971 - RNA, 22 nt, Human
ggcagcuguggacgucgucauu

SEQ ID NO: 430972 - RNA, 20 nt, Human
caagcccucuuuagccugcc

SEQ ID NO: 430973 - RNA, 22 nt, Human
gaagcuaaaagagaugugguuu

SEQ ID NO: 430974 - RNA, 22 nt, Human
cugguacagggaaauaaaggaa

SEQ ID NO: 430975 - RNA, 22 nt, Human
acagaacuuucugauccugagc

SEQ ID NO: 430976 - RNA, 22 nt, Human
auauuaaugagcaaguaaguga

SEQ ID NO: 430977 - RNA, 22 nt, Human
agcuccuugaagggcucuggga

SEQ ID NO: 430978 - RNA, 22 nt, Human
agguccugggaguucuagugug

SEQ ID NO: 430979 - RNA, 22 nt, Human
ugaauaauuccuuuuugucaag

SEQ ID NO: 430980 - RNA, 22 nt, Human
gauuuauaaagguugcacugga

SEQ ID NO: 430981 - RNA, 22 nt, Human
cacuuugccucuuaccuguggu

SEQ ID NO: 430982 - RNA, 22 nt, Human
gcuggucccaauguguuuccuu

SEQ ID NO: 430983 - RNA, 22 nt, Human
ccucagcugcuucccuggagcc

SEQ ID NO: 430984 - RNA, 22 nt, Human
gccuggaguagcauggcaagcc

SEQ ID NO: 430985 - RNA, 22 nt, Human
ugugugaacauguuuucauuuc

SEQ ID NO: 430986 - RNA, 22 nt, Human
ccugccugcagaaaguaucucc

SEQ ID NO: 430987 - RNA, 22 nt, Human
gaugaugagauaaggauaacuu

SEQ ID NO: 430988 - RNA, 22 nt, Human
cagcaaggccauuggaugcagu

SEQ ID NO: 430989 - RNA, 22 nt, Human
gguaacacaggugcaguuuuaa

SEQ ID NO: 430990 - RNA, 22 nt, Human
aguaccauuacucacuuauuuu

SEQ ID NO: 430991 - RNA, 22 nt, Human
uggcccugcuguaucaucugcu

SEQ ID NO: 430992 - RNA, 22 nt, Human
aaggcugagggcuguaccuggc

SEQ ID NO: 430993 - RNA, 22 nt, Human
ugagccuguggggugacaacca

SEQ ID NO: 430994 - RNA, 22 nt, Human
ccaagaggggcagagggcugca

SEQ ID NO: 430995 - RNA, 22 nt, Human
auucaagaggaacaaugaagau

SEQ ID NO: 430996 - RNA, 22 nt, Human
acuuaaaaagaaucuuuucacg

SEQ ID NO: 430997 - RNA, 22 nt, Human
ugauaugggaaaagggcucgga

SEQ ID NO: 430998 - RNA, 22 nt, Human
uucuugauguaccaacuuggga

SEQ ID NO: 430999 - RNA, 22 nt, Human
auucagaaaguugucauauuug

SEQ ID NO: 431000 - RNA, 22 nt, Human
uccauacuaacagcauuuauca

SEQ ID NO: 431001 - RNA, 22 nt, Human
ccuggaaagaggaaggaagccu

SEQ ID NO: 431002 - RNA, 22 nt, Human
aacagucuuacagaaguagcca

SEQ ID NO: 431003 - RNA, 22 nt, Human
aaaauaguuaacguucagagua

SEQ ID NO: 431004 - RNA, 22 nt, Human
ccaggcagccaagugugugugu

SEQ ID NO: 431005 - RNA, 22 nt, Human
uccugcagaccucagucagguc

SEQ ID NO: 431006 - RNA, 22 nt, Human
acaaaugaaccugaaaucucag

SEQ ID NO: 431007 - RNA, 22 nt, Human
cuguccuguggaccugaggacg

SEQ ID NO: 431008 - RNA, 22 nt, Human
cccucugccugcgcccuggugu

SEQ ID NO: 431009 - RNA, 22 nt, Human
ggccccagcuguggugaauaga

SEQ ID NO: 431010 - RNA, 22 nt, Human
aacacugagaacaauacagagu

SEQ ID NO: 431011 - RNA, 22 nt, Human
cagcucuggguaggaggaaucu

SEQ ID NO: 431012 - RNA, 21 nt, Human
uuuuaacaaggauuucccuag

SEQ ID NO: 431013 - RNA, 22 nt, Human
ugggaggcagaaguugacugga

SEQ ID NO: 431014 - RNA, 22 nt, Human
ccaguacuugcuaccucaauug

SEQ ID NO: 431015 - RNA, 22 nt, Human
caggcaagauccagaggcugcu

SEQ ID NO: 431016 - RNA, 22 nt, Human
caaguauuuuaaggacuagugg

SEQ ID NO: 431017 - RNA, 22 nt, Human
cacauugcagguugagaaggug

SEQ ID NO: 431018 - RNA, 22 nt, Human
agggaagggcagggucuaugca

SEQ ID NO: 431019 - RNA, 22 nt, Human
ggcaggcuggcuuuguuccagg

SEQ ID NO: 431020 - RNA, 22 nt, Human
cugcccaggggagugcugucgg

SEQ ID NO: 431021 - RNA, 22 nt, Human
aacaguacuggacaaggaguca

SEQ ID NO: 431022 - RNA, 22 nt, Human
acauucuauuucaucaugucua

SEQ ID NO: 431023 - RNA, 22 nt, Human
gucaggggccaugggccaagga

SEQ ID NO: 431024 - RNA, 22 nt, Human
aaagagggacaggcgcagacac

SEQ ID NO: 431025 - RNA, 22 nt, Human
augcauauuucuugggcuuacc

SEQ ID NO: 431026 - RNA, 22 nt, Human
ccagucugaggccuggugaggg

SEQ ID NO: 431027 - RNA, 22 nt, Human
uggugagauguauggaggguug

SEQ ID NO: 431028 - RNA, 20 nt, Human
aggaaggagaaucugagcaa

SEQ ID NO: 431029 - RNA, 22 nt, Human
cuggggcccaucgagggcugag

SEQ ID NO: 431030 - RNA, 22 nt, Human
gccuccugaagugcugggauua

SEQ ID NO: 431031 - RNA, 22 nt, Human
ugcagaaggccugacauugcac

SEQ ID NO: 431032 - RNA, 22 nt, Human
ggucccaggagaauaggugcaa

SEQ ID NO: 431033 - RNA, 22 nt, Human
uacccaggagaaacagcagggc

SEQ ID NO: 431034 - RNA, 22 nt, Human
cucacauucacaggacagaagg

SEQ ID NO: 431035 - RNA, 22 nt, Human
gccacaggcacuuaagggcugg

SEQ ID NO: 431036 - RNA, 22 nt, Human
ggccugagcucuggggaggcaa

SEQ ID NO: 431037 - RNA, 22 nt, Human
ggcugcagauagccagccacca

SEQ ID NO: 431038 - RNA, 22 nt, Human
aauucaaagccgcuugggaauc

SEQ ID NO: 431039 - RNA, 22 nt, Human
ccuggcucuagaggccacuccu

SEQ ID NO: 431040 - RNA, 19 nt, Human
agcaccugugagagccugg

SEQ ID NO: 431041 - RNA, 23 nt, Human
auaaauuacuaucucccuagagc

SEQ ID NO: 431042 - RNA, 22 nt, Human
uuuagacacacuuuguauauuu

SEQ ID NO: 431043 - RNA, 22 nt, Human
ccagcagcugacaccaguccca

SEQ ID NO: 431044 - RNA, 17 nt, Human
cucagcagggcucacuu

SEQ ID NO: 431045 - RNA, 22 nt, Human
gcuguuucuuuccuggcacuug

SEQ ID NO: 431046 - RNA, 22 nt, Human
ugccucaggcaccuggcagguu

SEQ ID NO: 431047 - RNA, 22 nt, Human
ugcaggacucaaggguagcagg

SEQ ID NO: 431048 - RNA, 22 nt, Human
gcccauggcagaacugugagca

SEQ ID NO: 431049 - RNA, 22 nt, Human
agucccaguucgguucuuccuc

SEQ ID NO: 431050 - RNA, 22 nt, Human
gaacauuuggauuuguaaauuu

SEQ ID NO: 431051 - RNA, 22 nt, Human
gcucugcuaauauuguaguacc

SEQ ID NO: 431052 - RNA, 22 nt, Human
ccagagcaauucucacagaacu

SEQ ID NO: 431053 - RNA, 22 nt, Human
aauuuccagaucagaugacuca

SEQ ID NO: 431054 - RNA, 18 nt, Human
uucuggcucacucaugcu

SEQ ID NO: 431055 - RNA, 22 nt, Human
ugugaggcuaccugccaggguc

SEQ ID NO: 431056 - RNA, 22 nt, Human
uuaaggcauugauauggugcua

SEQ ID NO: 431057 - RNA, 22 nt, Human
gucccagggagguucagggcuu

SEQ ID NO: 431058 - RNA, 21 nt, Human
agagacagagaaaguaacauu

SEQ ID NO: 431059 - RNA, 22 nt, Human
aaaucucaauuugaauuguagc

SEQ ID NO: 431060 - RNA, 22 nt, Human
ccaggccuuucuucuuggucug

SEQ ID NO: 431061 - RNA, 23 nt, Human
guccuagugcuuggugcccaggc

SEQ ID NO: 431062 - RNA, 22 nt, Human
acagaauuaggagauccucuug

SEQ ID NO: 431063 - RNA, 22 nt, Human
gcacuugucaaauauuauagua

SEQ ID NO: 431064 - RNA, 22 nt, Human
ugcaggacauuaguuaugaauu

SEQ ID NO: 431065 - RNA, 22 nt, Human
ccucuggggugagugggccacu

SEQ ID NO: 431066 - RNA, 22 nt, Human
gaaucacagaggcaaauucuga

SEQ ID NO: 431067 - RNA, 22 nt, Human
cuccaggaccagggcuccugga

SEQ ID NO: 431068 - RNA, 22 nt, Human
ggggcaaagggagagucccuac

SEQ ID NO: 431069 - RNA, 23 nt, Human
uggcagauacaggcaugacuucu

SEQ ID NO: 431070 - RNA, 22 nt, Human
uugcagcuguugcaaagucucu

SEQ ID NO: 431071 - RNA, 22 nt, Human
auuacagaaagcaauauugagu

SEQ ID NO: 431072 - RNA, 22 nt, Human
ugggcaaguaucggacucugag

SEQ ID NO: 431073 - RNA, 22 nt, Human
aaggcaauuucagggcucucua

SEQ ID NO: 431074 - RNA, 22 nt, Human
uaaauucacuccugguagaccu

SEQ ID NO: 431075 - RNA, 22 nt, Human
caaagugagagaauggcagaaa

SEQ ID NO: 431076 - RNA, 22 nt, Human
aaauuauuaugccccucuauaa

SEQ ID NO: 431077 - RNA, 22 nt, Human
agcugccuguccuaggccauca

SEQ ID NO: 431078 - RNA, 22 nt, Human
agccugucugucuccaaagcug

SEQ ID NO: 431079 - RNA, 22 nt, Human
aggccugggucucgugccuacc

SEQ ID NO: 431080 - RNA, 22 nt, Human
gcccugugccagucacgcugug

SEQ ID NO: 431081 - RNA, 22 nt, Human
augggaggaaggaggcccuuga

SEQ ID NO: 431082 - RNA, 22 nt, Human
cagcccugcagccauggccugu

SEQ ID NO: 431083 - RNA, 22 nt, Human
cccugccucugaagcugcucag

SEQ ID NO: 431084 - RNA, 22 nt, Human
caucaagauggaagagcaaaua

SEQ ID NO: 431085 - RNA, 22 nt, Human
gaacauucuugggcaaguuacu

SEQ ID NO: 431086 - RNA, 22 nt, Human
gaacagagcugacuacaaggca

SEQ ID NO: 431087 - RNA, 22 nt, Human
aagcugccaaugguaagcugcu

SEQ ID NO: 431088 - RNA, 22 nt, Human
ugggcagaggacagggaagauc

SEQ ID NO: 431089 - RNA, 22 nt, Human
gccaggcuccccggaucccugg

SEQ ID NO: 431090 - RNA, 22 nt, Human
gggcagcagcaggaggucucug

SEQ ID NO: 431091 - RNA, 21 nt, Human
gcagccagacgggauucaguu

SEQ ID NO: 431092 - RNA, 22 nt, Human
ucccuggguccugcuugcucuc

SEQ ID NO: 431093 - RNA, 22 nt, Human
aggaaggagggcagauauuaag

SEQ ID NO: 431094 - RNA, 22 nt, Human
uuuuccucaccuaacucaaggu

SEQ ID NO: 431095 - RNA, 22 nt, Human
acaugaaaguuauucugaguug

SEQ ID NO: 431096 - RNA, 22 nt, Human
auuaaauuggacgcugggggaa

SEQ ID NO: 431097 - RNA, 23 nt, Human
cugggcuguccugaggucaccuc

SEQ ID NO: 431098 - RNA, 22 nt, Human
cuugggagacacaagaagacau

SEQ ID NO: 431099 - RNA, 22 nt, Human
ccuuugcauucuagauguuuag

SEQ ID NO: 431100 - RNA, 23 nt, Human
auaugucaugcaccagcacuuua

SEQ ID NO: 431101 - RNA, 19 nt, Human
ccugugugggguagagauc

SEQ ID NO: 431102 - RNA, 22 nt, Human
cuccuuccugguuagcaccuua

SEQ ID NO: 431103 - RNA, 22 nt, Human
ucagacaggcuucuuucucccu

SEQ ID NO: 431104 - RNA, 22 nt, Human
uccccuccaacuccaacuaugg

SEQ ID NO: 431105 - RNA, 20 nt, Human
gcauugaguauagacagaug

SEQ ID NO: 431106 - RNA, 22 nt, Human
gccuucuguccaaccccacgau

SEQ ID NO: 431107 - RNA, 22 nt, Human
acagaguacauucagagacuau

SEQ ID NO: 431108 - RNA, 20 nt, Human
ugcucaggauggagaggugu

SEQ ID NO: 431109 - RNA, 22 nt, Human
aagcacagggacuuuaggaaua

SEQ ID NO: 431110 - RNA, 22 nt, Human
uuacagaagaguaacuuggcaa

SEQ ID NO: 431111 - RNA, 22 nt, Human
aggaaggaagagacaccauuug

SEQ ID NO: 431112 - RNA, 22 nt, Human
cuggagagggagcccuggcagu

SEQ ID NO: 431113 - RNA, 21 nt, Human
agaagcuagucacuaaaucca

SEQ ID NO: 431114 - RNA, 22 nt, Human
ucccagaguauuagcaauugcu

SEQ ID NO: 431115 - RNA, 22 nt, Human
ggacaggcugcaucugagcaug

SEQ ID NO: 431116 - RNA, 21 nt, Human
ugucacagauucucagcuugc

SEQ ID NO: 431117 - RNA, 22 nt, Human
cacaugaaggcuggggucguga

SEQ ID NO: 431118 - RNA, 19 nt, Human
ggagaagcccaggaauccu

SEQ ID NO: 431119 - RNA, 22 nt, Human
uggcuccucuucuggguguccc

SEQ ID NO: 431120 - RNA, 22 nt, Human
gaaaugaaauagcaccaagguu

SEQ ID NO: 431121 - RNA, 22 nt, Human
agcuaaugaugagauacagaua

SEQ ID NO: 431122 - RNA, 22 nt, Human
gcuggcuccucuguccucacgg

SEQ ID NO: 431123 - RNA, 22 nt, Human
uaguccugaccagcuggauguu

SEQ ID NO: 431124 - RNA, 22 nt, Human
cugcagugaaaucaggaagcaa

SEQ ID NO: 431125 - RNA, 22 nt, Human
uaguucaccccucuuuauuuuc

SEQ ID NO: 431126 - RNA, 22 nt, Human
gcccucagaguuccccacagug

SEQ ID NO: 431127 - RNA, 21 nt, Human
acagcagcaaucugucuuucc

SEQ ID NO: 431128 - RNA, 22 nt, Human
ugcaaauuauugggccccaacu

SEQ ID NO: 431129 - RNA, 22 nt, Human
agcucuccacacauaggacuag

SEQ ID NO: 431130 - RNA, 22 nt, Human
uucaagaagguacauuuacauc

SEQ ID NO: 431131 - RNA, 22 nt, Human
gcugugugcucacguaguggaa

SEQ ID NO: 431132 - RNA, 22 nt, Human
aaaggcauggaacagauucucc

SEQ ID NO: 431133 - RNA, 22 nt, Human
ucuggcucuuugggugauugua

SEQ ID NO: 431134 - RNA, 22 nt, Human
ucagccugcuccaagugcugcc

SEQ ID NO: 431135 - RNA, 22 nt, Human
cagcccagcagggucuggcccu

SEQ ID NO: 431136 - RNA, 23 nt, Human
uaugccaaaauggaaaguguaua

SEQ ID NO: 431137 - RNA, 22 nt, Human
cagagcagacguugagauuaag

SEQ ID NO: 431138 - RNA, 21 nt, Human
agaagccuggguggagguggg

SEQ ID NO: 431139 - RNA, 18 nt, Human
ggguccugugggagacag

SEQ ID NO: 431140 - RNA, 22 nt, Human
aaguggcuuugagcuucugcca

SEQ ID NO: 431141 - RNA, 22 nt, Human
cagaggcuguguaggcagacug

SEQ ID NO: 431142 - RNA, 16 nt, Human
cagacagagaacaggg

SEQ ID NO: 431143 - RNA, 22 nt, Human
cagcuccugccugggcagcugu

SEQ ID NO: 431144 - RNA, 22 nt, Human
aaaauguaugauggaggugcua

SEQ ID NO: 431145 - RNA, 22 nt, Human
ccuguugucucuuccuguugac

SEQ ID NO: 431146 - RNA, 22 nt, Human
ugggcugcccaagguggccaug

SEQ ID NO: 431147 - RNA, 22 nt, Human
gugggccuugcagggugcaggg

SEQ ID NO: 431148 - RNA, 22 nt, Human
gcagcugucacuuucacaaugc

SEQ ID NO: 431149 - RNA, 22 nt, Human
uguauucuuaguuuuaaucaga

SEQ ID NO: 431150 - RNA, 22 nt, Human
agagccuggaccugagcuacaa

SEQ ID NO: 431151 - RNA, 22 nt, Human
agcucacagaaauccugcagga

SEQ ID NO: 431152 - RNA, 22 nt, Human
ccugugugucugucacugcaca

SEQ ID NO: 431153 - RNA, 20 nt, Human
ucaagacagacauggaguuu

SEQ ID NO: 431154 - RNA, 19 nt, Human
cugaggcccauguaccaug

SEQ ID NO: 431155 - RNA, 22 nt, Human
gugcccuggcucacagugucuc

SEQ ID NO: 431156 - RNA, 22 nt, Human
gugcccugucucuugucuccag

SEQ ID NO: 431157 - RNA, 22 nt, Human
cugaaucaugccauuuugcuua

SEQ ID NO: 431158 - RNA, 22 nt, Human
ggcugcuggggacgugggagag

SEQ ID NO: 431159 - RNA, 22 nt, Human
aacauugaaauauuugcaauag

SEQ ID NO: 431160 - RNA, 22 nt, Human
cacaauguguuggguuaaguuu

SEQ ID NO: 431161 - RNA, 22 nt, Human
agaggcaggaagagcugauuuu

SEQ ID NO: 431162 - RNA, 22 nt, Human
ggcaggagcucuccaguuugcc

SEQ ID NO: 431163 - RNA, 22 nt, Human
ucccagagcaguacuccaggag

SEQ ID NO: 431164 - RNA, 22 nt, Human
cugggacagcugagacaggaga

SEQ ID NO: 431165 - RNA, 22 nt, Human
cagaagaguagcugaacaaguu

SEQ ID NO: 431166 - RNA, 22 nt, Human
ccacagagacucugcaggacug

SEQ ID NO: 431167 - RNA, 22 nt, Human
cgaggcaggcaggcggaggaua

SEQ ID NO: 431168 - RNA, 22 nt, Human
cacugaaaggaaaccagagcau

SEQ ID NO: 431169 - RNA, 22 nt, Human
acauucaaggccuucugacaca

SEQ ID NO: 431170 - RNA, 22 nt, Human
uggcuccuuccgcagcaugccu

SEQ ID NO: 431171 - RNA, 21 nt, Human
cauuucuaagccuggcuauag

SEQ ID NO: 431172 - RNA, 17 nt, Human
aauacugcuuauccagg

SEQ ID NO: 431173 - RNA, 22 nt, Human
uaguggagaaguggagucugug

SEQ ID NO: 431174 - RNA, 20 nt, Human
guccugggagccacagcaca

SEQ ID NO: 431175 - RNA, 23 nt, Human
ucccugagcuggagagacugcac

SEQ ID NO: 431176 - RNA, 22 nt, Human
caggaaggcgcggcugugccug

SEQ ID NO: 431177 - RNA, 22 nt, Human
aggcacaggaacaggaaaagag

SEQ ID NO: 431178 - RNA, 22 nt, Human
ucagaauuagagcucuucuuga

SEQ ID NO: 431179 - RNA, 21 nt, Human
cccagggaagccgcagucacc

SEQ ID NO: 431180 - RNA, 22 nt, Human
auagcaauuaagcuccagaauu

SEQ ID NO: 431181 - RNA, 22 nt, Human
gcaugcugagcccacgccuggg

SEQ ID NO: 431182 - RNA, 22 nt, Human
aagcacaauuucaccuucuugu

SEQ ID NO: 431183 - RNA, 22 nt, Human
cuuuggcaacacaugugggaca

SEQ ID NO: 431184 - RNA, 22 nt, Human
uuagcauuucuggaaucacaag

SEQ ID NO: 431185 - RNA, 22 nt, Human
uuuauuaauguagcauccaugg

SEQ ID NO: 431186 - RNA, 22 nt, Human
ugacagagagguaaguuaugaa

SEQ ID NO: 431187 - RNA, 22 nt, Human
aagcagaauuucccacuaguug

SEQ ID NO: 431188 - RNA, 22 nt, Human
uccugaaggcagauggggauca

SEQ ID NO: 431189 - RNA, 22 nt, Human
cuagccugggauuugaacuuau

SEQ ID NO: 431190 - RNA, 22 nt, Human
aacccagccguguagcugccgc

SEQ ID NO: 431191 - RNA, 22 nt, Human
cagcuguugucucucacauauu

SEQ ID NO: 431192 - RNA, 22 nt, Human
ucaggcugggcuccucucccca

SEQ ID NO: 431193 - RNA, 22 nt, Human
gcuuugcugggugcuucaugua

SEQ ID NO: 431194 - RNA, 22 nt, Human
uuugacaugaaguagcuuauaa

SEQ ID NO: 431195 - RNA, 17 nt, Human
cuuugcagcagacaugu

SEQ ID NO: 431196 - RNA, 23 nt, Human
ccugcagcugccacgcccugcuc

SEQ ID NO: 431197 - RNA, 22 nt, Human
cucggaauggaacaacagcggu

SEQ ID NO: 431198 - RNA, 22 nt, Human
gcugcuuucuguuaggaauugg

SEQ ID NO: 431199 - RNA, 22 nt, Human
ccagaagucaggaaugagucuu

SEQ ID NO: 431200 - RNA, 23 nt, Human
cuagaugcaagcuccaugaggga

SEQ ID NO: 431201 - RNA, 23 nt, Human
acagguacacuugauugcaaucc

SEQ ID NO: 431202 - RNA, 22 nt, Human
uggugccuugggccuacagcgc

SEQ ID NO: 431203 - RNA, 22 nt, Human
ugcagagggacagccacagcuc

SEQ ID NO: 431204 - RNA, 22 nt, Human
aauacaaucaaauucacuagca

SEQ ID NO: 431205 - RNA, 22 nt, Human
cucagggaguagcacaugugga

SEQ ID NO: 431206 - RNA, 22 nt, Human
ccuggaugauccaugucaugga

SEQ ID NO: 431207 - RNA, 22 nt, Human
gcacaaaagguacuucauguag

SEQ ID NO: 431208 - RNA, 22 nt, Human
cagcuugggggcgcuggccuca

SEQ ID NO: 431209 - RNA, 22 nt, Human
auucuuuauugcugaugguuau

SEQ ID NO: 431210 - RNA, 22 nt, Human
ucuuugcaacucccauuuccau

SEQ ID NO: 431211 - RNA, 22 nt, Human
gccugcagaggugcugcuagcu

SEQ ID NO: 431212 - RNA, 22 nt, Human
cuggguaccucaccgcugcugc

SEQ ID NO: 431213 - RNA, 22 nt, Human
uggccuggccacauccagcagg

SEQ ID NO: 431214 - RNA, 22 nt, Human
uggcucuggauuaaucuaggaa

SEQ ID NO: 431215 - RNA, 22 nt, Human
agcuggugucaccuccagucca

SEQ ID NO: 431216 - RNA, 22 nt, Human
cagaggaagagauacaagcccu

SEQ ID NO: 431217 - RNA, 22 nt, Human
uggcagauuguaggcaguuagg

SEQ ID NO: 431218 - RNA, 22 nt, Human
cacaggagcuguggggcagugu

SEQ ID NO: 431219 - RNA, 22 nt, Human
caggaacauuguagaauugaaa

SEQ ID NO: 431220 - RNA, 22 nt, Human
aagcugcagacccccugucuca

SEQ ID NO: 431221 - RNA, 22 nt, Human
uccuucccaggugucgccgccu

SEQ ID NO: 431222 - RNA, 22 nt, Human
cacacagaugguaagggaggga

SEQ ID NO: 431223 - RNA, 22 nt, Human
ucucccaggcugcccuguggac

SEQ ID NO: 431224 - RNA, 20 nt, Human
cccugcagccaugggagugg

SEQ ID NO: 431225 - RNA, 22 nt, Human
ucaggaaggcuucacacgagug

SEQ ID NO: 431226 - RNA, 22 nt, Human
ugcauaauggaugauuucacaa

SEQ ID NO: 431227 - RNA, 22 nt, Human
uucaccuguguuuuguggcuga

SEQ ID NO: 431228 - RNA, 22 nt, Human
aaaguuuuagcuguccaguucc

SEQ ID NO: 431229 - RNA, 22 nt, Human
cagcuggugaacuaguuuuuca

SEQ ID NO: 431230 - RNA, 22 nt, Human
uguguguguuuacaguuucuca

SEQ ID NO: 431231 - RNA, 22 nt, Human
gagggauggugugagaggcuca

SEQ ID NO: 431232 - RNA, 21 nt, Human
guucagagauuauugagucau

SEQ ID NO: 431233 - RNA, 22 nt, Human
aaagacuugggagcaguaugcu

SEQ ID NO: 431234 - RNA, 23 nt, Human
uggaguugauguccuucugugcu

SEQ ID NO: 431235 - RNA, 22 nt, Human
gcaguuauguauguguuugaga

SEQ ID NO: 431236 - RNA, 22 nt, Human
uguacaaauucaguucuagggu

SEQ ID NO: 431237 - RNA, 22 nt, Human
gaggagacugacagcagauucu

SEQ ID NO: 431238 - RNA, 22 nt, Human
ccagcgcuucccaucagggagg

SEQ ID NO: 431239 - RNA, 22 nt, Human
ccccaggccuguuggauggcgc

SEQ ID NO: 431240 - RNA, 22 nt, Human
uaacaguuuugaguuuugcuuc

SEQ ID NO: 431241 - RNA, 22 nt, Human
aaaugcagaucccugaaucuca

SEQ ID NO: 431242 - RNA, 22 nt, Human
cccaagggagugccuggucaac

SEQ ID NO: 431243 - RNA, 22 nt, Human
gugggaugcaguggugaguggc

SEQ ID NO: 431244 - RNA, 22 nt, Human
uucacagugcucacaguucagu

SEQ ID NO: 431245 - RNA, 21 nt, Human
cagagcuguccaaacccugac

SEQ ID NO: 431246 - RNA, 22 nt, Human
gacaauuucucaauauagaaac

SEQ ID NO: 431247 - RNA, 20 nt, Human
agcuccuggacuagagagug

SEQ ID NO: 431248 - RNA, 22 nt, Human
ccagcagcuuugcauacacuaa

SEQ ID NO: 431249 - RNA, 22 nt, Human
ugcaggacuucaggacucugag

SEQ ID NO: 431250 - RNA, 22 nt, Human
ccuggcugcuauagcagcaugu

SEQ ID NO: 431251 - RNA, 20 nt, Human
acauguacagacagguuucu

SEQ ID NO: 431252 - RNA, 22 nt, Human
gaaaggagggaaacagagcggu

SEQ ID NO: 431253 - RNA, 22 nt, Human
caguggucugugcuucuguaca

SEQ ID NO: 431254 - RNA, 22 nt, Human
ggaguuguucugcaggagagaa

SEQ ID NO: 431255 - RNA, 22 nt, Human
ccaggaagcauaauguaguggg

SEQ ID NO: 431256 - RNA, 22 nt, Human
uggcccugcugggucagagcug

SEQ ID NO: 431257 - RNA, 22 nt, Human
agcagagaggagguggcccugu

SEQ ID NO: 431258 - RNA, 22 nt, Human
guccagccagcugguccuugcc

SEQ ID NO: 431259 - RNA, 22 nt, Human
ugcagacaagucgugggaucuu

SEQ ID NO: 431260 - RNA, 22 nt, Human
aucuaacuuauguuuuaccaaa

SEQ ID NO: 431261 - RNA, 22 nt, Human
acugcauuugucugucucaauu

SEQ ID NO: 431262 - RNA, 22 nt, Human
aaaugucagaggaacauauuga

SEQ ID NO: 431263 - RNA, 22 nt, Human
acuuuccuagacuucagugaca

SEQ ID NO: 431264 - RNA, 22 nt, Human
cugaagcuuaguuuacgcucca

SEQ ID NO: 431265 - RNA, 22 nt, Human
aggcucugugauccacaaugag

SEQ ID NO: 431266 - RNA, 22 nt, Human
gcacagaaguaaaauacaaguc

SEQ ID NO: 431267 - RNA, 18 nt, Human
agcagcugugccacacug

SEQ ID NO: 431268 - RNA, 22 nt, Human
ucuaaauucuuuccuggguuga

SEQ ID NO: 431269 - RNA, 22 nt, Human
aauauggcuccauuccuuuagg

SEQ ID NO: 431270 - RNA, 22 nt, Human
ccuggcucgcugaccucagggg

SEQ ID NO: 431271 - RNA, 23 nt, Human
uucuuuauaaaucaaugggaugu

SEQ ID NO: 431272 - RNA, 22 nt, Human
ugcauuuguaacauucaagaau

SEQ ID NO: 431273 - RNA, 22 nt, Human
aaagugcaguccaugaaauuaa

SEQ ID NO: 431274 - RNA, 22 nt, Human
aggaagcaaaaggcagggucua

SEQ ID NO: 431275 - RNA, 22 nt, Human
gugaagacuuggagaaguuaag

SEQ ID NO: 431276 - RNA, 22 nt, Human
uuauugcaacuccuaaauagag

SEQ ID NO: 431277 - RNA, 22 nt, Human
gaacaucuuauccauuuccucu

SEQ ID NO: 431278 - RNA, 22 nt, Human
gggccacacagaaccuccuggu

SEQ ID NO: 431279 - RNA, 22 nt, Human
acagaauuaacauuugaugaau

SEQ ID NO: 431280 - RNA, 20 nt, Human
auacacaugcagacagaugc

SEQ ID NO: 431281 - RNA, 22 nt, Human
caggcagccugcggucugcaca

SEQ ID NO: 431282 - RNA, 22 nt, Human
uggguggaauaaaucaguucug

SEQ ID NO: 431283 - RNA, 22 nt, Human
cagagcagagugauuguucugg

SEQ ID NO: 431284 - RNA, 22 nt, Human
cuggugcuggagccuagucccu

SEQ ID NO: 431285 - RNA, 22 nt, Human
uccugggcccaggcugccaggg

SEQ ID NO: 431286 - RNA, 22 nt, Human
gagauggagucuuuuucuguca

SEQ ID NO: 431287 - RNA, 22 nt, Human
aaaugugcuugugaucagcugu

SEQ ID NO: 431288 - RNA, 22 nt, Human
gcacaggcacagagggccacug

SEQ ID NO: 431289 - RNA, 22 nt, Human
uguuucaguccacuuaggcagc

SEQ ID NO: 431290 - RNA, 22 nt, Human
caggcagaggcuuuucauggcu

SEQ ID NO: 431291 - RNA, 22 nt, Human
uccugucugucuuuggucccuu

SEQ ID NO: 431292 - RNA, 22 nt, Human
ugguccuggccuugaccccagg

SEQ ID NO: 431293 - RNA, 22 nt, Human
gcugggagccccgagccagcgc

SEQ ID NO: 431294 - RNA, 22 nt, Human
aggcacagagaaguaaaguauc

SEQ ID NO: 431295 - RNA, 22 nt, Human
cugggugccagcauggcugagu

SEQ ID NO: 431296 - RNA, 22 nt, Human
gagagaauguacaugcuagggg

SEQ ID NO: 431297 - RNA, 22 nt, Human
guggcucucgccagccugcggg

SEQ ID NO: 431298 - RNA, 22 nt, Human
aaauucaguuuuaauaaucacu

SEQ ID NO: 431299 - RNA, 22 nt, Human
uuaaugaccuagagcaguaauu

SEQ ID NO: 431300 - RNA, 19 nt, Human
ucagaacucagaaugugua

SEQ ID NO: 431301 - RNA, 22 nt, Human
aagcugccugggaggaagggcu

SEQ ID NO: 431302 - RNA, 22 nt, Human
augauucagcccaauuuuucua

SEQ ID NO: 431303 - RNA, 22 nt, Human
ugcauuuuugagguuaacucaa

SEQ ID NO: 431304 - RNA, 22 nt, Human
auuaacaugaguuggagauagg

SEQ ID NO: 431305 - RNA, 22 nt, Human
cuggcucccgucugguggccau

SEQ ID NO: 431306 - RNA, 22 nt, Human
ucugaggccuagagaggggcuu

SEQ ID NO: 431307 - RNA, 22 nt, Human
cagagcuggcucugcauguaca

SEQ ID NO: 431308 - RNA, 22 nt, Human
uuuauugcauacacaaauguca

SEQ ID NO: 431309 - RNA, 23 nt, Human
ggacccuguggagggugagaguc

SEQ ID NO: 431310 - RNA, 22 nt, Human
agcuguggggaggaggcuagca

SEQ ID NO: 431311 - RNA, 22 nt, Human
gugcagguggcuucuagcuucu

SEQ ID NO: 431312 - RNA, 22 nt, Human
uuucuucuugauuuaaacaggg

SEQ ID NO: 431313 - RNA, 22 nt, Human
cuuugcaagugcuuuguagucc

SEQ ID NO: 431314 - RNA, 22 nt, Human
gccagcagcgagaguuuaaccu

SEQ ID NO: 431315 - RNA, 22 nt, Human
aaggcugggaaacaugcaggcc

SEQ ID NO: 431316 - RNA, 22 nt, Human
aaaucacagggucucuaaguau

SEQ ID NO: 431317 - RNA, 22 nt, Human
ggagacaggguugaaccacgca

SEQ ID NO: 431318 - RNA, 22 nt, Human
uuguauuuccuauaaccuuucu

SEQ ID NO: 431319 - RNA, 22 nt, Human
ugggugggagcgcccugucugg

SEQ ID NO: 431320 - RNA, 22 nt, Human
ucacuggugugagaggagcaaa

SEQ ID NO: 431321 - RNA, 22 nt, Human
uuuggccacagauccuuggggg

SEQ ID NO: 431322 - RNA, 22 nt, Human
cauuacaaaguuauaaacaguu

SEQ ID NO: 431323 - RNA, 22 nt, Human
auggcagggcccuuggcuccca

SEQ ID NO: 431324 - RNA, 17 nt, Human
ucugaagccagucugcu

SEQ ID NO: 431325 - RNA, 19 nt, Human
uucacauuggaagaaguag

SEQ ID NO: 431326 - RNA, 22 nt, Human
uuuccucuaaacgcauuugcuu

SEQ ID NO: 431327 - RNA, 22 nt, Human
aggcaccuugagagcaggagcu

SEQ ID NO: 431328 - RNA, 22 nt, Human
aaacacauuuuaggaaaaucua

SEQ ID NO: 431329 - RNA, 17 nt, Human
ggcagccucaggcguuu

SEQ ID NO: 431330 - RNA, 19 nt, Human
aaaguuuuauucucauuug

SEQ ID NO: 431331 - RNA, 23 nt, Human
uccuccugacacagccugaguga

SEQ ID NO: 431332 - RNA, 22 nt, Human
ugcucccaggacucuugagcca

SEQ ID NO: 431333 - RNA, 22 nt, Human
agagaauucuggugcuaacaag

SEQ ID NO: 431334 - RNA, 22 nt, Human
acagaugagacuccaggaccuu

SEQ ID NO: 431335 - RNA, 22 nt, Human
cugcauuauucuaguccaagcc

SEQ ID NO: 431336 - RNA, 22 nt, Human
agaggaagccauugcuuacuga

SEQ ID NO: 431337 - RNA, 22 nt, Human
cagggcuccccagagagccucu

SEQ ID NO: 431338 - RNA, 22 nt, Human
gucugaggguugugcuggagga

SEQ ID NO: 431339 - RNA, 22 nt, Human
aggcaccuggaucuuggaauuc

SEQ ID NO: 431340 - RNA, 22 nt, Human
acuccaggaaacuuaggggaaa

SEQ ID NO: 431341 - RNA, 22 nt, Human
ugucccuggagcuucugucccc

SEQ ID NO: 431342 - RNA, 22 nt, Human
cgucuaggccgugcccugaggu

SEQ ID NO: 431343 - RNA, 22 nt, Human
uucagagagaaaccagugggaa

SEQ ID NO: 431344 - RNA, 22 nt, Human
caggcacugugcugagcucugc

SEQ ID NO: 431345 - RNA, 22 nt, Human
caguguuuguugagaaaggcaa

SEQ ID NO: 431346 - RNA, 22 nt, Human
ugcccuggcuggagugcagugg

SEQ ID NO: 431347 - RNA, 22 nt, Human
agugaauauuuuuagacaccca

SEQ ID NO: 431348 - RNA, 22 nt, Human
caauuuuacucuuccucuucca

SEQ ID NO: 431349 - RNA, 22 nt, Human
ugcucaguccuccugcagugcc

SEQ ID NO: 431350 - RNA, 22 nt, Human
uuucagagcugagaugccacag

SEQ ID NO: 431351 - RNA, 22 nt, Human
gauggaggaaaaguuggaaugc

SEQ ID NO: 431352 - RNA, 22 nt, Human
gaucuuuucagucuugguaguu

SEQ ID NO: 431353 - RNA, 22 nt, Human
aacaggcagcagacugaaucug

SEQ ID NO: 431354 - RNA, 22 nt, Human
ugggccuguugccugaguccau

SEQ ID NO: 431355 - RNA, 22 nt, Human
cccagagcuccgguccugccca

SEQ ID NO: 431356 - RNA, 22 nt, Human
gcauuauuaacuggaggaaaag

SEQ ID NO: 431357 - RNA, 22 nt, Human
agauauaguuguugagaagaac

SEQ ID NO: 431358 - RNA, 22 nt, Human
ugugaauagucagcauuuuguu

SEQ ID NO: 431359 - RNA, 22 nt, Human
uuuuacauugggaaaugccucu

SEQ ID NO: 431360 - RNA, 20 nt, Human
agaaggcaggagacaaaagg

SEQ ID NO: 431361 - RNA, 22 nt, Human
aaggccucaggugaggcugccc

SEQ ID NO: 431362 - RNA, 22 nt, Human
cacagaggauuuuuagggcagu

SEQ ID NO: 431363 - RNA, 22 nt, Human
gugaaggacuagcauggagggc

SEQ ID NO: 431364 - RNA, 22 nt, Human
gaauacaaagcagaacucauac

SEQ ID NO: 431365 - RNA, 22 nt, Human
ucugccugcggcugcagguggc

SEQ ID NO: 431366 - RNA, 22 nt, Human
gcucaaagaccagacagaggag

SEQ ID NO: 431367 - RNA, 22 nt, Human
uaaaugcuaucgcauaaaaccu

SEQ ID NO: 431368 - RNA, 22 nt, Human
uuugaaaggguuaugagacuga

SEQ ID NO: 431369 - RNA, 22 nt, Human
cuggcucccaugagcucucacg

SEQ ID NO: 431370 - RNA, 22 nt, Human
uucagaaucuaugugccagcuc

SEQ ID NO: 431371 - RNA, 22 nt, Human
uucuuuauccuauuuguaggug

SEQ ID NO: 431372 - RNA, 22 nt, Human
gugaauaauauuguuuauaaaa

SEQ ID NO: 431373 - RNA, 22 nt, Human
uggccugggcaugaagcaucgu

SEQ ID NO: 431374 - RNA, 22 nt, Human
uuucucccuccacuacaggcuc

SEQ ID NO: 431375 - RNA, 23 nt, Human
uauugcaagcucugccucccggg

SEQ ID NO: 431376 - RNA, 22 nt, Human
cucucagaaguuuaugucagaa

SEQ ID NO: 431377 - RNA, 22 nt, Human
gaaaaaugcuccaaaucugugg

SEQ ID NO: 431378 - RNA, 22 nt, Human
agaggauucacugcagaagaca

SEQ ID NO: 431379 - RNA, 22 nt, Human
gcacagcaguggcauaaacaau

SEQ ID NO: 431380 - RNA, 19 nt, Human
cugaggugcaguaagaggc

SEQ ID NO: 431381 - RNA, 22 nt, Human
cacaguacuuaauucucuaaau

SEQ ID NO: 431382 - RNA, 22 nt, Human
uccauacucagaaaguauugca

SEQ ID NO: 431383 - RNA, 22 nt, Human
ggcugggcuccgggagcaugcg

SEQ ID NO: 431384 - RNA, 22 nt, Human
cuggggggcuacugacagagga

SEQ ID NO: 431385 - RNA, 22 nt, Human
uguuuaaugaagaugguuuuuc

SEQ ID NO: 431386 - RNA, 22 nt, Human
ucauuuauaaggaugcaauuaa

SEQ ID NO: 431387 - RNA, 22 nt, Human
augguggacgggagacaggacu

SEQ ID NO: 431388 - RNA, 22 nt, Human
auuuauagggcauugaaaacug

SEQ ID NO: 431389 - RNA, 22 nt, Human
auacaaucaucauuauauuccc

SEQ ID NO: 431390 - RNA, 22 nt, Human
uggaaacacucaagcuuauauu

SEQ ID NO: 431391 - RNA, 22 nt, Human
agcuaaugaaauauuuucugau

SEQ ID NO: 431392 - RNA, 22 nt, Human
aagcacagugggcagagcagcc

SEQ ID NO: 431393 - RNA, 22 nt, Human
ugcagaagacacaagguaacgu

SEQ ID NO: 431394 - RNA, 22 nt, Human
acacuucauuuacauuauaggc

SEQ ID NO: 431395 - RNA, 22 nt, Human
auuaaggcacuugagcaugaug

SEQ ID NO: 431396 - RNA, 22 nt, Human
agagagcugacuuuggagucag

SEQ ID NO: 431397 - RNA, 22 nt, Human
uaauuuuaauaguauguggcau

SEQ ID NO: 431398 - RNA, 21 nt, Human
agagaagggauuccaggcccu

SEQ ID NO: 431399 - RNA, 22 nt, Human
gcagcugccgugagcucacgcc

SEQ ID NO: 431400 - RNA, 22 nt, Human
uggcagaguggaccauacucaa

SEQ ID NO: 431401 - RNA, 22 nt, Human
gagcuguccuaccaggaguccu

SEQ ID NO: 431402 - RNA, 22 nt, Human
augaccaagaguccaggucaag

SEQ ID NO: 431403 - RNA, 22 nt, Human
agggcagagcugucuaaauggc

SEQ ID NO: 431404 - RNA, 22 nt, Human
ccuggagcaaaaaucuaaggag

SEQ ID NO: 431405 - RNA, 22 nt, Human
cauucaaauuaagauuuuguua

SEQ ID NO: 431406 - RNA, 18 nt, Human
uccugccugcgggcuccc

SEQ ID NO: 431407 - RNA, 22 nt, Human
aacauugaauuuaaaauacagu

SEQ ID NO: 431408 - RNA, 22 nt, Human
cccagagagcauuuggacaaag

SEQ ID NO: 431409 - RNA, 22 nt, Human
ucccagccggugccuggguccc

SEQ ID NO: 431410 - RNA, 20 nt, Human
cagcagagacccauggggag

SEQ ID NO: 431411 - RNA, 22 nt, Human
ucuucaaauacagucauauuga

SEQ ID NO: 431412 - RNA, 22 nt, Human
aguuuuucugcuggucucacua

SEQ ID NO: 431413 - RNA, 22 nt, Human
agcugccagcaucccggaaggg

SEQ ID NO: 431414 - RNA, 22 nt, Human
caggcagcucuaauggaaagug

SEQ ID NO: 431415 - RNA, 23 nt, Human
uucaugagauuaucugcaugugu

SEQ ID NO: 431416 - RNA, 22 nt, Human
auaucucauuaccuugcuguuc

SEQ ID NO: 431417 - RNA, 22 nt, Human
cagcuuuagagaaaacauauuu

SEQ ID NO: 431418 - RNA, 21 nt, Human
ccugugugucugacugggcua

SEQ ID NO: 431419 - RNA, 22 nt, Human
uaaggaaacaacuuguauuuuu

SEQ ID NO: 431420 - RNA, 22 nt, Human
cacagugcaugaugggcagaag

SEQ ID NO: 431421 - RNA, 22 nt, Human
gggauggcucaaaggagucagg

SEQ ID NO: 431422 - RNA, 22 nt, Human
uauuuguuccagagauaaaaau

SEQ ID NO: 431423 - RNA, 22 nt, Human
auucagaauuuuggggagcuaa

SEQ ID NO: 431424 - RNA, 22 nt, Human
uagaaacaucagcuaaccaaaa

SEQ ID NO: 431425 - RNA, 22 nt, Human
uuugcaaacuuuccucuggacc

SEQ ID NO: 431426 - RNA, 22 nt, Human
uuccuuuuagaaucaugaagac

SEQ ID NO: 431427 - RNA, 22 nt, Human
caagaaauguuuacugagcauc

SEQ ID NO: 431428 - RNA, 22 nt, Human
gcccagccccuggguggacgug

SEQ ID NO: 431429 - RNA, 22 nt, Human
caagcagacaguaggccuagaa

SEQ ID NO: 431430 - RNA, 22 nt, Human
agcaccugucaaguccaggcug

SEQ ID NO: 431431 - RNA, 22 nt, Human
ucagaggagggacucagaccca

SEQ ID NO: 431432 - RNA, 22 nt, Human
gaagacauguuuuuaauaugua

SEQ ID NO: 431433 - RNA, 22 nt, Human
uuuaaauucugucugccgcuua

SEQ ID NO: 431434 - RNA, 22 nt, Human
ccaggaagcggugagggcugcc

SEQ ID NO: 431435 - RNA, 22 nt, Human
ugcuagggaagaacgagggaau

SEQ ID NO: 431436 - RNA, 22 nt, Human
uugagacacuuugggcaucacu

SEQ ID NO: 431437 - RNA, 22 nt, Human
gacagguaaagaugguggcagg

SEQ ID NO: 431438 - RNA, 22 nt, Human
ugcagaagcagagaguugccaa

SEQ ID NO: 431439 - RNA, 22 nt, Human
gccaccagcagaaaaggggcca

SEQ ID NO: 431440 - RNA, 22 nt, Human
aagcugaggcccauggcaaggu

SEQ ID NO: 431441 - RNA, 22 nt, Human
uaggcagggauuaggguugauu

SEQ ID NO: 431442 - RNA, 22 nt, Human
caggaagcucuuagcagucacc

SEQ ID NO: 431443 - RNA, 22 nt, Human
gagggggcuagcgcagugccca

SEQ ID NO: 431444 - RNA, 22 nt, Human
cuggccaggcuugggacagaca

SEQ ID NO: 431445 - RNA, 22 nt, Human
cuguccuguagcuccaucaguc

SEQ ID NO: 431446 - RNA, 22 nt, Human
gcagcccucccugggugugucu

SEQ ID NO: 431447 - RNA, 22 nt, Human
aaacugcacuuuauuuugucaa

SEQ ID NO: 431448 - RNA, 22 nt, Human
ugcuccaugcgcucggccggcg

SEQ ID NO: 431449 - RNA, 22 nt, Human
cacauuuaggagguggggaagc

SEQ ID NO: 431450 - RNA, 22 nt, Human
gcccugggcucccugcuccaca

SEQ ID NO: 431451 - RNA, 22 nt, Human
ccagaggaaaaauaucucccua

SEQ ID NO: 431452 - RNA, 22 nt, Human
agcugguuuaggaaaagguagg

SEQ ID NO: 431453 - RNA, 22 nt, Human
ucagacaguuugcagugugccu

SEQ ID NO: 431454 - RNA, 22 nt, Human
gccaacaggccuugcucugcuc

SEQ ID NO: 431455 - RNA, 22 nt, Human
augcagcuauuugagcauguca

SEQ ID NO: 431456 - RNA, 22 nt, Human
cugacccagaggaacugcaaag

SEQ ID NO: 431457 - RNA, 22 nt, Human
auccuacaaagcagggcuaugg

SEQ ID NO: 431458 - RNA, 22 nt, Human
acauuaaaaaauguugcaugaa

SEQ ID NO: 431459 - RNA, 22 nt, Human
cccuccccagggucauauugaa

SEQ ID NO: 431460 - RNA, 22 nt, Human
uucuuuuuaucuucccauaaga

SEQ ID NO: 431461 - RNA, 22 nt, Human
aacuuugcauaacuaacuacag

SEQ ID NO: 431462 - RNA, 22 nt, Human
aggccagcccucaccuguguuc

SEQ ID NO: 431463 - RNA, 22 nt, Human
aauguaccagccuaagaagugg

SEQ ID NO: 431464 - RNA, 22 nt, Human
aacacuuucuauuauuaugguu

SEQ ID NO: 431465 - RNA, 21 nt, Human
ucuuugcaucaguuguuuucu

SEQ ID NO: 431466 - RNA, 22 nt, Human
aagccgggccugagaaaugaca

SEQ ID NO: 431467 - RNA, 22 nt, Human
ccaggccucccuuuuccagcca

SEQ ID NO: 431468 - RNA, 22 nt, Human
gcacagaacagagaaauagcca

SEQ ID NO: 431469 - RNA, 22 nt, Human
gcuguucccauguggggcucag

SEQ ID NO: 431470 - RNA, 22 nt, Human
agggcugguauguccaugaaag

SEQ ID NO: 431471 - RNA, 22 nt, Human
aucaaauaaagguaccuagcuu

SEQ ID NO: 431472 - RNA, 20 nt, Human
ugugcccugcagacuucuuu

SEQ ID NO: 431473 - RNA, 22 nt, Human
uuacagaacugucuugaaauuu

SEQ ID NO: 431474 - RNA, 22 nt, Human
cugugucccaguaccuugggua

SEQ ID NO: 431475 - RNA, 22 nt, Human
cacauuuacauauaaaacuuuc

SEQ ID NO: 431476 - RNA, 22 nt, Human
agcagugcccauucugcccccu

SEQ ID NO: 431477 - RNA, 22 nt, Human
uggccugggugcugcugacauc

SEQ ID NO: 431478 - RNA, 22 nt, Human
agcacagauuugucaacauaga

SEQ ID NO: 431479 - RNA, 22 nt, Human
gggagccacagugaggugcaug

SEQ ID NO: 431480 - RNA, 22 nt, Human
gcaggccugguuuacaugguag

SEQ ID NO: 431481 - RNA, 22 nt, Human
ucugagggugggagaaggagcu

SEQ ID NO: 431482 - RNA, 22 nt, Human
cugggaggcccacguugggaag

SEQ ID NO: 431483 - RNA, 22 nt, Human
uccugccuucauacugcuguau

SEQ ID NO: 431484 - RNA, 21 nt, Human
uacaagaccggauucgggccc

SEQ ID NO: 431485 - RNA, 22 nt, Human
gugccucagcaccgccugcagc

SEQ ID NO: 431486 - RNA, 22 nt, Human
gggcacagagaagguuuuagug

SEQ ID NO: 431487 - RNA, 22 nt, Human
uguuuguucccucucuuuccug

SEQ ID NO: 431488 - RNA, 22 nt, Human
uuuauccaccuuacccuguucc

SEQ ID NO: 431489 - RNA, 22 nt, Human
caaggacacugauguucauccu

SEQ ID NO: 431490 - RNA, 22 nt, Human
agacaagacuaggcaguuguug

SEQ ID NO: 431491 - RNA, 22 nt, Human
uuugggcaguccuggaauuugu

SEQ ID NO: 431492 - RNA, 22 nt, Human
uggggcugucccgguuuggcga

SEQ ID NO: 431493 - RNA, 22 nt, Human
ucuggcuccuggcuccacugcc

SEQ ID NO: 431494 - RNA, 22 nt, Human
acugugcuuucucuggaggcau

SEQ ID NO: 431495 - RNA, 22 nt, Human
gaaguucaacugccaugcuugg

SEQ ID NO: 431496 - RNA, 22 nt, Human
uuuccucacucaugucaucagu

SEQ ID NO: 431497 - RNA, 22 nt, Human
acagagcaauaacagggagagg

SEQ ID NO: 431498 - RNA, 22 nt, Human
aauuuuacuucccucaguguag

SEQ ID NO: 431499 - RNA, 22 nt, Human
cagcugccaagaaucuuuucua

SEQ ID NO: 431500 - RNA, 22 nt, Human
aggcagcuggcagcacccaggg

SEQ ID NO: 431501 - RNA, 22 nt, Human
ucacaguagacuucucaagagc

SEQ ID NO: 431502 - RNA, 22 nt, Human
gugcccuggaugacuuuggucu

SEQ ID NO: 431503 - RNA, 22 nt, Human
cugugggagaggugccuggauu

SEQ ID NO: 431504 - RNA, 18 nt, Human
ugaggaaggggaaguauu

SEQ ID NO: 431505 - RNA, 22 nt, Human
agagcugagaauguggcuuccu

SEQ ID NO: 431506 - RNA, 22 nt, Human
cccagcuccuuacagggccgaa

SEQ ID NO: 431507 - RNA, 22 nt, Human
ucaggcugauaggaggaacuga

SEQ ID NO: 431508 - RNA, 22 nt, Human
gggcugagugucccaggccgaa

SEQ ID NO: 431509 - RNA, 22 nt, Human
ucugucacucuagagauggcag

SEQ ID NO: 431510 - RNA, 22 nt, Human
uuauagcagcaugauuuacaau

SEQ ID NO: 431511 - RNA, 22 nt, Human
uaauuuaugaugcaaagaaaag

SEQ ID NO: 431512 - RNA, 22 nt, Human
cacaauuuguuuuaucaguauu

SEQ ID NO: 431513 - RNA, 22 nt, Human
uaaggcacacaguugcugcaug

SEQ ID NO: 431514 - RNA, 22 nt, Human
aguuuuucugggaggcacugcu

SEQ ID NO: 431515 - RNA, 22 nt, Human
uccugaaggccugaguuccacc

SEQ ID NO: 431516 - RNA, 22 nt, Human
agacaaguguggugagagcagu

SEQ ID NO: 431517 - RNA, 20 nt, Human
cuugaugagauaaacagcag

SEQ ID NO: 431518 - RNA, 15 nt, Human
ugcauuaucaauaga

SEQ ID NO: 431519 - RNA, 22 nt, Human
gacaagacaccucucuccaucc

SEQ ID NO: 431520 - RNA, 22 nt, Human
agcuccugauucucagagauag

SEQ ID NO: 431521 - RNA, 22 nt, Human
cugaggccucuguucaccagaa

SEQ ID NO: 431522 - RNA, 22 nt, Human
uuaacauuugugaagcauuuag

SEQ ID NO: 431523 - RNA, 22 nt, Human
gcuuagcaaacaucuguagucc

SEQ ID NO: 431524 - RNA, 22 nt, Human
caggcuggagugaguguagugg

SEQ ID NO: 431525 - RNA, 22 nt, Human
gcacagaaccagacaugaggca

SEQ ID NO: 431526 - RNA, 22 nt, Human
cagacuggccacaucugcacug

SEQ ID NO: 431527 - RNA, 22 nt, Human
cuacaugaacucuuaagucaca

SEQ ID NO: 431528 - RNA, 22 nt, Human
aggauuugaaauauuuaguaaa

SEQ ID NO: 431529 - RNA, 22 nt, Human
ucucuaaagcacuuuaaccaca

SEQ ID NO: 431530 - RNA, 22 nt, Human
cacaggaaucagcauuaauggc

SEQ ID NO: 431531 - RNA, 22 nt, Human
agagccuggcucccagcuaccg

SEQ ID NO: 431532 - RNA, 22 nt, Human
ugcccacaccugggggaggcug

SEQ ID NO: 431533 - RNA, 22 nt, Human
acuucauucauuuucacgaaug

SEQ ID NO: 431534 - RNA, 22 nt, Human
guccaugacugugacucacaug

SEQ ID NO: 431535 - RNA, 22 nt, Human
ccugccagggccuuggaagaaa

SEQ ID NO: 431536 - RNA, 22 nt, Human
aagcuaaguauaggugaauccu

SEQ ID NO: 431537 - RNA, 22 nt, Human
aggcccuuggacucaugcucga

SEQ ID NO: 431538 - RNA, 22 nt, Human
uuacaaguuucuggcuucaucc

SEQ ID NO: 431539 - RNA, 22 nt, Human
gcuguauuuauaugaaggcaug

SEQ ID NO: 431540 - RNA, 18 nt, Human
cuuauuguuuaaauggcc

SEQ ID NO: 431541 - RNA, 22 nt, Human
ggugggcacauucagucucugu

SEQ ID NO: 431542 - RNA, 22 nt, Human
aauaugcagcuuaucuucuagg

SEQ ID NO: 431543 - RNA, 22 nt, Human
gcucugcuguguuuguucagca

SEQ ID NO: 431544 - RNA, 22 nt, Human
ucagacagggcuucucaaacuu

SEQ ID NO: 431545 - RNA, 22 nt, Human
gagcugcagaguaaccuuugca

SEQ ID NO: 431546 - RNA, 22 nt, Human
gcucuugauuuccaggagcuag

SEQ ID NO: 431547 - RNA, 22 nt, Human
uugcaaauuccaauccaauauu

SEQ ID NO: 431548 - RNA, 19 nt, Human
ugcccaggccucccaaaag

SEQ ID NO: 431549 - RNA, 22 nt, Human
uuucagaguuaguagagcaugu

SEQ ID NO: 431550 - RNA, 22 nt, Human
aaaguucaugguguuauagaaa

SEQ ID NO: 431551 - RNA, 22 nt, Human
cuggccucagagggucauggug

SEQ ID NO: 431552 - RNA, 22 nt, Human
auuuucauuuugcagggugaga

SEQ ID NO: 431553 - RNA, 22 nt, Human
auccagcacuuguucaugugaa

SEQ ID NO: 431554 - RNA, 22 nt, Human
ccaggcugccgaggaaagaaag

SEQ ID NO: 431555 - RNA, 22 nt, Human
augaacaucucugauccaagca

SEQ ID NO: 431556 - RNA, 22 nt, Human
aggcaagcccccagugaggcuc

SEQ ID NO: 431557 - RNA, 23 nt, Human
ccugggcauuggcugcagcuucu

SEQ ID NO: 431558 - RNA, 22 nt, Human
ccaggcugcuuuauuacucugu

SEQ ID NO: 431559 - RNA, 22 nt, Human
ugaugagggggaacagagauuu

SEQ ID NO: 431560 - RNA, 22 nt, Human
uggcucagauuuuuguaggcuu

SEQ ID NO: 431561 - RNA, 22 nt, Human
ugucccagggaaggcccagcac

SEQ ID NO: 431562 - RNA, 22 nt, Human
aggagccagaauccagacucgg

SEQ ID NO: 431563 - RNA, 22 nt, Human
cagacaggcaggugagagcucc

SEQ ID NO: 431564 - RNA, 22 nt, Human
gagccuggauugaagugggugg

SEQ ID NO: 431565 - RNA, 22 nt, Human
acagccagguaaaggcauggca

SEQ ID NO: 431566 - RNA, 22 nt, Human
uucacaggcuuggagguggggg

SEQ ID NO: 431567 - RNA, 22 nt, Human
uuucauaauacuguacaugaaa

SEQ ID NO: 431568 - RNA, 22 nt, Human
ucucugggcucaggagcccggc

SEQ ID NO: 431569 - RNA, 22 nt, Human
ccaugggaauugggagguccca

SEQ ID NO: 431570 - RNA, 22 nt, Human
aauacagaggcuuccaguaaaa

SEQ ID NO: 431571 - RNA, 22 nt, Human
gcccugucccuuggcuucuagg

SEQ ID NO: 431572 - RNA, 22 nt, Human
cugcauuagucaugcuuugcag

SEQ ID NO: 431573 - RNA, 22 nt, Human
gcauggcaaauaucgagggcag

SEQ ID NO: 431574 - RNA, 22 nt, Human
cagagacauucuccccauugga

SEQ ID NO: 431575 - RNA, 22 nt, Human
aggcagcuuucuggugcaccau

SEQ ID NO: 431576 - RNA, 22 nt, Human
uaaguuuuaagcaaucugauaa

SEQ ID NO: 431577 - RNA, 19 nt, Human
aagcuaagaccugaagguu

SEQ ID NO: 431578 - RNA, 22 nt, Human
aggaggcugguucaggccauau

SEQ ID NO: 431579 - RNA, 22 nt, Human
cagcaaggucugucaauagugg

SEQ ID NO: 431580 - RNA, 22 nt, Human
agcucaggcucugcagggacua

SEQ ID NO: 431581 - RNA, 22 nt, Human
cagagcagaaaccugggugauu

SEQ ID NO: 431582 - RNA, 22 nt, Human
cauuucuacagcuucuucagaa

SEQ ID NO: 431583 - RNA, 22 nt, Human
cugccagcucucuggaggcucu

SEQ ID NO: 431584 - RNA, 22 nt, Human
ggcaguuucucaggcaggggua

SEQ ID NO: 431585 - RNA, 22 nt, Human
ggucccaggcugcgggcuggug

SEQ ID NO: 431586 - RNA, 22 nt, Human
acagaaugcguagugcauguug

SEQ ID NO: 431587 - RNA, 22 nt, Human
acuggcagugucguuuacauga

SEQ ID NO: 431588 - RNA, 22 nt, Human
ugccucugccuccauuguuagu

SEQ ID NO: 431589 - RNA, 20 nt, Human
ccuccuggucaggugugcag

SEQ ID NO: 431590 - RNA, 22 nt, Human
uuagucuucucauaguaaaacu

SEQ ID NO: 431591 - RNA, 22 nt, Human
ugggaugagcuauauagaaagu

SEQ ID NO: 431592 - RNA, 20 nt, Human
agccugccagcuggcccaga

SEQ ID NO: 431593 - RNA, 22 nt, Human
ugaggcagcuuuuucugugugu

SEQ ID NO: 431594 - RNA, 22 nt, Human
cagugagggcccccuuccaggu

SEQ ID NO: 431595 - RNA, 22 nt, Human
ucugggcuuggauuggcucugc

SEQ ID NO: 431596 - RNA, 22 nt, Human
gagagcugcaagguagggcggg

SEQ ID NO: 431597 - RNA, 22 nt, Human
aggcagcugaccacaguaugau

SEQ ID NO: 431598 - RNA, 22 nt, Human
agugcuggagggaggcagguuc

SEQ ID NO: 431599 - RNA, 19 nt, Human
aaguugaucauuuugacag

SEQ ID NO: 431600 - RNA, 22 nt, Human
gaggcugguucugaaguacugu

SEQ ID NO: 431601 - RNA, 22 nt, Human
gcugccucugcacagcucacuc

SEQ ID NO: 431602 - RNA, 22 nt, Human
gacagcuggcaguggaaaggug

SEQ ID NO: 431603 - RNA, 19 nt, Human
auuaacaucaguguuggcc

SEQ ID NO: 431604 - RNA, 22 nt, Human
uuauugugaggaauaagugaga

SEQ ID NO: 431605 - RNA, 22 nt, Human
ugugacaagcauuguauauugg

SEQ ID NO: 431606 - RNA, 16 nt, Human
ggcaccagugaacaca

SEQ ID NO: 431607 - RNA, 22 nt, Human
ucccuguaagguucugagauuu

SEQ ID NO: 431608 - RNA, 23 nt, Human
acucguggaauucucugcgaucg

SEQ ID NO: 431609 - RNA, 22 nt, Human
gcccagguuggagagcaguggc

SEQ ID NO: 431610 - RNA, 22 nt, Human
ucccagccacaguuuccaccug

SEQ ID NO: 431611 - RNA, 22 nt, Human
gccaaggccucugcaggaugag

SEQ ID NO: 431612 - RNA, 22 nt, Human
gagcuuaggccagggacaggga

SEQ ID NO: 431613 - RNA, 22 nt, Human
ucagcaaccaggggcacagucc

SEQ ID NO: 431614 - RNA, 22 nt, Human
ucugccucuuucaggccuggca

SEQ ID NO: 431615 - RNA, 22 nt, Human
cucccacauggaauagcaggga

SEQ ID NO: 431616 - RNA, 22 nt, Human
ggcugccucuggaagcuggaga

SEQ ID NO: 431617 - RNA, 22 nt, Human
gucaggaaaacccggguugacu

SEQ ID NO: 431618 - RNA, 22 nt, Human
cucagaguucuccugggaggug

SEQ ID NO: 431619 - RNA, 22 nt, Human
agcagcauguucauuacauuau

SEQ ID NO: 431620 - RNA, 21 nt, Human
ucugcccuccaggagcucaua

SEQ ID NO: 431621 - RNA, 22 nt, Human
cuguguggacugguugaggccc

SEQ ID NO: 431622 - RNA, 21 nt, Human
agagucugcauuucugacaag

SEQ ID NO: 431623 - RNA, 22 nt, Human
ggccugagcuugggcagcguau

SEQ ID NO: 431624 - RNA, 22 nt, Human
agucucacuucuugagcuaugc

SEQ ID NO: 431625 - RNA, 22 nt, Human
aguccugugaggggugcagcuu

SEQ ID NO: 431626 - RNA, 22 nt, Human
ugacaagagaccccuccgcagg

SEQ ID NO: 431627 - RNA, 22 nt, Human
ucuucuggaucgaucacauugu

SEQ ID NO: 431628 - RNA, 22 nt, Human
caauuucugggccucacacaag

SEQ ID NO: 431629 - RNA, 22 nt, Human
ugcuggggauccguaccaaccc

SEQ ID NO: 431630 - RNA, 21 nt, Human
agagaagggacucuuccaguc

SEQ ID NO: 431631 - RNA, 22 nt, Human
ugcccaaacugacauuggcagu

SEQ ID NO: 431632 - RNA, 21 nt, Human
aagcaggcuguaaucaugugg

SEQ ID NO: 431633 - RNA, 17 nt, Human
aagagaggcugagcugg

SEQ ID NO: 431634 - RNA, 22 nt, Human
uggcaaaggcgcucacaugccu

SEQ ID NO: 431635 - RNA, 22 nt, Human
gugcagauccugauugcaguuc

SEQ ID NO: 431636 - RNA, 22 nt, Human
caaguucaaguccuggcucugc

SEQ ID NO: 431637 - RNA, 22 nt, Human
agcaacagcccugagguucaug

SEQ ID NO: 431638 - RNA, 22 nt, Human
cccagcucaagcagagagcuaa

SEQ ID NO: 431639 - RNA, 22 nt, Human
cugggagauugcuagagaugca

SEQ ID NO: 431640 - RNA, 22 nt, Human
cagcccugagcaaggcuuuuaa

SEQ ID NO: 431641 - RNA, 22 nt, Human
gucuuuauuacaaauccuuuuc

SEQ ID NO: 431642 - RNA, 22 nt, Human
cuugaugacucaggaggaggag

SEQ ID NO: 431643 - RNA, 22 nt, Human
guuccugacuguggaguuuggu

SEQ ID NO: 431644 - RNA, 22 nt, Human
cacaaggaccucagauggauga

SEQ ID NO: 431645 - RNA, 22 nt, Human
agggaugggaacuccuccagca

SEQ ID NO: 431646 - RNA, 17 nt, Human
aggcagguaagaguuau

SEQ ID NO: 431647 - RNA, 21 nt, Human
gcucaggcucagguucagguu

SEQ ID NO: 431648 - RNA, 22 nt, Human
ggccucugcaacuggcuguggc

SEQ ID NO: 431649 - RNA, 22 nt, Human
acaguauacauugauuaggacc

SEQ ID NO: 431650 - RNA, 22 nt, Human
cagcccagugcacgcccguuuc

SEQ ID NO: 431651 - RNA, 22 nt, Human
guucuagaugacugagcagcug

SEQ ID NO: 431652 - RNA, 20 nt, Human
auaaaauaacugccacaaga

SEQ ID NO: 431653 - RNA, 21 nt, Human
gggcucuccugaggccaugaa

SEQ ID NO: 431654 - RNA, 22 nt, Human
gcgagccucuggaguccucugg

SEQ ID NO: 431655 - RNA, 19 nt, Human
gccuggcugggaugagccc

SEQ ID NO: 431656 - RNA, 18 nt, Human
ucauucaaagucuacuga

SEQ ID NO: 431657 - RNA, 22 nt, Human
gcaggcaggagcccaacugccu

SEQ ID NO: 431658 - RNA, 22 nt, Human
agccuggagaggcgccauacac

SEQ ID NO: 431659 - RNA, 22 nt, Human
augggaggcagcagagcccagc

SEQ ID NO: 431660 - RNA, 22 nt, Human
gcuggcuggcgggugcguccuc

SEQ ID NO: 431661 - RNA, 22 nt, Human
cugcugggcagaggcugcauga

SEQ ID NO: 431662 - RNA, 22 nt, Human
uuagcauuucauuucaagagga

SEQ ID NO: 431663 - RNA, 22 nt, Human
uguguacaggccuugcuagacu

SEQ ID NO: 431664 - RNA, 21 nt, Human
aggcuguccuuugccagcccu

SEQ ID NO: 431665 - RNA, 22 nt, Human
ugcccugggcuuugcuaugacu

SEQ ID NO: 431666 - RNA, 22 nt, Human
gcagugugaccgagcuugcuuc

SEQ ID NO: 431667 - RNA, 22 nt, Human
uaaggcaggaacuggcuguuuu

SEQ ID NO: 431668 - RNA, 22 nt, Human
cugggaucagcaguagugauga

SEQ ID NO: 431669 - RNA, 22 nt, Human
gaaggcuggcucagcuuuccag

SEQ ID NO: 431670 - RNA, 22 nt, Human
ccaucagagggcugcucugcaa

SEQ ID NO: 431671 - RNA, 22 nt, Human
ugggacagggaaucugaucccc

SEQ ID NO: 431672 - RNA, 17 nt, Human
gcugguccuugguaacu

SEQ ID NO: 431673 - RNA, 22 nt, Human
agccugagcugccugccgccuc

SEQ ID NO: 431674 - RNA, 22 nt, Human
agcacugauuuuguugcacuua

SEQ ID NO: 431675 - RNA, 22 nt, Human
ccucagcucccaugagaucugc

SEQ ID NO: 431676 - RNA, 22 nt, Human
augggaggcaaagaucgcagaa

SEQ ID NO: 431677 - RNA, 22 nt, Human
accuuuggucauuuacuuuuca

SEQ ID NO: 431678 - RNA, 22 nt, Human
ggcugggcugcugggucagagc

SEQ ID NO: 431679 - RNA, 22 nt, Human
gaacagaguugaaacaaggcug

SEQ ID NO: 431680 - RNA, 21 nt, Human
ugcagagauaucugaagcaga

SEQ ID NO: 431681 - RNA, 23 nt, Human
uugggcaaaucacuaacgucucc

SEQ ID NO: 431682 - RNA, 22 nt, Human
guggguggaucaccugagguca

SEQ ID NO: 431683 - RNA, 22 nt, Human
caaagcugauacucagcaagua

SEQ ID NO: 431684 - RNA, 22 nt, Human
ggcauagcggcucagcguccag

SEQ ID NO: 431685 - RNA, 22 nt, Human
gagcugccggcccacaguacua

SEQ ID NO: 431686 - RNA, 22 nt, Human
augcaguuuuaaaucauuucag

SEQ ID NO: 431687 - RNA, 22 nt, Human
uugcagcugaggaaauugaagc

SEQ ID NO: 431688 - RNA, 22 nt, Human
cccagagaagugaagugacuug

SEQ ID NO: 431689 - RNA, 22 nt, Human
caggacacuaaaaagccaagcu

SEQ ID NO: 431690 - RNA, 22 nt, Human
cucaccaggaacagcugcggag

SEQ ID NO: 431691 - RNA, 22 nt, Human
aggucagaaaaggagagcauug

SEQ ID NO: 431692 - RNA, 22 nt, Human
auagcacuuauagauuuggucu

SEQ ID NO: 431693 - RNA, 22 nt, Human
aaguucaagaucaagguuccag

SEQ ID NO: 431694 - RNA, 22 nt, Human
cugcaguguucuggaaugcauu

SEQ ID NO: 431695 - RNA, 20 nt, Human
aggcaagguagaugucugcu

SEQ ID NO: 431696 - RNA, 22 nt, Human
augcauauaauggccagaacaa

SEQ ID NO: 431697 - RNA, 22 nt, Human
uauauuaacuugugauccugga

SEQ ID NO: 431698 - RNA, 23 nt, Human
aucuaauuucuccaaaucucuac

SEQ ID NO: 431699 - RNA, 22 nt, Human
ucugaagccuuuguacaggccu

SEQ ID NO: 431700 - RNA, 23 nt, Human
uuucacauuuacuguuagauggc

SEQ ID NO: 431701 - RNA, 22 nt, Human
uuucuacauuuguaaccagauu

SEQ ID NO: 431702 - RNA, 22 nt, Human
cccagagagcuuucuuugugcu

SEQ ID NO: 431703 - RNA, 22 nt, Human
acaggcugggcgcuuccugcgg

SEQ ID NO: 431704 - RNA, 22 nt, Human
ucugucacuauuggccagaaca

SEQ ID NO: 431705 - RNA, 22 nt, Human
gcaagacaugucuaagguuuaa

SEQ ID NO: 431706 - RNA, 22 nt, Human
auauauuugagaauauucauga

SEQ ID NO: 431707 - RNA, 22 nt, Human
agggcagagcacugaauuggga

SEQ ID NO: 431708 - RNA, 19 nt, Human
gcaggguguugacuguccc

SEQ ID NO: 431709 - RNA, 22 nt, Human
ucuuugcucuuacacaguuagu

SEQ ID NO: 431710 - RNA, 22 nt, Human
uugcugaugguauuaugcuagu

SEQ ID NO: 431711 - RNA, 22 nt, Human
auuuauugaagcuuauuacguu

SEQ ID NO: 431712 - RNA, 22 nt, Human
cugcagcuccucucugugcccc

SEQ ID NO: 431713 - RNA, 20 nt, Human
guucucacugaucugcaggg

SEQ ID NO: 431714 - RNA, 22 nt, Human
cugggaccucggggugaucaaa

SEQ ID NO: 431715 - RNA, 22 nt, Human
cccuccagccauggacccaggu

SEQ ID NO: 431716 - RNA, 22 nt, Human
aggccugggacgggagccguga

SEQ ID NO: 431717 - RNA, 22 nt, Human
uggagcagugguccuggagaug

SEQ ID NO: 431718 - RNA, 22 nt, Human
guuuuucuaaguagcgauauuu

SEQ ID NO: 431719 - RNA, 22 nt, Human
caggcucuuuugguggcaagga

SEQ ID NO: 431720 - RNA, 22 nt, Human
uaaaguuuggcagacaauaaca

SEQ ID NO: 431721 - RNA, 22 nt, Human
cagcagcucccauccgcugagc

SEQ ID NO: 431722 - RNA, 22 nt, Human
ggaagagccuggggugucaggc

SEQ ID NO: 431723 - RNA, 22 nt, Human
agacagcagaaacuagagcacu

SEQ ID NO: 431724 - RNA, 22 nt, Human
gccuggcacucacugaagaggc

SEQ ID NO: 431725 - RNA, 22 nt, Human
agcuccuggugccucagccgaa

SEQ ID NO: 431726 - RNA, 22 nt, Human
ggucccagaauugguuagcaca

SEQ ID NO: 431727 - RNA, 21 nt, Human
ccugggagaucagcugccuuc

SEQ ID NO: 431728 - RNA, 22 nt, Human
cuggccauguugccucugagac

SEQ ID NO: 431729 - RNA, 22 nt, Human
gaaagaagcuuuagauggcuau

SEQ ID NO: 431730 - RNA, 22 nt, Human
guauuuuuagguaaggaaagua

SEQ ID NO: 431731 - RNA, 22 nt, Human
cuaaggaaaggaaauacaguaa

SEQ ID NO: 431732 - RNA, 22 nt, Human
ucagcacugauagaagucaaua

SEQ ID NO: 431733 - RNA, 22 nt, Human
acaguggccucaaagaaagaga

SEQ ID NO: 431734 - RNA, 22 nt, Human
augcauauuucaugaaucuuug

SEQ ID NO: 431735 - RNA, 22 nt, Human
gagagacagcagaacgugcagc

SEQ ID NO: 431736 - RNA, 22 nt, Human
uuucuaguauauaacuagaucu

SEQ ID NO: 431737 - RNA, 22 nt, Human
ugaggccagucucaucacaggc

SEQ ID NO: 431738 - RNA, 22 nt, Human
uuuaaauuauaguuaaugucug

SEQ ID NO: 431739 - RNA, 22 nt, Human
uuuugguucugggauacagaga

SEQ ID NO: 431740 - RNA, 22 nt, Human
cuguagccaguuuggccucacc

SEQ ID NO: 431741 - RNA, 22 nt, Human
ggcaggcaaugaggaugggaag

SEQ ID NO: 431742 - RNA, 22 nt, Human
uguaggaguccaaucaggagac

SEQ ID NO: 431743 - RNA, 22 nt, Human
ucagcagguggugggcagguga

SEQ ID NO: 431744 - RNA, 22 nt, Human
ucagcucugcaaggucaccucc

SEQ ID NO: 431745 - RNA, 22 nt, Human
uuuauuagauuaucaaagaggu

SEQ ID NO: 431746 - RNA, 20 nt, Human
aaacauucauguacaaguga

SEQ ID NO: 431747 - RNA, 22 nt, Human
cauuuucucaaugaacccucuu

SEQ ID NO: 431748 - RNA, 22 nt, Human
aaggcagcucagcucauggcag

SEQ ID NO: 431749 - RNA, 22 nt, Human
uucucuaagccuuaguuucuuc

SEQ ID NO: 431750 - RNA, 22 nt, Human
gaagcccuauccucuccuggga

SEQ ID NO: 431751 - RNA, 22 nt, Human
gugauccgaugucagucgcaga

SEQ ID NO: 431752 - RNA, 22 nt, Human
cugggagaggcugcuccgcucu

SEQ ID NO: 431753 - RNA, 21 nt, Human
gggggaagaggaguugcuagu

SEQ ID NO: 431754 - RNA, 22 nt, Human
cuuuacaauucaagggaacucu

SEQ ID NO: 431755 - RNA, 22 nt, Human
gccugccuuuguaugacccuga

SEQ ID NO: 431756 - RNA, 22 nt, Human
gagcuggugugugcccgagcac

SEQ ID NO: 431757 - RNA, 22 nt, Human
augagcccuggaggcauuuuuu

SEQ ID NO: 431758 - RNA, 22 nt, Human
aggcuccagggcugugugggag

SEQ ID NO: 431759 - RNA, 22 nt, Human
cauucaaacauuaauuuauuca

SEQ ID NO: 431760 - RNA, 22 nt, Human
gccugggaagacuaagugggag

SEQ ID NO: 431761 - RNA, 18 nt, Human
uggcagcuagguaaagaa

SEQ ID NO: 431762 - RNA, 22 nt, Human
aagagaauacaagcaggcagga

SEQ ID NO: 431763 - RNA, 22 nt, Human
caauuauauuuagaaugauaca

SEQ ID NO: 431764 - RNA, 22 nt, Human
uauacaaugaguacauucuggg

SEQ ID NO: 431765 - RNA, 22 nt, Human
gacagcagacagaacuaccugc

SEQ ID NO: 431766 - RNA, 22 nt, Human
uguccuccagcagcaugguaug

SEQ ID NO: 431767 - RNA, 22 nt, Human
auugcaaagcguagacucuaaa

SEQ ID NO: 431768 - RNA, 22 nt, Human
gauuuggcuuggaugauuaaac

SEQ ID NO: 431769 - RNA, 22 nt, Human
gggcucugguacuuccuggcuc

SEQ ID NO: 431770 - RNA, 22 nt, Human
uagucaaucaguauguauugga

SEQ ID NO: 431771 - RNA, 22 nt, Human
agcuguguagggaaucagagaa

SEQ ID NO: 431772 - RNA, 22 nt, Human
ccugggcuucugucuagauguu

SEQ ID NO: 431773 - RNA, 22 nt, Human
ucauuuugccugccauuugagu

SEQ ID NO: 431774 - RNA, 22 nt, Human
acaugcaaagccacaggacccg

SEQ ID NO: 431775 - RNA, 21 nt, Human
agaggcaggcauuaaguacac

SEQ ID NO: 431776 - RNA, 17 nt, Human
uccuucagggccucaca

SEQ ID NO: 431777 - RNA, 22 nt, Human
uuccucagggcggaugggcagg

SEQ ID NO: 431778 - RNA, 22 nt, Human
caugaacaaauucuguuugagg

SEQ ID NO: 431779 - RNA, 22 nt, Human
uuuuauacacaugaacaugcag

SEQ ID NO: 431780 - RNA, 22 nt, Human
uggcccugaggggcugugcccc

SEQ ID NO: 431781 - RNA, 22 nt, Human
uucauucauucaugaauguuaa

SEQ ID NO: 431782 - RNA, 22 nt, Human
ugcugccaccugguggcugaag

SEQ ID NO: 431783 - RNA, 22 nt, Human
gaguuacagagaggauuauggu

SEQ ID NO: 431784 - RNA, 22 nt, Human
uucuguguggguagcuccuguu

SEQ ID NO: 431785 - RNA, 22 nt, Human
aaggcaggaugggaaaagauuu

SEQ ID NO: 431786 - RNA, 22 nt, Human
acagugucuccugguacccagu

SEQ ID NO: 431787 - RNA, 22 nt, Human
gaaggcaagcuuuggauaugag

SEQ ID NO: 431788 - RNA, 22 nt, Human
ggauaagaaaauuguaauaacu

SEQ ID NO: 431789 - RNA, 22 nt, Human
gugaacaguucauuuuaucaug

SEQ ID NO: 431790 - RNA, 22 nt, Human
aagaaggcggaccagaagggag

SEQ ID NO: 431791 - RNA, 22 nt, Human
ugccucugugugcaggugagca

SEQ ID NO: 431792 - RNA, 22 nt, Human
cuauuugaauugucacaggcua

SEQ ID NO: 431793 - RNA, 20 nt, Human
aaaggaauauaugaaguaua

SEQ ID NO: 431794 - RNA, 20 nt, Human
aggaaggaaguuugcaugga

SEQ ID NO: 431795 - RNA, 22 nt, Human
ugcccagguuugagugcccaag

SEQ ID NO: 431796 - RNA, 22 nt, Human
uaaaugcagcaguuucuguucu

SEQ ID NO: 431797 - RNA, 22 nt, Human
ugcagcugcaaguccaggucag

SEQ ID NO: 431798 - RNA, 22 nt, Human
cccagacauaacagcagagagg

SEQ ID NO: 431799 - RNA, 22 nt, Human
ccucugcacuucaccuuagcuc

SEQ ID NO: 431800 - RNA, 22 nt, Human
aggugccagugcuguggucccc

SEQ ID NO: 431801 - RNA, 22 nt, Human
gccucuggaguugcuuguaaau

SEQ ID NO: 431802 - RNA, 22 nt, Human
uccuggggcugcaaggccuguc

SEQ ID NO: 431803 - RNA, 22 nt, Human
aaugucauuuuuaaaugugaga

SEQ ID NO: 431804 - RNA, 22 nt, Human
ccuuucucuuugcugaucaugu

SEQ ID NO: 431805 - RNA, 22 nt, Human
gaaauauuucucuugagccccu

SEQ ID NO: 431806 - RNA, 22 nt, Human
ugggcagauguggcucuccuug

SEQ ID NO: 431807 - RNA, 22 nt, Human
gaugauuuuugccagugugaug

SEQ ID NO: 431808 - RNA, 22 nt, Human
ucauaaagcucuuccaaaugua

SEQ ID NO: 431809 - RNA, 22 nt, Human
aagaguggagcuggaaaguggg

SEQ ID NO: 431810 - RNA, 22 nt, Human
agggacagaugaaugacugagu

SEQ ID NO: 431811 - RNA, 22 nt, Human
ggcaggcagauggcugcaccaa

SEQ ID NO: 431812 - RNA, 22 nt, Human
uugcuuuauuggguuuacugcc

SEQ ID NO: 431813 - RNA, 22 nt, Human
gagcccuguagcaagucauguc

SEQ ID NO: 431814 - RNA, 22 nt, Human
ugaagcuagcaggaagagcagg

SEQ ID NO: 431815 - RNA, 22 nt, Human
uuugcaaaugaagcucugagga

SEQ ID NO: 431816 - RNA, 22 nt, Human
gcaagcagacauucagguaggu

SEQ ID NO: 431817 - RNA, 22 nt, Human
uuaacauuaaaagcagcauuuu

SEQ ID NO: 431818 - RNA, 22 nt, Human
cccagcaggucggugcugccug

SEQ ID NO: 431819 - RNA, 22 nt, Human
uggaaagaaaaacaggccauga

SEQ ID NO: 431820 - RNA, 22 nt, Human
agaggucagaggucgccagguc

SEQ ID NO: 431821 - RNA, 22 nt, Human
gcugagcucccagcaguaucug

SEQ ID NO: 431822 - RNA, 22 nt, Human
gcaaacauuccacagaaggaag

SEQ ID NO: 431823 - RNA, 17 nt, Human
cuuguggccaguuuuua

SEQ ID NO: 431824 - RNA, 22 nt, Human
ucuggcugcguggccuuuagca

SEQ ID NO: 431825 - RNA, 22 nt, Human
caaacugccaaugguuuuuaua

SEQ ID NO: 431826 - RNA, 22 nt, Human
guuuuaguggguggccacugau

SEQ ID NO: 431827 - RNA, 22 nt, Human
gcuccaggauaauaaaguuguu

SEQ ID NO: 431828 - RNA, 22 nt, Human
cucugcccagugcccacaggag

SEQ ID NO: 431829 - RNA, 22 nt, Human
gcagacagacugcagugauuuu

SEQ ID NO: 431830 - RNA, 23 nt, Human
ucccugggcccgugccagcggug

SEQ ID NO: 431831 - RNA, 22 nt, Human
uccuuccugcucuaacauucag

SEQ ID NO: 431832 - RNA, 22 nt, Human
acauucaaggcagcacugagug

SEQ ID NO: 431833 - RNA, 22 nt, Human
cagguccucgggggaggccggc

SEQ ID NO: 431834 - RNA, 22 nt, Human
cuuuucuuauguggacguaccu

SEQ ID NO: 431835 - RNA, 22 nt, Human
aggcucuguaugaagguuuggg

SEQ ID NO: 431836 - RNA, 22 nt, Human
ugggcugcugucugcacaugcu

SEQ ID NO: 431837 - RNA, 20 nt, Human
ccagguggugccuggagagg

SEQ ID NO: 431838 - RNA, 22 nt, Human
ccugggcuuucggcggcuuccu

SEQ ID NO: 431839 - RNA, 22 nt, Human
uccucugggcucccugcaacag

SEQ ID NO: 431840 - RNA, 22 nt, Human
cagguccugcagggagaguaaa

SEQ ID NO: 431841 - RNA, 22 nt, Human
gcucuggcuacuccacccuguu

SEQ ID NO: 431842 - RNA, 22 nt, Human
agccacagagguugaugugguu

SEQ ID NO: 431843 - RNA, 22 nt, Human
ucauugaagcccuugacaagcc

SEQ ID NO: 431844 - RNA, 19 nt, Human
acacaaugacacauauaua

SEQ ID NO: 431845 - RNA, 22 nt, Human
agcuccuggacgaacagggagu

SEQ ID NO: 431846 - RNA, 22 nt, Human
uucacaauuaacuuuauacuua

SEQ ID NO: 431847 - RNA, 22 nt, Human
uguccuagauccagcugugcug

SEQ ID NO: 431848 - RNA, 22 nt, Human
agcauucaaguaauucacuugg

SEQ ID NO: 431849 - RNA, 22 nt, Human
caguacuuugaagauauuuuag

SEQ ID NO: 431850 - RNA, 22 nt, Human
ggauugagagcacugguagcug

SEQ ID NO: 431851 - RNA, 22 nt, Human
uuugcagcaauucguuauacag

SEQ ID NO: 431852 - RNA, 22 nt, Human
uagcagcauuuuuguagaguau

SEQ ID NO: 431853 - RNA, 22 nt, Human
cagaagcacuaggaggaaacgu

SEQ ID NO: 431854 - RNA, 22 nt, Human
uagugucuguugcuuuuguuca

SEQ ID NO: 431855 - RNA, 22 nt, Human
uaguccagccuuggguguagcc

SEQ ID NO: 431856 - RNA, 22 nt, Human
ucccagagugagccaggggcag

SEQ ID NO: 431857 - RNA, 22 nt, Human
uccccacaucucugcaucaggc

SEQ ID NO: 431858 - RNA, 21 nt, Human
ucuuauacagcaauagaucug

SEQ ID NO: 431859 - RNA, 22 nt, Human
aucuuucuaugguacuuucucc

SEQ ID NO: 431860 - RNA, 21 nt, Human
uuccuggggacuuccguggga

SEQ ID NO: 431861 - RNA, 21 nt, Human
uugaaggaucacuucuguacc

SEQ ID NO: 431862 - RNA, 20 nt, Human
uuuuccucguguuuguucua

SEQ ID NO: 431863 - RNA, 23 nt, Human
cagcugguugugggaguggcugc

SEQ ID NO: 431864 - RNA, 22 nt, Human
uuccaagugucagaucagauuu

SEQ ID NO: 431865 - RNA, 22 nt, Human
uuguuuaaaagaaaucauagaa

SEQ ID NO: 431866 - RNA, 22 nt, Human
ucuuugcacacagcgauucuuc

SEQ ID NO: 431867 - RNA, 22 nt, Human
ucacuuugacggccaacuucua

SEQ ID NO: 431868 - RNA, 22 nt, Human
ucuaaauucaguuuauuuugau

SEQ ID NO: 431869 - RNA, 23 nt, Human
acuuaaaugguucuuuaucucag

SEQ ID NO: 431870 - RNA, 20 nt, Human
agaaggcauuccucauucuu

SEQ ID NO: 431871 - RNA, 22 nt, Human
uuacagcacagugcuuuuacug

SEQ ID NO: 431872 - RNA, 22 nt, Human
agcagaugagccucaugacugg

SEQ ID NO: 431873 - RNA, 22 nt, Human
gccuuugcugugacaaugcugg

SEQ ID NO: 431874 - RNA, 22 nt, Human
cuucucccugggggcucuuuau

SEQ ID NO: 431875 - RNA, 22 nt, Human
agugugugcaugcauucgugca

SEQ ID NO: 431876 - RNA, 22 nt, Human
cuccacucaacaagcccagugu

SEQ ID NO: 431877 - RNA, 22 nt, Human
gcucaagggaugggagugggug

SEQ ID NO: 431878 - RNA, 22 nt, Human
uagcaucuguacugacauaauc

SEQ ID NO: 431879 - RNA, 22 nt, Human
cccagguccccaccugucugcu

SEQ ID NO: 431880 - RNA, 22 nt, Human
ucugggcugcugugcagugacc

SEQ ID NO: 431881 - RNA, 22 nt, Human
auguguguaaacaaguauaauu

SEQ ID NO: 431882 - RNA, 22 nt, Human
aauuuuacaaaauaccuccgau

SEQ ID NO: 431883 - RNA, 19 nt, Human
gcugugccucucuccugcu

SEQ ID NO: 431884 - RNA, 22 nt, Human
aauuauauugaaguugaauguc

SEQ ID NO: 431885 - RNA, 22 nt, Human
ggccgggcaggucucagccagc

SEQ ID NO: 431886 - RNA, 22 nt, Human
uccugaggcuaaagugcagugg

SEQ ID NO: 431887 - RNA, 22 nt, Human
cagagcuggagaaguggauuua

SEQ ID NO: 431888 - RNA, 22 nt, Human
cacagggagaggaacagcgcag

SEQ ID NO: 431889 - RNA, 22 nt, Human
caggaggcccaaagggcgcaga

SEQ ID NO: 431890 - RNA, 22 nt, Human
cacuuuauuauaaauuugagag

SEQ ID NO: 431891 - RNA, 21 nt, Human
aggugcagagccagggaccag

SEQ ID NO: 431892 - RNA, 22 nt, Human
ggugggcacccgagacuggauc

SEQ ID NO: 431893 - RNA, 22 nt, Human
cagcagagcauuugguaggagg

SEQ ID NO: 431894 - RNA, 22 nt, Human
gcucccagauuucagccuugug

SEQ ID NO: 431895 - RNA, 22 nt, Human
gaaaucuacgauuagugaaaau

SEQ ID NO: 431896 - RNA, 22 nt, Human
agucuggguggcugagcuacag

SEQ ID NO: 431897 - RNA, 22 nt, Human
ucagagaaaggccaaaauauca

SEQ ID NO: 431898 - RNA, 22 nt, Human
ugaaaucaauaauuggugauug

SEQ ID NO: 431899 - RNA, 22 nt, Human
ucucugagaucagccacugacu

SEQ ID NO: 431900 - RNA, 22 nt, Human
agcuguuuucuucuaggaagac

SEQ ID NO: 431901 - RNA, 22 nt, Human
uuuuuguagucauuagaagagg

SEQ ID NO: 431902 - RNA, 22 nt, Human
auguguguauauauagucauuu

SEQ ID NO: 431903 - RNA, 21 nt, Human
gacagcaacuguaguccucuu

SEQ ID NO: 431904 - RNA, 22 nt, Human
agcaggcuccuuccuucucugg

SEQ ID NO: 431905 - RNA, 22 nt, Human
ugugcuauuacacauuuauuua

SEQ ID NO: 431906 - RNA, 22 nt, Human
aauaguugugaaucaggacuag

SEQ ID NO: 431907 - RNA, 21 nt, Human
ggccucugucauccugggaag

SEQ ID NO: 431908 - RNA, 22 nt, Human
ugugaagguuaaauaauaugau

SEQ ID NO: 431909 - RNA, 22 nt, Human
agagcaggcauaaagcuuugaa

SEQ ID NO: 431910 - RNA, 22 nt, Human
gcaggugggggucggugcaucu

SEQ ID NO: 431911 - RNA, 22 nt, Human
uguaccaugcgacgccucucac

SEQ ID NO: 431912 - RNA, 22 nt, Human
ccugguguugccaaucugugcc

SEQ ID NO: 431913 - RNA, 22 nt, Human
ugggaguggggcauagaaggua

SEQ ID NO: 431914 - RNA, 22 nt, Human
cagaagcagugagagaugugca

SEQ ID NO: 431915 - RNA, 20 nt, Human
agcaggugacggggccugcu

SEQ ID NO: 431916 - RNA, 22 nt, Human
cccagccagccucuucccauau

SEQ ID NO: 431917 - RNA, 22 nt, Human
agcuccuggcaaggucauggug

SEQ ID NO: 431918 - RNA, 18 nt, Human
agccuggaggguugaagu

SEQ ID NO: 431919 - RNA, 19 nt, Human
cucugccucuggcuguggc

SEQ ID NO: 431920 - RNA, 22 nt, Human
aacaguacaacuccacaagacu

SEQ ID NO: 431921 - RNA, 22 nt, Human
agaaggcagguuuuaaaauguc

SEQ ID NO: 431922 - RNA, 22 nt, Human
acaggcugcugggcuccgugcu

SEQ ID NO: 431923 - RNA, 22 nt, Human
acauaauagguaccugaauaau

SEQ ID NO: 431924 - RNA, 22 nt, Human
aaugaagacacaucuuucucau

SEQ ID NO: 431925 - RNA, 19 nt, Human
agcagcagaagugugccuu

SEQ ID NO: 431926 - RNA, 22 nt, Human
agauuuaaagcaguauucgcaa

SEQ ID NO: 431927 - RNA, 22 nt, Human
uuauacccuccauaccuggccu

SEQ ID NO: 431928 - RNA, 22 nt, Human
ccagcagccagagaaggaccuc

SEQ ID NO: 431929 - RNA, 22 nt, Human
aggcagcuuucuguaggggugu

SEQ ID NO: 431930 - RNA, 22 nt, Human
auuaaacugagcaaauuaacau

SEQ ID NO: 431931 - RNA, 22 nt, Human
caggaggcuccuagggcucugu

SEQ ID NO: 431932 - RNA, 21 nt, Human
aggcucucauccagggaccca

SEQ ID NO: 431933 - RNA, 22 nt, Human
aaguuuuugguagagaaaagua

SEQ ID NO: 431934 - RNA, 22 nt, Human
ugcugccaggucuugcugucca

SEQ ID NO: 431935 - RNA, 22 nt, Human
gucuggaagaacuagggauguu

SEQ ID NO: 431936 - RNA, 21 nt, Human
ugcagcugacacccuuuggga

SEQ ID NO: 431937 - RNA, 22 nt, Human
ugaagcuggaaguuagguagac

SEQ ID NO: 431938 - RNA, 22 nt, Human
ucagcugcagcaggcaccauuu

SEQ ID NO: 431939 - RNA, 22 nt, Human
cuggggagugaagguaauuaca

SEQ ID NO: 431940 - RNA, 22 nt, Human
gggcgagggcgaaagcgagagc

SEQ ID NO: 431941 - RNA, 22 nt, Human
ugggcagauuaaugcaguggcu

SEQ ID NO: 431942 - RNA, 22 nt, Human
uucaaaguaaaaauguguucac

SEQ ID NO: 431943 - RNA, 22 nt, Human
augucuuucuugugucccaaga

SEQ ID NO: 431944 - RNA, 20 nt, Human
cuguccccgaggucaccagg

SEQ ID NO: 431945 - RNA, 17 nt, Human
ccugcccagagacagau

SEQ ID NO: 431946 - RNA, 22 nt, Human
ugacacauaccgaaaauauuug

SEQ ID NO: 431947 - RNA, 22 nt, Human
cugcccaguuugggagccuuuc

SEQ ID NO: 431948 - RNA, 22 nt, Human
auucucagaucuuagaggaaua

SEQ ID NO: 431949 - RNA, 22 nt, Human
agcccagaggcugggcgugcau

SEQ ID NO: 431950 - RNA, 22 nt, Human
uuuuauagcugaauaguauucc

SEQ ID NO: 431951 - RNA, 22 nt, Human
ggaggaugccaagcugugcaca

SEQ ID NO: 431952 - RNA, 21 nt, Human
gcccagagggagccaagccca

SEQ ID NO: 431953 - RNA, 22 nt, Human
gcuggcagcauuagacccuggg

SEQ ID NO: 431954 - RNA, 22 nt, Human
caggaguggugugagggacucc

SEQ ID NO: 431955 - RNA, 22 nt, Human
acuuugcaagguacuaacugua

SEQ ID NO: 431956 - RNA, 23 nt, Human
ccuggguuucagagcugcuuuuc

SEQ ID NO: 431957 - RNA, 22 nt, Human
gaauuucauuuguuuccuacca

SEQ ID NO: 431958 - RNA, 22 nt, Human
cuuguugggucgugaauucugu

SEQ ID NO: 431959 - RNA, 22 nt, Human
cagaggaacguuuggauugauu

SEQ ID NO: 431960 - RNA, 22 nt, Human
ucagccuacacuccaacagcau

SEQ ID NO: 431961 - RNA, 21 nt, Human
ggaguuuuucuggaagggacu

SEQ ID NO: 431962 - RNA, 22 nt, Human
ugcuagcacugugcagucuacg

SEQ ID NO: 431963 - RNA, 22 nt, Human
aggacagguguagugggcucug

SEQ ID NO: 431964 - RNA, 22 nt, Human
agcuguuuccauaaaugagaca

SEQ ID NO: 431965 - RNA, 22 nt, Human
agcaacuagccaggaugcagag

SEQ ID NO: 431966 - RNA, 22 nt, Human
aagugauucuagucaugauucu

SEQ ID NO: 431967 - RNA, 22 nt, Human
agccagagagccccagguucua

SEQ ID NO: 431968 - RNA, 22 nt, Human
uccuuggagcucuccaagggau

SEQ ID NO: 431969 - RNA, 22 nt, Human
uucagaaugagaauggaugggu

SEQ ID NO: 431970 - RNA, 22 nt, Human
accacuuaucaucacuaucuca

SEQ ID NO: 431971 - RNA, 22 nt, Human
cugggugaguugaugaaggaga

SEQ ID NO: 431972 - RNA, 22 nt, Human
cagagcagugaggaguugugua

SEQ ID NO: 431973 - RNA, 19 nt, Human
ucugucacuggggguauuc

SEQ ID NO: 431974 - RNA, 18 nt, Human
ucagaggagauaccuaaa

SEQ ID NO: 431975 - RNA, 22 nt, Human
uccuccagcccucuaggaaaau

SEQ ID NO: 431976 - RNA, 22 nt, Human
ucccagagcagaugugcuaaag

SEQ ID NO: 431977 - RNA, 22 nt, Human
uucaggccuaauuucuagcccc

SEQ ID NO: 431978 - RNA, 22 nt, Human
ucaggccuuguccugaccuccu

SEQ ID NO: 431979 - RNA, 22 nt, Human
gagcaacaguggcagugguggg

SEQ ID NO: 431980 - RNA, 22 nt, Human
auucaaacaggaagaaaucauu

SEQ ID NO: 431981 - RNA, 22 nt, Human
gcugccacgaucucugcuguag

SEQ ID NO: 431982 - RNA, 20 nt, Human
auugaaauuuuucugagauu

SEQ ID NO: 431983 - RNA, 17 nt, Human
agacacugagccaagua

SEQ ID NO: 431984 - RNA, 22 nt, Human
uucucuaauggugaugauuaga

SEQ ID NO: 431985 - RNA, 22 nt, Human
uucaguaaggauaauaaacaga

SEQ ID NO: 431986 - RNA, 22 nt, Human
aaggcccuuccaccaguccucg

SEQ ID NO: 431987 - RNA, 22 nt, Human
cagggaagagccgaugcugcag

SEQ ID NO: 431988 - RNA, 21 nt, Human
guucaaguauuuuuuucgcug

SEQ ID NO: 431989 - RNA, 22 nt, Human
ucacugcagagaccucuaguca

SEQ ID NO: 431990 - RNA, 22 nt, Human
ucugggagcacacgcagugauc

SEQ ID NO: 431991 - RNA, 22 nt, Human
cugguucaugguggaaugacau

SEQ ID NO: 431992 - RNA, 22 nt, Human
ugagagcuugaguaucacuggc

SEQ ID NO: 431993 - RNA, 22 nt, Human
uugauuuuuuucuacuaugcgc

SEQ ID NO: 431994 - RNA, 21 nt, Human
agacagaacaacugcucucca

SEQ ID NO: 431995 - RNA, 22 nt, Human
uuauagcaggugacuaaugagu

SEQ ID NO: 431996 - RNA, 22 nt, Human
ggcucccuagggagagugggag

SEQ ID NO: 431997 - RNA, 22 nt, Human
ugcauuauugaaggcccugugg

SEQ ID NO: 431998 - RNA, 22 nt, Human
uuccuguaucugcuucuuacua

SEQ ID NO: 431999 - RNA, 22 nt, Human
uucuuuuagucauucagggaag

SEQ ID NO: 432000 - RNA, 22 nt, Human
acacuuugcuacauuucauauu

SEQ ID NO: 432001 - RNA, 21 nt, Human
aagcuuuuccugagaguuguc

SEQ ID NO: 432002 - RNA, 23 nt, Human
agcagcagugagaggugucuuac

SEQ ID NO: 432003 - RNA, 22 nt, Human
ucauuuguaccauuuuuuaaga

SEQ ID NO: 432004 - RNA, 22 nt, Human
uauuguacauuucaaaguagcu

SEQ ID NO: 432005 - RNA, 22 nt, Human
ugacacaggcagcucccagcac

SEQ ID NO: 432006 - RNA, 22 nt, Human
gaggccugaggcugccuggagc

SEQ ID NO: 432007 - RNA, 22 nt, Human
cucacugcccugaaguuggguu

SEQ ID NO: 432008 - RNA, 22 nt, Human
gcaacuuuagaaaaaucuauaa

SEQ ID NO: 432009 - RNA, 22 nt, Human
gcugcccugucugcagcaggac

SEQ ID NO: 432010 - RNA, 22 nt, Human
aaggaaaggaugagcaugcauu

SEQ ID NO: 432011 - RNA, 22 nt, Human
aagagcuggcccaaucugagca

SEQ ID NO: 432012 - RNA, 22 nt, Human
aaaggcauuuuaauucuaaaga

SEQ ID NO: 432013 - RNA, 22 nt, Human
uuguuguuggagccaauaugca

SEQ ID NO: 432014 - RNA, 22 nt, Human
cagaagcauugacuccuugcuc

SEQ ID NO: 432015 - RNA, 22 nt, Human
gccuggaggaauguagcugagg

SEQ ID NO: 432016 - RNA, 22 nt, Human
auucuuauuauaguaaaacagu

SEQ ID NO: 432017 - RNA, 22 nt, Human
acugcagccuuugggcucauaa

SEQ ID NO: 432018 - RNA, 17 nt, Human
ggacacagcucauggcu

SEQ ID NO: 432019 - RNA, 22 nt, Human
gacaaggagccaccagucacgu

SEQ ID NO: 432020 - RNA, 22 nt, Human
ggccugaggccaccagcagccc

SEQ ID NO: 432021 - RNA, 22 nt, Human
ccuggcagcuccuccccggcgg

SEQ ID NO: 432022 - RNA, 22 nt, Human
uugcuuuugggaaaacaugccu

SEQ ID NO: 432023 - RNA, 20 nt, Human
gagccugggaagucuaaggu

SEQ ID NO: 432024 - RNA, 19 nt, Human
ugggccugcaucugggucu

SEQ ID NO: 432025 - RNA, 22 nt, Human
cuggugggagcagcaggcagcu

SEQ ID NO: 432026 - RNA, 22 nt, Human
cccagcauccucagggagcggg

SEQ ID NO: 432027 - RNA, 22 nt, Human
aagagucuauuggaacuagaca

SEQ ID NO: 432028 - RNA, 22 nt, Human
aggcagguuggggaaaagcacu

SEQ ID NO: 432029 - RNA, 22 nt, Human
cacuuugcuuagagaacaaggc

SEQ ID NO: 432030 - RNA, 19 nt, Human
ucugcccaguugucugccc

SEQ ID NO: 432031 - RNA, 22 nt, Human
gcaggcagagguggaggagaca

SEQ ID NO: 432032 - RNA, 22 nt, Human
acagccaggaauucuggagaag

SEQ ID NO: 432033 - RNA, 22 nt, Human
caggagcugggucuggaagcag

SEQ ID NO: 432034 - RNA, 22 nt, Human
uggcaaacuggaggaagcccug

SEQ ID NO: 432035 - RNA, 22 nt, Human
ugggcaaaggcuguaacccauc

SEQ ID NO: 432036 - RNA, 22 nt, Human
auauucucugcugcuuuugugu

SEQ ID NO: 432037 - RNA, 22 nt, Human
cuccccuccuuaggucuucuag

SEQ ID NO: 432038 - RNA, 21 nt, Human
cuuuucuagucccagccccgc

SEQ ID NO: 432039 - RNA, 22 nt, Human
guuucagaaaugguuuaugcaa

SEQ ID NO: 432040 - RNA, 22 nt, Human
ucugccuggauuuuggaaagcu

SEQ ID NO: 432041 - RNA, 22 nt, Human
uacaggacagauguuuacagga

SEQ ID NO: 432042 - RNA, 22 nt, Human
uggcacugccuggcagggcccc

SEQ ID NO: 432043 - RNA, 22 nt, Human
gacuuugccacuugcuccagcu

SEQ ID NO: 432044 - RNA, 22 nt, Human
gaauuucaggacaacuggaagg

SEQ ID NO: 432045 - RNA, 22 nt, Human
agcugguggauuaugcuguaca

SEQ ID NO: 432046 - RNA, 22 nt, Human
cacugguauuugaaaauagaug

SEQ ID NO: 432047 - RNA, 22 nt, Human
aaugccuucccauuuauacuuu

SEQ ID NO: 432048 - RNA, 22 nt, Human
augggagugugcuugaggaguu

SEQ ID NO: 432049 - RNA, 22 nt, Human
agcacaguuucuuuuccuuguc

SEQ ID NO: 432050 - RNA, 22 nt, Human
aacuuaaugauuucaugcaugu

SEQ ID NO: 432051 - RNA, 22 nt, Human
gacaggcaauuaccagcgccca

SEQ ID NO: 432052 - RNA, 22 nt, Human
acagagaugucagauuggcagc

SEQ ID NO: 432053 - RNA, 22 nt, Human
guuccugaugcuuugaaauuca

SEQ ID NO: 432054 - RNA, 22 nt, Human
uuacuauaugcguggcaggugc

SEQ ID NO: 432055 - RNA, 22 nt, Human
agaggcagaaguguucaaaccc

SEQ ID NO: 432056 - RNA, 22 nt, Human
gaacaaagacauggaggaggau

SEQ ID NO: 432057 - RNA, 22 nt, Human
aacaguguguacacaucauagg

SEQ ID NO: 432058 - RNA, 22 nt, Human
ugcaauauguugcauuguaugg

SEQ ID NO: 432059 - RNA, 22 nt, Human
ccugggcugggcgucucauggg

SEQ ID NO: 432060 - RNA, 22 nt, Human
cagcugccacaccucuuucucu

SEQ ID NO: 432061 - RNA, 22 nt, Human
cuguuucauagaguugugaauu

SEQ ID NO: 432062 - RNA, 22 nt, Human
cuaaauacuagccuucagauuu

SEQ ID NO: 432063 - RNA, 22 nt, Human
guauuuuucaguuaggagcuua

SEQ ID NO: 432064 - RNA, 22 nt, Human
ugcaacagacuuuauuaacucu

SEQ ID NO: 432065 - RNA, 23 nt, Human
uggagguuuuacugaguugagga

SEQ ID NO: 432066 - RNA, 22 nt, Human
gauucaaagacagacucauuuc

SEQ ID NO: 432067 - RNA, 22 nt, Human
gagaguccuuaguuugcaggua

SEQ ID NO: 432068 - RNA, 22 nt, Human
ggcagagcuuguuccuucuguu

SEQ ID NO: 432069 - RNA, 17 nt, Human
uugcccugauuuuuaac

SEQ ID NO: 432070 - RNA, 22 nt, Human
ggcugccuucagacuccagcuu

SEQ ID NO: 432071 - RNA, 22 nt, Human
uugcaacucuugaaaagcauug

SEQ ID NO: 432072 - RNA, 20 nt, Human
ccagaggcugacagacuuug

SEQ ID NO: 432073 - RNA, 22 nt, Human
cucaggccauuccuaccaaggg

SEQ ID NO: 432074 - RNA, 17 nt, Human
aggcagcucagaacauc

SEQ ID NO: 432075 - RNA, 22 nt, Human
gugcacagagcccagggccgcg

SEQ ID NO: 432076 - RNA, 22 nt, Human
ucacucaguuuuuggccucugc

SEQ ID NO: 432077 - RNA, 22 nt, Human
ugugccugaguuggcugaguac

SEQ ID NO: 432078 - RNA, 22 nt, Human
uauaaagcugacucaugaaacu

SEQ ID NO: 432079 - RNA, 22 nt, Human
ugcugucccccgugucugggcu

SEQ ID NO: 432080 - RNA, 22 nt, Human
ggcaccugaugacugcuucccu

SEQ ID NO: 432081 - RNA, 22 nt, Human
agcccaggucuggcccagccug

SEQ ID NO: 432082 - RNA, 22 nt, Human
cuggugagacgguugacaggag

SEQ ID NO: 432083 - RNA, 22 nt, Human
ugcaucuguucagagcugucga

SEQ ID NO: 432084 - RNA, 22 nt, Human
agcccuguugucugaugauggg

SEQ ID NO: 432085 - RNA, 22 nt, Human
uacacauguuuggcaaguaugu

SEQ ID NO: 432086 - RNA, 22 nt, Human
aaggcagcaagaauuccagguu

SEQ ID NO: 432087 - RNA, 20 nt, Human
uucuugauuugauccugguu

SEQ ID NO: 432088 - RNA, 21 nt, Human
uuugaaagcuacaucuauagc

SEQ ID NO: 432089 - RNA, 22 nt, Human
ucuauuuacagaaagcagaauu

SEQ ID NO: 432090 - RNA, 22 nt, Human
cagcuguugacugguacaugaa

SEQ ID NO: 432091 - RNA, 22 nt, Human
caucuuuaacaauuuacaaugu

SEQ ID NO: 432092 - RNA, 22 nt, Human
acagacagggcaccugccuccu

SEQ ID NO: 432093 - RNA, 22 nt, Human
gccuguucuccagcauccaggu

SEQ ID NO: 432094 - RNA, 22 nt, Human
caagacaugcaauugccacuuu

SEQ ID NO: 432095 - RNA, 20 nt, Human
cagggcacacugcagccucg

SEQ ID NO: 432096 - RNA, 22 nt, Human
aaggcaauugauuauuuuuccu

SEQ ID NO: 432097 - RNA, 22 nt, Human
cacucccuucaggagccuagga

SEQ ID NO: 432098 - RNA, 22 nt, Human
ggcugagcaauuuugaugacau

SEQ ID NO: 432099 - RNA, 22 nt, Human
gugcccugugaacuguaaggaa

SEQ ID NO: 432100 - RNA, 18 nt, Human
gcucagguauagacaggg

SEQ ID NO: 432101 - RNA, 22 nt, Human
uuugcuuaaaagcggagcaaga

SEQ ID NO: 432102 - RNA, 19 nt, Human
caagauuuguucacacaug

SEQ ID NO: 432103 - RNA, 20 nt, Human
gugccuggagaagaggcugu

SEQ ID NO: 432104 - RNA, 22 nt, Human
ccccuggguccaggcuucucug

SEQ ID NO: 432105 - RNA, 22 nt, Human
guuuaacaucugugaagcugcu

SEQ ID NO: 432106 - RNA, 22 nt, Human
gcccagagugaguccugggccc

SEQ ID NO: 432107 - RNA, 22 nt, Human
gcugcccuaauaucacauguua

SEQ ID NO: 432108 - RNA, 22 nt, Human
uagcauaggaaaguacugggaa

SEQ ID NO: 432109 - RNA, 22 nt, Human
uacaaguacuguggcuuugaau

SEQ ID NO: 432110 - RNA, 22 nt, Human
uccugggccuguacuccauccg

SEQ ID NO: 432111 - RNA, 22 nt, Human
cccuggcauaaaacuucuccag

SEQ ID NO: 432112 - RNA, 22 nt, Human
cuggugcccuguguggcaggag

SEQ ID NO: 432113 - RNA, 22 nt, Human
cugcuccuccccaucaggcagc

SEQ ID NO: 432114 - RNA, 22 nt, Human
uucuacagaauaaauguuuaca

SEQ ID NO: 432115 - RNA, 22 nt, Human
cugggcugcaguuccugguccu

SEQ ID NO: 432116 - RNA, 22 nt, Human
gugaaauauuuuguuuauguca

SEQ ID NO: 432117 - RNA, 22 nt, Human
gacagcagaugaagccugcaga

SEQ ID NO: 432118 - RNA, 22 nt, Human
cagcugaccuggcuaagggagc

SEQ ID NO: 432119 - RNA, 22 nt, Human
guuucacauaauuuuaaauugu

SEQ ID NO: 432120 - RNA, 22 nt, Human
uuuagacagcaucuggugacuu

SEQ ID NO: 432121 - RNA, 22 nt, Human
uggcagugggaagcuggaaguc

SEQ ID NO: 432122 - RNA, 22 nt, Human
cucugggcaaguaugauagaaa

SEQ ID NO: 432123 - RNA, 18 nt, Human
agaagcacaagaugucuu

SEQ ID NO: 432124 - RNA, 22 nt, Human
cugcagccuaggugcagcuggg

SEQ ID NO: 432125 - RNA, 22 nt, Human
agaauaccauaauauagaaaga

SEQ ID NO: 432126 - RNA, 22 nt, Human
agcugcuccuuuccugcaggcg

SEQ ID NO: 432127 - RNA, 22 nt, Human
aaacaaugaaauucauucuuca

SEQ ID NO: 432128 - RNA, 20 nt, Human
gaggcccagagaggugaagc

SEQ ID NO: 432129 - RNA, 22 nt, Human
cauguacauucuguagauggag

SEQ ID NO: 432130 - RNA, 17 nt, Human
gccaaaggguuccaauc

SEQ ID NO: 432131 - RNA, 20 nt, Human
aauccugggacagaggcagg

SEQ ID NO: 432132 - RNA, 22 nt, Human
ugcucagugagucugugacagg

SEQ ID NO: 432133 - RNA, 22 nt, Human
aauagaauguaaucuaauacau

SEQ ID NO: 432134 - RNA, 22 nt, Human
cuguacaaauggcaguugaguu

SEQ ID NO: 432135 - RNA, 22 nt, Human
ccugggcuuacgaccucugacu

SEQ ID NO: 432136 - RNA, 22 nt, Human
ugaagcccugugucagcuucca

SEQ ID NO: 432137 - RNA, 22 nt, Human
uacaggcccauagucccugcuu

SEQ ID NO: 432138 - RNA, 22 nt, Human
uuuuauugucaaugaagacaga

SEQ ID NO: 432139 - RNA, 22 nt, Human
uccaaggacgcuggaccccugc

SEQ ID NO: 432140 - RNA, 22 nt, Human
augcuugggacucccuguagca

SEQ ID NO: 432141 - RNA, 22 nt, Human
auauuauucuaguaacagugau

SEQ ID NO: 432142 - RNA, 22 nt, Human
gacacagacaguuagagguaau

SEQ ID NO: 432143 - RNA, 22 nt, Human
uucuuuuaauugugggggagug

SEQ ID NO: 432144 - RNA, 19 nt, Human
uuacaauggugauuagguu

SEQ ID NO: 432145 - RNA, 22 nt, Human
aauugguuugaauaaauaaaga

SEQ ID NO: 432146 - RNA, 22 nt, Human
aauacauguuuucuacuauucu

SEQ ID NO: 432147 - RNA, 22 nt, Human
gauaaagggggaccaaaugacu

SEQ ID NO: 432148 - RNA, 17 nt, Human
ggaaaagaagaguagga

SEQ ID NO: 432149 - RNA, 22 nt, Human
gacagacacuguguccucacuu

SEQ ID NO: 432150 - RNA, 22 nt, Human
cauuuuacugacucuugaauua

SEQ ID NO: 432151 - RNA, 22 nt, Human
agcuaaggaacucuguaacacc

SEQ ID NO: 432152 - RNA, 22 nt, Human
ucccacccauccugcaucucuu

SEQ ID NO: 432153 - RNA, 19 nt, Human
ggugugugcuggggccugu

SEQ ID NO: 432154 - RNA, 22 nt, Human
cagcaggcccagaguuucaugg

SEQ ID NO: 432155 - RNA, 22 nt, Human
uccacugcagcuucugauggaa

SEQ ID NO: 432156 - RNA, 22 nt, Human
aggccagcgcugcuagcucccg

SEQ ID NO: 432157 - RNA, 20 nt, Human
acuuugcauuuccugauuuu

SEQ ID NO: 432158 - RNA, 22 nt, Human
uugugcauuucucugagugugu

SEQ ID NO: 432159 - RNA, 22 nt, Human
gcaggcaauuuuggaaggucag

SEQ ID NO: 432160 - RNA, 21 nt, Human
cuuggcugcagugacaggcau

SEQ ID NO: 432161 - RNA, 22 nt, Human
acaggagugaaucuggcacuua

SEQ ID NO: 432162 - RNA, 22 nt, Human
ccacacugaaccucagugucuu

SEQ ID NO: 432163 - RNA, 22 nt, Human
gcagggcuauuggaaggagaug

SEQ ID NO: 432164 - RNA, 22 nt, Human
gaggcugaggguuagagaguca

SEQ ID NO: 432165 - RNA, 22 nt, Human
aaggcuggguaaccuguccacu

SEQ ID NO: 432166 - RNA, 22 nt, Human
cugaagcugcauaccaaagacu

SEQ ID NO: 432167 - RNA, 18 nt, Human
cugcuugggagacgucag

SEQ ID NO: 432168 - RNA, 22 nt, Human
uaacacuggcuuuugcugaggc

SEQ ID NO: 432169 - RNA, 22 nt, Human
uauuucuaagagauaucuguac

SEQ ID NO: 432170 - RNA, 22 nt, Human
aacauuucagcaaauaagaaca

SEQ ID NO: 432171 - RNA, 23 nt, Human
agcuaaggaagcugaggcacagu

SEQ ID NO: 432172 - RNA, 18 nt, Human
gggcccuggcguccgccc

SEQ ID NO: 432173 - RNA, 22 nt, Human
guccucagucaguuuggugggg

SEQ ID NO: 432174 - RNA, 22 nt, Human
ccagcugguguuccuuaggacc

SEQ ID NO: 432175 - RNA, 22 nt, Human
acaggccugauguuauccuauu

SEQ ID NO: 432176 - RNA, 22 nt, Human
ugcagugguugagagcccagac

SEQ ID NO: 432177 - RNA, 22 nt, Human
gaaggagcuaccaagacugaau

SEQ ID NO: 432178 - RNA, 22 nt, Human
ugugugaaggagccacuguuca

SEQ ID NO: 432179 - RNA, 22 nt, Human
cacugguaguuucagcaaccag

SEQ ID NO: 432180 - RNA, 22 nt, Human
cacagcaagagcuaaaugacca

SEQ ID NO: 432181 - RNA, 22 nt, Human
cacagggcaggccccaggccuc

SEQ ID NO: 432182 - RNA, 22 nt, Human
auugcuuuucagacaaugaggc

SEQ ID NO: 432183 - RNA, 22 nt, Human
uagauugauugcaaagacaggc

SEQ ID NO: 432184 - RNA, 22 nt, Human
agggcagcuaaggugcugacug

SEQ ID NO: 432185 - RNA, 22 nt, Human
uggcacagagggacccagcagc

SEQ ID NO: 432186 - RNA, 22 nt, Human
uugugaauagugccgcuauaaa

SEQ ID NO: 432187 - RNA, 22 nt, Human
uggccagcuuuuuguagugcuc

SEQ ID NO: 432188 - RNA, 22 nt, Human
guaaaggcucugauaaguacug

SEQ ID NO: 432189 - RNA, 21 nt, Human
caaaaggauaggaaauuaggg

SEQ ID NO: 432190 - RNA, 22 nt, Human
cuuguuuucuaaaacaucauuu

SEQ ID NO: 432191 - RNA, 22 nt, Human
agaagagaaauagugccacugu

SEQ ID NO: 432192 - RNA, 22 nt, Human
ggacagggaucauuaucugagc

SEQ ID NO: 432193 - RNA, 22 nt, Human
auguguguguuuaauccucaaa

SEQ ID NO: 432194 - RNA, 22 nt, Human
uuucuugacugcuuaggaaugc

SEQ ID NO: 432195 - RNA, 22 nt, Human
caguucuaucauuuuagagaug

SEQ ID NO: 432196 - RNA, 22 nt, Human
aagugauacguguuuauuucca

SEQ ID NO: 432197 - RNA, 22 nt, Human
auuuagacuucuugcagguaau

SEQ ID NO: 432198 - RNA, 22 nt, Human
aggccagaaaaagacagcucca

SEQ ID NO: 432199 - RNA, 22 nt, Human
gaauuuuaaguguucgccucuu

SEQ ID NO: 432200 - RNA, 22 nt, Human
uccugccugagcguggaggagg

SEQ ID NO: 432201 - RNA, 22 nt, Human
aucugguucuucuuaggcauca

SEQ ID NO: 432202 - RNA, 22 nt, Human
ugucacaaacauacauuauaga

SEQ ID NO: 432203 - RNA, 22 nt, Human
gcuccacuuccuucugcccuca

SEQ ID NO: 432204 - RNA, 22 nt, Human
uugcaaauucauggaucugaau

SEQ ID NO: 432205 - RNA, 22 nt, Human
aucgaauaauugcauucuauaa

SEQ ID NO: 432206 - RNA, 22 nt, Human
gcucucuggaggccauggacag

SEQ ID NO: 432207 - RNA, 22 nt, Human
ugguaaaaacugcaauuacuuu

SEQ ID NO: 432208 - RNA, 22 nt, Human
gacaggugagaugaggaacacc

SEQ ID NO: 432209 - RNA, 22 nt, Human
acccaggagguggaggcugcag

SEQ ID NO: 432210 - RNA, 23 nt, Human
caggaagcagaugggguagaaga

SEQ ID NO: 432211 - RNA, 22 nt, Human
ggcucuggguucugcaaugcgu

SEQ ID NO: 432212 - RNA, 22 nt, Human
agucacacuucguaucucuagc

SEQ ID NO: 432213 - RNA, 22 nt, Human
cauuguuaccaucuuuuaccua

SEQ ID NO: 432214 - RNA, 20 nt, Human
aucaggaagagagacugacc

SEQ ID NO: 432215 - RNA, 22 nt, Human
ugggcuggcugaacuucaaccu

SEQ ID NO: 432216 - RNA, 22 nt, Human
uccuggagagugggcgagcaca

SEQ ID NO: 432217 - RNA, 17 nt, Human
cucugcagugcauggcu

SEQ ID NO: 432218 - RNA, 22 nt, Human
augccaggcuguuuggccucag

SEQ ID NO: 432219 - RNA, 22 nt, Human
uuaaguacuucccuguuggaca

SEQ ID NO: 432220 - RNA, 22 nt, Human
agcugugugccaggggagaugu

SEQ ID NO: 432221 - RNA, 22 nt, Human
ugucacauugaauaugauuuau

SEQ ID NO: 432222 - RNA, 22 nt, Human
gagagcuguguucauucuacca

SEQ ID NO: 432223 - RNA, 22 nt, Human
ggcuugaauggauauaaucugu

SEQ ID NO: 432224 - RNA, 22 nt, Human
gaggcuaagguucugccagaag

SEQ ID NO: 432225 - RNA, 22 nt, Human
caggcuggagugcaauggcaca

SEQ ID NO: 432226 - RNA, 22 nt, Human
cucggguaccaugcuaggcacu

SEQ ID NO: 432227 - RNA, 22 nt, Human
gcuggcuguguuccuucugcca

SEQ ID NO: 432228 - RNA, 22 nt, Human
ccugggcucuauccugacccag

SEQ ID NO: 432229 - RNA, 22 nt, Human
uagcacugagucuagcuuugga

SEQ ID NO: 432230 - RNA, 22 nt, Human
uccuggauaucaaacaaacauu

SEQ ID NO: 432231 - RNA, 22 nt, Human
uaaggcagguagaugacuacgg

SEQ ID NO: 432232 - RNA, 21 nt, Human
agacagacugccugacccacg

SEQ ID NO: 432233 - RNA, 22 nt, Human
cugggccagggaggugucugua

SEQ ID NO: 432234 - RNA, 22 nt, Human
uguguguggggaggcagcagau

SEQ ID NO: 432235 - RNA, 19 nt, Human
ggccuggcuaucccugcug

SEQ ID NO: 432236 - RNA, 22 nt, Human
ucccagaguuuccuguguccca

SEQ ID NO: 432237 - RNA, 22 nt, Human
ucagcaggcaccggaaguguuu

SEQ ID NO: 432238 - RNA, 22 nt, Human
uauaccaaaauaucagaaaggg

SEQ ID NO: 432239 - RNA, 22 nt, Human
cacaguaucuuuugaguaagca

SEQ ID NO: 432240 - RNA, 22 nt, Human
ucugacagucacaguggaggau

SEQ ID NO: 432241 - RNA, 22 nt, Human
ucaggccuucagaccuggcccg

SEQ ID NO: 432242 - RNA, 22 nt, Human
ugcagaaggaggaggaaaucca

SEQ ID NO: 432243 - RNA, 22 nt, Human
gcucagagaaguuaaggaauuu

SEQ ID NO: 432244 - RNA, 22 nt, Human
caagauaucaaugacauaguau

SEQ ID NO: 432245 - RNA, 22 nt, Human
uucucuaagaguuauaugaauu

SEQ ID NO: 432246 - RNA, 22 nt, Human
ugugaauagauugaagcuuugg

SEQ ID NO: 432247 - RNA, 22 nt, Human
ugugggcaggcccgggucugag

SEQ ID NO: 432248 - RNA, 22 nt, Human
ucagaauucugaagggcacaaa

SEQ ID NO: 432249 - RNA, 22 nt, Human
guccugaaugccuuuaggcaga

SEQ ID NO: 432250 - RNA, 22 nt, Human
guugaauaucccguaucuuaaa

SEQ ID NO: 432251 - RNA, 22 nt, Human
uuacaugacucaauagaagggc

SEQ ID NO: 432252 - RNA, 22 nt, Human
ccagcagcgauagggugagugc

SEQ ID NO: 432253 - RNA, 22 nt, Human
cuggcugugcugacugagaggg

SEQ ID NO: 432254 - RNA, 22 nt, Human
acugucaccaucagagcgggaa

SEQ ID NO: 432255 - RNA, 22 nt, Human
uuaauuaaauucaugagcauug

SEQ ID NO: 432256 - RNA, 21 nt, Human
cccaggaggcugagaagagca

SEQ ID NO: 432257 - RNA, 22 nt, Human
agcaggcuaaauaauaauacau

SEQ ID NO: 432258 - RNA, 22 nt, Human
agucuagcuuaggagccuagcu

SEQ ID NO: 432259 - RNA, 22 nt, Human
acuuucuccagaaaaccaagga

SEQ ID NO: 432260 - RNA, 22 nt, Human
uuauuaguguugauauuaggau

SEQ ID NO: 432261 - RNA, 22 nt, Human
ugggggcuccaggcuccaggga

SEQ ID NO: 432262 - RNA, 22 nt, Human
aggccuuuguggagcucauggc

SEQ ID NO: 432263 - RNA, 22 nt, Human
cccaggcugauguucagcgggu

SEQ ID NO: 432264 - RNA, 22 nt, Human
acauguuaaacaucauggaaug

SEQ ID NO: 432265 - RNA, 22 nt, Human
cacacagugggaaaaccugaag

SEQ ID NO: 432266 - RNA, 22 nt, Human
ggcuccuggggaggugagcuug

SEQ ID NO: 432267 - RNA, 22 nt, Human
ccuggcacgaagggcugagguu

SEQ ID NO: 432268 - RNA, 22 nt, Human
uguggcuguguccaccugcugc

SEQ ID NO: 432269 - RNA, 22 nt, Human
agcagggcagguaaggaucaga

SEQ ID NO: 432270 - RNA, 22 nt, Human
uggcugaaagccuggccugcca

SEQ ID NO: 432271 - RNA, 19 nt, Human
gagcaacauauguaaacuc

SEQ ID NO: 432272 - RNA, 22 nt, Human
agccuggauucgugcauccaca

SEQ ID NO: 432273 - RNA, 22 nt, Human
gcugaggccucagaaggcugag

SEQ ID NO: 432274 - RNA, 22 nt, Human
gcaggaguguauuugcauguaa

SEQ ID NO: 432275 - RNA, 22 nt, Human
cugcccugggccaggaagcggc

SEQ ID NO: 432276 - RNA, 22 nt, Human
gcucccugcacucugcagcccu

SEQ ID NO: 432277 - RNA, 22 nt, Human
gaaggaaaacagaucugccuga

SEQ ID NO: 432278 - RNA, 19 nt, Human
ccugggagucagcugaagg

SEQ ID NO: 432279 - RNA, 22 nt, Human
gccaugggcaaaugcagagcug

SEQ ID NO: 432280 - RNA, 22 nt, Human
ucaggcugcuguacugugaaug

SEQ ID NO: 432281 - RNA, 22 nt, Human
uccuucagggggccgccugcac

SEQ ID NO: 432282 - RNA, 22 nt, Human
uguaccaugugacuggagucuu

SEQ ID NO: 432283 - RNA, 22 nt, Human
aggagcugucagagugccagag

SEQ ID NO: 432284 - RNA, 22 nt, Human
aguugcagccuucaggagaccc

SEQ ID NO: 432285 - RNA, 22 nt, Human
uuccauaaaggugauaguauac

SEQ ID NO: 432286 - RNA, 22 nt, Human
augcauucagcggaaugcuuag

SEQ ID NO: 432287 - RNA, 22 nt, Human
agccagccccugacuguguccu

SEQ ID NO: 432288 - RNA, 22 nt, Human
aaguccugggcauuugaacagg

SEQ ID NO: 432289 - RNA, 22 nt, Human
ugcagcugaugauacccccaug

SEQ ID NO: 432290 - RNA, 22 nt, Human
caguacucccagaacaaacccu

SEQ ID NO: 432291 - RNA, 21 nt, Human
aucauuaauugcugagugaca

SEQ ID NO: 432292 - RNA, 22 nt, Human
gcacacagauuaggaaacagaa

SEQ ID NO: 432293 - RNA, 22 nt, Human
uuuauucaagaugagguucaug

SEQ ID NO: 432294 - RNA, 22 nt, Human
ucaggggcuugaggugcauguc

SEQ ID NO: 432295 - RNA, 22 nt, Human
aguccuaggcccugcuccagau

SEQ ID NO: 432296 - RNA, 22 nt, Human
aagcccuggcggguggagggcc

SEQ ID NO: 432297 - RNA, 22 nt, Human
gaggccuggaauuccagccugg

SEQ ID NO: 432298 - RNA, 22 nt, Human
uacaguuccaggaucauagggu

SEQ ID NO: 432299 - RNA, 22 nt, Human
gagcugugagggacacauugcu

SEQ ID NO: 432300 - RNA, 22 nt, Human
uggcugccuuucaccucaucuc

SEQ ID NO: 432301 - RNA, 22 nt, Human
aucagaggaccuaguugggcag

SEQ ID NO: 432302 - RNA, 22 nt, Human
ugcugagggagcaucaaagaaa

SEQ ID NO: 432303 - RNA, 23 nt, Human
uuuaacauuugaacauguggcca

SEQ ID NO: 432304 - RNA, 22 nt, Human
ucuuagcagacuuggcuacugu

SEQ ID NO: 432305 - RNA, 20 nt, Human
agcauuuuaugguaggaaac

SEQ ID NO: 432306 - RNA, 22 nt, Human
ccucaggcuugugagccuucag

SEQ ID NO: 432307 - RNA, 22 nt, Human
uucauuaaguauaaaauguggu

SEQ ID NO: 432308 - RNA, 16 nt, Human
aucuaagaauguagag

SEQ ID NO: 432309 - RNA, 22 nt, Human
cugguacauuugaugauaauag

SEQ ID NO: 432310 - RNA, 22 nt, Human
uuagcauucugccuccuauauc

SEQ ID NO: 432311 - RNA, 22 nt, Human
ccugucuguauugguuugcuau

SEQ ID NO: 432312 - RNA, 22 nt, Human
gugagagaauuugaguuaaauu

SEQ ID NO: 432313 - RNA, 22 nt, Human
agcagagcugcaguggccugcu

SEQ ID NO: 432314 - RNA, 19 nt, Human
gaaaacaugggugaggguc

SEQ ID NO: 432315 - RNA, 19 nt, Human
acuccagggaugacagaag

SEQ ID NO: 432316 - RNA, 22 nt, Human
uauuuaaccaguuaaauuucca

SEQ ID NO: 432317 - RNA, 22 nt, Human
uggcagauguggcauagagcau

SEQ ID NO: 432318 - RNA, 22 nt, Human
uggcacuggcgcaggauggcgg

SEQ ID NO: 432319 - RNA, 22 nt, Human
ccuggcagcaggugggcccgug

SEQ ID NO: 432320 - RNA, 22 nt, Human
caggacagugcagguccauccu

SEQ ID NO: 432321 - RNA, 22 nt, Human
uuaccauaguacuaucaguuua

SEQ ID NO: 432322 - RNA, 22 nt, Human
aagcaucuuaaaaaguaucaga

SEQ ID NO: 432323 - RNA, 22 nt, Human
ugaagaggccgugugcagguga

SEQ ID NO: 432324 - RNA, 22 nt, Human
uucuugauuucaugcaguuaag

SEQ ID NO: 432325 - RNA, 22 nt, Human
gugcagcucaguugaaaugcag

SEQ ID NO: 432326 - RNA, 22 nt, Human
cuggcucccuggacauggggcc

SEQ ID NO: 432327 - RNA, 22 nt, Human
aauccauuuacucuuuacaaga

SEQ ID NO: 432328 - RNA, 22 nt, Human
cagcaggguagguuguaucagu

SEQ ID NO: 432329 - RNA, 22 nt, Human
cuguggcucaaaaucccaugau

SEQ ID NO: 432330 - RNA, 22 nt, Human
agaugcugucacacacacuguu

SEQ ID NO: 432331 - RNA, 22 nt, Human
aaaugcuacacaggaauucuca

SEQ ID NO: 432332 - RNA, 22 nt, Human
uuccaugagcucugaguucaca

SEQ ID NO: 432333 - RNA, 23 nt, Human
uaucuuuuucaauguuggaaaua

SEQ ID NO: 432334 - RNA, 22 nt, Human
auucagaaaggguugccugguu

SEQ ID NO: 432335 - RNA, 22 nt, Human
ggagccuguggcugcuugaagc

SEQ ID NO: 432336 - RNA, 22 nt, Human
aucucaaagcauggagcagaau

SEQ ID NO: 432337 - RNA, 22 nt, Human
aaugacaauauuaauuuggagg

SEQ ID NO: 432338 - RNA, 22 nt, Human
uugcaaaucucuuguguuuggu

SEQ ID NO: 432339 - RNA, 22 nt, Human
cuugaugauuugcagagggagu

SEQ ID NO: 432340 - RNA, 22 nt, Human
cuggggcucacuuuggucaggc

SEQ ID NO: 432341 - RNA, 22 nt, Human
gcugucugcaucucuagagcuu

SEQ ID NO: 432342 - RNA, 22 nt, Human
agccuggauccauguggcuacc

SEQ ID NO: 432343 - RNA, 22 nt, Human
uuucuaguucucugccaaaaaa

SEQ ID NO: 432344 - RNA, 22 nt, Human
cagcuguuccuggaaggagacc

SEQ ID NO: 432345 - RNA, 21 nt, Human
cagagguggccugaccucuga

SEQ ID NO: 432346 - RNA, 22 nt, Human
aaguucaagcucugccuaaaau

SEQ ID NO: 432347 - RNA, 22 nt, Human
agccucugcacuucuuacaggu

SEQ ID NO: 432348 - RNA, 22 nt, Human
gaggccucugucccaccaggga

SEQ ID NO: 432349 - RNA, 22 nt, Human
ugacacaguugucgacucuaca

SEQ ID NO: 432350 - RNA, 22 nt, Human
ccucuuugugccugcaggcugc

SEQ ID NO: 432351 - RNA, 22 nt, Human
guugaauauuuuaagaguuuug

SEQ ID NO: 432352 - RNA, 22 nt, Human
uacacaaaggcacucuguuguu

SEQ ID NO: 432353 - RNA, 22 nt, Human
cccagacugcagagcgggcaga

SEQ ID NO: 432354 - RNA, 22 nt, Human
aaaguugaguuuuauguguuac

SEQ ID NO: 432355 - RNA, 22 nt, Human
uggcucagaacuacuucuaguu

SEQ ID NO: 432356 - RNA, 22 nt, Human
uacagaggaggggauuuuaaua

SEQ ID NO: 432357 - RNA, 22 nt, Human
gcagagcugggucuguauccaa

SEQ ID NO: 432358 - RNA, 22 nt, Human
ccagauucauagaaacucauag

SEQ ID NO: 432359 - RNA, 22 nt, Human
agagcuggaaucagaccucagg

SEQ ID NO: 432360 - RNA, 22 nt, Human
uuuucuaauuuaguuacccucc

SEQ ID NO: 432361 - RNA, 22 nt, Human
ggcgaggccgggacaggcugga

SEQ ID NO: 432362 - RNA, 23 nt, Human
cacagggagggaaacucuuucag

SEQ ID NO: 432363 - RNA, 22 nt, Human
gcaggccugacuguagggggca

SEQ ID NO: 432364 - RNA, 21 nt, Human
uuuguucaggggcaaaguuaa

SEQ ID NO: 432365 - RNA, 22 nt, Human
auucauaaguaaaugauuaccu

SEQ ID NO: 432366 - RNA, 22 nt, Human
ccagaggcuggcaagggcuccu

SEQ ID NO: 432367 - RNA, 22 nt, Human
uucuggaauauuugacacaauu

SEQ ID NO: 432368 - RNA, 22 nt, Human
uuuccagucucagcccuguaac

SEQ ID NO: 432369 - RNA, 22 nt, Human
cugggucuggcuacugcuuccu

SEQ ID NO: 432370 - RNA, 22 nt, Human
ucaagacagauggguaacuugg

SEQ ID NO: 432371 - RNA, 22 nt, Human
agguaauuguauguuccaagca

SEQ ID NO: 432372 - RNA, 22 nt, Human
ugcucagacaagcugaacagua

SEQ ID NO: 432373 - RNA, 22 nt, Human
uuugucauaacucugcugcaag

SEQ ID NO: 432374 - RNA, 22 nt, Human
cucucuggcuuggcacggagau

SEQ ID NO: 432375 - RNA, 22 nt, Human
gauggcuucacuuacauggcug

SEQ ID NO: 432376 - RNA, 22 nt, Human
uagcagagcgggugcgaggcgg

SEQ ID NO: 432377 - RNA, 23 nt, Human
uuaaaggcagauguugaguauua

SEQ ID NO: 432378 - RNA, 22 nt, Human
auuucuacauugaguuuuagca

SEQ ID NO: 432379 - RNA, 22 nt, Human
gaaauauucuugucuuguuuuc

SEQ ID NO: 432380 - RNA, 22 nt, Human
gccugcagggugaugggcugcc

SEQ ID NO: 432381 - RNA, 22 nt, Human
cagcaggugcaggugcggccgc

SEQ ID NO: 432382 - RNA, 22 nt, Human
ggggacaguuaaagaccaagac

SEQ ID NO: 432383 - RNA, 22 nt, Human
ucaggaaaggcagagugucugu

SEQ ID NO: 432384 - RNA, 22 nt, Human
ugagccagucugucugggugaa

SEQ ID NO: 432385 - RNA, 22 nt, Human
uuuucuuaggugcuccaaguag

SEQ ID NO: 432386 - RNA, 22 nt, Human
caagucugaccucugggugaag

SEQ ID NO: 432387 - RNA, 22 nt, Human
cuggccaguuguccuggcuugg

SEQ ID NO: 432388 - RNA, 22 nt, Human
uaaaggaagaauucucugugau

SEQ ID NO: 432389 - RNA, 22 nt, Human
guguuaaauuucuaauuuguga

SEQ ID NO: 432390 - RNA, 22 nt, Human
ucccagaaaaaggaggcuauga

SEQ ID NO: 432391 - RNA, 22 nt, Human
ucccagacaaucauuggccacc

SEQ ID NO: 432392 - RNA, 22 nt, Human
gagcaggccagcaauggaaggg

SEQ ID NO: 432393 - RNA, 18 nt, Human
cuuccucaucgcucuccc

SEQ ID NO: 432394 - RNA, 22 nt, Human
cagugggugaugaguccugggg

SEQ ID NO: 432395 - RNA, 22 nt, Human
guacuucuuuagucaauaugua

SEQ ID NO: 432396 - RNA, 22 nt, Human
uuauucagcagggacuuccuuu

SEQ ID NO: 432397 - RNA, 22 nt, Human
cagggcuugaucugcauccugc

SEQ ID NO: 432398 - RNA, 19 nt, Human
gcagcugugggaagagcca

SEQ ID NO: 432399 - RNA, 22 nt, Human
aacuggcugggaacaccuagag

SEQ ID NO: 432400 - RNA, 22 nt, Human
ucugggagauccaagcagaacu

SEQ ID NO: 432401 - RNA, 22 nt, Human
uugacaaaacaacacagauuuc

SEQ ID NO: 432402 - RNA, 22 nt, Human
caggggccuggcugucuaggaa

SEQ ID NO: 432403 - RNA, 22 nt, Human
gucccugcccuccugggacuca

SEQ ID NO: 432404 - RNA, 19 nt, Human
gucuggauuuuucgguaac

SEQ ID NO: 432405 - RNA, 22 nt, Human
agaagcacagguaaagugauuu

SEQ ID NO: 432406 - RNA, 22 nt, Human
auggcugggauuuccuuugcgu

SEQ ID NO: 432407 - RNA, 18 nt, Human
gagcccugagucugcaca

SEQ ID NO: 432408 - RNA, 19 nt, Human
cccagcuugaccaccugcu

SEQ ID NO: 432409 - RNA, 21 nt, Human
cauugagauaggagagauugu

SEQ ID NO: 432410 - RNA, 22 nt, Human
auauuauaaguuauuucaaguu

SEQ ID NO: 432411 - RNA, 22 nt, Human
ggccagcggcacagccuggccc

SEQ ID NO: 432412 - RNA, 22 nt, Human
acagguacuuuguaaugaagga

SEQ ID NO: 432413 - RNA, 22 nt, Human
ugcaggccucacaccuggcacc

SEQ ID NO: 432414 - RNA, 22 nt, Human
gacagcagguaauuaguuaaca

SEQ ID NO: 432415 - RNA, 22 nt, Human
uccuguguuacugccuggagcg

SEQ ID NO: 432416 - RNA, 22 nt, Human
agcaagcuguucuuggagagua

SEQ ID NO: 432417 - RNA, 19 nt, Human
cagagccucagagcuagaa

SEQ ID NO: 432418 - RNA, 22 nt, Human
cauuuacagcagacugaugaaa

SEQ ID NO: 432419 - RNA, 22 nt, Human
cacaggaaagucagccagaaga

SEQ ID NO: 432420 - RNA, 22 nt, Human
auacaaaauauauacuggagac

SEQ ID NO: 432421 - RNA, 22 nt, Human
caaauacaaauacgggcagcuu

SEQ ID NO: 432422 - RNA, 22 nt, Human
agagccuggggauuggcaaggg

SEQ ID NO: 432423 - RNA, 22 nt, Human
gccuggagaaaggaagguggga

SEQ ID NO: 432424 - RNA, 22 nt, Human
uacugcaugggugcaugcugcu

SEQ ID NO: 432425 - RNA, 22 nt, Human
ucuuugcaaauguuauuaucuu

SEQ ID NO: 432426 - RNA, 22 nt, Human
gaagccaacauuccaaguagaa

SEQ ID NO: 432427 - RNA, 22 nt, Human
cgccugggaguccacaccugcu

SEQ ID NO: 432428 - RNA, 22 nt, Human
cuuccucacggugcaacaggaa

SEQ ID NO: 432429 - RNA, 22 nt, Human
uuaagagcaacauauggugaca

SEQ ID NO: 432430 - RNA, 22 nt, Human
uaaggcauaaggaagauuugga

SEQ ID NO: 432431 - RNA, 22 nt, Human
ugucaccagcugcuccucagga

SEQ ID NO: 432432 - RNA, 22 nt, Human
caggcagcugaggacuuugcua

SEQ ID NO: 432433 - RNA, 22 nt, Human
uggacucagugcugccauuccc

SEQ ID NO: 432434 - RNA, 22 nt, Human
acugcauuggagagcaugaauu

SEQ ID NO: 432435 - RNA, 22 nt, Human
auccugggcugcacccucagcc

SEQ ID NO: 432436 - RNA, 22 nt, Human
agaaauucaauucuaauuagcu

SEQ ID NO: 432437 - RNA, 21 nt, Human
uggccagcugcucgucuccuc

SEQ ID NO: 432438 - RNA, 22 nt, Human
gcuuagcaaugugacaagaugc

SEQ ID NO: 432439 - RNA, 22 nt, Human
gcuuccugagacaacauugagu

SEQ ID NO: 432440 - RNA, 22 nt, Human
uaggaaauggcucaguuacugc

SEQ ID NO: 432441 - RNA, 22 nt, Human
aaguagaaaaccgcacuggacu

SEQ ID NO: 432442 - RNA, 22 nt, Human
agcaacaguguauaucauaggc

SEQ ID NO: 432443 - RNA, 22 nt, Human
gcuggugccuuguuguuguuac

SEQ ID NO: 432444 - RNA, 22 nt, Human
uuguaaaugaccuuuucuaauu

SEQ ID NO: 432445 - RNA, 22 nt, Human
gacagagugcagggcuagaaga

SEQ ID NO: 432446 - RNA, 22 nt, Human
uggaugagucugagauugggca

SEQ ID NO: 432447 - RNA, 22 nt, Human
aaccucuacauccaggaaagga

SEQ ID NO: 432448 - RNA, 22 nt, Human
ugcaggggcuugucugggccug

SEQ ID NO: 432449 - RNA, 22 nt, Human
uuaaugacaucauaggugaagu

SEQ ID NO: 432450 - RNA, 22 nt, Human
agggcagacuaggauggaagug

SEQ ID NO: 432451 - RNA, 22 nt, Human
ugcauuauggcugagucucuca

SEQ ID NO: 432452 - RNA, 22 nt, Human
augcccugugacucuccuggac

SEQ ID NO: 432453 - RNA, 21 nt, Human
ucaggaggcucagacuccugc

SEQ ID NO: 432454 - RNA, 17 nt, Human
ugcagcugauggggaaa

SEQ ID NO: 432455 - RNA, 22 nt, Human
guauucuugaguggcaacuagg

SEQ ID NO: 432456 - RNA, 22 nt, Human
ggcuccuguggcaagacagcuu

SEQ ID NO: 432457 - RNA, 22 nt, Human
aacaucuuuuuguuugcugaaa

SEQ ID NO: 432458 - RNA, 22 nt, Human
aaggcaaguuuuaguuuucugg

SEQ ID NO: 432459 - RNA, 22 nt, Human
augcaacaauguauuuauguau

SEQ ID NO: 432460 - RNA, 22 nt, Human
uguagaaagaauauguuucaua

SEQ ID NO: 432461 - RNA, 22 nt, Human
gcuccucugucaaaugagagug

SEQ ID NO: 432462 - RNA, 17 nt, Human
ucugagaaugcuggagg

SEQ ID NO: 432463 - RNA, 22 nt, Human
uuauugcauagauuaugccaua

SEQ ID NO: 432464 - RNA, 22 nt, Human
agcuccaggccuugggccccgg

SEQ ID NO: 432465 - RNA, 22 nt, Human
ccauuacugaaauaaagagaau

SEQ ID NO: 432466 - RNA, 22 nt, Human
gaucuuuucagguuucucuagu

SEQ ID NO: 432467 - RNA, 22 nt, Human
cugggccauggaagucucugcc

SEQ ID NO: 432468 - RNA, 22 nt, Human
acaggcaaggccagugagaaau

SEQ ID NO: 432469 - RNA, 22 nt, Human
caggguggggcuggcuaucaaa

SEQ ID NO: 432470 - RNA, 22 nt, Human
uccugccucacaguugaaguuu

SEQ ID NO: 432471 - RNA, 22 nt, Human
uuuucugaccuaucuacauuua

SEQ ID NO: 432472 - RNA, 22 nt, Human
gaguccuguugucccagauggg

SEQ ID NO: 432473 - RNA, 22 nt, Human
aaaugcaugagaaaguauucug

SEQ ID NO: 432474 - RNA, 22 nt, Human
auuaagaucauuguagaagauu

SEQ ID NO: 432475 - RNA, 19 nt, Human
uggaaggcuaagacacuug

SEQ ID NO: 432476 - RNA, 22 nt, Human
gugacccaggacacuguguauc

SEQ ID NO: 432477 - RNA, 21 nt, Human
aucucacagcccagagaagcc

SEQ ID NO: 432478 - RNA, 22 nt, Human
ucauuuguugcuguuaccugag

SEQ ID NO: 432479 - RNA, 22 nt, Human
gcucugggaacugacugccuuc

SEQ ID NO: 432480 - RNA, 22 nt, Human
ggccuugggcagacacgucaca

SEQ ID NO: 432481 - RNA, 21 nt, Human
guucaaguuccugcucuguga

SEQ ID NO: 432482 - RNA, 22 nt, Human
uauuuuacaaaugggaaugcug

SEQ ID NO: 432483 - RNA, 22 nt, Human
acugucuccucaucaugccugg

SEQ ID NO: 432484 - RNA, 22 nt, Human
agucacaugcauuuucuucaau

SEQ ID NO: 432485 - RNA, 22 nt, Human
acagucuacuaaacaucaucag

SEQ ID NO: 432486 - RNA, 22 nt, Human
gcagcugucggaaagcuaagug

SEQ ID NO: 432487 - RNA, 23 nt, Human
cugcauguccacugguguaaaug

SEQ ID NO: 432488 - RNA, 22 nt, Human
acauugcaauaauaauucucuu

SEQ ID NO: 432489 - RNA, 22 nt, Human
aauaacuugaagaucucuucca

SEQ ID NO: 432490 - RNA, 22 nt, Human
ugggcaggauaauaucucaugu

SEQ ID NO: 432491 - RNA, 22 nt, Human
cacagaaguuucauagucucga

SEQ ID NO: 432492 - RNA, 22 nt, Human
agggcagccucucagccuaggu

SEQ ID NO: 432493 - RNA, 22 nt, Human
gcaaggcuguugcugcugcaag

SEQ ID NO: 432494 - RNA, 22 nt, Human
uucuuuuacauuaagauuucag

SEQ ID NO: 432495 - RNA, 22 nt, Human
cuucaagagaaugcagggaugu

SEQ ID NO: 432496 - RNA, 19 nt, Human
agcagcuuaauuuuguagc

SEQ ID NO: 432497 - RNA, 23 nt, Human
uuuuauugauauguagcuguugu

SEQ ID NO: 432498 - RNA, 22 nt, Human
ucccacugugaauccaaggccu

SEQ ID NO: 432499 - RNA, 22 nt, Human
agagucagaaagcagacagggg

SEQ ID NO: 432500 - RNA, 23 nt, Human
aaaggcacagcauugucuagcag

SEQ ID NO: 432501 - RNA, 20 nt, Human
ggaagcagagaacuguuuuc

SEQ ID NO: 432502 - RNA, 22 nt, Human
augagcaagagcuauguacaga

SEQ ID NO: 432503 - RNA, 22 nt, Human
cagcagagcuuauguuggguca

SEQ ID NO: 432504 - RNA, 22 nt, Human
ccugagccugaguggugcaggg

SEQ ID NO: 432505 - RNA, 22 nt, Human
ggacacagcugcagccacaccc

SEQ ID NO: 432506 - RNA, 22 nt, Human
acagagauggcacagagaaggu

SEQ ID NO: 432507 - RNA, 22 nt, Human
uaaggcaaagaaccauaguaau

SEQ ID NO: 432508 - RNA, 18 nt, Human
cagagcuccuggaugcag

SEQ ID NO: 432509 - RNA, 22 nt, Human
ucauuauucucuuuaauguucu

SEQ ID NO: 432510 - RNA, 22 nt, Human
ucucagagaacaguuggugcuu

SEQ ID NO: 432511 - RNA, 22 nt, Human
augugaaugcaguuaucuauaa

SEQ ID NO: 432512 - RNA, 22 nt, Human
acagaacugcagacagugccaa

SEQ ID NO: 432513 - RNA, 22 nt, Human
cuguguguccucggacgaguuu

SEQ ID NO: 432514 - RNA, 22 nt, Human
guuuccuguuucucagcagccc

SEQ ID NO: 432515 - RNA, 22 nt, Human
ugcaggugcguuuucaagccuc

SEQ ID NO: 432516 - RNA, 22 nt, Human
cuccuuccugccccagugauaa

SEQ ID NO: 432517 - RNA, 21 nt, Human
aaaaggaggcaggugaacagc

SEQ ID NO: 432518 - RNA, 22 nt, Human
gcaggccuuggcaaugagccug

SEQ ID NO: 432519 - RNA, 22 nt, Human
acacuuuguccuuuuucauugu

SEQ ID NO: 432520 - RNA, 22 nt, Human
ccuccagggcagacggggagca

SEQ ID NO: 432521 - RNA, 22 nt, Human
cagaccugagguugaguaccag

SEQ ID NO: 432522 - RNA, 22 nt, Human
gccuggcuucccuuggagcauu

SEQ ID NO: 432523 - RNA, 22 nt, Human
ugcccucagaauugcucccugc

SEQ ID NO: 432524 - RNA, 22 nt, Human
uucggaguauugacaugugaag

SEQ ID NO: 432525 - RNA, 22 nt, Human
cagcugaggucaaagaagcagg

SEQ ID NO: 432526 - RNA, 22 nt, Human
aggcuggaucucuguugccuuc

SEQ ID NO: 432527 - RNA, 22 nt, Human
ucauaaagugaaggaugauggg

SEQ ID NO: 432528 - RNA, 17 nt, Human
gacaagacagaauucau

SEQ ID NO: 432529 - RNA, 22 nt, Human
agcagcaggcuguguggacuga

SEQ ID NO: 432530 - RNA, 22 nt, Human
aggauuugcacugguguuugag

SEQ ID NO: 432531 - RNA, 22 nt, Human
agcaaaauaagguaauuuauug

SEQ ID NO: 432532 - RNA, 22 nt, Human
ucuguagcaagugagaggcauu

SEQ ID NO: 432533 - RNA, 23 nt, Human
augcccugugcagaaauguggaa

SEQ ID NO: 432534 - RNA, 22 nt, Human
ugcaaauucagaagaacugccc

SEQ ID NO: 432535 - RNA, 22 nt, Human
uucuccuuuguaauucucaucc

SEQ ID NO: 432536 - RNA, 22 nt, Human
uugcaaauaauagccugaaacu

SEQ ID NO: 432537 - RNA, 20 nt, Human
uauuuacaacuuagagccuc

SEQ ID NO: 432538 - RNA, 22 nt, Human
ugggcaaacugucaaccauguc

SEQ ID NO: 432539 - RNA, 22 nt, Human
agaauuucuggaagauugcaag

SEQ ID NO: 432540 - RNA, 22 nt, Human
uccugaagaacgaagucaugua

SEQ ID NO: 432541 - RNA, 18 nt, Human
cauaauuuucuuucuuua

SEQ ID NO: 432542 - RNA, 20 nt, Human
auggaggaagggcaagagaa

SEQ ID NO: 432543 - RNA, 19 nt, Human
aggaaagguggccuuagca

SEQ ID NO: 432544 - RNA, 22 nt, Human
uggcaggggaggugcuugcuua

SEQ ID NO: 432545 - RNA, 22 nt, Human
uuguuuuaacgacucagcuugu

SEQ ID NO: 432546 - RNA, 18 nt, Human
cacaauagacaccgauaa

SEQ ID NO: 432547 - RNA, 22 nt, Human
agcauguguaaucucaauaccu

SEQ ID NO: 432548 - RNA, 22 nt, Human
gcagggcugcagagggcacugu

SEQ ID NO: 432549 - RNA, 23 nt, Human
uccagcagagccuuccaggaggg

SEQ ID NO: 432550 - RNA, 22 nt, Human
acuuucucccacccacccgucu

SEQ ID NO: 432551 - RNA, 22 nt, Human
gugcuuccuguauugauuccau

SEQ ID NO: 432552 - RNA, 22 nt, Human
uuuuacaggucauagguauagu

SEQ ID NO: 432553 - RNA, 22 nt, Human
ccaugccauacuggccacccgg

SEQ ID NO: 432554 - RNA, 22 nt, Human
aggcucuggcaacagcuggugu

SEQ ID NO: 432555 - RNA, 22 nt, Human
aggccagcucuacccuuggacu

SEQ ID NO: 432556 - RNA, 22 nt, Human
gcaggcugaaacucggggucua

SEQ ID NO: 432557 - RNA, 22 nt, Human
cuagggaacaagaugcccaggg

SEQ ID NO: 432558 - RNA, 22 nt, Human
ggcaucaggaucugucuugcuu

SEQ ID NO: 432559 - RNA, 22 nt, Human
acuuugccccaaagaaguuggu

SEQ ID NO: 432560 - RNA, 22 nt, Human
uccugccuuagagcaaggaaaa

SEQ ID NO: 432561 - RNA, 22 nt, Human
caaggcaggcaguucacuugag

SEQ ID NO: 432562 - RNA, 22 nt, Human
ugggggcuagaacccagggauu

SEQ ID NO: 432563 - RNA, 22 nt, Human
aaguuccuauauccaaauacag

SEQ ID NO: 432564 - RNA, 22 nt, Human
agcuacaguugcccucagcagg

SEQ ID NO: 432565 - RNA, 22 nt, Human
caguggaagacucagcucuccc

SEQ ID NO: 432566 - RNA, 20 nt, Human
aaaguucauguuugcacuuu

SEQ ID NO: 432567 - RNA, 22 nt, Human
acagucaaucagaacagcaugu

SEQ ID NO: 432568 - RNA, 22 nt, Human
uguaaauaaugcauguaaauca

SEQ ID NO: 432569 - RNA, 22 nt, Human
ggcagcuguuggcucucuagga

SEQ ID NO: 432570 - RNA, 22 nt, Human
augcccugcaucaagugacacu

SEQ ID NO: 432571 - RNA, 21 nt, Human
ugguggagugugcugagcaug

SEQ ID NO: 432572 - RNA, 22 nt, Human
agaugcugccucuccucacaag

SEQ ID NO: 432573 - RNA, 22 nt, Human
ccagacuguggaguuccuggug

SEQ ID NO: 432574 - RNA, 22 nt, Human
uuuauguaguuacggacuauca

SEQ ID NO: 432575 - RNA, 22 nt, Human
gcaggggcuaaggacacagaga

SEQ ID NO: 432576 - RNA, 22 nt, Human
aauccuggccuagcugggcuca

SEQ ID NO: 432577 - RNA, 22 nt, Human
cuucacaguaaauccagaagaa

SEQ ID NO: 432578 - RNA, 22 nt, Human
agccccaguaagggagggccug

SEQ ID NO: 432579 - RNA, 22 nt, Human
agggcagaaaccaccuugaugg

SEQ ID NO: 432580 - RNA, 23 nt, Human
ccugacccugucucccucacaug

SEQ ID NO: 432581 - RNA, 22 nt, Human
uucaauagaaagucccuaguua

SEQ ID NO: 432582 - RNA, 22 nt, Human
ccugggugucaugggcagcugg

SEQ ID NO: 432583 - RNA, 22 nt, Human
caucuuuuggccuauucugagg

SEQ ID NO: 432584 - RNA, 22 nt, Human
gagcugaguuaccuccagauca

SEQ ID NO: 432585 - RNA, 21 nt, Human
agguuccugagucaugccuua

SEQ ID NO: 432586 - RNA, 22 nt, Human
gcccugucggaacugcgaccuc

SEQ ID NO: 432587 - RNA, 22 nt, Human
uucacauuccgcggcuauuuuc

SEQ ID NO: 432588 - RNA, 22 nt, Human
ucuucaaacccugguuuuguga

SEQ ID NO: 432589 - RNA, 22 nt, Human
auauuuucacagaacuugcaaa

SEQ ID NO: 432590 - RNA, 22 nt, Human
cugucccagauguucucagcac

SEQ ID NO: 432591 - RNA, 22 nt, Human
uagaaggaggacuggcaguguu

SEQ ID NO: 432592 - RNA, 22 nt, Human
uuaaaggcaugguuagacaugg

SEQ ID NO: 432593 - RNA, 22 nt, Human
aaauauaguaaaugcauaguuc

SEQ ID NO: 432594 - RNA, 22 nt, Human
uauuucuaagcuguaagucuga

SEQ ID NO: 432595 - RNA, 22 nt, Human
aagaacuuccuaauauauuuuc

SEQ ID NO: 432596 - RNA, 22 nt, Human
ggagccugagcggcccagggcc

SEQ ID NO: 432597 - RNA, 22 nt, Human
cagcccugggaucuuagugccu

SEQ ID NO: 432598 - RNA, 22 nt, Human
aacaggcacuaagcaugugggg

SEQ ID NO: 432599 - RNA, 20 nt, Human
gucuccucuuugcauuccua

SEQ ID NO: 432600 - RNA, 22 nt, Human
uccugggcaaagaggggcagug

SEQ ID NO: 432601 - RNA, 22 nt, Human
cagcaccuuccuuaacuccagg

SEQ ID NO: 432602 - RNA, 22 nt, Human
agcaggcaccagggcucguccu

SEQ ID NO: 432603 - RNA, 22 nt, Human
ggcaggccugagaggcagggcu

SEQ ID NO: 432604 - RNA, 22 nt, Human
ggagaugggggauuuuacagcg

SEQ ID NO: 432605 - RNA, 22 nt, Human
augcagcugugggcaagaaaug

SEQ ID NO: 432606 - RNA, 22 nt, Human
ggucccaggaaucuguguucua

SEQ ID NO: 432607 - RNA, 22 nt, Human
uuccaaagcugcuuuauuuagu

SEQ ID NO: 432608 - RNA, 22 nt, Human
ccagcacugcucucagacugag

SEQ ID NO: 432609 - RNA, 22 nt, Human
aaauugaauuugggaaacauug

SEQ ID NO: 432610 - RNA, 22 nt, Human
ggugucccaggccagcugugug

SEQ ID NO: 432611 - RNA, 22 nt, Human
ucugagccguauggcuuggcua

SEQ ID NO: 432612 - RNA, 22 nt, Human
uugaaagauauguuaaucuuuc

SEQ ID NO: 432613 - RNA, 22 nt, Human
uuucagagggcagaucuggggc

SEQ ID NO: 432614 - RNA, 22 nt, Human
gccugccuagaauugcagcuuu

SEQ ID NO: 432615 - RNA, 22 nt, Human
ugcucccaggcucuguggucug

SEQ ID NO: 432616 - RNA, 22 nt, Human
gcaagacaauggagcauaaacg

SEQ ID NO: 432617 - RNA, 22 nt, Human
caaacauucaaguacaagucuu

SEQ ID NO: 432618 - RNA, 22 nt, Human
agguaagcaugguggcugcugu

SEQ ID NO: 432619 - RNA, 22 nt, Human
agcuggguguguaucagauaaa

SEQ ID NO: 432620 - RNA, 22 nt, Human
ggaugcuggggaccaaucucug

SEQ ID NO: 432621 - RNA, 22 nt, Human
guuuuucuuugugugaagacaa

SEQ ID NO: 432622 - RNA, 22 nt, Human
uagugucucuuccuguuugaaa

SEQ ID NO: 432623 - RNA, 22 nt, Human
auucacuguggguccuuuggau

SEQ ID NO: 432624 - RNA, 19 nt, Human
ucagaggauuuggcuauga

SEQ ID NO: 432625 - RNA, 22 nt, Human
gccaggcucagcagucaaccug

SEQ ID NO: 432626 - RNA, 22 nt, Human
uuucagagaacugaguccuugc

SEQ ID NO: 432627 - RNA, 22 nt, Human
aaguacauggaggauagcugcu

SEQ ID NO: 432628 - RNA, 22 nt, Human
gaacuguaguuaauacuacaca

SEQ ID NO: 432629 - RNA, 22 nt, Human
ggugcaugugagaaagacuggg

SEQ ID NO: 432630 - RNA, 22 nt, Human
uuggaaaugauuucuauuauua

SEQ ID NO: 432631 - RNA, 22 nt, Human
acagaacuuccagggaacauac

SEQ ID NO: 432632 - RNA, 22 nt, Human
aagaacaugaagucacaaaugc

SEQ ID NO: 432633 - RNA, 22 nt, Human
acaggccuagggucaauuuccu

SEQ ID NO: 432634 - RNA, 22 nt, Human
auucacacuguauacacaggau

SEQ ID NO: 432635 - RNA, 22 nt, Human
gcagcccugcaggcagcuccag

SEQ ID NO: 432636 - RNA, 22 nt, Human
gcccugagccuaugagccucuc

SEQ ID NO: 432637 - RNA, 22 nt, Human
agcaggcuuguuaugucugaga

SEQ ID NO: 432638 - RNA, 22 nt, Human
agaaaugacacacaugagacau

SEQ ID NO: 432639 - RNA, 22 nt, Human
agacaaaugguaauuaugucua

SEQ ID NO: 432640 - RNA, 22 nt, Human
gacaagacaugugaugacauca

SEQ ID NO: 432641 - RNA, 22 nt, Human
ucuuaugggaaagauguaauua

SEQ ID NO: 432642 - RNA, 22 nt, Human
agucccagugagaugagccacg

SEQ ID NO: 432643 - RNA, 22 nt, Human
uuaacacugauuguagagacac

SEQ ID NO: 432644 - RNA, 22 nt, Human
ugcauuauacauggaucuaaag

SEQ ID NO: 432645 - RNA, 22 nt, Human
agcagcccaguuguacugagug

SEQ ID NO: 432646 - RNA, 23 nt, Human
ugcccacaaaaguaaagacauuu

SEQ ID NO: 432647 - RNA, 22 nt, Human
uguccucaaggagcuucagucu

SEQ ID NO: 432648 - RNA, 22 nt, Human
cagugcuccugauguacccuug

SEQ ID NO: 432649 - RNA, 22 nt, Human
uaguuaaagcccuaaauugaua

SEQ ID NO: 432650 - RNA, 22 nt, Human
gcauggcagccaguacauggug

SEQ ID NO: 432651 - RNA, 22 nt, Human
ucagaguuucaggauacaaaua

SEQ ID NO: 432652 - RNA, 22 nt, Human
gaggacacggccuuuuggaaaa

SEQ ID NO: 432653 - RNA, 22 nt, Human
ccaggaagguguuuaacuagag

SEQ ID NO: 432654 - RNA, 22 nt, Human
ugaaggcaacugagaaaaagca

SEQ ID NO: 432655 - RNA, 22 nt, Human
ucaaaggagacacaaggagaaa

SEQ ID NO: 432656 - RNA, 22 nt, Human
gacacagaccaccaggcccugg

SEQ ID NO: 432657 - RNA, 22 nt, Human
ucagaggaauaaugcugcauuu

SEQ ID NO: 432658 - RNA, 22 nt, Human
acuuaacagacauuauuuaccu

SEQ ID NO: 432659 - RNA, 22 nt, Human
ugggaggcuuccagaccuugcu

SEQ ID NO: 432660 - RNA, 22 nt, Human
gagggugggcuccuaucugggu

SEQ ID NO: 432661 - RNA, 22 nt, Human
ugcuucaggaagaaacgccagg

SEQ ID NO: 432662 - RNA, 20 nt, Human
auguagaugaaagcaaaggc

SEQ ID NO: 432663 - RNA, 20 nt, Human
ccucacagggcagagagggg

SEQ ID NO: 432664 - RNA, 22 nt, Human
ucacucagcuagcuucaggagc

SEQ ID NO: 432665 - RNA, 23 nt, Human
caggcaggaugaggacuacacuc

SEQ ID NO: 432666 - RNA, 22 nt, Human
caggguccaucuuucaucacug

SEQ ID NO: 432667 - RNA, 22 nt, Human
ggaaagagggacccagcuuggu

SEQ ID NO: 432668 - RNA, 20 nt, Human
aagagaggaaguuauacuag

SEQ ID NO: 432669 - RNA, 20 nt, Human
ucuggugccccuuccugaga

SEQ ID NO: 432670 - RNA, 22 nt, Human
agcauccagaaaacucucagaa

SEQ ID NO: 432671 - RNA, 20 nt, Human
gccucagccaacccaugggg

SEQ ID NO: 432672 - RNA, 22 nt, Human
uuggaaggcccugccuagcagg

SEQ ID NO: 432673 - RNA, 22 nt, Human
cucuuuuaugugacguguguga

SEQ ID NO: 432674 - RNA, 21 nt, Human
agcagagugcuuugacuuugu

SEQ ID NO: 432675 - RNA, 22 nt, Human
uuuuaugucauaaggacacuca

SEQ ID NO: 432676 - RNA, 22 nt, Human
ugccaggccaaugaaggcaggg

SEQ ID NO: 432677 - RNA, 22 nt, Human
cccuaggcugaggccagggugc

SEQ ID NO: 432678 - RNA, 22 nt, Human
ucacaguauaaccucauauagg

SEQ ID NO: 432679 - RNA, 22 nt, Human
ccugggccaggcuugggaaugc

SEQ ID NO: 432680 - RNA, 22 nt, Human
gcugcuuugacagugggaacag

SEQ ID NO: 432681 - RNA, 22 nt, Human
gaggcccaguccugcaagcacg

SEQ ID NO: 432682 - RNA, 18 nt, Human
gcaggcccuguuucuggg

SEQ ID NO: 432683 - RNA, 22 nt, Human
acuguguccucauguggcagaa

SEQ ID NO: 432684 - RNA, 23 nt, Human
aaaugacuaaauguucuuauaga

SEQ ID NO: 432685 - RNA, 22 nt, Human
ucaaaagacacaggaggcuagu

SEQ ID NO: 432686 - RNA, 21 nt, Human
gccagugcugucugugugauc

SEQ ID NO: 432687 - RNA, 22 nt, Human
ugucccagaucacaggagggga

SEQ ID NO: 432688 - RNA, 22 nt, Human
aaggacaccugcagagggacca

SEQ ID NO: 432689 - RNA, 22 nt, Human
aaggcagccuuuguuugauuga

SEQ ID NO: 432690 - RNA, 22 nt, Human
cucuggcugccucucaggccug

SEQ ID NO: 432691 - RNA, 21 nt, Human
uaauauagguucacaacuagu

SEQ ID NO: 432692 - RNA, 22 nt, Human
acaacuuuaauggguuucagcu

SEQ ID NO: 432693 - RNA, 22 nt, Human
aacacuuucuuccuugcucagg

SEQ ID NO: 432694 - RNA, 22 nt, Human
cagucccagacauaguaaggga

SEQ ID NO: 432695 - RNA, 19 nt, Human
gccugggaugggcagaacu

SEQ ID NO: 432696 - RNA, 22 nt, Human
uuuguacacaggauguuauaau

SEQ ID NO: 432697 - RNA, 22 nt, Human
ugagugccugaacauagaguag

SEQ ID NO: 432698 - RNA, 22 nt, Human
ugggcucuuccuauaguuuaua

SEQ ID NO: 432699 - RNA, 22 nt, Human
aaucacaugugcucaauuuuaa

SEQ ID NO: 432700 - RNA, 22 nt, Human
agcagucauuuuaggucaugca

SEQ ID NO: 432701 - RNA, 22 nt, Human
gucuggcuuuugcccuguguuu

SEQ ID NO: 432702 - RNA, 22 nt, Human
caggcaccuuugugcaugggca

SEQ ID NO: 432703 - RNA, 22 nt, Human
aggaaggacuccaugguccguc

SEQ ID NO: 432704 - RNA, 20 nt, Human
agaagcugauacugauggaa

SEQ ID NO: 432705 - RNA, 22 nt, Human
aagagaagaaagugucuacaca

SEQ ID NO: 432706 - RNA, 22 nt, Human
agcugccaucugaagaacugca

SEQ ID NO: 432707 - RNA, 22 nt, Human
ugcuuucaaaggcuuucuagau

SEQ ID NO: 432708 - RNA, 22 nt, Human
uaggcuugcuucuccuccacag

SEQ ID NO: 432709 - RNA, 22 nt, Human
cacaugaauucacauguauuuu

SEQ ID NO: 432710 - RNA, 21 nt, Human
acaguuuauuagaguaagugc

SEQ ID NO: 432711 - RNA, 22 nt, Human
ccaggccuucugaggacacucu

SEQ ID NO: 432712 - RNA, 18 nt, Human
gauauauaggaggaaagu

SEQ ID NO: 432713 - RNA, 22 nt, Human
uugacccagcuuuccccacaau

SEQ ID NO: 432714 - RNA, 21 nt, Human
gcucccuggcugugugaccug

SEQ ID NO: 432715 - RNA, 21 nt, Human
gccugccugcgugacccucuu

SEQ ID NO: 432716 - RNA, 22 nt, Human
acaugcauacaagcacauguag

SEQ ID NO: 432717 - RNA, 22 nt, Human
gcaacauuaaaccaauaauugu

SEQ ID NO: 432718 - RNA, 22 nt, Human
acauucaagaugcauucacuua

SEQ ID NO: 432719 - RNA, 22 nt, Human
aaucacaauuacuuuugcacca

SEQ ID NO: 432720 - RNA, 22 nt, Human
ucaugcagagccagucaggaua

SEQ ID NO: 432721 - RNA, 22 nt, Human
ugcaaauuuauauggugacugc

SEQ ID NO: 432722 - RNA, 22 nt, Human
aggaauugguucaagguuuauc

SEQ ID NO: 432723 - RNA, 22 nt, Human
agcuguccuggcucaggcugug

SEQ ID NO: 432724 - RNA, 22 nt, Human
gccacugugguccucccaugau

SEQ ID NO: 432725 - RNA, 22 nt, Human
cuggacaaccacucagccucag

SEQ ID NO: 432726 - RNA, 22 nt, Human
gugcaugugcauccauguguac

SEQ ID NO: 432727 - RNA, 22 nt, Human
ugggcucugaagucagucugcu

SEQ ID NO: 432728 - RNA, 22 nt, Human
uauugcaauuuggcuaaagaau

SEQ ID NO: 432729 - RNA, 22 nt, Human
ucagaggaugcuguucuuuaau

SEQ ID NO: 432730 - RNA, 22 nt, Human
gugucccaaucuacuuuucccu

SEQ ID NO: 432731 - RNA, 22 nt, Human
aaaaggaggacaugguuacaga

SEQ ID NO: 432732 - RNA, 20 nt, Human
guugcuuuagucugguuugg

SEQ ID NO: 432733 - RNA, 22 nt, Human
uauucaggucgagcuaacugcu

SEQ ID NO: 432734 - RNA, 21 nt, Human
uauaguguggauaugcugaug

SEQ ID NO: 432735 - RNA, 21 nt, Human
cuuugcaagaugucuaugaaa

SEQ ID NO: 432736 - RNA, 22 nt, Human
ggaauugguuucaagggaaagu

SEQ ID NO: 432737 - RNA, 22 nt, Human
uuucagagaaagcccaaagacu

SEQ ID NO: 432738 - RNA, 22 nt, Human
gucccaggcuuauguggagcuu

SEQ ID NO: 432739 - RNA, 22 nt, Human
uaaggcauucucaugcugugaa

SEQ ID NO: 432740 - RNA, 20 nt, Human
auuuggcaugaaguauugau

SEQ ID NO: 432741 - RNA, 22 nt, Human
aaauagcauuguauuuagcuga

SEQ ID NO: 432742 - RNA, 22 nt, Human
aguggcuuggcugcacuacagg

SEQ ID NO: 432743 - RNA, 22 nt, Human
cccagagauguccugagugaua

SEQ ID NO: 432744 - RNA, 22 nt, Human
uaaguacaaauguauacauaag

SEQ ID NO: 432745 - RNA, 22 nt, Human
ugccugugucacagugauguuu

SEQ ID NO: 432746 - RNA, 22 nt, Human
aacauucuuuagcucuuccugc

SEQ ID NO: 432747 - RNA, 22 nt, Human
gcuguuuccaguuacguggaua

SEQ ID NO: 432748 - RNA, 19 nt, Human
ugucccagacuccgugucu

SEQ ID NO: 432749 - RNA, 22 nt, Human
gcagcuggagccagccagacac

SEQ ID NO: 432750 - RNA, 22 nt, Human
caccagucuuuauuuuguuauu

SEQ ID NO: 432751 - RNA, 22 nt, Human
augggaggaugcucgggugcuc

SEQ ID NO: 432752 - RNA, 22 nt, Human
aaugccuugccugcuacaacuu

SEQ ID NO: 432753 - RNA, 22 nt, Human
acagagagaaacaaucagcagc

SEQ ID NO: 432754 - RNA, 22 nt, Human
cuuccaaaauuuauauguugaa

SEQ ID NO: 432755 - RNA, 22 nt, Human
uguaauuuucucaaguuucuac

SEQ ID NO: 432756 - RNA, 22 nt, Human
gcucuguggcaggaggucuugu

SEQ ID NO: 432757 - RNA, 22 nt, Human
acaaugcagccuauggauccag

SEQ ID NO: 432758 - RNA, 23 nt, Human
cccaggaguuucacugcaaaggu

SEQ ID NO: 432759 - RNA, 20 nt, Human
uccagaggccacauccagug

SEQ ID NO: 432760 - RNA, 23 nt, Human
ucugucaccuauggcugcucuuc

SEQ ID NO: 432761 - RNA, 22 nt, Human
ucugaggccuugggacagaagu

SEQ ID NO: 432762 - RNA, 23 nt, Human
aggcugcagaagaauagggucau

SEQ ID NO: 432763 - RNA, 21 nt, Human
acacagaggcaucaucacuuu

SEQ ID NO: 432764 - RNA, 22 nt, Human
aggcuugggacugcuuaggagc

SEQ ID NO: 432765 - RNA, 22 nt, Human
cucugccaucuuggagcucaag

SEQ ID NO: 432766 - RNA, 22 nt, Human
aaggaagaagggaaguuacuua

SEQ ID NO: 432767 - RNA, 22 nt, Human
cugugucggacgugggcagcag

SEQ ID NO: 432768 - RNA, 23 nt, Human
uugcaaaaugcaauugaguuaga

SEQ ID NO: 432769 - RNA, 22 nt, Human
uacuuugguuaaugaaauguga

SEQ ID NO: 432770 - RNA, 22 nt, Human
agccuguggaucccugcacugg

SEQ ID NO: 432771 - RNA, 22 nt, Human
uuuauaggguagcuaggauuga

SEQ ID NO: 432772 - RNA, 22 nt, Human
caggacaguauaggcuuuagga

SEQ ID NO: 432773 - RNA, 22 nt, Human
ucacauuuucuacuacuguacg

SEQ ID NO: 432774 - RNA, 22 nt, Human
accacugcccauggugaaaacu

SEQ ID NO: 432775 - RNA, 22 nt, Human
gcugccacauuuucaggacuaa

SEQ ID NO: 432776 - RNA, 22 nt, Human
uucacaguggcuuaggcuaugg

SEQ ID NO: 432777 - RNA, 22 nt, Human
agggaagcuuguuacugagaag

SEQ ID NO: 432778 - RNA, 22 nt, Human
cagagggcucaguccugcugga

SEQ ID NO: 432779 - RNA, 22 nt, Human
gggcacagucuaaaguugggcc

SEQ ID NO: 432780 - RNA, 22 nt, Human
aggcagcuggcaaauucuagag

SEQ ID NO: 432781 - RNA, 22 nt, Human
cuggcccuggagggcugugcga

SEQ ID NO: 432782 - RNA, 22 nt, Human
acagagcaguucuggagcuggc

SEQ ID NO: 432783 - RNA, 22 nt, Human
gcucccaggcauggagguaauu

SEQ ID NO: 432784 - RNA, 22 nt, Human
aggcuccaccagucaggugcau

SEQ ID NO: 432785 - RNA, 22 nt, Human
auacaauccagccauugccaca

SEQ ID NO: 432786 - RNA, 22 nt, Human
ggccccucagcaucugagucag

SEQ ID NO: 432787 - RNA, 22 nt, Human
aaggcugaggagggccugcagg

SEQ ID NO: 432788 - RNA, 22 nt, Human
uuuauuaagaugcgaaugcuga

SEQ ID NO: 432789 - RNA, 22 nt, Human
gagcccagggugaaauagcagc

SEQ ID NO: 432790 - RNA, 22 nt, Human
guugcaaaugggaagaugguua

SEQ ID NO: 432791 - RNA, 22 nt, Human
gagcccugcccacuugucugag

SEQ ID NO: 432792 - RNA, 22 nt, Human
cuacuuugcugcccagcagugc

SEQ ID NO: 432793 - RNA, 22 nt, Human
gcucuggguagccacugccugg

SEQ ID NO: 432794 - RNA, 22 nt, Human
cagcccuugcgacacccuggcu

SEQ ID NO: 432795 - RNA, 22 nt, Human
cugcucuguucccccaucaucu

SEQ ID NO: 432796 - RNA, 22 nt, Human
uuucaaacugggagugagggga

SEQ ID NO: 432797 - RNA, 22 nt, Human
cucuccacucagcgucaugucc

SEQ ID NO: 432798 - RNA, 22 nt, Human
auucaaacacuuugagaaguuc

SEQ ID NO: 432799 - RNA, 20 nt, Human
ucacaauaugagcucauaca

SEQ ID NO: 432800 - RNA, 22 nt, Human
ugaugauuucauuucuagcugu

SEQ ID NO: 432801 - RNA, 22 nt, Human
agauuggguuugcuucugugcc

SEQ ID NO: 432802 - RNA, 18 nt, Human
uuggcuuugagaacuggu

SEQ ID NO: 432803 - RNA, 22 nt, Human
aggcugagguaggaggaucgcu

SEQ ID NO: 432804 - RNA, 22 nt, Human
gaggcuaagcacuggcauuucu

SEQ ID NO: 432805 - RNA, 22 nt, Human
uuguacaacacauauucuacag

SEQ ID NO: 432806 - RNA, 22 nt, Human
agugcugucccgacaacugagg

SEQ ID NO: 432807 - RNA, 22 nt, Human
ugagccaguggaagauggcagu

SEQ ID NO: 432808 - RNA, 22 nt, Human
uacauuaucuuguuaucuuuca

SEQ ID NO: 432809 - RNA, 22 nt, Human
gcuggcuguguuucaucucuga

SEQ ID NO: 432810 - RNA, 22 nt, Human
cugcccucccaguugguccgug

SEQ ID NO: 432811 - RNA, 22 nt, Human
gcagggacagggcagggccuuu

SEQ ID NO: 432812 - RNA, 22 nt, Human
cagcugagaaauggggaaaggg

SEQ ID NO: 432813 - RNA, 22 nt, Human
aaauuauuacaagcuaguuggc

SEQ ID NO: 432814 - RNA, 22 nt, Human
ugguacaaggguugggagacag

SEQ ID NO: 432815 - RNA, 22 nt, Human
gaaauauuacaguggaggggau

SEQ ID NO: 432816 - RNA, 22 nt, Human
agggcagaccacgugcaaggau

SEQ ID NO: 432817 - RNA, 22 nt, Human
acaggaggggcaugaaagacgg

SEQ ID NO: 432818 - RNA, 17 nt, Human
uuuucuccugcccauuc

SEQ ID NO: 432819 - RNA, 22 nt, Human
ccugggagaacugcuggguugg

SEQ ID NO: 432820 - RNA, 22 nt, Human
gcugaagcugcagcaggaggaa

SEQ ID NO: 432821 - RNA, 22 nt, Human
uggugaggucauagagaacugu

SEQ ID NO: 432822 - RNA, 23 nt, Human
uuacaguaggaguuggaaaacca

SEQ ID NO: 432823 - RNA, 22 nt, Human
cuuaaauuuucaucuacaagaa

SEQ ID NO: 432824 - RNA, 21 nt, Human
gcucucugcaugguggcucag

SEQ ID NO: 432825 - RNA, 22 nt, Human
ucccuccccacuucugagcuuu

SEQ ID NO: 432826 - RNA, 22 nt, Human
gcuguuucggguggagguggag

SEQ ID NO: 432827 - RNA, 22 nt, Human
caggaaauucaagagaggcugc

SEQ ID NO: 432828 - RNA, 23 nt, Human
gcugucaguuguuuuugucucua

SEQ ID NO: 432829 - RNA, 22 nt, Human
ugcccagcuucuuacuuuuaaa

SEQ ID NO: 432830 - RNA, 22 nt, Human
aaguccugaaacuucuuucuga

SEQ ID NO: 432831 - RNA, 22 nt, Human
cccaggucugugccagcucuga

SEQ ID NO: 432832 - RNA, 22 nt, Human
uguagugugacauaggugucca

SEQ ID NO: 432833 - RNA, 22 nt, Human
uuauugcaccaugccucaguuu

SEQ ID NO: 432834 - RNA, 22 nt, Human
cugggaguuucuagagaaagac

SEQ ID NO: 432835 - RNA, 22 nt, Human
ccaggguggaggcuggauggag

SEQ ID NO: 432836 - RNA, 22 nt, Human
caaauucaaugaacauguuuaa

SEQ ID NO: 432837 - RNA, 22 nt, Human
gcaagcaguuacccaggauucg

SEQ ID NO: 432838 - RNA, 22 nt, Human
aaggagacauuugcagagcacc

SEQ ID NO: 432839 - RNA, 22 nt, Human
gucaggggaugugcugguggcc

SEQ ID NO: 432840 - RNA, 22 nt, Human
gagccugaugaaacaggcagac

SEQ ID NO: 432841 - RNA, 20 nt, Human
caggaugauuggacacgaug

SEQ ID NO: 432842 - RNA, 22 nt, Human
ugcccugcagugagugcgucug

SEQ ID NO: 432843 - RNA, 22 nt, Human
uuuaaagaaauuccucaucuuu

SEQ ID NO: 432844 - RNA, 22 nt, Human
augaugcaccauuauaagaguu

SEQ ID NO: 432845 - RNA, 22 nt, Human
gauuuuacaugucauaucuauu

SEQ ID NO: 432846 - RNA, 22 nt, Human
uggugugggcguggcaggcaag

SEQ ID NO: 432847 - RNA, 22 nt, Human
agagucuuccaggcagccugag

SEQ ID NO: 432848 - RNA, 22 nt, Human
aggcuugacugcugauuuugcc

SEQ ID NO: 432849 - RNA, 22 nt, Human
aagcagagccaccagcuuugga

SEQ ID NO: 432850 - RNA, 22 nt, Human
cacgugagaccuugcagaggug

SEQ ID NO: 432851 - RNA, 23 nt, Human
ugacaagucucagccaaugcaga

SEQ ID NO: 432852 - RNA, 22 nt, Human
gcuugcagcaggugcuuaggaa

SEQ ID NO: 432853 - RNA, 22 nt, Human
gacaagacagcuugcagacaac

SEQ ID NO: 432854 - RNA, 22 nt, Human
ccugccugguguaagucuaagg

SEQ ID NO: 432855 - RNA, 20 nt, Human
uucuugagccaaaaggcaua

SEQ ID NO: 432856 - RNA, 22 nt, Human
ugugugugugcgcgcacgcaua

SEQ ID NO: 432857 - RNA, 19 nt, Human
caguuccagcuucuugacc

SEQ ID NO: 432858 - RNA, 22 nt, Human
ucaggcugggagacaaucacug

SEQ ID NO: 432859 - RNA, 22 nt, Human
gugagcagaacagguggcuucu

SEQ ID NO: 432860 - RNA, 22 nt, Human
aagagggcugcaaucuuauugc

SEQ ID NO: 432861 - RNA, 22 nt, Human
gcuuuucauagauaaaauucua

SEQ ID NO: 432862 - RNA, 18 nt, Human
accuccccauuuucugaa

SEQ ID NO: 432863 - RNA, 22 nt, Human
aguggcagagucaggguuugga

SEQ ID NO: 432864 - RNA, 22 nt, Human
gggcaggugugcagagcuguug

SEQ ID NO: 432865 - RNA, 22 nt, Human
gcccuagggggaaccgaggacu

SEQ ID NO: 432866 - RNA, 22 nt, Human
ccagcugggauuaagggaaaau

SEQ ID NO: 432867 - RNA, 22 nt, Human
uugcaggggaaggagcagagcu

SEQ ID NO: 432868 - RNA, 20 nt, Human
ugcaggcuucgcucuaggag

SEQ ID NO: 432869 - RNA, 22 nt, Human
gagguucgauacagcguauuua

SEQ ID NO: 432870 - RNA, 22 nt, Human
acugggccuggauuggcguguc

SEQ ID NO: 432871 - RNA, 22 nt, Human
ggacagagagugaauaugacau

SEQ ID NO: 432872 - RNA, 22 nt, Human
agagcccuggagggcagucccg

SEQ ID NO: 432873 - RNA, 22 nt, Human
cuggccagacuacacaugugug

SEQ ID NO: 432874 - RNA, 22 nt, Human
cuguauauggcuuacuuuauau

SEQ ID NO: 432875 - RNA, 22 nt, Human
caggggccggcuguccgugccc

SEQ ID NO: 432876 - RNA, 22 nt, Human
aaggcucugcaaaaccuccaag

SEQ ID NO: 432877 - RNA, 22 nt, Human
caaguucacaugcauccuugcu

SEQ ID NO: 432878 - RNA, 22 nt, Human
acuuuguaggaaaaagucacaa

SEQ ID NO: 432879 - RNA, 22 nt, Human
uccugaagaggcuacacugcuu

SEQ ID NO: 432880 - RNA, 22 nt, Human
uuucuugugccuaauuuugggc

SEQ ID NO: 432881 - RNA, 22 nt, Human
cacaggagaaaggggaagcucg

SEQ ID NO: 432882 - RNA, 22 nt, Human
acagaugagaagcugcauucaa

SEQ ID NO: 432883 - RNA, 20 nt, Human
uuguuuaaaggugaagaggc

SEQ ID NO: 432884 - RNA, 21 nt, Human
cacugcagccuugaccugggc

SEQ ID NO: 432885 - RNA, 22 nt, Human
acuuuuuacaggguguauacca

SEQ ID NO: 432886 - RNA, 22 nt, Human
cagcccugcuggcaaugaugag

SEQ ID NO: 432887 - RNA, 22 nt, Human
ucucagcugccugcccugcucc

SEQ ID NO: 432888 - RNA, 22 nt, Human
uccagcagugcucuagagcgug

SEQ ID NO: 432889 - RNA, 21 nt, Human
acaaugcauggaacucauggc

SEQ ID NO: 432890 - RNA, 22 nt, Human
agcugccacauggugucacugu

SEQ ID NO: 432891 - RNA, 21 nt, Human
gccagccuguuuaccuguggu

SEQ ID NO: 432892 - RNA, 22 nt, Human
gaagcugaugaggaccagauug

SEQ ID NO: 432893 - RNA, 22 nt, Human
uuauuuguggcauaugagacga

SEQ ID NO: 432894 - RNA, 22 nt, Human
gaggccuccucugagacaucug

SEQ ID NO: 432895 - RNA, 22 nt, Human
gacagggcgcccagccuguuuc

SEQ ID NO: 432896 - RNA, 22 nt, Human
ccuggaaagagaaugaaugagc

SEQ ID NO: 432897 - RNA, 22 nt, Human
uucuggcucuccccugcugggu

SEQ ID NO: 432898 - RNA, 22 nt, Human
gaggcagcuuaggguacugacu

SEQ ID NO: 432899 - RNA, 22 nt, Human
ucuugggauugcccugcaguuc

SEQ ID NO: 432900 - RNA, 22 nt, Human
gaagcccauuuguacagcacau

SEQ ID NO: 432901 - RNA, 22 nt, Human
guccuggggaauacagaagccg

SEQ ID NO: 432902 - RNA, 22 nt, Human
agcugccauccgaggugucaga

SEQ ID NO: 432903 - RNA, 22 nt, Human
gcucagaggccacuguuggaaa

SEQ ID NO: 432904 - RNA, 20 nt, Human
aacaguaccauuuaucucag

SEQ ID NO: 432905 - RNA, 22 nt, Human
cagcccugcggagguguauacu

SEQ ID NO: 432906 - RNA, 22 nt, Human
uguauuuaauuguaucaucaca

SEQ ID NO: 432907 - RNA, 22 nt, Human
cuggagccagccagggcccucu

SEQ ID NO: 432908 - RNA, 22 nt, Human
cugcacagagcagggcagacac

SEQ ID NO: 432909 - RNA, 19 nt, Human
gcuccugggccucacucau

SEQ ID NO: 432910 - RNA, 22 nt, Human
acaugcaaaaauauauuuauga

SEQ ID NO: 432911 - RNA, 22 nt, Human
agcagguggacagaggaagaaa

SEQ ID NO: 432912 - RNA, 19 nt, Human
uggccagguacugucugcu

SEQ ID NO: 432913 - RNA, 22 nt, Human
uugucugacuucuuuaguuacu

SEQ ID NO: 432914 - RNA, 19 nt, Human
ccagcagacacagcugccc

SEQ ID NO: 432915 - RNA, 22 nt, Human
caaaugaauauuuccauggguu

SEQ ID NO: 432916 - RNA, 22 nt, Human
cacaauuagcagcucuuuauuu

SEQ ID NO: 432917 - RNA, 22 nt, Human
uggcuucagagacagaaucuau

SEQ ID NO: 432918 - RNA, 22 nt, Human
cugagguggaacagaggugaag

SEQ ID NO: 432919 - RNA, 22 nt, Human
ccaguucuucuugacacgaaag

SEQ ID NO: 432920 - RNA, 22 nt, Human
agcaggcagcaugggacccucc

SEQ ID NO: 432921 - RNA, 22 nt, Human
gcugaagcccacguggcuugua

SEQ ID NO: 432922 - RNA, 22 nt, Human
uuuuauuggagugauaccaagc

SEQ ID NO: 432923 - RNA, 22 nt, Human
acuucauauuguuuccacuaga

SEQ ID NO: 432924 - RNA, 22 nt, Human
aacacuuuuuaguaaagauuga

SEQ ID NO: 432925 - RNA, 18 nt, Human
gcaggugccacugcuguu

SEQ ID NO: 432926 - RNA, 22 nt, Human
auugcaaaauuguccuguggaa

SEQ ID NO: 432927 - RNA, 22 nt, Human
agagcagcugugacauggacag

SEQ ID NO: 432928 - RNA, 22 nt, Human
cgcgguggcggccuccagcgcc

SEQ ID NO: 432929 - RNA, 22 nt, Human
uugagaaaggggucaauaucuc

SEQ ID NO: 432930 - RNA, 22 nt, Human
uugauaucucugcuguguuagg

SEQ ID NO: 432931 - RNA, 22 nt, Human
gcaggcugagaguccaagaagg

SEQ ID NO: 432932 - RNA, 22 nt, Human
gcagcaaagcucuucaugugau

SEQ ID NO: 432933 - RNA, 22 nt, Human
gagugcagaugaacagaagauu

SEQ ID NO: 432934 - RNA, 22 nt, Human
cagacagaaggcuccuugaggu

SEQ ID NO: 432935 - RNA, 22 nt, Human
cagcccugccauggagccuccu

SEQ ID NO: 432936 - RNA, 22 nt, Human
caauacaauuaccaguuaauca

SEQ ID NO: 432937 - RNA, 22 nt, Human
ggagaguggauuccagcuguau

SEQ ID NO: 432938 - RNA, 22 nt, Human
ggcugcacgccucucagcuugc

SEQ ID NO: 432939 - RNA, 22 nt, Human
ccuggaaaaugccacuuucaca

SEQ ID NO: 432940 - RNA, 22 nt, Human
ugggacacccucacgccugcac

SEQ ID NO: 432941 - RNA, 19 nt, Human
gguggcucagggcccagcc

SEQ ID NO: 432942 - RNA, 22 nt, Human
cauggugaggggugaagggcag

SEQ ID NO: 432943 - RNA, 22 nt, Human
ucugcugcugcagcuacacuau

SEQ ID NO: 432944 - RNA, 22 nt, Human
uccuuagacaaagagugggcuu

SEQ ID NO: 432945 - RNA, 22 nt, Human
aguucacauuccgagguacugg

SEQ ID NO: 432946 - RNA, 22 nt, Human
gcuccagggucagcucagaacu

SEQ ID NO: 432947 - RNA, 22 nt, Human
uggaaagagaaacucuugcuaa

SEQ ID NO: 432948 - RNA, 22 nt, Human
gaccugccugagcugccucugc

SEQ ID NO: 432949 - RNA, 22 nt, Human
aaggcagccaugugcuuugggu

SEQ ID NO: 432950 - RNA, 22 nt, Human
uuuuuguauagaaaugaacuaa

SEQ ID NO: 432951 - RNA, 22 nt, Human
agcuguuuaauaaaugucuguu

SEQ ID NO: 432952 - RNA, 22 nt, Human
uacuaggaagcagcugcauugg

SEQ ID NO: 432953 - RNA, 22 nt, Human
ccccagcugcauacuugccaag

SEQ ID NO: 432954 - RNA, 22 nt, Human
ucuccaggugcuaagugugccu

SEQ ID NO: 432955 - RNA, 21 nt, Human
ugcaguauguauuuguaucca

SEQ ID NO: 432956 - RNA, 22 nt, Human
aagcugcccuguguuagaguuc

SEQ ID NO: 432957 - RNA, 22 nt, Human
aaacaucaauugcaucucccaa

SEQ ID NO: 432958 - RNA, 22 nt, Human
cccaggagacagaaacagaggu

SEQ ID NO: 432959 - RNA, 22 nt, Human
cugaagucccuguuuuguuuac

SEQ ID NO: 432960 - RNA, 22 nt, Human
cugggccuccacgggccaucac

SEQ ID NO: 432961 - RNA, 22 nt, Human
guucaaauggcugcaguuacca

SEQ ID NO: 432962 - RNA, 22 nt, Human
gcugucacauuuggagcacugg

SEQ ID NO: 432963 - RNA, 22 nt, Human
acccucugagaggcacacuuug

SEQ ID NO: 432964 - RNA, 22 nt, Human
cugagcagucuagccagguguu

SEQ ID NO: 432965 - RNA, 17 nt, Human
ucuacuccugaaggaag

SEQ ID NO: 432966 - RNA, 22 nt, Human
ucuaaagagaaccuuuucucau

SEQ ID NO: 432967 - RNA, 21 nt, Human
uuucuuaucuguaaaguggga

SEQ ID NO: 432968 - RNA, 22 nt, Human
ggcaccagggacaauccucuuc

SEQ ID NO: 432969 - RNA, 22 nt, Human
guacaaaaguuauugcgguuuu

SEQ ID NO: 432970 - RNA, 22 nt, Human
ugcauuauuacaagguaagacu

SEQ ID NO: 432971 - RNA, 22 nt, Human
ucagagacaccagagagcugug

SEQ ID NO: 432972 - RNA, 22 nt, Human
ugcaggaaaaauaaauaguguu

SEQ ID NO: 432973 - RNA, 22 nt, Human
agccagaggaacuugaugacug

SEQ ID NO: 432974 - RNA, 22 nt, Human
cccaggagguuggggcuacagu

SEQ ID NO: 432975 - RNA, 22 nt, Human
cagaauuucagugauguuuucu

SEQ ID NO: 432976 - RNA, 23 nt, Human
agcuccugaggccagccucuccu

SEQ ID NO: 432977 - RNA, 22 nt, Human
uucucacaggcuggaaugauga

SEQ ID NO: 432978 - RNA, 18 nt, Human
ccugcagcccaggaggcc

SEQ ID NO: 432979 - RNA, 18 nt, Human
cugccacuuaauguggug

SEQ ID NO: 432980 - RNA, 22 nt, Human
gcuuccaguccucagaggcugg

SEQ ID NO: 432981 - RNA, 22 nt, Human
cagcccugugcggagggcccug

SEQ ID NO: 432982 - RNA, 22 nt, Human
ggagcucaguggggggacugug

SEQ ID NO: 432983 - RNA, 22 nt, Human
caucuuuaguuauugaauauag

SEQ ID NO: 432984 - RNA, 22 nt, Human
auuauugcaauuugacauucag

SEQ ID NO: 432985 - RNA, 22 nt, Human
gaagaaauguguucaagguagg

SEQ ID NO: 432986 - RNA, 19 nt, Human
gauuucuacaaaugucaga

SEQ ID NO: 432987 - RNA, 22 nt, Human
uuugaaaggugucgagaugugu

SEQ ID NO: 432988 - RNA, 22 nt, Human
agggcccaugugggagcacuug

SEQ ID NO: 432989 - RNA, 22 nt, Human
agcagggcagugaucagaaagg

SEQ ID NO: 432990 - RNA, 22 nt, Human
ccugggaggcggagguugcagg

SEQ ID NO: 432991 - RNA, 22 nt, Human
ugcacacaccgugcuucacuga

SEQ ID NO: 432992 - RNA, 22 nt, Human
cagcagccuggccccuccucgg

SEQ ID NO: 432993 - RNA, 22 nt, Human
gcagcguggggcugagucagcu

SEQ ID NO: 432994 - RNA, 22 nt, Human
ccacagcaggacuggagccgcc

SEQ ID NO: 432995 - RNA, 22 nt, Human
cagcauggcuugaguguuuccu

SEQ ID NO: 432996 - RNA, 22 nt, Human
ccucacagggccaggccccuca

SEQ ID NO: 432997 - RNA, 22 nt, Human
aagugaaucuccuuucuuuauu

SEQ ID NO: 432998 - RNA, 22 nt, Human
augcaguuagguaauagucuca

SEQ ID NO: 432999 - RNA, 22 nt, Human
ugcugggcuaggguggagcucu

SEQ ID NO: 433000 - RNA, 22 nt, Human
ggcucucagggaaaggccuccc

SEQ ID NO: 433001 - RNA, 22 nt, Human
uuccuaacaaacuucagugaau

SEQ ID NO: 433002 - RNA, 22 nt, Human
ccagcuccucuucccaguguca

SEQ ID NO: 433003 - RNA, 22 nt, Human
gcccacaguuaaugggggcucu

SEQ ID NO: 433004 - RNA, 22 nt, Human
cccuggaguccggagcucaccu

SEQ ID NO: 433005 - RNA, 22 nt, Human
aguguuguaugggaugacugcu

SEQ ID NO: 433006 - RNA, 22 nt, Human
ugcccagcagggagcuaccugg

SEQ ID NO: 433007 - RNA, 22 nt, Human
uaugcaaagccacccagggacg

SEQ ID NO: 433008 - RNA, 22 nt, Human
gaggggcugcccuggugucagg

SEQ ID NO: 433009 - RNA, 22 nt, Human
uugaggccugcuggaagguguu

SEQ ID NO: 433010 - RNA, 22 nt, Human
ugcacacacaugcagagggaga

SEQ ID NO: 433011 - RNA, 22 nt, Human
gauggaagaaaaaugcaugucu

SEQ ID NO: 433012 - RNA, 22 nt, Human
aggaaagcaauggcugagaaca

SEQ ID NO: 433013 - RNA, 22 nt, Human
cccagcuccaagggacagcgaa

SEQ ID NO: 433014 - RNA, 22 nt, Human
ggcagacacucaaaagcuggga

SEQ ID NO: 433015 - RNA, 22 nt, Human
ugaggcagcaauugauuauuca

SEQ ID NO: 433016 - RNA, 22 nt, Human
ucagacagaggagcucgugcag

SEQ ID NO: 433017 - RNA, 22 nt, Human
aaucuuuuucacaagaaagcac

SEQ ID NO: 433018 - RNA, 22 nt, Human
cuucccuucugugcagggcaga

SEQ ID NO: 433019 - RNA, 22 nt, Human
aaaaugaacagaacaaugggga

SEQ ID NO: 433020 - RNA, 22 nt, Human
cuuugcagauuuguuuagugcu

SEQ ID NO: 433021 - RNA, 23 nt, Human
ucagagaggcccccugcagagau

SEQ ID NO: 433022 - RNA, 22 nt, Human
gaggacagugugaucugccagc

SEQ ID NO: 433023 - RNA, 22 nt, Human
cuggacaggcuggggacugcaa

SEQ ID NO: 433024 - RNA, 22 nt, Human
gcagugguccaguucacaccca

SEQ ID NO: 433025 - RNA, 22 nt, Human
aaaguugaccgaaagauuuuga

SEQ ID NO: 433026 - RNA, 22 nt, Human
guggcagagcaggagacaggac

SEQ ID NO: 433027 - RNA, 22 nt, Human
ggcaccaggggauguaaugucc

SEQ ID NO: 433028 - RNA, 22 nt, Human
ccuggagggcgccgcacagucc

SEQ ID NO: 433029 - RNA, 22 nt, Human
gacagggccaaaccggcugauc

SEQ ID NO: 433030 - RNA, 22 nt, Human
aagugacauaccuuacauaugu

SEQ ID NO: 433031 - RNA, 22 nt, Human
ucagaagggaaacacaagugac

SEQ ID NO: 433032 - RNA, 22 nt, Human
auuaaauuuucacuaggcuccc

SEQ ID NO: 433033 - RNA, 22 nt, Human
ucacacagugagcggggcucag

SEQ ID NO: 433034 - RNA, 22 nt, Human
gcaguaugaguguuuuagacau

SEQ ID NO: 433035 - RNA, 22 nt, Human
agacuuugagcucuuagagaag

SEQ ID NO: 433036 - RNA, 22 nt, Human
gcugagcugggacaguccuggg

SEQ ID NO: 433037 - RNA, 22 nt, Human
uuaggauuugaaaaggggcaga

SEQ ID NO: 433038 - RNA, 22 nt, Human
agagcugcccacacagcagauu

SEQ ID NO: 433039 - RNA, 22 nt, Human
ucaugcaggcagccuuuaguaa

SEQ ID NO: 433040 - RNA, 23 nt, Human
gggugggccaaauuagguagccu

SEQ ID NO: 433041 - RNA, 22 nt, Human
gggccaugagagguucaucaac

SEQ ID NO: 433042 - RNA, 22 nt, Human
aaugauauagcagacauagccu

SEQ ID NO: 433043 - RNA, 22 nt, Human
aaggcagcagaggaaaggugcu

SEQ ID NO: 433044 - RNA, 22 nt, Human
auuugucauguauguaaaguug

SEQ ID NO: 433045 - RNA, 22 nt, Human
uuaacaugucuugacuucaucu

SEQ ID NO: 433046 - RNA, 22 nt, Human
uuucuaaaugguggcugcauug

SEQ ID NO: 433047 - RNA, 19 nt, Human
aggaaggaaccugagucug

SEQ ID NO: 433048 - RNA, 22 nt, Human
uggcagaugugguuugagacag

SEQ ID NO: 433049 - RNA, 21 nt, Human
ugacuuuauuugacagcccag

SEQ ID NO: 433050 - RNA, 22 nt, Human
cucagagccaguuagcaggugc

SEQ ID NO: 433051 - RNA, 23 nt, Human
auugaacagagagaaaaacaucc

SEQ ID NO: 433052 - RNA, 22 nt, Human
cucagaguccccacaucugggu

SEQ ID NO: 433053 - RNA, 22 nt, Human
agagccugaggaugucccagcu

SEQ ID NO: 433054 - RNA, 22 nt, Human
uugcugaucugugaaucagcca

SEQ ID NO: 433055 - RNA, 22 nt, Human
auaaaggcagauuuuggaccuc

SEQ ID NO: 433056 - RNA, 22 nt, Human
gaugauuuuaguugacuaaacu

SEQ ID NO: 433057 - RNA, 22 nt, Human
uuaagggccauuauggaugggu

SEQ ID NO: 433058 - RNA, 22 nt, Human
auaaauuuauaauuguuuccug

SEQ ID NO: 433059 - RNA, 22 nt, Human
gcagcuguacuggcagcauugu

SEQ ID NO: 433060 - RNA, 22 nt, Human
aaagggccuccgccugggcagg

SEQ ID NO: 433061 - RNA, 22 nt, Human
cugcccuggcagccuaccaugg

SEQ ID NO: 433062 - RNA, 22 nt, Human
cagcaaagguagaagcacagga

SEQ ID NO: 433063 - RNA, 22 nt, Human
cuggaagguaacaaggccauua

SEQ ID NO: 433064 - RNA, 22 nt, Human
gaaggagggugcggaucugagc

SEQ ID NO: 433065 - RNA, 22 nt, Human
ucugucacuuuuauuuacugaa

SEQ ID NO: 433066 - RNA, 22 nt, Human
augacagacccucuaaagacaa

SEQ ID NO: 433067 - RNA, 22 nt, Human
gagcugagauuugaagcaaguu

SEQ ID NO: 433068 - RNA, 22 nt, Human
aggcugcagugcagguaggauu

SEQ ID NO: 433069 - RNA, 22 nt, Human
gggcagacugguuauacacggg

SEQ ID NO: 433070 - RNA, 22 nt, Human
gaugcauuacaaaagugauuau

SEQ ID NO: 433071 - RNA, 22 nt, Human
acugucacuccaacugagucgu

SEQ ID NO: 433072 - RNA, 22 nt, Human
ugcaguggaagagguggagauc

SEQ ID NO: 433073 - RNA, 18 nt, Human
acaggccucaguccugca

SEQ ID NO: 433074 - RNA, 22 nt, Human
uaugacaagaaauacagaggua

SEQ ID NO: 433075 - RNA, 22 nt, Human
gccuucugcgcucgugucuccg

SEQ ID NO: 433076 - RNA, 17 nt, Human
uaaagccagucaaguca

SEQ ID NO: 433077 - RNA, 22 nt, Human
acauucaaaauauuucugaugu

SEQ ID NO: 433078 - RNA, 22 nt, Human
aaguccugggugagaacugucc

SEQ ID NO: 433079 - RNA, 22 nt, Human
uuugggcaagguccagauuccu

SEQ ID NO: 433080 - RNA, 20 nt, Human
uccagccacuuccgcugguc

SEQ ID NO: 433081 - RNA, 22 nt, Human
uaaggcagugaaacuauucugu

SEQ ID NO: 433082 - RNA, 22 nt, Human
guucaaguuaugccuuuacccu

SEQ ID NO: 433083 - RNA, 22 nt, Human
caaauagugucacauugugagg

SEQ ID NO: 433084 - RNA, 22 nt, Human
gccugagaucagccaagccccu

SEQ ID NO: 433085 - RNA, 20 nt, Human
cugcccugcccuggguccug

SEQ ID NO: 433086 - RNA, 22 nt, Human
agacuucacucccagagauucu

SEQ ID NO: 433087 - RNA, 22 nt, Human
cauugguuugauauugccaugg

SEQ ID NO: 433088 - RNA, 22 nt, Human
cuggggggagcugcguccagca

SEQ ID NO: 433089 - RNA, 22 nt, Human
ugagcuuccucccugcauccau

SEQ ID NO: 433090 - RNA, 23 nt, Human
cccaggagccugaguccucucug

SEQ ID NO: 433091 - RNA, 22 nt, Human
uagucccauuuugagguauuug

SEQ ID NO: 433092 - RNA, 22 nt, Human
ugugagcacugugaugcuguuc

SEQ ID NO: 433093 - RNA, 22 nt, Human
ugacuugucucuuugggagaca

SEQ ID NO: 433094 - RNA, 22 nt, Human
cagcugaaagaaggaaguguca

SEQ ID NO: 433095 - RNA, 23 nt, Human
cugcauauggagguuagcaacuc

SEQ ID NO: 433096 - RNA, 21 nt, Human
aggcccuggaggucagagaaa

SEQ ID NO: 433097 - RNA, 22 nt, Human
uacagcagggcgcugugaugaa

SEQ ID NO: 433098 - RNA, 22 nt, Human
augaauggauggggucaagaua

SEQ ID NO: 433099 - RNA, 22 nt, Human
accaaaaagauauguugaagcc

SEQ ID NO: 433100 - RNA, 22 nt, Human
uuggccaguggaaagaggagga

SEQ ID NO: 433101 - RNA, 22 nt, Human
ccccagagaaagucagcagcau

SEQ ID NO: 433102 - RNA, 23 nt, Human
cagaccuggcagucauccucaac

SEQ ID NO: 433103 - RNA, 22 nt, Human
uugggaggucauaaaucuguuc

SEQ ID NO: 433104 - RNA, 22 nt, Human
uccagcuggcccggccaugaau

SEQ ID NO: 433105 - RNA, 22 nt, Human
ucaggcugccuaucagacugug

SEQ ID NO: 433106 - RNA, 22 nt, Human
gaaguucacauagcuggcaggu

SEQ ID NO: 433107 - RNA, 22 nt, Human
acacuuugauagauaaugcagg

SEQ ID NO: 433108 - RNA, 22 nt, Human
auuuucucucaaaccuuaaaau

SEQ ID NO: 433109 - RNA, 22 nt, Human
cagggacagacagauauauuug

SEQ ID NO: 433110 - RNA, 22 nt, Human
ggagcagcacugccacacagag

SEQ ID NO: 433111 - RNA, 22 nt, Human
gcacccaggcuugggcagcaac

SEQ ID NO: 433112 - RNA, 23 nt, Human
cugcccugaucuugaucuauugu

SEQ ID NO: 433113 - RNA, 22 nt, Human
aauuauauuguggugugaaugu

SEQ ID NO: 433114 - RNA, 20 nt, Human
cugcuuaaguaagugacaca

SEQ ID NO: 433115 - RNA, 22 nt, Human
uccuggaggcaaaugaagacuc

SEQ ID NO: 433116 - RNA, 22 nt, Human
ggcauggacgucucugaggcca

SEQ ID NO: 433117 - RNA, 22 nt, Human
cagaauuuagcacaauguaugg

SEQ ID NO: 433118 - RNA, 22 nt, Human
gagccccaggacagcucuaguu

SEQ ID NO: 433119 - RNA, 22 nt, Human
cauuuguaauacugacuugcag

SEQ ID NO: 433120 - RNA, 22 nt, Human
agaagcugacagaugcagcagg

SEQ ID NO: 433121 - RNA, 23 nt, Human
ugccucugccucccuagucugca

SEQ ID NO: 433122 - RNA, 22 nt, Human
cugccaucugaggguccagccu

SEQ ID NO: 433123 - RNA, 22 nt, Human
augaggccuaucuuggcagagg

SEQ ID NO: 433124 - RNA, 22 nt, Human
ugguacaacuguauuaggcaaa

SEQ ID NO: 433125 - RNA, 22 nt, Human
auuauugccagcuauuacaaca

SEQ ID NO: 433126 - RNA, 22 nt, Human
aggaugagagauacauggagca

SEQ ID NO: 433127 - RNA, 22 nt, Human
uguuucagagcacugggcuuau

SEQ ID NO: 433128 - RNA, 22 nt, Human
agcaggcugggcaauaugggca

SEQ ID NO: 433129 - RNA, 22 nt, Human
ugcauuauucuuuuuugguagg

SEQ ID NO: 433130 - RNA, 22 nt, Human
ccucugaguccucccugguugc

SEQ ID NO: 433131 - RNA, 23 nt, Human
gcuguuuccccaugugcugaagg

SEQ ID NO: 433132 - RNA, 22 nt, Human
aucauucaagugcucuaaaaug

SEQ ID NO: 433133 - RNA, 22 nt, Human
aagaacaugggugugggcauuc

SEQ ID NO: 433134 - RNA, 20 nt, Human
cuguggcucaugcaucugcc

SEQ ID NO: 433135 - RNA, 22 nt, Human
agcagcugcagggagggucugc

SEQ ID NO: 433136 - RNA, 22 nt, Human
ggcccugggaugcucagcagug

SEQ ID NO: 433137 - RNA, 22 nt, Human
cugugggcuccugcagcucagg

SEQ ID NO: 433138 - RNA, 20 nt, Human
gggaugagaguccuagcucu

SEQ ID NO: 433139 - RNA, 18 nt, Human
gcuuugcagaaauacaga

SEQ ID NO: 433140 - RNA, 22 nt, Human
agugacagcugggaaggugaaa

SEQ ID NO: 433141 - RNA, 22 nt, Human
agcagcugcuccacuugcuuaa

SEQ ID NO: 433142 - RNA, 22 nt, Human
uauacagcuauggcaagacaaa

SEQ ID NO: 433143 - RNA, 22 nt, Human
gcuguuucucuugagucaaaau

SEQ ID NO: 433144 - RNA, 22 nt, Human
gacagcagacaaaccauguuuu

SEQ ID NO: 433145 - RNA, 22 nt, Human
acuaauuguauaguugauguaa

SEQ ID NO: 433146 - RNA, 22 nt, Human
uucuggcuugaccccuacuucc

SEQ ID NO: 433147 - RNA, 22 nt, Human
ucaugcaguuuugccaccuaag

SEQ ID NO: 433148 - RNA, 22 nt, Human
gcugccugauuuacauagugaa

SEQ ID NO: 433149 - RNA, 22 nt, Human
ggccugaggcaauagucagaca

SEQ ID NO: 433150 - RNA, 22 nt, Human
cucccuggaggugagcuggcac

SEQ ID NO: 433151 - RNA, 22 nt, Human
gcugucagcgcccaaggagcuc

SEQ ID NO: 433152 - RNA, 22 nt, Human
ugaagcagagugaaggugaauu

SEQ ID NO: 433153 - RNA, 22 nt, Human
ggguguccugugccaagcuggg

SEQ ID NO: 433154 - RNA, 22 nt, Human
ugggccuccugcccuggccuag

SEQ ID NO: 433155 - RNA, 22 nt, Human
uuugcuuuugugcucuaguggu

SEQ ID NO: 433156 - RNA, 22 nt, Human
ccucucuguaagggucccuccc

SEQ ID NO: 433157 - RNA, 17 nt, Human
agcagcugaagcagcca

SEQ ID NO: 433158 - RNA, 22 nt, Human
cauuucuagggaucauaaagua

SEQ ID NO: 433159 - RNA, 22 nt, Human
ggagacugaucugagugauaac

SEQ ID NO: 433160 - RNA, 22 nt, Human
cucugggcggcccaggccaacc

SEQ ID NO: 433161 - RNA, 22 nt, Human
uagcaacaugguuaucacauua

SEQ ID NO: 433162 - RNA, 22 nt, Human
ucuuauagcucaaaggaagagu

SEQ ID NO: 433163 - RNA, 22 nt, Human
uggccucaaccguccuaagcac

SEQ ID NO: 433164 - RNA, 22 nt, Human
acaaggcacuuuaugaagagga

SEQ ID NO: 433165 - RNA, 22 nt, Human
auucauacaggcuuugcucuua

SEQ ID NO: 433166 - RNA, 22 nt, Human
uauugcuucauaauuguugcca

SEQ ID NO: 433167 - RNA, 22 nt, Human
ccugggagugugccaucucugu

SEQ ID NO: 433168 - RNA, 22 nt, Human
gggucccaggaaggagcagugu

SEQ ID NO: 433169 - RNA, 18 nt, Human
gggcauggaugcagcauc

SEQ ID NO: 433170 - RNA, 20 nt, Human
acagaaagagagaaugucag

SEQ ID NO: 433171 - RNA, 22 nt, Human
ugcuggcuuucugucccuggca

SEQ ID NO: 433172 - RNA, 22 nt, Human
uuauugcaacuuuagggauaga

SEQ ID NO: 433173 - RNA, 22 nt, Human
agggcucuguccccagaggccc

SEQ ID NO: 433174 - RNA, 22 nt, Human
agguuccucuucauguucaaca

SEQ ID NO: 433175 - RNA, 22 nt, Human
cugggcuagaaggaccaggaug

SEQ ID NO: 433176 - RNA, 22 nt, Human
cuggggcugcagcgaucuucau

SEQ ID NO: 433177 - RNA, 19 nt, Human
aacuuugcuacccuauccu

SEQ ID NO: 433178 - RNA, 22 nt, Human
cuucuccuuauaugucccguuc

SEQ ID NO: 433179 - RNA, 22 nt, Human
ugagacagucaccaggcaggcc

SEQ ID NO: 433180 - RNA, 22 nt, Human
ccacccagccagaugcaggaag

SEQ ID NO: 433181 - RNA, 22 nt, Human
uggcagauucugguugauacuu

SEQ ID NO: 433182 - RNA, 22 nt, Human
uauuuuugccucucagauaaaa

SEQ ID NO: 433183 - RNA, 22 nt, Human
gcaguggggaaugcuggggaga

SEQ ID NO: 433184 - RNA, 22 nt, Human
gaggagggagcuggaagcucuu

SEQ ID NO: 433185 - RNA, 22 nt, Human
gcugagugauugauauuuuagu

SEQ ID NO: 433186 - RNA, 22 nt, Human
cuuuguuuauauuucuccucga

SEQ ID NO: 433187 - RNA, 18 nt, Human
ccuguguguguugcaggc

SEQ ID NO: 433188 - RNA, 22 nt, Human
uuucagaggaaaucucauugag

SEQ ID NO: 433189 - RNA, 22 nt, Human
augacaaaagaagacaugaggu

SEQ ID NO: 433190 - RNA, 22 nt, Human
augcuuggcguuucacuuccug

SEQ ID NO: 433191 - RNA, 22 nt, Human
gcccaggaggucaaguagcuau

SEQ ID NO: 433192 - RNA, 22 nt, Human
acaggcagggaccuuggcuaag

SEQ ID NO: 433193 - RNA, 22 nt, Human
acugaaguagucauugucauua

SEQ ID NO: 433194 - RNA, 22 nt, Human
uggcagggccugaaucuuauac

SEQ ID NO: 433195 - RNA, 22 nt, Human
auuucuauaggaggacaguauu

SEQ ID NO: 433196 - RNA, 22 nt, Human
uggggacauucaugcagguugu

SEQ ID NO: 433197 - RNA, 22 nt, Human
caggacuauguucaacagauag

SEQ ID NO: 433198 - RNA, 21 nt, Human
gagugcaggucugaugccauc

SEQ ID NO: 433199 - RNA, 18 nt, Human
agcaacagaaacauaugg

SEQ ID NO: 433200 - RNA, 22 nt, Human
gcugccaguguggcaugaugca

SEQ ID NO: 433201 - RNA, 22 nt, Human
ccaacagguugagagucugaau

SEQ ID NO: 433202 - RNA, 22 nt, Human
ccagggugagaaaaggcuggau

SEQ ID NO: 433203 - RNA, 22 nt, Human
cauuccuuaacguggggagucu

SEQ ID NO: 433204 - RNA, 22 nt, Human
aaugaacacuuagccuuucuau

SEQ ID NO: 433205 - RNA, 22 nt, Human
ucagcaggcgguuccuuguggg

SEQ ID NO: 433206 - RNA, 22 nt, Human
cacagaggucugggcccagcag

SEQ ID NO: 433207 - RNA, 22 nt, Human
cuagagaaaauguuaauacagu

SEQ ID NO: 433208 - RNA, 22 nt, Human
ggcaggagaauggcgugaacuc

SEQ ID NO: 433209 - RNA, 22 nt, Human
ucccugaggaagggguguggug

SEQ ID NO: 433210 - RNA, 22 nt, Human
aaaguuuuauucaagcauuagu

SEQ ID NO: 433211 - RNA, 20 nt, Human
cugggcucaagugauccucc

SEQ ID NO: 433212 - RNA, 22 nt, Human
cuuugcaggaguaugugauaau

SEQ ID NO: 433213 - RNA, 22 nt, Human
ccccagcaggaauacagggguc

SEQ ID NO: 433214 - RNA, 22 nt, Human
cagugucuuauuuguagcucag

SEQ ID NO: 433215 - RNA, 22 nt, Human
gggcuaggucugaucagagaag

SEQ ID NO: 433216 - RNA, 22 nt, Human
ggccucuggucaagacaagcau

SEQ ID NO: 433217 - RNA, 22 nt, Human
acaggcugagcguccaucuuca

SEQ ID NO: 433218 - RNA, 22 nt, Human
auucaaauuaaguuaauucagc

SEQ ID NO: 433219 - RNA, 22 nt, Human
cagcacuguucccagaccacug

SEQ ID NO: 433220 - RNA, 22 nt, Human
uauggcuuuucauuccuaugug

SEQ ID NO: 433221 - RNA, 19 nt, Human
aaaaacuuaguccagaaag

SEQ ID NO: 433222 - RNA, 22 nt, Human
uguugggaagcucugccagggg

SEQ ID NO: 433223 - RNA, 22 nt, Human
uugcaaauauguucuccuauuc

SEQ ID NO: 433224 - RNA, 22 nt, Human
cugagaauaaagccagcaggag

SEQ ID NO: 433225 - RNA, 22 nt, Human
gacagggcauggugcagaguuc

SEQ ID NO: 433226 - RNA, 22 nt, Human
cggcacagccgggcaaggcugg

SEQ ID NO: 433227 - RNA, 22 nt, Human
ucccugggccacagcugugagc

SEQ ID NO: 433228 - RNA, 21 nt, Human
acuuggcagaacgcagaaggc

SEQ ID NO: 433229 - RNA, 17 nt, Human
agcaggcacgucagcac

SEQ ID NO: 433230 - RNA, 22 nt, Human
uacuagaaccucacaacaaucc

SEQ ID NO: 433231 - RNA, 22 nt, Human
cagcugugcuguauuaagcucu

SEQ ID NO: 433232 - RNA, 22 nt, Human
gaauuucaaaagccagaacggg

SEQ ID NO: 433233 - RNA, 22 nt, Human
guugcagcaucacugcugagug

SEQ ID NO: 433234 - RNA, 22 nt, Human
aaccagucccagugagaugaac

SEQ ID NO: 433235 - RNA, 22 nt, Human
caccagcuuugcccacugccca

SEQ ID NO: 433236 - RNA, 23 nt, Human
agcucugcucgggcaugcccugc

SEQ ID NO: 433237 - RNA, 22 nt, Human
cagcuccccucuguggggcagu

SEQ ID NO: 433238 - RNA, 22 nt, Human
gcacagccuugcccugugcccu

SEQ ID NO: 433239 - RNA, 22 nt, Human
uccagcagcccgaaggcccauc

SEQ ID NO: 433240 - RNA, 22 nt, Human
gccuccccaaagugcugacagc

SEQ ID NO: 433241 - RNA, 22 nt, Human
uuucuuaugagcaagacucuau

SEQ ID NO: 433242 - RNA, 22 nt, Human
ucaugcagauaagaauaaguaa

SEQ ID NO: 433243 - RNA, 22 nt, Human
ggugugugguuuugauacaguc

SEQ ID NO: 433244 - RNA, 22 nt, Human
uucuuauaagauaggccucagg

SEQ ID NO: 433245 - RNA, 22 nt, Human
aguuccaaagccuguauucuua

SEQ ID NO: 433246 - RNA, 22 nt, Human
cacuggcugagcuucucuaggg

SEQ ID NO: 433247 - RNA, 22 nt, Human
gcacacagaauugauucacugu

SEQ ID NO: 433248 - RNA, 22 nt, Human
accagcucagaagccagaaaga

SEQ ID NO: 433249 - RNA, 22 nt, Human
ugcaggaagacuucccaagcca

SEQ ID NO: 433250 - RNA, 22 nt, Human
uugcauuugcucauuugauaug

SEQ ID NO: 433251 - RNA, 22 nt, Human
ugcucaucaacaugaugaucau

SEQ ID NO: 433252 - RNA, 22 nt, Human
guuugcaggaacucuggggaga

SEQ ID NO: 433253 - RNA, 22 nt, Human
gcuccuggcuccaggcagccaa

SEQ ID NO: 433254 - RNA, 22 nt, Human
aaagaagacagacauuucuuuc

SEQ ID NO: 433255 - RNA, 22 nt, Human
ggcuacagcgggguggagacgg

SEQ ID NO: 433256 - RNA, 23 nt, Human
gggagccauggguggucauggag

SEQ ID NO: 433257 - RNA, 22 nt, Human
cuugaugaugacgucggugaug

SEQ ID NO: 433258 - RNA, 23 nt, Human
gcaggaacucaggguaggcagca

SEQ ID NO: 433259 - RNA, 22 nt, Human
ccugccugucccucaguccaca

SEQ ID NO: 433260 - RNA, 22 nt, Human
cccaggagauaacguucccaag

SEQ ID NO: 433261 - RNA, 22 nt, Human
cugggugcugugggcucagagg

SEQ ID NO: 433262 - RNA, 22 nt, Human
ugcaggccucagacuuagccau

SEQ ID NO: 433263 - RNA, 22 nt, Human
cccagccucugggcucacccaa

SEQ ID NO: 433264 - RNA, 22 nt, Human
cugucagcacucuacuacagau

SEQ ID NO: 433265 - RNA, 22 nt, Human
aggaagccuggggcugcccucg

SEQ ID NO: 433266 - RNA, 22 nt, Human
gaguccuggagaaacgcaggug

SEQ ID NO: 433267 - RNA, 22 nt, Human
ggcagccaugcuccaggugcag

SEQ ID NO: 433268 - RNA, 22 nt, Human
gagccugggacugggggucaug

SEQ ID NO: 433269 - RNA, 22 nt, Human
acuguauuggaaauauagcaaa

SEQ ID NO: 433270 - RNA, 22 nt, Human
gauacaguauuuaaagagcaac

SEQ ID NO: 433271 - RNA, 22 nt, Human
ccuggcucugaaguccacauca

SEQ ID NO: 433272 - RNA, 22 nt, Human
aaaagagguuaaccaggugugu

SEQ ID NO: 433273 - RNA, 22 nt, Human
aauaauguaggaugauaaauga

SEQ ID NO: 433274 - RNA, 22 nt, Human
gcugucugcugugcacugagca

SEQ ID NO: 433275 - RNA, 20 nt, Human
ugacucugcaaccgucucuc

SEQ ID NO: 433276 - RNA, 22 nt, Human
cagaagaaaguggggagacaag

SEQ ID NO: 433277 - RNA, 22 nt, Human
caggggccaggcugucugcugu

SEQ ID NO: 433278 - RNA, 20 nt, Human
ccuggagccuggaaggaguc

SEQ ID NO: 433279 - RNA, 22 nt, Human
ggcagcaguaggagcuaaucuu

SEQ ID NO: 433280 - RNA, 22 nt, Human
ugugugaagcacauguucaagg

SEQ ID NO: 433281 - RNA, 22 nt, Human
uugaacauuggcaauuucauau

SEQ ID NO: 433282 - RNA, 22 nt, Human
uuugucaaguuugcaaauacgu

SEQ ID NO: 433283 - RNA, 22 nt, Human
uuccugcaaagccagaugucga

SEQ ID NO: 433284 - RNA, 22 nt, Human
ccacacagggggaugaguuauu

SEQ ID NO: 433285 - RNA, 22 nt, Human
caggcacuagcagaaugaggcu

SEQ ID NO: 433286 - RNA, 22 nt, Human
augcagagacagauguggcaug

SEQ ID NO: 433287 - RNA, 22 nt, Human
cacagaggaaaugacuuucuua

SEQ ID NO: 433288 - RNA, 22 nt, Human
ugcuggagcggaggugagccag

SEQ ID NO: 433289 - RNA, 22 nt, Human
cauuauugccagccauacugaa

SEQ ID NO: 433290 - RNA, 22 nt, Human
cagggcuccccgcaccgcagcc

SEQ ID NO: 433291 - RNA, 22 nt, Human
aggcaauagguuccucaucuuu

SEQ ID NO: 433292 - RNA, 20 nt, Human
aauuuuaucuccauccuuug

SEQ ID NO: 433293 - RNA, 22 nt, Human
ugcccacagcucagggcugcuc

SEQ ID NO: 433294 - RNA, 23 nt, Human
cugggacaugguaggggcacaac

SEQ ID NO: 433295 - RNA, 22 nt, Human
ugccugucuccucugcagggug

SEQ ID NO: 433296 - RNA, 22 nt, Human
ugguaccauguugcuuugauuu

SEQ ID NO: 433297 - RNA, 22 nt, Human
uggcaggaagacguggggcacc

SEQ ID NO: 433298 - RNA, 22 nt, Human
cagcugcuuucagcaggaggga

SEQ ID NO: 433299 - RNA, 23 nt, Human
cagcaggagggugccugggcugc

SEQ ID NO: 433300 - RNA, 21 nt, Human
gacaggcaaggagucacuuag

SEQ ID NO: 433301 - RNA, 22 nt, Human
gggguccuggaggccagcugga

SEQ ID NO: 433302 - RNA, 22 nt, Human
uauuccaagucacuguguccug

SEQ ID NO: 433303 - RNA, 22 nt, Human
uugcccaccuuagucuucagac

SEQ ID NO: 433304 - RNA, 22 nt, Human
uuuuuauacuuugcucaagauu

SEQ ID NO: 433305 - RNA, 22 nt, Human
ugauuauauucuaacuucauaa

SEQ ID NO: 433306 - RNA, 22 nt, Human
uacaggaaggcucuggaggugc

SEQ ID NO: 433307 - RNA, 22 nt, Human
gcucuccacugaccacggggca

SEQ ID NO: 433308 - RNA, 22 nt, Human
guuuaacauuguaccaacaccu

SEQ ID NO: 433309 - RNA, 22 nt, Human
auuuaccauauguacugaguau

SEQ ID NO: 433310 - RNA, 22 nt, Human
uauguacaauuuguuguauguc

SEQ ID NO: 433311 - RNA, 22 nt, Human
aaaacagacagccaguguagag

SEQ ID NO: 433312 - RNA, 22 nt, Human
cugggcaguuuauucaguucug

SEQ ID NO: 433313 - RNA, 22 nt, Human
uugaggauucaugucagaauuc

SEQ ID NO: 433314 - RNA, 22 nt, Human
cugccugugugugccugcagaa

SEQ ID NO: 433315 - RNA, 22 nt, Human
uuccugaaaauacagggagacc

SEQ ID NO: 433316 - RNA, 22 nt, Human
acagauuuuaaaugacacuccc

SEQ ID NO: 433317 - RNA, 22 nt, Human
uuugcaaauuucgucuccucag

SEQ ID NO: 433318 - RNA, 22 nt, Human
ugggagccauuuuagaggcugc

SEQ ID NO: 433319 - RNA, 22 nt, Human
gcaggcugcugagauccuuagg

SEQ ID NO: 433320 - RNA, 22 nt, Human
gccacagggcagaugcgcagag

SEQ ID NO: 433321 - RNA, 22 nt, Human
auauuuauaagcaagcaggacu

SEQ ID NO: 433322 - RNA, 22 nt, Human
gccuggcccagggcuccgcagg

SEQ ID NO: 433323 - RNA, 22 nt, Human
uguaucaaucauguaauuuggu

SEQ ID NO: 433324 - RNA, 22 nt, Human
caccacuguaucccuagcacuu

SEQ ID NO: 433325 - RNA, 20 nt, Human
cagaacagucugagaggcca

SEQ ID NO: 433326 - RNA, 22 nt, Human
gauuguggaagucagugguucu

SEQ ID NO: 433327 - RNA, 22 nt, Human
ugcagaggagucagccugggca

SEQ ID NO: 433328 - RNA, 22 nt, Human
ucaaaggguaauguaauagucu

SEQ ID NO: 433329 - RNA, 22 nt, Human
gugcucuccuggcugcccugac

SEQ ID NO: 433330 - RNA, 22 nt, Human
uugcaaaucuuugccagaaggc

SEQ ID NO: 433331 - RNA, 22 nt, Human
gauucaaaguuaaugaagaugc

SEQ ID NO: 433332 - RNA, 22 nt, Human
uaugaagauauaucugaucucu

SEQ ID NO: 433333 - RNA, 22 nt, Human
gacaggaaacaagaaggcagga

SEQ ID NO: 433334 - RNA, 22 nt, Human
ugcaggcagggccagcgugagg

SEQ ID NO: 433335 - RNA, 22 nt, Human
cuggcucauagagcagcuccaa

SEQ ID NO: 433336 - RNA, 22 nt, Human
cagggacagagacugcaccuug

SEQ ID NO: 433337 - RNA, 22 nt, Human
uagaaaugcaguguacuguguc

SEQ ID NO: 433338 - RNA, 22 nt, Human
ucagcuggugaguggauagaca

SEQ ID NO: 433339 - RNA, 19 nt, Human
cugagcagcggcagcacuu

SEQ ID NO: 433340 - RNA, 22 nt, Human
ugccagcacuucuggcugucug

SEQ ID NO: 433341 - RNA, 22 nt, Human
ccuugccucauugugcuucucc

SEQ ID NO: 433342 - RNA, 22 nt, Human
acagaaauucaaacuggaauuu

SEQ ID NO: 433343 - RNA, 22 nt, Human
ccagagaaagguuugauucauu

SEQ ID NO: 433344 - RNA, 22 nt, Human
cagggcuagggagcccuccugg

SEQ ID NO: 433345 - RNA, 22 nt, Human
uuuacaugaguagcagauguuc

SEQ ID NO: 433346 - RNA, 21 nt, Human
auaauguacaaaaacugucuu

SEQ ID NO: 433347 - RNA, 22 nt, Human
acugcagccuugaacucugggc

SEQ ID NO: 433348 - RNA, 22 nt, Human
caguucaaaauuuugaagaagg

SEQ ID NO: 433349 - RNA, 22 nt, Human
gcagggacaucuucagaucacu

SEQ ID NO: 433350 - RNA, 22 nt, Human
cuauuuaagaauaaaaggggca

SEQ ID NO: 433351 - RNA, 22 nt, Human
uugcagggcaggaccauggaca

SEQ ID NO: 433352 - RNA, 22 nt, Human
ccucagggaggccucuguggcu

SEQ ID NO: 433353 - RNA, 22 nt, Human
agacacagguguaauuucugcu

SEQ ID NO: 433354 - RNA, 22 nt, Human
ucuuugcauuccugugugcuuu

SEQ ID NO: 433355 - RNA, 22 nt, Human
ugugugugcacgugcgcgcgag

SEQ ID NO: 433356 - RNA, 22 nt, Human
ugaagcaggaaacuucuuguuu

SEQ ID NO: 433357 - RNA, 22 nt, Human
auuacaguaacagcuacaaugc

SEQ ID NO: 433358 - RNA, 22 nt, Human
ggcuccugccgucuuuucugag

SEQ ID NO: 433359 - RNA, 22 nt, Human
cagggacaaggaauaagauuag

SEQ ID NO: 433360 - RNA, 20 nt, Human
acauguacuaaugaauacag

SEQ ID NO: 433361 - RNA, 22 nt, Human
uggcacugaccccaggccugug

SEQ ID NO: 433362 - RNA, 22 nt, Human
uucaaagugcauguuccucaga

SEQ ID NO: 433363 - RNA, 22 nt, Human
caggaggcaguuucagaaguca

SEQ ID NO: 433364 - RNA, 22 nt, Human
gugccuggcacacagaaggcaa

SEQ ID NO: 433365 - RNA, 22 nt, Human
ucagcccugggcuuccucaugg

SEQ ID NO: 433366 - RNA, 22 nt, Human
cuggcuccugaggcuuggcccc

SEQ ID NO: 433367 - RNA, 22 nt, Human
agacaaguaggaaugguugaag

SEQ ID NO: 433368 - RNA, 22 nt, Human
gcuguauuggaacacauccaug

SEQ ID NO: 433369 - RNA, 22 nt, Human
uuaccauagaaacuuccuuuuu

SEQ ID NO: 433370 - RNA, 18 nt, Human
agucuucugauccauuuu

SEQ ID NO: 433371 - RNA, 22 nt, Human
augauuuuuucuaacacagucg

SEQ ID NO: 433372 - RNA, 20 nt, Human
ccagagcagccacugaaguu

SEQ ID NO: 433373 - RNA, 22 nt, Human
ucagaggagcaaaagaggggau

SEQ ID NO: 433374 - RNA, 22 nt, Human
ggcaccagggcaagggucuuuc

SEQ ID NO: 433375 - RNA, 22 nt, Human
aaugccaacuuggauauacauu

SEQ ID NO: 433376 - RNA, 22 nt, Human
gacagaagaggaacuuggacag

SEQ ID NO: 433377 - RNA, 22 nt, Human
agggaagcccuggcugagaccc

SEQ ID NO: 433378 - RNA, 22 nt, Human
caaaggagguaaugggugugag

SEQ ID NO: 433379 - RNA, 22 nt, Human
gaggcuggggucugccuuucug

SEQ ID NO: 433380 - RNA, 22 nt, Human
uggagagaagaggcagugugcu

SEQ ID NO: 433381 - RNA, 22 nt, Human
cagggacaugacuggucucugu

SEQ ID NO: 433382 - RNA, 22 nt, Human
cagggacauugguggccagguu

SEQ ID NO: 433383 - RNA, 22 nt, Human
agagaugacaugagggacuuaa

SEQ ID NO: 433384 - RNA, 22 nt, Human
cugugagcuggguggccaggac

SEQ ID NO: 433385 - RNA, 22 nt, Human
agucucugucguagaucagcgu

SEQ ID NO: 433386 - RNA, 22 nt, Human
uauaccaaaaaaauucuugucu

SEQ ID NO: 433387 - RNA, 22 nt, Human
aggcugccuguuccaaucuccu

SEQ ID NO: 433388 - RNA, 22 nt, Human
aaagaucuguguuaacucaagg

SEQ ID NO: 433389 - RNA, 22 nt, Human
aauuggcagaacuuuauauauu

SEQ ID NO: 433390 - RNA, 16 nt, Human
ccaccugcagcucuca

SEQ ID NO: 433391 - RNA, 22 nt, Human
ccuuagcauuagaagcuguggg

SEQ ID NO: 433392 - RNA, 22 nt, Human
caggguggcccuguggucucau

SEQ ID NO: 433393 - RNA, 22 nt, Human
ugccaggcuuagagcaggggcu

SEQ ID NO: 433394 - RNA, 22 nt, Human
auucagcaaacauuuauugugu

SEQ ID NO: 433395 - RNA, 22 nt, Human
agcuucuguucaucuuccaggc

SEQ ID NO: 433396 - RNA, 17 nt, Human
gcugccaccuuuggagc

SEQ ID NO: 433397 - RNA, 22 nt, Human
gcuguuucccgugcgcugcguc

SEQ ID NO: 433398 - RNA, 20 nt, Human
agugccagggcaggugagag

SEQ ID NO: 433399 - RNA, 22 nt, Human
uauagcacacaguuuauaaaag

SEQ ID NO: 433400 - RNA, 22 nt, Human
acacagagugguuuguagaaua

SEQ ID NO: 433401 - RNA, 22 nt, Human
gcagcgcuguaggcccaaggca

SEQ ID NO: 433402 - RNA, 22 nt, Human
ugaggcuggcaaggcugguauu

SEQ ID NO: 433403 - RNA, 22 nt, Human
cacccaggcagguggcugagaa

SEQ ID NO: 433404 - RNA, 22 nt, Human
auucuuuucccaacugcuuuaa

SEQ ID NO: 433405 - RNA, 22 nt, Human
gggagacacgcugcaggcauaa

SEQ ID NO: 433406 - RNA, 22 nt, Human
agaacugugaaguaugugaaau

SEQ ID NO: 433407 - RNA, 22 nt, Human
cagaggaaaguauuucuggaag

SEQ ID NO: 433408 - RNA, 22 nt, Human
acacagagguggccacucuuuu

SEQ ID NO: 433409 - RNA, 20 nt, Human
agccucugcccuucccacug

SEQ ID NO: 433410 - RNA, 22 nt, Human
gacccagaggccugacagugug

SEQ ID NO: 433411 - RNA, 22 nt, Human
cccagagaugggaggugaucgg

SEQ ID NO: 433412 - RNA, 22 nt, Human
cugugcaguaggucagggcugg

SEQ ID NO: 433413 - RNA, 22 nt, Human
agccacagagagggagcugcaa

SEQ ID NO: 433414 - RNA, 22 nt, Human
acagaggacaacuaggcgcuca

SEQ ID NO: 433415 - RNA, 22 nt, Human
aaaaguaauugcaguuuuguca

SEQ ID NO: 433416 - RNA, 20 nt, Human
gaggcugcggacugcuggac

SEQ ID NO: 433417 - RNA, 22 nt, Human
agcagcaggaggcuguccacca

SEQ ID NO: 433418 - RNA, 22 nt, Human
aaaucucacuguagucaaagug

SEQ ID NO: 433419 - RNA, 20 nt, Human
uccugagugcaguuggcuug

SEQ ID NO: 433420 - RNA, 22 nt, Human
cugugucucuccuuacaagacu

SEQ ID NO: 433421 - RNA, 22 nt, Human
uuauaauucuggcauaggcugu

SEQ ID NO: 433422 - RNA, 22 nt, Human
agcuguugcugggaggagagaa

SEQ ID NO: 433423 - RNA, 21 nt, Human
cuguccucagauguggacgag

SEQ ID NO: 433424 - RNA, 19 nt, Human
gggcagaauggcaucucag

SEQ ID NO: 433425 - RNA, 22 nt, Human
aauuaauucaguuuuuaaggga

SEQ ID NO: 433426 - RNA, 23 nt, Human
acuuugcauacccaaauuguuuu

SEQ ID NO: 433427 - RNA, 22 nt, Human
acugaaaaagacaucuugguaa

SEQ ID NO: 433428 - RNA, 22 nt, Human
acuauucaagugcucauucaga

SEQ ID NO: 433429 - RNA, 22 nt, Human
ucuuagcauuucauaacaacug

SEQ ID NO: 433430 - RNA, 22 nt, Human
aagcuggaacaucuugaggaag

SEQ ID NO: 433431 - RNA, 20 nt, Human
gcagccguggagacuaggag

SEQ ID NO: 433432 - RNA, 22 nt, Human
acaauuuuccccauagguuauc

SEQ ID NO: 433433 - RNA, 22 nt, Human
ugcaauuucaggcauauauugu

SEQ ID NO: 433434 - RNA, 22 nt, Human
cagcccuggcccaggugccuua

SEQ ID NO: 433435 - RNA, 22 nt, Human
gcugucccuugucccaccuugc

SEQ ID NO: 433436 - RNA, 22 nt, Human
uuuggccacuugggaguccagg

SEQ ID NO: 433437 - RNA, 22 nt, Human
uccuggagauaauugcagugaa

SEQ ID NO: 433438 - RNA, 22 nt, Human
cucaguccuuauuugccucuac

SEQ ID NO: 433439 - RNA, 22 nt, Human
auccaguuaagaugaggucaua

SEQ ID NO: 433440 - RNA, 22 nt, Human
ugcaggcuggcagauaucucau

SEQ ID NO: 433441 - RNA, 22 nt, Human
uccagcagguccgagacaaguu

SEQ ID NO: 433442 - RNA, 21 nt, Human
gggcuggaggaugggaagccc

SEQ ID NO: 433443 - RNA, 22 nt, Human
gagcagcagguggcugugaugg

SEQ ID NO: 433444 - RNA, 21 nt, Human
ucacaugcuuauuccuggaau

SEQ ID NO: 433445 - RNA, 21 nt, Human
gcaggcuggucaaaccucagu

SEQ ID NO: 433446 - RNA, 22 nt, Human
uuuagcaucgaaguaaauuuag

SEQ ID NO: 433447 - RNA, 22 nt, Human
uacaggaaagaaauuugaacuc

SEQ ID NO: 433448 - RNA, 22 nt, Human
aagggaggggauguaagccugg

SEQ ID NO: 433449 - RNA, 22 nt, Human
ggcaacaacuggacauagcugg

SEQ ID NO: 433450 - RNA, 22 nt, Human
gcagggcauagaggcacggagg

SEQ ID NO: 433451 - RNA, 22 nt, Human
agagcuggcugguagcccugau

SEQ ID NO: 433452 - RNA, 22 nt, Human
ucuagcugaggguaggagaccu

SEQ ID NO: 433453 - RNA, 22 nt, Human
cccagcagugacccagugauac

SEQ ID NO: 433454 - RNA, 22 nt, Human
ccaggccuguguuguguggagg

SEQ ID NO: 433455 - RNA, 22 nt, Human
agacacagcuaccauaauacca

SEQ ID NO: 433456 - RNA, 22 nt, Human
uggugagaauugguuggauuua

SEQ ID NO: 433457 - RNA, 22 nt, Human
aauuaagagagaguugaagcaa

SEQ ID NO: 433458 - RNA, 22 nt, Human
cuugaugauagaaugugaggag

SEQ ID NO: 433459 - RNA, 22 nt, Human
gagagcugggaaagccguggag

SEQ ID NO: 433460 - RNA, 22 nt, Human
aagaccugcguuauccugccug

SEQ ID NO: 433461 - RNA, 22 nt, Human
ucacaggcuggucuccgaggac

SEQ ID NO: 433462 - RNA, 22 nt, Human
uaggcagauuccauauuuuggc

SEQ ID NO: 433463 - RNA, 22 nt, Human
agcagugggggaguguuaguuu

SEQ ID NO: 433464 - RNA, 22 nt, Human
caauuuuauugguccaaauaca

SEQ ID NO: 433465 - RNA, 22 nt, Human
gugucccaauguucaggacggc

SEQ ID NO: 433466 - RNA, 19 nt, Human
ggccuugcucuguggcagc

SEQ ID NO: 433467 - RNA, 22 nt, Human
gcugagacugacaugaagaggu

SEQ ID NO: 433468 - RNA, 22 nt, Human
aaggcagccagauccuuugggu

SEQ ID NO: 433469 - RNA, 22 nt, Human
ugaagcuaguauuaacucagau

SEQ ID NO: 433470 - RNA, 22 nt, Human
gcccucuguguaacaauccaga

SEQ ID NO: 433471 - RNA, 22 nt, Human
uugcccaccuucuuuucgugcc

SEQ ID NO: 433472 - RNA, 22 nt, Human
agucacagaaacccaggugugg

SEQ ID NO: 433473 - RNA, 22 nt, Human
gagcuuugcuggaagccugggg

SEQ ID NO: 433474 - RNA, 23 nt, Human
uucuacagcuucuucaguuaagg

SEQ ID NO: 433475 - RNA, 22 nt, Human
ugagcugggcugggcugagcug

SEQ ID NO: 433476 - RNA, 20 nt, Human
cagcaggcuauggggcaccc

SEQ ID NO: 433477 - RNA, 22 nt, Human
agccuggcacugaggcagggcg

SEQ ID NO: 433478 - RNA, 22 nt, Human
ugaagccaucaggaagccagca

SEQ ID NO: 433479 - RNA, 21 nt, Human
ucagcaggcaccagaaggcug

SEQ ID NO: 433480 - RNA, 21 nt, Human
aaaucacuguccaaucuuggu

SEQ ID NO: 433481 - RNA, 22 nt, Human
ucaaaggguagcccagggaaga

SEQ ID NO: 433482 - RNA, 22 nt, Human
gagcuggugaucagcuggagga

SEQ ID NO: 433483 - RNA, 22 nt, Human
uaauuuuacuuccugagcaccu

SEQ ID NO: 433484 - RNA, 19 nt, Human
ugaagagcugucaaaagug

SEQ ID NO: 433485 - RNA, 20 nt, Human
uuuugcagagaaggcgacug

SEQ ID NO: 433486 - RNA, 22 nt, Human
aaagcacagagcucccacagga

SEQ ID NO: 433487 - RNA, 22 nt, Human
ugcagcugggucugcccuggcu

SEQ ID NO: 433488 - RNA, 22 nt, Human
cuccugggcugggaacucagcc

SEQ ID NO: 433489 - RNA, 22 nt, Human
cagaaacacuguauuuagggaa

SEQ ID NO: 433490 - RNA, 22 nt, Human
ggcugccugaggcagugagaga

SEQ ID NO: 433491 - RNA, 18 nt, Human
gguggcaggucagaugcc

SEQ ID NO: 433492 - RNA, 22 nt, Human
guucagagugggaaugaucacu

SEQ ID NO: 433493 - RNA, 22 nt, Human
aaggcaaugggauggaucaugu

SEQ ID NO: 433494 - RNA, 22 nt, Human
ugggcagggagcuggaaccaca

SEQ ID NO: 433495 - RNA, 22 nt, Human
gagggccucugcugcuccacau

SEQ ID NO: 433496 - RNA, 22 nt, Human
uauguacauacaugugcauacg

SEQ ID NO: 433497 - RNA, 23 nt, Human
cauuucuagguguguuuggccau

SEQ ID NO: 433498 - RNA, 21 nt, Human
aguguccuugaucuugccuug

SEQ ID NO: 433499 - RNA, 22 nt, Human
caaaugaaaauggcgucuugga

SEQ ID NO: 433500 - RNA, 23 nt, Human
guuuuacaggugagaaaauggag

SEQ ID NO: 433501 - RNA, 22 nt, Human
gugugugucuccgcggccguag

SEQ ID NO: 433502 - RNA, 22 nt, Human
gacugcauaggaccaaauagua

SEQ ID NO: 433503 - RNA, 22 nt, Human
uacaggaaguuacagacuauga

SEQ ID NO: 433504 - RNA, 22 nt, Human
aaaaaggcuaagcaucuugugc

SEQ ID NO: 433505 - RNA, 22 nt, Human
gggcuccacagcagugagugga

SEQ ID NO: 433506 - RNA, 22 nt, Human
gccucuccgagccacugccucu

SEQ ID NO: 433507 - RNA, 18 nt, Human
ggcagggaaaagauaggg

SEQ ID NO: 433508 - RNA, 22 nt, Human
caugagaaccaggucuguguuu

SEQ ID NO: 433509 - RNA, 21 nt, Human
ggcacagccugaaaugccuca

SEQ ID NO: 433510 - RNA, 22 nt, Human
ccaggcuguuuucaaacuuggg

SEQ ID NO: 433511 - RNA, 22 nt, Human
agacauagggaggcauauaaau

SEQ ID NO: 433512 - RNA, 22 nt, Human
aguacuuuacuucuuacaguuu

SEQ ID NO: 433513 - RNA, 22 nt, Human
uccuggaggggacagcaugggc

SEQ ID NO: 433514 - RNA, 22 nt, Human
ugcaaauucaaacauuuuccug

SEQ ID NO: 433515 - RNA, 21 nt, Human
aguuucaggaaguucagcugc

SEQ ID NO: 433516 - RNA, 22 nt, Human
cacacaugucucuccaugcucu

SEQ ID NO: 433517 - RNA, 22 nt, Human
gacacagggggauguguggacg

SEQ ID NO: 433518 - RNA, 22 nt, Human
agcaggcauagaguagcacuca

SEQ ID NO: 433519 - RNA, 20 nt, Human
agaaucugacccagagagac

SEQ ID NO: 433520 - RNA, 22 nt, Human
guccuggugccaccugcgggau

SEQ ID NO: 433521 - RNA, 22 nt, Human
uggaaugcagugggagcuuacc

SEQ ID NO: 433522 - RNA, 22 nt, Human
ucaggaagucucaauuagcuac

SEQ ID NO: 433523 - RNA, 22 nt, Human
cacauaaucaccaaguccuuuc

SEQ ID NO: 433524 - RNA, 22 nt, Human
cauuucuaagaaggcugcacau

SEQ ID NO: 433525 - RNA, 22 nt, Human
gcccacaguguagcagguacuc

SEQ ID NO: 433526 - RNA, 22 nt, Human
uccugggcugugugccacucug

SEQ ID NO: 433527 - RNA, 22 nt, Human
cagacuuucugacucccuugcc

SEQ ID NO: 433528 - RNA, 22 nt, Human
uuugcauuuuagauuuaggccu

SEQ ID NO: 433529 - RNA, 22 nt, Human
caugaacagauucuucauuucu

SEQ ID NO: 433530 - RNA, 22 nt, Human
uuaaaggcuauggcugccuggg

SEQ ID NO: 433531 - RNA, 22 nt, Human
cugccuuugcccuugacacugu

SEQ ID NO: 433532 - RNA, 22 nt, Human
uacauugcuuucuaauacaucu

SEQ ID NO: 433533 - RNA, 22 nt, Human
aaagaugaucuacaaguucauu

SEQ ID NO: 433534 - RNA, 21 nt, Human
uggaaaaauguggccuaguga

SEQ ID NO: 433535 - RNA, 18 nt, Human
cuccuuucccuacaccuc

SEQ ID NO: 433536 - RNA, 21 nt, Human
gaguccuggcuaggguggcag

SEQ ID NO: 433537 - RNA, 22 nt, Human
uccucagaugcucuuggacgcc

SEQ ID NO: 433538 - RNA, 22 nt, Human
gcagaggauagcauaugaaccu

SEQ ID NO: 433539 - RNA, 22 nt, Human
uuauugcagccgcagggcgcug

SEQ ID NO: 433540 - RNA, 23 nt, Human
uccugaggguuucccagccuugg

SEQ ID NO: 433541 - RNA, 23 nt, Human
uggauaaaauacuuacauucaac

SEQ ID NO: 433542 - RNA, 22 nt, Human
cacagaagaaucaugcuguguu

SEQ ID NO: 433543 - RNA, 22 nt, Human
ggggaggccaguggaccguccc

SEQ ID NO: 433544 - RNA, 22 nt, Human
uccugcagagccgcccucaggu

SEQ ID NO: 433545 - RNA, 22 nt, Human
aguggccacugacuuggaaauc

SEQ ID NO: 433546 - RNA, 22 nt, Human
aacaugauuucaugcauuuaga

SEQ ID NO: 433547 - RNA, 22 nt, Human
auggaugaguccuugagacaca

SEQ ID NO: 433548 - RNA, 22 nt, Human
ucccagcagucagagcuaugug

SEQ ID NO: 433549 - RNA, 22 nt, Human
uucuggaguugugaccucaggg

SEQ ID NO: 433550 - RNA, 22 nt, Human
guguccugccacccugggcuuu

SEQ ID NO: 433551 - RNA, 22 nt, Human
cugggccagucucggccgcucu

SEQ ID NO: 433552 - RNA, 22 nt, Human
uaaaacuucucauuuuuauggu

SEQ ID NO: 433553 - RNA, 22 nt, Human
acugaaguccacacauguagga

SEQ ID NO: 433554 - RNA, 20 nt, Human
cccaggaguuugcucuuacu

SEQ ID NO: 433555 - RNA, 17 nt, Human
acacagacaggcagaca

SEQ ID NO: 433556 - RNA, 18 nt, Human
auugagcaugacagaccu

SEQ ID NO: 433557 - RNA, 22 nt, Human
uuuuaugugcuggacuggcagu

SEQ ID NO: 433558 - RNA, 22 nt, Human
agaaaaguuuaaaucuuggcac

SEQ ID NO: 433559 - RNA, 23 nt, Human
agaggcaggaguggcuugcccgg

SEQ ID NO: 433560 - RNA, 22 nt, Human
aggccuggugugccggaugcag

SEQ ID NO: 433561 - RNA, 22 nt, Human
ccaggccugcauucccucucag

SEQ ID NO: 433562 - RNA, 22 nt, Human
acagaugaggcuggcgagggca

SEQ ID NO: 433563 - RNA, 22 nt, Human
ucugggcugugccaaagcucuu

SEQ ID NO: 433564 - RNA, 22 nt, Human
uuugaaaguguuuacuugggaa

SEQ ID NO: 433565 - RNA, 22 nt, Human
ucaggcugaaaggacuccaguu

SEQ ID NO: 433566 - RNA, 22 nt, Human
uauugcaaguggcauaaaauuu

SEQ ID NO: 433567 - RNA, 22 nt, Human
ggagcagagcucuucaucugca

SEQ ID NO: 433568 - RNA, 22 nt, Human
ugauucuuucuccaccaauuca

SEQ ID NO: 433569 - RNA, 22 nt, Human
uguguccuucugggagucccag

SEQ ID NO: 433570 - RNA, 22 nt, Human
uggcacaggaucucagcggcca

SEQ ID NO: 433571 - RNA, 22 nt, Human
uuguuaaaggcaaaacaagcac

SEQ ID NO: 433572 - RNA, 22 nt, Human
aagacaaugcauuacuaagaag

SEQ ID NO: 433573 - RNA, 22 nt, Human
cuggcagcagcuucuggaucga

SEQ ID NO: 433574 - RNA, 22 nt, Human
ugaagccaucccucagauggcc

SEQ ID NO: 433575 - RNA, 22 nt, Human
cagcagcaaaucuagaagagga

SEQ ID NO: 433576 - RNA, 22 nt, Human
gaggccuguagucauggaugua

SEQ ID NO: 433577 - RNA, 22 nt, Human
ggagguucucucuuugcagagc

SEQ ID NO: 433578 - RNA, 22 nt, Human
agagggcauaaaauagagcacg

SEQ ID NO: 433579 - RNA, 22 nt, Human
cccuggccagcucaugucugag

SEQ ID NO: 433580 - RNA, 22 nt, Human
aggucuggugagagcaggugcu

SEQ ID NO: 433581 - RNA, 22 nt, Human
cagucccagcugcucagaaggc

SEQ ID NO: 433582 - RNA, 18 nt, Human
aaggcacaggagaacauu

SEQ ID NO: 433583 - RNA, 22 nt, Human
gguuccuguacuuagcuaugua

SEQ ID NO: 433584 - RNA, 22 nt, Human
cugagcugcucccgcugcagcg

SEQ ID NO: 433585 - RNA, 22 nt, Human
aagcaggcuugguguggccgcu

SEQ ID NO: 433586 - RNA, 19 nt, Human
ggagccuggagcacgugcc

SEQ ID NO: 433587 - RNA, 22 nt, Human
aagcccuuggcgcacaccgggc

SEQ ID NO: 433588 - RNA, 22 nt, Human
ccagcagcuuuauuggcucucc

SEQ ID NO: 433589 - RNA, 22 nt, Human
augcaggcagacacugugggca

SEQ ID NO: 433590 - RNA, 22 nt, Human
agacccacacuuugaguagcaa

SEQ ID NO: 433591 - RNA, 21 nt, Human
ugcagcugacacugguaugcc

SEQ ID NO: 433592 - RNA, 22 nt, Human
aggaaggacugcagcauuuggu

SEQ ID NO: 433593 - RNA, 22 nt, Human
guuccacaaaaggucuaguuua

SEQ ID NO: 433594 - RNA, 22 nt, Human
agcaacauuuuucaauuaacau

SEQ ID NO: 433595 - RNA, 22 nt, Human
gaauacaaacuuaaggcuuuac

SEQ ID NO: 433596 - RNA, 21 nt, Human
caggcuugacccuagugggaa

SEQ ID NO: 433597 - RNA, 22 nt, Human
uuuaaacaucuuguugccuuaa

SEQ ID NO: 433598 - RNA, 22 nt, Human
gucccuggaucugggacagcug

SEQ ID NO: 433599 - RNA, 22 nt, Human
cagggagcuuucccaggacccu

SEQ ID NO: 433600 - RNA, 22 nt, Human
ggcaucaguauggccauagggu

SEQ ID NO: 433601 - RNA, 22 nt, Human
ucccagagucuucuccuguaau

SEQ ID NO: 433602 - RNA, 22 nt, Human
cuuugcuuacuggugucugcau

SEQ ID NO: 433603 - RNA, 22 nt, Human
agcuccugcuugacagaagagg

SEQ ID NO: 433604 - RNA, 22 nt, Human
cuuccucaggcauuagcuggac

SEQ ID NO: 433605 - RNA, 22 nt, Human
uauuauugcaaguauauaaagu

SEQ ID NO: 433606 - RNA, 18 nt, Human
gggcagcacagcagccuc

SEQ ID NO: 433607 - RNA, 22 nt, Human
uacaggagcauggggaagggau

SEQ ID NO: 433608 - RNA, 22 nt, Human
gggaagcugaagcuagagaaaa

SEQ ID NO: 433609 - RNA, 22 nt, Human
agaggcagccguauuucaaagg

SEQ ID NO: 433610 - RNA, 22 nt, Human
gaauacaagccaggcacaaggc

SEQ ID NO: 433611 - RNA, 22 nt, Human
cagcauuuggugaucaucuuaa

SEQ ID NO: 433612 - RNA, 22 nt, Human
ucagcugccuuucccaugcuag

SEQ ID NO: 433613 - RNA, 22 nt, Human
agcugggucuugggccaggaga

SEQ ID NO: 433614 - RNA, 22 nt, Human
ucauuuguucucauucucuacu

SEQ ID NO: 433615 - RNA, 22 nt, Human
uugaagacacagacauauagag

SEQ ID NO: 433616 - RNA, 22 nt, Human
cagcauagcugauuaaggcaaa

SEQ ID NO: 433617 - RNA, 22 nt, Human
aggcagcuucugauuagcagcg

SEQ ID NO: 433618 - RNA, 22 nt, Human
ugggaggagcccucugggaagg

SEQ ID NO: 433619 - RNA, 20 nt, Human
cugcccagccacugagggau

SEQ ID NO: 433620 - RNA, 22 nt, Human
gcaggcugaguauuacccuagu

SEQ ID NO: 433621 - RNA, 22 nt, Human
gaggccagaagucugagaucag

SEQ ID NO: 433622 - RNA, 22 nt, Human
cuggccuggagccucugggugg

SEQ ID NO: 433623 - RNA, 22 nt, Human
ccagcuccaggacugggagcug

SEQ ID NO: 433624 - RNA, 22 nt, Human
agagugggccucugagucccag

SEQ ID NO: 433625 - RNA, 23 nt, Human
uucagacugccuucagcauuguc

SEQ ID NO: 433626 - RNA, 22 nt, Human
cagcucugugcaggccugggga

SEQ ID NO: 433627 - RNA, 21 nt, Human
gacaaagugaagcaggcagga

SEQ ID NO: 433628 - RNA, 23 nt, Human
aggcuaguuugugacuuucuuug

SEQ ID NO: 433629 - RNA, 22 nt, Human
ggagacaguauggcuuguagcu

SEQ ID NO: 433630 - RNA, 22 nt, Human
uuugcagccacagugccuugua

SEQ ID NO: 433631 - RNA, 22 nt, Human
acaggccugagauuuugcauuu

SEQ ID NO: 433632 - RNA, 22 nt, Human
gagacacagagaggcuguguga

SEQ ID NO: 433633 - RNA, 22 nt, Human
uaucacaauuccuauaguuugu

SEQ ID NO: 433634 - RNA, 21 nt, Human
acaaaagaagcugccuuuuaa

SEQ ID NO: 433635 - RNA, 22 nt, Human
ugugaauagugccgcaauaaac

SEQ ID NO: 433636 - RNA, 23 nt, Human
aggcaaggguguaaaggaaauga

SEQ ID NO: 433637 - RNA, 22 nt, Human
agcuccugcagacuccugcuca

SEQ ID NO: 433638 - RNA, 22 nt, Human
gcaucuaagguggauaacuucu

SEQ ID NO: 433639 - RNA, 22 nt, Human
uugaaaaaauugguagaggaug

SEQ ID NO: 433640 - RNA, 22 nt, Human
ugaggauggucccgaggacacu

SEQ ID NO: 433641 - RNA, 22 nt, Human
cacauuuaucuguucuuucuag

SEQ ID NO: 433642 - RNA, 22 nt, Human
cuccucccugcgauugcucugc

SEQ ID NO: 433643 - RNA, 22 nt, Human
uuuacauguaauguuauacaaa

SEQ ID NO: 433644 - RNA, 22 nt, Human
uaaggcaauggcauucuugaca

SEQ ID NO: 433645 - RNA, 22 nt, Human
gacagagcagcacccagccccu

SEQ ID NO: 433646 - RNA, 22 nt, Human
uugcagcuccauuuuaauggcu

SEQ ID NO: 433647 - RNA, 20 nt, Human
agcaaggcuggagcuuaugg

SEQ ID NO: 433648 - RNA, 19 nt, Human
auagagacagaguuuaauc

SEQ ID NO: 433649 - RNA, 22 nt, Human
aggaggcagaugcuuggcugua

SEQ ID NO: 433650 - RNA, 22 nt, Human
agcaggugacccaagcaggcug

SEQ ID NO: 433651 - RNA, 22 nt, Human
aucaugcagcuaauccaauuca

SEQ ID NO: 433652 - RNA, 21 nt, Human
gggccacaccuucugcagacc

SEQ ID NO: 433653 - RNA, 20 nt, Human
accccagccccucuaucuga

SEQ ID NO: 433654 - RNA, 22 nt, Human
caguacuuugcaucauuccacu

SEQ ID NO: 433655 - RNA, 22 nt, Human
uuacacaugcucacuuauuugu

SEQ ID NO: 433656 - RNA, 22 nt, Human
cagcuguugugauccauuuacg

SEQ ID NO: 433657 - RNA, 22 nt, Human
ucuggccauggcaagccgagug

SEQ ID NO: 433658 - RNA, 22 nt, Human
ccuggaaaugcaaaagccauga

SEQ ID NO: 433659 - RNA, 22 nt, Human
acuuugcaauacuuaauacaaa

SEQ ID NO: 433660 - RNA, 22 nt, Human
gggcuccaacggugagcaugga

SEQ ID NO: 433661 - RNA, 22 nt, Human
acaaaugaaucauacauaaugu

SEQ ID NO: 433662 - RNA, 22 nt, Human
cagggcccauggcucagguagg

SEQ ID NO: 433663 - RNA, 22 nt, Human
cagcaacauauaugaaacugug

SEQ ID NO: 433664 - RNA, 22 nt, Human
gcuggcuguaucaccuggccag

SEQ ID NO: 433665 - RNA, 22 nt, Human
cugucauuuucuuccaauauaa

SEQ ID NO: 433666 - RNA, 22 nt, Human
ugcuguagcccugcacagugca

SEQ ID NO: 433667 - RNA, 22 nt, Human
uuucauugucuacauaugacau

SEQ ID NO: 433668 - RNA, 22 nt, Human
uacuuaaaacugauagaaucuc

SEQ ID NO: 433669 - RNA, 22 nt, Human
ucuggccagcaugagaccuggu

SEQ ID NO: 433670 - RNA, 22 nt, Human
aaugaggcuugcauugugaacu

SEQ ID NO: 433671 - RNA, 22 nt, Human
gagcugccugaacaagcagcag

SEQ ID NO: 433672 - RNA, 20 nt, Human
guccaggacccagcaggagg

SEQ ID NO: 433673 - RNA, 23 nt, Human
aagcugccuucgcaguuggucug

SEQ ID NO: 433674 - RNA, 22 nt, Human
uauuagaaagcuuaauaucgug

SEQ ID NO: 433675 - RNA, 22 nt, Human
cugggcagcuaccaccacugcu

SEQ ID NO: 433676 - RNA, 22 nt, Human
ccugaggcuuaaucugucccaa

SEQ ID NO: 433677 - RNA, 22 nt, Human
ugcaggcugcaccccugcccug

SEQ ID NO: 433678 - RNA, 22 nt, Human
gauuuuauauggcauacugugg

SEQ ID NO: 433679 - RNA, 22 nt, Human
cugaggccagcugcagagcucu

SEQ ID NO: 433680 - RNA, 18 nt, Human
ggcugugcguggaggcug

SEQ ID NO: 433681 - RNA, 22 nt, Human
gccagagccacuuuugggugau

SEQ ID NO: 433682 - RNA, 22 nt, Human
uauggcuuucaaaggaacucgg

SEQ ID NO: 433683 - RNA, 22 nt, Human
uauuaaauguuauuuggguugu

SEQ ID NO: 433684 - RNA, 22 nt, Human
aaagcacauuacaagcucaguc

SEQ ID NO: 433685 - RNA, 22 nt, Human
auucagcauaaucaguagcuug

SEQ ID NO: 433686 - RNA, 22 nt, Human
cccagagggaagggaaugaggu

SEQ ID NO: 433687 - RNA, 22 nt, Human
ucucagagagcuguguuuuccu

SEQ ID NO: 433688 - RNA, 22 nt, Human
gaaaaugagccucagcuacauu

SEQ ID NO: 433689 - RNA, 22 nt, Human
uuugacaaauaggggaauaagg

SEQ ID NO: 433690 - RNA, 22 nt, Human
gcauggcagugaggauggugcu

SEQ ID NO: 433691 - RNA, 22 nt, Human
ugucacagucucgugagcaucu

SEQ ID NO: 433692 - RNA, 22 nt, Human
cagcagggggcagcgcagauca

SEQ ID NO: 433693 - RNA, 22 nt, Human
cagaaauguacugacaugcagu

SEQ ID NO: 433694 - RNA, 22 nt, Human
gggaugaggaucaaucagggag

SEQ ID NO: 433695 - RNA, 22 nt, Human
cagcugcccugccuugcccuua

SEQ ID NO: 433696 - RNA, 22 nt, Human
augcacuuuguaaucuguucaa

SEQ ID NO: 433697 - RNA, 22 nt, Human
ugcaauuuucagaaauuccaaa

SEQ ID NO: 433698 - RNA, 22 nt, Human
aagcaggcgagggccuggagca

SEQ ID NO: 433699 - RNA, 22 nt, Human
cuagcagggauugggcacuggg

SEQ ID NO: 433700 - RNA, 22 nt, Human
aguacacaagacacauuuaaaa

SEQ ID NO: 433701 - RNA, 22 nt, Human
uguucagaacaaagguaaauga

SEQ ID NO: 433702 - RNA, 22 nt, Human
ugaggccugcauugaacuagaa

SEQ ID NO: 433703 - RNA, 22 nt, Human
ugggcaggaugcguugauucuu

SEQ ID NO: 433704 - RNA, 22 nt, Human
gcuguccagagcaugggagcaa

SEQ ID NO: 433705 - RNA, 22 nt, Human
ggcagagcgcaugcgucgcaga

SEQ ID NO: 433706 - RNA, 22 nt, Human
uucagaauaauguguuagagaa

SEQ ID NO: 433707 - RNA, 22 nt, Human
ucagcugccccgggcacugccc

SEQ ID NO: 433708 - RNA, 22 nt, Human
uggcauuuucuccuuugaguuu

SEQ ID NO: 433709 - RNA, 23 nt, Human
agcuguuucuugugaguugagug

SEQ ID NO: 433710 - RNA, 22 nt, Human
ucacaggagggagagacaccca

SEQ ID NO: 433711 - RNA, 22 nt, Human
aggaagagguagcugucaaggg

SEQ ID NO: 433712 - RNA, 22 nt, Human
gcucuugauguucauugacuug

SEQ ID NO: 433713 - RNA, 17 nt, Human
agucugggaccugcgug

SEQ ID NO: 433714 - RNA, 22 nt, Human
gaauugcugaugaaucugauug

SEQ ID NO: 433715 - RNA, 22 nt, Human
acaauucaagaugagauucagg

SEQ ID NO: 433716 - RNA, 22 nt, Human
cagagaaacucagauagcugau

SEQ ID NO: 433717 - RNA, 22 nt, Human
auaguuuaaggaacuaugcgau

SEQ ID NO: 433718 - RNA, 22 nt, Human
acuuugcauggaaaauggucau

SEQ ID NO: 433719 - RNA, 22 nt, Human
uucuugaugcuuguuuaaaggu

SEQ ID NO: 433720 - RNA, 18 nt, Human
augcccuguugacuucag

SEQ ID NO: 433721 - RNA, 22 nt, Human
gggcuuggcacaugggcucagc

SEQ ID NO: 433722 - RNA, 22 nt, Human
agcuuugcugcuggagaagggu

SEQ ID NO: 433723 - RNA, 22 nt, Human
acagccuguguaccagcuggga

SEQ ID NO: 433724 - RNA, 22 nt, Human
uuuuauugguaaugauaaaagu

SEQ ID NO: 433725 - RNA, 22 nt, Human
gguuccugaucguugucucucu

SEQ ID NO: 433726 - RNA, 22 nt, Human
auguuaaauagccauuuguuug

SEQ ID NO: 433727 - RNA, 22 nt, Human
ccaggcaccauguucuuaggac

SEQ ID NO: 433728 - RNA, 22 nt, Human
ugggccuguugggguugaguua

SEQ ID NO: 433729 - RNA, 22 nt, Human
cagaaagaccugggcucaagag

SEQ ID NO: 433730 - RNA, 22 nt, Human
ucccaggcuaggccucugcguu

SEQ ID NO: 433731 - RNA, 22 nt, Human
gcucagagaaauuauaggaauu

SEQ ID NO: 433732 - RNA, 22 nt, Human
gugcccuggggugaaccccugg

SEQ ID NO: 433733 - RNA, 22 nt, Human
ucuaagaggcaucaagacaagc

SEQ ID NO: 433734 - RNA, 22 nt, Human
uugcaaauauuguuuaccuuuc

SEQ ID NO: 433735 - RNA, 22 nt, Human
aggcaguuguugcugagcagcu

SEQ ID NO: 433736 - RNA, 22 nt, Human
uggcacaguccugggugccugc

SEQ ID NO: 433737 - RNA, 22 nt, Human
aucugguuuuggcugugucccu

SEQ ID NO: 433738 - RNA, 22 nt, Human
gucuuucuuaauucaagugcuu

SEQ ID NO: 433739 - RNA, 22 nt, Human
ugccuuggauugcagggaaccu

SEQ ID NO: 433740 - RNA, 22 nt, Human
caggacaguuggcaucugcugc

SEQ ID NO: 433741 - RNA, 22 nt, Human
uauuuucuggacagucuugcuu

SEQ ID NO: 433742 - RNA, 22 nt, Human
ucuuuuagcucugcaaggaaag

SEQ ID NO: 433743 - RNA, 22 nt, Human
aagguucccucucuggaagccu

SEQ ID NO: 433744 - RNA, 22 nt, Human
acugguacucagcuggcacuca

SEQ ID NO: 433745 - RNA, 22 nt, Human
uggcucaguuuagcagcucagu

SEQ ID NO: 433746 - RNA, 22 nt, Human
aggccucacauugggcuucaag

SEQ ID NO: 433747 - RNA, 20 nt, Human
ggcacuggaagcacacagga

SEQ ID NO: 433748 - RNA, 23 nt, Human
cuguggcaaguccugcaccugcc

SEQ ID NO: 433749 - RNA, 22 nt, Human
guuccacaaaauguacccaguu

SEQ ID NO: 433750 - RNA, 22 nt, Human
uuuccagguauuaauacuguau

SEQ ID NO: 433751 - RNA, 22 nt, Human
ggcaguggugggaggcucgcuc

SEQ ID NO: 433752 - RNA, 21 nt, Human
gcaaggccuaucauggcagcu

SEQ ID NO: 433753 - RNA, 22 nt, Human
gcugucagaaggugaaggguaa

SEQ ID NO: 433754 - RNA, 22 nt, Human
cacauccuucagcugagcccag

SEQ ID NO: 433755 - RNA, 22 nt, Human
ucauuuucacacauaaauagca

SEQ ID NO: 433756 - RNA, 22 nt, Human
uuccagagaggcucauguuccc

SEQ ID NO: 433757 - RNA, 22 nt, Human
ggugcucaagagggcauccucu

SEQ ID NO: 433758 - RNA, 23 nt, Human
auuauccagugcacuucacagcu

SEQ ID NO: 433759 - RNA, 22 nt, Human
caggcacucauucagagaggug

SEQ ID NO: 433760 - RNA, 21 nt, Human
agcagacacuugugaccuucc

SEQ ID NO: 433761 - RNA, 22 nt, Human
gcugcccaguucugcugcugcc

SEQ ID NO: 433762 - RNA, 22 nt, Human
gcuccaggagcucacagcucgc

SEQ ID NO: 433763 - RNA, 22 nt, Human
aagagcuggaugaagaaaucaa

SEQ ID NO: 433764 - RNA, 22 nt, Human
gaauuucagagguaacaucauc

SEQ ID NO: 433765 - RNA, 22 nt, Human
cagcagcuacuuggagcagcag

SEQ ID NO: 433766 - RNA, 22 nt, Human
cccagcucugcagaccugcccu

SEQ ID NO: 433767 - RNA, 22 nt, Human
gcuguuuccuacaugguguuau

SEQ ID NO: 433768 - RNA, 22 nt, Human
ccaugccuuucacugaaccagu

SEQ ID NO: 433769 - RNA, 18 nt, Human
cagaggagagacauucag

SEQ ID NO: 433770 - RNA, 22 nt, Human
uccuccagaaacugaggcagaa

SEQ ID NO: 433771 - RNA, 22 nt, Human
gagguaggagguagguauugug

SEQ ID NO: 433772 - RNA, 20 nt, Human
auucuaaagcucugcucuuu

SEQ ID NO: 433773 - RNA, 22 nt, Human
ucaguguccggagccugagugc

SEQ ID NO: 433774 - RNA, 22 nt, Human
acaggcuguacuucuaaucauc

SEQ ID NO: 433775 - RNA, 23 nt, Human
gggaagcuccauggaggugcugg

SEQ ID NO: 433776 - RNA, 22 nt, Human
ggagccugugggaugagaugug

SEQ ID NO: 433777 - RNA, 22 nt, Human
caaugacagguucaugacuccu

SEQ ID NO: 433778 - RNA, 22 nt, Human
gacaggaaauauggggguuguu

SEQ ID NO: 433779 - RNA, 22 nt, Human
gcccacagaggcaccaccaggc

SEQ ID NO: 433780 - RNA, 22 nt, Human
caggaccuggaaugcuugugaa

SEQ ID NO: 433781 - RNA, 22 nt, Human
uauuacaauuuacauugcacuu

SEQ ID NO: 433782 - RNA, 21 nt, Human
gcaaggcaaugccaugauuuc

SEQ ID NO: 433783 - RNA, 22 nt, Human
aaucacauuacagcauaucugu

SEQ ID NO: 433784 - RNA, 22 nt, Human
aaggcaauauugaguuucccuu

SEQ ID NO: 433785 - RNA, 22 nt, Human
caggugagaggcgguccugcau

SEQ ID NO: 433786 - RNA, 22 nt, Human
cugaggcuuugugugcaugccu

SEQ ID NO: 433787 - RNA, 22 nt, Human
cagcuguucagcaacucgcaga

SEQ ID NO: 433788 - RNA, 22 nt, Human
ugacacaguagaaagaugauga

SEQ ID NO: 433789 - RNA, 19 nt, Human
ggaaggcagaggggcugug

SEQ ID NO: 433790 - RNA, 22 nt, Human
ggcccagcacagugcuuggggg

SEQ ID NO: 433791 - RNA, 22 nt, Human
ugggaagaagcagagaacugga

SEQ ID NO: 433792 - RNA, 22 nt, Human
agguggugaugacagaagacag

SEQ ID NO: 433793 - RNA, 22 nt, Human
aggaagccaugguggacgucua

SEQ ID NO: 433794 - RNA, 22 nt, Human
caggacagguguucuagaucag

SEQ ID NO: 433795 - RNA, 22 nt, Human
aguaucucaaagugguuuaugg

SEQ ID NO: 433796 - RNA, 22 nt, Human
ugcccacagcaaagagguagga

SEQ ID NO: 433797 - RNA, 22 nt, Human
gcacacaguauaugcucauuaa

SEQ ID NO: 433798 - RNA, 22 nt, Human
agccaacaacucugagcccagu

SEQ ID NO: 433799 - RNA, 22 nt, Human
acacaagaauaaugaugaaggu

SEQ ID NO: 433800 - RNA, 22 nt, Human
cugggugguucuaacuguugau

SEQ ID NO: 433801 - RNA, 22 nt, Human
aacuuugcuugggucaaacuca

SEQ ID NO: 433802 - RNA, 19 nt, Human
cugccuguuauggagagaa

SEQ ID NO: 433803 - RNA, 23 nt, Human
gacacaggagcacccagcugagc

SEQ ID NO: 433804 - RNA, 22 nt, Human
gggcaggagagaacagucaugg

SEQ ID NO: 433805 - RNA, 22 nt, Human
uuugcaaauaaauaagugcucg

SEQ ID NO: 433806 - RNA, 22 nt, Human
cagccagcuggcacugugagua

SEQ ID NO: 433807 - RNA, 22 nt, Human
aaguuccuugaaugaagcuagg

SEQ ID NO: 433808 - RNA, 22 nt, Human
ggagagucugccgagccagccc

SEQ ID NO: 433809 - RNA, 22 nt, Human
agauauguuacugcaucauggg

SEQ ID NO: 433810 - RNA, 22 nt, Human
uuuaaggcuucacuggaguggg

SEQ ID NO: 433811 - RNA, 22 nt, Human
cccugagcagucugcagagagc

SEQ ID NO: 433812 - RNA, 22 nt, Human
cugccucuggccucaggcccag

SEQ ID NO: 433813 - RNA, 22 nt, Human
agcugggaugaggagcauccuu

SEQ ID NO: 433814 - RNA, 22 nt, Human
gauuuucugagccuucaaauuu

SEQ ID NO: 433815 - RNA, 22 nt, Human
guccugggaaggaagccaggga

SEQ ID NO: 433816 - RNA, 22 nt, Human
agaagcagacucugaggcaagg

SEQ ID NO: 433817 - RNA, 22 nt, Human
aggcaauaagccucaacugucu

SEQ ID NO: 433818 - RNA, 22 nt, Human
gaugauuuugaugcaguaaaga

SEQ ID NO: 433819 - RNA, 22 nt, Human
aguacaaugucugacacaguag

SEQ ID NO: 433820 - RNA, 22 nt, Human
uuuucucccgcuggcugcucuu

SEQ ID NO: 433821 - RNA, 22 nt, Human
gcagaggcaaucagguaugugg

SEQ ID NO: 433822 - RNA, 22 nt, Human
ugagggacuugcuaguucucug

SEQ ID NO: 433823 - RNA, 22 nt, Human
ugaugauuugaaaccaguuucu

SEQ ID NO: 433824 - RNA, 22 nt, Human
cuggccugaggucggcuguagg

SEQ ID NO: 433825 - RNA, 22 nt, Human
ucccagaggcaguugguaacuu

SEQ ID NO: 433826 - RNA, 22 nt, Human
cagcuggucaacugaaugaaca

SEQ ID NO: 433827 - RNA, 22 nt, Human
guuucuaugguuuauauuacug

SEQ ID NO: 433828 - RNA, 22 nt, Human
auuguauuagcacaauacaauu

SEQ ID NO: 433829 - RNA, 22 nt, Human
cugccugugccaccgccucauu

SEQ ID NO: 433830 - RNA, 22 nt, Human
aggcagaggagaaugaucuucc

SEQ ID NO: 433831 - RNA, 22 nt, Human
auuucauauguaucaccuagcc

SEQ ID NO: 433832 - RNA, 22 nt, Human
cuggagccggaccagggacggu

SEQ ID NO: 433833 - RNA, 22 nt, Human
agcuguuuuugucugcugaucc

SEQ ID NO: 433834 - RNA, 18 nt, Human
gucaccuggaucagauua

SEQ ID NO: 433835 - RNA, 22 nt, Human
uccugaagaaggcagauauuug

SEQ ID NO: 433836 - RNA, 22 nt, Human
cuggccagaguuggagggugug

SEQ ID NO: 433837 - RNA, 20 nt, Human
cagaggcauuuucagacucu

SEQ ID NO: 433838 - RNA, 22 nt, Human
accggguaggugucaacucuga

SEQ ID NO: 433839 - RNA, 22 nt, Human
acacaaugauucacaagcagca

SEQ ID NO: 433840 - RNA, 22 nt, Human
cucuuuuacaccaaaaggccua

SEQ ID NO: 433841 - RNA, 21 nt, Human
ggcugcugucaccgcugucac

SEQ ID NO: 433842 - RNA, 22 nt, Human
uuuaacagauaguuucuucugu

SEQ ID NO: 433843 - RNA, 22 nt, Human
gugcauuugugcaugcacaugu

SEQ ID NO: 433844 - RNA, 22 nt, Human
ugcuggguguuccgcacuugac

SEQ ID NO: 433845 - RNA, 22 nt, Human
aucuaaaaggagcucuuuaucu

SEQ ID NO: 433846 - RNA, 22 nt, Human
cuccugggaauuuaguugugag

SEQ ID NO: 433847 - RNA, 22 nt, Human
cuuucauuugauaagaaugcca

SEQ ID NO: 433848 - RNA, 22 nt, Human
uguccagggauggggucaggga

SEQ ID NO: 433849 - RNA, 22 nt, Human
ccugccuggcuuccagaagaga

SEQ ID NO: 433850 - RNA, 22 nt, Human
aggcagcauuugaauccagguc

SEQ ID NO: 433851 - RNA, 19 nt, Human
gcucagucuccugauugcu

SEQ ID NO: 433852 - RNA, 22 nt, Human
gcuuccagcaccagcagagggg

SEQ ID NO: 433853 - RNA, 22 nt, Human
aagacauguuuuaagaauauuu

SEQ ID NO: 433854 - RNA, 22 nt, Human
ugugcccaucccucuggagugu

SEQ ID NO: 433855 - RNA, 22 nt, Human
gcugucacucaccaggccugca

SEQ ID NO: 433856 - RNA, 22 nt, Human
cugcaggcucgaagacacggau

SEQ ID NO: 433857 - RNA, 22 nt, Human
ugcagauagcgucauucuugcu

SEQ ID NO: 433858 - RNA, 22 nt, Human
gaggcugcuguuagcccugggc

SEQ ID NO: 433859 - RNA, 22 nt, Human
uuauacaguuuauacuuagaau

SEQ ID NO: 433860 - RNA, 22 nt, Human
ugguaauuauaaaauguuuuug

SEQ ID NO: 433861 - RNA, 22 nt, Human
aggucuggaggcggagucagga

SEQ ID NO: 433862 - RNA, 22 nt, Human
gagggcucuacucaccacccug

SEQ ID NO: 433863 - RNA, 21 nt, Human
auauuucucauaagguuaugg

SEQ ID NO: 433864 - RNA, 22 nt, Human
aggcugaggcuuuccuuggaga

SEQ ID NO: 433865 - RNA, 22 nt, Human
aagcccugagcacugcagagaa

SEQ ID NO: 433866 - RNA, 22 nt, Human
uguuugcauuaauuagaaggua

SEQ ID NO: 433867 - RNA, 22 nt, Human
uaauuauuaugacaacaauugc

SEQ ID NO: 433868 - RNA, 22 nt, Human
ccaggagaugauguuggggauu

SEQ ID NO: 433869 - RNA, 20 nt, Human
cuccucaguuccaugggagg

SEQ ID NO: 433870 - RNA, 22 nt, Human
cagcccugcagcuggaucucac

SEQ ID NO: 433871 - RNA, 22 nt, Human
ugugccuggcauucugggcuuc

SEQ ID NO: 433872 - RNA, 22 nt, Human
agcagcccaaacagacuaagac

SEQ ID NO: 433873 - RNA, 22 nt, Human
gccugagagaacugaccaagag

SEQ ID NO: 433874 - RNA, 21 nt, Human
agaagagaagcaggacccucu

SEQ ID NO: 433875 - RNA, 22 nt, Human
aguagaaagaaggcacugggcc

SEQ ID NO: 433876 - RNA, 22 nt, Human
caugcuucaugcaaaauucuga

SEQ ID NO: 433877 - RNA, 17 nt, Human
gcucccugaggacagcu

SEQ ID NO: 433878 - RNA, 22 nt, Human
augcauauguacuugcauaugu

SEQ ID NO: 433879 - RNA, 22 nt, Human
acaaguuucauuguuuagaacc

SEQ ID NO: 433880 - RNA, 22 nt, Human
ccuuugcaaugaauuguuauug

SEQ ID NO: 433881 - RNA, 22 nt, Human
gccugguggacacugggcauca

SEQ ID NO: 433882 - RNA, 20 nt, Human
cucaguguggccugaguguu

SEQ ID NO: 433883 - RNA, 22 nt, Human
aauaacuucaucuucaggauag

SEQ ID NO: 433884 - RNA, 22 nt, Human
agucccagcucagaaccacuag

SEQ ID NO: 433885 - RNA, 22 nt, Human
auugaauagcugcuuguuguau

SEQ ID NO: 433886 - RNA, 22 nt, Human
aagacaaugaguccugauggga

SEQ ID NO: 433887 - RNA, 22 nt, Human
ucagggcaggacaguguaggcc

SEQ ID NO: 433888 - RNA, 22 nt, Human
uccccaggaaauucugauucuu

SEQ ID NO: 433889 - RNA, 22 nt, Human
gccagcagggcccaaaugcugg

SEQ ID NO: 433890 - RNA, 22 nt, Human
cccagacuccucuggcuggugg

SEQ ID NO: 433891 - RNA, 22 nt, Human
caugagaaugaagaagacuuaa

SEQ ID NO: 433892 - RNA, 22 nt, Human
uacaaaacagugcucugguccu

SEQ ID NO: 433893 - RNA, 22 nt, Human
acaguagucuuaauuucaugua

SEQ ID NO: 433894 - RNA, 22 nt, Human
ucaggcugguggucagauggcu

SEQ ID NO: 433895 - RNA, 18 nt, Human
ugugguggagcugccuuc

SEQ ID NO: 433896 - RNA, 22 nt, Human
uaguuaaagauucuguuaagag

SEQ ID NO: 433897 - RNA, 22 nt, Human
ccuggagauuauuugguccaau

SEQ ID NO: 433898 - RNA, 22 nt, Human
cagggagcuggcuggcgugagu

SEQ ID NO: 433899 - RNA, 22 nt, Human
gcagcuggggccacacuuaggc

SEQ ID NO: 433900 - RNA, 22 nt, Human
gcagcuggcucagagagguggg

SEQ ID NO: 433901 - RNA, 22 nt, Human
acagggaaguucugcaacagga

SEQ ID NO: 433902 - RNA, 22 nt, Human
ccagccaggcauugcaaacuga

SEQ ID NO: 433903 - RNA, 22 nt, Human
ucaggcuguagggccccuggag

SEQ ID NO: 433904 - RNA, 22 nt, Human
gcucagggccauggaccagcag

SEQ ID NO: 433905 - RNA, 22 nt, Human
ugggcuccucgucacucgcugu

SEQ ID NO: 433906 - RNA, 22 nt, Human
gaggcuagagcaggggcucaau

SEQ ID NO: 433907 - RNA, 22 nt, Human
gcaggagucacugacuuggucc

SEQ ID NO: 433908 - RNA, 22 nt, Human
ugggcaaagucacauacaugau

SEQ ID NO: 433909 - RNA, 17 nt, Human
ggccuugggcugcucuu

SEQ ID NO: 433910 - RNA, 22 nt, Human
uguggagcagcgucacagccuu

SEQ ID NO: 433911 - RNA, 22 nt, Human
agagaagagucuugucaaauua

SEQ ID NO: 433912 - RNA, 22 nt, Human
cugccucucaggucccugagau

SEQ ID NO: 433913 - RNA, 22 nt, Human
agagcuggacgucugagcccua

SEQ ID NO: 433914 - RNA, 22 nt, Human
acauagaucugugauucauucu

SEQ ID NO: 433915 - RNA, 22 nt, Human
gccuggagcucggcugagggcg

SEQ ID NO: 433916 - RNA, 18 nt, Human
caggaugagugaugggga

SEQ ID NO: 433917 - RNA, 22 nt, Human
cugaagcuugauaaacuauaaa

SEQ ID NO: 433918 - RNA, 22 nt, Human
acacugaauaauugagaguuga

SEQ ID NO: 433919 - RNA, 19 nt, Human
caggccucuggucugcugu

SEQ ID NO: 433920 - RNA, 22 nt, Human
uggccuggaaccuggcagggac

SEQ ID NO: 433921 - RNA, 21 nt, Human
aggugccaaggagaagcaggc

SEQ ID NO: 433922 - RNA, 22 nt, Human
gaggcuggucagcccuaagauc

SEQ ID NO: 433923 - RNA, 22 nt, Human
acccacagaaccugugacaaca

SEQ ID NO: 433924 - RNA, 22 nt, Human
ucacucagccugccugguuccu

SEQ ID NO: 433925 - RNA, 22 nt, Human
uaagagcagagguugaauaaau

SEQ ID NO: 433926 - RNA, 22 nt, Human
cagaguuuuauguaugcaugua

SEQ ID NO: 433927 - RNA, 22 nt, Human
uggccugguuauauugcuauca

SEQ ID NO: 433928 - RNA, 22 nt, Human
uuuuguuggcuuaagaaauaca

SEQ ID NO: 433929 - RNA, 20 nt, Human
cccaggagcugugccccauc

SEQ ID NO: 433930 - RNA, 20 nt, Human
ccuguuccauucccucaacc

SEQ ID NO: 433931 - RNA, 22 nt, Human
ugcaguuuugccaggcaaugga

SEQ ID NO: 433932 - RNA, 22 nt, Human
gcaguggauccaaugguaucuu

SEQ ID NO: 433933 - RNA, 22 nt, Human
cucucccccacagcagccuucu

SEQ ID NO: 433934 - RNA, 22 nt, Human
gcagcccucuuggucacuaggc

SEQ ID NO: 433935 - RNA, 22 nt, Human
ggagccugcgggagcucccauu

SEQ ID NO: 433936 - RNA, 21 nt, Human
ggguccugggaugggauccag

SEQ ID NO: 433937 - RNA, 22 nt, Human
uuuacugaacugcuaguacagg

SEQ ID NO: 433938 - RNA, 18 nt, Human
augggaggggccaagaga

SEQ ID NO: 433939 - RNA, 22 nt, Human
guggccuggaugagcuucgaca

SEQ ID NO: 433940 - RNA, 20 nt, Human
ugaaggcagguaagaaagau

SEQ ID NO: 433941 - RNA, 22 nt, Human
acaggcagauuaaggguaggca

SEQ ID NO: 433942 - RNA, 22 nt, Human
agcucccagggcugggcaaguu

SEQ ID NO: 433943 - RNA, 22 nt, Human
cauuuaaagguuguggguaaaa

SEQ ID NO: 433944 - RNA, 22 nt, Human
cggcagcugauugcagagcacc

SEQ ID NO: 433945 - RNA, 22 nt, Human
cugacucacuguggcucuuaau

SEQ ID NO: 433946 - RNA, 23 nt, Human
aagcugccagucugaagccuggg

SEQ ID NO: 433947 - RNA, 22 nt, Human
auuucagauucgagaggaagug

SEQ ID NO: 433948 - RNA, 22 nt, Human
ggcaaacaccaggcgagggagc

SEQ ID NO: 433949 - RNA, 22 nt, Human
ccagcuggcaggagagucaggg

SEQ ID NO: 433950 - RNA, 22 nt, Human
acugcagccuagggaccacagu

SEQ ID NO: 433951 - RNA, 22 nt, Human
cuggcccagucucagaguguca

SEQ ID NO: 433952 - RNA, 22 nt, Human
augauggagguguccuggauuu

SEQ ID NO: 433953 - RNA, 22 nt, Human
acagaguuguguuuguacaacg

SEQ ID NO: 433954 - RNA, 22 nt, Human
uaagauaaggaacauucuguga

SEQ ID NO: 433955 - RNA, 22 nt, Human
auggcuuggcaccaucuccuug

SEQ ID NO: 433956 - RNA, 22 nt, Human
agccuguccagaggacagggcu

SEQ ID NO: 433957 - RNA, 22 nt, Human
ucaggcugcuuucaugcuuaga

SEQ ID NO: 433958 - RNA, 22 nt, Human
gcagcuggcucugggaaaaacu

SEQ ID NO: 433959 - RNA, 22 nt, Human
aacagcuagaauucuacuggcu

SEQ ID NO: 433960 - RNA, 22 nt, Human
ucugggcugcuaugaggcagag

SEQ ID NO: 433961 - RNA, 22 nt, Human
gcagggaagaucuuggagcugc

SEQ ID NO: 433962 - RNA, 22 nt, Human
aggccagcuucuacccucuguu

SEQ ID NO: 433963 - RNA, 22 nt, Human
uauauugaccaguacaauuggu

SEQ ID NO: 433964 - RNA, 22 nt, Human
cugugggcauuugagugugggu

SEQ ID NO: 433965 - RNA, 22 nt, Human
gugccugggcaugagcuuguug

SEQ ID NO: 433966 - RNA, 18 nt, Human
ucugaauauuaugcagug

SEQ ID NO: 433967 - RNA, 22 nt, Human
gcacagggaggcuggccuggcc

SEQ ID NO: 433968 - RNA, 22 nt, Human
uaaggcaaacaggaaagcaggc

SEQ ID NO: 433969 - RNA, 22 nt, Human
guggcccucugauagggucagg

SEQ ID NO: 433970 - RNA, 22 nt, Human
acagcagauuucccugggcucc

SEQ ID NO: 433971 - RNA, 22 nt, Human
aggcaauacacagcauuucaca

SEQ ID NO: 433972 - RNA, 22 nt, Human
gggcuccaaaauccuguagccu

SEQ ID NO: 433973 - RNA, 22 nt, Human
agagcugcaccuaugcagaccu

SEQ ID NO: 433974 - RNA, 22 nt, Human
ccucacucugcacccugcagca

SEQ ID NO: 433975 - RNA, 22 nt, Human
ugguccauguccuccaucucuc

SEQ ID NO: 433976 - RNA, 22 nt, Human
cagcccugggucccugcccugg

SEQ ID NO: 433977 - RNA, 22 nt, Human
cuaaaugacagguaccauagug

SEQ ID NO: 433978 - RNA, 21 nt, Human
gcccucaggggaggauggccu

SEQ ID NO: 433979 - RNA, 22 nt, Human
ucauuuguggaagugauugugg

SEQ ID NO: 433980 - RNA, 22 nt, Human
cacaggcaccccugacugcuca

SEQ ID NO: 433981 - RNA, 22 nt, Human
cgggcagaucacacagggcuug

SEQ ID NO: 433982 - RNA, 22 nt, Human
cugcagaggguuugagcauccu

SEQ ID NO: 433983 - RNA, 22 nt, Human
gggagaaggagcuaguucuuga

SEQ ID NO: 433984 - RNA, 22 nt, Human
uuauaguuaugaaagacugagg

SEQ ID NO: 433985 - RNA, 22 nt, Human
auaaagcaauagauuguguaau

SEQ ID NO: 433986 - RNA, 21 nt, Human
aaaaggaaggucuguuugggg

SEQ ID NO: 433987 - RNA, 22 nt, Human
uuguuacagcagcaauagaaaa

SEQ ID NO: 433988 - RNA, 22 nt, Human
acaguuauucuuuaugcaacca

SEQ ID NO: 433989 - RNA, 22 nt, Human
aggaagggauacauaggauagu

SEQ ID NO: 433990 - RNA, 22 nt, Human
gaaggcagguuuuucaaaacug

SEQ ID NO: 433991 - RNA, 22 nt, Human
aaauguacugauacuuauuuua

SEQ ID NO: 433992 - RNA, 22 nt, Human
uauguacacauacacuuguaau

SEQ ID NO: 433993 - RNA, 22 nt, Human
aucuagaaaaggugacuaaaau

SEQ ID NO: 433994 - RNA, 22 nt, Human
gagcuaggcuagggggagucgc

SEQ ID NO: 433995 - RNA, 22 nt, Human
uauggcuugaguuucagacuau

SEQ ID NO: 433996 - RNA, 22 nt, Human
auccuugagaaaauaaaugacc

SEQ ID NO: 433997 - RNA, 22 nt, Human
gagcagaacuacucacauaucg

SEQ ID NO: 433998 - RNA, 23 nt, Human
acagugaaacacgcaguaagagu

SEQ ID NO: 433999 - RNA, 22 nt, Human
aagcuaagauuacagauuuggg

SEQ ID NO: 434000 - RNA, 19 nt, Human
cuccucagucccagagguc

SEQ ID NO: 434001 - RNA, 22 nt, Human
ugggaagcuacucaugcaggca

SEQ ID NO: 434002 - RNA, 22 nt, Human
cagcuaguacaaugggagagca

SEQ ID NO: 434003 - RNA, 22 nt, Human
cucccagaggugucauucgagc

SEQ ID NO: 434004 - RNA, 22 nt, Human
gucuggaaauuaagaggagguu

SEQ ID NO: 434005 - RNA, 22 nt, Human
ucucuuccaguaagagucuuua

SEQ ID NO: 434006 - RNA, 22 nt, Human
ucagaauuuugguuugguuggu

SEQ ID NO: 434007 - RNA, 20 nt, Human
gcagugcuggugccucugcu

SEQ ID NO: 434008 - RNA, 22 nt, Human
uguccagggggcuuaccuggag

SEQ ID NO: 434009 - RNA, 22 nt, Human
uauuaacauuuuaugaaaauaa

SEQ ID NO: 434010 - RNA, 22 nt, Human
uguggcccagaugagugugcua

SEQ ID NO: 434011 - RNA, 22 nt, Human
guaaggcaauaguaaggagucc

SEQ ID NO: 434012 - RNA, 22 nt, Human
uuccaauuuguggugaguuaau

SEQ ID NO: 434013 - RNA, 22 nt, Human
cuuugauauaaguauacauagu

SEQ ID NO: 434014 - RNA, 22 nt, Human
auuccaaacuuaccccagagga

SEQ ID NO: 434015 - RNA, 22 nt, Human
gaggggcugggcagucccugga

SEQ ID NO: 434016 - RNA, 22 nt, Human
cagaggauauaugguuuguaug

SEQ ID NO: 434017 - RNA, 22 nt, Human
ucccagagguugagucacuuau

SEQ ID NO: 434018 - RNA, 22 nt, Human
uucagcaacauuuguugagugc

SEQ ID NO: 434019 - RNA, 22 nt, Human
gcuccacuaggaaucugcucuu

SEQ ID NO: 434020 - RNA, 22 nt, Human
gaucugaauagacuugcuaagg

SEQ ID NO: 434021 - RNA, 22 nt, Human
acagcagagugugagauagcca

SEQ ID NO: 434022 - RNA, 22 nt, Human
ccagagaaccuugagcugugag

SEQ ID NO: 434023 - RNA, 22 nt, Human
gugcccugaguggguaggagag

SEQ ID NO: 434024 - RNA, 22 nt, Human
auucagaaacucugggcagaac

SEQ ID NO: 434025 - RNA, 22 nt, Human
cugccagcucaaagcgcagcua

SEQ ID NO: 434026 - RNA, 22 nt, Human
agggcuccaaggaaguguagcu

SEQ ID NO: 434027 - RNA, 22 nt, Human
aaauuagaaauacuuucaaagc

SEQ ID NO: 434028 - RNA, 22 nt, Human
uugagcaaugucacugaggcuu

SEQ ID NO: 434029 - RNA, 22 nt, Human
cagcaaagcaggcuccuagaac

SEQ ID NO: 434030 - RNA, 22 nt, Human
aggagcuggguuccuuuggugg

SEQ ID NO: 434031 - RNA, 22 nt, Human
ucagaggugguaaaggacagca

SEQ ID NO: 434032 - RNA, 22 nt, Human
gugucccacucuggaggugaag

SEQ ID NO: 434033 - RNA, 22 nt, Human
ugucccauggacacaacuucuu

SEQ ID NO: 434034 - RNA, 22 nt, Human
ccugucucccuggcauggcuca

SEQ ID NO: 434035 - RNA, 22 nt, Human
gccaggaaggcugaagccagaa

SEQ ID NO: 434036 - RNA, 22 nt, Human
uauggcaauugucuaaguuuua

SEQ ID NO: 434037 - RNA, 22 nt, Human
uggcccugcuuaugucucucuu

SEQ ID NO: 434038 - RNA, 22 nt, Human
cagcucaaguuucccaggucag

SEQ ID NO: 434039 - RNA, 23 nt, Human
gcugagguacauuuacaggaaga

SEQ ID NO: 434040 - RNA, 22 nt, Human
ugagccaggcucaagugauccu

SEQ ID NO: 434041 - RNA, 22 nt, Human
cuccuuccugcagaucugagau

SEQ ID NO: 434042 - RNA, 20 nt, Human
cugggcugcccagcuauggg

SEQ ID NO: 434043 - RNA, 22 nt, Human
cagcaggcguugggagaaagac

SEQ ID NO: 434044 - RNA, 22 nt, Human
acuggacagaggaaauauggag

SEQ ID NO: 434045 - RNA, 22 nt, Human
cugugccaguguauuccuguga

SEQ ID NO: 434046 - RNA, 22 nt, Human
gagcaacaguuuaugguuuuuc

SEQ ID NO: 434047 - RNA, 22 nt, Human
augacaaaggcugaaagggaaa

SEQ ID NO: 434048 - RNA, 23 nt, Human
aggcaauacaaggcaucucugga

SEQ ID NO: 434049 - RNA, 22 nt, Human
guguuaaaugcaaucacaugca

SEQ ID NO: 434050 - RNA, 22 nt, Human
ucaaguauuauuacagauguag

SEQ ID NO: 434051 - RNA, 19 nt, Human
gcaggcacagcccugggug

SEQ ID NO: 434052 - RNA, 22 nt, Human
cccagaggaggaucucggcccg

SEQ ID NO: 434053 - RNA, 22 nt, Human
ugucccucugaggcuucccugg

SEQ ID NO: 434054 - RNA, 22 nt, Human
aagagcuccaggcaaugcgguc

SEQ ID NO: 434055 - RNA, 22 nt, Human
ggagccuguggccgucacgacu

SEQ ID NO: 434056 - RNA, 20 nt, Human
acauagaucagugauugaca

SEQ ID NO: 434057 - RNA, 22 nt, Human
caacagagcaguugaucaggaa

SEQ ID NO: 434058 - RNA, 19 nt, Human
uggagaggaaaugcugcuc

SEQ ID NO: 434059 - RNA, 22 nt, Human
ucaauagauuagguauuagauu

SEQ ID NO: 434060 - RNA, 22 nt, Human
cagcaguagucucuguggcuuu

SEQ ID NO: 434061 - RNA, 22 nt, Human
aauaggaaaauauuuaacaaga

SEQ ID NO: 434062 - RNA, 22 nt, Human
cacacaaauauucuggaggcaa

SEQ ID NO: 434063 - RNA, 22 nt, Human
agagggcccauguugggcugcu

SEQ ID NO: 434064 - RNA, 22 nt, Human
ucauauuuauauguuggcacag

SEQ ID NO: 434065 - RNA, 20 nt, Human
cacugcccuccagccugagc

SEQ ID NO: 434066 - RNA, 22 nt, Human
cuggagccccaggcugugcaga

SEQ ID NO: 434067 - RNA, 21 nt, Human
aaugucauugaauggugagac

SEQ ID NO: 434068 - RNA, 22 nt, Human
gcugccaauccagcugugggag

SEQ ID NO: 434069 - RNA, 22 nt, Human
aggagccaaggaaaacaguauu

SEQ ID NO: 434070 - RNA, 22 nt, Human
gcagcuggauuucaagagggag

SEQ ID NO: 434071 - RNA, 23 nt, Human
ucugagggagugggcaguggcac

SEQ ID NO: 434072 - RNA, 22 nt, Human
aacaggcaggagaauucugccu

SEQ ID NO: 434073 - RNA, 22 nt, Human
cucucugggcccaguuggcacc

SEQ ID NO: 434074 - RNA, 22 nt, Human
uacuuugcuaaaaugugcagaa

SEQ ID NO: 434075 - RNA, 22 nt, Human
cuccaggacucaggccccuggg

SEQ ID NO: 434076 - RNA, 22 nt, Human
aagcacaggaucuugaggagcg

SEQ ID NO: 434077 - RNA, 22 nt, Human
cugaggcagaaaaagcaagggu

SEQ ID NO: 434078 - RNA, 22 nt, Human
aggccucuucagggagcaugga

SEQ ID NO: 434079 - RNA, 22 nt, Human
ggagucccuguccccauacgag

SEQ ID NO: 434080 - RNA, 22 nt, Human
gauuuuacaaacugcaggaccc

SEQ ID NO: 434081 - RNA, 22 nt, Human
cagaagcagauucuaaagcaag

SEQ ID NO: 434082 - RNA, 22 nt, Human
guucacaauuuuuacugauugg

SEQ ID NO: 434083 - RNA, 16 nt, Human
guaaaggcagggaauu

SEQ ID NO: 434084 - RNA, 22 nt, Human
ucccuguccugggcaaucccag

SEQ ID NO: 434085 - RNA, 22 nt, Human
uugugagcauguuuacuugauu

SEQ ID NO: 434086 - RNA, 22 nt, Human
auuagaaugacagaaaugaggc

SEQ ID NO: 434087 - RNA, 22 nt, Human
ccagagggaacugggccucauu

SEQ ID NO: 434088 - RNA, 22 nt, Human
acagcagagccaguggcucuag

SEQ ID NO: 434089 - RNA, 22 nt, Human
cagcucucuaaggucuugcuuu

SEQ ID NO: 434090 - RNA, 22 nt, Human
cuuuuuccagcuucaggguggg

SEQ ID NO: 434091 - RNA, 22 nt, Human
ugauuuuauuggugaggaaauu

SEQ ID NO: 434092 - RNA, 17 nt, Human
ccacagccuggcacuug

SEQ ID NO: 434093 - RNA, 22 nt, Human
cuccauggcuuucgcaucugca

SEQ ID NO: 434094 - RNA, 22 nt, Human
gaaacacauaugaacaguugau

SEQ ID NO: 434095 - RNA, 22 nt, Human
ugaagacagaccaaggagaaug

SEQ ID NO: 434096 - RNA, 22 nt, Human
cgcagcuggauaucaugugccu

SEQ ID NO: 434097 - RNA, 22 nt, Human
aaagacuuucaccuagcaaaga

SEQ ID NO: 434098 - RNA, 22 nt, Human
cuuauugugagguauugagauu

SEQ ID NO: 434099 - RNA, 22 nt, Human
aagagcuggaguuugcagcccu

SEQ ID NO: 434100 - RNA, 22 nt, Human
gaacagugccagcacacaauaa

SEQ ID NO: 434101 - RNA, 22 nt, Human
gagacacaaucucauuuacauu

SEQ ID NO: 434102 - RNA, 22 nt, Human
ggagaaugauauauagcucagu

SEQ ID NO: 434103 - RNA, 22 nt, Human
acaugcagacgggauccuggca

SEQ ID NO: 434104 - RNA, 22 nt, Human
agcagcaggcuagggaacugcu

SEQ ID NO: 434105 - RNA, 22 nt, Human
ccaggccucuggcugcuuaguc

SEQ ID NO: 434106 - RNA, 22 nt, Human
uugggcagauguuuccugugga

SEQ ID NO: 434107 - RNA, 22 nt, Human
ucaggaggcggugcugccuuug

SEQ ID NO: 434108 - RNA, 22 nt, Human
ucccagcagcauagcucagaau

SEQ ID NO: 434109 - RNA, 22 nt, Human
ugguacaagaguauuugcgguu

SEQ ID NO: 434110 - RNA, 22 nt, Human
acagaaaugauguuuggcaaua

SEQ ID NO: 434111 - RNA, 22 nt, Human
acaggaaguuuggaaagccuca

SEQ ID NO: 434112 - RNA, 22 nt, Human
ugaauagauggugacaguauga

SEQ ID NO: 434113 - RNA, 22 nt, Human
uucucagguagugcugaugcug

SEQ ID NO: 434114 - RNA, 22 nt, Human
cagaggaguucaguacacagcc

SEQ ID NO: 434115 - RNA, 22 nt, Human
gagcucagggcauugagcaaga

SEQ ID NO: 434116 - RNA, 22 nt, Human
gcagcaggagaguuuguccugc

SEQ ID NO: 434117 - RNA, 22 nt, Human
aagcccuguuaggcacugggga

SEQ ID NO: 434118 - RNA, 22 nt, Human
cacaaggacuggauggaguggg

SEQ ID NO: 434119 - RNA, 22 nt, Human
gcuaaggcucagguucuaagga

SEQ ID NO: 434120 - RNA, 22 nt, Human
cuguuucaccacuggcucuuug

SEQ ID NO: 434121 - RNA, 22 nt, Human
ugcccagccccuaucccuggga

SEQ ID NO: 434122 - RNA, 19 nt, Human
uucaaguaaacuauuauua

SEQ ID NO: 434123 - RNA, 22 nt, Human
cagaggcugccagccaugugca

SEQ ID NO: 434124 - RNA, 21 nt, Human
uugauuuuaggaaguuuguca

SEQ ID NO: 434125 - RNA, 22 nt, Human
acacccagagcgccagugccga

SEQ ID NO: 434126 - RNA, 18 nt, Human
ucucaaaaauaauggcuu

SEQ ID NO: 434127 - RNA, 22 nt, Human
cagcacuaauccugcaauuucu

SEQ ID NO: 434128 - RNA, 22 nt, Human
auacacuguucacuagaucuuc

SEQ ID NO: 434129 - RNA, 20 nt, Human
aacacaggguuaccaucaga

SEQ ID NO: 434130 - RNA, 21 nt, Human
aaguagaucacuguucucuug

SEQ ID NO: 434131 - RNA, 17 nt, Human
cuggucccaccaagccc

SEQ ID NO: 434132 - RNA, 22 nt, Human
gccuucugauugcuggacugac

SEQ ID NO: 434133 - RNA, 18 nt, Human
cugccccuucucugagau

SEQ ID NO: 434134 - RNA, 23 nt, Human
ugacacaggucaaaaauaagaug

SEQ ID NO: 434135 - RNA, 22 nt, Human
cacaggaacaaagaagacaauu

SEQ ID NO: 434136 - RNA, 22 nt, Human
aaugaagaaauggacaucuuua

SEQ ID NO: 434137 - RNA, 22 nt, Human
aauaugcaaagcguguuaucug

SEQ ID NO: 434138 - RNA, 19 nt, Human
aggagccuugagcagugag

SEQ ID NO: 434139 - RNA, 22 nt, Human
augguggauuugugauucagcu

SEQ ID NO: 434140 - RNA, 22 nt, Human
cugaggccuguguuggggcagu

SEQ ID NO: 434141 - RNA, 22 nt, Human
aaugauaccaaacauguagaua

SEQ ID NO: 434142 - RNA, 22 nt, Human
ccaggcucugucuggucagaag

SEQ ID NO: 434143 - RNA, 22 nt, Human
auuauuguugcggcuguuaccg

SEQ ID NO: 434144 - RNA, 22 nt, Human
caggccucagagaguggcgggg

SEQ ID NO: 434145 - RNA, 22 nt, Human
agcagcuggcagcuucuucucu

SEQ ID NO: 434146 - RNA, 19 nt, Human
cuggccuguguccugugcu

SEQ ID NO: 434147 - RNA, 22 nt, Human
accugccuucucaaggacauga

SEQ ID NO: 434148 - RNA, 22 nt, Human
caucucugguucagucucugug

SEQ ID NO: 434149 - RNA, 22 nt, Human
gggugggccugucuggccaugu

SEQ ID NO: 434150 - RNA, 22 nt, Human
ugaaggugucuuugugaacauc

SEQ ID NO: 434151 - RNA, 22 nt, Human
gaggccaggggucagcaauugg

SEQ ID NO: 434152 - RNA, 20 nt, Human
aauugcccauccuccuagcc

SEQ ID NO: 434153 - RNA, 22 nt, Human
aggagggagaugcccauccugg

SEQ ID NO: 434154 - RNA, 22 nt, Human
gcacugaaugcuuuuacuguaa

SEQ ID NO: 434155 - RNA, 22 nt, Human
acagcagcaauagcagugacau

SEQ ID NO: 434156 - RNA, 22 nt, Human
caggccucuccuuagucuggca

SEQ ID NO: 434157 - RNA, 22 nt, Human
ucacaaugaaaaacacuacaua

SEQ ID NO: 434158 - RNA, 22 nt, Human
gguccguuuuugaagacagugg

SEQ ID NO: 434159 - RNA, 22 nt, Human
cuggcagcauggagccugugcu

SEQ ID NO: 434160 - RNA, 19 nt, Human
ugcucaguggcuaaaagca

SEQ ID NO: 434161 - RNA, 22 nt, Human
ccagcuucucucugaugcagcu

SEQ ID NO: 434162 - RNA, 22 nt, Human
uacacaaugacuuaagauguca

SEQ ID NO: 434163 - RNA, 22 nt, Human
cugacucagcagcugaugaucc

SEQ ID NO: 434164 - RNA, 22 nt, Human
aaacagaguuugguaaauagcc

SEQ ID NO: 434165 - RNA, 22 nt, Human
acaguucuguccuagacuucgu

SEQ ID NO: 434166 - RNA, 22 nt, Human
cuagagaagagguuaagcauga

SEQ ID NO: 434167 - RNA, 22 nt, Human
gaaaagagaacaucugaggauc

SEQ ID NO: 434168 - RNA, 21 nt, Human
guugaauauccauguaugugu

SEQ ID NO: 434169 - RNA, 22 nt, Human
agcaagauugaggcuuccucag

SEQ ID NO: 434170 - RNA, 22 nt, Human
cugcugcucuugugcauuagug

SEQ ID NO: 434171 - RNA, 22 nt, Human
ucagacuugacuuuguaaguuu

SEQ ID NO: 434172 - RNA, 22 nt, Human
auccaacaggacaaagaaagga

SEQ ID NO: 434173 - RNA, 22 nt, Human
ugcaggcucucugcugccagau

SEQ ID NO: 434174 - RNA, 22 nt, Human
cagcugaguuacucugaggucu

SEQ ID NO: 434175 - RNA, 22 nt, Human
ucagagcuuaucucuugcugga

SEQ ID NO: 434176 - RNA, 22 nt, Human
ggccccagggauuaggccaacc

SEQ ID NO: 434177 - RNA, 20 nt, Human
gcccaagguccagaaggggg

SEQ ID NO: 434178 - RNA, 22 nt, Human
ucagaggucacacagcaaguuu

SEQ ID NO: 434179 - RNA, 22 nt, Human
aacagcagggaugacauggcca

SEQ ID NO: 434180 - RNA, 22 nt, Human
gccugggagagggauagugcag

SEQ ID NO: 434181 - RNA, 22 nt, Human
gggcucuggauggagccugcag

SEQ ID NO: 434182 - RNA, 22 nt, Human
gcaggccagcugugcagauggg

SEQ ID NO: 434183 - RNA, 22 nt, Human
caggcagcugacugucagauau

SEQ ID NO: 434184 - RNA, 22 nt, Human
ggcagcaggagccaucugguag

SEQ ID NO: 434185 - RNA, 21 nt, Human
gagccuucccucugcccuuuc

SEQ ID NO: 434186 - RNA, 22 nt, Human
caugccuguauuucugaucuau

SEQ ID NO: 434187 - RNA, 22 nt, Human
cccacaguuaaccaaaggaauu

SEQ ID NO: 434188 - RNA, 22 nt, Human
aaauucaguuccucagccacau

SEQ ID NO: 434189 - RNA, 22 nt, Human
uuugcaaauuagccacccuguu

SEQ ID NO: 434190 - RNA, 22 nt, Human
gccagcagggaagccuugggcu

SEQ ID NO: 434191 - RNA, 22 nt, Human
ucccagagauuuccucuccuuc

SEQ ID NO: 434192 - RNA, 22 nt, Human
ccaggcugggcuacaaguugag

SEQ ID NO: 434193 - RNA, 22 nt, Human
acacuaauuaagcugcuuuacu

SEQ ID NO: 434194 - RNA, 22 nt, Human
ggagccugggccuccugcccuu

SEQ ID NO: 434195 - RNA, 22 nt, Human
ugcacacaaaugugaacgugcc

SEQ ID NO: 434196 - RNA, 22 nt, Human
ugaucaaaacauuacuccacca

SEQ ID NO: 434197 - RNA, 22 nt, Human
uguacaaagguacuuugauguu

SEQ ID NO: 434198 - RNA, 22 nt, Human
ucaggccccuugucagcucugu

SEQ ID NO: 434199 - RNA, 22 nt, Human
uggcuccuuuccgggucuccag

SEQ ID NO: 434200 - RNA, 20 nt, Human
caacagaggggucuggagua

SEQ ID NO: 434201 - RNA, 22 nt, Human
uuauggaauaaccuuucugaaa

SEQ ID NO: 434202 - RNA, 22 nt, Human
gcugagcugcuguucauccugc

SEQ ID NO: 434203 - RNA, 22 nt, Human
auucaaguccagcuucucuaca

SEQ ID NO: 434204 - RNA, 19 nt, Human
ucucagagcccuagaggcc

SEQ ID NO: 434205 - RNA, 22 nt, Human
uugcagcugugagcuuuacacg

SEQ ID NO: 434206 - RNA, 22 nt, Human
aggccagguuccucaaucuuga

SEQ ID NO: 434207 - RNA, 23 nt, Human
ggccucuguguucugcccacaug

SEQ ID NO: 434208 - RNA, 22 nt, Human
gcucccaggaugaggagccagg

SEQ ID NO: 434209 - RNA, 22 nt, Human
cagggguggcugcagcagaggu

SEQ ID NO: 434210 - RNA, 22 nt, Human
aaguuuuucacauugcuguugu

SEQ ID NO: 434211 - RNA, 22 nt, Human
gccuggaguuguggugaagcca

SEQ ID NO: 434212 - RNA, 22 nt, Human
cuguguccucccgcugcaccca

SEQ ID NO: 434213 - RNA, 22 nt, Human
gaucaaggcaguagggccagcu

SEQ ID NO: 434214 - RNA, 22 nt, Human
ucugggcacugcugagccugua

SEQ ID NO: 434215 - RNA, 21 nt, Human
acacaacaggcagucauuuuc

SEQ ID NO: 434216 - RNA, 22 nt, Human
ucaaacuguuagauuucagcuc

SEQ ID NO: 434217 - RNA, 22 nt, Human
gcccuucauuuauaguuggaau

SEQ ID NO: 434218 - RNA, 22 nt, Human
agcagggcucuguggagggugg

SEQ ID NO: 434219 - RNA, 22 nt, Human
ucugagaagcgugucucuguuu

SEQ ID NO: 434220 - RNA, 22 nt, Human
aaauguacaacauccauauaua

SEQ ID NO: 434221 - RNA, 18 nt, Human
aggcuucuuggcucaguc

SEQ ID NO: 434222 - RNA, 22 nt, Human
auucuacaccucucucauuuag

SEQ ID NO: 434223 - RNA, 22 nt, Human
uccccaggggcaucucucugcu

SEQ ID NO: 434224 - RNA, 21 nt, Human
augaagcaagggucacacgug

SEQ ID NO: 434225 - RNA, 22 nt, Human
cugcagagaauuguggggcuuc

SEQ ID NO: 434226 - RNA, 22 nt, Human
agagcacugcugauuuacaguc

SEQ ID NO: 434227 - RNA, 23 nt, Human
cugcauugucuccugggagcaug

SEQ ID NO: 434228 - RNA, 22 nt, Human
aagcagagaaaagcuuagguuc

SEQ ID NO: 434229 - RNA, 22 nt, Human
gccuuccuuacaccugcucagc

SEQ ID NO: 434230 - RNA, 22 nt, Human
gggcuccaacuacaucagccuu

SEQ ID NO: 434231 - RNA, 22 nt, Human
cagagcugggaucccaugggcg

SEQ ID NO: 434232 - RNA, 22 nt, Human
ggaugaggaaaccacagugucc

SEQ ID NO: 434233 - RNA, 22 nt, Human
uucaacauuuuugaguuuaggu

SEQ ID NO: 434234 - RNA, 22 nt, Human
caggcccuggcagggcugaguc

SEQ ID NO: 434235 - RNA, 22 nt, Human
acacuuuaucaauauucaaaaa

SEQ ID NO: 434236 - RNA, 22 nt, Human
uuacagcagcagggacagacua

SEQ ID NO: 434237 - RNA, 22 nt, Human
gaacauucacagacucaccauu

SEQ ID NO: 434238 - RNA, 22 nt, Human
ucaugcagaguagaaagggcaa

SEQ ID NO: 434239 - RNA, 22 nt, Human
gacagcaacacucaauucugca

SEQ ID NO: 434240 - RNA, 22 nt, Human
uuucagagcucuaggcucucag

SEQ ID NO: 434241 - RNA, 22 nt, Human
ugacagagcugggauuugaagc

SEQ ID NO: 434242 - RNA, 22 nt, Human
cagggcacuuaaauugccucgu

SEQ ID NO: 434243 - RNA, 22 nt, Human
gcucccucugcucaggcacuug

SEQ ID NO: 434244 - RNA, 22 nt, Human
gaugauuuaaguggccaaagua

SEQ ID NO: 434245 - RNA, 22 nt, Human
gcucuugacucccaguucugug

SEQ ID NO: 434246 - RNA, 20 nt, Human
agcauuugaaauaugacuau

SEQ ID NO: 434247 - RNA, 22 nt, Human
ccuccuggcccugggccuggaa

SEQ ID NO: 434248 - RNA, 22 nt, Human
cagccugcccuggaagcccagc

SEQ ID NO: 434249 - RNA, 22 nt, Human
cagcagaguauggcacucaacu

SEQ ID NO: 434250 - RNA, 22 nt, Human
cugggagggguagccaauccua

SEQ ID NO: 434251 - RNA, 21 nt, Human
uaaagcucguucaggaaaguc

SEQ ID NO: 434252 - RNA, 22 nt, Human
uggcagcuggcucugcgcaggc

SEQ ID NO: 434253 - RNA, 22 nt, Human
auuuggcaacauuaauugaauc

SEQ ID NO: 434254 - RNA, 22 nt, Human
agaaggcauagaccggauuaug

SEQ ID NO: 434255 - RNA, 22 nt, Human
ggagcuguugcgcaugcgcucg

SEQ ID NO: 434256 - RNA, 22 nt, Human
aaguauucauaaggacauaugu

SEQ ID NO: 434257 - RNA, 22 nt, Human
cacugugucaguuugguuagac

SEQ ID NO: 434258 - RNA, 22 nt, Human
caggcaggugcagauuccucuu

SEQ ID NO: 434259 - RNA, 19 nt, Human
aggucuaaucauaagacaa

SEQ ID NO: 434260 - RNA, 22 nt, Human
aaggaggaauuucagggugaau

SEQ ID NO: 434261 - RNA, 22 nt, Human
uaggguccugccuacagagaca

SEQ ID NO: 434262 - RNA, 22 nt, Human
gacugcauucauuugguuggca

SEQ ID NO: 434263 - RNA, 22 nt, Human
gagggcagagacagugauucac

SEQ ID NO: 434264 - RNA, 19 nt, Human
acccauuuucaguauuggc

SEQ ID NO: 434265 - RNA, 22 nt, Human
uuacuauaguccagcccuuuuu

SEQ ID NO: 434266 - RNA, 22 nt, Human
ugucacauaggcaaaauguuuu

SEQ ID NO: 434267 - RNA, 22 nt, Human
aaauaacuuucuguguauaguc

SEQ ID NO: 434268 - RNA, 18 nt, Human
ggagccagucugucucug

SEQ ID NO: 434269 - RNA, 22 nt, Human
aacacaaagaagcugcaggauc

SEQ ID NO: 434270 - RNA, 22 nt, Human
accaucuuagcagacugcagug

SEQ ID NO: 434271 - RNA, 22 nt, Human
ucugagaagcgggagccuguga

SEQ ID NO: 434272 - RNA, 22 nt, Human
augugcucuuauuacccugucg

SEQ ID NO: 434273 - RNA, 22 nt, Human
uccaguuuccaaucacugcacg

SEQ ID NO: 434274 - RNA, 22 nt, Human
cucugggaugaggccuaggcac

SEQ ID NO: 434275 - RNA, 22 nt, Human
gagggaagaaagaauugaugcg

SEQ ID NO: 434276 - RNA, 22 nt, Human
guggccucugugcuccugccua

SEQ ID NO: 434277 - RNA, 22 nt, Human
aaguauucuacaaagaaauuga

SEQ ID NO: 434278 - RNA, 22 nt, Human
aaguagaugaucuuucugcaua

SEQ ID NO: 434279 - RNA, 22 nt, Human
cccauucuucaugguuuccugu

SEQ ID NO: 434280 - RNA, 22 nt, Human
cagugaggaguccagggcagag

SEQ ID NO: 434281 - RNA, 22 nt, Human
ucagcaguggguccugagggug

SEQ ID NO: 434282 - RNA, 22 nt, Human
uuaauacaacuguugucacugg

SEQ ID NO: 434283 - RNA, 22 nt, Human
agcagcuugagcuggggcuggc

SEQ ID NO: 434284 - RNA, 22 nt, Human
ugcagaagaauguaggcauaag

SEQ ID NO: 434285 - RNA, 22 nt, Human
cacccaggacaggccagaugug

SEQ ID NO: 434286 - RNA, 22 nt, Human
ccucuccccucccaaggcggga

SEQ ID NO: 434287 - RNA, 20 nt, Human
ucagccuucucauccugggg

SEQ ID NO: 434288 - RNA, 22 nt, Human
ggaacacaaaugggagagcugg

SEQ ID NO: 434289 - RNA, 22 nt, Human
ugagggauccagaggcaguggu

SEQ ID NO: 434290 - RNA, 22 nt, Human
gcaggcugggguagccccacuu

SEQ ID NO: 434291 - RNA, 22 nt, Human
gcagagcauguccucaggacag

SEQ ID NO: 434292 - RNA, 22 nt, Human
auuuggaaaagcgguaacuugc

SEQ ID NO: 434293 - RNA, 22 nt, Human
cugagcagcacagggcgccagg

SEQ ID NO: 434294 - RNA, 22 nt, Human
gcagcuguguaaugagcccaca

SEQ ID NO: 434295 - RNA, 22 nt, Human
ggcacagggugauguugcaguu

SEQ ID NO: 434296 - RNA, 22 nt, Human
cagguucccuugcagcuaagug

SEQ ID NO: 434297 - RNA, 22 nt, Human
agcacuuaaguuaauugaacug

SEQ ID NO: 434298 - RNA, 19 nt, Human
gccaggccuggaccugcag

SEQ ID NO: 434299 - RNA, 22 nt, Human
ccugucaggguuugccucagaa

SEQ ID NO: 434300 - RNA, 22 nt, Human
ccugggaggcggagguugcagu

SEQ ID NO: 434301 - RNA, 22 nt, Human
aagcacaguucuuagaguuaca

SEQ ID NO: 434302 - RNA, 22 nt, Human
uucacagugguagugcauuuag

SEQ ID NO: 434303 - RNA, 22 nt, Human
cucugcagaggcccaaggcuga

SEQ ID NO: 434304 - RNA, 22 nt, Human
agaauaaaucaaauguccugag

SEQ ID NO: 434305 - RNA, 22 nt, Human
gcugccugccuugccuggagga

SEQ ID NO: 434306 - RNA, 22 nt, Human
ugccuguggaaaggcuggugcu

SEQ ID NO: 434307 - RNA, 22 nt, Human
ccuggguuauuuuggucuagug

SEQ ID NO: 434308 - RNA, 22 nt, Human
ggaggcccagaaggaagcccag

SEQ ID NO: 434309 - RNA, 20 nt, Human
cagcuagugguaggagucgg

SEQ ID NO: 434310 - RNA, 22 nt, Human
agcaaagaagacacaggcuuca

SEQ ID NO: 434311 - RNA, 22 nt, Human
gcucuugaauauggguuucaug

SEQ ID NO: 434312 - RNA, 20 nt, Human
ugguccugucccacccacuc

SEQ ID NO: 434313 - RNA, 22 nt, Human
auucucuagucucuuccauaaa

SEQ ID NO: 434314 - RNA, 19 nt, Human
cagcccucuuaccacugug

SEQ ID NO: 434315 - RNA, 22 nt, Human
gcagcugucagaaguuggaauc

SEQ ID NO: 434316 - RNA, 22 nt, Human
agggcuggaggguacuaguuua

SEQ ID NO: 434317 - RNA, 22 nt, Human
gcuguuuccccuucacaguggc

SEQ ID NO: 434318 - RNA, 22 nt, Human
auugacaauucuaugcagagca

SEQ ID NO: 434319 - RNA, 16 nt, Human
aacccacagcucccga

SEQ ID NO: 434320 - RNA, 22 nt, Human
aaguuccugagcucauauagca

SEQ ID NO: 434321 - RNA, 22 nt, Human
acauguuagaaaugcagaaucu

SEQ ID NO: 434322 - RNA, 22 nt, Human
aaggcuaaguaaggcucuuucu

SEQ ID NO: 434323 - RNA, 22 nt, Human
ggcagucuuaucagcauuggac

SEQ ID NO: 434324 - RNA, 22 nt, Human
ucccagagaagagcuggaugga

SEQ ID NO: 434325 - RNA, 22 nt, Human
auuuuucaacuuuggaaauggc

SEQ ID NO: 434326 - RNA, 22 nt, Human
caggaaagaaaugagaacacca

SEQ ID NO: 434327 - RNA, 22 nt, Human
acagaagcucaagagagcagug

SEQ ID NO: 434328 - RNA, 22 nt, Human
aacaugcaaugucugaaaaucc

SEQ ID NO: 434329 - RNA, 22 nt, Human
agcagcuguuuguugaauuggu

SEQ ID NO: 434330 - RNA, 22 nt, Human
aagcccagcugaaagcauuuuu

SEQ ID NO: 434331 - RNA, 22 nt, Human
uuaucacuuaugagcuuuuugc

SEQ ID NO: 434332 - RNA, 22 nt, Human
ugcccuggggagcccagccagg

SEQ ID NO: 434333 - RNA, 22 nt, Human
acaggcuguugggguccagggu

SEQ ID NO: 434334 - RNA, 22 nt, Human
uccaggccaauguagcaggccc

SEQ ID NO: 434335 - RNA, 22 nt, Human
agagccuggucugagauaggac

SEQ ID NO: 434336 - RNA, 22 nt, Human
caggcagaugcugacaagaguu

SEQ ID NO: 434337 - RNA, 22 nt, Human
ggcucaguaagucagguucauu

SEQ ID NO: 434338 - RNA, 22 nt, Human
auacaaaaauuagccgggagua

SEQ ID NO: 434339 - RNA, 22 nt, Human
uucuaaguguugacaaagucua

SEQ ID NO: 434340 - RNA, 22 nt, Human
gucaugccagcggagcucggga

SEQ ID NO: 434341 - RNA, 22 nt, Human
auuuaacaagacagagaacugg

SEQ ID NO: 434342 - RNA, 22 nt, Human
cagagcuggagggaacccuggc

SEQ ID NO: 434343 - RNA, 22 nt, Human
cacauuuaauccuuuauaagua

SEQ ID NO: 434344 - RNA, 22 nt, Human
aacagcagggggaccugcuggu

SEQ ID NO: 434345 - RNA, 22 nt, Human
aagcugcccucauucccagugc

SEQ ID NO: 434346 - RNA, 22 nt, Human
ugaugaggcuucuuggugaaca

SEQ ID NO: 434347 - RNA, 22 nt, Human
cuucaaauucgaggaguagaug

SEQ ID NO: 434348 - RNA, 22 nt, Human
uaauaguuucauaaugugcuuc

SEQ ID NO: 434349 - RNA, 22 nt, Human
ggcaggguggcagaggcucaga

SEQ ID NO: 434350 - RNA, 22 nt, Human
accugccuaguugguucugccc

SEQ ID NO: 434351 - RNA, 22 nt, Human
ucugggcuugguuagggcuguu

SEQ ID NO: 434352 - RNA, 22 nt, Human
uucuauaagacucauauuucuu

SEQ ID NO: 434353 - RNA, 22 nt, Human
acagaugaugugcacagauaga

SEQ ID NO: 434354 - RNA, 22 nt, Human
uucacauggcaauagagaggga

SEQ ID NO: 434355 - RNA, 22 nt, Human
ggacacagccacuuaggguacc

SEQ ID NO: 434356 - RNA, 22 nt, Human
cagugcugcaucuccaugccag

SEQ ID NO: 434357 - RNA, 21 nt, Human
cucugcugucuaccagcuguu

SEQ ID NO: 434358 - RNA, 22 nt, Human
cacaggcucuccagggccugga

SEQ ID NO: 434359 - RNA, 23 nt, Human
aaaguugauuugcaguuuaagag

SEQ ID NO: 434360 - RNA, 22 nt, Human
gucuuuaugguaugaaaacuga

SEQ ID NO: 434361 - RNA, 22 nt, Human
gcccagaguucaaggcugcagu

SEQ ID NO: 434362 - RNA, 22 nt, Human
ggccagguaagagugcagccgc

SEQ ID NO: 434363 - RNA, 22 nt, Human
augugugugugcgcgcgcagga

SEQ ID NO: 434364 - RNA, 22 nt, Human
uugagcaagccugcggcgggaa

SEQ ID NO: 434365 - RNA, 22 nt, Human
agcagcugaaaggcaaacuucu

SEQ ID NO: 434366 - RNA, 22 nt, Human
caggcagaagaaguggaaggac

SEQ ID NO: 434367 - RNA, 22 nt, Human
uacuaaaugauuaagcaggaau

SEQ ID NO: 434368 - RNA, 22 nt, Human
uuagaaaucaccucugaagauc

SEQ ID NO: 434369 - RNA, 22 nt, Human
uauuggauuucugaaagaugag

SEQ ID NO: 434370 - RNA, 22 nt, Human
ucauuugugugagugauuugac

SEQ ID NO: 434371 - RNA, 22 nt, Human
auucagacucuugagcaguccc

SEQ ID NO: 434372 - RNA, 23 nt, Human
ucauucaaggcugguaucuuuca

SEQ ID NO: 434373 - RNA, 22 nt, Human
gugccuggagcuaauguguaua

SEQ ID NO: 434374 - RNA, 21 nt, Human
acagaguaguugaaacagaga

SEQ ID NO: 434375 - RNA, 22 nt, Human
uuuggaaagugugauuucaagg

SEQ ID NO: 434376 - RNA, 22 nt, Human
uuugacaaaggaaaaaugcaca

SEQ ID NO: 434377 - RNA, 22 nt, Human
ccugggugaugugcugcccucg

SEQ ID NO: 434378 - RNA, 22 nt, Human
gcaggcugaugacuggaguugg

SEQ ID NO: 434379 - RNA, 22 nt, Human
gcugucagugaggugagacaug

SEQ ID NO: 434380 - RNA, 22 nt, Human
gcugccucugcgacucugggcg

SEQ ID NO: 434381 - RNA, 22 nt, Human
ggcauccuccauauaggugaau

SEQ ID NO: 434382 - RNA, 22 nt, Human
gcagcugccccgacugugaguc

SEQ ID NO: 434383 - RNA, 23 nt, Human
acccaucucuccugucaugcaga

SEQ ID NO: 434384 - RNA, 22 nt, Human
cugugccaggcccagcugacuu

SEQ ID NO: 434385 - RNA, 20 nt, Human
agguuccuuuguggagaauu

SEQ ID NO: 434386 - RNA, 22 nt, Human
uuaaagcccagcauauacuagg

SEQ ID NO: 434387 - RNA, 22 nt, Human
cgcagaagagguugucuagucc

SEQ ID NO: 434388 - RNA, 22 nt, Human
agcccuccaaagguugggggag

SEQ ID NO: 434389 - RNA, 22 nt, Human
ggcuagggagacagagggcaug

SEQ ID NO: 434390 - RNA, 22 nt, Human
cucuccuugaggcuuggacuuc

SEQ ID NO: 434391 - RNA, 21 nt, Human
uuucuaaggaggaagaaaaga

SEQ ID NO: 434392 - RNA, 22 nt, Human
cccagccaaggugcugguguug

SEQ ID NO: 434393 - RNA, 20 nt, Human
cacugccagaauacacuguc

SEQ ID NO: 434394 - RNA, 22 nt, Human
gcucucugccuuucucaaugac

SEQ ID NO: 434395 - RNA, 21 nt, Human
gguuaaaagacacaucuguuu

SEQ ID NO: 434396 - RNA, 22 nt, Human
ccagcccugucaccaacuggag

SEQ ID NO: 434397 - RNA, 22 nt, Human
gagaaggcugauccuuggaguu

SEQ ID NO: 434398 - RNA, 22 nt, Human
aaaaggaggucacuuuauuccu

SEQ ID NO: 434399 - RNA, 22 nt, Human
cacagaggaugcccaagcgauc

SEQ ID NO: 434400 - RNA, 22 nt, Human
uguggcugacuccuggucccca

SEQ ID NO: 434401 - RNA, 22 nt, Human
guccuugcuugagacaggcagu

SEQ ID NO: 434402 - RNA, 22 nt, Human
agggaauggaugauggcagguu

SEQ ID NO: 434403 - RNA, 22 nt, Human
ucuuugcacacaucccuucccg

SEQ ID NO: 434404 - RNA, 20 nt, Human
gcagcugcccccagucccug

SEQ ID NO: 434405 - RNA, 22 nt, Human
gccuggagaggaagccggugga

SEQ ID NO: 434406 - RNA, 21 nt, Human
augacagaugcugcagaucgu

SEQ ID NO: 434407 - RNA, 22 nt, Human
uccugcagccacugcaggcaga

SEQ ID NO: 434408 - RNA, 22 nt, Human
gcuccagggaacagaauguacu

SEQ ID NO: 434409 - RNA, 20 nt, Human
aaggcagaguggguuggagc

SEQ ID NO: 434410 - RNA, 22 nt, Human
aaauugccaaauuguuuuccag

SEQ ID NO: 434411 - RNA, 22 nt, Human
agagccugggcagcuccucugg

SEQ ID NO: 434412 - RNA, 22 nt, Human
gcccuaucauucauugagugcu

SEQ ID NO: 434413 - RNA, 22 nt, Human
aagauucagccaaauuguucau

SEQ ID NO: 434414 - RNA, 22 nt, Human
uuucaaauaccauaaaccuaau

SEQ ID NO: 434415 - RNA, 18 nt, Human
aggccagcccugcuacug

SEQ ID NO: 434416 - RNA, 22 nt, Human
uccugagggcugcagucauagg

SEQ ID NO: 434417 - RNA, 22 nt, Human
acacagagcaaaucaugacaga

SEQ ID NO: 434418 - RNA, 22 nt, Human
acaguacuguguuaacugaacc

SEQ ID NO: 434419 - RNA, 21 nt, Human
ggugggcacaggagagcagag

SEQ ID NO: 434420 - RNA, 18 nt, Human
gagagcccagcagguggu

SEQ ID NO: 434421 - RNA, 22 nt, Human
ugcccacauucaaaaggugaug

SEQ ID NO: 434422 - RNA, 22 nt, Human
uccugggcuugcuccuccagcu

SEQ ID NO: 434423 - RNA, 22 nt, Human
cagagcugggcauggugaaagg

SEQ ID NO: 434424 - RNA, 22 nt, Human
ccugcagacacuuguccagcaa

SEQ ID NO: 434425 - RNA, 22 nt, Human
gagcauaggacacagaggugug

SEQ ID NO: 434426 - RNA, 22 nt, Human
ccugccugacagagaagguuca

SEQ ID NO: 434427 - RNA, 22 nt, Human
ucugggugacccugggcaaggc

SEQ ID NO: 434428 - RNA, 22 nt, Human
ggcccugagcugaaguacugug

SEQ ID NO: 434429 - RNA, 22 nt, Human
cuguggcaagucugccugucac

SEQ ID NO: 434430 - RNA, 22 nt, Human
ugcacacacaggagucuccucc

SEQ ID NO: 434431 - RNA, 22 nt, Human
gagcucagcccaaagagcagug

SEQ ID NO: 434432 - RNA, 22 nt, Human
uggggaugaaacccaggcaucu

SEQ ID NO: 434433 - RNA, 22 nt, Human
ucccagagaaagucaaggucuu

SEQ ID NO: 434434 - RNA, 22 nt, Human
aggguccaguaacagaugccag

SEQ ID NO: 434435 - RNA, 22 nt, Human
gcaguggcaccgcuggcucugg

SEQ ID NO: 434436 - RNA, 22 nt, Human
gggaugagagcugggacagaag

SEQ ID NO: 434437 - RNA, 22 nt, Human
gagcaugagggaaggcagcaga

SEQ ID NO: 434438 - RNA, 22 nt, Human
ugaggcagcaauuguauuguau

SEQ ID NO: 434439 - RNA, 22 nt, Human
aauccaauccuacucagaaagu

SEQ ID NO: 434440 - RNA, 22 nt, Human
aaucuagagugcuaggucugug

SEQ ID NO: 434441 - RNA, 22 nt, Human
ccagagaagaaaagcaccuuuu

SEQ ID NO: 434442 - RNA, 21 nt, Human
ugcccacagcaaaugcagagg

SEQ ID NO: 434443 - RNA, 22 nt, Human
uuaagacauuuuuggagauuau

SEQ ID NO: 434444 - RNA, 22 nt, Human
ucagcagaggggaaggcaucug

SEQ ID NO: 434445 - RNA, 22 nt, Human
uuggaaagaagggcugagcaag

SEQ ID NO: 434446 - RNA, 22 nt, Human
gcagcccugcagcuccacaccg

SEQ ID NO: 434447 - RNA, 22 nt, Human
cacugccuggaaggagagacau

SEQ ID NO: 434448 - RNA, 22 nt, Human
ccagccugaaaugccucauccu

SEQ ID NO: 434449 - RNA, 22 nt, Human
acggugcuggguauugggguuc

SEQ ID NO: 434450 - RNA, 22 nt, Human
agccagagggaaucuuugggga

SEQ ID NO: 434451 - RNA, 22 nt, Human
gcuggugagcaaaggagaagga

SEQ ID NO: 434452 - RNA, 22 nt, Human
cacuuaucucauuuaaucacca

SEQ ID NO: 434453 - RNA, 22 nt, Human
caggagguugguagcaguagau

SEQ ID NO: 434454 - RNA, 22 nt, Human
cuggccacuggagguggcaccc

SEQ ID NO: 434455 - RNA, 22 nt, Human
ugagggagcacacacugaagug

SEQ ID NO: 434456 - RNA, 19 nt, Human
uacuuauuagaaauauggg

SEQ ID NO: 434457 - RNA, 22 nt, Human
cgcgcugcagacagcggaggcc

SEQ ID NO: 434458 - RNA, 22 nt, Human
acagcugggugucccacuucug

SEQ ID NO: 434459 - RNA, 20 nt, Human
agggcagagggauuacaggc

SEQ ID NO: 434460 - RNA, 22 nt, Human
aaugaaugaaccacauauaaca

SEQ ID NO: 434461 - RNA, 22 nt, Human
gaggcagagucacaaagagucu

SEQ ID NO: 434462 - RNA, 22 nt, Human
ucagagccaaucauggugcauu

SEQ ID NO: 434463 - RNA, 22 nt, Human
gggucuggcaugcugagaugga

SEQ ID NO: 434464 - RNA, 22 nt, Human
caggccuccacuccacgcagac

SEQ ID NO: 434465 - RNA, 22 nt, Human
gagcugccaguguaugaauucu

SEQ ID NO: 434466 - RNA, 18 nt, Human
gcucaggcccuagucagu

SEQ ID NO: 434467 - RNA, 22 nt, Human
ugcaguggaaagacucagacuu

SEQ ID NO: 434468 - RNA, 22 nt, Human
ugcccucagccaccuccaaguu

SEQ ID NO: 434469 - RNA, 22 nt, Human
gaugcagaaaguagacaccauc

SEQ ID NO: 434470 - RNA, 22 nt, Human
gaucuuuacuacugccuucucu

SEQ ID NO: 434471 - RNA, 22 nt, Human
aaugauauuuauugaauagaug

SEQ ID NO: 434472 - RNA, 22 nt, Human
augacuuuccuggcaaaaguug

SEQ ID NO: 434473 - RNA, 22 nt, Human
ggugggcaacauuuggccugag

SEQ ID NO: 434474 - RNA, 19 nt, Human
cuaaggcaagaaacuggac

SEQ ID NO: 434475 - RNA, 22 nt, Human
gagcacuguacucauuugcacu

SEQ ID NO: 434476 - RNA, 22 nt, Human
gagggaagaggccugacauuuu

SEQ ID NO: 434477 - RNA, 22 nt, Human
cagaauuuaaguggauuauucu

SEQ ID NO: 434478 - RNA, 22 nt, Human
cagagcagaagguccaagccug

SEQ ID NO: 434479 - RNA, 22 nt, Human
cccagccucuggguucugccgg

SEQ ID NO: 434480 - RNA, 22 nt, Human
agagccagccuucucagcuuac

SEQ ID NO: 434481 - RNA, 22 nt, Human
agagcuggauggucaagauggc

SEQ ID NO: 434482 - RNA, 22 nt, Human
acagaauaguagcuuaaaguca

SEQ ID NO: 434483 - RNA, 22 nt, Human
aaggcagccucugccagccggg

SEQ ID NO: 434484 - RNA, 23 nt, Human
agagaaucauggaaacucuuucu

SEQ ID NO: 434485 - RNA, 22 nt, Human
ccuggagcgcgggucaagcugg

SEQ ID NO: 434486 - RNA, 21 nt, Human
ucauuugugaucugauuucca

SEQ ID NO: 434487 - RNA, 22 nt, Human
cugagaggcggagcuugcagug

SEQ ID NO: 434488 - RNA, 22 nt, Human
aaguuuguucauucauucaucc

SEQ ID NO: 434489 - RNA, 22 nt, Human
gcuggguuuucuuccgggccua

SEQ ID NO: 434490 - RNA, 19 nt, Human
ccaggccucuggggccugu

SEQ ID NO: 434491 - RNA, 22 nt, Human
caauauagagagaaaauuaugu

SEQ ID NO: 434492 - RNA, 22 nt, Human
auugugaauugagaguacuucu

SEQ ID NO: 434493 - RNA, 22 nt, Human
ucaugcagugaaucuuucuugc

SEQ ID NO: 434494 - RNA, 22 nt, Human
ggggcagaaguagugccccuga

SEQ ID NO: 434495 - RNA, 22 nt, Human
acauucuauucugcaggacaag

SEQ ID NO: 434496 - RNA, 22 nt, Human
uacaugaacaaaauagcagaaa

SEQ ID NO: 434497 - RNA, 22 nt, Human
ugucaccucuuuggcugcagcu

SEQ ID NO: 434498 - RNA, 22 nt, Human
gaggcugguaggaaaggaaaca

SEQ ID NO: 434499 - RNA, 22 nt, Human
cccagcagaaucugaugagggc

SEQ ID NO: 434500 - RNA, 22 nt, Human
aauuaacagagggcuuauuacu

SEQ ID NO: 434501 - RNA, 22 nt, Human
cagacagagucuucccaucagu

SEQ ID NO: 434502 - RNA, 22 nt, Human
uuuauguaaguggaaugaugcc

SEQ ID NO: 434503 - RNA, 22 nt, Human
gcugccugcucggcuccuggga

SEQ ID NO: 434504 - RNA, 17 nt, Human
agugugugaaauggugg

SEQ ID NO: 434505 - RNA, 22 nt, Human
cagcagguauguuuguucagca

SEQ ID NO: 434506 - RNA, 22 nt, Human
cucuggcuccauuucccuaugu

SEQ ID NO: 434507 - RNA, 22 nt, Human
cugcauuaaguugccuguaaga

SEQ ID NO: 434508 - RNA, 22 nt, Human
cugggagaugacucagagcagg

SEQ ID NO: 434509 - RNA, 22 nt, Human
guuggcuaugagagcuuuagug

SEQ ID NO: 434510 - RNA, 22 nt, Human
gccaccaggagcccaguccaaa

SEQ ID NO: 434511 - RNA, 22 nt, Human
aauuauugagcaucuacugugu

SEQ ID NO: 434512 - RNA, 22 nt, Human
uugcauuuugguuguaaauaug

SEQ ID NO: 434513 - RNA, 22 nt, Human
uggccaggcagguagaacggcc

SEQ ID NO: 434514 - RNA, 17 nt, Human
acauuugcaaaggucug

SEQ ID NO: 434515 - RNA, 22 nt, Human
cuguccuccggccaccuacagu

SEQ ID NO: 434516 - RNA, 22 nt, Human
cauggcaggaggcugcuggcag

SEQ ID NO: 434517 - RNA, 22 nt, Human
ggagccugacagugcccagcau

SEQ ID NO: 434518 - RNA, 22 nt, Human
agggccagcugcagaauuagca

SEQ ID NO: 434519 - RNA, 22 nt, Human
uagcaucucaaccuccugaaag

SEQ ID NO: 434520 - RNA, 22 nt, Human
cugcauaugauagaugccuugc

SEQ ID NO: 434521 - RNA, 22 nt, Human
aggcuucuugagccccacaggc

SEQ ID NO: 434522 - RNA, 22 nt, Human
ugcauauugugaaaauguagau

SEQ ID NO: 434523 - RNA, 22 nt, Human
aggaagcuaaccagggagugag

SEQ ID NO: 434524 - RNA, 22 nt, Human
caugaaaauaacauuguuguga

SEQ ID NO: 434525 - RNA, 17 nt, Human
agaggcagauacuugga

SEQ ID NO: 434526 - RNA, 22 nt, Human
ugggcuggcugaggcauucacu

SEQ ID NO: 434527 - RNA, 22 nt, Human
gcacaaaacacauuuugacaau

SEQ ID NO: 434528 - RNA, 22 nt, Human
aggccagggucccacacucgca

SEQ ID NO: 434529 - RNA, 22 nt, Human
gagccagccgcaagagcuguga

SEQ ID NO: 434530 - RNA, 22 nt, Human
caguggcaggggaagcaggugu

SEQ ID NO: 434531 - RNA, 22 nt, Human
aagaaugugcuaaugaaaacuu

SEQ ID NO: 434532 - RNA, 22 nt, Human
auuuugauaaucauguuagaga

SEQ ID NO: 434533 - RNA, 22 nt, Human
ccugucucuuucaaucugagag

SEQ ID NO: 434534 - RNA, 22 nt, Human
auccugggaagcugacauugaa

SEQ ID NO: 434535 - RNA, 21 nt, Human
cccaggaguccuauuuaaaug

SEQ ID NO: 434536 - RNA, 19 nt, Human
agucucacccaagcagucu

SEQ ID NO: 434537 - RNA, 17 nt, Human
cccuggcaaagaauggc

SEQ ID NO: 434538 - RNA, 22 nt, Human
agucacauagaaguggguuuaa

SEQ ID NO: 434539 - RNA, 22 nt, Human
gggccugcuccccaucgcugcu

SEQ ID NO: 434540 - RNA, 22 nt, Human
agggcucuguuggggucagcac

SEQ ID NO: 434541 - RNA, 22 nt, Human
uaaggcaggcuuucauccagag

SEQ ID NO: 434542 - RNA, 22 nt, Human
cuauacaguaaccacagugauu

SEQ ID NO: 434543 - RNA, 22 nt, Human
cuggguggaaagugcugagaau

SEQ ID NO: 434544 - RNA, 22 nt, Human
aagcccuggcaaugucagauga

SEQ ID NO: 434545 - RNA, 22 nt, Human
caauuucuuguuaauucucagg

SEQ ID NO: 434546 - RNA, 22 nt, Human
cagaauuuuucacucaaucuuc

SEQ ID NO: 434547 - RNA, 22 nt, Human
ugcaguggcgccaucucagcuc

SEQ ID NO: 434548 - RNA, 22 nt, Human
agucuugguccaggcucauuuc

SEQ ID NO: 434549 - RNA, 22 nt, Human
gucuggcuguccagcuuaucua

SEQ ID NO: 434550 - RNA, 22 nt, Human
agcagcuuaucuuggagaggca

SEQ ID NO: 434551 - RNA, 22 nt, Human
ugccucugcugcuguggcauca

SEQ ID NO: 434552 - RNA, 22 nt, Human
caaggcccugcaaccugacuug

SEQ ID NO: 434553 - RNA, 22 nt, Human
ggcaccaggcugggcauaggcc

SEQ ID NO: 434554 - RNA, 22 nt, Human
acagcagcuggguucccaccau

SEQ ID NO: 434555 - RNA, 22 nt, Human
acaugcauaaacuacuucuuau

SEQ ID NO: 434556 - RNA, 22 nt, Human
gugcccugaugcaauugucuca

SEQ ID NO: 434557 - RNA, 22 nt, Human
uuacauauugucuauuguucaa

SEQ ID NO: 434558 - RNA, 22 nt, Human
uccuggaguugugcagugcaca

SEQ ID NO: 434559 - RNA, 22 nt, Human
acuaggaauucaaguagacaga

SEQ ID NO: 434560 - RNA, 22 nt, Human
cugaguccuugggcuuagagug

SEQ ID NO: 434561 - RNA, 22 nt, Human
cugagggcaccgacagagugga

SEQ ID NO: 434562 - RNA, 22 nt, Human
ucagagaaguaagguggggugc

SEQ ID NO: 434563 - RNA, 22 nt, Human
ugcaacaguggggcaugcugaa

SEQ ID NO: 434564 - RNA, 22 nt, Human
ugcagcuggauuuaucuuuucc

SEQ ID NO: 434565 - RNA, 22 nt, Human
gagaaagcuaaauaaguugauu

SEQ ID NO: 434566 - RNA, 22 nt, Human
ugaacauuaguugaguaaaguc

SEQ ID NO: 434567 - RNA, 22 nt, Human
cugugagggcagggaccagagg

SEQ ID NO: 434568 - RNA, 22 nt, Human
gcagaggacacaggagggcaag

SEQ ID NO: 434569 - RNA, 22 nt, Human
ccacaucugguggccagugcua

SEQ ID NO: 434570 - RNA, 22 nt, Human
cagaggccccagaacuagcucu

SEQ ID NO: 434571 - RNA, 22 nt, Human
uuccugggcuuuccccucuggu

SEQ ID NO: 434572 - RNA, 22 nt, Human
gccucugggcucugccccuggc

SEQ ID NO: 434573 - RNA, 22 nt, Human
cauccaaacucucauuaucugu

SEQ ID NO: 434574 - RNA, 22 nt, Human
aaggaagaagacucuuuacucc

SEQ ID NO: 434575 - RNA, 22 nt, Human
caggagcuacucagguuggguu

SEQ ID NO: 434576 - RNA, 22 nt, Human
uuugugugcuugguauugaaga

SEQ ID NO: 434577 - RNA, 22 nt, Human
uccugccugcaaucccagcacu

SEQ ID NO: 434578 - RNA, 21 nt, Human
ucccacucuaaauggacugaa

SEQ ID NO: 434579 - RNA, 22 nt, Human
uuuccuugccuccuguccuucu

SEQ ID NO: 434580 - RNA, 22 nt, Human
accaguccgcggagcuccgggg

SEQ ID NO: 434581 - RNA, 22 nt, Human
cugcuuccaugcaauggcaguc

SEQ ID NO: 434582 - RNA, 18 nt, Human
uuguuuuaagacucuguc

SEQ ID NO: 434583 - RNA, 22 nt, Human
ucaggccucaagcugcuuuaag

SEQ ID NO: 434584 - RNA, 22 nt, Human
gcaggccucuaauucaccgcag

SEQ ID NO: 434585 - RNA, 22 nt, Human
cugcugcugagagcucagccug

SEQ ID NO: 434586 - RNA, 22 nt, Human
caguacucuuauuugaaauaug

SEQ ID NO: 434587 - RNA, 17 nt, Human
agcaccuguccaguccc

SEQ ID NO: 434588 - RNA, 22 nt, Human
acauuuuacaccaagacuucuu

SEQ ID NO: 434589 - RNA, 19 nt, Human
agggccugcagcucaagcu

SEQ ID NO: 434590 - RNA, 22 nt, Human
uuccugaaugcuguugugcugu

SEQ ID NO: 434591 - RNA, 22 nt, Human
acuuagcagguacuuucauauu

SEQ ID NO: 434592 - RNA, 22 nt, Human
caggaagcugagcugcacugca

SEQ ID NO: 434593 - RNA, 22 nt, Human
cugacugugagagcaggaaugg

SEQ ID NO: 434594 - RNA, 22 nt, Human
ccugucagcugauggcuaugua

SEQ ID NO: 434595 - RNA, 22 nt, Human
cugggcacuugcucacagcucu

SEQ ID NO: 434596 - RNA, 22 nt, Human
gcucccagggaccgcagggcag

SEQ ID NO: 434597 - RNA, 22 nt, Human
aagcccagcaucccugcaccag

SEQ ID NO: 434598 - RNA, 22 nt, Human
uccagccacucagcagggauug

SEQ ID NO: 434599 - RNA, 22 nt, Human
caguggcagagaacagagaccu

SEQ ID NO: 434600 - RNA, 22 nt, Human
uucucugcuacauacuagggcu

SEQ ID NO: 434601 - RNA, 22 nt, Human
agacccugucaguguuaggaaa

SEQ ID NO: 434602 - RNA, 22 nt, Human
ggccacagaacagcuacaggac

SEQ ID NO: 434603 - RNA, 22 nt, Human
cccaggaggucgaagcugcagu

SEQ ID NO: 434604 - RNA, 22 nt, Human
cccagaaggucgaggcugcagu

SEQ ID NO: 434605 - RNA, 22 nt, Human
ugucaccaugccagcuucugcc

SEQ ID NO: 434606 - RNA, 22 nt, Human
cccugggcucagagcagguagc

SEQ ID NO: 434607 - RNA, 22 nt, Human
cagaaagccgacuuacaaugga

SEQ ID NO: 434608 - RNA, 22 nt, Human
aaaaaguuucaacugccaacuc

SEQ ID NO: 434609 - RNA, 21 nt, Human
ugccuuggcaaaugaccauga

SEQ ID NO: 434610 - RNA, 22 nt, Human
cugcccugcucuccgggaucuu

SEQ ID NO: 434611 - RNA, 22 nt, Human
uccagcagguuggucaggugca

SEQ ID NO: 434612 - RNA, 22 nt, Human
gcuguccaugucuggccucagu

SEQ ID NO: 434613 - RNA, 22 nt, Human
agcaggcuuuccacagaaggag

SEQ ID NO: 434614 - RNA, 22 nt, Human
acccagagugucugucucaguc

SEQ ID NO: 434615 - RNA, 22 nt, Human
ucaguacuucccauucugagcu

SEQ ID NO: 434616 - RNA, 22 nt, Human
cccagagaucuuguccuuucca

SEQ ID NO: 434617 - RNA, 22 nt, Human
gacuuuauuuccuuauuuguga

SEQ ID NO: 434618 - RNA, 22 nt, Human
ggcucccugccuguccucaguc

SEQ ID NO: 434619 - RNA, 20 nt, Human
gcugccuguuucuguaagua

SEQ ID NO: 434620 - RNA, 22 nt, Human
aggccagcugccacccgguccg

SEQ ID NO: 434621 - RNA, 22 nt, Human
ucacaguacugugacuauugac

SEQ ID NO: 434622 - RNA, 22 nt, Human
gcacagcccugagcgcaugucu

SEQ ID NO: 434623 - RNA, 22 nt, Human
ggcagcaaaaagccugguugaa

SEQ ID NO: 434624 - RNA, 22 nt, Human
aguggcaguaacauuccacaau

SEQ ID NO: 434625 - RNA, 22 nt, Human
aagggagcggggagacccuaug

SEQ ID NO: 434626 - RNA, 22 nt, Human
ugcaggcagcuaaaccauguaa

SEQ ID NO: 434627 - RNA, 22 nt, Human
uccaccauguaacaagcucugu

SEQ ID NO: 434628 - RNA, 22 nt, Human
gcuuccaguaaguugcugccau

SEQ ID NO: 434629 - RNA, 21 nt, Human
aggaguugcuguggccugguu

SEQ ID NO: 434630 - RNA, 22 nt, Human
uacaguuccucucguggaggug

SEQ ID NO: 434631 - RNA, 22 nt, Human
ucuuugcagaacgaugaagaug

SEQ ID NO: 434632 - RNA, 22 nt, Human
cagcagcugcgugcccaggccg

SEQ ID NO: 434633 - RNA, 22 nt, Human
gagggaguaacguacuacagug

SEQ ID NO: 434634 - RNA, 22 nt, Human
uuugggcagugggcuuagcggc

SEQ ID NO: 434635 - RNA, 22 nt, Human
gccuuccaggcagggggagcag

SEQ ID NO: 434636 - RNA, 22 nt, Human
cacaggaggaggccagagcgua

SEQ ID NO: 434637 - RNA, 22 nt, Human
aaggcagccauagcaccaucca

SEQ ID NO: 434638 - RNA, 22 nt, Human
aagcaaauucuggaggugaggu

SEQ ID NO: 434639 - RNA, 22 nt, Human
ucaugcaggacuuacgagagau

SEQ ID NO: 434640 - RNA, 19 nt, Human
ucagucuaggaaugagcua

SEQ ID NO: 434641 - RNA, 22 nt, Human
aagcccuggauagagagaacug

SEQ ID NO: 434642 - RNA, 23 nt, Human
gacagagugagaccuugucuuac

SEQ ID NO: 434643 - RNA, 18 nt, Human
cagcugccagcucaugga

SEQ ID NO: 434644 - RNA, 22 nt, Human
ggccuuccuggcggcucagggu

SEQ ID NO: 434645 - RNA, 22 nt, Human
ggcagagguagcuggaaccagg

SEQ ID NO: 434646 - RNA, 22 nt, Human
aaauucaauuaacuuucaugcu

SEQ ID NO: 434647 - RNA, 19 nt, Human
ccagccucucuuccacccc

SEQ ID NO: 434648 - RNA, 22 nt, Human
gggaagcagaucauaccagacc

SEQ ID NO: 434649 - RNA, 22 nt, Human
acaccagggccuagccagggcg

SEQ ID NO: 434650 - RNA, 22 nt, Human
cagaggucaagaucugaaguga

SEQ ID NO: 434651 - RNA, 22 nt, Human
ucucaaauucccuuuuccuccu

SEQ ID NO: 434652 - RNA, 22 nt, Human
ugugccaggcacuugcccaggc

SEQ ID NO: 434653 - RNA, 22 nt, Human
guuugcagggagagauguggug

SEQ ID NO: 434654 - RNA, 22 nt, Human
auggauuggauuuuuauggacc

SEQ ID NO: 434655 - RNA, 23 nt, Human
agcaaugcugggagacucuguaa

SEQ ID NO: 434656 - RNA, 22 nt, Human
ugcaggcauaaccgauguugau

SEQ ID NO: 434657 - RNA, 22 nt, Human
agcuccuggucuuuguccagag

SEQ ID NO: 434658 - RNA, 22 nt, Human
gcaaacauuuggucuagugugu

SEQ ID NO: 434659 - RNA, 22 nt, Human
cucccagagaccaagcugagaa

SEQ ID NO: 434660 - RNA, 22 nt, Human
auucagaauugugggcaguaca

SEQ ID NO: 434661 - RNA, 22 nt, Human
aggagcugaaacuucucauaug

SEQ ID NO: 434662 - RNA, 22 nt, Human
cugacccuagcaucucugugca

SEQ ID NO: 434663 - RNA, 22 nt, Human
ucaaaucucacucugcauuucu

SEQ ID NO: 434664 - RNA, 22 nt, Human
agaaaaguuuucugagacugac

SEQ ID NO: 434665 - RNA, 18 nt, Human
ggcagccuggacaugcuc

SEQ ID NO: 434666 - RNA, 22 nt, Human
aacacugaguaucagaguuggg

SEQ ID NO: 434667 - RNA, 22 nt, Human
ccagaggagaugccuccucugu

SEQ ID NO: 434668 - RNA, 22 nt, Human
aggacccacgcacaggaacccc

SEQ ID NO: 434669 - RNA, 22 nt, Human
ccuggcugguggcagcgacaag

SEQ ID NO: 434670 - RNA, 22 nt, Human
uuaaaugacuuuuauuauucuc

SEQ ID NO: 434671 - RNA, 21 nt, Human
gaacauuuggguuguuucuac

SEQ ID NO: 434672 - RNA, 22 nt, Human
ccucaggcccugucccugcgcc

SEQ ID NO: 434673 - RNA, 22 nt, Human
ccaggcaggcgauggugcagug

SEQ ID NO: 434674 - RNA, 22 nt, Human
gaacauuuggcaugagaauuug

SEQ ID NO: 434675 - RNA, 22 nt, Human
acaaguucugggaauuaggaca

SEQ ID NO: 434676 - RNA, 22 nt, Human
uccuggguggugguaggagcag

SEQ ID NO: 434677 - RNA, 22 nt, Human
ccuuagcaaauuggcaucuucu

SEQ ID NO: 434678 - RNA, 22 nt, Human
caguacuuuucaaccaguauga

SEQ ID NO: 434679 - RNA, 22 nt, Human
cagaguuucgguaagcauagaa

SEQ ID NO: 434680 - RNA, 23 nt, Human
ugucacauuuaguuggcauuguu

SEQ ID NO: 434681 - RNA, 22 nt, Human
cuggcuccaucacugggugaug

SEQ ID NO: 434682 - RNA, 23 nt, Human
uggccagcagaagcaaggggagc

SEQ ID NO: 434683 - RNA, 22 nt, Human
uccuggacuggcucagcacccu

SEQ ID NO: 434684 - RNA, 21 nt, Human
uuuacugagcacuuacuaugu

SEQ ID NO: 434685 - RNA, 22 nt, Human
gcaggagcucguuuccaggcug

SEQ ID NO: 434686 - RNA, 23 nt, Human
ggagccuggcauaugagacgcau

SEQ ID NO: 434687 - RNA, 22 nt, Human
uuuuucuuaaauguggguuggc

SEQ ID NO: 434688 - RNA, 22 nt, Human
uggcacugccaaccugcuaggu

SEQ ID NO: 434689 - RNA, 22 nt, Human
caggcuuggcagggaggcuggu

SEQ ID NO: 434690 - RNA, 22 nt, Human
uuggccagguguaggucacacc

SEQ ID NO: 434691 - RNA, 22 nt, Human
uuuauucacuggggucugcccg

SEQ ID NO: 434692 - RNA, 22 nt, Human
auugcuuuuaagcaccaccuaa

SEQ ID NO: 434693 - RNA, 22 nt, Human
aauaucuucuaaggauagaacu

SEQ ID NO: 434694 - RNA, 22 nt, Human
cacagaguggaggcuuggccug

SEQ ID NO: 434695 - RNA, 22 nt, Human
aacugcauguguguggcaugau

SEQ ID NO: 434696 - RNA, 22 nt, Human
cuggcucccucucccugaguca

SEQ ID NO: 434697 - RNA, 22 nt, Human
auucagaagcuauucuuaguuc

SEQ ID NO: 434698 - RNA, 22 nt, Human
uagagcugauaaugaggccaag

SEQ ID NO: 434699 - RNA, 19 nt, Human
aaggcuggagaaggccucu

SEQ ID NO: 434700 - RNA, 22 nt, Human
cagagcagguaucuuuggugaa

SEQ ID NO: 434701 - RNA, 22 nt, Human
cagggagcaggcucuguccauc

SEQ ID NO: 434702 - RNA, 22 nt, Human
uucaugaagggugaauauaguc

SEQ ID NO: 434703 - RNA, 22 nt, Human
acagacagaggcuccaugagga

SEQ ID NO: 434704 - RNA, 20 nt, Human
ucauccaggacaggaguggc

SEQ ID NO: 434705 - RNA, 22 nt, Human
gagccagcuacauggucugcaa

SEQ ID NO: 434706 - RNA, 22 nt, Human
uggcagcacuagguacugagcu

SEQ ID NO: 434707 - RNA, 22 nt, Human
ucagaauuuuuguuacccuuga

SEQ ID NO: 434708 - RNA, 22 nt, Human
caggcacaagaucggcuagaua

SEQ ID NO: 434709 - RNA, 22 nt, Human
cuggagcucuccagagccccgu

SEQ ID NO: 434710 - RNA, 22 nt, Human
uggacucaaguccaaguucacg

SEQ ID NO: 434711 - RNA, 22 nt, Human
agauucaguuaaggcugguaga

SEQ ID NO: 434712 - RNA, 22 nt, Human
acuuuguugaagaauauguuag

SEQ ID NO: 434713 - RNA, 22 nt, Human
gggccuguaugggucucagaua

SEQ ID NO: 434714 - RNA, 22 nt, Human
aauuuuacaagaaggccucgua

SEQ ID NO: 434715 - RNA, 22 nt, Human
uuguuucaaauauuucagaaua

SEQ ID NO: 434716 - RNA, 22 nt, Human
aguucacaauagaagagguggc

SEQ ID NO: 434717 - RNA, 22 nt, Human
gccaggcauguccucugcagaa

SEQ ID NO: 434718 - RNA, 22 nt, Human
aagagcugcccaaggugaacag

SEQ ID NO: 434719 - RNA, 22 nt, Human
cugcauuacuaacaaacuccca

SEQ ID NO: 434720 - RNA, 18 nt, Human
ggugagggagcuggaagc

SEQ ID NO: 434721 - RNA, 22 nt, Human
agcagcuguggaaaaguaacua

SEQ ID NO: 434722 - RNA, 17 nt, Human
caggcacaugaagccag

SEQ ID NO: 434723 - RNA, 16 nt, Human
ccacaguaagaaauac

SEQ ID NO: 434724 - RNA, 22 nt, Human
cugccucugguuuuggucccug

SEQ ID NO: 434725 - RNA, 19 nt, Human
ugggcagguucaguaaugg

SEQ ID NO: 434726 - RNA, 22 nt, Human
aggggcacuagaaugggagacu

SEQ ID NO: 434727 - RNA, 22 nt, Human
agcaccuguguucaugccucau

SEQ ID NO: 434728 - RNA, 22 nt, Human
ugcagcugaccagcaaguccug

SEQ ID NO: 434729 - RNA, 22 nt, Human
uuuuccucuguauuugaaaugc

SEQ ID NO: 434730 - RNA, 23 nt, Human
uguaaauuuuguagucacauuuu

SEQ ID NO: 434731 - RNA, 22 nt, Human
agcuguuuuuccagucucugga

SEQ ID NO: 434732 - RNA, 22 nt, Human
cucugagcagaggccguggcua

SEQ ID NO: 434733 - RNA, 22 nt, Human
ugagaggagugauuguaaaauu

SEQ ID NO: 434734 - RNA, 22 nt, Human
uggccuggaaaaaugcagaugg

SEQ ID NO: 434735 - RNA, 22 nt, Human
acugccaaugguaguuugaugg

SEQ ID NO: 434736 - RNA, 19 nt, Human
cagaccuguccagccugug

SEQ ID NO: 434737 - RNA, 22 nt, Human
ugagaaucagcugcacagaggu

SEQ ID NO: 434738 - RNA, 22 nt, Human
ggagacagugguagggccuaag

SEQ ID NO: 434739 - RNA, 22 nt, Human
gcucagggcgcgagggacgugg

SEQ ID NO: 434740 - RNA, 21 nt, Human
uuuaucaucacgagcuugagc

SEQ ID NO: 434741 - RNA, 22 nt, Human
cugaggcuucucuaguucagcu

SEQ ID NO: 434742 - RNA, 22 nt, Human
aggccucugagcagcacucaug

SEQ ID NO: 434743 - RNA, 20 nt, Human
cagcugccuggcucugggau

SEQ ID NO: 434744 - RNA, 22 nt, Human
gcuggcuguuggagguaccugc

SEQ ID NO: 434745 - RNA, 22 nt, Human
cugcauuauuggaacggcugaa

SEQ ID NO: 434746 - RNA, 22 nt, Human
cagauauguggauucuauuagc

SEQ ID NO: 434747 - RNA, 22 nt, Human
auauucuugugauuauaaagua

SEQ ID NO: 434748 - RNA, 22 nt, Human
uuuaguguagccuaagcagaau

SEQ ID NO: 434749 - RNA, 22 nt, Human
ggagggugcauuuuacccugug

SEQ ID NO: 434750 - RNA, 22 nt, Human
acaggcugcccgcuccccaccu

SEQ ID NO: 434751 - RNA, 22 nt, Human
ccugggucuguauugguaggua

SEQ ID NO: 434752 - RNA, 22 nt, Human
aaggcacuugcccagagcugca

SEQ ID NO: 434753 - RNA, 22 nt, Human
gaugaugaggccaugaggcagg

SEQ ID NO: 434754 - RNA, 22 nt, Human
uuauuuaauuuucucacucaga

SEQ ID NO: 434755 - RNA, 22 nt, Human
ccagcucucagcgggagacuca

SEQ ID NO: 434756 - RNA, 22 nt, Human
gaggaaagaaccccagucaaua

SEQ ID NO: 434757 - RNA, 22 nt, Human
auuagcaaucacgcagucauuu

SEQ ID NO: 434758 - RNA, 22 nt, Human
ugcagcugggacauuuuugaua

SEQ ID NO: 434759 - RNA, 22 nt, Human
ccaggaagcucugcuccacggg

SEQ ID NO: 434760 - RNA, 22 nt, Human
cugcccugggauggucugugcg

SEQ ID NO: 434761 - RNA, 22 nt, Human
ucacagugaggcaguucuugua

SEQ ID NO: 434762 - RNA, 22 nt, Human
cugccagcacugccuccugagg

SEQ ID NO: 434763 - RNA, 22 nt, Human
uucaacuuuaugcauauguauu

SEQ ID NO: 434764 - RNA, 22 nt, Human
ucccagccugacagugcaucaa

SEQ ID NO: 434765 - RNA, 22 nt, Human
gccaggaguucagaugcauguu

SEQ ID NO: 434766 - RNA, 21 nt, Human
ucugagaacuucugcugcagc

SEQ ID NO: 434767 - RNA, 17 nt, Human
agcaggcugcagaggcc

SEQ ID NO: 434768 - RNA, 22 nt, Human
ucucuuccccuuuccuuuaaca

SEQ ID NO: 434769 - RNA, 22 nt, Human
auuuuccuccaugugagcaguu

SEQ ID NO: 434770 - RNA, 22 nt, Human
caggggaguuuuaugcaacaga

SEQ ID NO: 434771 - RNA, 22 nt, Human
uucacauaaauagaucacauca

SEQ ID NO: 434772 - RNA, 22 nt, Human
ccaggagcaaagaucacuggga

SEQ ID NO: 434773 - RNA, 22 nt, Human
gcuuagcaucuuacaaugcuga

SEQ ID NO: 434774 - RNA, 22 nt, Human
cucagagcugaggccagggaca

SEQ ID NO: 434775 - RNA, 22 nt, Human
cacugaguucccugacauuuca

SEQ ID NO: 434776 - RNA, 22 nt, Human
acaauucacuccagugacccca

SEQ ID NO: 434777 - RNA, 22 nt, Human
uagugaauuccuaauaggaaga

SEQ ID NO: 434778 - RNA, 23 nt, Human
uauuagcaauucccacagagcag

SEQ ID NO: 434779 - RNA, 22 nt, Human
ccaggcugugguuuagauagag

SEQ ID NO: 434780 - RNA, 18 nt, Human
cacauuuaccuggcuccc

SEQ ID NO: 434781 - RNA, 22 nt, Human
cuugucagccaauuguggauuu

SEQ ID NO: 434782 - RNA, 22 nt, Human
acccacaccuccguauaucacu

SEQ ID NO: 434783 - RNA, 22 nt, Human
agagggcaaguguaguccagua

SEQ ID NO: 434784 - RNA, 22 nt, Human
ccagggcaucacauccaguguu

SEQ ID NO: 434785 - RNA, 22 nt, Human
uacuauuuggaauuuuaaauug

SEQ ID NO: 434786 - RNA, 22 nt, Human
ugaagguggcauaggagagaug

SEQ ID NO: 434787 - RNA, 22 nt, Human
caggcccucgcccgcagcgacc

SEQ ID NO: 434788 - RNA, 22 nt, Human
uuauuuaaaagugguaagauuc

SEQ ID NO: 434789 - RNA, 22 nt, Human
uccucuggaaccucacccuugc

SEQ ID NO: 434790 - RNA, 21 nt, Human
ccagcuccaggaccuuggauc

SEQ ID NO: 434791 - RNA, 21 nt, Human
aaggagccuaggaggcucagg

SEQ ID NO: 434792 - RNA, 22 nt, Human
agacaauauauaauuuuaguug

SEQ ID NO: 434793 - RNA, 22 nt, Human
uuucuauaacuggacuggauug

SEQ ID NO: 434794 - RNA, 16 nt, Human
gagaagagcccggcag

SEQ ID NO: 434795 - RNA, 22 nt, Human
cagcaggcuggacuucaguccc

SEQ ID NO: 434796 - RNA, 22 nt, Human
cauggccuugagugacugcacu

SEQ ID NO: 434797 - RNA, 22 nt, Human
uuuauccacaguauccaaaauc

SEQ ID NO: 434798 - RNA, 22 nt, Human
aacaacaacggagaaaggguug

SEQ ID NO: 434799 - RNA, 22 nt, Human
ucucagagggaggauuacugcc

SEQ ID NO: 434800 - RNA, 22 nt, Human
augauuuucugauaaagaacug

SEQ ID NO: 434801 - RNA, 20 nt, Human
ugcacagcugugaauaggau

SEQ ID NO: 434802 - RNA, 22 nt, Human
augguggacucuugauucaggc

SEQ ID NO: 434803 - RNA, 22 nt, Human
uuucaaauggagucgugaaaug

SEQ ID NO: 434804 - RNA, 22 nt, Human
ucagaauuggacaauagaagca

SEQ ID NO: 434805 - RNA, 23 nt, Human
gcaggacaacagagugggaaggc

SEQ ID NO: 434806 - RNA, 22 nt, Human
gugcagugagcagugcagcacc

SEQ ID NO: 434807 - RNA, 22 nt, Human
agucugggcugucugcaggagu

SEQ ID NO: 434808 - RNA, 22 nt, Human
ucaggaaagccuagaagagaac

SEQ ID NO: 434809 - RNA, 22 nt, Human
gagacagagagguacucaacau

SEQ ID NO: 434810 - RNA, 22 nt, Human
ggcagccuccagggcacuggug

SEQ ID NO: 434811 - RNA, 22 nt, Human
agcagggggaguuagacuagau

SEQ ID NO: 434812 - RNA, 22 nt, Human
aaggcuggaccuggaugaaucu

SEQ ID NO: 434813 - RNA, 20 nt, Human
acuuucucgguuucucaccu

SEQ ID NO: 434814 - RNA, 22 nt, Human
ucucuuccaguggcuuugauuu

SEQ ID NO: 434815 - RNA, 22 nt, Human
ugaagcuagucaagcuuagaua

SEQ ID NO: 434816 - RNA, 22 nt, Human
ggcugugccucaaggcuacuca

SEQ ID NO: 434817 - RNA, 22 nt, Human
auugaaaaugacauuugugccc

SEQ ID NO: 434818 - RNA, 22 nt, Human
uuuuauugcaauaaagugugua

SEQ ID NO: 434819 - RNA, 22 nt, Human
cugagcugggcucucuugaggg

SEQ ID NO: 434820 - RNA, 22 nt, Human
cagagugauggcaccugcuggg

SEQ ID NO: 434821 - RNA, 22 nt, Human
gcacagagagucccgggugccc

SEQ ID NO: 434822 - RNA, 22 nt, Human
aaauguuccggguaaggagaaa

SEQ ID NO: 434823 - RNA, 22 nt, Human
cuauugaggacauaaggacucu

SEQ ID NO: 434824 - RNA, 22 nt, Human
gguuaaaaauaauuuacuuggc

SEQ ID NO: 434825 - RNA, 22 nt, Human
auuuucucacaaugcagaagga

SEQ ID NO: 434826 - RNA, 22 nt, Human
agguuugguuugacaagacuga

SEQ ID NO: 434827 - RNA, 22 nt, Human
ccagacaggggcuguuccugcu

SEQ ID NO: 434828 - RNA, 20 nt, Human
augcccuguccucuucuguu

SEQ ID NO: 434829 - RNA, 22 nt, Human
uggcucugucacugugagcuau

SEQ ID NO: 434830 - RNA, 22 nt, Human
cucaggccugaguggcaguccc

SEQ ID NO: 434831 - RNA, 22 nt, Human
uggcuccuaucaaggagugggu

SEQ ID NO: 434832 - RNA, 21 nt, Human
acauguacacauguaugcaca

SEQ ID NO: 434833 - RNA, 22 nt, Human
auuguuaugaaaauaagauguu

SEQ ID NO: 434834 - RNA, 22 nt, Human
gcugcccucccagggcaagcuu

SEQ ID NO: 434835 - RNA, 22 nt, Human
ugaucccuggacuugaguaagu

SEQ ID NO: 434836 - RNA, 17 nt, Human
agccugggaaggaguga

SEQ ID NO: 434837 - RNA, 22 nt, Human
aggccagguggucaugcuugcu

SEQ ID NO: 434838 - RNA, 22 nt, Human
gcagcuguucagcuggccagau

SEQ ID NO: 434839 - RNA, 22 nt, Human
agcacacaggacuugauucaug

SEQ ID NO: 434840 - RNA, 22 nt, Human
cccuugagccuggaggagcucu

SEQ ID NO: 434841 - RNA, 22 nt, Human
ugcagccauuuucugccaaugc

SEQ ID NO: 434842 - RNA, 22 nt, Human
ggggcccagggcagcagugcag

SEQ ID NO: 434843 - RNA, 22 nt, Human
gagcccaggcagagguugcagu

SEQ ID NO: 434844 - RNA, 22 nt, Human
gguguccaucaggcugugcuuc

SEQ ID NO: 434845 - RNA, 22 nt, Human
ccuggaaacacaugaugaugaa

SEQ ID NO: 434846 - RNA, 22 nt, Human
uugcuuuguuacugcaguuucc

SEQ ID NO: 434847 - RNA, 22 nt, Human
ucagaguucucuguccagauga

SEQ ID NO: 434848 - RNA, 22 nt, Human
gaagaagccucuguggaucuga

SEQ ID NO: 434849 - RNA, 22 nt, Human
cagcacuaggauauacauuucc

SEQ ID NO: 434850 - RNA, 22 nt, Human
gggcauggugaugugcaccugu

SEQ ID NO: 434851 - RNA, 22 nt, Human
ccaguuaaucacugaguccugu

SEQ ID NO: 434852 - RNA, 22 nt, Human
uccucagaaaccccugugaggu

SEQ ID NO: 434853 - RNA, 22 nt, Human
ucaggaagcuacugccagcagc

SEQ ID NO: 434854 - RNA, 22 nt, Human
gagcugagggucuaggaggguu

SEQ ID NO: 434855 - RNA, 22 nt, Human
ucuaaaugugguagucauaaga

SEQ ID NO: 434856 - RNA, 22 nt, Human
cacuggaagagcaucugagcca

SEQ ID NO: 434857 - RNA, 22 nt, Human
gaaggaaaggucucaugccuuu

SEQ ID NO: 434858 - RNA, 22 nt, Human
ugacaaauucauauuucagagg

SEQ ID NO: 434859 - RNA, 22 nt, Human
agccaggcuacuccuugcugac

SEQ ID NO: 434860 - RNA, 22 nt, Human
gacagaguuguugauguaugcu

SEQ ID NO: 434861 - RNA, 22 nt, Human
cagcugccagcuucucuccauc

SEQ ID NO: 434862 - RNA, 22 nt, Human
cacaauuuccuugcuucacuuu

SEQ ID NO: 434863 - RNA, 20 nt, Human
agccagaagaaggcuggaga

SEQ ID NO: 434864 - RNA, 22 nt, Human
guguggcugauugacaugguca

SEQ ID NO: 434865 - RNA, 22 nt, Human
ugggccucggagcacaggagac

SEQ ID NO: 434866 - RNA, 22 nt, Human
ggacaggaugcugaagaugaag

SEQ ID NO: 434867 - RNA, 22 nt, Human
cagugcugcaggcgccugcggu

SEQ ID NO: 434868 - RNA, 21 nt, Human
agcagacagcccaagaaaauc

SEQ ID NO: 434869 - RNA, 22 nt, Human
ugcugccagggcucugcccaca

SEQ ID NO: 434870 - RNA, 22 nt, Human
aagacauuguggagauguugcu

SEQ ID NO: 434871 - RNA, 22 nt, Human
ugcucaguagcagugugcugcu

SEQ ID NO: 434872 - RNA, 22 nt, Human
ugcuuuaaccaucuuguuugga

SEQ ID NO: 434873 - RNA, 22 nt, Human
ucacaaaugucuccuguccugu

SEQ ID NO: 434874 - RNA, 22 nt, Human
cagaagcaaaugccuugcugag

SEQ ID NO: 434875 - RNA, 22 nt, Human
uagcaggguccaaugugaggca

SEQ ID NO: 434876 - RNA, 22 nt, Human
ugcagcugagucacccagccau

SEQ ID NO: 434877 - RNA, 22 nt, Human
cuguguguuuauaucauuuccu

SEQ ID NO: 434878 - RNA, 22 nt, Human
uuacaagauaaccugaugcugu

SEQ ID NO: 434879 - RNA, 22 nt, Human
gagcaggcaacucugcagugcc

SEQ ID NO: 434880 - RNA, 22 nt, Human
aauucauagcaacaaagaccca

SEQ ID NO: 434881 - RNA, 22 nt, Human
uuacaaacugucauauaguauu

SEQ ID NO: 434882 - RNA, 22 nt, Human
gcugugcuauaucucugagugu

SEQ ID NO: 434883 - RNA, 22 nt, Human
ugcuuucaugaagucuauagag

SEQ ID NO: 434884 - RNA, 22 nt, Human
agccagcacggauuucccagga

SEQ ID NO: 434885 - RNA, 20 nt, Human
gacaggagaguuagguaggu

SEQ ID NO: 434886 - RNA, 22 nt, Human
ugcauauuuucugauucagaag

SEQ ID NO: 434887 - RNA, 15 nt, Human
ugggcagaucacuug

SEQ ID NO: 434888 - RNA, 22 nt, Human
gagagguguguuucagauaaga

SEQ ID NO: 434889 - RNA, 22 nt, Human
auuaaauguuccuuaaauuaua

SEQ ID NO: 434890 - RNA, 22 nt, Human
ccagaccacccuggccaugcac

SEQ ID NO: 434891 - RNA, 22 nt, Human
gagagcugcagccgagaggggg

SEQ ID NO: 434892 - RNA, 22 nt, Human
gaagaacacuucaugauucauu

SEQ ID NO: 434893 - RNA, 22 nt, Human
aggaaaugcugaugcuccugga

SEQ ID NO: 434894 - RNA, 22 nt, Human
ccucuugccaaucagcuacaga

SEQ ID NO: 434895 - RNA, 22 nt, Human
acccucugccuugagcagugcc

SEQ ID NO: 434896 - RNA, 22 nt, Human
uuuucauuguaaaucaggaaac

SEQ ID NO: 434897 - RNA, 18 nt, Human
ugacagaaccuggagccu

SEQ ID NO: 434898 - RNA, 22 nt, Human
gggaucugaugcacugcugaaa

SEQ ID NO: 434899 - RNA, 19 nt, Human
ggccaggcugacugugguc

SEQ ID NO: 434900 - RNA, 22 nt, Human
uggcauguggcagcugguucag

SEQ ID NO: 434901 - RNA, 22 nt, Human
uguaccaucucagcauucagga

SEQ ID NO: 434902 - RNA, 22 nt, Human
uuauacaggagauuccuuacuu

SEQ ID NO: 434903 - RNA, 21 nt, Human
gaagagaguccucauccugag

SEQ ID NO: 434904 - RNA, 22 nt, Human
agcaacagguuuauuaucuuau

SEQ ID NO: 434905 - RNA, 20 nt, Human
aggcaacucaaguuuuugcc

SEQ ID NO: 434906 - RNA, 22 nt, Human
uagcugccaaaagggugggcua

SEQ ID NO: 434907 - RNA, 22 nt, Human
gugacagucaaagacaugacuu

SEQ ID NO: 434908 - RNA, 19 nt, Human
gcagcaaacaaaacaggua

SEQ ID NO: 434909 - RNA, 22 nt, Human
cagcccuuccuucuguuuauac

SEQ ID NO: 434910 - RNA, 21 nt, Human
ugcaauuuagacuugaacauu

SEQ ID NO: 434911 - RNA, 22 nt, Human
ggggcagagucuggacuguugu

SEQ ID NO: 434912 - RNA, 22 nt, Human
uggauugauaaaaugggauguu

SEQ ID NO: 434913 - RNA, 22 nt, Human
aaugagggggaugggaaagugu

SEQ ID NO: 434914 - RNA, 22 nt, Human
uauuuaauuagugauuguagag

SEQ ID NO: 434915 - RNA, 22 nt, Human
gucaggacaagguggucuccag

SEQ ID NO: 434916 - RNA, 22 nt, Human
agcuguugucugcaggagaagc

SEQ ID NO: 434917 - RNA, 22 nt, Human
aggcagccaucugcaggaagga

SEQ ID NO: 434918 - RNA, 22 nt, Human
uauuaagagauguaugaagaga

SEQ ID NO: 434919 - RNA, 22 nt, Human
ccagcagccccucaaugaucug

SEQ ID NO: 434920 - RNA, 22 nt, Human
gcuguuccugcuuagaggucgg

SEQ ID NO: 434921 - RNA, 22 nt, Human
auucaauaagucacuguggaau

SEQ ID NO: 434922 - RNA, 22 nt, Human
uugaggcccggcaggccgagcg

SEQ ID NO: 434923 - RNA, 22 nt, Human
caggaggccaacugugggacuu

SEQ ID NO: 434924 - RNA, 22 nt, Human
caaagggcggcugucggagggu

SEQ ID NO: 434925 - RNA, 22 nt, Human
gcuauucaucaauuguucuagc

SEQ ID NO: 434926 - RNA, 22 nt, Human
ccuggccugugaaucugagagc

SEQ ID NO: 434927 - RNA, 22 nt, Human
agaugcugugucuguucccuug

SEQ ID NO: 434928 - RNA, 22 nt, Human
acuuagcaguuuagaauauguc

SEQ ID NO: 434929 - RNA, 22 nt, Human
uugauuuugccugaucugagag

SEQ ID NO: 434930 - RNA, 22 nt, Human
agcugcucucacuggacgccug

SEQ ID NO: 434931 - RNA, 22 nt, Human
ucagcaggcucugguugaccau

SEQ ID NO: 434932 - RNA, 22 nt, Human
cuguccugcccacccugcaggg

SEQ ID NO: 434933 - RNA, 22 nt, Human
gagaagcaaucgugacaucucc

SEQ ID NO: 434934 - RNA, 22 nt, Human
augcaguggcagcuccuggugu

SEQ ID NO: 434935 - RNA, 22 nt, Human
aacauucugguucuaaaaaccu

SEQ ID NO: 434936 - RNA, 22 nt, Human
ccaggcugcagucaaggggcau

SEQ ID NO: 434937 - RNA, 22 nt, Human
ucugccugcuaacuccugcacc

SEQ ID NO: 434938 - RNA, 22 nt, Human
gguugguaacucccugugcagu

SEQ ID NO: 434939 - RNA, 22 nt, Human
uucaaacucacacuagggagac

SEQ ID NO: 434940 - RNA, 22 nt, Human
ugggccaggcaugugaucagca

SEQ ID NO: 434941 - RNA, 22 nt, Human
cagcccuggccccagguggucu

SEQ ID NO: 434942 - RNA, 22 nt, Human
agaagcagcuuucaaggugauu

SEQ ID NO: 434943 - RNA, 22 nt, Human
ugcccaggaucuggcgaugcuc

SEQ ID NO: 434944 - RNA, 22 nt, Human
gcagcuggugcaaaugucacuc

SEQ ID NO: 434945 - RNA, 16 nt, Human
uuuuauugugacagcc

SEQ ID NO: 434946 - RNA, 22 nt, Human
uggcagcauguuauguaaggaa

SEQ ID NO: 434947 - RNA, 22 nt, Human
ucuggguguagggccuggcaac

SEQ ID NO: 434948 - RNA, 21 nt, Human
aggaaaggccagcacguaggg

SEQ ID NO: 434949 - RNA, 22 nt, Human
ggagccuuagacaucugauccu

SEQ ID NO: 434950 - RNA, 22 nt, Human
gaucugaaaaugcucuucuucu

SEQ ID NO: 434951 - RNA, 22 nt, Human
cagcuguugugcugggcaguua

SEQ ID NO: 434952 - RNA, 22 nt, Human
gcuccaggcagcauaguggaug

SEQ ID NO: 434953 - RNA, 22 nt, Human
cuguauaucaugguuuugcagu

SEQ ID NO: 434954 - RNA, 22 nt, Human
gaggcagcaaaauauaucauaa

SEQ ID NO: 434955 - RNA, 22 nt, Human
uaaggcauuauagagacagccu

SEQ ID NO: 434956 - RNA, 22 nt, Human
ugaagcuauugguaaggaagug

SEQ ID NO: 434957 - RNA, 22 nt, Human
agccuggccacucagggccuga

SEQ ID NO: 434958 - RNA, 22 nt, Human
ugcaggacuggggagcggaagg

SEQ ID NO: 434959 - RNA, 22 nt, Human
ggagaggguguggaaaguuauc

SEQ ID NO: 434960 - RNA, 22 nt, Human
cagcugaagaaagagugguuag

SEQ ID NO: 434961 - RNA, 22 nt, Human
guuccucaugaguaccccuuaa

SEQ ID NO: 434962 - RNA, 22 nt, Human
uaaguucauaagcuuauucuua

SEQ ID NO: 434963 - RNA, 22 nt, Human
cagcuguuucaguagcguuacu

SEQ ID NO: 434964 - RNA, 22 nt, Human
cugacuguugcuguugaugagg

SEQ ID NO: 434965 - RNA, 23 nt, Human
aacuuugccaggagacagcacag

SEQ ID NO: 434966 - RNA, 22 nt, Human
gauaaugugccgauaauuucua

SEQ ID NO: 434967 - RNA, 22 nt, Human
uuccugauaaugagauuuuccc

SEQ ID NO: 434968 - RNA, 22 nt, Human
uugcccugccucccugagguga

SEQ ID NO: 434969 - RNA, 22 nt, Human
guuccucagcccuuacuuagcc

SEQ ID NO: 434970 - RNA, 21 nt, Human
aggcaauaaaguuuugucuac

SEQ ID NO: 434971 - RNA, 22 nt, Human
ucauuuguucaucugcucuucu

SEQ ID NO: 434972 - RNA, 22 nt, Human
ggcaaaaacagcaaugacuuuu

SEQ ID NO: 434973 - RNA, 22 nt, Human
guuuuauaggcuguugcuauau

SEQ ID NO: 434974 - RNA, 22 nt, Human
cugccagcucgccacaaugaca

SEQ ID NO: 434975 - RNA, 22 nt, Human
aaacauuccauuucuauguaag

SEQ ID NO: 434976 - RNA, 22 nt, Human
cugugucccuugucccagagcc

SEQ ID NO: 434977 - RNA, 22 nt, Human
ccuggagcccaaggcagugaga

SEQ ID NO: 434978 - RNA, 22 nt, Human
agugggcagugcgcucggaugc

SEQ ID NO: 434979 - RNA, 22 nt, Human
uucccuggcucuucuacaucgu

SEQ ID NO: 434980 - RNA, 22 nt, Human
uauaggaaguauucaaagacug

SEQ ID NO: 434981 - RNA, 22 nt, Human
ccuggcagacagcacugaagcu

SEQ ID NO: 434982 - RNA, 22 nt, Human
acacuuugggcuggauaauuau

SEQ ID NO: 434983 - RNA, 22 nt, Human
ucacuuuggauuauguaauuuc

SEQ ID NO: 434984 - RNA, 22 nt, Human
agaagaauacuugauguucaug

SEQ ID NO: 434985 - RNA, 22 nt, Human
uggagugaaguaaagaggacaa

SEQ ID NO: 434986 - RNA, 19 nt, Human
ggacacagaaagcugcauu

SEQ ID NO: 434987 - RNA, 22 nt, Human
agagugggugaucucuguuguc

SEQ ID NO: 434988 - RNA, 22 nt, Human
auugacaacccugguaugagca

SEQ ID NO: 434989 - RNA, 22 nt, Human
uugcuugcagacuuagcaaauu

SEQ ID NO: 434990 - RNA, 21 nt, Human
gcaggaugcaucuuggugucu

SEQ ID NO: 434991 - RNA, 22 nt, Human
caggcuggacauuagauacaua

SEQ ID NO: 434992 - RNA, 22 nt, Human
ucucccaguccucugugcuuac

SEQ ID NO: 434993 - RNA, 22 nt, Human
gaggaggcuuccgggaggcacg

SEQ ID NO: 434994 - RNA, 22 nt, Human
gccuucugaucgcuggacugac

SEQ ID NO: 434995 - RNA, 22 nt, Human
ucagaggacaagcucccuggug

SEQ ID NO: 434996 - RNA, 22 nt, Human
caggcagccaggggaccugucc

SEQ ID NO: 434997 - RNA, 22 nt, Human
cugacaaaccacugcuccagcu

SEQ ID NO: 434998 - RNA, 22 nt, Human
ugaacccaggagguugcaguga

SEQ ID NO: 434999 - RNA, 22 nt, Human
ccuggugcuuaccagagcuuuu

SEQ ID NO: 435000 - RNA, 22 nt, Human
ugguacaagauguucuaacuga

SEQ ID NO: 435001 - RNA, 22 nt, Human
uaugcauauguguucauuggag

SEQ ID NO: 435002 - RNA, 22 nt, Human
uacaugaaccuuuaugugugau

SEQ ID NO: 435003 - RNA, 22 nt, Human
guaucuuuugguggaaaaauaa

SEQ ID NO: 435004 - RNA, 22 nt, Human
guggcagagggugagcuggacu

SEQ ID NO: 435005 - RNA, 22 nt, Human
ccuggagccccucuggccagcc

SEQ ID NO: 435006 - RNA, 22 nt, Human
agauuggagauggaagaaaagu

SEQ ID NO: 435007 - RNA, 22 nt, Human
cacaggaaucgucacuuagcgc

SEQ ID NO: 435008 - RNA, 22 nt, Human
ucuuagcaaauuuucuuugccu

SEQ ID NO: 435009 - RNA, 23 nt, Human
acagagacaaugguuucaucuug

SEQ ID NO: 435010 - RNA, 22 nt, Human
cagugccucuuaagugucaccc

SEQ ID NO: 435011 - RNA, 21 nt, Human
cuggacugaggagacagucgc

SEQ ID NO: 435012 - RNA, 22 nt, Human
cuauauucuggaauguccauuu

SEQ ID NO: 435013 - RNA, 22 nt, Human
gcaguacuuuaucacauggaau

SEQ ID NO: 435014 - RNA, 22 nt, Human
acaaaguuaacaguuggauagu

SEQ ID NO: 435015 - RNA, 22 nt, Human
gcuuacaggugaggcagcaaga

SEQ ID NO: 435016 - RNA, 22 nt, Human
uuggcucaccuggagccuguug

SEQ ID NO: 435017 - RNA, 22 nt, Human
cagagacacuuaacaggaaugg

SEQ ID NO: 435018 - RNA, 22 nt, Human
cugcuacaccggaauagugaca

SEQ ID NO: 435019 - RNA, 22 nt, Human
uccugaagcaguuagcaugagc

SEQ ID NO: 435020 - RNA, 22 nt, Human
aguggcagagccaggguuggga

SEQ ID NO: 435021 - RNA, 22 nt, Human
agguggcuguauucagcuguaa

SEQ ID NO: 435022 - RNA, 22 nt, Human
ugguaauuuauuuugagagauu

SEQ ID NO: 435023 - RNA, 23 nt, Human
ucacagagcauacugcauuuugc

SEQ ID NO: 435024 - RNA, 22 nt, Human
ugcuagggauauaguggcgagu

SEQ ID NO: 435025 - RNA, 22 nt, Human
ugugaggcuugaaguaauucca

SEQ ID NO: 435026 - RNA, 18 nt, Human
ugcaggcuguugaaacug

SEQ ID NO: 435027 - RNA, 22 nt, Human
aaaugcacaaagauuuugcacu

SEQ ID NO: 435028 - RNA, 22 nt, Human
ccccagcacuuggaguggggag

SEQ ID NO: 435029 - RNA, 21 nt, Human
gcagggacaaagcuucaggag

SEQ ID NO: 435030 - RNA, 22 nt, Human
ugaguggaguagugaaugcauu

SEQ ID NO: 435031 - RNA, 22 nt, Human
agaaggcaccguggccaauauu

SEQ ID NO: 435032 - RNA, 22 nt, Human
acuuugcacuaaguuacucauu

SEQ ID NO: 435033 - RNA, 20 nt, Human
uaucuaaaugcuuacauuac

SEQ ID NO: 435034 - RNA, 22 nt, Human
aucuuauuuaacacagcaaaac

SEQ ID NO: 435035 - RNA, 22 nt, Human
ugcccuguuaucuuggaagagu

SEQ ID NO: 435036 - RNA, 22 nt, Human
ucaugccaauuucugcauggcu

SEQ ID NO: 435037 - RNA, 22 nt, Human
ucaggccugagaaaaauccuuu

SEQ ID NO: 435038 - RNA, 20 nt, Human
uccucagaagacauuugggg

SEQ ID NO: 435039 - RNA, 22 nt, Human
uagcugucagcaaucaaguggu

SEQ ID NO: 435040 - RNA, 20 nt, Human
aauuauauaacuccaacauu

SEQ ID NO: 435041 - RNA, 22 nt, Human
agcagggacuacgugaaaguga

SEQ ID NO: 435042 - RNA, 22 nt, Human
ugcccagcgcccacauucuguc

SEQ ID NO: 435043 - RNA, 22 nt, Human
ggccuugggcuggcugcaguau

SEQ ID NO: 435044 - RNA, 22 nt, Human
aauuuacaggugcacucgccau

SEQ ID NO: 435045 - RNA, 23 nt, Human
uggcccugaaucuguccuggagg

SEQ ID NO: 435046 - RNA, 21 nt, Human
gcagagcuggaaccaggaccc

SEQ ID NO: 435047 - RNA, 22 nt, Human
acuuuguugaugaaauaguuuu

SEQ ID NO: 435048 - RNA, 22 nt, Human
aaggcagcaacuaauggaucuc

SEQ ID NO: 435049 - RNA, 22 nt, Human
ccucagaguuggaaucacauuu

SEQ ID NO: 435050 - RNA, 22 nt, Human
cuaaaggcucagcauucuuuuc

SEQ ID NO: 435051 - RNA, 22 nt, Human
uuuucuccccagagaccaucau

SEQ ID NO: 435052 - RNA, 22 nt, Human
caagagcugaggcuggagaggu

SEQ ID NO: 435053 - RNA, 22 nt, Human
ucaguacuugcauccucuccuu

SEQ ID NO: 435054 - RNA, 22 nt, Human
guggccugucagaagccguggg

SEQ ID NO: 435055 - RNA, 22 nt, Human
auacuuauacuaagaauguacu

SEQ ID NO: 435056 - RNA, 22 nt, Human
cacuggaauguugaggagacaa

SEQ ID NO: 435057 - RNA, 22 nt, Human
ccuggaaagcgguucauuuugu

SEQ ID NO: 435058 - RNA, 22 nt, Human
auuguugucuuuaccuguauuu

SEQ ID NO: 435059 - RNA, 22 nt, Human
augucuuugccauaguucauau

SEQ ID NO: 435060 - RNA, 22 nt, Human
gacaugcaguucucaaggguag

SEQ ID NO: 435061 - RNA, 22 nt, Human
gagggcaguagccucguacccu

SEQ ID NO: 435062 - RNA, 22 nt, Human
uaugacaaaugauauauuuggc

SEQ ID NO: 435063 - RNA, 19 nt, Human
uucuucuaccucuaccacu

SEQ ID NO: 435064 - RNA, 22 nt, Human
cugaaaauguuacacaggaaga

SEQ ID NO: 435065 - RNA, 22 nt, Human
auucaaacuguguuaggcagca

SEQ ID NO: 435066 - RNA, 22 nt, Human
cuuuauuguccuucuuaggugg

SEQ ID NO: 435067 - RNA, 23 nt, Human
cacauggaggaccguucuuauaa

SEQ ID NO: 435068 - RNA, 22 nt, Human
uugagacacaaggcacaguaag

SEQ ID NO: 435069 - RNA, 22 nt, Human
cccagccucuguuugcuccucu

SEQ ID NO: 435070 - RNA, 20 nt, Human
ucccucaguuuccagcccug

SEQ ID NO: 435071 - RNA, 22 nt, Human
aagcacagagagguaaaguaac

SEQ ID NO: 435072 - RNA, 21 nt, Human
acagggcaugcagcuggcugu

SEQ ID NO: 435073 - RNA, 22 nt, Human
ucagaggaacuggacuaaagcc

SEQ ID NO: 435074 - RNA, 22 nt, Human
ccacagagacagagcccagggu

SEQ ID NO: 435075 - RNA, 22 nt, Human
auuauugcaagcagugaaggga

SEQ ID NO: 435076 - RNA, 21 nt, Human
gggagcuggaaacugggugac

SEQ ID NO: 435077 - RNA, 22 nt, Human
gcaaauggagugaagagcugga

SEQ ID NO: 435078 - RNA, 22 nt, Human
aagcagaacugggaaguagugg

SEQ ID NO: 435079 - RNA, 22 nt, Human
ggcuccaguuuccccuuggggc

SEQ ID NO: 435080 - RNA, 22 nt, Human
aaguguguugacugaauugggg

SEQ ID NO: 435081 - RNA, 22 nt, Human
auccaugaucaauuuauuacua

SEQ ID NO: 435082 - RNA, 22 nt, Human
gagcagcuugcgcugucuucac

SEQ ID NO: 435083 - RNA, 22 nt, Human
ugccugggaaccaauccuggcu

SEQ ID NO: 435084 - RNA, 22 nt, Human
auucacacauacucauguguga

SEQ ID NO: 435085 - RNA, 22 nt, Human
gugaaggcaaugauaagaguga

SEQ ID NO: 435086 - RNA, 22 nt, Human
aaagacaugacacauuggagag

SEQ ID NO: 435087 - RNA, 22 nt, Human
gaaucuagggccuagaucacag

SEQ ID NO: 435088 - RNA, 22 nt, Human
cagguggguguaugaaugcaaa

SEQ ID NO: 435089 - RNA, 22 nt, Human
aagcacagagaugggcacgccu

SEQ ID NO: 435090 - RNA, 22 nt, Human
aguggcagagugcacucaggca

SEQ ID NO: 435091 - RNA, 22 nt, Human
acuccagggaggugagugugcg

SEQ ID NO: 435092 - RNA, 22 nt, Human
acgagguuggagaguuguuugg

SEQ ID NO: 435093 - RNA, 22 nt, Human
aauacagaggggucacaauuca

SEQ ID NO: 435094 - RNA, 22 nt, Human
acagagcugggugcccccugga

SEQ ID NO: 435095 - RNA, 22 nt, Human
agcccuggggugcagaaccaug

SEQ ID NO: 435096 - RNA, 22 nt, Human
cuucaagauauuucuagaauca

SEQ ID NO: 435097 - RNA, 22 nt, Human
uacugcaucgaaaugcuuuuau

SEQ ID NO: 435098 - RNA, 22 nt, Human
caauucaauggcaaaguauugu

SEQ ID NO: 435099 - RNA, 22 nt, Human
cacugagaccagagucccugac

SEQ ID NO: 435100 - RNA, 22 nt, Human
gcaggaugggagcuucacuuug

SEQ ID NO: 435101 - RNA, 20 nt, Human
gucagugucuucaguaguga

SEQ ID NO: 435102 - RNA, 19 nt, Human
uugaaauuguuugauaugg

SEQ ID NO: 435103 - RNA, 22 nt, Human
cugugugugcuacaggcuucca

SEQ ID NO: 435104 - RNA, 22 nt, Human
acaaaugacuauuugguacagg

SEQ ID NO: 435105 - RNA, 22 nt, Human
gucccagggaagaaggcagcac

SEQ ID NO: 435106 - RNA, 22 nt, Human
ccacaguagaauucaucucccu

SEQ ID NO: 435107 - RNA, 22 nt, Human
uguaccauauauguuacugacu

SEQ ID NO: 435108 - RNA, 22 nt, Human
agugcuuuuauuauauacagga

SEQ ID NO: 435109 - RNA, 22 nt, Human
gcugggcuugguuucccugcuu

SEQ ID NO: 435110 - RNA, 22 nt, Human
caguccugagcuccugggcuga

SEQ ID NO: 435111 - RNA, 21 nt, Human
agugacagaggaaggugcaua

SEQ ID NO: 435112 - RNA, 20 nt, Human
aggcaccugucacaggugag

SEQ ID NO: 435113 - RNA, 22 nt, Human
caggacagcucaacaccuccuc

SEQ ID NO: 435114 - RNA, 22 nt, Human
gaggaagagcauggccaguuuc

SEQ ID NO: 435115 - RNA, 22 nt, Human
gagaacaggcucuggagucaga

SEQ ID NO: 435116 - RNA, 22 nt, Human
cuggagggaggaggcugcuauu

SEQ ID NO: 435117 - RNA, 22 nt, Human
gugggccacugggaggcaaggg

SEQ ID NO: 435118 - RNA, 22 nt, Human
guggccugccgugugguauggg

SEQ ID NO: 435119 - RNA, 17 nt, Human
uuauugcagugcugaag

SEQ ID NO: 435120 - RNA, 22 nt, Human
aggcuucuuuuagaggggaugg

SEQ ID NO: 435121 - RNA, 22 nt, Human
aggcuggaaagggaccagagug

SEQ ID NO: 435122 - RNA, 22 nt, Human
aagcacagcuggaacagcagga

SEQ ID NO: 435123 - RNA, 22 nt, Human
gccugccuuugugaggaagcgg

SEQ ID NO: 435124 - RNA, 22 nt, Human
uugaacaauuugguauacaaac

SEQ ID NO: 435125 - RNA, 22 nt, Human
agagacaggguuuugucguguu

SEQ ID NO: 435126 - RNA, 22 nt, Human
auuugcuuguaaauguaugccu

SEQ ID NO: 435127 - RNA, 22 nt, Human
cacaugaagauucaacuggaug

SEQ ID NO: 435128 - RNA, 22 nt, Human
uuauuuauucauucugucuguc

SEQ ID NO: 435129 - RNA, 22 nt, Human
caguccugcuggccuucccugg

SEQ ID NO: 435130 - RNA, 22 nt, Human
cacugccuccccaggcuccaca

SEQ ID NO: 435131 - RNA, 22 nt, Human
ggcacagggggcugaggacuag

SEQ ID NO: 435132 - RNA, 17 nt, Human
cugaggcccagggccca

SEQ ID NO: 435133 - RNA, 22 nt, Human
auuugcaaugauuucagugcuu

SEQ ID NO: 435134 - RNA, 22 nt, Human
ccagcagccaccuucucgaaau

SEQ ID NO: 435135 - RNA, 22 nt, Human
uuuagcaaaaaagcucugcgua

SEQ ID NO: 435136 - RNA, 22 nt, Human
ccacaguaacuguuuuguaccg

SEQ ID NO: 435137 - RNA, 22 nt, Human
uaucuuuagaggaagagaaucu

SEQ ID NO: 435138 - RNA, 22 nt, Human
cacuuguugguggugaaaucac

SEQ ID NO: 435139 - RNA, 22 nt, Human
uuuaaauuuagaagaaacacug

SEQ ID NO: 435140 - RNA, 22 nt, Human
aaaugcacugaacacauguugu

SEQ ID NO: 435141 - RNA, 22 nt, Human
ggaacauuuaaauucuuauuug

SEQ ID NO: 435142 - RNA, 22 nt, Human
ugggagcccaagggagcugccg

SEQ ID NO: 435143 - RNA, 22 nt, Human
gagagggccgggggccagcucc

SEQ ID NO: 435144 - RNA, 22 nt, Human
uuggcugaaagccaugagaccg

SEQ ID NO: 435145 - RNA, 22 nt, Human
aucacaauguacguuaaaaugu

SEQ ID NO: 435146 - RNA, 22 nt, Human
caauuucucgaacucuaaucca

SEQ ID NO: 435147 - RNA, 22 nt, Human
agaagccauguuuaguaggaug

SEQ ID NO: 435148 - RNA, 20 nt, Human
ugggugccugccacggggcc

SEQ ID NO: 435149 - RNA, 20 nt, Human
acccagcucugugcccuggg

SEQ ID NO: 435150 - RNA, 22 nt, Human
uauauuaaacccucucuguagg

SEQ ID NO: 435151 - RNA, 22 nt, Human
ccccuccuggccacacugucag

SEQ ID NO: 435152 - RNA, 22 nt, Human
gaggcuggaggucaaagaugaa

SEQ ID NO: 435153 - RNA, 22 nt, Human
gcucuugaggaagugcagggca

SEQ ID NO: 435154 - RNA, 22 nt, Human
ucaugcaguuugaaguucaggg

SEQ ID NO: 435155 - RNA, 18 nt, Human
agcugguggggagacagc

SEQ ID NO: 435156 - RNA, 22 nt, Human
agcagcuguuagaaacaggaag

SEQ ID NO: 435157 - RNA, 23 nt, Human
ugauuacaagggccaaagaaagg

SEQ ID NO: 435158 - RNA, 17 nt, Human
uuugaaaggaugucagu

SEQ ID NO: 435159 - RNA, 22 nt, Human
ggagcugcuccuucagccaagu

SEQ ID NO: 435160 - RNA, 22 nt, Human
gccugccugcugugugcaaguu

SEQ ID NO: 435161 - RNA, 22 nt, Human
cugucauuguacauguuauaca

SEQ ID NO: 435162 - RNA, 22 nt, Human
gcuccaggagagggaagcagau

SEQ ID NO: 435163 - RNA, 22 nt, Human
aauguaaaguugggcacaaaug

SEQ ID NO: 435164 - RNA, 22 nt, Human
cggcuggugucgggcacagcaa

SEQ ID NO: 435165 - RNA, 22 nt, Human
gcuggagcuugagaggacaggg

SEQ ID NO: 435166 - RNA, 22 nt, Human
agccuggacagcuacggagaac

SEQ ID NO: 435167 - RNA, 22 nt, Human
cagcccaguaccaagcaguugg

SEQ ID NO: 435168 - RNA, 22 nt, Human
gaggaaugggugucucgugauu

SEQ ID NO: 435169 - RNA, 22 nt, Human
augcccugaaagauucaaaggc

SEQ ID NO: 435170 - RNA, 22 nt, Human
gaguccuggaacccugaaugcu

SEQ ID NO: 435171 - RNA, 22 nt, Human
acugggagucaugaggaaggag

SEQ ID NO: 435172 - RNA, 22 nt, Human
ccagcugguuaaaauagagaaa

SEQ ID NO: 435173 - RNA, 22 nt, Human
ccuggugcugcuaucaggggua

SEQ ID NO: 435174 - RNA, 22 nt, Human
gagagcuggguucaaguagcug

SEQ ID NO: 435175 - RNA, 22 nt, Human
agcuaggggaccaagguggccc

SEQ ID NO: 435176 - RNA, 22 nt, Human
cccacagugaucgcauucguac

SEQ ID NO: 435177 - RNA, 22 nt, Human
ugccuggcacagagcagguggc

SEQ ID NO: 435178 - RNA, 22 nt, Human
uuuuacaagcugagucguuaaa

SEQ ID NO: 435179 - RNA, 22 nt, Human
caggcacaguguugcuguucaa

SEQ ID NO: 435180 - RNA, 22 nt, Human
ucaggcugaccagguuuugcuc

SEQ ID NO: 435181 - RNA, 21 nt, Human
aggcagaaagagcccaggcug

SEQ ID NO: 435182 - RNA, 22 nt, Human
cagcagcaguguucuagaaucu

SEQ ID NO: 435183 - RNA, 21 nt, Human
uggcucugagccucauggcug

SEQ ID NO: 435184 - RNA, 17 nt, Human
guccugggaggagagag

SEQ ID NO: 435185 - RNA, 22 nt, Human
uuuagcaaguucucugagagaa

SEQ ID NO: 435186 - RNA, 22 nt, Human
uauugcaauuggcagagugcua

SEQ ID NO: 435187 - RNA, 22 nt, Human
uuuauccaugcucccguugaug

SEQ ID NO: 435188 - RNA, 17 nt, Human
ggcuggaggggacccgg

SEQ ID NO: 435189 - RNA, 22 nt, Human
aagacaauuuugaguaugcaca

SEQ ID NO: 435190 - RNA, 22 nt, Human
uuugcaaaaugaggugaagagu

SEQ ID NO: 435191 - RNA, 22 nt, Human
caaggcaggucugaggagguug

SEQ ID NO: 435192 - RNA, 22 nt, Human
uguggccagccacaggcauggu

SEQ ID NO: 435193 - RNA, 20 nt, Human
agcaguuuccuaacucagcu

SEQ ID NO: 435194 - RNA, 22 nt, Human
gcagcugagagaagaacagggc

SEQ ID NO: 435195 - RNA, 21 nt, Human
uggccagcuggagucuccaca

SEQ ID NO: 435196 - RNA, 22 nt, Human
ugcagauacaguauguggaagc

SEQ ID NO: 435197 - RNA, 22 nt, Human
ccaauucauccucuggggcuuc

SEQ ID NO: 435198 - RNA, 22 nt, Human
acuccagagcucacaugucuaa

SEQ ID NO: 435199 - RNA, 22 nt, Human
aggagccaagaugcugucuggc

SEQ ID NO: 435200 - RNA, 22 nt, Human
uggccagccauaaaagaaccca

SEQ ID NO: 435201 - RNA, 20 nt, Human
ggcugugcccuuccguggcc

SEQ ID NO: 435202 - RNA, 18 nt, Human
aagcugcccucaggcagg

SEQ ID NO: 435203 - RNA, 22 nt, Human
ucugggcuauauggucucugcu

SEQ ID NO: 435204 - RNA, 22 nt, Human
gcagugcuaaggauucugccuu

SEQ ID NO: 435205 - RNA, 22 nt, Human
auucagaaauagaaaauuugau

SEQ ID NO: 435206 - RNA, 22 nt, Human
acacaauacagggcucaaaaua

SEQ ID NO: 435207 - RNA, 19 nt, Human
acacagggcuagaguuaca

SEQ ID NO: 435208 - RNA, 22 nt, Human
cccuggagcugcuugcauguug

SEQ ID NO: 435209 - RNA, 22 nt, Human
uugcagcuuagugauguuaucu

SEQ ID NO: 435210 - RNA, 22 nt, Human
agguaaggcuguaagcuaagcc

SEQ ID NO: 435211 - RNA, 22 nt, Human
agagcagauggagcuggaagag

SEQ ID NO: 435212 - RNA, 22 nt, Human
gagcucccuggagguucagaua

SEQ ID NO: 435213 - RNA, 22 nt, Human
ugggcaagucacuucugucuuu

SEQ ID NO: 435214 - RNA, 20 nt, Human
caggccucugggggcccugg

SEQ ID NO: 435215 - RNA, 22 nt, Human
agaagugccauacuguggucca

SEQ ID NO: 435216 - RNA, 22 nt, Human
ugagccagauaagggcucacgc

SEQ ID NO: 435217 - RNA, 22 nt, Human
gccugugcauagcagcggacuc

SEQ ID NO: 435218 - RNA, 22 nt, Human
aagagacuggaaacuaggguca

SEQ ID NO: 435219 - RNA, 22 nt, Human
uccugccucuugccuucuucac

SEQ ID NO: 435220 - RNA, 22 nt, Human
ugguacaaaaguaauugcguga

SEQ ID NO: 435221 - RNA, 22 nt, Human
gucugugcaguuacuagcuggu

SEQ ID NO: 435222 - RNA, 17 nt, Human
ucagcaguaaugguggg

SEQ ID NO: 435223 - RNA, 19 nt, Human
gccagcagaaugaugaggc

SEQ ID NO: 435224 - RNA, 22 nt, Human
agcagagcggggccuccggaag

SEQ ID NO: 435225 - RNA, 22 nt, Human
gucccuaguggaaagacaugau

SEQ ID NO: 435226 - RNA, 22 nt, Human
auuuuacuuaguguaaugucca

SEQ ID NO: 435227 - RNA, 22 nt, Human
uuuauuguuaucaugggugagu

SEQ ID NO: 435228 - RNA, 22 nt, Human
cagagcuuucugucacauuagu

SEQ ID NO: 435229 - RNA, 22 nt, Human
acaggcugccuaccaaguauca

SEQ ID NO: 435230 - RNA, 22 nt, Human
uauaaaauggcaucagcuccaa

SEQ ID NO: 435231 - RNA, 22 nt, Human
cugagaauggacagcagggcag

SEQ ID NO: 435232 - RNA, 22 nt, Human
ugcuacagagccaggaagagug

SEQ ID NO: 435233 - RNA, 23 nt, Human
ucaaacauauugugagacacagg

SEQ ID NO: 435234 - RNA, 17 nt, Human
uccagagcacagagcuc

SEQ ID NO: 435235 - RNA, 22 nt, Human
aagggcagaauagagaagaugg

SEQ ID NO: 435236 - RNA, 22 nt, Human
cagagcugguaagugguagagg

SEQ ID NO: 435237 - RNA, 19 nt, Human
uagcugccuguuaccucca

SEQ ID NO: 435238 - RNA, 22 nt, Human
ccagcccuguaaggaugaggca

SEQ ID NO: 435239 - RNA, 22 nt, Human
aggaugagauuccagggucaau

SEQ ID NO: 435240 - RNA, 22 nt, Human
gaguugaagaaauaguuuugau

SEQ ID NO: 435241 - RNA, 22 nt, Human
caaauacugagcacgcaaucaa

SEQ ID NO: 435242 - RNA, 16 nt, Human
gcuaggcaacaggcug

SEQ ID NO: 435243 - RNA, 22 nt, Human
ggcaggcaggucuucauggccc

SEQ ID NO: 435244 - RNA, 22 nt, Human
caacaguuccuccauccucucu

SEQ ID NO: 435245 - RNA, 22 nt, Human
uucaaguaugagaaaggggacu

SEQ ID NO: 435246 - RNA, 22 nt, Human
cauguacaaaaggcaaaugccu

SEQ ID NO: 435247 - RNA, 22 nt, Human
gcuguuucggccuccuggggaa

SEQ ID NO: 435248 - RNA, 22 nt, Human
uucuuuauguuaaugaaucuau

SEQ ID NO: 435249 - RNA, 22 nt, Human
ugcagcccagccccagaaccuu

SEQ ID NO: 435250 - RNA, 22 nt, Human
ugaggcaguucuuacuuguauu

SEQ ID NO: 435251 - RNA, 18 nt, Human
acaaaggaucaugaggga

SEQ ID NO: 435252 - RNA, 22 nt, Human
ggagcugcacgcucugaagccu

SEQ ID NO: 435253 - RNA, 22 nt, Human
gaggccugggagccuguccucc

SEQ ID NO: 435254 - RNA, 22 nt, Human
ccacaagaugcaaacucuaaca

SEQ ID NO: 435255 - RNA, 22 nt, Human
ggcacagcacaguggacccagg

SEQ ID NO: 435256 - RNA, 22 nt, Human
ugaugaggagacuguggcuugg

SEQ ID NO: 435257 - RNA, 21 nt, Human
agcuguuugaagcuauauugg

SEQ ID NO: 435258 - RNA, 17 nt, Human
acagcagggaaguguug

SEQ ID NO: 435259 - RNA, 22 nt, Human
auucagaaagcaagugcugggu

SEQ ID NO: 435260 - RNA, 22 nt, Human
gccucccuguucuuccacaaua

SEQ ID NO: 435261 - RNA, 18 nt, Human
uggagcagguaggcauga

SEQ ID NO: 435262 - RNA, 22 nt, Human
acagagcauuugggacagagag

SEQ ID NO: 435263 - RNA, 22 nt, Human
gacaggaagucugaaggaggga

SEQ ID NO: 435264 - RNA, 22 nt, Human
uucagcacuuuguuuugcucau

SEQ ID NO: 435265 - RNA, 22 nt, Human
ugcccacagauaugugcagucu

SEQ ID NO: 435266 - RNA, 22 nt, Human
acuuuccuggcccuguccucug

SEQ ID NO: 435267 - RNA, 22 nt, Human
uuguacaacguuuuaaauuuga

SEQ ID NO: 435268 - RNA, 22 nt, Human
cacugcccaggaccugccaccc

SEQ ID NO: 435269 - RNA, 17 nt, Human
aauagcugcucagagag

SEQ ID NO: 435270 - RNA, 22 nt, Human
aaguucaagagugacauauuag

SEQ ID NO: 435271 - RNA, 22 nt, Human
ucccugcucagcucaccuggca

SEQ ID NO: 435272 - RNA, 22 nt, Human
ggagcugaaggggugggcucag

SEQ ID NO: 435273 - RNA, 22 nt, Human
gcacugguguguuaguaaggga

SEQ ID NO: 435274 - RNA, 22 nt, Human
uugauuaaaaugagacaucauu

SEQ ID NO: 435275 - RNA, 22 nt, Human
aauuaaaugacaggggaagaug

SEQ ID NO: 435276 - RNA, 21 nt, Human
aagaaagauaauuaaggaccc

SEQ ID NO: 435277 - RNA, 19 nt, Human
ugagacagagaccaguucu

SEQ ID NO: 435278 - RNA, 22 nt, Human
agcucacaguguccuuccucaa

SEQ ID NO: 435279 - RNA, 22 nt, Human
gccaggaaugcauaaaugaccu

SEQ ID NO: 435280 - RNA, 22 nt, Human
auucaauaaauaugcuacaugg

SEQ ID NO: 435281 - RNA, 22 nt, Human
cugcauaucaaauuacuccugg

SEQ ID NO: 435282 - RNA, 22 nt, Human
ccaaggcuccucagcuggucuu

SEQ ID NO: 435283 - RNA, 22 nt, Human
uuucucccaacucuggaagcca

SEQ ID NO: 435284 - RNA, 22 nt, Human
caguguggcugagacagaggcu

SEQ ID NO: 435285 - RNA, 17 nt, Human
cuaagggcccacucuuc

SEQ ID NO: 435286 - RNA, 22 nt, Human
guagaaaugguguguuucuucu

SEQ ID NO: 435287 - RNA, 22 nt, Human
agagccugcuguguaagucaca

SEQ ID NO: 435288 - RNA, 22 nt, Human
ugaagacucagaagcuaagaua

SEQ ID NO: 435289 - RNA, 20 nt, Human
aagagaagaagucuuugaaa

SEQ ID NO: 435290 - RNA, 22 nt, Human
ccucugagagaaggccuucagc

SEQ ID NO: 435291 - RNA, 19 nt, Human
ggaugagggucaggcauag

SEQ ID NO: 435292 - RNA, 21 nt, Human
agcacagcauauccaauguca

SEQ ID NO: 435293 - RNA, 22 nt, Human
gaaggcugucagagaggagggc

SEQ ID NO: 435294 - RNA, 22 nt, Human
ccagugcaggugagcaccaggu

SEQ ID NO: 435295 - RNA, 23 nt, Human
auuuuuugucuuuguaacuagau

SEQ ID NO: 435296 - RNA, 22 nt, Human
auugagaagaaaaucuaauaua

SEQ ID NO: 435297 - RNA, 22 nt, Human
ccacaguaagagauaguuuaug

SEQ ID NO: 435298 - RNA, 19 nt, Human
ccugugagaggacaggugu

SEQ ID NO: 435299 - RNA, 22 nt, Human
aagagcuggcucuugcagcagc

SEQ ID NO: 435300 - RNA, 22 nt, Human
ugcucaguuaagcagaggaaau

SEQ ID NO: 435301 - RNA, 22 nt, Human
guggcacacaggagagagcuca

SEQ ID NO: 435302 - RNA, 22 nt, Human
gcuuucucuucacugauguuca

SEQ ID NO: 435303 - RNA, 22 nt, Human
acagggcagagaggcaggcuug

SEQ ID NO: 435304 - RNA, 22 nt, Human
cuucuugacuucugggugcccu

SEQ ID NO: 435305 - RNA, 22 nt, Human
ugcauauuuguaugauguuuag

SEQ ID NO: 435306 - RNA, 22 nt, Human
ugccuggcaacuguggugggcu

SEQ ID NO: 435307 - RNA, 22 nt, Human
uaaaggcaguaauuccugaguu

SEQ ID NO: 435308 - RNA, 22 nt, Human
uuguuacacauaauaacauuuu

SEQ ID NO: 435309 - RNA, 16 nt, Human
aucuaagaugugcauu

SEQ ID NO: 435310 - RNA, 20 nt, Human
gcuggcugaacugaaagcaa

SEQ ID NO: 435311 - RNA, 22 nt, Human
ccccucagguacccgugcagca

SEQ ID NO: 435312 - RNA, 22 nt, Human
ugacacagauuagagacauacc

SEQ ID NO: 435313 - RNA, 22 nt, Human
gacaggcaccuugucugucuug

SEQ ID NO: 435314 - RNA, 22 nt, Human
uacagaggcuggguuuucaggg

SEQ ID NO: 435315 - RNA, 22 nt, Human
uggggccugagguggagcugca

SEQ ID NO: 435316 - RNA, 22 nt, Human
cagucuaaucuguuacucauua

SEQ ID NO: 435317 - RNA, 22 nt, Human
aggcaguuuaggcagcgauuua

SEQ ID NO: 435318 - RNA, 22 nt, Human
ugcauuggucuuaaucuucagg

SEQ ID NO: 435319 - RNA, 22 nt, Human
ggcaccuggauguagcagugaa

SEQ ID NO: 435320 - RNA, 22 nt, Human
ccucaggguggcaucagaucuu

SEQ ID NO: 435321 - RNA, 22 nt, Human
agcauggggcuccgcaaugaac

SEQ ID NO: 435322 - RNA, 22 nt, Human
aggacagcccccaacagcaaca

SEQ ID NO: 435323 - RNA, 22 nt, Human
guggcuugaccaucccugcuac

SEQ ID NO: 435324 - RNA, 22 nt, Human
caggcccugggcaggcacagag

SEQ ID NO: 435325 - RNA, 22 nt, Human
uccugcagagacagaggccuca

SEQ ID NO: 435326 - RNA, 22 nt, Human
cccagcacaggcaauuccauac

SEQ ID NO: 435327 - RNA, 22 nt, Human
uuggccagcucuggaaaguggu

SEQ ID NO: 435328 - RNA, 22 nt, Human
ucugaggggcuggaagggcugc

SEQ ID NO: 435329 - RNA, 22 nt, Human
caggacagaaauaaggaauaua

SEQ ID NO: 435330 - RNA, 22 nt, Human
gaugcaaacugugacauagagu

SEQ ID NO: 435331 - RNA, 22 nt, Human
augcauauucuuagccccuccu

SEQ ID NO: 435332 - RNA, 20 nt, Human
aggguggcaaguuagugaca

SEQ ID NO: 435333 - RNA, 22 nt, Human
ugcaauaaguuguguuaucacu

SEQ ID NO: 435334 - RNA, 22 nt, Human
ucuaacauugaauggcugauua

SEQ ID NO: 435335 - RNA, 22 nt, Human
uggcuccuaggauggugccugg

SEQ ID NO: 435336 - RNA, 22 nt, Human
ccuggcucuguccucgcgcaaa

SEQ ID NO: 435337 - RNA, 22 nt, Human
uauguacauaacaugaaaugca

SEQ ID NO: 435338 - RNA, 22 nt, Human
caugugucaaaugauguagcug

SEQ ID NO: 435339 - RNA, 22 nt, Human
auucaaaugucaaauccaccag

SEQ ID NO: 435340 - RNA, 20 nt, Human
cacucuaaccauauuuccuc

SEQ ID NO: 435341 - RNA, 22 nt, Human
auauuuugaaguuaauaaugug

SEQ ID NO: 435342 - RNA, 22 nt, Human
ucuccaggugacucugauguau

SEQ ID NO: 435343 - RNA, 22 nt, Human
cccaggcuggagugcaauggca

SEQ ID NO: 435344 - RNA, 22 nt, Human
ucacugcaaucucugccuucca

SEQ ID NO: 435345 - RNA, 22 nt, Human
cguugugagcuugguagacacu

SEQ ID NO: 435346 - RNA, 22 nt, Human
aaguucaaggugauaguggcag

SEQ ID NO: 435347 - RNA, 22 nt, Human
cccaggaguuugaguucagcau

SEQ ID NO: 435348 - RNA, 22 nt, Human
agaacagcagcacgucaagcug

SEQ ID NO: 435349 - RNA, 22 nt, Human
aaaugcaucagcucauaagaga

SEQ ID NO: 435350 - RNA, 23 nt, Human
agcagcccagaugccuuccaucc

SEQ ID NO: 435351 - RNA, 22 nt, Human
ucugaaaauguugacuuuguuu

SEQ ID NO: 435352 - RNA, 22 nt, Human
acacaggaggaggauggugguc

SEQ ID NO: 435353 - RNA, 22 nt, Human
agagcugcaauuucauguggug

SEQ ID NO: 435354 - RNA, 22 nt, Human
ucaggccugcagugccaaccca

SEQ ID NO: 435355 - RNA, 21 nt, Human
agguuucugugagcagagcag

SEQ ID NO: 435356 - RNA, 22 nt, Human
ugaaguaggcagcaugcugaga

SEQ ID NO: 435357 - RNA, 22 nt, Human
aggggccauuguucugcccgcu

SEQ ID NO: 435358 - RNA, 22 nt, Human
ucagaguuggccuuucuguauu

SEQ ID NO: 435359 - RNA, 22 nt, Human
ggcacagcugaugcagacacac

SEQ ID NO: 435360 - RNA, 20 nt, Human
cagaccugcacccacuucga

SEQ ID NO: 435361 - RNA, 22 nt, Human
auggcagaccugggcuggagaa

SEQ ID NO: 435362 - RNA, 22 nt, Human
uucucuacuucacaagggaugg

SEQ ID NO: 435363 - RNA, 22 nt, Human
gcagccacuaguuuuccuguuu

SEQ ID NO: 435364 - RNA, 17 nt, Human
gccagggagaggaagcc

SEQ ID NO: 435365 - RNA, 22 nt, Human
cccaggagaugcacuccauugg

SEQ ID NO: 435366 - RNA, 22 nt, Human
ucaaaacccagccaucaggacu

SEQ ID NO: 435367 - RNA, 22 nt, Human
ggaggacaggggcugcagcaca

SEQ ID NO: 435368 - RNA, 22 nt, Human
uuaugacagaaaugaaaagcug

SEQ ID NO: 435369 - RNA, 20 nt, Human
caccagucaugagucaauac

SEQ ID NO: 435370 - RNA, 22 nt, Human
caagugucuauaucagugcuug

SEQ ID NO: 435371 - RNA, 22 nt, Human
agcugguaaaggggaaagcaga

SEQ ID NO: 435372 - RNA, 19 nt, Human
cacuucaauccuuuaucaa

SEQ ID NO: 435373 - RNA, 22 nt, Human
cacaggcagccuuguagaagaa

SEQ ID NO: 435374 - RNA, 22 nt, Human
aagcccugggauguucagcagu

SEQ ID NO: 435375 - RNA, 22 nt, Human
gcccagcccugaggucacagcu

SEQ ID NO: 435376 - RNA, 22 nt, Human
ucucuggguugagaacuaggac

SEQ ID NO: 435377 - RNA, 22 nt, Human
cagcagcaccuauuauaguguu

SEQ ID NO: 435378 - RNA, 22 nt, Human
guccuagugccuggaagcuggg

SEQ ID NO: 435379 - RNA, 22 nt, Human
gaggcagccagagguucucauu

SEQ ID NO: 435380 - RNA, 22 nt, Human
caguugagucugcuagcuagga

SEQ ID NO: 435381 - RNA, 22 nt, Human
ugccuggguccaggccaagccu

SEQ ID NO: 435382 - RNA, 22 nt, Human
guucagaguauuaauugauuua

SEQ ID NO: 435383 - RNA, 22 nt, Human
acaacauuuccauuuccuuggu

SEQ ID NO: 435384 - RNA, 22 nt, Human
cugucauuuaagacauucugga

SEQ ID NO: 435385 - RNA, 23 nt, Human
acacauuuuucccguucugaggu

SEQ ID NO: 435386 - RNA, 23 nt, Human
uuugcaaauuuuccugacuacuc

SEQ ID NO: 435387 - RNA, 22 nt, Human
ccccagcacucugacucuuacc

SEQ ID NO: 435388 - RNA, 22 nt, Human
caguacauuucauaugauucua

SEQ ID NO: 435389 - RNA, 22 nt, Human
uuuugguacaugcaauagcaau

SEQ ID NO: 435390 - RNA, 22 nt, Human
gcucacuggccugaagaggacg

SEQ ID NO: 435391 - RNA, 22 nt, Human
ggcucaggagaggggcuaaaag

SEQ ID NO: 435392 - RNA, 22 nt, Human
aggugccugucgucucugguua

SEQ ID NO: 435393 - RNA, 22 nt, Human
acuauaaaaggauaaaccagaa

SEQ ID NO: 435394 - RNA, 22 nt, Human
ugggauggcauccugggccuug

SEQ ID NO: 435395 - RNA, 23 nt, Human
cccagcgcugagcccugcaggca

SEQ ID NO: 435396 - RNA, 22 nt, Human
gccagcagcccagaaggacuuu

SEQ ID NO: 435397 - RNA, 18 nt, Human
caggagcaggaguugaac

SEQ ID NO: 435398 - RNA, 22 nt, Human
aaucacaugugggucuuguagc

SEQ ID NO: 435399 - RNA, 22 nt, Human
gagguuccagacagcuuaggga

SEQ ID NO: 435400 - RNA, 22 nt, Human
gcccagcagaucucagugucuc

SEQ ID NO: 435401 - RNA, 22 nt, Human
augcacuucaagcaucucucug

SEQ ID NO: 435402 - RNA, 22 nt, Human
cagggacucccaggguagcucc

SEQ ID NO: 435403 - RNA, 22 nt, Human
gcugggcagccuggccgcugcc

SEQ ID NO: 435404 - RNA, 22 nt, Human
cccuggaguccuggcaguugau

SEQ ID NO: 435405 - RNA, 22 nt, Human
gcucccacaaccuucuugcucc

SEQ ID NO: 435406 - RNA, 22 nt, Human
cagcccuggcgcccccagaucu

SEQ ID NO: 435407 - RNA, 22 nt, Human
uuccuuuagugucauauacuuu

SEQ ID NO: 435408 - RNA, 22 nt, Human
acagaacugggggcacagauag

SEQ ID NO: 435409 - RNA, 22 nt, Human
augucauuuaaauguuuguaua

SEQ ID NO: 435410 - RNA, 22 nt, Human
agaaagauccuucuggcugccu

SEQ ID NO: 435411 - RNA, 22 nt, Human
cgcauccagggcgcaggaucug

SEQ ID NO: 435412 - RNA, 19 nt, Human
ugcagaagacacaguggug

SEQ ID NO: 435413 - RNA, 22 nt, Human
cccagccuuugcuuccugguuc

SEQ ID NO: 435414 - RNA, 22 nt, Human
ugaggcaggacauggacaacug

SEQ ID NO: 435415 - RNA, 22 nt, Human
guccugucccccaaggcugugg

SEQ ID NO: 435416 - RNA, 22 nt, Human
agcacaauauggguuuuauagu

SEQ ID NO: 435417 - RNA, 19 nt, Human
cuguuucaaguaggaggag

SEQ ID NO: 435418 - RNA, 22 nt, Human
gcagcccaggagcaggcgaccc

SEQ ID NO: 435419 - RNA, 22 nt, Human
cuccaggacccaguggcuccag

SEQ ID NO: 435420 - RNA, 22 nt, Human
aaagagcuuuagaaaucucaga

SEQ ID NO: 435421 - RNA, 22 nt, Human
ugcaggagcugugcggugaggg

SEQ ID NO: 435422 - RNA, 22 nt, Human
acucuauaaagauaccucaauu

SEQ ID NO: 435423 - RNA, 22 nt, Human
gauuccuuuggugaacugccga

SEQ ID NO: 435424 - RNA, 22 nt, Human
aacauagaauuguuauauuuuc

SEQ ID NO: 435425 - RNA, 22 nt, Human
agcagugcuauggccaggcuaa

SEQ ID NO: 435426 - RNA, 22 nt, Human
uaaauguaccuucugccuuacu

SEQ ID NO: 435427 - RNA, 22 nt, Human
ucugaggcuucagacuguacug

SEQ ID NO: 435428 - RNA, 22 nt, Human
aacacuuuguugccuaugaacg

SEQ ID NO: 435429 - RNA, 22 nt, Human
cauuaagauuuuuuucuacugg

SEQ ID NO: 435430 - RNA, 22 nt, Human
ucagaauuguggagaaagggga

SEQ ID NO: 435431 - RNA, 22 nt, Human
augcaacaaaugcuacgaaucg

SEQ ID NO: 435432 - RNA, 22 nt, Human
uacagaacugaaguagugaaaa

SEQ ID NO: 435433 - RNA, 22 nt, Human
ggcuagggaaauccugauccaa

SEQ ID NO: 435434 - RNA, 22 nt, Human
ugggaagauggagugacaggca

SEQ ID NO: 435435 - RNA, 22 nt, Human
ucugggcuuuacacugugcuua

SEQ ID NO: 435436 - RNA, 21 nt, Human
auuuacaaaacagucccuucc

SEQ ID NO: 435437 - RNA, 22 nt, Human
uucaacaugcuuuauuucuaaa

SEQ ID NO: 435438 - RNA, 22 nt, Human
aguuuacauauuugucggaguc

SEQ ID NO: 435439 - RNA, 22 nt, Human
ccuggggagagaaagcccagcc

SEQ ID NO: 435440 - RNA, 22 nt, Human
ugcaacaggagaguucagggca

SEQ ID NO: 435441 - RNA, 22 nt, Human
gaggccucugucccgccaggga

SEQ ID NO: 435442 - RNA, 17 nt, Human
ucuuugcaaugagacug

SEQ ID NO: 435443 - RNA, 22 nt, Human
ccugggagccgacugacugugc

SEQ ID NO: 435444 - RNA, 22 nt, Human
gagaaggcuuccaaauucugug

SEQ ID NO: 435445 - RNA, 22 nt, Human
uacuuugcggcgcggaggagca

SEQ ID NO: 435446 - RNA, 22 nt, Human
caagcccaggauuccccaguua

SEQ ID NO: 435447 - RNA, 19 nt, Human
gcuggcagauguggccgug

SEQ ID NO: 435448 - RNA, 22 nt, Human
uuucaaaugcaugucuuuccuc

SEQ ID NO: 435449 - RNA, 22 nt, Human
uuugcuuuguuuaaaaguggua

SEQ ID NO: 435450 - RNA, 18 nt, Human
uaugagaagauuagcaau

SEQ ID NO: 435451 - RNA, 22 nt, Human
ggcugcugacaaacaugaucau

SEQ ID NO: 435452 - RNA, 22 nt, Human
aggcuaggcaugugcuaccaca

SEQ ID NO: 435453 - RNA, 22 nt, Human
gagggaaggucacccuuguagc

SEQ ID NO: 435454 - RNA, 22 nt, Human
gcagggacaaggcagguguucu

SEQ ID NO: 435455 - RNA, 22 nt, Human
uugcuuuucccugucucugauu

SEQ ID NO: 435456 - RNA, 22 nt, Human
cacaagacuuauuuguguagaa

SEQ ID NO: 435457 - RNA, 22 nt, Human
uaggcugggccugccuuccagg

SEQ ID NO: 435458 - RNA, 22 nt, Human
uacaguacagucuagacucugg

SEQ ID NO: 435459 - RNA, 22 nt, Human
aagugcauuagauagaaugaug

SEQ ID NO: 435460 - RNA, 22 nt, Human
guccccucaaaauucauauguu

SEQ ID NO: 435461 - RNA, 21 nt, Human
gcccuaggcuaccuggagcgc

SEQ ID NO: 435462 - RNA, 22 nt, Human
caagacauugauuuuguacaga

SEQ ID NO: 435463 - RNA, 22 nt, Human
caggccuggagugcaauggcac

SEQ ID NO: 435464 - RNA, 20 nt, Human
caggcagaggaugcugacca

SEQ ID NO: 435465 - RNA, 22 nt, Human
caucugaagagcuuugcaagag

SEQ ID NO: 435466 - RNA, 22 nt, Human
aggggcacgaguagagcucuag

SEQ ID NO: 435467 - RNA, 20 nt, Human
gcugaccccugcugucaugc

SEQ ID NO: 435468 - RNA, 22 nt, Human
uacaggaacugggcaggacauu

SEQ ID NO: 435469 - RNA, 22 nt, Human
auucagacugucuaaaugguuu

SEQ ID NO: 435470 - RNA, 22 nt, Human
cagaaacagacaugacgcagua

SEQ ID NO: 435471 - RNA, 22 nt, Human
cauuuucagcacccaucugaaa

SEQ ID NO: 435472 - RNA, 22 nt, Human
uguccuggugcuucuugggauu

SEQ ID NO: 435473 - RNA, 22 nt, Human
cagagccucucagaggucagac

SEQ ID NO: 435474 - RNA, 22 nt, Human
ugccucugugggcagagcugcc

SEQ ID NO: 435475 - RNA, 22 nt, Human
cgcaggcaaugcuccgcggggg

SEQ ID NO: 435476 - RNA, 22 nt, Human
uccaggagcauccaggugaagc

SEQ ID NO: 435477 - RNA, 22 nt, Human
agugucuuucauauccuccauc

SEQ ID NO: 435478 - RNA, 22 nt, Human
ggcaaaaaccgcaauaacuucu

SEQ ID NO: 435479 - RNA, 22 nt, Human
cuugcaaaguagcugagagguu

SEQ ID NO: 435480 - RNA, 18 nt, Human
aaauguacuguccauggc

SEQ ID NO: 435481 - RNA, 22 nt, Human
cagccagagaaagggcacugcc

SEQ ID NO: 435482 - RNA, 22 nt, Human
aacaugcaugaagaaguuauau

SEQ ID NO: 435483 - RNA, 22 nt, Human
agagccugcagcugugaagaaa

SEQ ID NO: 435484 - RNA, 22 nt, Human
ggcaggagggcggacaaugacc

SEQ ID NO: 435485 - RNA, 22 nt, Human
agcuccagccucuucuggaggu

SEQ ID NO: 435486 - RNA, 20 nt, Human
gugcagauguccuuucacac

SEQ ID NO: 435487 - RNA, 22 nt, Human
ugaauacacuaaaaaucacuuu

SEQ ID NO: 435488 - RNA, 22 nt, Human
uuuggccaagaaaguucugugg

SEQ ID NO: 435489 - RNA, 22 nt, Human
acaggcaagaggaaagcaagua

SEQ ID NO: 435490 - RNA, 22 nt, Human
aagaucaagugcuggcaguguu

SEQ ID NO: 435491 - RNA, 22 nt, Human
gacagagauugaaucaggaaau

SEQ ID NO: 435492 - RNA, 22 nt, Human
ucucaaaguagcucccacagau

SEQ ID NO: 435493 - RNA, 22 nt, Human
ugaugaggggcucagaggucag

SEQ ID NO: 435494 - RNA, 22 nt, Human
uugcaaauaaacaaguauacau

SEQ ID NO: 435495 - RNA, 22 nt, Human
cugagagguaaucacacaaaau

SEQ ID NO: 435496 - RNA, 22 nt, Human
uuuaacagaugugaaauuuuca

SEQ ID NO: 435497 - RNA, 17 nt, Human
ggcagagcugacagggc

SEQ ID NO: 435498 - RNA, 22 nt, Human
ucaugcaguuacuguuaugcaa

SEQ ID NO: 435499 - RNA, 22 nt, Human
uggcacaggaauuuagaugcag

SEQ ID NO: 435500 - RNA, 22 nt, Human
ugccuccuucaggagggcccgg

SEQ ID NO: 435501 - RNA, 22 nt, Human
augggaaguguuagaagauuuu

SEQ ID NO: 435502 - RNA, 22 nt, Human
ggcaguggguggaucucaggga

SEQ ID NO: 435503 - RNA, 21 nt, Human
gucagggauucaagugcucac

SEQ ID NO: 435504 - RNA, 22 nt, Human
gucuggaagaaccugugccagu

SEQ ID NO: 435505 - RNA, 22 nt, Human
gcuuugcuaugacucaccagca

SEQ ID NO: 435506 - RNA, 22 nt, Human
guuugcauaaaguggaugcagg

SEQ ID NO: 435507 - RNA, 22 nt, Human
uuucauugagacuauagacauc

SEQ ID NO: 435508 - RNA, 22 nt, Human
gccaacagcugggugcaugucc

SEQ ID NO: 435509 - RNA, 22 nt, Human
uugcuuuauucacaucuauauu

SEQ ID NO: 435510 - RNA, 22 nt, Human
aggaaagauggaaggaggauaa

SEQ ID NO: 435511 - RNA, 23 nt, Human
cuggcuccgaagacuccaggauc

SEQ ID NO: 435512 - RNA, 22 nt, Human
aagcuaaguggaagucuuauca

SEQ ID NO: 435513 - RNA, 22 nt, Human
ccugcccuagagaugacacaau

SEQ ID NO: 435514 - RNA, 22 nt, Human
cucaggaguaguucagcagcug

SEQ ID NO: 435515 - RNA, 22 nt, Human
uggcugccuagucccucagccu

SEQ ID NO: 435516 - RNA, 22 nt, Human
cugggccuugaucacacaggug

SEQ ID NO: 435517 - RNA, 22 nt, Human
cgcaggcucgguucacagagca

SEQ ID NO: 435518 - RNA, 22 nt, Human
uacuucauuccuuuguaaaaug

SEQ ID NO: 435519 - RNA, 22 nt, Human
uggccugucuuguugugcuaga

SEQ ID NO: 435520 - RNA, 22 nt, Human
ccugagcaucagcgccuccuua

SEQ ID NO: 435521 - RNA, 22 nt, Human
gccugggaacucugaucuccug

SEQ ID NO: 435522 - RNA, 22 nt, Human
uuuuaguuguacugucaacagu

SEQ ID NO: 435523 - RNA, 22 nt, Human
gccaccagugggggccugggca

SEQ ID NO: 435524 - RNA, 22 nt, Human
ugcagaagaaugagcuuggagu

SEQ ID NO: 435525 - RNA, 20 nt, Human
ugcacagggugggaagcaac

SEQ ID NO: 435526 - RNA, 22 nt, Human
ccaccagcagugugcaaggauu

SEQ ID NO: 435527 - RNA, 18 nt, Human
cugaggcccagagagggc

SEQ ID NO: 435528 - RNA, 23 nt, Human
aaaugacauaugguuucugaagg

SEQ ID NO: 435529 - RNA, 19 nt, Human
cuggggcuuugguacugcc

SEQ ID NO: 435530 - RNA, 22 nt, Human
ccaguuuagguacuaggcucua

SEQ ID NO: 435531 - RNA, 18 nt, Human
ggagagugacagagucgu

SEQ ID NO: 435532 - RNA, 22 nt, Human
uucagugucaauuuuuaaauau

SEQ ID NO: 435533 - RNA, 22 nt, Human
agcuguuuguacuuagauagua

SEQ ID NO: 435534 - RNA, 22 nt, Human
gcagaacauuucacaguaucuu

SEQ ID NO: 435535 - RNA, 22 nt, Human
aguucaaacucuauaagaacuu

SEQ ID NO: 435536 - RNA, 22 nt, Human
ccugcagguccccggaugcgca

SEQ ID NO: 435537 - RNA, 22 nt, Human
aggaugagccgcgcaagcugac

SEQ ID NO: 435538 - RNA, 22 nt, Human
cucccagaaaauucucagacaa

SEQ ID NO: 435539 - RNA, 22 nt, Human
gacagagguguccuugagucca

SEQ ID NO: 435540 - RNA, 22 nt, Human
cccagccuuccacccuggacua

SEQ ID NO: 435541 - RNA, 22 nt, Human
gcucugccaaggacccauucuc

SEQ ID NO: 435542 - RNA, 22 nt, Human
augcauaugugugcacacgugu

SEQ ID NO: 435543 - RNA, 22 nt, Human
gaauauuaguaucaguuauacc

SEQ ID NO: 435544 - RNA, 22 nt, Human
ugcagcugaaaggacugaauga

SEQ ID NO: 435545 - RNA, 22 nt, Human
ugagcccaggaguuggaggcug

SEQ ID NO: 435546 - RNA, 22 nt, Human
caggcacacccacuggugcaga

SEQ ID NO: 435547 - RNA, 22 nt, Human
cauucaaaugugccacuguccu

SEQ ID NO: 435548 - RNA, 22 nt, Human
aggcuccuuguucaucauccau

SEQ ID NO: 435549 - RNA, 22 nt, Human
cacagaacaccaaagaaccuuc

SEQ ID NO: 435550 - RNA, 22 nt, Human
gagcacagaaggagaaauaugg

SEQ ID NO: 435551 - RNA, 22 nt, Human
agcugcccugggucuugcugcu

SEQ ID NO: 435552 - RNA, 22 nt, Human
agccuggagcuugaguuaugag

SEQ ID NO: 435553 - RNA, 22 nt, Human
ugcuugcuggaggcagacagaa

SEQ ID NO: 435554 - RNA, 22 nt, Human
auagcaacaccccaauuuucua

SEQ ID NO: 435555 - RNA, 22 nt, Human
aagccaaguuggaagacugaau

SEQ ID NO: 435556 - RNA, 22 nt, Human
cagcagaguaauucucaccucu

SEQ ID NO: 435557 - RNA, 22 nt, Human
cccagaaggcuugccaggaagc

SEQ ID NO: 435558 - RNA, 22 nt, Human
acauggaaaacuaacugcuuuu

SEQ ID NO: 435559 - RNA, 21 nt, Human
ugaugaggucauagcacccuc

SEQ ID NO: 435560 - RNA, 22 nt, Human
auguuuacaaaaaggaggcuug

SEQ ID NO: 435561 - RNA, 22 nt, Human
ugcccugugugugcaagcacug

SEQ ID NO: 435562 - RNA, 18 nt, Human
cuagggcuguggcucuca

SEQ ID NO: 435563 - RNA, 22 nt, Human
ucucugggaaauggagaauuuu

SEQ ID NO: 435564 - RNA, 22 nt, Human
gcguggugcugcccugcacaca

SEQ ID NO: 435565 - RNA, 22 nt, Human
ucccuggguucccguggaagug

SEQ ID NO: 435566 - RNA, 22 nt, Human
uuucaaacuccagcucaccaau

SEQ ID NO: 435567 - RNA, 23 nt, Human
ggagaggggugugggcaucuuua

SEQ ID NO: 435568 - RNA, 22 nt, Human
agagacaggauaucugcucaug

SEQ ID NO: 435569 - RNA, 22 nt, Human
aagccaauggauugguugcuuu

SEQ ID NO: 435570 - RNA, 22 nt, Human
agguggcagagcuggcccagcg

SEQ ID NO: 435571 - RNA, 22 nt, Human
caacaguguugcaaucugaaaa

SEQ ID NO: 435572 - RNA, 22 nt, Human
aaaguuuuagaacuaggaagca

SEQ ID NO: 435573 - RNA, 22 nt, Human
uaauauacuucccauaguuuga

SEQ ID NO: 435574 - RNA, 22 nt, Human
aggcuugacaauuuuacaugua

SEQ ID NO: 435575 - RNA, 22 nt, Human
gcacagccagcaucugagggau

SEQ ID NO: 435576 - RNA, 23 nt, Human
aggaaggagguccuaacaguauc

SEQ ID NO: 435577 - RNA, 22 nt, Human
aagaaaugcugauguuggaugg

SEQ ID NO: 435578 - RNA, 21 nt, Human
ugacugaggcuucuucacaca

SEQ ID NO: 435579 - RNA, 22 nt, Human
uaacuacuaauugaugauaaug

SEQ ID NO: 435580 - RNA, 22 nt, Human
caggcuggagugcaauggugcu

SEQ ID NO: 435581 - RNA, 22 nt, Human
gugcaguggcagauccuagcuc

SEQ ID NO: 435582 - RNA, 22 nt, Human
uucuuauauugggucauggaua

SEQ ID NO: 435583 - RNA, 22 nt, Human
ggcagccaugugggcagcgagu

SEQ ID NO: 435584 - RNA, 22 nt, Human
ugaggccucauuuagggagagg

SEQ ID NO: 435585 - RNA, 22 nt, Human
aagcagcuuaaauuagagccug

SEQ ID NO: 435586 - RNA, 22 nt, Human
ugcagcugcuugauucaucuug

SEQ ID NO: 435587 - RNA, 22 nt, Human
ugcacuauuucgccaugguugu

SEQ ID NO: 435588 - RNA, 22 nt, Human
gcaaacaucuuagccauagagu

SEQ ID NO: 435589 - RNA, 22 nt, Human
uaaugaggaaauagagggaaug

SEQ ID NO: 435590 - RNA, 22 nt, Human
uuucaguucaucugugaagauu

SEQ ID NO: 435591 - RNA, 22 nt, Human
aauaacuuuuaaaagacccugg

SEQ ID NO: 435592 - RNA, 22 nt, Human
agggaagcaggaauagcucuga

SEQ ID NO: 435593 - RNA, 22 nt, Human
auacaacugcucucagauaagu

SEQ ID NO: 435594 - RNA, 22 nt, Human
augaggauguuaguggacugga

SEQ ID NO: 435595 - RNA, 22 nt, Human
uggcucucuacaggucaagacc

SEQ ID NO: 435596 - RNA, 23 nt, Human
agcugaggcugugggugucagag

SEQ ID NO: 435597 - RNA, 22 nt, Human
aggagcagaacuguuguggagg

SEQ ID NO: 435598 - RNA, 18 nt, Human
gccaggaagaggaaugug

SEQ ID NO: 435599 - RNA, 22 nt, Human
ugacagcugagccccaggcaag

SEQ ID NO: 435600 - RNA, 22 nt, Human
ugaugaggcauaugcuacacau

SEQ ID NO: 435601 - RNA, 22 nt, Human
ucccaggauguuggcggcaggu

SEQ ID NO: 435602 - RNA, 22 nt, Human
uuucuaaaggguagauuuggcc

SEQ ID NO: 435603 - RNA, 22 nt, Human
guuccucauccagucaugacua

SEQ ID NO: 435604 - RNA, 22 nt, Human
auguaccagauguauguucuca

SEQ ID NO: 435605 - RNA, 22 nt, Human
ccugggccucacccagcucuug

SEQ ID NO: 435606 - RNA, 22 nt, Human
gugugccaacaaaagacagugc

SEQ ID NO: 435607 - RNA, 22 nt, Human
aggguccaucaaggacugcaca

SEQ ID NO: 435608 - RNA, 22 nt, Human
aaaaggcauuuugucaaccaua

SEQ ID NO: 435609 - RNA, 22 nt, Human
agcagagguuuguuggaaaccu

SEQ ID NO: 435610 - RNA, 22 nt, Human
gcccagggcagggcaagaguga

SEQ ID NO: 435611 - RNA, 22 nt, Human
uaggaauugcccgugggguccu

SEQ ID NO: 435612 - RNA, 17 nt, Human
uuuguacaacauuuuaa

SEQ ID NO: 435613 - RNA, 22 nt, Human
auaacuuauuagauuggagcug

SEQ ID NO: 435614 - RNA, 18 nt, Human
uggagcaggaagccuggc

SEQ ID NO: 435615 - RNA, 22 nt, Human
cagcugugcugauugcucagua

SEQ ID NO: 435616 - RNA, 22 nt, Human
gugccugugcggacucagggaa

SEQ ID NO: 435617 - RNA, 22 nt, Human
gagcccaggaaguggaggcuga

SEQ ID NO: 435618 - RNA, 22 nt, Human
cacagcaaagacacucucaacu

SEQ ID NO: 435619 - RNA, 22 nt, Human
auugcuuuugagcuagaauuuu

SEQ ID NO: 435620 - RNA, 23 nt, Human
uuuugcaauaagucacuggaaua

SEQ ID NO: 435621 - RNA, 22 nt, Human
uuuauuguguugaaacugaauu

SEQ ID NO: 435622 - RNA, 22 nt, Human
gggagcugagggaccucugugg

SEQ ID NO: 435623 - RNA, 22 nt, Human
ugcaaauugcaugauguguauc

SEQ ID NO: 435624 - RNA, 22 nt, Human
ggccuuggugccauggccaguu

SEQ ID NO: 435625 - RNA, 22 nt, Human
auaaggcaucucucaguuagca

SEQ ID NO: 435626 - RNA, 22 nt, Human
ugucccagcacuuugggagucu

SEQ ID NO: 435627 - RNA, 22 nt, Human
gaagcucuggacagugaagaag

SEQ ID NO: 435628 - RNA, 22 nt, Human
cauucaaaaugggcugaccugu

SEQ ID NO: 435629 - RNA, 22 nt, Human
cugcugggcuccucaugugacu

SEQ ID NO: 435630 - RNA, 22 nt, Human
gagcccugacacugagggaguu

SEQ ID NO: 435631 - RNA, 22 nt, Human
caggggcucccugggugccagu

SEQ ID NO: 435632 - RNA, 22 nt, Human
aauagcaauuacccuucaacuc

SEQ ID NO: 435633 - RNA, 22 nt, Human
ugucccagacauaaguggacau

SEQ ID NO: 435634 - RNA, 22 nt, Human
auuacuaugauuugaucauuac

SEQ ID NO: 435635 - RNA, 22 nt, Human
gggucuggacggcugcaggaag

SEQ ID NO: 435636 - RNA, 22 nt, Human
cauggcagagccugcagguggg

SEQ ID NO: 435637 - RNA, 22 nt, Human
gaagccaagggcugcuuuuccu

SEQ ID NO: 435638 - RNA, 21 nt, Human
ggauuuuaaaaacugcaccug

SEQ ID NO: 435639 - RNA, 22 nt, Human
uucaacuuuggagauuuaauaa

SEQ ID NO: 435640 - RNA, 22 nt, Human
uuucuauaugaggagcuaaagu

SEQ ID NO: 435641 - RNA, 22 nt, Human
uggccaggaggcugcuucugac

SEQ ID NO: 435642 - RNA, 22 nt, Human
cagcucugaggaacacuccuuu

SEQ ID NO: 435643 - RNA, 22 nt, Human
aagagucauagagacauugauu

SEQ ID NO: 435644 - RNA, 22 nt, Human
uucacauuucucugcuguuuga

SEQ ID NO: 435645 - RNA, 22 nt, Human
uucaguauaaaaucaaagugau

SEQ ID NO: 435646 - RNA, 21 nt, Human
aaagcagcccauggcacaguc

SEQ ID NO: 435647 - RNA, 22 nt, Human
gugcccugaucgcuaggcuccc

SEQ ID NO: 435648 - RNA, 22 nt, Human
aagccagcauuuucccauuccu

SEQ ID NO: 435649 - RNA, 22 nt, Human
ucagcagugucaguucccagag

SEQ ID NO: 435650 - RNA, 22 nt, Human
cugggcuguaauguggcacuga

SEQ ID NO: 435651 - RNA, 22 nt, Human
cuuucuaauucucccauagucu

SEQ ID NO: 435652 - RNA, 22 nt, Human
uaucagcaggccaaagcugcaa

SEQ ID NO: 435653 - RNA, 22 nt, Human
uuauugcaaccuuuucuggugu

SEQ ID NO: 435654 - RNA, 22 nt, Human
ugucugcuacuugguucuacca

SEQ ID NO: 435655 - RNA, 22 nt, Human
cacaagagagugcgcguugcaa

SEQ ID NO: 435656 - RNA, 22 nt, Human
gacagaggcaagaccagaagcc

SEQ ID NO: 435657 - RNA, 22 nt, Human
ugugcuauuugacuguuugcua

SEQ ID NO: 435658 - RNA, 22 nt, Human
cugucuccagggcaggugcagg

SEQ ID NO: 435659 - RNA, 22 nt, Human
ugcagaagaccuuccagggcug

SEQ ID NO: 435660 - RNA, 22 nt, Human
uguuaaaaauucagcucuagau

SEQ ID NO: 435661 - RNA, 22 nt, Human
ucaggaagccacuccacagaga

SEQ ID NO: 435662 - RNA, 22 nt, Human
cagagcugcuucccaguuugug

SEQ ID NO: 435663 - RNA, 22 nt, Human
gacagcagauaagaccucauca

SEQ ID NO: 435664 - RNA, 22 nt, Human
ugccuguccugaggaugagggu

SEQ ID NO: 435665 - RNA, 22 nt, Human
cacagaggcaugacccugcccu

SEQ ID NO: 435666 - RNA, 20 nt, Human
gcugccagugccugaugcuu

SEQ ID NO: 435667 - RNA, 21 nt, Human
aacaaagggaugcucaucuuu

SEQ ID NO: 435668 - RNA, 22 nt, Human
aaauacaauuucaggcuguaau

SEQ ID NO: 435669 - RNA, 22 nt, Human
aaaauucauggcuugggaaaag

SEQ ID NO: 435670 - RNA, 22 nt, Human
cccaggcucccaggugggacaa

SEQ ID NO: 435671 - RNA, 22 nt, Human
caggcagacauuuuugacauag

SEQ ID NO: 435672 - RNA, 22 nt, Human
uauaaauuauuaggcugcuaaa

SEQ ID NO: 435673 - RNA, 22 nt, Human
agcacaguggcuucuaugucua

SEQ ID NO: 435674 - RNA, 22 nt, Human
cuguccccgcgaguccagagcu

SEQ ID NO: 435675 - RNA, 22 nt, Human
gccagggaggcuguaggguccu

SEQ ID NO: 435676 - RNA, 22 nt, Human
caguuuguauuuauuacucaua

SEQ ID NO: 435677 - RNA, 22 nt, Human
cacaguacugcuuugggaugug

SEQ ID NO: 435678 - RNA, 22 nt, Human
gugcccuguugcacacuugagg

SEQ ID NO: 435679 - RNA, 20 nt, Human
gagggcacauuguuccgugc

SEQ ID NO: 435680 - RNA, 22 nt, Human
gcaagcaguuguggcuucugag

SEQ ID NO: 435681 - RNA, 19 nt, Human
ggccucugcaggccgcccc

SEQ ID NO: 435682 - RNA, 22 nt, Human
gcaguggcuaggagucuggcgu

SEQ ID NO: 435683 - RNA, 22 nt, Human
gggcagagagcuggaacuccuu

SEQ ID NO: 435684 - RNA, 22 nt, Human
aggagcugagucagcccgacag

SEQ ID NO: 435685 - RNA, 22 nt, Human
ucucagugcagcaaggaauuua

SEQ ID NO: 435686 - RNA, 19 nt, Human
cugggagguguucagagaa

SEQ ID NO: 435687 - RNA, 22 nt, Human
ccaggccugugcaaggagggag

SEQ ID NO: 435688 - RNA, 22 nt, Human
uggaugagggcugagcacuggg

SEQ ID NO: 435689 - RNA, 22 nt, Human
agcuaaggagcaaguaggaguu

SEQ ID NO: 435690 - RNA, 22 nt, Human
agcuggaagcugaugagcacag

SEQ ID NO: 435691 - RNA, 19 nt, Human
uccauggcucuucauccuu

SEQ ID NO: 435692 - RNA, 22 nt, Human
guccugguuuucacagaccuuu

SEQ ID NO: 435693 - RNA, 22 nt, Human
aggcagcuggacauaacuaacc

SEQ ID NO: 435694 - RNA, 21 nt, Human
agcauucugcuucuuuccugg

SEQ ID NO: 435695 - RNA, 20 nt, Human
agccaggcucaagcuccccc

SEQ ID NO: 435696 - RNA, 22 nt, Human
agagcuggggccagagucaagg

SEQ ID NO: 435697 - RNA, 22 nt, Human
ugagccugaguucaaggcugca

SEQ ID NO: 435698 - RNA, 21 nt, Human
ccugagccuguuuauccagaa

SEQ ID NO: 435699 - RNA, 22 nt, Human
uuugugaucuccucccucuaga

SEQ ID NO: 435700 - RNA, 22 nt, Human
ccagggcagcagaauuggggca

SEQ ID NO: 435701 - RNA, 22 nt, Human
gucccucugugucccugcaguc

SEQ ID NO: 435702 - RNA, 21 nt, Human
ggccauccugggaagggcugc

SEQ ID NO: 435703 - RNA, 22 nt, Human
aauaacuuguaugguuauucca

SEQ ID NO: 435704 - RNA, 22 nt, Human
uagcccuggagcagggaaauac

SEQ ID NO: 435705 - RNA, 22 nt, Human
auugagaaugcaaucuacuaug

SEQ ID NO: 435706 - RNA, 22 nt, Human
uaaugcaacgugagauaauuaa

SEQ ID NO: 435707 - RNA, 23 nt, Human
cauguacagaguuugauaaagug

SEQ ID NO: 435708 - RNA, 22 nt, Human
ccugagcucaaagggugccugg

SEQ ID NO: 435709 - RNA, 22 nt, Human
ggaagagagaucccauagaugu

SEQ ID NO: 435710 - RNA, 22 nt, Human
cagcccuggaacagcugacuca

SEQ ID NO: 435711 - RNA, 22 nt, Human
uuuucuccuaagacccuucacc

SEQ ID NO: 435712 - RNA, 22 nt, Human
cacaggaauauaaguuugaguu

SEQ ID NO: 435713 - RNA, 22 nt, Human
augcuuuauguucuggcauuuu

SEQ ID NO: 435714 - RNA, 22 nt, Human
auaaagacaugcuuacuugccc

SEQ ID NO: 435715 - RNA, 22 nt, Human
gaugcugagagguggagggaac

SEQ ID NO: 435716 - RNA, 22 nt, Human
auggacaaugccaauacaguuu

SEQ ID NO: 435717 - RNA, 22 nt, Human
uuccuuuucuuaaacauaugug

SEQ ID NO: 435718 - RNA, 22 nt, Human
ccagcccugccagagagagcug

SEQ ID NO: 435719 - RNA, 22 nt, Human
ucccagggauuaggacauggau

SEQ ID NO: 435720 - RNA, 22 nt, Human
agcccccaaaagugcuuaugau

SEQ ID NO: 435721 - RNA, 22 nt, Human
uccagccaugacucggacagug

SEQ ID NO: 435722 - RNA, 23 nt, Human
ucugggcaccuuguugacaugau

SEQ ID NO: 435723 - RNA, 22 nt, Human
acugggcuguggacacccagcg

SEQ ID NO: 435724 - RNA, 23 nt, Human
ccucagcauggcaggagcccagc

SEQ ID NO: 435725 - RNA, 22 nt, Human
caggcaauaaaggguugguugg

SEQ ID NO: 435726 - RNA, 22 nt, Human
auugcuuuguacaugccuagca

SEQ ID NO: 435727 - RNA, 22 nt, Human
agguaagguuuggaggcagugg

SEQ ID NO: 435728 - RNA, 22 nt, Human
ugcauauacccgcauuuacaua

SEQ ID NO: 435729 - RNA, 22 nt, Human
ggagaagccaggugauaagcaa

SEQ ID NO: 435730 - RNA, 22 nt, Human
cuuugcuuuacucccacugugu

SEQ ID NO: 435731 - RNA, 22 nt, Human
acaguaauuaaggucugaaacg

SEQ ID NO: 435732 - RNA, 22 nt, Human
acaggaagugggaagaaacagg

SEQ ID NO: 435733 - RNA, 22 nt, Human
aauaguuuuauaggugggauua

SEQ ID NO: 435734 - RNA, 22 nt, Human
ucugggugcccuuugcucuguu

SEQ ID NO: 435735 - RNA, 22 nt, Human
agagaauuaacauuccauggcu

SEQ ID NO: 435736 - RNA, 22 nt, Human
uuugggcacagauauuaaguau

SEQ ID NO: 435737 - RNA, 22 nt, Human
ggcagcagcaagguuggagcug

SEQ ID NO: 435738 - RNA, 22 nt, Human
acagcaacuccugcuucugagu

SEQ ID NO: 435739 - RNA, 17 nt, Human
ccauacugacauauuga

SEQ ID NO: 435740 - RNA, 22 nt, Human
cacagggcuaaaugaaggguug

SEQ ID NO: 435741 - RNA, 22 nt, Human
aggccaggccuuucuccauucc

SEQ ID NO: 435742 - RNA, 22 nt, Human
ugaugggaggugcugcaggacc

SEQ ID NO: 435743 - RNA, 23 nt, Human
accaacaagccucuggagagugg

SEQ ID NO: 435744 - RNA, 22 nt, Human
cccagagaaucuuucagaaagg

SEQ ID NO: 435745 - RNA, 22 nt, Human
gcagggcucugcuguaguccua

SEQ ID NO: 435746 - RNA, 22 nt, Human
uucugaaaccuucaguaugaag

SEQ ID NO: 435747 - RNA, 21 nt, Human
uccagccaguaaaugcucagc

SEQ ID NO: 435748 - RNA, 22 nt, Human
ucucacucauuuccuaggucuu

SEQ ID NO: 435749 - RNA, 17 nt, Human
cccagcuggcagugccg

SEQ ID NO: 435750 - RNA, 22 nt, Human
uggggacauagccagucuggcu

SEQ ID NO: 435751 - RNA, 22 nt, Human
guccagccccugacucccaggc

SEQ ID NO: 435752 - RNA, 22 nt, Human
gggcacagaagucuaagacauc

SEQ ID NO: 435753 - RNA, 20 nt, Human
uuccuguaaccggcagcugc

SEQ ID NO: 435754 - RNA, 21 nt, Human
cagacaugagucucagcuuug

SEQ ID NO: 435755 - RNA, 22 nt, Human
acaggccuuaggagagaugggg

SEQ ID NO: 435756 - RNA, 22 nt, Human
cacuggcuaugagggagauggg

SEQ ID NO: 435757 - RNA, 22 nt, Human
ccaggaggugcuggaagaaagc

SEQ ID NO: 435758 - RNA, 22 nt, Human
gcugccaugccacagcacucac

SEQ ID NO: 435759 - RNA, 17 nt, Human
aagacagaagccaugag

SEQ ID NO: 435760 - RNA, 22 nt, Human
agcagcugggcucagagcuggg

SEQ ID NO: 435761 - RNA, 22 nt, Human
uaucuagauuucuuucucugug

SEQ ID NO: 435762 - RNA, 22 nt, Human
uugcaaaugguaccaagggucu

SEQ ID NO: 435763 - RNA, 22 nt, Human
uaaggacauuagaaaugaugcu

SEQ ID NO: 435764 - RNA, 22 nt, Human
agccauccuccacagccuugau

SEQ ID NO: 435765 - RNA, 22 nt, Human
agugaaaagaugcauuucucug

SEQ ID NO: 435766 - RNA, 22 nt, Human
gacagagaggcugagcaguaca

SEQ ID NO: 435767 - RNA, 22 nt, Human
ugccaggccucaggagucucca

SEQ ID NO: 435768 - RNA, 22 nt, Human
gcccagccagagcugugugaug

SEQ ID NO: 435769 - RNA, 22 nt, Human
uuuauccauugguuagaaaauc

SEQ ID NO: 435770 - RNA, 22 nt, Human
gccuggagcucaugugggcauu

SEQ ID NO: 435771 - RNA, 22 nt, Human
ccacugcucugccaggagcugg

SEQ ID NO: 435772 - RNA, 18 nt, Human
agagacagcagcaaaaga

SEQ ID NO: 435773 - RNA, 22 nt, Human
cccagccuacucugccauagca

SEQ ID NO: 435774 - RNA, 21 nt, Human
uccaggccaugguggggaggc

SEQ ID NO: 435775 - RNA, 20 nt, Human
gcuucaaagccauccuuuua

SEQ ID NO: 435776 - RNA, 22 nt, Human
ugggcagacugagcccuguccc

SEQ ID NO: 435777 - RNA, 22 nt, Human
caggcagggagcuggaaaggau

SEQ ID NO: 435778 - RNA, 22 nt, Human
uggcaguggcucagagugcaga

SEQ ID NO: 435779 - RNA, 22 nt, Human
aaguuucuguucauaucucuga

SEQ ID NO: 435780 - RNA, 23 nt, Human
caguacuuaguguagcguuaauu

SEQ ID NO: 435781 - RNA, 22 nt, Human
cuuuacugaagugaagaccugg

SEQ ID NO: 435782 - RNA, 22 nt, Human
auccaguucuuggaagcacagg

SEQ ID NO: 435783 - RNA, 22 nt, Human
guauaucuucagaaauuauagg

SEQ ID NO: 435784 - RNA, 22 nt, Human
gcagacagcauguugggcuauu

SEQ ID NO: 435785 - RNA, 22 nt, Human
ugaggccacuuccccacagccc

SEQ ID NO: 435786 - RNA, 22 nt, Human
aguacuuucuuccgagagagaa

SEQ ID NO: 435787 - RNA, 22 nt, Human
aauuucaaacucuugcccucag

SEQ ID NO: 435788 - RNA, 22 nt, Human
ccugagcugaacuaagcaguuu

SEQ ID NO: 435789 - RNA, 21 nt, Human
agagaagaggacuuucucaca

SEQ ID NO: 435790 - RNA, 22 nt, Human
acaggaaauuggcauaucaguu

SEQ ID NO: 435791 - RNA, 22 nt, Human
caaagggcauggccugagcacu

SEQ ID NO: 435792 - RNA, 22 nt, Human
gggcuggaggugagcaggacag

SEQ ID NO: 435793 - RNA, 22 nt, Human
caggaagggggauccuuggaag

SEQ ID NO: 435794 - RNA, 22 nt, Human
uaucugaacaaccuuuauuacu

SEQ ID NO: 435795 - RNA, 22 nt, Human
gccagccugugggggcucugug

SEQ ID NO: 435796 - RNA, 22 nt, Human
cucucagaagcuuccaguaugg

SEQ ID NO: 435797 - RNA, 22 nt, Human
agcagcagggucauugcucuuu

SEQ ID NO: 435798 - RNA, 19 nt, Human
acauuuaaauucagaucuc

SEQ ID NO: 435799 - RNA, 22 nt, Human
aauuuaacugagaguacuuuua

SEQ ID NO: 435800 - RNA, 22 nt, Human
uugcugaugcccuuguccaggc

SEQ ID NO: 435801 - RNA, 22 nt, Human
agcaacagcaacgacauuucuc

SEQ ID NO: 435802 - RNA, 22 nt, Human
acaguauauauagucuaaaagc

SEQ ID NO: 435803 - RNA, 22 nt, Human
uagcacaaguaucugcuuuucc

SEQ ID NO: 435804 - RNA, 22 nt, Human
agcugccaggccccugagaacc

SEQ ID NO: 435805 - RNA, 22 nt, Human
ccuguucaccauggucacgugc

SEQ ID NO: 435806 - RNA, 22 nt, Human
ucagcacuuuuuaaagcagcau

SEQ ID NO: 435807 - RNA, 22 nt, Human
uauucagaguguagcaaauaga

SEQ ID NO: 435808 - RNA, 22 nt, Human
uuccaaagucauguugcugaua

SEQ ID NO: 435809 - RNA, 22 nt, Human
ugcaaauuugagcagacuguuc

SEQ ID NO: 435810 - RNA, 23 nt, Human
ugugacagggucauugaaaaggg

SEQ ID NO: 435811 - RNA, 22 nt, Human
uggagcugggguuugaaucugg

SEQ ID NO: 435812 - RNA, 22 nt, Human
uaaaugcuuagauucauagaaa

SEQ ID NO: 435813 - RNA, 22 nt, Human
ggcaggaauaaauuauggacuu

SEQ ID NO: 435814 - RNA, 22 nt, Human
uggcacuggaaucguagccuug

SEQ ID NO: 435815 - RNA, 22 nt, Human
caguacuucuuggaaacuggau

SEQ ID NO: 435816 - RNA, 18 nt, Human
cacaauuuacagaugaca

SEQ ID NO: 435817 - RNA, 22 nt, Human
cuucagcagccucuugcauaaa

SEQ ID NO: 435818 - RNA, 22 nt, Human
ucugucacccaggcuggagugc

SEQ ID NO: 435819 - RNA, 22 nt, Human
uucaaaauuguucuaagcucug

SEQ ID NO: 435820 - RNA, 22 nt, Human
gccucugcucucagguagccuc

SEQ ID NO: 435821 - RNA, 22 nt, Human
ugcccaggcuggagugcagagg

SEQ ID NO: 435822 - RNA, 22 nt, Human
ugcccagcuauuccuuucuuag

SEQ ID NO: 435823 - RNA, 22 nt, Human
cagcccuguugcgcuuccggcg

SEQ ID NO: 435824 - RNA, 22 nt, Human
uugcccaccauccaauaaaaug

SEQ ID NO: 435825 - RNA, 22 nt, Human
cagacagggaccucgcuccaga

SEQ ID NO: 435826 - RNA, 23 nt, Human
cuagaauuuugcuaaaagacuag

SEQ ID NO: 435827 - RNA, 22 nt, Human
gagcagagacaguacaacuggc

SEQ ID NO: 435828 - RNA, 22 nt, Human
uccauuuucaucucauguauaa

SEQ ID NO: 435829 - RNA, 22 nt, Human
gggcacuggaaggcucucaggc

SEQ ID NO: 435830 - RNA, 22 nt, Human
agaacaucugaagauacaaagu

SEQ ID NO: 435831 - RNA, 22 nt, Human
uucagcacuggacagcgagucu

SEQ ID NO: 435832 - RNA, 22 nt, Human
ccucaaaggccuggcaccagaa

SEQ ID NO: 435833 - RNA, 21 nt, Human
uuuagcauuuacauauuucca

SEQ ID NO: 435834 - RNA, 20 nt, Human
ucagcccugaguccaggcug

SEQ ID NO: 435835 - RNA, 22 nt, Human
caggagcaaggagcagugggau

SEQ ID NO: 435836 - RNA, 22 nt, Human
uggcucuguugugcugagccag

SEQ ID NO: 435837 - RNA, 22 nt, Human
cugagcugggacucaguagcaa

SEQ ID NO: 435838 - RNA, 22 nt, Human
uucuggaaguguuagaaucugg

SEQ ID NO: 435839 - RNA, 22 nt, Human
cugggcuggacacacuuaaccu

SEQ ID NO: 435840 - RNA, 22 nt, Human
aaagacuuggcuuaugauuugc

SEQ ID NO: 435841 - RNA, 22 nt, Human
agcugccagaugacagugcuau

SEQ ID NO: 435842 - RNA, 22 nt, Human
aagagagggauuugguuuauug

SEQ ID NO: 435843 - RNA, 20 nt, Human
aacaguaccccccuuguucu

SEQ ID NO: 435844 - RNA, 22 nt, Human
uggcagcugucagaaugcaaau

SEQ ID NO: 435845 - RNA, 22 nt, Human
agaaaugcucaggucaacuuaa

SEQ ID NO: 435846 - RNA, 22 nt, Human
aggcugggaaaccugaaguugu

SEQ ID NO: 435847 - RNA, 22 nt, Human
gcccaugggccugaggcccuag

SEQ ID NO: 435848 - RNA, 19 nt, Human
ccaguagagacagcugcag

SEQ ID NO: 435849 - RNA, 22 nt, Human
agcuggugugcucuggaauccu

SEQ ID NO: 435850 - RNA, 22 nt, Human
cauucaaagcaggaaaggccuu

SEQ ID NO: 435851 - RNA, 22 nt, Human
uuauugcagauggugugagaga

SEQ ID NO: 435852 - RNA, 22 nt, Human
ucugaggcuaagagacagaggc

SEQ ID NO: 435853 - RNA, 22 nt, Human
ccuccccacagcccaggagacu

SEQ ID NO: 435854 - RNA, 22 nt, Human
acauggaagcaaaguucuauuu

SEQ ID NO: 435855 - RNA, 19 nt, Human
cagcaagaaugaaggcaua

SEQ ID NO: 435856 - RNA, 22 nt, Human
agauuuuauagauaauuuccca

SEQ ID NO: 435857 - RNA, 22 nt, Human
gggaaaaauaaugcacagauau

SEQ ID NO: 435858 - RNA, 23 nt, Human
agucagagagugugagacaacug

SEQ ID NO: 435859 - RNA, 22 nt, Human
cuuugcaugugguagaagguuc

SEQ ID NO: 435860 - RNA, 22 nt, Human
gauuuucuugggaaacaaugag

SEQ ID NO: 435861 - RNA, 22 nt, Human
uucagagaacuucauggaagag

SEQ ID NO: 435862 - RNA, 22 nt, Human
cccuccaggcacugcccucuuc

SEQ ID NO: 435863 - RNA, 22 nt, Human
gccucagcucccagcccaggcu

SEQ ID NO: 435864 - RNA, 22 nt, Human
uaaggaaaauggacaucaaaca

SEQ ID NO: 435865 - RNA, 22 nt, Human
uuuucauuguuccucgagcauu

SEQ ID NO: 435866 - RNA, 22 nt, Human
ucacaguacuccccaaaguuuc

SEQ ID NO: 435867 - RNA, 22 nt, Human
gggagcuggagcuggaagacuc

SEQ ID NO: 435868 - RNA, 21 nt, Human
gaugauggcaggcagcacugg

SEQ ID NO: 435869 - RNA, 22 nt, Human
uuggcucaggaccccugugacu

SEQ ID NO: 435870 - RNA, 22 nt, Human
cccaggccccagggcuugucag

SEQ ID NO: 435871 - RNA, 22 nt, Human
ucaacaaugggucuguaaugga

SEQ ID NO: 435872 - RNA, 22 nt, Human
cucugggcaccaaagagcagcu

SEQ ID NO: 435873 - RNA, 22 nt, Human
gcagggcuaauggggcaaguag

SEQ ID NO: 435874 - RNA, 22 nt, Human
aauugcuuagagaauccaggua

SEQ ID NO: 435875 - RNA, 22 nt, Human
auguuauuaaaguacagauucu

SEQ ID NO: 435876 - RNA, 22 nt, Human
uguacagagguguacauaugau

SEQ ID NO: 435877 - RNA, 22 nt, Human
aauauccagguagaugucuucu

SEQ ID NO: 435878 - RNA, 22 nt, Human
acuuucucaaaucagacuuuaa

SEQ ID NO: 435879 - RNA, 22 nt, Human
auacacuggccuuugcagagcc

SEQ ID NO: 435880 - RNA, 22 nt, Human
uggccagguguggguucucaga

SEQ ID NO: 435881 - RNA, 22 nt, Human
ccccaggagauuugggagcaca

SEQ ID NO: 435882 - RNA, 22 nt, Human
aguuuccuugggcauuuguuua

SEQ ID NO: 435883 - RNA, 22 nt, Human
aacaguuugccugaaauguauu

SEQ ID NO: 435884 - RNA, 23 nt, Human
ucugcucugaaguucggcugagc

SEQ ID NO: 435885 - RNA, 23 nt, Human
uauggcuuacagugcuuuaggua

SEQ ID NO: 435886 - RNA, 22 nt, Human
uggagaugccuggagauuaggg

SEQ ID NO: 435887 - RNA, 22 nt, Human
uuacagacaaacuguguuaagu

SEQ ID NO: 435888 - RNA, 22 nt, Human
agcagcugugggcaauauguaa

SEQ ID NO: 435889 - RNA, 22 nt, Human
uccuguggaagacaguguuggg

SEQ ID NO: 435890 - RNA, 22 nt, Human
ucagcaggcccauccuccaggc

SEQ ID NO: 435891 - RNA, 22 nt, Human
acauucaaguuucugcucaugg

SEQ ID NO: 435892 - RNA, 22 nt, Human
uugccuuauagugcucugcauu

SEQ ID NO: 435893 - RNA, 22 nt, Human
agccugggcaacaacacagcga

SEQ ID NO: 435894 - RNA, 22 nt, Human
uucuuuuaaaagagagcagaaa

SEQ ID NO: 435895 - RNA, 22 nt, Human
caggccucccggugcacacuga

SEQ ID NO: 435896 - RNA, 22 nt, Human
auuacaauaauacaugcucauu

SEQ ID NO: 435897 - RNA, 22 nt, Human
ucaggcugaaucauccuagcuu

SEQ ID NO: 435898 - RNA, 22 nt, Human
cagagugggcugucagccacca

SEQ ID NO: 435899 - RNA, 22 nt, Human
ucagaggaaagggaacauaguc

SEQ ID NO: 435900 - RNA, 22 nt, Human
uuuauauaacagagacugcuau

SEQ ID NO: 435901 - RNA, 22 nt, Human
auuauuguacuuucaauaaggu

SEQ ID NO: 435902 - RNA, 22 nt, Human
agggcagccugagugcuggccc

SEQ ID NO: 435903 - RNA, 22 nt, Human
uuauacagggaguuucccugca

SEQ ID NO: 435904 - RNA, 22 nt, Human
caucugguuuaaaagaagaaag

SEQ ID NO: 435905 - RNA, 22 nt, Human
cuggggcugcggacgggagccc

SEQ ID NO: 435906 - RNA, 22 nt, Human
gacacagagauaggccuguguu

SEQ ID NO: 435907 - RNA, 22 nt, Human
ucuguaucacccguucccagaa

SEQ ID NO: 435908 - RNA, 20 nt, Human
gaauuuuaugaacacuacca

SEQ ID NO: 435909 - RNA, 22 nt, Human
ucaaaggaauuugauuuugaug

SEQ ID NO: 435910 - RNA, 22 nt, Human
ucaaguguaguggugucagguc

SEQ ID NO: 435911 - RNA, 22 nt, Human
aggaagccugcaggugacugcu

SEQ ID NO: 435912 - RNA, 22 nt, Human
cuggauuuugaugagcaguuuu

SEQ ID NO: 435913 - RNA, 22 nt, Human
ggcacagcaccuuuucacauug

SEQ ID NO: 435914 - RNA, 22 nt, Human
cucagaggcaagcaaggagcug

SEQ ID NO: 435915 - RNA, 22 nt, Human
ucagaauucuacaauagaucag

SEQ ID NO: 435916 - RNA, 22 nt, Human
auuccaaaaggauguuagaaug

SEQ ID NO: 435917 - RNA, 22 nt, Human
cuguccuaugaguacucacuag

SEQ ID NO: 435918 - RNA, 22 nt, Human
caggccucaugguguguccuuc

SEQ ID NO: 435919 - RNA, 22 nt, Human
auuucccaggacuagaaauaua

SEQ ID NO: 435920 - RNA, 17 nt, Human
ucugagaacuugaagca

SEQ ID NO: 435921 - RNA, 22 nt, Human
cuagagaauugucuugagaguu

SEQ ID NO: 435922 - RNA, 22 nt, Human
uaagacaagccucgcauuugua

SEQ ID NO: 435923 - RNA, 22 nt, Human
uccugaagucacaggcucugag

SEQ ID NO: 435924 - RNA, 22 nt, Human
caagcuccuuacauccacaggg

SEQ ID NO: 435925 - RNA, 22 nt, Human
cagagggaguuucugagguugc

SEQ ID NO: 435926 - RNA, 22 nt, Human
aggcugucaucuuugcaggcag

SEQ ID NO: 435927 - RNA, 18 nt, Human
cuccccagcugcccccag

SEQ ID NO: 435928 - RNA, 22 nt, Human
uggcagauguauaucacagcuu

SEQ ID NO: 435929 - RNA, 22 nt, Human
gagcacaggcugcugugaacug

SEQ ID NO: 435930 - RNA, 22 nt, Human
gagcaggccuggggugaggccu

SEQ ID NO: 435931 - RNA, 22 nt, Human
aguauuuucgccaucacaagaa

SEQ ID NO: 435932 - RNA, 22 nt, Human
guugcaaacuccuacuucucau

SEQ ID NO: 435933 - RNA, 22 nt, Human
uguacacaauucuuaacauaca

SEQ ID NO: 435934 - RNA, 22 nt, Human
acuguguggaaauuugugaggg

SEQ ID NO: 435935 - RNA, 22 nt, Human
cuagagaaucuuuuaagaagug

SEQ ID NO: 435936 - RNA, 22 nt, Human
acacagaagcuuuuucuauucc

SEQ ID NO: 435937 - RNA, 21 nt, Human
uggcuuugcccugcuugcccc

SEQ ID NO: 435938 - RNA, 22 nt, Human
caggcccauucuaggcuugcua

SEQ ID NO: 435939 - RNA, 22 nt, Human
agacacagaacacaaaagcaua

SEQ ID NO: 435940 - RNA, 22 nt, Human
ucugcccaccagcgguugcaua

SEQ ID NO: 435941 - RNA, 21 nt, Human
uucugccuucgaggucucagg

SEQ ID NO: 435942 - RNA, 22 nt, Human
aggcagcuggaaaacuccaggc

SEQ ID NO: 435943 - RNA, 22 nt, Human
aaguuuaacuugaauucuuucu

SEQ ID NO: 435944 - RNA, 22 nt, Human
acagcaggaagcuggagggaaa

SEQ ID NO: 435945 - RNA, 22 nt, Human
ugaugggaaaaugaggccuggg

SEQ ID NO: 435946 - RNA, 22 nt, Human
cugacucuccucaagcauaaau

SEQ ID NO: 435947 - RNA, 22 nt, Human
ccaagggaaaccgagaggcugg

SEQ ID NO: 435948 - RNA, 22 nt, Human
auguaggauugagugauagagg

SEQ ID NO: 435949 - RNA, 22 nt, Human
gugggacucuucuuuggcagug

SEQ ID NO: 435950 - RNA, 22 nt, Human
cugggaggcagucucucuagaa

SEQ ID NO: 435951 - RNA, 17 nt, Human
caacuucacaaacuguc

SEQ ID NO: 435952 - RNA, 22 nt, Human
ccugacucuggccaggccagcu

SEQ ID NO: 435953 - RNA, 22 nt, Human
uggccugguaccacauagauuu

SEQ ID NO: 435954 - RNA, 22 nt, Human
ucaaaggguccuuaacaugaga

SEQ ID NO: 435955 - RNA, 22 nt, Human
agcuggccuguuagagcugagu

SEQ ID NO: 435956 - RNA, 22 nt, Human
caagcaaugcccugguauauua

SEQ ID NO: 435957 - RNA, 22 nt, Human
uggagcccagggugagaaggag

SEQ ID NO: 435958 - RNA, 22 nt, Human
agcagggcagugcuucagcucu

SEQ ID NO: 435959 - RNA, 22 nt, Human
uaacaucuugcaguagcagaac

SEQ ID NO: 435960 - RNA, 22 nt, Human
cagagcugcaaaugccccuccg

SEQ ID NO: 435961 - RNA, 22 nt, Human
gcagcccuaaccugucauagug

SEQ ID NO: 435962 - RNA, 22 nt, Human
ggguccagcgacagcaggcuca

SEQ ID NO: 435963 - RNA, 22 nt, Human
ccagaggacuugggggcugaau

SEQ ID NO: 435964 - RNA, 22 nt, Human
gcugcagggagcuggaaggcuc

SEQ ID NO: 435965 - RNA, 22 nt, Human
acuuugcaaugggcagaaccca

SEQ ID NO: 435966 - RNA, 22 nt, Human
cuggugggaggcaagguggaag

SEQ ID NO: 435967 - RNA, 22 nt, Human
agaauacccaucccuucaacuc

SEQ ID NO: 435968 - RNA, 22 nt, Human
ggccuggaagaggacagagaaa

SEQ ID NO: 435969 - RNA, 22 nt, Human
cauggaaggcaaaagacacaga

SEQ ID NO: 435970 - RNA, 22 nt, Human
gccaggcagccacccucugcga

SEQ ID NO: 435971 - RNA, 22 nt, Human
auugcagcucagggugaugacu

SEQ ID NO: 435972 - RNA, 22 nt, Human
gcagcaggcacggucucgacau

SEQ ID NO: 435973 - RNA, 22 nt, Human
gaugcauugcaucgaguagcuu

SEQ ID NO: 435974 - RNA, 22 nt, Human
ucccagcagggccgaccagccu

SEQ ID NO: 435975 - RNA, 22 nt, Human
uuugggcauuaguaaguuaagc

SEQ ID NO: 435976 - RNA, 22 nt, Human
cuugcagccuuaccaaggcauu

SEQ ID NO: 435977 - RNA, 22 nt, Human
auguacaauuuuugcuuagggg

SEQ ID NO: 435978 - RNA, 22 nt, Human
augcauugucaggcaauuucau

SEQ ID NO: 435979 - RNA, 22 nt, Human
agucccagcuucccccaugcag

SEQ ID NO: 435980 - RNA, 22 nt, Human
aggcccuaauccaacaugacug

SEQ ID NO: 435981 - RNA, 22 nt, Human
gcagggcugggugggagacaga

SEQ ID NO: 435982 - RNA, 17 nt, Human
ggugaguguccaggugg

SEQ ID NO: 435983 - RNA, 21 nt, Human
augcauauuuuaaguuguguc

SEQ ID NO: 435984 - RNA, 22 nt, Human
gacaggaacauaaauguaggag

SEQ ID NO: 435985 - RNA, 22 nt, Human
gacuccucagucacccucagcu

SEQ ID NO: 435986 - RNA, 22 nt, Human
ggacagggcucuuggcacuccu

SEQ ID NO: 435987 - RNA, 22 nt, Human
uuuccucacuucaugagaguuu

SEQ ID NO: 435988 - RNA, 22 nt, Human
aagcugccuugcugaggagaaa

SEQ ID NO: 435989 - RNA, 22 nt, Human
gcugggcuggaaggccaaggca

SEQ ID NO: 435990 - RNA, 22 nt, Human
acaaguuccacuacagaguugu

SEQ ID NO: 435991 - RNA, 22 nt, Human
agaauuuagcuccuuggucaua

SEQ ID NO: 435992 - RNA, 22 nt, Human
agucugaaccagauggcaaggu

SEQ ID NO: 435993 - RNA, 21 nt, Human
ugaggccugccagucucagaa

SEQ ID NO: 435994 - RNA, 22 nt, Human
agcaacagcccuguuucauuag

SEQ ID NO: 435995 - RNA, 18 nt, Human
cccagcuccacuucccuc

SEQ ID NO: 435996 - RNA, 22 nt, Human
aacauugcauucucuaugagau

SEQ ID NO: 435997 - RNA, 22 nt, Human
aggaauuuagacagggcauaaa

SEQ ID NO: 435998 - RNA, 22 nt, Human
ucuucagauugcacugagcaag

SEQ ID NO: 435999 - RNA, 22 nt, Human
ucuucuuugaaucauagugacc

SEQ ID NO: 436000 - RNA, 22 nt, Human
ccuucuugagguagcacauucu

SEQ ID NO: 436001 - RNA, 22 nt, Human
uucuggaaguggaauuuuugua

SEQ ID NO: 436002 - RNA, 22 nt, Human
ggcuuugcauuuugauggaggu

SEQ ID NO: 436003 - RNA, 22 nt, Human
caggguggaauggaaugcuggc

SEQ ID NO: 436004 - RNA, 22 nt, Human
aauguacacugaaagccuauca

SEQ ID NO: 436005 - RNA, 22 nt, Human
ggcagccauacucagaccuggg

SEQ ID NO: 436006 - RNA, 22 nt, Human
caaaugaauuucccugcaaaug

SEQ ID NO: 436007 - RNA, 22 nt, Human
ccaggcagggcucaaggaaccu

SEQ ID NO: 436008 - RNA, 22 nt, Human
guucaaaucucaggacuucaga

SEQ ID NO: 436009 - RNA, 19 nt, Human
cuggugaggguuauugaua

SEQ ID NO: 436010 - RNA, 22 nt, Human
gcagagugggagcccagggcug

SEQ ID NO: 436011 - RNA, 17 nt, Human
gcuccaggcgugaguga

SEQ ID NO: 436012 - RNA, 22 nt, Human
agcagcuguggggacaagggua

SEQ ID NO: 436013 - RNA, 22 nt, Human
uuucucaguaauguccuggaau

SEQ ID NO: 436014 - RNA, 22 nt, Human
uuauugcaccuuccucacuaac

SEQ ID NO: 436015 - RNA, 19 nt, Human
gagggcucauuugaacaau

SEQ ID NO: 436016 - RNA, 22 nt, Human
gcuggcugggucccugagaggc

SEQ ID NO: 436017 - RNA, 22 nt, Human
ggcacagggagccgcaguugca

SEQ ID NO: 436018 - RNA, 20 nt, Human
uacaauacacaugcauauga

SEQ ID NO: 436019 - RNA, 22 nt, Human
gccucaggccgcccugcugcuc

SEQ ID NO: 436020 - RNA, 22 nt, Human
aggcaacaaggguagucaguga

SEQ ID NO: 436021 - RNA, 22 nt, Human
ucaggccuagaacacagcagau

SEQ ID NO: 436022 - RNA, 22 nt, Human
uuguaaauaguaguaagaugcc

SEQ ID NO: 436023 - RNA, 22 nt, Human
ggcucugcaugcagguugucag

SEQ ID NO: 436024 - RNA, 22 nt, Human
cuuaaauucuuaaugcccucau

SEQ ID NO: 436025 - RNA, 22 nt, Human
cccagcaugcacgcugacacuc

SEQ ID NO: 436026 - RNA, 22 nt, Human
cuauaaaucuacccagcauugg

SEQ ID NO: 436027 - RNA, 22 nt, Human
caggcacuucugcugcuugucu

SEQ ID NO: 436028 - RNA, 22 nt, Human
acacagaguccuuacugaggua

SEQ ID NO: 436029 - RNA, 22 nt, Human
caucaaaucugacuuuucuucc

SEQ ID NO: 436030 - RNA, 22 nt, Human
aggcuggucuauacggagacga

SEQ ID NO: 436031 - RNA, 22 nt, Human
ccaggcagcucugauuuauguc

SEQ ID NO: 436032 - RNA, 22 nt, Human
cacaggaaauauuaggagggau

SEQ ID NO: 436033 - RNA, 23 nt, Human
acauuacuuagccagagucucag

SEQ ID NO: 436034 - RNA, 22 nt, Human
gagcccuguucaggccuccuca

SEQ ID NO: 436035 - RNA, 22 nt, Human
cauuuguauagugcuuagacca

SEQ ID NO: 436036 - RNA, 22 nt, Human
gacagacagggguucuccugga

SEQ ID NO: 436037 - RNA, 22 nt, Human
augggaggcaggcucagaaccg

SEQ ID NO: 436038 - RNA, 22 nt, Human
uuagaaauacaagugagguuga

SEQ ID NO: 436039 - RNA, 22 nt, Human
aaggcuggguuugggaugugau

SEQ ID NO: 436040 - RNA, 22 nt, Human
augcaacagagaaaauauugag

SEQ ID NO: 436041 - RNA, 22 nt, Human
agucuugucuuauuuuaauaga

SEQ ID NO: 436042 - RNA, 22 nt, Human
ucuuggcuacuuaggaggauuc

SEQ ID NO: 436043 - RNA, 22 nt, Human
uuccaaguguugagauuagagg

SEQ ID NO: 436044 - RNA, 22 nt, Human
aaaaguucccugguuagaaaag

SEQ ID NO: 436045 - RNA, 23 nt, Human
auuuuacaggucaguuccuugaa

SEQ ID NO: 436046 - RNA, 22 nt, Human
uggccuggggaccugugagacc

SEQ ID NO: 436047 - RNA, 22 nt, Human
aaguuucuguaugcucuucugu

SEQ ID NO: 436048 - RNA, 22 nt, Human
aggaauguauuauuccuucugg

SEQ ID NO: 436049 - RNA, 22 nt, Human
auauuaagaugcuauugguuuu

SEQ ID NO: 436050 - RNA, 22 nt, Human
aaguauucuggcagucauucag

SEQ ID NO: 436051 - RNA, 21 nt, Human
ggaagcaguggcggcaacucc

SEQ ID NO: 436052 - RNA, 22 nt, Human
ggugccaggcucccagcucagg

SEQ ID NO: 436053 - RNA, 22 nt, Human
ucagauuuuauuuuccuguuac

SEQ ID NO: 436054 - RNA, 22 nt, Human
cagacaugauguaagcagaggc

SEQ ID NO: 436055 - RNA, 21 nt, Human
aggcagcgugagggccacuca

SEQ ID NO: 436056 - RNA, 22 nt, Human
cuuccucaugugcaaugcaagc

SEQ ID NO: 436057 - RNA, 22 nt, Human
agcagggggccacagucacagc

SEQ ID NO: 436058 - RNA, 22 nt, Human
gugagaagauaaguauugcaaa

SEQ ID NO: 436059 - RNA, 22 nt, Human
agcaggcuuucaagagucuucu

SEQ ID NO: 436060 - RNA, 22 nt, Human
cgguccuggcacuugcggcucc

SEQ ID NO: 436061 - RNA, 22 nt, Human
cuguuucaagugaagucagaca

SEQ ID NO: 436062 - RNA, 17 nt, Human
agcugccagggagugug

SEQ ID NO: 436063 - RNA, 22 nt, Human
ccaagagguugaggcugcagug

SEQ ID NO: 436064 - RNA, 22 nt, Human
ugcugucaguuggcaggaugag

SEQ ID NO: 436065 - RNA, 22 nt, Human
aagcugccagcugagcugaggc

SEQ ID NO: 436066 - RNA, 22 nt, Human
uggaaggcauuucacacaggau

SEQ ID NO: 436067 - RNA, 22 nt, Human
ggaccugccagaacucaggcua

SEQ ID NO: 436068 - RNA, 22 nt, Human
gaggcuggugguuaguuccauu

SEQ ID NO: 436069 - RNA, 22 nt, Human
uggucccuaggaaagcaguguu

SEQ ID NO: 436070 - RNA, 22 nt, Human
ugaagcaggguggccagauugu

SEQ ID NO: 436071 - RNA, 20 nt, Human
cagagcuguuauggaugaug

SEQ ID NO: 436072 - RNA, 22 nt, Human
cugagccagagggagucggguc

SEQ ID NO: 436073 - RNA, 22 nt, Human
ccagggugaccagcuggccuag

SEQ ID NO: 436074 - RNA, 22 nt, Human
ucaaacuguucagaacuccuuu

SEQ ID NO: 436075 - RNA, 23 nt, Human
ccaauucauggcagauuugaaga

SEQ ID NO: 436076 - RNA, 22 nt, Human
cagcccaaagccccaggcuaga

SEQ ID NO: 436077 - RNA, 22 nt, Human
cugucucucuaggacacugggg

SEQ ID NO: 436078 - RNA, 22 nt, Human
cacagcuuguuuagugacucac

SEQ ID NO: 436079 - RNA, 22 nt, Human
cagacaggcuagccagacucac

SEQ ID NO: 436080 - RNA, 22 nt, Human
caggcucugcugcuacagcugu

SEQ ID NO: 436081 - RNA, 22 nt, Human
uaaggaaagugccaugauuucu

SEQ ID NO: 436082 - RNA, 21 nt, Human
auacuuugaauuacagccuug

SEQ ID NO: 436083 - RNA, 22 nt, Human
aggaggccccuccuggguugcu

SEQ ID NO: 436084 - RNA, 22 nt, Human
ucaauagagccuucuuucaggu

SEQ ID NO: 436085 - RNA, 22 nt, Human
ugcauauuugauugagauaccu

SEQ ID NO: 436086 - RNA, 22 nt, Human
ucuguaguaugguacuuauuua

SEQ ID NO: 436087 - RNA, 21 nt, Human
ucagagagucacagugaacug

SEQ ID NO: 436088 - RNA, 22 nt, Human
agcuaaggacaguugauuuaga

SEQ ID NO: 436089 - RNA, 22 nt, Human
cagcucagcuuccugggugugu

SEQ ID NO: 436090 - RNA, 20 nt, Human
ugcauuuguuauuuguacuc

SEQ ID NO: 436091 - RNA, 22 nt, Human
acucagagaauaucuagaagga

SEQ ID NO: 436092 - RNA, 22 nt, Human
aaaaaugucauuauggaacuga

SEQ ID NO: 436093 - RNA, 22 nt, Human
aggcugaggcaagaggaucacu

SEQ ID NO: 436094 - RNA, 22 nt, Human
ucccagcccagauuugugugac

SEQ ID NO: 436095 - RNA, 21 nt, Human
uccaggccucaggaagggaug

SEQ ID NO: 436096 - RNA, 22 nt, Human
gcaggcugcccucuuguguuga

SEQ ID NO: 436097 - RNA, 22 nt, Human
cuuuaugaaggaacaaugcucc

SEQ ID NO: 436098 - RNA, 22 nt, Human
auggagccauuccugaagacuu

SEQ ID NO: 436099 - RNA, 22 nt, Human
gcucccuguucucagccaugau

SEQ ID NO: 436100 - RNA, 22 nt, Human
aagguccuuuugcagugugauc

SEQ ID NO: 436101 - RNA, 22 nt, Human
acacagauaaugcucauauagg

SEQ ID NO: 436102 - RNA, 18 nt, Human
auuuugaacugggaauau

SEQ ID NO: 436103 - RNA, 23 nt, Human
ccagcuccgugagccucgggcuc

SEQ ID NO: 436104 - RNA, 22 nt, Human
uccccaggagcaaugauucagu

SEQ ID NO: 436105 - RNA, 22 nt, Human
caagcagagacuagauagcugu

SEQ ID NO: 436106 - RNA, 22 nt, Human
acaagacugugcucuaagagug

SEQ ID NO: 436107 - RNA, 22 nt, Human
ggcagaguugguggagucaguu

SEQ ID NO: 436108 - RNA, 23 nt, Human
acugguacagguuuacugguguc

SEQ ID NO: 436109 - RNA, 22 nt, Human
aacacuuuggaugcagaaccaa

SEQ ID NO: 436110 - RNA, 22 nt, Human
cacuuuauaugcauuaccucau

SEQ ID NO: 436111 - RNA, 17 nt, Human
caggcagacauguaagc

SEQ ID NO: 436112 - RNA, 22 nt, Human
aggcccuggcacugccugggag

SEQ ID NO: 436113 - RNA, 22 nt, Human
aggcuuggaaguggcagaacug

SEQ ID NO: 436114 - RNA, 22 nt, Human
cuguggcugcagccuugguccu

SEQ ID NO: 436115 - RNA, 22 nt, Human
aaggcacauuccugaaaacaau

SEQ ID NO: 436116 - RNA, 22 nt, Human
gcagggccagguacaagaagca

SEQ ID NO: 436117 - RNA, 22 nt, Human
auggccuggccagagcucugcu

SEQ ID NO: 436118 - RNA, 23 nt, Human
aggcaagaacggguuguucaccc

SEQ ID NO: 436119 - RNA, 22 nt, Human
ugaagcuagguucaugaggucg

SEQ ID NO: 436120 - RNA, 22 nt, Human
auucacacuuuacuucuuucca

SEQ ID NO: 436121 - RNA, 22 nt, Human
cagaguacugggagaacagaag

SEQ ID NO: 436122 - RNA, 22 nt, Human
ugcaaaaacagccuugaggccu

SEQ ID NO: 436123 - RNA, 22 nt, Human
uacuuuuagccuauuugauucu

SEQ ID NO: 436124 - RNA, 19 nt, Human
cuuugcuuguuucuguguc

SEQ ID NO: 436125 - RNA, 22 nt, Human
gcugggagccguaccugucacg

SEQ ID NO: 436126 - RNA, 22 nt, Human
aggcuuggcuggcagcccuggg

SEQ ID NO: 436127 - RNA, 22 nt, Human
uuuggaagacagggcaggaaag

SEQ ID NO: 436128 - RNA, 22 nt, Human
gacagcagccacagggagaggg

SEQ ID NO: 436129 - RNA, 22 nt, Human
ugccugucuucaggagugucac

SEQ ID NO: 436130 - RNA, 21 nt, Human
cagagcagcguucugcugugg

SEQ ID NO: 436131 - RNA, 22 nt, Human
uuucuuauauucugucauuguu

SEQ ID NO: 436132 - RNA, 22 nt, Human
ucugcccaguuugugcucaggu

SEQ ID NO: 436133 - RNA, 22 nt, Human
acaguacuaagugcucacauga

SEQ ID NO: 436134 - RNA, 20 nt, Human
ugcagcugguuucacaggga

SEQ ID NO: 436135 - RNA, 22 nt, Human
gcuggagccaagcugcucuugg

SEQ ID NO: 436136 - RNA, 22 nt, Human
cauuuguagaguaggaaagagu

SEQ ID NO: 436137 - RNA, 22 nt, Human
gagagcauguggucuaguuuua

SEQ ID NO: 436138 - RNA, 22 nt, Human
ggccaggaagggaagaucagca

SEQ ID NO: 436139 - RNA, 20 nt, Human
ggcaggaccccaguggcauc

SEQ ID NO: 436140 - RNA, 22 nt, Human
ucaggaaagaguuagaugauua

SEQ ID NO: 436141 - RNA, 22 nt, Human
agcaggcacaagaaagggaggu

SEQ ID NO: 436142 - RNA, 22 nt, Human
gcugagcaggguggggaaaggc

SEQ ID NO: 436143 - RNA, 22 nt, Human
agcaacagaagauagagugaau

SEQ ID NO: 436144 - RNA, 22 nt, Human
uuaaauuccagccucauaauag

SEQ ID NO: 436145 - RNA, 23 nt, Human
cacugcagcguggucuggcagga

SEQ ID NO: 436146 - RNA, 22 nt, Human
cauggcagcaauuuuccugacu

SEQ ID NO: 436147 - RNA, 22 nt, Human
acaacacauguguauaugugug

SEQ ID NO: 436148 - RNA, 22 nt, Human
uuggccagagaccagagcaggg

SEQ ID NO: 436149 - RNA, 22 nt, Human
ucuuagcauuuguuaauaccca

SEQ ID NO: 436150 - RNA, 22 nt, Human
uccugagggcucggggcucaug

SEQ ID NO: 436151 - RNA, 22 nt, Human
uacaaguauguuuuaaaauguu

SEQ ID NO: 436152 - RNA, 22 nt, Human
uaggacaggugaggggcugugg

SEQ ID NO: 436153 - RNA, 22 nt, Human
cgcaggcugcagccaagaagag

SEQ ID NO: 436154 - RNA, 22 nt, Human
gagcuggccgcagagagggcag

SEQ ID NO: 436155 - RNA, 22 nt, Human
caaugcaugauggaauugccuu

SEQ ID NO: 436156 - RNA, 22 nt, Human
aguacagaccugucucuuccug

SEQ ID NO: 436157 - RNA, 22 nt, Human
uacagaggggacauggaagaca

SEQ ID NO: 436158 - RNA, 22 nt, Human
aucaugcagagucugggcuuca

SEQ ID NO: 436159 - RNA, 22 nt, Human
ggggacccucaggacugcgucu

SEQ ID NO: 436160 - RNA, 22 nt, Human
gcaacauugagucuaaguacca

SEQ ID NO: 436161 - RNA, 22 nt, Human
ugaaccaggaggcagccagcac

SEQ ID NO: 436162 - RNA, 22 nt, Human
ugcccuguuccugccuccagcu

SEQ ID NO: 436163 - RNA, 22 nt, Human
aggacacagcugcucugcagag

SEQ ID NO: 436164 - RNA, 22 nt, Human
uugacaaaguuuaguaauaauc

SEQ ID NO: 436165 - RNA, 22 nt, Human
ggaaagagcuaaaagggugaga

SEQ ID NO: 436166 - RNA, 22 nt, Human
aucaugcaauaaggugaggccu

SEQ ID NO: 436167 - RNA, 22 nt, Human
uggcucugugucucccagcagc

SEQ ID NO: 436168 - RNA, 22 nt, Human
uuacaguagcuuuauuuggagu

SEQ ID NO: 436169 - RNA, 22 nt, Human
uagcagaaccagcagucaauuu

SEQ ID NO: 436170 - RNA, 22 nt, Human
gcugagguggcugccuuaguaa

SEQ ID NO: 436171 - RNA, 22 nt, Human
uacacccagguaccgugauuuc

SEQ ID NO: 436172 - RNA, 22 nt, Human
aacauuucuucugaaacugagu

SEQ ID NO: 436173 - RNA, 22 nt, Human
ugcccccuuuucuuguuacacu

SEQ ID NO: 436174 - RNA, 22 nt, Human
cugggaggauacacaagaucag

SEQ ID NO: 436175 - RNA, 22 nt, Human
uauaaaauucucaguuuggggu

SEQ ID NO: 436176 - RNA, 22 nt, Human
uaaggcccgugaguuucauauc

SEQ ID NO: 436177 - RNA, 18 nt, Human
gcccugguggagcuggug

SEQ ID NO: 436178 - RNA, 22 nt, Human
agcagcaggagccgugggguga

SEQ ID NO: 436179 - RNA, 22 nt, Human
uucuggcugcagucccuguaau

SEQ ID NO: 436180 - RNA, 23 nt, Human
aucugggcaucuggagugguccu

SEQ ID NO: 436181 - RNA, 22 nt, Human
cacagcccugcgccccaguuug

SEQ ID NO: 436182 - RNA, 21 nt, Human
cugcaucucauagaacauguc

SEQ ID NO: 436183 - RNA, 22 nt, Human
uuuuaguuuggauuucuaaagc

SEQ ID NO: 436184 - RNA, 21 nt, Human
agaaggcaccagcaaggacug

SEQ ID NO: 436185 - RNA, 22 nt, Human
ggagcccaagucugcacucggc

SEQ ID NO: 436186 - RNA, 21 nt, Human
aagagcuggaucaaggauaag

SEQ ID NO: 436187 - RNA, 22 nt, Human
cuggaagggaaaucucuuggca

SEQ ID NO: 436188 - RNA, 22 nt, Human
cagaauccacaacagaaguuga

SEQ ID NO: 436189 - RNA, 23 nt, Human
ucaugcagagaaggacugcuuac

SEQ ID NO: 436190 - RNA, 22 nt, Human
ccuguguggaaaccgcaugacg

SEQ ID NO: 436191 - RNA, 22 nt, Human
gaggcaggcagauugcuugagg

SEQ ID NO: 436192 - RNA, 22 nt, Human
gugcagugaaaaaagaaugucc

SEQ ID NO: 436193 - RNA, 22 nt, Human
uuuuuugucccagagagccugg

SEQ ID NO: 436194 - RNA, 22 nt, Human
cugagccagggccacacaugga

SEQ ID NO: 436195 - RNA, 22 nt, Human
aguuuuuccguggcuacgauaa

SEQ ID NO: 436196 - RNA, 22 nt, Human
gcugucccgaaccccugguaau

SEQ ID NO: 436197 - RNA, 22 nt, Human
uucuggaaggguggaguagcuu

SEQ ID NO: 436198 - RNA, 23 nt, Human
uccagcagccaagaaggguagaa

SEQ ID NO: 436199 - RNA, 22 nt, Human
cgcuggccauagccuccugugu

SEQ ID NO: 436200 - RNA, 22 nt, Human
uucacauuggugauauguuucu

SEQ ID NO: 436201 - RNA, 23 nt, Human
uugcaaaaugagucuugagugaa

SEQ ID NO: 436202 - RNA, 22 nt, Human
caaggaaaacagaugaucaaca

SEQ ID NO: 436203 - RNA, 22 nt, Human
aauucaaugguuuuuaggauau

SEQ ID NO: 436204 - RNA, 22 nt, Human
cugagccagcuggcaugugcua

SEQ ID NO: 436205 - RNA, 22 nt, Human
auugcaaauaaugcgagccagu

SEQ ID NO: 436206 - RNA, 22 nt, Human
aagcagaggccacagagugggc

SEQ ID NO: 436207 - RNA, 22 nt, Human
cuguggcauugccgaggcuggc

SEQ ID NO: 436208 - RNA, 22 nt, Human
aaggagugcugaaaggaagcgg

SEQ ID NO: 436209 - RNA, 22 nt, Human
ucagggagaggugagagccugu

SEQ ID NO: 436210 - RNA, 22 nt, Human
uucagggacuuagugucaguuu

SEQ ID NO: 436211 - RNA, 22 nt, Human
cauacaaucaaguucuuuauua

SEQ ID NO: 436212 - RNA, 22 nt, Human
aaaaacacaaguggcuuggucu

SEQ ID NO: 436213 - RNA, 22 nt, Human
ggccaugguuggggaagacaug

SEQ ID NO: 436214 - RNA, 22 nt, Human
uugcugaucugaaacguuacug

SEQ ID NO: 436215 - RNA, 22 nt, Human
uuuuaugagaaugcgccacuug

SEQ ID NO: 436216 - RNA, 19 nt, Human
gaguacaggugcagaaaug

SEQ ID NO: 436217 - RNA, 22 nt, Human
cugcccagauuuuaccaccugc

SEQ ID NO: 436218 - RNA, 20 nt, Human
ugggcagcacugcuggcugg

SEQ ID NO: 436219 - RNA, 18 nt, Human
guuuggcauaacugaugc

SEQ ID NO: 436220 - RNA, 22 nt, Human
cucacuggcaagacuacaggug

SEQ ID NO: 436221 - RNA, 22 nt, Human
ugcaggcuguuugguggaucuc

SEQ ID NO: 436222 - RNA, 23 nt, Human
cuuugcaaaaacauuagucagug

SEQ ID NO: 436223 - RNA, 22 nt, Human
auccugaguuccugccucuaaa

SEQ ID NO: 436224 - RNA, 22 nt, Human
uuagauaaauuaagacuuuaca

SEQ ID NO: 436225 - RNA, 22 nt, Human
uccuguggucuggaaggaaugg

SEQ ID NO: 436226 - RNA, 22 nt, Human
augggcuguccuaguccagccc

SEQ ID NO: 436227 - RNA, 22 nt, Human
ugccaggcccagcuccagagcu

SEQ ID NO: 436228 - RNA, 22 nt, Human
ccaggaaaaagagaaacauggu

SEQ ID NO: 436229 - RNA, 22 nt, Human
cugacuguuugcugaaaggucu

SEQ ID NO: 436230 - RNA, 22 nt, Human
cuaaggcaccgaggcaggagcg

SEQ ID NO: 436231 - RNA, 22 nt, Human
acagcaaaagacaagaacuuaa

SEQ ID NO: 436232 - RNA, 21 nt, Human
cucagagcaguucagagggau

SEQ ID NO: 436233 - RNA, 22 nt, Human
auacuguaucacuugugaguga

SEQ ID NO: 436234 - RNA, 21 nt, Human
ucauuggucauuaagcucugu

SEQ ID NO: 436235 - RNA, 22 nt, Human
gagcagugaagacagaaguaca

SEQ ID NO: 436236 - RNA, 22 nt, Human
agcaagcuggaggggcucauga

SEQ ID NO: 436237 - RNA, 21 nt, Human
ugcaggcuguuuaagaggcaa

SEQ ID NO: 436238 - RNA, 20 nt, Human
acagcagccuugcuagaaac

SEQ ID NO: 436239 - RNA, 22 nt, Human
cagcuucuuagucuuuccuugu

SEQ ID NO: 436240 - RNA, 22 nt, Human
acagaagaaguucaaggugaag

SEQ ID NO: 436241 - RNA, 22 nt, Human
gaauaauagcagaaauuagcag

SEQ ID NO: 436242 - RNA, 20 nt, Human
ugccaugguaacagagugug

SEQ ID NO: 436243 - RNA, 21 nt, Human
caaguucagaagguugggcug

SEQ ID NO: 436244 - RNA, 22 nt, Human
uaauaugggcagucugaauaua

SEQ ID NO: 436245 - RNA, 22 nt, Human
agaguucagcuacugcaaaugu

SEQ ID NO: 436246 - RNA, 19 nt, Human
cuggcagccugucuguguc

SEQ ID NO: 436247 - RNA, 22 nt, Human
aagugauacaucuagucuauaa

SEQ ID NO: 436248 - RNA, 22 nt, Human
gaggccugcuuuggcacucugg

SEQ ID NO: 436249 - RNA, 23 nt, Human
ggcaauaacgagcuugucucuga

SEQ ID NO: 436250 - RNA, 22 nt, Human
agcagagccugggcuaggggug

SEQ ID NO: 436251 - RNA, 22 nt, Human
uuugcaaaauuauucccagcau

SEQ ID NO: 436252 - RNA, 22 nt, Human
gcacaauaacagccaagguuau

SEQ ID NO: 436253 - RNA, 22 nt, Human
ugcagcugauuaaagggcagac

SEQ ID NO: 436254 - RNA, 22 nt, Human
cagcauuucaggaggcugaggu

SEQ ID NO: 436255 - RNA, 22 nt, Human
aagcccugucacccugacuuca

SEQ ID NO: 436256 - RNA, 22 nt, Human
uaaagacacugguuuuaaucau

SEQ ID NO: 436257 - RNA, 22 nt, Human
aggcugaggcgggaggaucacu

SEQ ID NO: 436258 - RNA, 22 nt, Human
uucuccuuauucauaguugucu

SEQ ID NO: 436259 - RNA, 20 nt, Human
uaggacagggccuggcuucu

SEQ ID NO: 436260 - RNA, 22 nt, Human
agcgcaggaacacgucugccuu

SEQ ID NO: 436261 - RNA, 22 nt, Human
gauuuauaguaugugcuuucag

SEQ ID NO: 436262 - RNA, 18 nt, Human
gcuggcugcacuucugcu

SEQ ID NO: 436263 - RNA, 22 nt, Human
cuuuccucuggcacugucuggu

SEQ ID NO: 436264 - RNA, 22 nt, Human
ccugaagcacccggagcuggca

SEQ ID NO: 436265 - RNA, 22 nt, Human
ucuuagcacagcuauauaaguu

SEQ ID NO: 436266 - RNA, 22 nt, Human
auuagagaaauguugccaagau

SEQ ID NO: 436267 - RNA, 22 nt, Human
ucccagauuguugauggcuuaa

SEQ ID NO: 436268 - RNA, 22 nt, Human
uuugcaaauacagaggucuugc

SEQ ID NO: 436269 - RNA, 22 nt, Human
auguuauuucugaaagaucauu

SEQ ID NO: 436270 - RNA, 22 nt, Human
cacugguacguagguuggggca

SEQ ID NO: 436271 - RNA, 22 nt, Human
ucuggccccggucuucacagcu

SEQ ID NO: 436272 - RNA, 22 nt, Human
ucccagagccucugccacucug

SEQ ID NO: 436273 - RNA, 21 nt, Human
acaaauuguuuauauaggaag

SEQ ID NO: 436274 - RNA, 22 nt, Human
gggcacagcugcuacccagugc

SEQ ID NO: 436275 - RNA, 21 nt, Human
gagugcagcaagguagagucu

SEQ ID NO: 436276 - RNA, 22 nt, Human
uagcagggucucaggagucagg

SEQ ID NO: 436277 - RNA, 22 nt, Human
gcccacaguacgaggcucaggc

SEQ ID NO: 436278 - RNA, 22 nt, Human
ugcaaauuccauuuaaacacua

SEQ ID NO: 436279 - RNA, 22 nt, Human
ugugucccuuggaaccucagcu

SEQ ID NO: 436280 - RNA, 22 nt, Human
cuucuugaaguccuccagaagu

SEQ ID NO: 436281 - RNA, 22 nt, Human
uaaacugcuucucucagucugu

SEQ ID NO: 436282 - RNA, 20 nt, Human
uccaagcccuccuuccauuc

SEQ ID NO: 436283 - RNA, 22 nt, Human
aggcccaguagugcugccuuua

SEQ ID NO: 436284 - RNA, 22 nt, Human
agagcacaugguuccugugucc

SEQ ID NO: 436285 - RNA, 22 nt, Human
agaggccucaaaccagaccuga

SEQ ID NO: 436286 - RNA, 22 nt, Human
gcauuuuaauaagauucauagg

SEQ ID NO: 436287 - RNA, 22 nt, Human
gcucaaggcaggcagacaugag

SEQ ID NO: 436288 - RNA, 22 nt, Human
ucagcccuuccuggagcuuuua

SEQ ID NO: 436289 - RNA, 22 nt, Human
uguacauacauagauauacaca

SEQ ID NO: 436290 - RNA, 18 nt, Human
uggaggaaucacaauggc

SEQ ID NO: 436291 - RNA, 18 nt, Human
ccucaggggaccuggcag

SEQ ID NO: 436292 - RNA, 22 nt, Human
augaggcagguggaggcugcca

SEQ ID NO: 436293 - RNA, 22 nt, Human
gaggcuggaauauuagaaaugu

SEQ ID NO: 436294 - RNA, 22 nt, Human
acagaacugcaggaggaaaagc

SEQ ID NO: 436295 - RNA, 18 nt, Human
auuucuacuacuauaaag

SEQ ID NO: 436296 - RNA, 22 nt, Human
caagcagccccaacaugaggau

SEQ ID NO: 436297 - RNA, 22 nt, Human
agaagucaaugaugagagugcu

SEQ ID NO: 436298 - RNA, 18 nt, Human
ggagcccagaggacagga

SEQ ID NO: 436299 - RNA, 22 nt, Human
agcaggugucggcgagggucuu

SEQ ID NO: 436300 - RNA, 22 nt, Human
aguggcaguggaaagcacacgg

SEQ ID NO: 436301 - RNA, 22 nt, Human
aaagaccauguuuacagcuagg

SEQ ID NO: 436302 - RNA, 22 nt, Human
uucuuuauggaauggugauagu

SEQ ID NO: 436303 - RNA, 22 nt, Human
ugaaacaggaaguaaacagaca

SEQ ID NO: 436304 - RNA, 22 nt, Human
agagacagaggcaauauagcuu

SEQ ID NO: 436305 - RNA, 22 nt, Human
ccuuuuucccuggagggacagc

SEQ ID NO: 436306 - RNA, 22 nt, Human
cuggcagcuggaggcuagaggc

SEQ ID NO: 436307 - RNA, 22 nt, Human
uuguacaaagauuucacagcuc

SEQ ID NO: 436308 - RNA, 22 nt, Human
uauagcaagcaggacagucuca

SEQ ID NO: 436309 - RNA, 22 nt, Human
ugcagaagcugcaggucagugg

SEQ ID NO: 436310 - RNA, 22 nt, Human
cuggcuccauuacucagcaucu

SEQ ID NO: 436311 - RNA, 23 nt, Human
ugcccucccaaugcuucggucac

SEQ ID NO: 436312 - RNA, 22 nt, Human
aguucuuuuaccaaggcaaaug

SEQ ID NO: 436313 - RNA, 22 nt, Human
ugugcccauuacacagaggcau

SEQ ID NO: 436314 - RNA, 22 nt, Human
gacagaggcuggagcaccuccu

SEQ ID NO: 436315 - RNA, 22 nt, Human
agaggagcugggaggcccucgu

SEQ ID NO: 436316 - RNA, 20 nt, Human
gaacauggcagguggagggg

SEQ ID NO: 436317 - RNA, 22 nt, Human
uagccgggugugguggaacucc

SEQ ID NO: 436318 - RNA, 22 nt, Human
gaaggcaggcuucugauuaggu

SEQ ID NO: 436319 - RNA, 22 nt, Human
uguaagaaaaguaaauagugac

SEQ ID NO: 436320 - RNA, 22 nt, Human
aucuaagaggaugguuggaaau

SEQ ID NO: 436321 - RNA, 22 nt, Human
acaaggaacaagcauguaguuu

SEQ ID NO: 436322 - RNA, 22 nt, Human
caggugccucaggaugagacaa

SEQ ID NO: 436323 - RNA, 22 nt, Human
acugugugcccugacgccaggg

SEQ ID NO: 436324 - RNA, 22 nt, Human
uaaaggcagccacugagcucaa

SEQ ID NO: 436325 - RNA, 22 nt, Human
ggccuugggaggagggucagaa

SEQ ID NO: 436326 - RNA, 22 nt, Human
cauguaaagaauuucacacaag

SEQ ID NO: 436327 - RNA, 22 nt, Human
acagaguuguaaacauuuacca

SEQ ID NO: 436328 - RNA, 22 nt, Human
accugaggccuccccagcagac

SEQ ID NO: 436329 - RNA, 22 nt, Human
guuuugugaggcacccacaggu

SEQ ID NO: 436330 - RNA, 19 nt, Human
agcacagacaagaccagca

SEQ ID NO: 436331 - RNA, 22 nt, Human
guguguccucaguaguggcaug

SEQ ID NO: 436332 - RNA, 21 nt, Human
ugcucaguaaaugcugaguga

SEQ ID NO: 436333 - RNA, 22 nt, Human
agcagcagggugauagugccca

SEQ ID NO: 436334 - RNA, 22 nt, Human
agcacaaugugaaaagagcucu

SEQ ID NO: 436335 - RNA, 22 nt, Human
uauuuguauguguguacauaua

SEQ ID NO: 436336 - RNA, 22 nt, Human
aauucaaucuaagaaaugauca

SEQ ID NO: 436337 - RNA, 17 nt, Human
acagcaggcccggaggg

SEQ ID NO: 436338 - RNA, 22 nt, Human
gcagagcucuguucuuaucucc

SEQ ID NO: 436339 - RNA, 23 nt, Human
gccucuggagccccagugcucag

SEQ ID NO: 436340 - RNA, 17 nt, Human
uuacagcagcaauagag

SEQ ID NO: 436341 - RNA, 22 nt, Human
aaugccuuauaggcugaaaauu

SEQ ID NO: 436342 - RNA, 22 nt, Human
cuaggcuguaaagagcuaggag

SEQ ID NO: 436343 - RNA, 22 nt, Human
ugaagcaggugaauggaugucg

SEQ ID NO: 436344 - RNA, 22 nt, Human
aggcccugggagcagagaugca

SEQ ID NO: 436345 - RNA, 22 nt, Human
ugcaggugugguuccucagcca

SEQ ID NO: 436346 - RNA, 22 nt, Human
ggcaucguccugggcauaggga

SEQ ID NO: 436347 - RNA, 22 nt, Human
aggucuggaaacagcagggaga

SEQ ID NO: 436348 - RNA, 23 nt, Human
uaaggcauuuuuucuguaucagu

SEQ ID NO: 436349 - RNA, 22 nt, Human
uccugaaggagcaguugcuggg

SEQ ID NO: 436350 - RNA, 22 nt, Human
uacaaggcuucagcucagcuau

SEQ ID NO: 436351 - RNA, 22 nt, Human
ucccugagcuucaucaggcuuu

SEQ ID NO: 436352 - RNA, 22 nt, Human
gugcccucacaaaguggaaaga

SEQ ID NO: 436353 - RNA, 22 nt, Human
ccugggaagucagccaaggacg

SEQ ID NO: 436354 - RNA, 18 nt, Human
uagcagcacuggccgcuu

SEQ ID NO: 436355 - RNA, 22 nt, Human
cucaguccgucccgcuaggugc

SEQ ID NO: 436356 - RNA, 21 nt, Human
gugcucugggcagcagagggc

SEQ ID NO: 436357 - RNA, 22 nt, Human
acaggccuggguucaaauuugg

SEQ ID NO: 436358 - RNA, 22 nt, Human
uaacaucuuaacuggauacuuc

SEQ ID NO: 436359 - RNA, 22 nt, Human
uggaacgucguaauguugguua

SEQ ID NO: 436360 - RNA, 22 nt, Human
agcuguuuucuugccguccuag

SEQ ID NO: 436361 - RNA, 20 nt, Human
gagggcucguggauggauaa

SEQ ID NO: 436362 - RNA, 17 nt, Human
ggccuuggggccucagu

SEQ ID NO: 436363 - RNA, 22 nt, Human
aagcagugcgcucaucuaaggg

SEQ ID NO: 436364 - RNA, 22 nt, Human
ugguggcuguugcagaacugag

SEQ ID NO: 436365 - RNA, 22 nt, Human
ccagagaaagugaagcaaaugu

SEQ ID NO: 436366 - RNA, 22 nt, Human
gcacaagaauaaccauauuuaa

SEQ ID NO: 436367 - RNA, 22 nt, Human
cucaaaagacuuaaacauaaga

SEQ ID NO: 436368 - RNA, 22 nt, Human
aaaugcauucuguuuucacuag

SEQ ID NO: 436369 - RNA, 22 nt, Human
cuuugcaguauagccuaguaga

SEQ ID NO: 436370 - RNA, 22 nt, Human
cccaggaggcagauguugcagu

SEQ ID NO: 436371 - RNA, 22 nt, Human
gcccagcugucuggcagggaug

SEQ ID NO: 436372 - RNA, 22 nt, Human
ugggcagagaucuggaucaaac

SEQ ID NO: 436373 - RNA, 22 nt, Human
gagcagugguugaacagaggca

SEQ ID NO: 436374 - RNA, 22 nt, Human
ggcaucuguccaucucuccagc

SEQ ID NO: 436375 - RNA, 22 nt, Human
gucagcagugucagcucugggg

SEQ ID NO: 436376 - RNA, 22 nt, Human
auucaaguucuucugucuuugc

SEQ ID NO: 436377 - RNA, 22 nt, Human
gugcagcugcaggagucagguc

SEQ ID NO: 436378 - RNA, 22 nt, Human
uuucaaaccacugagguucuga

SEQ ID NO: 436379 - RNA, 22 nt, Human
ugggccaggauuucaagacccu

SEQ ID NO: 436380 - RNA, 22 nt, Human
aauucaaagacuagaauuuugc

SEQ ID NO: 436381 - RNA, 19 nt, Human
gcaggccucuugggaauua

SEQ ID NO: 436382 - RNA, 22 nt, Human
ucuaucagaguagaaggcaacg

SEQ ID NO: 436383 - RNA, 22 nt, Human
uccuggagggaggcggugcuac

SEQ ID NO: 436384 - RNA, 22 nt, Human
gcaacaguuggauuccagagga

SEQ ID NO: 436385 - RNA, 20 nt, Human
ucagccuugaaugcuugaaa

SEQ ID NO: 436386 - RNA, 22 nt, Human
aggacacaccagguccagcugu

SEQ ID NO: 436387 - RNA, 22 nt, Human
ccagagaggcaaaacuccuucc

SEQ ID NO: 436388 - RNA, 22 nt, Human
ucuuauaaaaggacucccauuu

SEQ ID NO: 436389 - RNA, 19 nt, Human
ccugggaggcggagguugc

SEQ ID NO: 436390 - RNA, 22 nt, Human
uguacaaaacaagaugggggua

SEQ ID NO: 436391 - RNA, 22 nt, Human
cuuauugugagaugcgauaauu

SEQ ID NO: 436392 - RNA, 22 nt, Human
gcuuugcacagauuagguuauu

SEQ ID NO: 436393 - RNA, 22 nt, Human
uaaaggagugugaugaaaggga

SEQ ID NO: 436394 - RNA, 22 nt, Human
aguggcagaagucacuggguag

SEQ ID NO: 436395 - RNA, 22 nt, Human
ugcagagguguugcugagauaa

SEQ ID NO: 436396 - RNA, 22 nt, Human
gagcugagccuggguggaccgc

SEQ ID NO: 436397 - RNA, 19 nt, Human
agacaaugggguuggcagu

SEQ ID NO: 436398 - RNA, 22 nt, Human
agaagcagggcagggaaaagca

SEQ ID NO: 436399 - RNA, 22 nt, Human
agucccaggcagccgagccggu

SEQ ID NO: 436400 - RNA, 22 nt, Human
agugcugaagacuggcuaggga

SEQ ID NO: 436401 - RNA, 19 nt, Human
agaggcagucuccaacagg

SEQ ID NO: 436402 - RNA, 22 nt, Human
uuugaaagaaaccagugaguga

SEQ ID NO: 436403 - RNA, 19 nt, Human
ucuggcugccaaggauuga

SEQ ID NO: 436404 - RNA, 22 nt, Human
ugaaggcagugauuuuguuugg

SEQ ID NO: 436405 - RNA, 22 nt, Human
agcuacuggagaacacaaaacc

SEQ ID NO: 436406 - RNA, 22 nt, Human
augauuuuucagcagaggaucu

SEQ ID NO: 436407 - RNA, 22 nt, Human
cagagccuaaaacgacuccacu

SEQ ID NO: 436408 - RNA, 22 nt, Human
gcagcugggccccagccucucc

SEQ ID NO: 436409 - RNA, 22 nt, Human
acggcuucuugacuguggguug

SEQ ID NO: 436410 - RNA, 22 nt, Human
uuuaaauuuguguuuagagggu

SEQ ID NO: 436411 - RNA, 22 nt, Human
uaaggcaguuuugccugagaua

SEQ ID NO: 436412 - RNA, 22 nt, Human
aauacugcauacaguuucucau

SEQ ID NO: 436413 - RNA, 22 nt, Human
cugcuuggaguccuccagcacc

SEQ ID NO: 436414 - RNA, 22 nt, Human
gcaggaacuggagcuggauguu

SEQ ID NO: 436415 - RNA, 22 nt, Human
ccccacagccgccagcagggag

SEQ ID NO: 436416 - RNA, 22 nt, Human
guccugguagggcucugugucu

SEQ ID NO: 436417 - RNA, 22 nt, Human
ucagauauucucuaagaacaau

SEQ ID NO: 436418 - RNA, 22 nt, Human
cagcaggcaggugggccaaguc

SEQ ID NO: 436419 - RNA, 22 nt, Human
uagacagauuuaaaggaaugga

SEQ ID NO: 436420 - RNA, 22 nt, Human
aguucagaaaugucuuugcaaa

SEQ ID NO: 436421 - RNA, 22 nt, Human
gccagcucagaugcaggaagga

SEQ ID NO: 436422 - RNA, 22 nt, Human
ucacaguaucuagaaaugaggg

SEQ ID NO: 436423 - RNA, 22 nt, Human
caccagggacaaugcuaggggu

SEQ ID NO: 436424 - RNA, 22 nt, Human
uuaugacaggaaaaucacagaa

SEQ ID NO: 436425 - RNA, 22 nt, Human
gagcagggcuuguccuccucau

SEQ ID NO: 436426 - RNA, 22 nt, Human
cagcccugugcuaagcacccuc

SEQ ID NO: 436427 - RNA, 22 nt, Human
ugggcaggagagaagcuaaaga

SEQ ID NO: 436428 - RNA, 22 nt, Human
caucaugccccgcuacagugca

SEQ ID NO: 436429 - RNA, 22 nt, Human
uccaggagugugugcuaauggg

SEQ ID NO: 436430 - RNA, 22 nt, Human
ugggccugaaggagcugcgccc

SEQ ID NO: 436431 - RNA, 22 nt, Human
aaacacuuccuguaacaugaca

SEQ ID NO: 436432 - RNA, 22 nt, Human
auucuauagacagaaggucaau

SEQ ID NO: 436433 - RNA, 22 nt, Human
gcacccagggcaggaagugagg

SEQ ID NO: 436434 - RNA, 22 nt, Human
gacaggcuggcaaugcccugcu

SEQ ID NO: 436435 - RNA, 22 nt, Human
cacauuuagagguuagcauggu

SEQ ID NO: 436436 - RNA, 19 nt, Human
auuuauuguaugauuccau

SEQ ID NO: 436437 - RNA, 22 nt, Human
uuuucucuacaaaauaaccagc

SEQ ID NO: 436438 - RNA, 22 nt, Human
gccuggagccucagcaaggagg

SEQ ID NO: 436439 - RNA, 22 nt, Human
ugccgcagugcggggagggccc

SEQ ID NO: 436440 - RNA, 22 nt, Human
ucugccugcaguguggcagggc

SEQ ID NO: 436441 - RNA, 22 nt, Human
uggugagauaacuuucggcaag

SEQ ID NO: 436442 - RNA, 22 nt, Human
gcugaggcugggagcagccugu

SEQ ID NO: 436443 - RNA, 21 nt, Human
agagccugagaucuuccagca

SEQ ID NO: 436444 - RNA, 22 nt, Human
cuccuucccaugagugugggca

SEQ ID NO: 436445 - RNA, 22 nt, Human
ucaggccugcccugaaagcaca

SEQ ID NO: 436446 - RNA, 19 nt, Human
ucccugaguuccagcccag

SEQ ID NO: 436447 - RNA, 22 nt, Human
uauuuuacaugauccagaguug

SEQ ID NO: 436448 - RNA, 22 nt, Human
aaaagcacuacaauuucgcuuc

SEQ ID NO: 436449 - RNA, 22 nt, Human
uacagaggaggugguugggagu

SEQ ID NO: 436450 - RNA, 22 nt, Human
caguacuuuucuggcuuucuac

SEQ ID NO: 436451 - RNA, 22 nt, Human
cugagggcuggagcugaggccu

SEQ ID NO: 436452 - RNA, 22 nt, Human
agacacagcaauaacuacuguu

SEQ ID NO: 436453 - RNA, 22 nt, Human
cccuggcaagugcuguguagcu

SEQ ID NO: 436454 - RNA, 22 nt, Human
gggcagaggggcgcuucccucu

SEQ ID NO: 436455 - RNA, 22 nt, Human
uucuaacuggcuugacaguuuc

SEQ ID NO: 436456 - RNA, 22 nt, Human
caaaguugcaguuaugugauua

SEQ ID NO: 436457 - RNA, 22 nt, Human
cuguuucagcuacuguuccaug

SEQ ID NO: 436458 - RNA, 22 nt, Human
ucacaguauagaguuauuuugg

SEQ ID NO: 436459 - RNA, 22 nt, Human
aagcagaggaccgacggaggga

SEQ ID NO: 436460 - RNA, 22 nt, Human
acagacaguaugguggggcuga

SEQ ID NO: 436461 - RNA, 22 nt, Human
cucccagacaugugccuccuug

SEQ ID NO: 436462 - RNA, 22 nt, Human
aaaugccucccauucuacugac

SEQ ID NO: 436463 - RNA, 22 nt, Human
ucacccccuguauuaguagcua

SEQ ID NO: 436464 - RNA, 22 nt, Human
gugcccugaggucuucacuuug

SEQ ID NO: 436465 - RNA, 22 nt, Human
agacaaguguuucuggguaacu

SEQ ID NO: 436466 - RNA, 23 nt, Human
agcaauaagaagggauacaugug

SEQ ID NO: 436467 - RNA, 22 nt, Human
aaguucaaggcucuagaguucc

SEQ ID NO: 436468 - RNA, 22 nt, Human
ccagggcagugggagaaggugc

SEQ ID NO: 436469 - RNA, 22 nt, Human
gcauugaaauggcaaaaagaga

SEQ ID NO: 436470 - RNA, 22 nt, Human
ucaugccaaacugaacacaguu

SEQ ID NO: 436471 - RNA, 22 nt, Human
caugcaaaauguauuuuauuag

SEQ ID NO: 436472 - RNA, 22 nt, Human
agggcagaaguacagacacuua

SEQ ID NO: 436473 - RNA, 22 nt, Human
gcuggaccaggugugcacaggc

SEQ ID NO: 436474 - RNA, 21 nt, Human
agcagcugggcaacauggagg

SEQ ID NO: 436475 - RNA, 22 nt, Human
uuuaucugucauuucccauauc

SEQ ID NO: 436476 - RNA, 19 nt, Human
gccaggagggcucuggcug

SEQ ID NO: 436477 - RNA, 22 nt, Human
aaacacuuuagaaagggacuug

SEQ ID NO: 436478 - RNA, 22 nt, Human
cagggacaauggcagagccuga

SEQ ID NO: 436479 - RNA, 22 nt, Human
acagugucugacacauuguagc

SEQ ID NO: 436480 - RNA, 22 nt, Human
uucuuuaucaguuacucauagg

SEQ ID NO: 436481 - RNA, 22 nt, Human
uugacuucccagacuuguguuu

SEQ ID NO: 436482 - RNA, 22 nt, Human
gugcagcuuccuggucucagcc

SEQ ID NO: 436483 - RNA, 19 nt, Human
uaucacugggcacugagga

SEQ ID NO: 436484 - RNA, 22 nt, Human
aucaauuuugaggauacaagaa

SEQ ID NO: 436485 - RNA, 22 nt, Human
cacagcaaaggcuucggcugau

SEQ ID NO: 436486 - RNA, 22 nt, Human
aagagauguugaaguuuauuag

SEQ ID NO: 436487 - RNA, 22 nt, Human
uggccuggaagagaggucgagg

SEQ ID NO: 436488 - RNA, 22 nt, Human
ugccucagagaccugacaguac

SEQ ID NO: 436489 - RNA, 22 nt, Human
ucacaauauuuaucuuccaauu

SEQ ID NO: 436490 - RNA, 22 nt, Human
cagcugagcugccagacuacug

SEQ ID NO: 436491 - RNA, 22 nt, Human
uaguuuuuaaguguacaauuuc

SEQ ID NO: 436492 - RNA, 22 nt, Human
acuccaggcaucugcuucugcu

SEQ ID NO: 436493 - RNA, 22 nt, Human
ggcagcugguucuuuccauuaa

SEQ ID NO: 436494 - RNA, 22 nt, Human
auugcuuuuccuuaacacaugc

SEQ ID NO: 436495 - RNA, 22 nt, Human
auggaaaagggucuuucauuuc

SEQ ID NO: 436496 - RNA, 20 nt, Human
uuuaucaggcacuuacuauu

SEQ ID NO: 436497 - RNA, 22 nt, Human
aaggacuggcauuaucuuaugu

SEQ ID NO: 436498 - RNA, 15 nt, Human
ccaggcugggugagc

SEQ ID NO: 436499 - RNA, 22 nt, Human
caaugacacucugcacagugcu

SEQ ID NO: 436500 - RNA, 17 nt, Human
ccucacagggaccagac

SEQ ID NO: 436501 - RNA, 22 nt, Human
ucucuggcuggcaccccaggga

SEQ ID NO: 436502 - RNA, 22 nt, Human
cuagcacugagaauagugcaua

SEQ ID NO: 436503 - RNA, 20 nt, Human
uacaggaccuucuuuguauc

SEQ ID NO: 436504 - RNA, 22 nt, Human
ugggcagacgcuguuggaaggc

SEQ ID NO: 436505 - RNA, 22 nt, Human
ggcagccaugcacgcugccugg

SEQ ID NO: 436506 - RNA, 22 nt, Human
uaggcccaguuccgccucccgg

SEQ ID NO: 436507 - RNA, 22 nt, Human
gauuucuacuugaacuugcuaa

SEQ ID NO: 436508 - RNA, 22 nt, Human
cacugcaguaacucuaggacug

SEQ ID NO: 436509 - RNA, 22 nt, Human
auccuuuauaagacuuguauuc

SEQ ID NO: 436510 - RNA, 22 nt, Human
cuuuaacaaaugacucuugucu

SEQ ID NO: 436511 - RNA, 22 nt, Human
aagcuggcaaacaagcaucauu

SEQ ID NO: 436512 - RNA, 22 nt, Human
cuucuguguuuuacuauaugua

SEQ ID NO: 436513 - RNA, 22 nt, Human
caauucaugggcugaggaaggg

SEQ ID NO: 436514 - RNA, 22 nt, Human
ucugaggccuucagcaugaauc

SEQ ID NO: 436515 - RNA, 22 nt, Human
cugcccugcuggagaucacagu

SEQ ID NO: 436516 - RNA, 22 nt, Human
gucuggagccacccuaagcauu

SEQ ID NO: 436517 - RNA, 22 nt, Human
uggggacaggagacuuacagcu

SEQ ID NO: 436518 - RNA, 22 nt, Human
gacuuccuaagauucaggaaug

SEQ ID NO: 436519 - RNA, 22 nt, Human
aauuuggagcuuuguuucuaga

SEQ ID NO: 436520 - RNA, 20 nt, Human
gcagucugucacagagcaug

SEQ ID NO: 436521 - RNA, 22 nt, Human
uuuccuugcacauugguuucca

SEQ ID NO: 436522 - RNA, 22 nt, Human
uggcucagcugucacagccugg

SEQ ID NO: 436523 - RNA, 22 nt, Human
aggugcagcugguggagucugg

SEQ ID NO: 436524 - RNA, 22 nt, Human
agguucuggagaacuuggaggu

SEQ ID NO: 436525 - RNA, 22 nt, Human
guuucagaguagaaccucaagg

SEQ ID NO: 436526 - RNA, 18 nt, Human
gaaaggagagacaguagg

SEQ ID NO: 436527 - RNA, 22 nt, Human
cagcagagcuuauuaacuaaaa

SEQ ID NO: 436528 - RNA, 22 nt, Human
gcugggcuccaggccaggguga

SEQ ID NO: 436529 - RNA, 22 nt, Human
ggcuagggacacagcucugcuc

SEQ ID NO: 436530 - RNA, 22 nt, Human
ccaggcuggauuuugcaguuca

SEQ ID NO: 436531 - RNA, 22 nt, Human
uucagcaaauggcuugagauaa

SEQ ID NO: 436532 - RNA, 22 nt, Human
aaggaauucccuuucugacaga

SEQ ID NO: 436533 - RNA, 22 nt, Human
ccagcugucugguuccagagcc

SEQ ID NO: 436534 - RNA, 22 nt, Human
aggcagccugguuugaauggaa

SEQ ID NO: 436535 - RNA, 22 nt, Human
augacagaggagugcaggugau

SEQ ID NO: 436536 - RNA, 22 nt, Human
acaguaccugcucucaagcaaa

SEQ ID NO: 436537 - RNA, 22 nt, Human
uugcaaaagcaauugcaguuuu

SEQ ID NO: 436538 - RNA, 22 nt, Human
cagaggcaggauaagaacugcg

SEQ ID NO: 436539 - RNA, 22 nt, Human
uacuuugcagcuugauaaaaug

SEQ ID NO: 436540 - RNA, 22 nt, Human
uaaggcauaaggccagaggcua

SEQ ID NO: 436541 - RNA, 22 nt, Human
auauuugugguaaagguaagaa

SEQ ID NO: 436542 - RNA, 22 nt, Human
uccaguucuaggucacucucug

SEQ ID NO: 436543 - RNA, 22 nt, Human
gagcugcccugagcuuugcaug

SEQ ID NO: 436544 - RNA, 22 nt, Human
ggucccaggaagugcggcggcg

SEQ ID NO: 436545 - RNA, 22 nt, Human
gggcagucacagugcuggagca

SEQ ID NO: 436546 - RNA, 22 nt, Human
guggagcccugccuugcucaug

SEQ ID NO: 436547 - RNA, 22 nt, Human
ccugggcaggccggacgcuggg

SEQ ID NO: 436548 - RNA, 22 nt, Human
ccuuugcauuuauguguccauu

SEQ ID NO: 436549 - RNA, 22 nt, Human
ucccagccauuccuuuaggugu

SEQ ID NO: 436550 - RNA, 22 nt, Human
aggcuuggcucuccuaugagaa

SEQ ID NO: 436551 - RNA, 22 nt, Human
uuucaaacuuaaauaccuuucc

SEQ ID NO: 436552 - RNA, 22 nt, Human
gcccaucccugaaccaacuggg

SEQ ID NO: 436553 - RNA, 22 nt, Human
ugacagaacagguugggagcaa

SEQ ID NO: 436554 - RNA, 22 nt, Human
aacacagaagugccaagagcca

SEQ ID NO: 436555 - RNA, 22 nt, Human
aggcaggcuagucgcuugagcc

SEQ ID NO: 436556 - RNA, 22 nt, Human
augagcugggccauccagugau

SEQ ID NO: 436557 - RNA, 22 nt, Human
guggccagccagggugcugaug

SEQ ID NO: 436558 - RNA, 22 nt, Human
aagagucagcuucuguaugggu

SEQ ID NO: 436559 - RNA, 22 nt, Human
cccucccaggaguggccagaga

SEQ ID NO: 436560 - RNA, 22 nt, Human
gaaaggagggcucacaaaagug

SEQ ID NO: 436561 - RNA, 22 nt, Human
ucauugguaauuauuuuugaca

SEQ ID NO: 436562 - RNA, 22 nt, Human
uuugaaauaugaggcauuauga

SEQ ID NO: 436563 - RNA, 23 nt, Human
ccugcccaggaauccggcggcgu

SEQ ID NO: 436564 - RNA, 22 nt, Human
ucagcucuuaacccucuggccu

SEQ ID NO: 436565 - RNA, 21 nt, Human
agaauuaaauuggauuugugu

SEQ ID NO: 436566 - RNA, 22 nt, Human
uggguggcacuucuggggucca

SEQ ID NO: 436567 - RNA, 18 nt, Human
ggagcccagaggugaguu

SEQ ID NO: 436568 - RNA, 22 nt, Human
gauacauuucaaggaggacugg

SEQ ID NO: 436569 - RNA, 22 nt, Human
ucugaucugucagucaugaagg

SEQ ID NO: 436570 - RNA, 23 nt, Human
ucagcugcuuccuccugccugcc

SEQ ID NO: 436571 - RNA, 20 nt, Human
guuuuucucucuugccacua

SEQ ID NO: 436572 - RNA, 22 nt, Human
ccagaggagcaggcuggcucca

SEQ ID NO: 436573 - RNA, 20 nt, Human
aggggcaccugcgacggggc

SEQ ID NO: 436574 - RNA, 22 nt, Human
gggcaagcucuucagaagcucu

SEQ ID NO: 436575 - RNA, 22 nt, Human
gcaggcuggucugaccaucccu

SEQ ID NO: 436576 - RNA, 22 nt, Human
gugcccuccugaagccaucaca

SEQ ID NO: 436577 - RNA, 22 nt, Human
uacuucauaccugcuagaaugg

SEQ ID NO: 436578 - RNA, 22 nt, Human
cuggccaacuugcuuguuggca

SEQ ID NO: 436579 - RNA, 22 nt, Human
uguacauagaucuugaaaauua

SEQ ID NO: 436580 - RNA, 18 nt, Human
caggaauggaugggauuu

SEQ ID NO: 436581 - RNA, 22 nt, Human
uggagggaacccaggcugcucu

SEQ ID NO: 436582 - RNA, 22 nt, Human
agauacaguguuacauuuuuau

SEQ ID NO: 436583 - RNA, 23 nt, Human
cacaggcagaaaucaagacggua

SEQ ID NO: 436584 - RNA, 22 nt, Human
aauugcuugaugacuaguaauu

SEQ ID NO: 436585 - RNA, 22 nt, Human
gaggcccugaagacagcugggg

SEQ ID NO: 436586 - RNA, 22 nt, Human
gcuguuucuuuggcaaacugau

SEQ ID NO: 436587 - RNA, 22 nt, Human
caguuucuuagugacacaaauc

SEQ ID NO: 436588 - RNA, 22 nt, Human
gaggccuggcugggaggaggug

SEQ ID NO: 436589 - RNA, 22 nt, Human
agcugucagugcugugccugua

SEQ ID NO: 436590 - RNA, 23 nt, Human
aacaggaugugcuucaucuuuug

SEQ ID NO: 436591 - RNA, 22 nt, Human
augagacaugacuucaggccuu

SEQ ID NO: 436592 - RNA, 22 nt, Human
ggagaagguggcucagcaaagg

SEQ ID NO: 436593 - RNA, 22 nt, Human
ugagacaguucugcagcugggu

SEQ ID NO: 436594 - RNA, 22 nt, Human
uagcagcacuauuuguuguagu

SEQ ID NO: 436595 - RNA, 22 nt, Human
gggcaccagcggccgcacugcc

SEQ ID NO: 436596 - RNA, 22 nt, Human
cuccucacuuuccagacugggc

SEQ ID NO: 436597 - RNA, 22 nt, Human
accaaaaauuguggggcugaau

SEQ ID NO: 436598 - RNA, 22 nt, Human
cccuuugcccaguauauucuag

SEQ ID NO: 436599 - RNA, 22 nt, Human
gguguguguggauuagcaugcc

SEQ ID NO: 436600 - RNA, 22 nt, Human
auugaaauugaugaaauucuug

SEQ ID NO: 436601 - RNA, 22 nt, Human
auguuucccauaagauuuucug

SEQ ID NO: 436602 - RNA, 22 nt, Human
cucugcugcaggaaggcgugca

SEQ ID NO: 436603 - RNA, 22 nt, Human
uuuuuacacuuagcauugagcg

SEQ ID NO: 436604 - RNA, 22 nt, Human
gccugggugucgaucacuagug

SEQ ID NO: 436605 - RNA, 22 nt, Human
acagcaggcaugaagaaauguu

SEQ ID NO: 436606 - RNA, 22 nt, Human
caucugccuaaguggcccuguu

SEQ ID NO: 436607 - RNA, 23 nt, Human
uggaccugaaccagugccucugu

SEQ ID NO: 436608 - RNA, 23 nt, Human
agcaggaaaccgagggugauguu

SEQ ID NO: 436609 - RNA, 22 nt, Human
aacauuucauuggaagcuaugu

SEQ ID NO: 436610 - RNA, 22 nt, Human
aggcccagggcugcucucugaa

SEQ ID NO: 436611 - RNA, 22 nt, Human
agaggcugcacuugcucaugau

SEQ ID NO: 436612 - RNA, 22 nt, Human
ggccccaggccuuuggucuggc

SEQ ID NO: 436613 - RNA, 22 nt, Human
ccacagcaugcaggccugacac

SEQ ID NO: 436614 - RNA, 21 nt, Human
acaguucaugauaacuccauc

SEQ ID NO: 436615 - RNA, 22 nt, Human
guggaaggugcuagaacaagga

SEQ ID NO: 436616 - RNA, 22 nt, Human
caauuucaucuugugcuucaau

SEQ ID NO: 436617 - RNA, 22 nt, Human
gcugggcuucaccuccagaguu

SEQ ID NO: 436618 - RNA, 22 nt, Human
uuaauuaacuagccaaccacua

SEQ ID NO: 436619 - RNA, 22 nt, Human
uccugaggagaagagugcuagg

SEQ ID NO: 436620 - RNA, 22 nt, Human
cagcugguuaucagagaggccu

SEQ ID NO: 436621 - RNA, 22 nt, Human
uacagaccaguaguucucagcg

SEQ ID NO: 436622 - RNA, 16 nt, Human
gccuggaguggcaggg

SEQ ID NO: 436623 - RNA, 19 nt, Human
ugagacagaagaugagccu

SEQ ID NO: 436624 - RNA, 22 nt, Human
gcucugucauuuugcagacacu

SEQ ID NO: 436625 - RNA, 22 nt, Human
agcaggaguuugaugcuuuuau

SEQ ID NO: 436626 - RNA, 22 nt, Human
gugcacagaaauugguaagacu

SEQ ID NO: 436627 - RNA, 22 nt, Human
cccaggagguggaguucacagu

SEQ ID NO: 436628 - RNA, 22 nt, Human
aagcuucagugugagcauguaa

SEQ ID NO: 436629 - RNA, 22 nt, Human
agcacagagguggaaguguaua

SEQ ID NO: 436630 - RNA, 22 nt, Human
uggagcaggugccaggugugug

SEQ ID NO: 436631 - RNA, 20 nt, Human
acacacuuugaucuugagcc

SEQ ID NO: 436632 - RNA, 22 nt, Human
uucaaguaaugcuacuccuaug

SEQ ID NO: 436633 - RNA, 21 nt, Human
cccaggagaagaaaagaugca

SEQ ID NO: 436634 - RNA, 22 nt, Human
uuuaguguaagcauaaagaaca

SEQ ID NO: 436635 - RNA, 22 nt, Human
uaaggccuugaaaggauguccu

SEQ ID NO: 436636 - RNA, 22 nt, Human
uggcccugcagaacuagccugg

SEQ ID NO: 436637 - RNA, 22 nt, Human
uuuauucuagcucagaauaguu

SEQ ID NO: 436638 - RNA, 22 nt, Human
ugaagacacauacaagggaaug

SEQ ID NO: 436639 - RNA, 22 nt, Human
cguggcugguggaccugagggc

SEQ ID NO: 436640 - RNA, 22 nt, Human
agccucuccagagccuggcaga

SEQ ID NO: 436641 - RNA, 22 nt, Human
aagcacauuguacauuugugcu

SEQ ID NO: 436642 - RNA, 22 nt, Human
agagcuguucagcagccagguu

SEQ ID NO: 436643 - RNA, 22 nt, Human
cuugcaaacacucaaagccauc

SEQ ID NO: 436644 - RNA, 22 nt, Human
ccuggagcuuggucacgcugcg

SEQ ID NO: 436645 - RNA, 22 nt, Human
gagcccugcuuccaagggggca

SEQ ID NO: 436646 - RNA, 22 nt, Human
gcaggagcuggaaagugauguu

SEQ ID NO: 436647 - RNA, 22 nt, Human
ucaggcuguaaauggugugggu

SEQ ID NO: 436648 - RNA, 23 nt, Human
ggcagauuugguuuguuuuaaua

SEQ ID NO: 436649 - RNA, 23 nt, Human
ucccugagaugcugcucuguccc

SEQ ID NO: 436650 - RNA, 22 nt, Human
cacuucaacaguuauuucuuag

SEQ ID NO: 436651 - RNA, 22 nt, Human
auucagagauuguuauucagac

SEQ ID NO: 436652 - RNA, 22 nt, Human
ggcagugccacuaagcucugcu

SEQ ID NO: 436653 - RNA, 19 nt, Human
uacaaguaggcguuuucuc

SEQ ID NO: 436654 - RNA, 22 nt, Human
cugcccugccuggccagugugg

SEQ ID NO: 436655 - RNA, 22 nt, Human
ugcauuaugcuugugcuguaua

SEQ ID NO: 436656 - RNA, 23 nt, Human
acagcuguugaaauuucaguggg

SEQ ID NO: 436657 - RNA, 22 nt, Human
cacccaggcuagagugcagugg

SEQ ID NO: 436658 - RNA, 22 nt, Human
uuugcuuucuguugaacagagu

SEQ ID NO: 436659 - RNA, 22 nt, Human
ugcugccagagagacagggacu

SEQ ID NO: 436660 - RNA, 21 nt, Human
agcagcugcaguuucuaucug

SEQ ID NO: 436661 - RNA, 22 nt, Human
ucaggccuagggagaaaauuca

SEQ ID NO: 436662 - RNA, 22 nt, Human
agacccagaaagcagcugcauu

SEQ ID NO: 436663 - RNA, 22 nt, Human
uaaggcaggacuggauagcuau

SEQ ID NO: 436664 - RNA, 20 nt, Human
aggccaggaaauguaguucu

SEQ ID NO: 436665 - RNA, 22 nt, Human
auuguacaaugcugagguuugg

SEQ ID NO: 436666 - RNA, 22 nt, Human
cauuucuagagucccaagaggu

SEQ ID NO: 436667 - RNA, 22 nt, Human
ccagagggcaaaaugaagcuua

SEQ ID NO: 436668 - RNA, 19 nt, Human
cuuauacagauuuucucau

SEQ ID NO: 436669 - RNA, 22 nt, Human
ucagcagggcugugguguggcu

SEQ ID NO: 436670 - RNA, 22 nt, Human
auaaaugauucagcaggaaaua

SEQ ID NO: 436671 - RNA, 22 nt, Human
cagcaguaacucccgugcagca

SEQ ID NO: 436672 - RNA, 22 nt, Human
aggcuggaugugccucaccgag

SEQ ID NO: 436673 - RNA, 22 nt, Human
ucaaguaugacaucaaguuucu

SEQ ID NO: 436674 - RNA, 22 nt, Human
auucagcaaacauuuauuaucu

SEQ ID NO: 436675 - RNA, 22 nt, Human
uuucuagacauuucuauguaca

SEQ ID NO: 436676 - RNA, 22 nt, Human
guguggggucuucucuuggccu

SEQ ID NO: 436677 - RNA, 22 nt, Human
accuggcauaagggcuugaguc

SEQ ID NO: 436678 - RNA, 22 nt, Human
ucagcugccccaguggccccag

SEQ ID NO: 436679 - RNA, 22 nt, Human
gcugagggaggcugaacugagu

SEQ ID NO: 436680 - RNA, 21 nt, Human
uacaucaugcuacuucucuga

SEQ ID NO: 436681 - RNA, 17 nt, Human
aaacugaaaaauucacu

SEQ ID NO: 436682 - RNA, 22 nt, Human
aaaguugacuacuaaggaaugu

SEQ ID NO: 436683 - RNA, 22 nt, Human
ugaagcuuuaggauggguucau

SEQ ID NO: 436684 - RNA, 22 nt, Human
ugccuggcaaugccagaagcca

SEQ ID NO: 436685 - RNA, 22 nt, Human
gaaaugaacugauuaucauugc

SEQ ID NO: 436686 - RNA, 22 nt, Human
cagcccugcacgcugccuccgc

SEQ ID NO: 436687 - RNA, 22 nt, Human
gacaagacauugguaaagauau

SEQ ID NO: 436688 - RNA, 22 nt, Human
ccagcuccugggucuuagucag

SEQ ID NO: 436689 - RNA, 22 nt, Human
guggcccugucccaggccuccu

SEQ ID NO: 436690 - RNA, 22 nt, Human
gaaggcagggaauguggugcua

SEQ ID NO: 436691 - RNA, 22 nt, Human
acaggcugcugagccauuugcu

SEQ ID NO: 436692 - RNA, 22 nt, Human
agcagagaccauauagcccaga

SEQ ID NO: 436693 - RNA, 22 nt, Human
agcuggugaaccugaggcacag

SEQ ID NO: 436694 - RNA, 20 nt, Human
aagagcugacucacaguggu

SEQ ID NO: 436695 - RNA, 22 nt, Human
uacaggaagucucaguacagua

SEQ ID NO: 436696 - RNA, 20 nt, Human
uacagccccugcuucuguug

SEQ ID NO: 436697 - RNA, 22 nt, Human
aauuucaaacuaauaggaacca

SEQ ID NO: 436698 - RNA, 22 nt, Human
ucccagcagagccagcaagccg

SEQ ID NO: 436699 - RNA, 22 nt, Human
aacuagaaccacuuguauuucc

SEQ ID NO: 436700 - RNA, 22 nt, Human
ggagccugggcauuaguaauuu

SEQ ID NO: 436701 - RNA, 22 nt, Human
uuauuaaugaguacaaguuauu

SEQ ID NO: 436702 - RNA, 22 nt, Human
uucuuaaagaggcaaaacacag

SEQ ID NO: 436703 - RNA, 22 nt, Human
uuaccauaaaguuuaucuuucu

SEQ ID NO: 436704 - RNA, 22 nt, Human
uugcaaaaucauuucucaggau

SEQ ID NO: 436705 - RNA, 22 nt, Human
gcagcaguggcugcagguccca

SEQ ID NO: 436706 - RNA, 22 nt, Human
uggcucucugggagguccuggc

SEQ ID NO: 436707 - RNA, 22 nt, Human
uggcagaaguucacuaguagcu

SEQ ID NO: 436708 - RNA, 23 nt, Human
agcacuuguaucuuacuaaaaug

SEQ ID NO: 436709 - RNA, 22 nt, Human
agcaggagagcagugcgugguc

SEQ ID NO: 436710 - RNA, 22 nt, Human
uccuucagccaugggcucucca

SEQ ID NO: 436711 - RNA, 22 nt, Human
gacaggaaaggggucuguuuuc

SEQ ID NO: 436712 - RNA, 22 nt, Human
ucuggggagcagcccuggugag

SEQ ID NO: 436713 - RNA, 22 nt, Human
ggacccaccaggccgggcucca

SEQ ID NO: 436714 - RNA, 22 nt, Human
gccuggcuugccagcccuggcg

SEQ ID NO: 436715 - RNA, 20 nt, Human
ugccuugggacagugccugu

SEQ ID NO: 436716 - RNA, 22 nt, Human
ccucugagaccagcucugcacc

SEQ ID NO: 436717 - RNA, 22 nt, Human
uauguacaucguugaauucaaa

SEQ ID NO: 436718 - RNA, 22 nt, Human
gcauggcuauuaugaggcagaa

SEQ ID NO: 436719 - RNA, 19 nt, Human
gccucugcuggggacaggc

SEQ ID NO: 436720 - RNA, 22 nt, Human
aaggcagagauuagcagaauga

SEQ ID NO: 436721 - RNA, 22 nt, Human
aagggcuggccacauucugggu

SEQ ID NO: 436722 - RNA, 18 nt, Human
cacaggcaggugauaggu

SEQ ID NO: 436723 - RNA, 22 nt, Human
auaaggcagucccuuaacaagg

SEQ ID NO: 436724 - RNA, 22 nt, Human
uuuauccaagcacaauuucuaa

SEQ ID NO: 436725 - RNA, 22 nt, Human
ggcuggccucaggguccucgcu

SEQ ID NO: 436726 - RNA, 22 nt, Human
acuacaauacucuuaguaaaag

SEQ ID NO: 436727 - RNA, 22 nt, Human
agucccagcccaguccuguaag

SEQ ID NO: 436728 - RNA, 22 nt, Human
guucuacaguuccuauuacuua

SEQ ID NO: 436729 - RNA, 22 nt, Human
gugucccaaagauuagaaauca

SEQ ID NO: 436730 - RNA, 22 nt, Human
ugccagcacaaguuaagagauc

SEQ ID NO: 436731 - RNA, 22 nt, Human
gggagagguuacccgagcaacu

SEQ ID NO: 436732 - RNA, 22 nt, Human
cagagaggauggauuccauagc

SEQ ID NO: 436733 - RNA, 22 nt, Human
uuugaaaggaauuaggaugaca

SEQ ID NO: 436734 - RNA, 18 nt, Human
gggcaagcggcugucacc

SEQ ID NO: 436735 - RNA, 19 nt, Human
uugugagcugaagaacagg

SEQ ID NO: 436736 - RNA, 22 nt, Human
ucagcuggcaguucagaggcug

SEQ ID NO: 436737 - RNA, 22 nt, Human
cucaggacuugguuaguguuuu

SEQ ID NO: 436738 - RNA, 22 nt, Human
cccaggguugccugccucugcu

SEQ ID NO: 436739 - RNA, 22 nt, Human
gcugacuuugccugucuuuagc

SEQ ID NO: 436740 - RNA, 22 nt, Human
agcccagcagaaaguccagccu

SEQ ID NO: 436741 - RNA, 22 nt, Human
auucuaaauguaauuuagaauu

SEQ ID NO: 436742 - RNA, 22 nt, Human
augagcaauuaggaagaaaaca

SEQ ID NO: 436743 - RNA, 22 nt, Human
cuggugcaggaaggagcuggca

SEQ ID NO: 436744 - RNA, 22 nt, Human
uauuuuacuuuaaagcgagaga

SEQ ID NO: 436745 - RNA, 22 nt, Human
cugggcuccuaaccauccaggu

SEQ ID NO: 436746 - RNA, 22 nt, Human
uauuacagggcuaguuaugagu

SEQ ID NO: 436747 - RNA, 22 nt, Human
agaaggcaucagaaguguguag

SEQ ID NO: 436748 - RNA, 22 nt, Human
acagugcauuauugcugaaugc

SEQ ID NO: 436749 - RNA, 22 nt, Human
cugagccuugaugucccuuguc

SEQ ID NO: 436750 - RNA, 22 nt, Human
gaucugguacaggccugcagcc

SEQ ID NO: 436751 - RNA, 22 nt, Human
gcugucacaagcaucuggggca

SEQ ID NO: 436752 - RNA, 22 nt, Human
uagcagcaauuucagaaguuug

SEQ ID NO: 436753 - RNA, 22 nt, Human
augcaaagcaccacacuaagau

SEQ ID NO: 436754 - RNA, 17 nt, Human
guccuggugugugagga

SEQ ID NO: 436755 - RNA, 22 nt, Human
ucuuuauuucugaaucccccau

SEQ ID NO: 436756 - RNA, 22 nt, Human
ugcacuggggucccagcgcacg

SEQ ID NO: 436757 - RNA, 22 nt, Human
gugaauaugaucuuauuuggaa

SEQ ID NO: 436758 - RNA, 22 nt, Human
uucuaaagagaaugcguuucug

SEQ ID NO: 436759 - RNA, 22 nt, Human
cagcagggaagcugugcuguuu

SEQ ID NO: 436760 - RNA, 22 nt, Human
ggcagcugggugccuaauaaug

SEQ ID NO: 436761 - RNA, 16 nt, Human
aacugcaugagugggu

SEQ ID NO: 436762 - RNA, 22 nt, Human
uucuuuauugagacuucauugu

SEQ ID NO: 436763 - RNA, 22 nt, Human
aggagcuguuuuguucagcaaa

SEQ ID NO: 436764 - RNA, 22 nt, Human
aacauaucauaggaugucauug

SEQ ID NO: 436765 - RNA, 22 nt, Human
acaguuacaucacuuacugaca

SEQ ID NO: 436766 - RNA, 22 nt, Human
ccagaggagggcucugaugagg

SEQ ID NO: 436767 - RNA, 22 nt, Human
ugcaauauuuuauauccaacaa

SEQ ID NO: 436768 - RNA, 22 nt, Human
ugccugucuuaauaucuggaaa

SEQ ID NO: 436769 - RNA, 20 nt, Human
cagagcagugcccaggcggc

SEQ ID NO: 436770 - RNA, 22 nt, Human
cauucaaaggcauguccuauuu

SEQ ID NO: 436771 - RNA, 22 nt, Human
aaggcagcccuggcucagccug

SEQ ID NO: 436772 - RNA, 22 nt, Human
cccagacucaucccugggagcu

SEQ ID NO: 436773 - RNA, 22 nt, Human
gcaaauauucaagacuuuucca

SEQ ID NO: 436774 - RNA, 22 nt, Human
cagcccugaguuagcccacgga

SEQ ID NO: 436775 - RNA, 22 nt, Human
auuacagauuauaaauuugagc

SEQ ID NO: 436776 - RNA, 23 nt, Human
augacaaacaggacaucuugugc

SEQ ID NO: 436777 - RNA, 22 nt, Human
gaggcagcuuggggcugugggu

SEQ ID NO: 436778 - RNA, 22 nt, Human
cuguagccagaagcagaaggcc

SEQ ID NO: 436779 - RNA, 22 nt, Human
auuaaaugguggucauucauuu

SEQ ID NO: 436780 - RNA, 19 nt, Human
gcugugugaccuugggcaa

SEQ ID NO: 436781 - RNA, 22 nt, Human
ucccaggcuaccagugagguca

SEQ ID NO: 436782 - RNA, 22 nt, Human
ucuucagagacucugagccccu

SEQ ID NO: 436783 - RNA, 22 nt, Human
caggcagugugacgcuaggguu

SEQ ID NO: 436784 - RNA, 22 nt, Human
agggcagcuggaagguggcuuc

SEQ ID NO: 436785 - RNA, 22 nt, Human
ccugugugcacacgaggccaug

SEQ ID NO: 436786 - RNA, 22 nt, Human
aaaaguugcaaaauugcucuuc

SEQ ID NO: 436787 - RNA, 22 nt, Human
cacccagcagcacuuaagacua

SEQ ID NO: 436788 - RNA, 22 nt, Human
uccucaggcugccuggaagacu

SEQ ID NO: 436789 - RNA, 22 nt, Human
gcuguuuccagacaaugucuuu

SEQ ID NO: 436790 - RNA, 22 nt, Human
uuuauauguuuguacaauuaag

SEQ ID NO: 436791 - RNA, 22 nt, Human
uuuguugaguuacagagaugaa

SEQ ID NO: 436792 - RNA, 22 nt, Human
agaugcugcuccacaggccagg

SEQ ID NO: 436793 - RNA, 22 nt, Human
gcccugggauuggguggaggcu

SEQ ID NO: 436794 - RNA, 22 nt, Human
aacaaguuacucuuaaaguaua

SEQ ID NO: 436795 - RNA, 22 nt, Human
auucauaacggcaaaugucacc

SEQ ID NO: 436796 - RNA, 22 nt, Human
aaggauacuuuuagagccugag

SEQ ID NO: 436797 - RNA, 22 nt, Human
ggcugaguugagaggauuacuu

SEQ ID NO: 436798 - RNA, 22 nt, Human
gggcacugaaugccaagcuagg

SEQ ID NO: 436799 - RNA, 22 nt, Human
caggcccauuuguagccacuuu

SEQ ID NO: 436800 - RNA, 22 nt, Human
uauuuauaaucugccaaagaga

SEQ ID NO: 436801 - RNA, 21 nt, Human
acagcaagccuuccuuucagg

SEQ ID NO: 436802 - RNA, 22 nt, Human
ugauucaguacuuucucuaacu

SEQ ID NO: 436803 - RNA, 22 nt, Human
uagcugucaccagaaauggcca

SEQ ID NO: 436804 - RNA, 22 nt, Human
agcagaacauuuucagggcugu

SEQ ID NO: 436805 - RNA, 22 nt, Human
gacagaggagaagaugcugugg

SEQ ID NO: 436806 - RNA, 22 nt, Human
aaggagcucccggcagaccagg

SEQ ID NO: 436807 - RNA, 22 nt, Human
uccugggaugacuuuugaaaug

SEQ ID NO: 436808 - RNA, 22 nt, Human
acaguauaaacuccuaaaagcc

SEQ ID NO: 436809 - RNA, 22 nt, Human
agggcagagaucugagugggca

SEQ ID NO: 436810 - RNA, 22 nt, Human
gaacaucugggaucauugcugu

SEQ ID NO: 436811 - RNA, 22 nt, Human
aaacaaauagugcaugggaauu

SEQ ID NO: 436812 - RNA, 22 nt, Human
acacaggaagucagcacugaug

SEQ ID NO: 436813 - RNA, 22 nt, Human
aaauuuuagacuccugggucua

SEQ ID NO: 436814 - RNA, 22 nt, Human
uucagaaugauuucagcgagca

SEQ ID NO: 436815 - RNA, 22 nt, Human
gaggcagccucaguggaccucg

SEQ ID NO: 436816 - RNA, 22 nt, Human
cugcacaggggaugagggcagu

SEQ ID NO: 436817 - RNA, 23 nt, Human
ccacaggcacagaggcuugcauc

SEQ ID NO: 436818 - RNA, 22 nt, Human
caaauucagaaaauugguagag

SEQ ID NO: 436819 - RNA, 22 nt, Human
acaguacucuaaugaaaagugc

SEQ ID NO: 436820 - RNA, 22 nt, Human
uauuuauauucugccuucugcu

SEQ ID NO: 436821 - RNA, 22 nt, Human
gcaggguccauggaggcagccc

SEQ ID NO: 436822 - RNA, 22 nt, Human
uuuauccagcagcuauucaaaa

SEQ ID NO: 436823 - RNA, 22 nt, Human
auugaagaucagggaaagauuc

SEQ ID NO: 436824 - RNA, 22 nt, Human
ccucucccagggagagccugag

SEQ ID NO: 436825 - RNA, 22 nt, Human
gaacauacaagaauuaaguaca

SEQ ID NO: 436826 - RNA, 22 nt, Human
ucaggccugugcuggaggagau

SEQ ID NO: 436827 - RNA, 22 nt, Human
acaggcuggaggaggaccaaga

SEQ ID NO: 436828 - RNA, 22 nt, Human
auucacaauagcagcuugcaug

SEQ ID NO: 436829 - RNA, 22 nt, Human
caaggaaguuuuaggagaggaa

SEQ ID NO: 436830 - RNA, 22 nt, Human
agaaggcacagugcugcuaaga

SEQ ID NO: 436831 - RNA, 22 nt, Human
gcacagccacugagugagaacc

SEQ ID NO: 436832 - RNA, 22 nt, Human
ucccagucuagagccggauugg

SEQ ID NO: 436833 - RNA, 22 nt, Human
gagagcuguaauagucaugucu

SEQ ID NO: 436834 - RNA, 22 nt, Human
aagaggagacuucagcaacuug

SEQ ID NO: 436835 - RNA, 22 nt, Human
aggaggcugaacuagggucugg

SEQ ID NO: 436836 - RNA, 22 nt, Human
agcagcagagcucuggucugca

SEQ ID NO: 436837 - RNA, 22 nt, Human
aauucaaauuugaguuugugau

SEQ ID NO: 436838 - RNA, 22 nt, Human
aggucagcaugaguagaaggua

SEQ ID NO: 436839 - RNA, 22 nt, Human
ugacuaaaauaggacauuaacu

SEQ ID NO: 436840 - RNA, 22 nt, Human
cgggcacacacuugacagguuc

SEQ ID NO: 436841 - RNA, 20 nt, Human
auacacauucauagaaaaau

SEQ ID NO: 436842 - RNA, 22 nt, Human
auguacaaccugcaugacaguc

SEQ ID NO: 436843 - RNA, 17 nt, Human
ggaagaaaaggaucauc

SEQ ID NO: 436844 - RNA, 22 nt, Human
aacacuuuuuauauauuguauc

SEQ ID NO: 436845 - RNA, 22 nt, Human
cagagcugucauuugccaguga

SEQ ID NO: 436846 - RNA, 20 nt, Human
cccuggagagaagcuccacg

SEQ ID NO: 436847 - RNA, 22 nt, Human
cacucugagaaguacaagcucc

SEQ ID NO: 436848 - RNA, 22 nt, Human
uugcagcuucuugcaucagaaa

SEQ ID NO: 436849 - RNA, 22 nt, Human
cagcuuccaucuccacugcccu

SEQ ID NO: 436850 - RNA, 22 nt, Human
cuguucucuggcgguggcuguu

SEQ ID NO: 436851 - RNA, 22 nt, Human
gucuccuccaguaggaaguggc

SEQ ID NO: 436852 - RNA, 22 nt, Human
agcaccagcucaaggugcaccu

SEQ ID NO: 436853 - RNA, 22 nt, Human
ucugucacccgagcaggcgaga

SEQ ID NO: 436854 - RNA, 19 nt, Human
aaaaggagagaucagaguu

SEQ ID NO: 436855 - RNA, 22 nt, Human
acagcagugucugguacugagu

SEQ ID NO: 436856 - RNA, 22 nt, Human
caggcugggacugaccccugcu

SEQ ID NO: 436857 - RNA, 22 nt, Human
gagcccagcccagagccauaug

SEQ ID NO: 436858 - RNA, 22 nt, Human
gauuccuuggcucugucucagg

SEQ ID NO: 436859 - RNA, 22 nt, Human
auagggcaguggcaucucuuaa

SEQ ID NO: 436860 - RNA, 22 nt, Human
uuucagaggagagcuggaccaa

SEQ ID NO: 436861 - RNA, 19 nt, Human
ggccuggauuuagggcucc

SEQ ID NO: 436862 - RNA, 22 nt, Human
ggcagcuguaagaugagugaau

SEQ ID NO: 436863 - RNA, 22 nt, Human
ugauauuugcugacugcauugu

SEQ ID NO: 436864 - RNA, 22 nt, Human
ccuuuuuucuaugccaacucug

SEQ ID NO: 436865 - RNA, 22 nt, Human
uagaggaacugccuuucuucug

SEQ ID NO: 436866 - RNA, 22 nt, Human
gcccucugcucagcuccucagc

SEQ ID NO: 436867 - RNA, 22 nt, Human
acagacaaguaguucagacaag

SEQ ID NO: 436868 - RNA, 22 nt, Human
caggggccuguccuggcuucug

SEQ ID NO: 436869 - RNA, 22 nt, Human
gggcuccaaaaucuaugucuuc

SEQ ID NO: 436870 - RNA, 22 nt, Human
ggccugugucugugccuguccu

SEQ ID NO: 436871 - RNA, 22 nt, Human
cacucuaaccuccaucuuccau

SEQ ID NO: 436872 - RNA, 21 nt, Human
ggcugcagggagcccuggggu

SEQ ID NO: 436873 - RNA, 22 nt, Human
uaccauuucaguaaaaacuuag

SEQ ID NO: 436874 - RNA, 22 nt, Human
aauggagacuucaaaauggauu

SEQ ID NO: 436875 - RNA, 22 nt, Human
cagcagcagacauuugaucuuc

SEQ ID NO: 436876 - RNA, 22 nt, Human
uucuaaauguaaauaguaugau

SEQ ID NO: 436877 - RNA, 22 nt, Human
ggagaccagaaggaagcuucga

SEQ ID NO: 436878 - RNA, 22 nt, Human
ggcuccagggaguggagagaag

SEQ ID NO: 436879 - RNA, 22 nt, Human
acagccagaggagccaggcugg

SEQ ID NO: 436880 - RNA, 22 nt, Human
aaauguacgggaguagaauuag

SEQ ID NO: 436881 - RNA, 23 nt, Human
cccuguagcccaggacaggcuuu

SEQ ID NO: 436882 - RNA, 22 nt, Human
uucuuuauaucugcuagugggu

SEQ ID NO: 436883 - RNA, 22 nt, Human
augacccagucaaagggaaugg

SEQ ID NO: 436884 - RNA, 20 nt, Human
agaagucagcucagaaguga

SEQ ID NO: 436885 - RNA, 22 nt, Human
uauuaaauuauggauuuaggag

SEQ ID NO: 436886 - RNA, 22 nt, Human
ugcaggcuccaggugcacauau

SEQ ID NO: 436887 - RNA, 22 nt, Human
gguggcagucuuaagagaucuu

SEQ ID NO: 436888 - RNA, 22 nt, Human
acccagaggcggagguugcagu

SEQ ID NO: 436889 - RNA, 22 nt, Human
aaggcagagucuaucuuggaag

SEQ ID NO: 436890 - RNA, 22 nt, Human
ggaagcuguuccuguguggcca

SEQ ID NO: 436891 - RNA, 23 nt, Human
aggcagcuggguagcaucuuucu

SEQ ID NO: 436892 - RNA, 22 nt, Human
gccugucucuuggaacuuggua

SEQ ID NO: 436893 - RNA, 18 nt, Human
cagauccaggcagcuauu

SEQ ID NO: 436894 - RNA, 22 nt, Human
aaggaagacacagaugaaguga

SEQ ID NO: 436895 - RNA, 23 nt, Human
acaucaugauagccaacuuggga

SEQ ID NO: 436896 - RNA, 22 nt, Human
aggucaccauggcaugcuccac

SEQ ID NO: 436897 - RNA, 22 nt, Human
gcuuugcuuccuuccccuucaa

SEQ ID NO: 436898 - RNA, 22 nt, Human
ccauggaguuccucuggucuau

SEQ ID NO: 436899 - RNA, 22 nt, Human
ucaggaaagaguaauguauaca

SEQ ID NO: 436900 - RNA, 22 nt, Human
acagagauguggaugagggauu

SEQ ID NO: 436901 - RNA, 22 nt, Human
cacugcaggucugagauggggg

SEQ ID NO: 436902 - RNA, 22 nt, Human
cagcaggcucugaguggcugcc

SEQ ID NO: 436903 - RNA, 22 nt, Human
agcccagccggauucccaguuc

SEQ ID NO: 436904 - RNA, 22 nt, Human
ucaggaaguugaggcguagaga

SEQ ID NO: 436905 - RNA, 22 nt, Human
agacaaauaagugcugggauuu

SEQ ID NO: 436906 - RNA, 22 nt, Human
ccugucccaagcagggcuggcc

SEQ ID NO: 436907 - RNA, 22 nt, Human
uccuccuguuucucaggccugg

SEQ ID NO: 436908 - RNA, 20 nt, Human
cagcccugugaccuggcccu

SEQ ID NO: 436909 - RNA, 22 nt, Human
cugcccugggaguaccuguccu

SEQ ID NO: 436910 - RNA, 22 nt, Human
uggccugggucacaccaggguc

SEQ ID NO: 436911 - RNA, 22 nt, Human
aaaggcuggauucagagaggug

SEQ ID NO: 436912 - RNA, 23 nt, Human
ccugcagcugcuggggcuccacc

SEQ ID NO: 436913 - RNA, 20 nt, Human
gccuggcacccggggcuggc

SEQ ID NO: 436914 - RNA, 22 nt, Human
cugcagagaugaagaagguggc

SEQ ID NO: 436915 - RNA, 23 nt, Human
uugcuuucaucaugagaugcucc

SEQ ID NO: 436916 - RNA, 22 nt, Human
cagggagcagccccuagaagua

SEQ ID NO: 436917 - RNA, 22 nt, Human
cugcccugacugaccuuuugaa

SEQ ID NO: 436918 - RNA, 22 nt, Human
augacacuguccuaguaaggaa

SEQ ID NO: 436919 - RNA, 22 nt, Human
ccugggcucaccaugccuugga

SEQ ID NO: 436920 - RNA, 22 nt, Human
cucccagauuccugcuguggga

SEQ ID NO: 436921 - RNA, 22 nt, Human
aggcaggugagucaaaacagac

SEQ ID NO: 436922 - RNA, 22 nt, Human
uguacaauagcuauuaucucca

SEQ ID NO: 436923 - RNA, 22 nt, Human
agcacguucuucauuacuucac

SEQ ID NO: 436924 - RNA, 22 nt, Human
aagggcagcugacagaugcuua

SEQ ID NO: 436925 - RNA, 22 nt, Human
acacaguauuacaauaggugcu

SEQ ID NO: 436926 - RNA, 22 nt, Human
aaccccaggcuggaggagucuc

SEQ ID NO: 436927 - RNA, 22 nt, Human
aaugaugagaacuggaguaauu

SEQ ID NO: 436928 - RNA, 22 nt, Human
uuccaggacuucauggcucuga

SEQ ID NO: 436929 - RNA, 22 nt, Human
caucuuuucagaagccauucug

SEQ ID NO: 436930 - RNA, 22 nt, Human
cagagcaguaaaucuggggcac

SEQ ID NO: 436931 - RNA, 22 nt, Human
acaagcauaagugagaugaaua

SEQ ID NO: 436932 - RNA, 22 nt, Human
uacuuauuguugaacugaauca

SEQ ID NO: 436933 - RNA, 22 nt, Human
uguuuaacuaguuuucacacuu

SEQ ID NO: 436934 - RNA, 22 nt, Human
caugaacagcuaacauuuuggg

SEQ ID NO: 436935 - RNA, 22 nt, Human
agccagggacgcugcaggcuac

SEQ ID NO: 436936 - RNA, 22 nt, Human
ugccagggccauagggagucua

SEQ ID NO: 436937 - RNA, 18 nt, Human
gcaacaguaucagcaggc

SEQ ID NO: 436938 - RNA, 22 nt, Human
uuuguacauauaaaucuuguau

SEQ ID NO: 436939 - RNA, 22 nt, Human
aaguuccuaaagucagggguca

SEQ ID NO: 436940 - RNA, 22 nt, Human
ugcagcugcaggagggugggag

SEQ ID NO: 436941 - RNA, 22 nt, Human
ggucccaggauugguugcgcag

SEQ ID NO: 436942 - RNA, 22 nt, Human
gcaauaaacauguuugaugcgc

SEQ ID NO: 436943 - RNA, 22 nt, Human
uuaugcagucgacaucugauca

SEQ ID NO: 436944 - RNA, 22 nt, Human
ugcaggaauagcuacagagcug

SEQ ID NO: 436945 - RNA, 22 nt, Human
uucaugaauggaaucaaugcuc

SEQ ID NO: 436946 - RNA, 22 nt, Human
caggcugaggcaguaggguuug

SEQ ID NO: 436947 - RNA, 22 nt, Human
gacacagcuuucugaagagcau

SEQ ID NO: 436948 - RNA, 22 nt, Human
ccaggcuggucugaauuucuag

SEQ ID NO: 436949 - RNA, 22 nt, Human
ucacuggggccuuuggucagga

SEQ ID NO: 436950 - RNA, 22 nt, Human
cagagucaugggccgucaggca

SEQ ID NO: 436951 - RNA, 22 nt, Human
caggccuuucuggggaagugag

SEQ ID NO: 436952 - RNA, 22 nt, Human
aaagcagacugauuugcaucac

SEQ ID NO: 436953 - RNA, 22 nt, Human
aaaguuuuauaugcugcagcga

SEQ ID NO: 436954 - RNA, 22 nt, Human
cugaggccguuggugggccuua

SEQ ID NO: 436955 - RNA, 22 nt, Human
auuuagcaaaaaaugaugaagc

SEQ ID NO: 436956 - RNA, 22 nt, Human
cacaggagggagcgggcagcca

SEQ ID NO: 436957 - RNA, 22 nt, Human
uucuuuuuaaaguguguaugca

SEQ ID NO: 436958 - RNA, 22 nt, Human
cccugccuugggguccacaccg

SEQ ID NO: 436959 - RNA, 22 nt, Human
gcagagcuaucuucuggauuug

SEQ ID NO: 436960 - RNA, 22 nt, Human
ccgggagcaggcgccaccgcca

SEQ ID NO: 436961 - RNA, 22 nt, Human
aagggcaggugggcauuucugg

SEQ ID NO: 436962 - RNA, 22 nt, Human
uuaacauacaucaugaacaaug

SEQ ID NO: 436963 - RNA, 22 nt, Human
gucugucaucugagauggagug

SEQ ID NO: 436964 - RNA, 22 nt, Human
auuuaccagcugugcacugaua

SEQ ID NO: 436965 - RNA, 22 nt, Human
uucaaacuaguuaaaagucaga

SEQ ID NO: 436966 - RNA, 22 nt, Human
uggucucuucuuccaagauggc

SEQ ID NO: 436967 - RNA, 22 nt, Human
ugaugauugggagacauuuggg

SEQ ID NO: 436968 - RNA, 22 nt, Human
caaguacuuugaaaaguugaau

SEQ ID NO: 436969 - RNA, 22 nt, Human
cacauuuaucucucuccgguga

SEQ ID NO: 436970 - RNA, 22 nt, Human
ugcugccacauuuaaagagggg

SEQ ID NO: 436971 - RNA, 22 nt, Human
aggcgagaggcuugggcuagua

SEQ ID NO: 436972 - RNA, 22 nt, Human
caguaauuccaagugcuuauac

SEQ ID NO: 436973 - RNA, 22 nt, Human
uggugagacaggaucaaccccu

SEQ ID NO: 436974 - RNA, 22 nt, Human
gacagcaacacaugcuuagugc

SEQ ID NO: 436975 - RNA, 22 nt, Human
gcucagggaaggccacgugaga

SEQ ID NO: 436976 - RNA, 22 nt, Human
cugaggaccccacaggaggccc

SEQ ID NO: 436977 - RNA, 22 nt, Human
gcagcuguggguuccaagucua

SEQ ID NO: 436978 - RNA, 22 nt, Human
aagaacaugaacacaauguuua

SEQ ID NO: 436979 - RNA, 22 nt, Human
uuucuugaccacuauguugaua

SEQ ID NO: 436980 - RNA, 22 nt, Human
ugggggcagccaggcugucaag

SEQ ID NO: 436981 - RNA, 22 nt, Human
ccagcagaagcucccgcugggu

SEQ ID NO: 436982 - RNA, 22 nt, Human
uaagauaauaaguaugucuaug

SEQ ID NO: 436983 - RNA, 22 nt, Human
uucucugcauuguaaagagcca

SEQ ID NO: 436984 - RNA, 23 nt, Human
agcuggguggccugcgugaagcu

SEQ ID NO: 436985 - RNA, 22 nt, Human
ccaggagccacucaggcccaca

SEQ ID NO: 436986 - RNA, 22 nt, Human
gaggucuucacaaagaacagca

SEQ ID NO: 436987 - RNA, 22 nt, Human
uaguccuggauugguggaggca

SEQ ID NO: 436988 - RNA, 22 nt, Human
agacuccaggagggaggcugcu

SEQ ID NO: 436989 - RNA, 22 nt, Human
cugagcugguggaagcaugcag

SEQ ID NO: 436990 - RNA, 22 nt, Human
cagcccugcugacacugucuga

SEQ ID NO: 436991 - RNA, 19 nt, Human
ccugggccuccaucacccc

SEQ ID NO: 436992 - RNA, 22 nt, Human
gggcuccaguuuggccaggaag

SEQ ID NO: 436993 - RNA, 22 nt, Human
cugcccaggaaccagaggggca

SEQ ID NO: 436994 - RNA, 22 nt, Human
aaguguauuaagcaacguuauu

SEQ ID NO: 436995 - RNA, 22 nt, Human
agccagcugccuuucacaucug

SEQ ID NO: 436996 - RNA, 22 nt, Human
uccugccucuuuucuuauucca

SEQ ID NO: 436997 - RNA, 22 nt, Human
cacaggaacuuacuggccacuu

SEQ ID NO: 436998 - RNA, 22 nt, Human
gccucuggucccucaugcugug

SEQ ID NO: 436999 - RNA, 22 nt, Human
cuguuucagaacuucuuaaaaa

SEQ ID NO: 437000 - RNA, 22 nt, Human
aaagccuucugucuagcagaua

SEQ ID NO: 437001 - RNA, 22 nt, Human
uaugugcaaaaugcuagacuag

SEQ ID NO: 437002 - RNA, 22 nt, Human
uaacaguugguguaauuucuug

SEQ ID NO: 437003 - RNA, 18 nt, Human
gaggcacauaguuggggc

SEQ ID NO: 437004 - RNA, 22 nt, Human
cuaagacaugcccugcaugaua

SEQ ID NO: 437005 - RNA, 21 nt, Human
uggcaggcagcuggaagcuug

SEQ ID NO: 437006 - RNA, 22 nt, Human
caagcaggguuuaugcauggag

SEQ ID NO: 437007 - RNA, 22 nt, Human
agguaacagcuucagcuucaga

SEQ ID NO: 437008 - RNA, 23 nt, Human
aaaugcacaguauugauuuuuaa

SEQ ID NO: 437009 - RNA, 22 nt, Human
agccugggcaugggacgggagg

SEQ ID NO: 437010 - RNA, 22 nt, Human
acaggccuagcuaaugcuuucc

SEQ ID NO: 437011 - RNA, 22 nt, Human
agagcugggugaagugccauca

SEQ ID NO: 437012 - RNA, 22 nt, Human
aauuauauguuaaucuucaauu

SEQ ID NO: 437013 - RNA, 22 nt, Human
caaacuauuguucacaagacaa

SEQ ID NO: 437014 - RNA, 22 nt, Human
caugggggucuggacaacaggc

SEQ ID NO: 437015 - RNA, 20 nt, Human
agagagcacaggcaggaaag

SEQ ID NO: 437016 - RNA, 22 nt, Human
aggcagcuuuaacugguaguag

SEQ ID NO: 437017 - RNA, 22 nt, Human
gcugucuucacuuccugguuuc

SEQ ID NO: 437018 - RNA, 22 nt, Human
ugggacagugugccuugcuccu

SEQ ID NO: 437019 - RNA, 22 nt, Human
gagcugagaucauguacacuag

SEQ ID NO: 437020 - RNA, 22 nt, Human
agggcagagaaauguaguugag

SEQ ID NO: 437021 - RNA, 16 nt, Human
cagcccugaggaagaa

SEQ ID NO: 437022 - RNA, 22 nt, Human
uuugcauuuugauaagaucacu

SEQ ID NO: 437023 - RNA, 22 nt, Human
aggcaggugggucacuugaguc

SEQ ID NO: 437024 - RNA, 20 nt, Human
aggcuuggcuuggcaggaac

SEQ ID NO: 437025 - RNA, 21 nt, Human
agugugugauaggcaggaaga

SEQ ID NO: 437026 - RNA, 22 nt, Human
gcaggaguguggugggacaucc

SEQ ID NO: 437027 - RNA, 22 nt, Human
agcaacaggguggucuucagaa

SEQ ID NO: 437028 - RNA, 22 nt, Human
aagcaaaugaaccagagguaau

SEQ ID NO: 437029 - RNA, 22 nt, Human
ggaaggcagugaaggggcugau

SEQ ID NO: 437030 - RNA, 22 nt, Human
augaggcagcugcuggagaacg

SEQ ID NO: 437031 - RNA, 22 nt, Human
gacuauuuauuuacagaaagcu

SEQ ID NO: 437032 - RNA, 22 nt, Human
uagcugccuuugggcuccugcu

SEQ ID NO: 437033 - RNA, 22 nt, Human
cugcccagaagcuuagagcuua

SEQ ID NO: 437034 - RNA, 22 nt, Human
gaggcagcagggcugguuccuu

SEQ ID NO: 437035 - RNA, 22 nt, Human
agggagccaggaacgcaggucg

SEQ ID NO: 437036 - RNA, 22 nt, Human
gcagcuguaucacuuuuaaaca

SEQ ID NO: 437037 - RNA, 22 nt, Human
ccugugucagccccugccucca

SEQ ID NO: 437038 - RNA, 22 nt, Human
gcuggccauggggagugaggag

SEQ ID NO: 437039 - RNA, 22 nt, Human
uggggcuggggaucuugagccu

SEQ ID NO: 437040 - RNA, 22 nt, Human
ugaacaaauggaaauaaccagu

SEQ ID NO: 437041 - RNA, 22 nt, Human
agaggcuccaccuucucugucc

SEQ ID NO: 437042 - RNA, 18 nt, Human
aggaagcaggaggaaggc

SEQ ID NO: 437043 - RNA, 22 nt, Human
ccaggcccccgagcagaagaca

SEQ ID NO: 437044 - RNA, 22 nt, Human
caagccugucucaccagugcua

SEQ ID NO: 437045 - RNA, 22 nt, Human
ccauuugguauagugaaaagga

SEQ ID NO: 437046 - RNA, 21 nt, Human
aaccagagccaggcucucagc

SEQ ID NO: 437047 - RNA, 20 nt, Human
uugcaaauaucuauugauug

SEQ ID NO: 437048 - RNA, 22 nt, Human
ucaaaacacuauuaccuuuaau

SEQ ID NO: 437049 - RNA, 22 nt, Human
ugugaggguuuuaagggaauga

SEQ ID NO: 437050 - RNA, 22 nt, Human
gggcugagacgauggggucuuc

SEQ ID NO: 437051 - RNA, 22 nt, Human
gguuccugauagauuccuuuug

SEQ ID NO: 437052 - RNA, 22 nt, Human
cuuuggcuugcccuggcaguac

SEQ ID NO: 437053 - RNA, 22 nt, Human
auuauuuacagugugcucgaag

SEQ ID NO: 437054 - RNA, 22 nt, Human
uuccuuccgggcaccaggcacu

SEQ ID NO: 437055 - RNA, 22 nt, Human
uucugugugcugucuuggcuuu

SEQ ID NO: 437056 - RNA, 22 nt, Human
ccugggaggcagagguugcagu

SEQ ID NO: 437057 - RNA, 18 nt, Human
gcucuggcucaccuccag

SEQ ID NO: 437058 - RNA, 22 nt, Human
guccaugauucuguguaguaga

SEQ ID NO: 437059 - RNA, 21 nt, Human
gcucagaguauugcacuguuu

SEQ ID NO: 437060 - RNA, 22 nt, Human
cauuguuauagcauuacacacc

SEQ ID NO: 437061 - RNA, 22 nt, Human
ugcugccaagcccgugcuccug

SEQ ID NO: 437062 - RNA, 22 nt, Human
gcuccaggcgagcuggaccaga

SEQ ID NO: 437063 - RNA, 22 nt, Human
gcagggacgccagggacagcaa

SEQ ID NO: 437064 - RNA, 23 nt, Human
ccagcucccaggucugaggacug

SEQ ID NO: 437065 - RNA, 20 nt, Human
gagagcuggggaugaggcug

SEQ ID NO: 437066 - RNA, 20 nt, Human
ccaggcuggcaaaugggggc

SEQ ID NO: 437067 - RNA, 22 nt, Human
caauuucacuaauaauauuuac

SEQ ID NO: 437068 - RNA, 22 nt, Human
uuagcacuggauuaaucaaagu

SEQ ID NO: 437069 - RNA, 22 nt, Human
ucacaacucuuuccauuuaaua

SEQ ID NO: 437070 - RNA, 16 nt, Human
agcagggcgggaagga

SEQ ID NO: 437071 - RNA, 22 nt, Human
aacaugcauguuauuuaucagu

SEQ ID NO: 437072 - RNA, 22 nt, Human
uucucccagaccaaaggcagca

SEQ ID NO: 437073 - RNA, 22 nt, Human
auuucucucauuguuagcuagg

SEQ ID NO: 437074 - RNA, 22 nt, Human
cagccagaaccuaggaugagcu

SEQ ID NO: 437075 - RNA, 22 nt, Human
uuuacuacuugugauaacugaa

SEQ ID NO: 437076 - RNA, 22 nt, Human
ugcacacagcugggccuggcug

SEQ ID NO: 437077 - RNA, 22 nt, Human
ccucaggcugucuuccuucugg

SEQ ID NO: 437078 - RNA, 22 nt, Human
aaguccugagaccagaaaaugg

SEQ ID NO: 437079 - RNA, 20 nt, Human
auuccucagccccagccuca

SEQ ID NO: 437080 - RNA, 22 nt, Human
agaggaauuucuggaaggaggc

SEQ ID NO: 437081 - RNA, 22 nt, Human
uucacauugaaggugcuuucuu

SEQ ID NO: 437082 - RNA, 22 nt, Human
guggacagagcuagaaaaugug

SEQ ID NO: 437083 - RNA, 22 nt, Human
cagcccugucuaugacugauga

SEQ ID NO: 437084 - RNA, 22 nt, Human
acagauacuauaauguaaagug

SEQ ID NO: 437085 - RNA, 22 nt, Human
aaggccucuucucucuggagau

SEQ ID NO: 437086 - RNA, 22 nt, Human
ucuuggcuaguaccuuccugcc

SEQ ID NO: 437087 - RNA, 22 nt, Human
uggcucagcuuacuuuugaggg

SEQ ID NO: 437088 - RNA, 22 nt, Human
uuuaucugcauucugaccaucu

SEQ ID NO: 437089 - RNA, 22 nt, Human
cagagguuugaucgaguagguc

SEQ ID NO: 437090 - RNA, 22 nt, Human
ucucucccaaaucugcagauag

SEQ ID NO: 437091 - RNA, 23 nt, Human
gccagccuugcucuccugcagcc

SEQ ID NO: 437092 - RNA, 22 nt, Human
aggugccuaucuggucucugca

SEQ ID NO: 437093 - RNA, 22 nt, Human
auguguguacacacgugacucu

SEQ ID NO: 437094 - RNA, 22 nt, Human
ucugacagggccaaacaugaca

SEQ ID NO: 437095 - RNA, 22 nt, Human
caauuucaugccauguauugcu

SEQ ID NO: 437096 - RNA, 17 nt, Human
acaggccugcuugcacu

SEQ ID NO: 437097 - RNA, 22 nt, Human
agccucugaugaucacaggggg

SEQ ID NO: 437098 - RNA, 22 nt, Human
uucacagucacccuucuccaug

SEQ ID NO: 437099 - RNA, 22 nt, Human
acagaguaucuaucaggaguau

SEQ ID NO: 437100 - RNA, 23 nt, Human
cauuucaacgaauuuuccuucug

SEQ ID NO: 437101 - RNA, 22 nt, Human
uucaaacugaggagaggauggc

SEQ ID NO: 437102 - RNA, 19 nt, Human
gaggagcuaucggagacag

SEQ ID NO: 437103 - RNA, 17 nt, Human
aggaagcgagcuggccu

SEQ ID NO: 437104 - RNA, 22 nt, Human
uuucuaaaauagauuuuauggu

SEQ ID NO: 437105 - RNA, 22 nt, Human
cuucugagauguuguuuuacag

SEQ ID NO: 437106 - RNA, 23 nt, Human
uccagccucuugcucucacaugc

SEQ ID NO: 437107 - RNA, 21 nt, Human
aggaaaggaaguccccagggu

SEQ ID NO: 437108 - RNA, 22 nt, Human
gggcuucucuuuagugagcuga

SEQ ID NO: 437109 - RNA, 22 nt, Human
uaaauugcauaaguacaaauga

SEQ ID NO: 437110 - RNA, 22 nt, Human
cccucagcuucucccugcagcu

SEQ ID NO: 437111 - RNA, 22 nt, Human
aggaaguuaguaaauuaugugc

SEQ ID NO: 437112 - RNA, 22 nt, Human
aaugaugaacucagagggaacc

SEQ ID NO: 437113 - RNA, 22 nt, Human
ucugccugccagucugguccuc

SEQ ID NO: 437114 - RNA, 22 nt, Human
gucugcccucacgccagcuggg

SEQ ID NO: 437115 - RNA, 22 nt, Human
ccugagcuggaagagcuugugc

SEQ ID NO: 437116 - RNA, 22 nt, Human
uggagcagagaugguggccuuc

SEQ ID NO: 437117 - RNA, 22 nt, Human
cugugugcugaaaugcagugag

SEQ ID NO: 437118 - RNA, 22 nt, Human
uugcccacucaugcuuuugaua

SEQ ID NO: 437119 - RNA, 22 nt, Human
gagcugccuacauugccaagag

SEQ ID NO: 437120 - RNA, 22 nt, Human
aaacugcagccuugaguucagg

SEQ ID NO: 437121 - RNA, 17 nt, Human
aggcagauguuuuauuu

SEQ ID NO: 437122 - RNA, 22 nt, Human
uagugccaccuuccaaguauca

SEQ ID NO: 437123 - RNA, 22 nt, Human
uucuuuuuggauagcugaugaa

SEQ ID NO: 437124 - RNA, 22 nt, Human
ggcacagcaagaagggaaauga

SEQ ID NO: 437125 - RNA, 21 nt, Human
gccuggcagguggaagggcuc

SEQ ID NO: 437126 - RNA, 22 nt, Human
cccaggagguagagguugcagu

SEQ ID NO: 437127 - RNA, 22 nt, Human
agcaacagcagguuugcacucc

SEQ ID NO: 437128 - RNA, 22 nt, Human
aacaggaaauacuuaugaggua

SEQ ID NO: 437129 - RNA, 22 nt, Human
cacagcugcccuacuccaugug

SEQ ID NO: 437130 - RNA, 22 nt, Human
uacagaggagaccaaggcucag

SEQ ID NO: 437131 - RNA, 22 nt, Human
ugaauagauuuuuaacauauaa

SEQ ID NO: 437132 - RNA, 22 nt, Human
ucugaggcugaauggacuccgu

SEQ ID NO: 437133 - RNA, 18 nt, Human
agugugugcccuuucagg

SEQ ID NO: 437134 - RNA, 22 nt, Human
ugaggcaggagaaucacaugaa

SEQ ID NO: 437135 - RNA, 22 nt, Human
cacugcaaccucugccaccugg

SEQ ID NO: 437136 - RNA, 22 nt, Human
uuuuuauaacucuuuugugaca

SEQ ID NO: 437137 - RNA, 22 nt, Human
guugauuuagugagugagcagu

SEQ ID NO: 437138 - RNA, 23 nt, Human
uggaggaaacacaucagaagacc

SEQ ID NO: 437139 - RNA, 22 nt, Human
cuucccuuuuuaugucuucagc

SEQ ID NO: 437140 - RNA, 22 nt, Human
gggcccuggacguggcggcaga

SEQ ID NO: 437141 - RNA, 20 nt, Human
cacaggaaagcuacucaguu

SEQ ID NO: 437142 - RNA, 22 nt, Human
acucucccugagagggaggcau

SEQ ID NO: 437143 - RNA, 22 nt, Human
cugggcaggauacuucauggga

SEQ ID NO: 437144 - RNA, 22 nt, Human
agcagcuggaacuaauaguggu

SEQ ID NO: 437145 - RNA, 22 nt, Human
uauuuaauuugcucauugugau

SEQ ID NO: 437146 - RNA, 20 nt, Human
uuucaaacugcaccuuugcu

SEQ ID NO: 437147 - RNA, 22 nt, Human
uuucuacaugucaguaacugau

SEQ ID NO: 437148 - RNA, 22 nt, Human
cauuucuaccaaaugugacugg

SEQ ID NO: 437149 - RNA, 22 nt, Human
ucaggacacuuggcacaagguc

SEQ ID NO: 437150 - RNA, 22 nt, Human
acuuugcaggccuuuucuugug

SEQ ID NO: 437151 - RNA, 22 nt, Human
aggccagcuguuacuagagcca

SEQ ID NO: 437152 - RNA, 22 nt, Human
caauacuuccuuguuagaggca

SEQ ID NO: 437153 - RNA, 22 nt, Human
uuagaaaaaggcuguggucuua

SEQ ID NO: 437154 - RNA, 22 nt, Human
ggccucuggcaggcaggcccuc

SEQ ID NO: 437155 - RNA, 22 nt, Human
caggcacugugcaagggucucg

SEQ ID NO: 437156 - RNA, 22 nt, Human
agccacagucaaccuguccaua

SEQ ID NO: 437157 - RNA, 23 nt, Human
acagacaacacugaugagagaaa

SEQ ID NO: 437158 - RNA, 22 nt, Human
caacaggcuuuauguuuaaagu

SEQ ID NO: 437159 - RNA, 22 nt, Human
cccagcaguuugcuuagaguga

SEQ ID NO: 437160 - RNA, 22 nt, Human
agcugcagauucuaucuagaag

SEQ ID NO: 437161 - RNA, 22 nt, Human
cccagcacuuugaauaugucac

SEQ ID NO: 437162 - RNA, 22 nt, Human
cacaugaagagagucuaguaau

SEQ ID NO: 437163 - RNA, 22 nt, Human
acaugcaugucaucagcccuuu

SEQ ID NO: 437164 - RNA, 16 nt, Human
ccuuucucugccuucc

SEQ ID NO: 437165 - RNA, 18 nt, Human
gccugccuagagcuugcc

SEQ ID NO: 437166 - RNA, 22 nt, Human
agacaagagcugaggacauauu

SEQ ID NO: 437167 - RNA, 22 nt, Human
caggcccucaggcaagggcucu

SEQ ID NO: 437168 - RNA, 22 nt, Human
ucugacccacaagcauccugga

SEQ ID NO: 437169 - RNA, 23 nt, Human
ugcucccaggugacgcugcuguu

SEQ ID NO: 437170 - RNA, 23 nt, Human
acaagauagggauaaaaagauaa

SEQ ID NO: 437171 - RNA, 22 nt, Human
cagggcccagucccugcuguca

SEQ ID NO: 437172 - RNA, 22 nt, Human
uccauuuuagagaugaagaaac

SEQ ID NO: 437173 - RNA, 22 nt, Human
ugagacagucccaugaucugca

SEQ ID NO: 437174 - RNA, 22 nt, Human
augcauauuucuuggagcaccu

SEQ ID NO: 437175 - RNA, 22 nt, Human
gcacagcucagcaugggaggac

SEQ ID NO: 437176 - RNA, 22 nt, Human
uuuauccauaucauuaaaaucu

SEQ ID NO: 437177 - RNA, 22 nt, Human
ccugaggcccuggcugugcuga

SEQ ID NO: 437178 - RNA, 22 nt, Human
aauauguuccacuuaaagcugg

SEQ ID NO: 437179 - RNA, 22 nt, Human
ucugaauuuuaacuacacaaag

SEQ ID NO: 437180 - RNA, 22 nt, Human
aggaaugauucaagacuuggcu

SEQ ID NO: 437181 - RNA, 23 nt, Human
gcuguuucacaacagccguguuu

SEQ ID NO: 437182 - RNA, 22 nt, Human
uaaagacaauaggaaaguuguu

SEQ ID NO: 437183 - RNA, 22 nt, Human
agcugagccagcagcaacagga

SEQ ID NO: 437184 - RNA, 22 nt, Human
acuaaguaguuucacauauaau

SEQ ID NO: 437185 - RNA, 22 nt, Human
uuuuaugugucaaagcaguggu

SEQ ID NO: 437186 - RNA, 22 nt, Human
uauucagaggugaaguagggag

SEQ ID NO: 437187 - RNA, 22 nt, Human
gcccucagcuccuggacacaug

SEQ ID NO: 437188 - RNA, 22 nt, Human
agcugcagcccuccugcauggc

SEQ ID NO: 437189 - RNA, 22 nt, Human
cagguccccuccccuaccaggc

SEQ ID NO: 437190 - RNA, 22 nt, Human
augcauuuuugaguaugaauga

SEQ ID NO: 437191 - RNA, 22 nt, Human
acagaggaagcauauagcacaa

SEQ ID NO: 437192 - RNA, 22 nt, Human
caggcacucagucuggaucccu

SEQ ID NO: 437193 - RNA, 19 nt, Human
agcacaguuuccacaugca

SEQ ID NO: 437194 - RNA, 18 nt, Human
ucuccacuucugugagaa

SEQ ID NO: 437195 - RNA, 22 nt, Human
cagagguagaaggcaugcagug

SEQ ID NO: 437196 - RNA, 22 nt, Human
gcaguggcuaagcucgcaugca

SEQ ID NO: 437197 - RNA, 22 nt, Human
ccugggcauaaaucacuccaag

SEQ ID NO: 437198 - RNA, 22 nt, Human
agcccuccucacaucagcgucc

SEQ ID NO: 437199 - RNA, 21 nt, Human
uggagcugccacuuguccucc

SEQ ID NO: 437200 - RNA, 22 nt, Human
ugcagcaguguuccuuggcuug

SEQ ID NO: 437201 - RNA, 22 nt, Human
aggagcugggcugcugcuggga

SEQ ID NO: 437202 - RNA, 22 nt, Human
ggacagaggguugacagaguau

SEQ ID NO: 437203 - RNA, 22 nt, Human
ggcugcugcccaccccugcaug

SEQ ID NO: 437204 - RNA, 22 nt, Human
guccugagucaagugugggcag

SEQ ID NO: 437205 - RNA, 22 nt, Human
gccaaggcugaggcccugggcu

SEQ ID NO: 437206 - RNA, 22 nt, Human
cagacagaggcuguaugagggc

SEQ ID NO: 437207 - RNA, 22 nt, Human
uauuuucuguggaggaccagau

SEQ ID NO: 437208 - RNA, 22 nt, Human
gcuccuggcuucacugacauca

SEQ ID NO: 437209 - RNA, 22 nt, Human
aagaugcuuauugcuccugcag

SEQ ID NO: 437210 - RNA, 22 nt, Human
caguacuuauuucuauuuaggg

SEQ ID NO: 437211 - RNA, 22 nt, Human
aacaguuuaugauaaauucuua

SEQ ID NO: 437212 - RNA, 23 nt, Human
agggcugaugccauugcagcucu

SEQ ID NO: 437213 - RNA, 22 nt, Human
aaauugccugaguaugucacau

SEQ ID NO: 437214 - RNA, 22 nt, Human
cuggacagaaagggcugcugug

SEQ ID NO: 437215 - RNA, 22 nt, Human
gcugccaguaguuggagcucca

SEQ ID NO: 437216 - RNA, 22 nt, Human
cuucacagccaacaugggcaca

SEQ ID NO: 437217 - RNA, 22 nt, Human
aagacagugugucaggcaggug

SEQ ID NO: 437218 - RNA, 22 nt, Human
cuuugcaaacgauuaccacaug

SEQ ID NO: 437219 - RNA, 22 nt, Human
cuguuucacguguuuaagccca

SEQ ID NO: 437220 - RNA, 22 nt, Human
acuuuguuccuuucacaaagaa

SEQ ID NO: 437221 - RNA, 18 nt, Human
agguuugguggaaacaua

SEQ ID NO: 437222 - RNA, 22 nt, Human
ggcacagggaggcccuggugug

SEQ ID NO: 437223 - RNA, 22 nt, Human
agccagcaggugagugcagccu

SEQ ID NO: 437224 - RNA, 22 nt, Human
agcccaggucucaaaguacagg

SEQ ID NO: 437225 - RNA, 22 nt, Human
gggccaggucggugaaugguca

SEQ ID NO: 437226 - RNA, 22 nt, Human
cagcccugggaguuggggccga

SEQ ID NO: 437227 - RNA, 21 nt, Human
caguccugcaaauaauucuuu

SEQ ID NO: 437228 - RNA, 22 nt, Human
agccuggguggggguucggaga

SEQ ID NO: 437229 - RNA, 22 nt, Human
uuugacaucuaagaauucuuac

SEQ ID NO: 437230 - RNA, 20 nt, Human
uccugggguaagccaugguc

SEQ ID NO: 437231 - RNA, 22 nt, Human
agcagcugguucccgagggcgu

SEQ ID NO: 437232 - RNA, 22 nt, Human
cuccucuggcuuccuggaggca

SEQ ID NO: 437233 - RNA, 22 nt, Human
gccugggugaauuugauccuaa

SEQ ID NO: 437234 - RNA, 22 nt, Human
ggcucuggugcccuggcuccca

SEQ ID NO: 437235 - RNA, 22 nt, Human
cagcagagacgguaagcagaac

SEQ ID NO: 437236 - RNA, 22 nt, Human
gcaauaaagauuuuacugucag

SEQ ID NO: 437237 - RNA, 22 nt, Human
ucugggcagcagcagcuaguag

SEQ ID NO: 437238 - RNA, 22 nt, Human
uacugaaagacugaauauuuag

SEQ ID NO: 437239 - RNA, 22 nt, Human
ucaugcagguuuccagccagau

SEQ ID NO: 437240 - RNA, 22 nt, Human
uacuuuuugucucuuugaaugu

SEQ ID NO: 437241 - RNA, 20 nt, Human
ccugggcuccaggagccccg

SEQ ID NO: 437242 - RNA, 22 nt, Human
gagcacagcuggagguagcauu

SEQ ID NO: 437243 - RNA, 22 nt, Human
cugcccugagggccuguguguu

SEQ ID NO: 437244 - RNA, 22 nt, Human
ggcaauaaaaguauccaguuuc

SEQ ID NO: 437245 - RNA, 22 nt, Human
ugacacaggggaaggagucugg

SEQ ID NO: 437246 - RNA, 22 nt, Human
caggcuccuucccagggauggu

SEQ ID NO: 437247 - RNA, 22 nt, Human
agauaacauguugcagauucug

SEQ ID NO: 437248 - RNA, 22 nt, Human
uguugcaggccccugggguaug

SEQ ID NO: 437249 - RNA, 22 nt, Human
gacugaaggucucagcauguga

SEQ ID NO: 437250 - RNA, 22 nt, Human
gacaauacagaaagggacaugc

SEQ ID NO: 437251 - RNA, 22 nt, Human
agguccugucuaucacccucgc

SEQ ID NO: 437252 - RNA, 22 nt, Human
agucugggagggaugccagugu

SEQ ID NO: 437253 - RNA, 22 nt, Human
caggccuuuuuuccugcagugu

SEQ ID NO: 437254 - RNA, 22 nt, Human
cuauucaguugugggcaacaau

SEQ ID NO: 437255 - RNA, 22 nt, Human
uucuauaaaugaauguguauau

SEQ ID NO: 437256 - RNA, 22 nt, Human
gccuggagcuacuggacacuga

SEQ ID NO: 437257 - RNA, 19 nt, Human
cugcucagagcagcuccag

SEQ ID NO: 437258 - RNA, 22 nt, Human
uuucagagucuggcugcagccu

SEQ ID NO: 437259 - RNA, 22 nt, Human
uauuuuguuuuguauccacugu

SEQ ID NO: 437260 - RNA, 22 nt, Human
ugagcccuaagggucaagcagg

SEQ ID NO: 437261 - RNA, 22 nt, Human
auaaauuaugaauggcccuuuu

SEQ ID NO: 437262 - RNA, 22 nt, Human
agcaggcuuacuuucugauuag

SEQ ID NO: 437263 - RNA, 22 nt, Human
ugcuaucaccaacucugcuaag

SEQ ID NO: 437264 - RNA, 22 nt, Human
gcaggccugcagguauggccgg

SEQ ID NO: 437265 - RNA, 22 nt, Human
agaggguagaagacaggguugc

SEQ ID NO: 437266 - RNA, 22 nt, Human
accagagcuuacaugcuagaaa

SEQ ID NO: 437267 - RNA, 23 nt, Human
aacauacuguuuaauauucacag

SEQ ID NO: 437268 - RNA, 22 nt, Human
ccugaagcacaaaagcacagcu

SEQ ID NO: 437269 - RNA, 22 nt, Human
aggagacaucuaacuguagguu

SEQ ID NO: 437270 - RNA, 22 nt, Human
aacaggaacuauuuguauucca

SEQ ID NO: 437271 - RNA, 22 nt, Human
gcugggacugagacagugaccu

SEQ ID NO: 437272 - RNA, 22 nt, Human
gacauucagccaauuacuuucu

SEQ ID NO: 437273 - RNA, 22 nt, Human
ugccaccuggacaaccuuaugc

SEQ ID NO: 437274 - RNA, 22 nt, Human
acaggcugaaaguuaaguucug

SEQ ID NO: 437275 - RNA, 22 nt, Human
acacucuacagagcaaucuacc

SEQ ID NO: 437276 - RNA, 22 nt, Human
acauggaucaaccuauuuucuu

SEQ ID NO: 437277 - RNA, 22 nt, Human
uggaaacagaucauaacuaagc

SEQ ID NO: 437278 - RNA, 22 nt, Human
cuaggcuguaaccccugccagg

SEQ ID NO: 437279 - RNA, 22 nt, Human
uuaacagacauauauauuugua

SEQ ID NO: 437280 - RNA, 19 nt, Human
aggggcacugucucuagag

SEQ ID NO: 437281 - RNA, 22 nt, Human
uaacagucaugugcuacugcua

SEQ ID NO: 437282 - RNA, 22 nt, Human
gccacugcacuccagcccaggc

SEQ ID NO: 437283 - RNA, 22 nt, Human
ucuguaguuuacaguauuucag

SEQ ID NO: 437284 - RNA, 22 nt, Human
ugcccagcaauaaaccagaaga

SEQ ID NO: 437285 - RNA, 22 nt, Human
cuggugcaaaaguaauuguggu

SEQ ID NO: 437286 - RNA, 22 nt, Human
gaggaaggagggaaagcgcgcg

SEQ ID NO: 437287 - RNA, 22 nt, Human
uaggcugggagccugaggcuag

SEQ ID NO: 437288 - RNA, 22 nt, Human
ugcuccugcugcaugcaucucc

SEQ ID NO: 437289 - RNA, 22 nt, Human
ucacaaaucauuuuaucugugu

SEQ ID NO: 437290 - RNA, 19 nt, Human
cccuggcaggcaagccugg

SEQ ID NO: 437291 - RNA, 22 nt, Human
uucaagaggcuuaauucuggau

SEQ ID NO: 437292 - RNA, 22 nt, Human
uauugcuuaaaaaauaugugag

SEQ ID NO: 437293 - RNA, 22 nt, Human
auacaucaugcuccauauauuu

SEQ ID NO: 437294 - RNA, 22 nt, Human
auuuauugagacuuaacaaccc

SEQ ID NO: 437295 - RNA, 21 nt, Human
aaaguucaugcuuuaauauuc

SEQ ID NO: 437296 - RNA, 22 nt, Human
caaguauuuccugauggccugu

SEQ ID NO: 437297 - RNA, 19 nt, Human
uccugcagguggcuugcag

SEQ ID NO: 437298 - RNA, 22 nt, Human
aggcagcccacaggacacagga

SEQ ID NO: 437299 - RNA, 22 nt, Human
agugaaauagcauuuaugaagc

SEQ ID NO: 437300 - RNA, 22 nt, Human
gugcccugguccccagcauaua

SEQ ID NO: 437301 - RNA, 22 nt, Human
ugccugaugcaggaguaucaga

SEQ ID NO: 437302 - RNA, 22 nt, Human
uucuuuuaaugucuggcuuuca

SEQ ID NO: 437303 - RNA, 22 nt, Human
uacugcauaacuggcauguggg

SEQ ID NO: 437304 - RNA, 20 nt, Human
uggaugucaaauuaggcugg

SEQ ID NO: 437305 - RNA, 22 nt, Human
cuccaugggggcuggccugugu

SEQ ID NO: 437306 - RNA, 23 nt, Human
uggagcugggcucagacccuggg

SEQ ID NO: 437307 - RNA, 21 nt, Human
cgcagcugagaaauauacaga

SEQ ID NO: 437308 - RNA, 23 nt, Human
ucucugguuaggggagauuggug

SEQ ID NO: 437309 - RNA, 22 nt, Human
ugcucccaaacgaccuacugug

SEQ ID NO: 437310 - RNA, 22 nt, Human
gaagcuaaaccacagcuaagaa

SEQ ID NO: 437311 - RNA, 22 nt, Human
aggcuuuggggcauucuguguu

SEQ ID NO: 437312 - RNA, 22 nt, Human
uauguacagggauagaacuuga

SEQ ID NO: 437313 - RNA, 22 nt, Human
cuccucagaagaggguaacaca

SEQ ID NO: 437314 - RNA, 22 nt, Human
auuugaaaucuggguuacucug

SEQ ID NO: 437315 - RNA, 22 nt, Human
guguuaaacauguucacagcau

SEQ ID NO: 437316 - RNA, 22 nt, Human
aggcuaggggcagugccagcau

SEQ ID NO: 437317 - RNA, 22 nt, Human
uuccugaacauuucuaaguuga

SEQ ID NO: 437318 - RNA, 19 nt, Human
acuuguuuuggaggugaug

SEQ ID NO: 437319 - RNA, 22 nt, Human
ugcugcagcagugcgggcagcu

SEQ ID NO: 437320 - RNA, 22 nt, Human
auugaaugcuugcuaacacuuu

SEQ ID NO: 437321 - RNA, 22 nt, Human
acagagguuaggauggguugua

SEQ ID NO: 437322 - RNA, 23 nt, Human
uggcagcuguguaagagaaagca

SEQ ID NO: 437323 - RNA, 22 nt, Human
gguguagcucugugucccacug

SEQ ID NO: 437324 - RNA, 22 nt, Human
aagucacagaacccauuguaac

SEQ ID NO: 437325 - RNA, 22 nt, Human
agcagguguuuguaucauaagg

SEQ ID NO: 437326 - RNA, 20 nt, Human
ccagagcugauggcugcccg

SEQ ID NO: 437327 - RNA, 22 nt, Human
agccacagcauguguguaugua

SEQ ID NO: 437328 - RNA, 22 nt, Human
ugaucugguccuacugugggca

SEQ ID NO: 437329 - RNA, 22 nt, Human
gugcccugagcuuaugcauucu

SEQ ID NO: 437330 - RNA, 22 nt, Human
aaaaugauauccugacuuuuau

SEQ ID NO: 437331 - RNA, 22 nt, Human
cugagguguugaugaccuaugc

SEQ ID NO: 437332 - RNA, 22 nt, Human
aaaauguaaagcuugaguguag

SEQ ID NO: 437333 - RNA, 22 nt, Human
ucaaacuguuuacagugagaua

SEQ ID NO: 437334 - RNA, 22 nt, Human
gcagcugucauuuacaacaggg

SEQ ID NO: 437335 - RNA, 22 nt, Human
uccugggcugcagggaagagca

SEQ ID NO: 437336 - RNA, 22 nt, Human
cagagcagggguuucccagguu

SEQ ID NO: 437337 - RNA, 22 nt, Human
uguccugugccaccuuccugag

SEQ ID NO: 437338 - RNA, 20 nt, Human
acaaggaaccaggagguggc

SEQ ID NO: 437339 - RNA, 22 nt, Human
gcagugccuugcuucucugucu

SEQ ID NO: 437340 - RNA, 19 nt, Human
agacacuggauggaaaaug

SEQ ID NO: 437341 - RNA, 22 nt, Human
uccauuuucuaaguaucacuua

SEQ ID NO: 437342 - RNA, 22 nt, Human
acaggccucccauccggagccc

SEQ ID NO: 437343 - RNA, 22 nt, Human
gcccuggaaucucuccauggga

SEQ ID NO: 437344 - RNA, 22 nt, Human
agagcaagugacagaaacaggg

SEQ ID NO: 437345 - RNA, 22 nt, Human
ucugcagcuucuugccagagag

SEQ ID NO: 437346 - RNA, 22 nt, Human
uccucuggauauaagccucacc

SEQ ID NO: 437347 - RNA, 22 nt, Human
cugggcacacagugacucugca

SEQ ID NO: 437348 - RNA, 22 nt, Human
ggcucagugggaacaagcugag

SEQ ID NO: 437349 - RNA, 22 nt, Human
uagcaggcucgcaauaaaaugu

SEQ ID NO: 437350 - RNA, 22 nt, Human
gaauuucagggucugguaggaa

SEQ ID NO: 437351 - RNA, 22 nt, Human
uuuucauugagcaccugaguaa

SEQ ID NO: 437352 - RNA, 22 nt, Human
agggcuggccacaugauuuggu

SEQ ID NO: 437353 - RNA, 22 nt, Human
uuuccucagaagugucuacuau

SEQ ID NO: 437354 - RNA, 18 nt, Human
uggccuggagacaacucu

SEQ ID NO: 437355 - RNA, 22 nt, Human
gugcauauguguguauacaaac

SEQ ID NO: 437356 - RNA, 22 nt, Human
gggccagaccucuucucaggga

SEQ ID NO: 437357 - RNA, 20 nt, Human
gagcugaguguggucauggg

SEQ ID NO: 437358 - RNA, 22 nt, Human
cugaggcugcccagggccaggu

SEQ ID NO: 437359 - RNA, 22 nt, Human
uaaauugcugauuuuagaugcu

SEQ ID NO: 437360 - RNA, 22 nt, Human
cuccuucccuucaaguguuccu

SEQ ID NO: 437361 - RNA, 22 nt, Human
ggcagggaggaggugaaaguga

SEQ ID NO: 437362 - RNA, 17 nt, Human
gcugagugcagggaguc

SEQ ID NO: 437363 - RNA, 22 nt, Human
gcuucaaacugagcuucaagug

SEQ ID NO: 437364 - RNA, 22 nt, Human
gcugcagcuuuaggauccagug

SEQ ID NO: 437365 - RNA, 18 nt, Human
agcaacaggaucccaggg

SEQ ID NO: 437366 - RNA, 22 nt, Human
cagcuguuccugguugguggga

SEQ ID NO: 437367 - RNA, 19 nt, Human
ucuaacagcuuucauucua

SEQ ID NO: 437368 - RNA, 22 nt, Human
uuugcuuucccuuguagaaagu

SEQ ID NO: 437369 - RNA, 22 nt, Human
augcacaggaaguguccccauu

SEQ ID NO: 437370 - RNA, 22 nt, Human
acagaaauucugggacagaaaa

SEQ ID NO: 437371 - RNA, 22 nt, Human
cucuuauacauauuuuuaggcg

SEQ ID NO: 437372 - RNA, 22 nt, Human
gcagagcagaggugcagguugg

SEQ ID NO: 437373 - RNA, 21 nt, Human
guauucuuuaugaagugaaaa

SEQ ID NO: 437374 - RNA, 22 nt, Human
cccagccugucuuucccaauga

SEQ ID NO: 437375 - RNA, 22 nt, Human
uaugaauauaccacaauuuagg

SEQ ID NO: 437376 - RNA, 22 nt, Human
cugggcuaauuaagcacagcug

SEQ ID NO: 437377 - RNA, 22 nt, Human
cacaggaagagguauacaauuc

SEQ ID NO: 437378 - RNA, 22 nt, Human
caugcauuuggaguuuucaagu

SEQ ID NO: 437379 - RNA, 22 nt, Human
agaugcugugaggaagcuagga

SEQ ID NO: 437380 - RNA, 22 nt, Human
cuggagccggcgagccccagcc

SEQ ID NO: 437381 - RNA, 22 nt, Human
uaggcugggaagaaagauucuc

SEQ ID NO: 437382 - RNA, 22 nt, Human
uuucucccccaugauaauuucu

SEQ ID NO: 437383 - RNA, 22 nt, Human
ggcacagcacuguaggccuggg

SEQ ID NO: 437384 - RNA, 22 nt, Human
cccagggcugcagauggaggcu

SEQ ID NO: 437385 - RNA, 22 nt, Human
ugacagagucggggcaagcugu

SEQ ID NO: 437386 - RNA, 22 nt, Human
cagcuguucacauuuccaaaac

SEQ ID NO: 437387 - RNA, 22 nt, Human
uugaacauaaaucacuggucag

SEQ ID NO: 437388 - RNA, 22 nt, Human
acucugagcaucccaagucuua

SEQ ID NO: 437389 - RNA, 22 nt, Human
acugccauugguucuggaaaau

SEQ ID NO: 437390 - RNA, 22 nt, Human
caugcagcagaauaaugacuau

SEQ ID NO: 437391 - RNA, 22 nt, Human
uggcagcauuaauuauucaggu

SEQ ID NO: 437392 - RNA, 22 nt, Human
caguccuggggaccaggcugag

SEQ ID NO: 437393 - RNA, 22 nt, Human
agcaaacauucagcagauuggc

SEQ ID NO: 437394 - RNA, 22 nt, Human
ggagcuaggcaaagcucacgga

SEQ ID NO: 437395 - RNA, 22 nt, Human
aaggcaaugacugauuuagaau

SEQ ID NO: 437396 - RNA, 22 nt, Human
agggggcauuaugaggcuuuuc

SEQ ID NO: 437397 - RNA, 22 nt, Human
cugccagaagagaacaccaguu

SEQ ID NO: 437398 - RNA, 22 nt, Human
ggcaggcuuugagaaagagcau

SEQ ID NO: 437399 - RNA, 22 nt, Human
cuuuacaaauagggagggagug

SEQ ID NO: 437400 - RNA, 22 nt, Human
uuucucaaguucagauauuuga

SEQ ID NO: 437401 - RNA, 22 nt, Human
gauuuuacugucuguguaucuc

SEQ ID NO: 437402 - RNA, 22 nt, Human
ggaggccuugaggccaggagcu

SEQ ID NO: 437403 - RNA, 22 nt, Human
uugcccacucuguuucccaaga

SEQ ID NO: 437404 - RNA, 22 nt, Human
ucccugggguaucgcugaggca

SEQ ID NO: 437405 - RNA, 22 nt, Human
ccugugugcugaugacgacaga

SEQ ID NO: 437406 - RNA, 22 nt, Human
gcacaggcuguuggccuucaga

SEQ ID NO: 437407 - RNA, 22 nt, Human
uaccauuugagagagaacauaa

SEQ ID NO: 437408 - RNA, 22 nt, Human
caagcuggaguuccucagagug

SEQ ID NO: 437409 - RNA, 22 nt, Human
acuguguccuauuuccuugaca

SEQ ID NO: 437410 - RNA, 20 nt, Human
acaguggguggggagcacug

SEQ ID NO: 437411 - RNA, 22 nt, Human
gaggggcacaguaaaggguccc

SEQ ID NO: 437412 - RNA, 22 nt, Human
cagcugaguaugcauucaagca

SEQ ID NO: 437413 - RNA, 22 nt, Human
uuccugaagucaaagaucuaaa

SEQ ID NO: 437414 - RNA, 22 nt, Human
cuuugcuucuccaaccugcuca

SEQ ID NO: 437415 - RNA, 22 nt, Human
caggaaaggugugucaugaugg

SEQ ID NO: 437416 - RNA, 22 nt, Human
aucuagaaguggcaugaauuac

SEQ ID NO: 437417 - RNA, 22 nt, Human
cacuaguaauucuugugcugga

SEQ ID NO: 437418 - RNA, 22 nt, Human
gcugccugcacagagcugcuuu

SEQ ID NO: 437419 - RNA, 22 nt, Human
cucagucucuugggcugugaag

SEQ ID NO: 437420 - RNA, 22 nt, Human
acaggcaggagcuccccauucc

SEQ ID NO: 437421 - RNA, 22 nt, Human
ugucccagucaaggcugucauc

SEQ ID NO: 437422 - RNA, 22 nt, Human
uuugcaaagucccugggaugga

SEQ ID NO: 437423 - RNA, 22 nt, Human
agguaaaauagauaguauuucu

SEQ ID NO: 437424 - RNA, 22 nt, Human
ugcugccaaaugcgagcucugu

SEQ ID NO: 437425 - RNA, 22 nt, Human
uguuuucagucauauagcaggu

SEQ ID NO: 437426 - RNA, 22 nt, Human
caguucaaaguuaagcagcagu

SEQ ID NO: 437427 - RNA, 22 nt, Human
ucacagccuggucacucugccc

SEQ ID NO: 437428 - RNA, 22 nt, Human
uucuaacucuguuauguguuuc

SEQ ID NO: 437429 - RNA, 22 nt, Human
uugagcaaugcugcaaagagau

SEQ ID NO: 437430 - RNA, 22 nt, Human
aaaguugauaagguaucguagu

SEQ ID NO: 437431 - RNA, 22 nt, Human
ggcuuugacaugcugaauuaaa

SEQ ID NO: 437432 - RNA, 22 nt, Human
aaagguuagacagcucugcaua

SEQ ID NO: 437433 - RNA, 22 nt, Human
gaaggcaagugagccaagagaa

SEQ ID NO: 437434 - RNA, 22 nt, Human
ggguggaguagaaagaugaauu

SEQ ID NO: 437435 - RNA, 22 nt, Human
aguguguguuugggcgguuuau

SEQ ID NO: 437436 - RNA, 22 nt, Human
ccucauguugcucgcaucugca

SEQ ID NO: 437437 - RNA, 22 nt, Human
aauuaagaaaauguuuuaugau

SEQ ID NO: 437438 - RNA, 18 nt, Human
gcaguaggcgcgcaggac

SEQ ID NO: 437439 - RNA, 22 nt, Human
ggcagaggaagcuggaaguggg

SEQ ID NO: 437440 - RNA, 22 nt, Human
cugggccaucagaggggcugga

SEQ ID NO: 437441 - RNA, 22 nt, Human
gcagaagggaauaaggagcuuu

SEQ ID NO: 437442 - RNA, 22 nt, Human
agguaauuuuguguuaaugauu

SEQ ID NO: 437443 - RNA, 22 nt, Human
ccaggacuucgaggcuacagug

SEQ ID NO: 437444 - RNA, 22 nt, Human
gccagagcagaauagaguggcc

SEQ ID NO: 437445 - RNA, 22 nt, Human
ccuggugccacuagagaauguc

SEQ ID NO: 437446 - RNA, 22 nt, Human
cugguccuugacgcgugggagg

SEQ ID NO: 437447 - RNA, 20 nt, Human
aaguccugaccuagucuaaa

SEQ ID NO: 437448 - RNA, 22 nt, Human
ccaggagcuggagggugcagug

SEQ ID NO: 437449 - RNA, 22 nt, Human
cuagagaauggcaaagauuaga

SEQ ID NO: 437450 - RNA, 22 nt, Human
gaggacagcucuaacuaaaguc

SEQ ID NO: 437451 - RNA, 20 nt, Human
cuccaaggcuugcaggaggc

SEQ ID NO: 437452 - RNA, 20 nt, Human
gggaggccccagaguccagg

SEQ ID NO: 437453 - RNA, 20 nt, Human
aggcagcuggccaggcaggu

SEQ ID NO: 437454 - RNA, 22 nt, Human
uguccacaucacucacuuguca

SEQ ID NO: 437455 - RNA, 22 nt, Human
gugcuccuggccacaugaagcu

SEQ ID NO: 437456 - RNA, 22 nt, Human
gccccaggggaggugcccugca

SEQ ID NO: 437457 - RNA, 22 nt, Human
cccagagaauuccacauagagg

SEQ ID NO: 437458 - RNA, 23 nt, Human
acucagagaccccgggaagugac

SEQ ID NO: 437459 - RNA, 22 nt, Human
caguauuuggaauauagcuaag

SEQ ID NO: 437460 - RNA, 22 nt, Human
aagcccuggauuaaagaugcca

SEQ ID NO: 437461 - RNA, 22 nt, Human
gcagcugggacacugaggccag

SEQ ID NO: 437462 - RNA, 22 nt, Human
aagcacuaauauuuuggcaccu

SEQ ID NO: 437463 - RNA, 22 nt, Human
uaugagaaaggagaaugacuuu

SEQ ID NO: 437464 - RNA, 22 nt, Human
acacaguaugaaaagucuaguu

SEQ ID NO: 437465 - RNA, 22 nt, Human
gcaggcuguagacaccaaacua

SEQ ID NO: 437466 - RNA, 22 nt, Human
cccacaggcccugcugccuuga

SEQ ID NO: 437467 - RNA, 22 nt, Human
uggcugaacuaaugugcuguuu

SEQ ID NO: 437468 - RNA, 22 nt, Human
uuaaguacaggguuagugacgg

SEQ ID NO: 437469 - RNA, 22 nt, Human
acuaaauggaaugauuacuaua

SEQ ID NO: 437470 - RNA, 22 nt, Human
ggaagcuaguuguguuucagga

SEQ ID NO: 437471 - RNA, 22 nt, Human
uuggaaacuuucaagcauaaug

SEQ ID NO: 437472 - RNA, 22 nt, Human
guuucagacuauucuguuucug

SEQ ID NO: 437473 - RNA, 22 nt, Human
cagcugucuaaguugagcagga

SEQ ID NO: 437474 - RNA, 22 nt, Human
agcugcccccagggcugugcuu

SEQ ID NO: 437475 - RNA, 21 nt, Human
gccuggcuucacaggcacuga

SEQ ID NO: 437476 - RNA, 22 nt, Human
uggcccagugcuuaugcucuga

SEQ ID NO: 437477 - RNA, 22 nt, Human
gcaggcagguggcaucuuguga

SEQ ID NO: 437478 - RNA, 22 nt, Human
acagaggucauggagaguucuc

SEQ ID NO: 437479 - RNA, 22 nt, Human
gacagacauuuccugauccaau

SEQ ID NO: 437480 - RNA, 22 nt, Human
acugguaccugucuugaauuuu

SEQ ID NO: 437481 - RNA, 22 nt, Human
aagacauucaugaagaagggau

SEQ ID NO: 437482 - RNA, 22 nt, Human
acaguucaagucuuagacaaca

SEQ ID NO: 437483 - RNA, 22 nt, Human
uuuuccucuguaugcgugagau

SEQ ID NO: 437484 - RNA, 22 nt, Human
acauaaugagcucuuuauaaau

SEQ ID NO: 437485 - RNA, 22 nt, Human
ccaggaagaaacagucuuuaua

SEQ ID NO: 437486 - RNA, 22 nt, Human
aacugcauucagaaagcucacu

SEQ ID NO: 437487 - RNA, 22 nt, Human
aggcuccagucuccucuggcag

SEQ ID NO: 437488 - RNA, 21 nt, Human
ugccagggauuuacagagccu

SEQ ID NO: 437489 - RNA, 22 nt, Human
ccuugggacagccagcuucaga

SEQ ID NO: 437490 - RNA, 22 nt, Human
gcagguggugggggagccguuc

SEQ ID NO: 437491 - RNA, 21 nt, Human
acaaaggaagucucuuuuaag

SEQ ID NO: 437492 - RNA, 22 nt, Human
agagccuguuuugugggagaug

SEQ ID NO: 437493 - RNA, 22 nt, Human
gagaagcaauuuccaacugugc

SEQ ID NO: 437494 - RNA, 22 nt, Human
cagcaacuccuguagcuuaugc

SEQ ID NO: 437495 - RNA, 22 nt, Human
uggccugggccugccggugcaa

SEQ ID NO: 437496 - RNA, 22 nt, Human
ccaggcugcuuagccuuaucuu

SEQ ID NO: 437497 - RNA, 20 nt, Human
ugaagcagccuugauucugu

SEQ ID NO: 437498 - RNA, 21 nt, Human
auuuucucuggaugaugguca

SEQ ID NO: 437499 - RNA, 19 nt, Human
uaaugcacuuaacacaugg

SEQ ID NO: 437500 - RNA, 22 nt, Human
acaggcugauagaccauaaaua

SEQ ID NO: 437501 - RNA, 22 nt, Human
acucuugucucaacuuuuguau

SEQ ID NO: 437502 - RNA, 22 nt, Human
uucaaguauauuuaacaucgua

SEQ ID NO: 437503 - RNA, 22 nt, Human
ugaggcuguucuaccagggcca

SEQ ID NO: 437504 - RNA, 22 nt, Human
ccaaggcuucccagagaugcuc

SEQ ID NO: 437505 - RNA, 22 nt, Human
agucaggcugacaggcuaggag

SEQ ID NO: 437506 - RNA, 22 nt, Human
uaaagugaaggucauaaugauu

SEQ ID NO: 437507 - RNA, 17 nt, Human
acagagcuacauauucu

SEQ ID NO: 437508 - RNA, 22 nt, Human
cugagccaaggggacagugaca

SEQ ID NO: 437509 - RNA, 22 nt, Human
ggcagugguuagaaacaugagc

SEQ ID NO: 437510 - RNA, 22 nt, Human
ucaggccccaucccagacuuau

SEQ ID NO: 437511 - RNA, 22 nt, Human
ucccucagucccuggacaggca

SEQ ID NO: 437512 - RNA, 22 nt, Human
aagauggcugcagcaauuccaa

SEQ ID NO: 437513 - RNA, 22 nt, Human
ggcagguggaaguuggcagagc

SEQ ID NO: 437514 - RNA, 22 nt, Human
gcuguuggcgaggagcucagcu

SEQ ID NO: 437515 - RNA, 22 nt, Human
gcccuggccuccuggaacaggc

SEQ ID NO: 437516 - RNA, 22 nt, Human
gaucacaugaguuaucuaacuu

SEQ ID NO: 437517 - RNA, 22 nt, Human
ucuggccaacaaaaacuaaguc

SEQ ID NO: 437518 - RNA, 22 nt, Human
gccagcuggagugagagugggc

SEQ ID NO: 437519 - RNA, 22 nt, Human
aaguugauuaaucuuucgagaa

SEQ ID NO: 437520 - RNA, 23 nt, Human
uuucaaauuacucugcagaugac

SEQ ID NO: 437521 - RNA, 22 nt, Human
cagcagcucagucucucaguag

SEQ ID NO: 437522 - RNA, 22 nt, Human
agaaacaucauuguuugguauu

SEQ ID NO: 437523 - RNA, 22 nt, Human
cacaggaagcaagccuggggcc

SEQ ID NO: 437524 - RNA, 22 nt, Human
acagcuguggggacucuugccc

SEQ ID NO: 437525 - RNA, 22 nt, Human
gcacuggaggguguaguugcug

SEQ ID NO: 437526 - RNA, 22 nt, Human
gguuccugugcccaugucaugg

SEQ ID NO: 437527 - RNA, 22 nt, Human
gcagcuggccccuuuccuuguu

SEQ ID NO: 437528 - RNA, 22 nt, Human
cuguugcucugaacaggucuug

SEQ ID NO: 437529 - RNA, 22 nt, Human
aagacugaguucaaaucacagc

SEQ ID NO: 437530 - RNA, 22 nt, Human
uuauaauugcuuauuagaccca

SEQ ID NO: 437531 - RNA, 23 nt, Human
ggacccacggucuuugaggcucu

SEQ ID NO: 437532 - RNA, 22 nt, Human
ucuaaagacacuuuuuacaggg

SEQ ID NO: 437533 - RNA, 22 nt, Human
ucaaacugcuaccuuuuaugug

SEQ ID NO: 437534 - RNA, 22 nt, Human
aacuuugcuggaaaauuggagc

SEQ ID NO: 437535 - RNA, 17 nt, Human
agcuagggccuagaauc

SEQ ID NO: 437536 - RNA, 22 nt, Human
auuauuguuagugacaggguga

SEQ ID NO: 437537 - RNA, 21 nt, Human
ugcuuuaugggaaaaauguca

SEQ ID NO: 437538 - RNA, 22 nt, Human
ugacaaguacauaauuucaugu

SEQ ID NO: 437539 - RNA, 21 nt, Human
ugggccagaucugaguuucua

SEQ ID NO: 437540 - RNA, 22 nt, Human
cagaggaaaugggaaggagaua

SEQ ID NO: 437541 - RNA, 22 nt, Human
gccagcaguauguccuggcagu

SEQ ID NO: 437542 - RNA, 22 nt, Human
cccaggcagccccagaagcuug

SEQ ID NO: 437543 - RNA, 22 nt, Human
ucccuggcagcuaagggugguc

SEQ ID NO: 437544 - RNA, 22 nt, Human
agguccugacgcccuuugaaau

SEQ ID NO: 437545 - RNA, 22 nt, Human
auaaagccuuucuguuuucagg

SEQ ID NO: 437546 - RNA, 22 nt, Human
guucucccuguccccugagcuu

SEQ ID NO: 437547 - RNA, 22 nt, Human
guggccagaagacugcaaugcu

SEQ ID NO: 437548 - RNA, 20 nt, Human
auccaugagagucuggauuc

SEQ ID NO: 437549 - RNA, 22 nt, Human
agcagaaccugcagaccugucu

SEQ ID NO: 437550 - RNA, 22 nt, Human
uuucaaaauuuugcagugguaa

SEQ ID NO: 437551 - RNA, 22 nt, Human
ggagccaguuuagaccucaguu

SEQ ID NO: 437552 - RNA, 22 nt, Human
agugacaagguaguuaguugga

SEQ ID NO: 437553 - RNA, 22 nt, Human
cagggcucaggaaaucagacgu

SEQ ID NO: 437554 - RNA, 22 nt, Human
cuggcuggccggagcgaggcgg

SEQ ID NO: 437555 - RNA, 22 nt, Human
caggcugagcucuggccugggc

SEQ ID NO: 437556 - RNA, 22 nt, Human
caagagagaugcagcucacuca

SEQ ID NO: 437557 - RNA, 22 nt, Human
aaauggcuuugaggguaggaca

SEQ ID NO: 437558 - RNA, 22 nt, Human
caagauucagagucuucuaacc

SEQ ID NO: 437559 - RNA, 22 nt, Human
auugaagaaacccaaauaaugg

SEQ ID NO: 437560 - RNA, 23 nt, Human
aggcccugccugucccucuuuuu

SEQ ID NO: 437561 - RNA, 22 nt, Human
agguccuggugaccauggaguu

SEQ ID NO: 437562 - RNA, 22 nt, Human
uugacaauguccuuugaauuuc

SEQ ID NO: 437563 - RNA, 22 nt, Human
uugggcuuuaauuccagagagg

SEQ ID NO: 437564 - RNA, 22 nt, Human
auucaagagcuggcuuugaaau

SEQ ID NO: 437565 - RNA, 22 nt, Human
uucuacaaauauuuacuguucc

SEQ ID NO: 437566 - RNA, 17 nt, Human
gcuguuucuccagaagu

SEQ ID NO: 437567 - RNA, 19 nt, Human
uccaccccagccagcucug

SEQ ID NO: 437568 - RNA, 22 nt, Human
acuggggcaggaaaguaugcug

SEQ ID NO: 437569 - RNA, 22 nt, Human
ggcuguccuuggccaaggcacu

SEQ ID NO: 437570 - RNA, 22 nt, Human
gccugguggugugcucaagugg

SEQ ID NO: 437571 - RNA, 22 nt, Human
uuggcuuguuaaaaaugcaauu

SEQ ID NO: 437572 - RNA, 22 nt, Human
ggccccagcagacccuccucug

SEQ ID NO: 437573 - RNA, 22 nt, Human
cugcugagguccuugcucagac

SEQ ID NO: 437574 - RNA, 22 nt, Human
ccccagccagcaggaccucuga

SEQ ID NO: 437575 - RNA, 22 nt, Human
uacauauucaacguucaguauu

SEQ ID NO: 437576 - RNA, 22 nt, Human
cuggagaggcugggaacagguu

SEQ ID NO: 437577 - RNA, 22 nt, Human
acuccaggauguagaaucagag

SEQ ID NO: 437578 - RNA, 22 nt, Human
gcauccaaauguuucauuucuu

SEQ ID NO: 437579 - RNA, 19 nt, Human
uaacucuuuccuuuucccc

SEQ ID NO: 437580 - RNA, 22 nt, Human
aaagugcaccugcuucuucuug

SEQ ID NO: 437581 - RNA, 22 nt, Human
gggaggacgguccagggcaaag

SEQ ID NO: 437582 - RNA, 22 nt, Human
ugagccagaguggagugugccu

SEQ ID NO: 437583 - RNA, 22 nt, Human
cccagcucucucaguucugcuu

SEQ ID NO: 437584 - RNA, 22 nt, Human
acagaccaaaaaaggauauugg

SEQ ID NO: 437585 - RNA, 22 nt, Human
aucaugcauuguauugaguuga

SEQ ID NO: 437586 - RNA, 21 nt, Human
ugcugccauagaccugaggga

SEQ ID NO: 437587 - RNA, 22 nt, Human
ccaggcagagugcuccagaaag

SEQ ID NO: 437588 - RNA, 20 nt, Human
uauaaauucagagcuuuggu

SEQ ID NO: 437589 - RNA, 22 nt, Human
agcagcaguugcugacguucua

SEQ ID NO: 437590 - RNA, 22 nt, Human
uauucagaaaauaaauuggauu

SEQ ID NO: 437591 - RNA, 22 nt, Human
acagaacuucaguaguauuccc

SEQ ID NO: 437592 - RNA, 22 nt, Human
uuugcagccucccuggcagaag

SEQ ID NO: 437593 - RNA, 23 nt, Human
ugcugggcagagcuggugcugag

SEQ ID NO: 437594 - RNA, 20 nt, Human
ugccaggcacggagugcaug

SEQ ID NO: 437595 - RNA, 22 nt, Human
ccugccuggcugucagcagagc

SEQ ID NO: 437596 - RNA, 22 nt, Human
acaauucaagaagagagaugaa

SEQ ID NO: 437597 - RNA, 18 nt, Human
aggcccuggccucgaaca

SEQ ID NO: 437598 - RNA, 22 nt, Human
augaagcuugaggugagagcug

SEQ ID NO: 437599 - RNA, 22 nt, Human
auuugcuaguggaauuuuccug

SEQ ID NO: 437600 - RNA, 18 nt, Human
ucaggcugggccuccuuc

SEQ ID NO: 437601 - RNA, 22 nt, Human
auuaaagaaacccagcauguga

SEQ ID NO: 437602 - RNA, 22 nt, Human
cagaaggcaaggccugccacgc

SEQ ID NO: 437603 - RNA, 22 nt, Human
cugaagcagauguggcugagau

SEQ ID NO: 437604 - RNA, 22 nt, Human
cuggagcuaggaaguccaagau

SEQ ID NO: 437605 - RNA, 22 nt, Human
aaaaaugugaccacaggguguu

SEQ ID NO: 437606 - RNA, 20 nt, Human
cuguagggugcagcaggcuc

SEQ ID NO: 437607 - RNA, 22 nt, Human
ugagcccagagaucugagcuau

SEQ ID NO: 437608 - RNA, 22 nt, Human
acaguucuuuggauggaagaau

SEQ ID NO: 437609 - RNA, 22 nt, Human
uuuuauugggaguccucuacug

SEQ ID NO: 437610 - RNA, 22 nt, Human
gcagggccagggcucaggcugu

SEQ ID NO: 437611 - RNA, 22 nt, Human
ugcacacauguauguauaugug

SEQ ID NO: 437612 - RNA, 22 nt, Human
caacugaacugauaucaacuau

SEQ ID NO: 437613 - RNA, 22 nt, Human
acaggaagugcuggcacuuaca

SEQ ID NO: 437614 - RNA, 22 nt, Human
augugcuugaagccucagagaa

SEQ ID NO: 437615 - RNA, 17 nt, Human
uggcagcugaaagcucu

SEQ ID NO: 437616 - RNA, 19 nt, Human
uacauacuuauucuaaaag

SEQ ID NO: 437617 - RNA, 22 nt, Human
agcagcugcuuuucuucauugg

SEQ ID NO: 437618 - RNA, 22 nt, Human
ugggcagaggcagcagaaaccu

SEQ ID NO: 437619 - RNA, 22 nt, Human
agucaguuaaccucacagcauc

SEQ ID NO: 437620 - RNA, 22 nt, Human
agccccaguccgcugcgggcgg

SEQ ID NO: 437621 - RNA, 22 nt, Human
augugggccgugcggguguccu

SEQ ID NO: 437622 - RNA, 22 nt, Human
accuggagaaagccucucccug

SEQ ID NO: 437623 - RNA, 22 nt, Human
uucucugcucucacauacagaa

SEQ ID NO: 437624 - RNA, 22 nt, Human
gaggcugggaaguccaauauca

SEQ ID NO: 437625 - RNA, 22 nt, Human
gcaugcugcaccagagccucuc

SEQ ID NO: 437626 - RNA, 20 nt, Human
cccaggagugagcagcuuua

SEQ ID NO: 437627 - RNA, 23 nt, Human
agcccagcagagaaccuaggucc

SEQ ID NO: 437628 - RNA, 22 nt, Human
agcagcugagccccagcuguga

SEQ ID NO: 437629 - RNA, 22 nt, Human
ggccccagauucugggcugggu

SEQ ID NO: 437630 - RNA, 22 nt, Human
uggcccugugugcaggcugcac

SEQ ID NO: 437631 - RNA, 22 nt, Human
gcaauuauuaugugacuuuuac

SEQ ID NO: 437632 - RNA, 22 nt, Human
cugcagcuuaaaggaguucaau

SEQ ID NO: 437633 - RNA, 22 nt, Human
aguguccuugagguuccuagga

SEQ ID NO: 437634 - RNA, 22 nt, Human
ggagucugacccuuagagauga

SEQ ID NO: 437635 - RNA, 22 nt, Human
agcuggugauggccuaagaagg

SEQ ID NO: 437636 - RNA, 22 nt, Human
agcugucuaccugcagaguccu

SEQ ID NO: 437637 - RNA, 22 nt, Human
gaauuucaagcagugcaauguu

SEQ ID NO: 437638 - RNA, 23 nt, Human
agacacuguaaagaauugcaguu

SEQ ID NO: 437639 - RNA, 22 nt, Human
ucagaauugauuuucaaaacag

SEQ ID NO: 437640 - RNA, 19 nt, Human
uaauauacagacccaucug

SEQ ID NO: 437641 - RNA, 22 nt, Human
cagccugacuauggcugcaggu

SEQ ID NO: 437642 - RNA, 22 nt, Human
uacagagggauuaucuaagggu

SEQ ID NO: 437643 - RNA, 22 nt, Human
acuguauuccuacuagaaucua

SEQ ID NO: 437644 - RNA, 22 nt, Human
cccugccuuguuggagccuaug

SEQ ID NO: 437645 - RNA, 22 nt, Human
uugcugauuuguuucuauucca

SEQ ID NO: 437646 - RNA, 22 nt, Human
ugcaggacaguuuggaagagag

SEQ ID NO: 437647 - RNA, 22 nt, Human
ugcaggaaacagaggcucaaau

SEQ ID NO: 437648 - RNA, 22 nt, Human
cugaagagaaagggagcucuuc

SEQ ID NO: 437649 - RNA, 21 nt, Human
ugacagcauagagcagggagg

SEQ ID NO: 437650 - RNA, 22 nt, Human
gggcuccagcagaggcagccgg

SEQ ID NO: 437651 - RNA, 22 nt, Human
aaggcacaugaccuaggccugg

SEQ ID NO: 437652 - RNA, 22 nt, Human
auaguuuuauagauauugugua

SEQ ID NO: 437653 - RNA, 22 nt, Human
gcaggcagucaucuuucauauu

SEQ ID NO: 437654 - RNA, 22 nt, Human
gcucagagauguucaguagcuu

SEQ ID NO: 437655 - RNA, 22 nt, Human
uggaugcuguaggacacgcucu

SEQ ID NO: 437656 - RNA, 22 nt, Human
cugccucuauucacugaggcag

SEQ ID NO: 437657 - RNA, 22 nt, Human
ggcuccugaggaccaggcacag

SEQ ID NO: 437658 - RNA, 23 nt, Human
gaggcagcuccugcagugcccug

SEQ ID NO: 437659 - RNA, 22 nt, Human
gcucagagaauuuacugcugcc

SEQ ID NO: 437660 - RNA, 22 nt, Human
acuuugcagggcuugauaucca

SEQ ID NO: 437661 - RNA, 22 nt, Human
auggaaaaggcugauuucauua

SEQ ID NO: 437662 - RNA, 22 nt, Human
guccagcccgggcuccgccagc

SEQ ID NO: 437663 - RNA, 22 nt, Human
guuuuauaauugcuucauaaga

SEQ ID NO: 437664 - RNA, 22 nt, Human
uaaggcaguagugucuguaggg

SEQ ID NO: 437665 - RNA, 22 nt, Human
ucugucacucccugaugaugaa

SEQ ID NO: 437666 - RNA, 22 nt, Human
uggcaggaaauacccugccuag

SEQ ID NO: 437667 - RNA, 22 nt, Human
uugcagcugcaguaaauguuca

SEQ ID NO: 437668 - RNA, 22 nt, Human
agcagcaggcugggaugagucu

SEQ ID NO: 437669 - RNA, 22 nt, Human
uuucagagaauuagaagcugau

SEQ ID NO: 437670 - RNA, 22 nt, Human
gaaucaggauucaagaucagcu

SEQ ID NO: 437671 - RNA, 22 nt, Human
ugggacagugaccccagagguc

SEQ ID NO: 437672 - RNA, 21 nt, Human
gacacaaaggguaguaauggu

SEQ ID NO: 437673 - RNA, 22 nt, Human
uucacagugagcuaugucuugu

SEQ ID NO: 437674 - RNA, 22 nt, Human
gcagacaggauuggguuaauag

SEQ ID NO: 437675 - RNA, 22 nt, Human
gcucaaugcucaaugcugcaaa

SEQ ID NO: 437676 - RNA, 22 nt, Human
uugcccugcagcggugaguggu

SEQ ID NO: 437677 - RNA, 22 nt, Human
gccaggcucucagugacugccc

SEQ ID NO: 437678 - RNA, 22 nt, Human
augcacagaacaauuuuaagag

SEQ ID NO: 437679 - RNA, 22 nt, Human
aucuuuuacuacaaaucaggug

SEQ ID NO: 437680 - RNA, 22 nt, Human
ugccaggccacguagcuucaag

SEQ ID NO: 437681 - RNA, 22 nt, Human
ugcauugagauuuuaaaauuca

SEQ ID NO: 437682 - RNA, 22 nt, Human
uucucuccuccuagaggcuuuu

SEQ ID NO: 437683 - RNA, 22 nt, Human
cugaagcugaaaacuuccagca

SEQ ID NO: 437684 - RNA, 22 nt, Human
ccuguucagagcuaagcaucau

SEQ ID NO: 437685 - RNA, 22 nt, Human
aauguggccacuuuuuucuggg

SEQ ID NO: 437686 - RNA, 22 nt, Human
gcaggccucuguugagggccuu

SEQ ID NO: 437687 - RNA, 22 nt, Human
cugcagagcauaaaucugaaua

SEQ ID NO: 437688 - RNA, 20 nt, Human
ggcagcaggaguuuccucuu

SEQ ID NO: 437689 - RNA, 22 nt, Human
uugcaaaugaccauugccacau

SEQ ID NO: 437690 - RNA, 20 nt, Human
uacaggaaucaagacugcau

SEQ ID NO: 437691 - RNA, 18 nt, Human
ucaggcugcccugugucu

SEQ ID NO: 437692 - RNA, 22 nt, Human
uaagaaacauuuuuaugacagu

SEQ ID NO: 437693 - RNA, 22 nt, Human
ggcccagguccagcgaguaccu

SEQ ID NO: 437694 - RNA, 22 nt, Human
uguauuuuuaggaaugcgcuau

SEQ ID NO: 437695 - RNA, 22 nt, Human
ggucccaguccucucccugcua

SEQ ID NO: 437696 - RNA, 23 nt, Human
cucagggauagaaaggaagacag

SEQ ID NO: 437697 - RNA, 22 nt, Human
aggcuggcuggggaugcgucuu

SEQ ID NO: 437698 - RNA, 22 nt, Human
cagcacuucagcauucagauuu

SEQ ID NO: 437699 - RNA, 22 nt, Human
gcucugucaacagcuagcugug

SEQ ID NO: 437700 - RNA, 22 nt, Human
acucagagugcaucuccuauuu

SEQ ID NO: 437701 - RNA, 22 nt, Human
gaaggagagggucaaggauaau

SEQ ID NO: 437702 - RNA, 22 nt, Human
ccugggcaggaugggcccggug

SEQ ID NO: 437703 - RNA, 22 nt, Human
uuucagagccugcaaucccaau

SEQ ID NO: 437704 - RNA, 22 nt, Human
ccagaaagacuuuuuagguacg

SEQ ID NO: 437705 - RNA, 22 nt, Human
caguacuuaguucucaugguuu

SEQ ID NO: 437706 - RNA, 22 nt, Human
agaguuaagacguacaugagug

SEQ ID NO: 437707 - RNA, 22 nt, Human
caaguuuaaggcacugauaagu

SEQ ID NO: 437708 - RNA, 22 nt, Human
ugagcacuuuaaaauauuccca

SEQ ID NO: 437709 - RNA, 22 nt, Human
uagacacuguaugagcugggug

SEQ ID NO: 437710 - RNA, 22 nt, Human
uggccuggugucugcgaggccu

SEQ ID NO: 437711 - RNA, 22 nt, Human
cugaguccagggacagaggcgu

SEQ ID NO: 437712 - RNA, 22 nt, Human
cagccugcuagggcaaugccuu

SEQ ID NO: 437713 - RNA, 22 nt, Human
auccuggcgccacacggcucua

SEQ ID NO: 437714 - RNA, 20 nt, Human
ccaggccugggccugcucua

SEQ ID NO: 437715 - RNA, 19 nt, Human
cccagagcauccugaacuu

SEQ ID NO: 437716 - RNA, 22 nt, Human
gauaccagacagggagggagaa

SEQ ID NO: 437717 - RNA, 22 nt, Human
aacagaguuucaaauaacaucu

SEQ ID NO: 437718 - RNA, 22 nt, Human
agcagcugccacuggaauagga

SEQ ID NO: 437719 - RNA, 22 nt, Human
auuuuguuuccuuuggaguaga

SEQ ID NO: 437720 - RNA, 22 nt, Human
uccagccuaauguucuucccac

SEQ ID NO: 437721 - RNA, 22 nt, Human
uugcccugcguuaccaucucuu

SEQ ID NO: 437722 - RNA, 22 nt, Human
uggcccugaggacccagugugg

SEQ ID NO: 437723 - RNA, 22 nt, Human
acagggaagcucaggggcucug

SEQ ID NO: 437724 - RNA, 22 nt, Human
acaauucauuaaugugagguag

SEQ ID NO: 437725 - RNA, 22 nt, Human
uucagaaugcuauuucugaaau

SEQ ID NO: 437726 - RNA, 22 nt, Human
ugucccaguucccaggguugcu

SEQ ID NO: 437727 - RNA, 22 nt, Human
uucugucacuuaggaggucaua

SEQ ID NO: 437728 - RNA, 22 nt, Human
guucaagucuggggcugccagu

SEQ ID NO: 437729 - RNA, 22 nt, Human
ugucccaggccucauguugcca

SEQ ID NO: 437730 - RNA, 22 nt, Human
gaaaaaugagcugaugucaggg

SEQ ID NO: 437731 - RNA, 22 nt, Human
agccacagcccacaggacucuu

SEQ ID NO: 437732 - RNA, 22 nt, Human
gugaauaauuuuuuaguauaag

SEQ ID NO: 437733 - RNA, 22 nt, Human
ucucugucugagccuggcagac

SEQ ID NO: 437734 - RNA, 22 nt, Human
uggcacugggaugcuacuguua

SEQ ID NO: 437735 - RNA, 22 nt, Human
ccuguggcuuccacgaccuaau

SEQ ID NO: 437736 - RNA, 22 nt, Human
ccaggccuggacggguggccug

SEQ ID NO: 437737 - RNA, 22 nt, Human
aauggcaacaugguauagugag

SEQ ID NO: 437738 - RNA, 22 nt, Human
caaauucacaugauugcuucug

SEQ ID NO: 437739 - RNA, 22 nt, Human
ucuuauaauguugaaggguugg

SEQ ID NO: 437740 - RNA, 21 nt, Human
uccucugcagugagguggccu

SEQ ID NO: 437741 - RNA, 22 nt, Human
acagagcugggaucugaaccca

SEQ ID NO: 437742 - RNA, 20 nt, Human
gcccucugccucccucagcg

SEQ ID NO: 437743 - RNA, 22 nt, Human
aguuuaacuuuguaaacgugag

SEQ ID NO: 437744 - RNA, 19 nt, Human
cuuugcaggggauggguga

SEQ ID NO: 437745 - RNA, 23 nt, Human
ucagcagcagaagugcugggaug

SEQ ID NO: 437746 - RNA, 23 nt, Human
uggccuggagagaaaagaugagu

SEQ ID NO: 437747 - RNA, 22 nt, Human
agaauauugaaaguucuugaca

SEQ ID NO: 437748 - RNA, 22 nt, Human
ggugcccagagccaggaaugag

SEQ ID NO: 437749 - RNA, 22 nt, Human
uacugcauagacacugggauau

SEQ ID NO: 437750 - RNA, 22 nt, Human
ccaggaggcagagguuacagug

SEQ ID NO: 437751 - RNA, 22 nt, Human
gcuuugcacaaccuuuaagaca

SEQ ID NO: 437752 - RNA, 18 nt, Human
gcaggccuagaacuuggu

SEQ ID NO: 437753 - RNA, 22 nt, Human
aaaugcauguagaauaauagag

SEQ ID NO: 437754 - RNA, 22 nt, Human
cugagggccugaggaccuagau

SEQ ID NO: 437755 - RNA, 22 nt, Human
aacuuugcuuuuguggguaaag

SEQ ID NO: 437756 - RNA, 22 nt, Human
agcaggcaggcugccagugaau

SEQ ID NO: 437757 - RNA, 21 nt, Human
gaggccucagccucagcuccu

SEQ ID NO: 437758 - RNA, 22 nt, Human
aaugcauaaugguuugugacaa

SEQ ID NO: 437759 - RNA, 18 nt, Human
agagcagcggcaucacac

SEQ ID NO: 437760 - RNA, 20 nt, Human
uacugggcaagcccacagac

SEQ ID NO: 437761 - RNA, 22 nt, Human
agcauguguggagaaauauuuu

SEQ ID NO: 437762 - RNA, 20 nt, Human
ggagagcagggaagacagua

SEQ ID NO: 437763 - RNA, 23 nt, Human
acacagaagaagacccaaggaag

SEQ ID NO: 437764 - RNA, 22 nt, Human
ggcagggagagcaugcugauaa

SEQ ID NO: 437765 - RNA, 22 nt, Human
auggcuuguucauugguaccug

SEQ ID NO: 437766 - RNA, 22 nt, Human
gcaggccuuuaucccugccuca

SEQ ID NO: 437767 - RNA, 22 nt, Human
aacaucauccuuugaguauuua

SEQ ID NO: 437768 - RNA, 20 nt, Human
cuuugcaggagaacagagaa

SEQ ID NO: 437769 - RNA, 22 nt, Human
uacaguuuagaaccauagaugg

SEQ ID NO: 437770 - RNA, 22 nt, Human
uacaaugcugugcauguaaugg

SEQ ID NO: 437771 - RNA, 22 nt, Human
aaaccauugcaucuuucuuaau

SEQ ID NO: 437772 - RNA, 22 nt, Human
aagagaggacauggugaaccug

SEQ ID NO: 437773 - RNA, 20 nt, Human
ggccggggagcucuccaggg

SEQ ID NO: 437774 - RNA, 22 nt, Human
aaggcagccuuuugaguugauu

SEQ ID NO: 437775 - RNA, 22 nt, Human
uagcaacaauggaaguaacuuc

SEQ ID NO: 437776 - RNA, 22 nt, Human
uagagcaguuggcagcuguauu

SEQ ID NO: 437777 - RNA, 22 nt, Human
ucugucacugagcucaggauuc

SEQ ID NO: 437778 - RNA, 22 nt, Human
agcccuggcucccagcagcgcu

SEQ ID NO: 437779 - RNA, 22 nt, Human
gcucucugaggugcuggcagag

SEQ ID NO: 437780 - RNA, 22 nt, Human
cagcaguguacaaggugucaga

SEQ ID NO: 437781 - RNA, 22 nt, Human
aagacauuuuagagauagggaa

SEQ ID NO: 437782 - RNA, 22 nt, Human
cugcccuggucccauggcugau

SEQ ID NO: 437783 - RNA, 22 nt, Human
cccagcaggcauguugggagga

SEQ ID NO: 437784 - RNA, 22 nt, Human
agcaucuaaacuaucaguuuga

SEQ ID NO: 437785 - RNA, 18 nt, Human
uugcuuuguaagcuugca

SEQ ID NO: 437786 - RNA, 22 nt, Human
uugcuuugguagcagcuauaga

SEQ ID NO: 437787 - RNA, 22 nt, Human
aggguggcaguuacuggagcaa

SEQ ID NO: 437788 - RNA, 22 nt, Human
uuuuucuugugcuggaucuaau

SEQ ID NO: 437789 - RNA, 22 nt, Human
cuggguuuuauuacagugagcu

SEQ ID NO: 437790 - RNA, 22 nt, Human
uggccugguuguugcugccguu

SEQ ID NO: 437791 - RNA, 22 nt, Human
uuuagcauguuccuuucauaga

SEQ ID NO: 437792 - RNA, 22 nt, Human
gggcuggucuggcuuagucagg

SEQ ID NO: 437793 - RNA, 22 nt, Human
aggaagcccuugucauuucugu

SEQ ID NO: 437794 - RNA, 22 nt, Human
caggaaggggcucacucuggcc

SEQ ID NO: 437795 - RNA, 20 nt, Human
ucuaauuaaaauugucuagu

SEQ ID NO: 437796 - RNA, 22 nt, Human
gcccucuguuauugcauccuua

SEQ ID NO: 437797 - RNA, 22 nt, Human
agguaauuucuccaaacaugcu

SEQ ID NO: 437798 - RNA, 22 nt, Human
uccugaagaugaaaagagaggu

SEQ ID NO: 437799 - RNA, 22 nt, Human
uauugugaagggaaaaauagug

SEQ ID NO: 437800 - RNA, 22 nt, Human
gaggccuggucuaugagauguu

SEQ ID NO: 437801 - RNA, 22 nt, Human
cagcccuuuccuucucagcuuu

SEQ ID NO: 437802 - RNA, 22 nt, Human
uucuuuaugcuucuguuuaggc

SEQ ID NO: 437803 - RNA, 22 nt, Human
gcagccugaugaucuggguugu

SEQ ID NO: 437804 - RNA, 22 nt, Human
ccuuucucuaucgacccaucgc

SEQ ID NO: 437805 - RNA, 20 nt, Human
cacugcauugauggaaacag

SEQ ID NO: 437806 - RNA, 22 nt, Human
cccucagggaccacugacuuca

SEQ ID NO: 437807 - RNA, 22 nt, Human
ugugaggcuggcaggggccagg

SEQ ID NO: 437808 - RNA, 22 nt, Human
gugcccucaugaaacgaaggau

SEQ ID NO: 437809 - RNA, 22 nt, Human
cagucccagacccagaaggugg

SEQ ID NO: 437810 - RNA, 22 nt, Human
ccucaggcugcucacacuuguc

SEQ ID NO: 437811 - RNA, 22 nt, Human
guuuuauaguucgggaccuguu

SEQ ID NO: 437812 - RNA, 22 nt, Human
agcuugccucuuaaucaccuca

SEQ ID NO: 437813 - RNA, 22 nt, Human
cacuauaucuguucuuguuuau

SEQ ID NO: 437814 - RNA, 20 nt, Human
cacaguauucuuccuuaaaa

SEQ ID NO: 437815 - RNA, 22 nt, Human
cugggcucuagaaaggaaagaa

SEQ ID NO: 437816 - RNA, 23 nt, Human
cacaacuaaucagaaucucuagg

SEQ ID NO: 437817 - RNA, 20 nt, Human
ugauuuucugaaacagcaca

SEQ ID NO: 437818 - RNA, 22 nt, Human
guuccucaguuguaaaaaaugu

SEQ ID NO: 437819 - RNA, 22 nt, Human
agccaacagccagcaucaacca

SEQ ID NO: 437820 - RNA, 22 nt, Human
cagaauccaugacagacguuga

SEQ ID NO: 437821 - RNA, 22 nt, Human
ccaggaagacacaugcucaucc

SEQ ID NO: 437822 - RNA, 22 nt, Human
aaggcagcaccgccuccugaaa

SEQ ID NO: 437823 - RNA, 22 nt, Human
ggucccaguugcccaggucagg

SEQ ID NO: 437824 - RNA, 22 nt, Human
gggauggggagcuggaaagggg

SEQ ID NO: 437825 - RNA, 22 nt, Human
cagcaggacauggaggaguaaa

SEQ ID NO: 437826 - RNA, 22 nt, Human
gacagcagggaaaguccagacc

SEQ ID NO: 437827 - RNA, 22 nt, Human
aggaccagaggccagagucagc

SEQ ID NO: 437828 - RNA, 22 nt, Human
guugcuuuucuccaucacaugg

SEQ ID NO: 437829 - RNA, 22 nt, Human
aagcacagaugcaagggggacc

SEQ ID NO: 437830 - RNA, 23 nt, Human
aggaggccugaaacugaggcuga

SEQ ID NO: 437831 - RNA, 22 nt, Human
uuucagagaugucuagccuauu

SEQ ID NO: 437832 - RNA, 20 nt, Human
cccacacccuucccacuugg

SEQ ID NO: 437833 - RNA, 22 nt, Human
aauuuauauguaauuaggcaca

SEQ ID NO: 437834 - RNA, 22 nt, Human
gcuuccagaucccaugcucuua

SEQ ID NO: 437835 - RNA, 22 nt, Human
aggagcugcuuaaaugguuggu

SEQ ID NO: 437836 - RNA, 22 nt, Human
acagcagaguggagaugagcac

SEQ ID NO: 437837 - RNA, 20 nt, Human
ccugugcuuaucacuugcug

SEQ ID NO: 437838 - RNA, 22 nt, Human
agagcagauggccagggggccu

SEQ ID NO: 437839 - RNA, 22 nt, Human
agcccugcaggaggugggagag

SEQ ID NO: 437840 - RNA, 22 nt, Human
uuauauuaguuagacuugcugu

SEQ ID NO: 437841 - RNA, 22 nt, Human
ugcaggugguuuggacacugcu

SEQ ID NO: 437842 - RNA, 22 nt, Human
agauuuuaguuuggggaggugc

SEQ ID NO: 437843 - RNA, 22 nt, Human
ucaguguaaguuauguagaugu

SEQ ID NO: 437844 - RNA, 22 nt, Human
ugcuuuuuaguacugucuuauu

SEQ ID NO: 437845 - RNA, 22 nt, Human
cauguaaaccauugugagcauc

SEQ ID NO: 437846 - RNA, 22 nt, Human
aucaggccagcaaucccugggc

SEQ ID NO: 437847 - RNA, 22 nt, Human
cuggcugggagcgagcugcuca

SEQ ID NO: 437848 - RNA, 22 nt, Human
cacugcaguuccccagugcgca

SEQ ID NO: 437849 - RNA, 22 nt, Human
caggacagagcccagacugugu

SEQ ID NO: 437850 - RNA, 22 nt, Human
ggcaagguacucuagagcacau

SEQ ID NO: 437851 - RNA, 22 nt, Human
ugcaugcaacaauucuucuaua

SEQ ID NO: 437852 - RNA, 22 nt, Human
aaaugcagaaugauuucaucua

SEQ ID NO: 437853 - RNA, 22 nt, Human
guguguguguaaaaauccagag

SEQ ID NO: 437854 - RNA, 22 nt, Human
acagcagcacuauugacauuuu

SEQ ID NO: 437855 - RNA, 22 nt, Human
agcugccaucagccuuuggaug

SEQ ID NO: 437856 - RNA, 22 nt, Human
uggcaaaguaucugucccagcu

SEQ ID NO: 437857 - RNA, 22 nt, Human
ugaggcaguauucuccauucca

SEQ ID NO: 437858 - RNA, 22 nt, Human
cuaggcuguucaugcucagacc

SEQ ID NO: 437859 - RNA, 22 nt, Human
gaaggcugcgaggggagugccg

SEQ ID NO: 437860 - RNA, 22 nt, Human
uuucuguuaggcaucauuuuaa

SEQ ID NO: 437861 - RNA, 22 nt, Human
ccuccuggaggcucuaagggag

SEQ ID NO: 437862 - RNA, 22 nt, Human
augacaauacuucaauaagcug

SEQ ID NO: 437863 - RNA, 22 nt, Human
gagagcaauggggacgggcagg

SEQ ID NO: 437864 - RNA, 23 nt, Human
auuugaaacuuucuuguuuccag

SEQ ID NO: 437865 - RNA, 22 nt, Human
agcagggcuugccgcuuguccu

SEQ ID NO: 437866 - RNA, 22 nt, Human
ggccugaggcgucccagcugug

SEQ ID NO: 437867 - RNA, 22 nt, Human
gcugcaggagcuggagcugugg

SEQ ID NO: 437868 - RNA, 17 nt, Human
ugaaggaaggaugaugu

SEQ ID NO: 437869 - RNA, 19 nt, Human
cuacuuuauaauaugccuc

SEQ ID NO: 437870 - RNA, 22 nt, Human
aaauguacacuuugcaucuuga

SEQ ID NO: 437871 - RNA, 19 nt, Human
gcucucccucucaguugag

SEQ ID NO: 437872 - RNA, 22 nt, Human
acagaugaaacccagcuaguug

SEQ ID NO: 437873 - RNA, 22 nt, Human
agagcagccugugaugaugcac

SEQ ID NO: 437874 - RNA, 22 nt, Human
cugcccaggaaggagaggaugg

SEQ ID NO: 437875 - RNA, 22 nt, Human
ggaauaaaaauuguuuacugua

SEQ ID NO: 437876 - RNA, 22 nt, Human
gucagcugggcaucugcagaug

SEQ ID NO: 437877 - RNA, 22 nt, Human
agccuggaggaggaguugagca

SEQ ID NO: 437878 - RNA, 22 nt, Human
aauguacaaaagucagccaacu

SEQ ID NO: 437879 - RNA, 22 nt, Human
ccagaggaguugaggcuuuggg

SEQ ID NO: 437880 - RNA, 22 nt, Human
agacacaguuugggauggguug

SEQ ID NO: 437881 - RNA, 22 nt, Human
gagagcugugguuugaccaggc

SEQ ID NO: 437882 - RNA, 22 nt, Human
ccugucaguugcugucagggau

SEQ ID NO: 437883 - RNA, 20 nt, Human
uagagagaggauauuaaagu

SEQ ID NO: 437884 - RNA, 22 nt, Human
ccaggcugggcggggaaccugg

SEQ ID NO: 437885 - RNA, 22 nt, Human
uuuugacaaugcuaaucucaau

SEQ ID NO: 437886 - RNA, 22 nt, Human
ugcaggccggcccuaggccuca

SEQ ID NO: 437887 - RNA, 22 nt, Human
ugcaggcucugugugugccugg

SEQ ID NO: 437888 - RNA, 22 nt, Human
auguguguaugugccuauaucu

SEQ ID NO: 437889 - RNA, 22 nt, Human
ggccucuguuuggagccaggau

SEQ ID NO: 437890 - RNA, 22 nt, Human
cuauucaguaagccaaaaccau

SEQ ID NO: 437891 - RNA, 22 nt, Human
agaaaauaauuucuuggcuggu

SEQ ID NO: 437892 - RNA, 22 nt, Human
auggccugggcccgcuucagau

SEQ ID NO: 437893 - RNA, 22 nt, Human
acugugugggccgcucacuggg

SEQ ID NO: 437894 - RNA, 22 nt, Human
aaggccagauucucucuagggg

SEQ ID NO: 437895 - RNA, 22 nt, Human
cugggcacaggggagcagaguc

SEQ ID NO: 437896 - RNA, 22 nt, Human
aggcugaggugugcugugaucg

SEQ ID NO: 437897 - RNA, 22 nt, Human
gucagugucuuaacagagauua

SEQ ID NO: 437898 - RNA, 22 nt, Human
aaaacacugcaaagcugauugg

SEQ ID NO: 437899 - RNA, 22 nt, Human
caaaugaagagggcaacuucug

SEQ ID NO: 437900 - RNA, 22 nt, Human
ucaagacagugugauacuggcc

SEQ ID NO: 437901 - RNA, 20 nt, Human
aggagccauugacugcagca

SEQ ID NO: 437902 - RNA, 22 nt, Human
ugccugggccucugaggaaggc

SEQ ID NO: 437903 - RNA, 22 nt, Human
aucacaaucccucucucugaua

SEQ ID NO: 437904 - RNA, 22 nt, Human
ugcagcugccuagggcuggcuu

SEQ ID NO: 437905 - RNA, 22 nt, Human
cagcaacccgggggaccuuucu

SEQ ID NO: 437906 - RNA, 22 nt, Human
auuuagcaccuccaucucaaca

SEQ ID NO: 437907 - RNA, 22 nt, Human
aagacaggaacauagcaaaucc

SEQ ID NO: 437908 - RNA, 22 nt, Human
ugauucaagcuacuguuacugg

SEQ ID NO: 437909 - RNA, 22 nt, Human
cacuaauuccaucuccuuuucc

SEQ ID NO: 437910 - RNA, 22 nt, Human
caaugacaucucccugcucuaa

SEQ ID NO: 437911 - RNA, 22 nt, Human
uguaugaagccagaaucuguuu

SEQ ID NO: 437912 - RNA, 22 nt, Human
ccaggagagcaaaggucacucu

SEQ ID NO: 437913 - RNA, 23 nt, Human
agcagcuguggaguuuugcauuu

SEQ ID NO: 437914 - RNA, 22 nt, Human
cacacaguggaguauuacucag

SEQ ID NO: 437915 - RNA, 22 nt, Human
ggacacaguggaagacagcuug

SEQ ID NO: 437916 - RNA, 22 nt, Human
ugggcagcagcaaagccagacu

SEQ ID NO: 437917 - RNA, 22 nt, Human
aggcagcuaagauggauaauga

SEQ ID NO: 437918 - RNA, 22 nt, Human
acaggcugccacuugcauccaa

SEQ ID NO: 437919 - RNA, 22 nt, Human
ccagagaaaaaugugucccugu

SEQ ID NO: 437920 - RNA, 22 nt, Human
acaaggcaguacaaugaugaca

SEQ ID NO: 437921 - RNA, 22 nt, Human
cugaggcugaagagggccuacg

SEQ ID NO: 437922 - RNA, 22 nt, Human
ccucucccaggcgcggcggcag

SEQ ID NO: 437923 - RNA, 22 nt, Human
ggacagagcccugguggccuaa

SEQ ID NO: 437924 - RNA, 22 nt, Human
caaggcagcuauugucuccaua

SEQ ID NO: 437925 - RNA, 22 nt, Human
ucccagccuuccagucugguuu

SEQ ID NO: 437926 - RNA, 22 nt, Human
uugacccaaggcccuggaauug

SEQ ID NO: 437927 - RNA, 23 nt, Human
agaugaggcuucuccauguuggu

SEQ ID NO: 437928 - RNA, 22 nt, Human
cuggagcugucuucacaggccu

SEQ ID NO: 437929 - RNA, 22 nt, Human
gggcaaggcagaagaguuggag

SEQ ID NO: 437930 - RNA, 22 nt, Human
uccuuccuggggucucugcugc

SEQ ID NO: 437931 - RNA, 22 nt, Human
cugcauuacaauucugcucuau

SEQ ID NO: 437932 - RNA, 22 nt, Human
gcccauggcuucccuaggcaca

SEQ ID NO: 437933 - RNA, 22 nt, Human
aggaggagguaagaaaagcaua

SEQ ID NO: 437934 - RNA, 22 nt, Human
ugcaaauauugggacagucuag

SEQ ID NO: 437935 - RNA, 22 nt, Human
cagagcagaagcgguccucaca

SEQ ID NO: 437936 - RNA, 22 nt, Human
ccugcagagccacgugccagcg

SEQ ID NO: 437937 - RNA, 22 nt, Human
ccagggcaacgcugucucagag

SEQ ID NO: 437938 - RNA, 22 nt, Human
guggcucuguaaaaugccugca

SEQ ID NO: 437939 - RNA, 18 nt, Human
uuugcugaugagcaucau

SEQ ID NO: 437940 - RNA, 22 nt, Human
gaaggaaaucugugauuuaugc

SEQ ID NO: 437941 - RNA, 22 nt, Human
aagcacuuagaagagugccugc

SEQ ID NO: 437942 - RNA, 22 nt, Human
ggccucugguucacagggagga

SEQ ID NO: 437943 - RNA, 22 nt, Human
gaaggaagauucuguuggaauc

SEQ ID NO: 437944 - RNA, 22 nt, Human
acagaaguuggaauuagauacu

SEQ ID NO: 437945 - RNA, 22 nt, Human
gagcugaguguccuaggcaugg

SEQ ID NO: 437946 - RNA, 22 nt, Human
cagugcugccaaagggaccuug

SEQ ID NO: 437947 - RNA, 22 nt, Human
cccagagaucuacugagcccag

SEQ ID NO: 437948 - RNA, 22 nt, Human
gggccuguguguucaggagccu

SEQ ID NO: 437949 - RNA, 22 nt, Human
gugaauauucuuugugcaguau

SEQ ID NO: 437950 - RNA, 21 nt, Human
agcagaacagucgagcacugc

SEQ ID NO: 437951 - RNA, 22 nt, Human
gagcaacaggugauggggcugu

SEQ ID NO: 437952 - RNA, 22 nt, Human
ugaagcuguaggcaugggcagc

SEQ ID NO: 437953 - RNA, 22 nt, Human
cuauuaaacacuacugugcacu

SEQ ID NO: 437954 - RNA, 22 nt, Human
uauaaauuaaugugcccaugag

SEQ ID NO: 437955 - RNA, 22 nt, Human
gggcacagagggucuugaagaa

SEQ ID NO: 437956 - RNA, 22 nt, Human
agaggggaguccuaaucugauu

SEQ ID NO: 437957 - RNA, 22 nt, Human
gcacugccacauaaucucagca

SEQ ID NO: 437958 - RNA, 22 nt, Human
ucagcaggcaggaggcaugcca

SEQ ID NO: 437959 - RNA, 22 nt, Human
acuauucaccuuucaugcagga

SEQ ID NO: 437960 - RNA, 18 nt, Human
cccagccucuccuuucua

SEQ ID NO: 437961 - RNA, 21 nt, Human
guucuacaguuuuagaauucc

SEQ ID NO: 437962 - RNA, 22 nt, Human
ugggcaaaugcuuuuuagucaa

SEQ ID NO: 437963 - RNA, 22 nt, Human
cagagcugagaauguugaugcu

SEQ ID NO: 437964 - RNA, 22 nt, Human
ucacaguaucacacaaggauua

SEQ ID NO: 437965 - RNA, 22 nt, Human
aguucacauaucuguuuuauuu

SEQ ID NO: 437966 - RNA, 22 nt, Human
ccacaggcggaguggcgggcag

SEQ ID NO: 437967 - RNA, 22 nt, Human
ugccucagucuaaagucucuca

SEQ ID NO: 437968 - RNA, 22 nt, Human
ucugagaaaguacuguauguuc

SEQ ID NO: 437969 - RNA, 22 nt, Human
gagcuaaggcacaggcaggcuu

SEQ ID NO: 437970 - RNA, 22 nt, Human
aacaggaauugaugggaguccu

SEQ ID NO: 437971 - RNA, 20 nt, Human
agguccugggacuggcagag

SEQ ID NO: 437972 - RNA, 22 nt, Human
ugcccaggcuggaaugcagugg

SEQ ID NO: 437973 - RNA, 22 nt, Human
gucccuggagcugagcagugcu

SEQ ID NO: 437974 - RNA, 17 nt, Human
cccagggaccacugcuu

SEQ ID NO: 437975 - RNA, 22 nt, Human
aaacacuuuaagugaggaggau

SEQ ID NO: 437976 - RNA, 22 nt, Human
auucagaaagauaugccugguu

SEQ ID NO: 437977 - RNA, 22 nt, Human
cccagcugcaccucuauggccu

SEQ ID NO: 437978 - RNA, 22 nt, Human
gaugaugggauccagcaaugua

SEQ ID NO: 437979 - RNA, 22 nt, Human
ccugaggagauuguggcugggg

SEQ ID NO: 437980 - RNA, 22 nt, Human
ugcacugcuuugcaaagcugag

SEQ ID NO: 437981 - RNA, 22 nt, Human
uaggccagcccuuaguccuguc

SEQ ID NO: 437982 - RNA, 22 nt, Human
agacacagcugcaggagguggg

SEQ ID NO: 437983 - RNA, 22 nt, Human
ucucccaggugggugccuggag

SEQ ID NO: 437984 - RNA, 19 nt, Human
ccuggcucugagcccagcc

SEQ ID NO: 437985 - RNA, 19 nt, Human
aaaaggaauauucuuuggg

SEQ ID NO: 437986 - RNA, 22 nt, Human
ugcauucaaauccugauccugc

SEQ ID NO: 437987 - RNA, 22 nt, Human
cccagcaucccagugggcagca

SEQ ID NO: 437988 - RNA, 22 nt, Human
gcaguaggggcuggagggcugu

SEQ ID NO: 437989 - RNA, 22 nt, Human
gggagccacaguagcagcuacu

SEQ ID NO: 437990 - RNA, 22 nt, Human
caccgcggagugauggagaaac

SEQ ID NO: 437991 - RNA, 22 nt, Human
agccacagugcaagagagaaaa

SEQ ID NO: 437992 - RNA, 22 nt, Human
auucacaaauaacaggugcaga

SEQ ID NO: 437993 - RNA, 21 nt, Human
ccccagcaccuugccagccug

SEQ ID NO: 437994 - RNA, 22 nt, Human
uagcagcauuaauuccauuugc

SEQ ID NO: 437995 - RNA, 22 nt, Human
ggccucugguucguggugaccu

SEQ ID NO: 437996 - RNA, 18 nt, Human
cuagagaagguuacuaug

SEQ ID NO: 437997 - RNA, 22 nt, Human
aaaguugaguaggguuugggcc

SEQ ID NO: 437998 - RNA, 22 nt, Human
aaauauagcaauuaugccuacu

SEQ ID NO: 437999 - RNA, 22 nt, Human
ggaugcugcuaucaggcuucga

SEQ ID NO: 438000 - RNA, 22 nt, Human
ucuucaaacccuggcucuuccu

SEQ ID NO: 438001 - RNA, 22 nt, Human
uucagugugugauaccugcugu

SEQ ID NO: 438002 - RNA, 22 nt, Human
agcuggcauacuuugcuaggaa

SEQ ID NO: 438003 - RNA, 21 nt, Human
uuccacaguccugaggauuca

SEQ ID NO: 438004 - RNA, 22 nt, Human
caaacugcaacaugaagugucc

SEQ ID NO: 438005 - RNA, 22 nt, Human
agcacuauuccaaugauccaau

SEQ ID NO: 438006 - RNA, 22 nt, Human
ggcaggaacacagauggugccg

SEQ ID NO: 438007 - RNA, 22 nt, Human
aauaacuucaguucuuacauua

SEQ ID NO: 438008 - RNA, 22 nt, Human
aaacuucauuuucaacugcaaa

SEQ ID NO: 438009 - RNA, 22 nt, Human
uucuaacaaguggcuuguuagu

SEQ ID NO: 438010 - RNA, 22 nt, Human
aacagaggcucccugcacuugu

SEQ ID NO: 438011 - RNA, 22 nt, Human
aguagaaauguaguguagagaa

SEQ ID NO: 438012 - RNA, 22 nt, Human
cagccugggcuccagagucccu

SEQ ID NO: 438013 - RNA, 22 nt, Human
gcugggcagcugaggccucuca

SEQ ID NO: 438014 - RNA, 22 nt, Human
caugaggauccaggugacaggc

SEQ ID NO: 438015 - RNA, 22 nt, Human
gugcagcaaaguuugagauaua

SEQ ID NO: 438016 - RNA, 22 nt, Human
uguccucuuccagugcuccuuc

SEQ ID NO: 438017 - RNA, 22 nt, Human
agucuauacuggacuguuguga

SEQ ID NO: 438018 - RNA, 22 nt, Human
ggcacugggcaccggcugaggg

SEQ ID NO: 438019 - RNA, 22 nt, Human
auaauacaugguuaaccucuuu

SEQ ID NO: 438020 - RNA, 22 nt, Human
ccaggaguuggagguugcagug

SEQ ID NO: 438021 - RNA, 22 nt, Human
cccaagcagggugcagaggcau

SEQ ID NO: 438022 - RNA, 22 nt, Human
gugcagcugccgaucagauagg

SEQ ID NO: 438023 - RNA, 22 nt, Human
ugggccucuguuuccucaucug

SEQ ID NO: 438024 - RNA, 21 nt, Human
caguuuaauaacaaagaagga

SEQ ID NO: 438025 - RNA, 22 nt, Human
agagaauccccagacagaguua

SEQ ID NO: 438026 - RNA, 22 nt, Human
caaguucauuguagcauuauug

SEQ ID NO: 438027 - RNA, 22 nt, Human
acaggcugaggaugauugcauc

SEQ ID NO: 438028 - RNA, 22 nt, Human
agcaggcaagcgugaguucucu

SEQ ID NO: 438029 - RNA, 22 nt, Human
uuuucuccaacucaaaggaaag

SEQ ID NO: 438030 - RNA, 22 nt, Human
acuuugaaauguguaagagaga

SEQ ID NO: 438031 - RNA, 19 nt, Human
augaaugagcugugagguu

SEQ ID NO: 438032 - RNA, 17 nt, Human
aggcauggucuggggug

SEQ ID NO: 438033 - RNA, 22 nt, Human
gcucuguccagcgugcacagaa

SEQ ID NO: 438034 - RNA, 22 nt, Human
uugcuuuugugugcucucugga

SEQ ID NO: 438035 - RNA, 18 nt, Human
cugcccagagcacuugug

SEQ ID NO: 438036 - RNA, 22 nt, Human
ugggaaaguguagccugcaggc

SEQ ID NO: 438037 - RNA, 22 nt, Human
acaugagaggcuguggaguaca

SEQ ID NO: 438038 - RNA, 23 nt, Human
ggcugagaagucccaugauaggu

SEQ ID NO: 438039 - RNA, 22 nt, Human
gcacagaggaugaggcagcucu

SEQ ID NO: 438040 - RNA, 22 nt, Human
guacaauaacuagucuuauagu

SEQ ID NO: 438041 - RNA, 22 nt, Human
gcccuagcgccagcucagcacc

SEQ ID NO: 438042 - RNA, 22 nt, Human
ucacaguagccauuucaugagu

SEQ ID NO: 438043 - RNA, 22 nt, Human
guccugguccugccuccccaug

SEQ ID NO: 438044 - RNA, 23 nt, Human
agaucugauguuaccaagaauug

SEQ ID NO: 438045 - RNA, 22 nt, Human
aaggcagcagugcacgacugau

SEQ ID NO: 438046 - RNA, 22 nt, Human
gacugcaugauguuccagagga

SEQ ID NO: 438047 - RNA, 22 nt, Human
uugcugggugcuauuaugaaca

SEQ ID NO: 438048 - RNA, 22 nt, Human
gcugucccgcugacuuccagcu

SEQ ID NO: 438049 - RNA, 22 nt, Human
cugcagccucaaccuccugagc

SEQ ID NO: 438050 - RNA, 22 nt, Human
agcaggcaggaaggcagcacug

SEQ ID NO: 438051 - RNA, 22 nt, Human
cagcaccuuccuauccaggaga

SEQ ID NO: 438052 - RNA, 22 nt, Human
gccaguuccuguggagucagag

SEQ ID NO: 438053 - RNA, 22 nt, Human
agcagggcuucugugccugugc

SEQ ID NO: 438054 - RNA, 22 nt, Human
caggcagcucaaccuugggagc

SEQ ID NO: 438055 - RNA, 22 nt, Human
cuuugcagugaauccauaaaua

SEQ ID NO: 438056 - RNA, 22 nt, Human
uggaaaaaaauuggcuagcuuc

SEQ ID NO: 438057 - RNA, 22 nt, Human
uuuuauguugcuauaauaggua

SEQ ID NO: 438058 - RNA, 22 nt, Human
cuguauuuguccucuauuuauu

SEQ ID NO: 438059 - RNA, 22 nt, Human
uucaacuuuaggcaaagaaaac

SEQ ID NO: 438060 - RNA, 22 nt, Human
uucauacauuuuuacuaacagc

SEQ ID NO: 438061 - RNA, 22 nt, Human
gaagaagggagugacaaaugca

SEQ ID NO: 438062 - RNA, 22 nt, Human
uaauuucuagggacuaaggugc

SEQ ID NO: 438063 - RNA, 22 nt, Human
auaacauggaguuugucauuua

SEQ ID NO: 438064 - RNA, 22 nt, Human
gcagcccuggccuggccuacuu

SEQ ID NO: 438065 - RNA, 22 nt, Human
gugugccaggaacuggcugcug

SEQ ID NO: 438066 - RNA, 22 nt, Human
uucaaacucugaguaguucugc

SEQ ID NO: 438067 - RNA, 22 nt, Human
aaguaaacuuacacauaguaaa

SEQ ID NO: 438068 - RNA, 22 nt, Human
cugggcugucaauggcccucug

SEQ ID NO: 438069 - RNA, 22 nt, Human
cagcccuuguuucuaaagcugc

SEQ ID NO: 438070 - RNA, 22 nt, Human
cuuucucuuacccaaggaucug

SEQ ID NO: 438071 - RNA, 22 nt, Human
uugcauugaaugcacauuuuua

SEQ ID NO: 438072 - RNA, 22 nt, Human
acuuuaucaggaaucacacagc

SEQ ID NO: 438073 - RNA, 22 nt, Human
ccugagcuuuaaaagccaugua

SEQ ID NO: 438074 - RNA, 22 nt, Human
gggcacaggagaaggaucuggc

SEQ ID NO: 438075 - RNA, 22 nt, Human
ggacccagcucugagacccugc

SEQ ID NO: 438076 - RNA, 22 nt, Human
uuuccagaugcuagguugaaag

SEQ ID NO: 438077 - RNA, 22 nt, Human
gagcagcagcugggccagguuc

SEQ ID NO: 438078 - RNA, 22 nt, Human
aggcagggucuugcuauguugc

SEQ ID NO: 438079 - RNA, 22 nt, Human
uuguguguuuguagaaaaucca

SEQ ID NO: 438080 - RNA, 22 nt, Human
acaaagagggaccagugacuug

SEQ ID NO: 438081 - RNA, 22 nt, Human
ugaucuuuucaaagacaagcuu

SEQ ID NO: 438082 - RNA, 22 nt, Human
acuccagggcuucuaugauggu

SEQ ID NO: 438083 - RNA, 22 nt, Human
ucauaaauugauuaugugcuuu

SEQ ID NO: 438084 - RNA, 22 nt, Human
gaaguagaaaacucaguuucaa

SEQ ID NO: 438085 - RNA, 18 nt, Human
accugccuguucuucucu

SEQ ID NO: 438086 - RNA, 22 nt, Human
uugauacaggcucuauuucauc

SEQ ID NO: 438087 - RNA, 22 nt, Human
cagaaugagauaacccagauug

SEQ ID NO: 438088 - RNA, 22 nt, Human
gcugagcuagaaaaggaccaca

SEQ ID NO: 438089 - RNA, 22 nt, Human
cccuggagucagguuggccugg

SEQ ID NO: 438090 - RNA, 22 nt, Human
ccaggcuggagugcaguagugu

SEQ ID NO: 438091 - RNA, 22 nt, Human
uaaggcagccgcucagagaggu

SEQ ID NO: 438092 - RNA, 22 nt, Human
acaguacugaguacugaguugg

SEQ ID NO: 438093 - RNA, 17 nt, Human
ucugggcuucagugguc

SEQ ID NO: 438094 - RNA, 22 nt, Human
gaugauuuuaugucuugucauu

SEQ ID NO: 438095 - RNA, 22 nt, Human
cuggggaugggaccuggcauaa

SEQ ID NO: 438096 - RNA, 20 nt, Human
aggcugccaggucucacauc

SEQ ID NO: 438097 - RNA, 22 nt, Human
cucugcagaauuugagcugcuc

SEQ ID NO: 438098 - RNA, 22 nt, Human
ucugucaccauucagcuugaau

SEQ ID NO: 438099 - RNA, 22 nt, Human
aguucagcuucccaggucacug

SEQ ID NO: 438100 - RNA, 22 nt, Human
uugcaaauguuauacugccagu

SEQ ID NO: 438101 - RNA, 22 nt, Human
agcuguuuccauucuugaguag

SEQ ID NO: 438102 - RNA, 22 nt, Human
gccaccagccccaugcgcugug

SEQ ID NO: 438103 - RNA, 22 nt, Human
augagguuuugauuggcacagg

SEQ ID NO: 438104 - RNA, 22 nt, Human
cugcacaguguuggaagcugcc

SEQ ID NO: 438105 - RNA, 22 nt, Human
aauguacaggcuggcuaugggg

SEQ ID NO: 438106 - RNA, 22 nt, Human
caacauuugaguaaagaaaugg

SEQ ID NO: 438107 - RNA, 22 nt, Human
acagcagccuuguugguuucga

SEQ ID NO: 438108 - RNA, 22 nt, Human
ucaaauucagugugacaacauu

SEQ ID NO: 438109 - RNA, 22 nt, Human
aguccugugcaaaugcaucuga

SEQ ID NO: 438110 - RNA, 22 nt, Human
cuccaggacugaggacagagcu

SEQ ID NO: 438111 - RNA, 22 nt, Human
aggaaagguucagugauugaaa

SEQ ID NO: 438112 - RNA, 22 nt, Human
cuugccuuugucuucaaaggcu

SEQ ID NO: 438113 - RNA, 22 nt, Human
aaucuuuuaggggauccugagg

SEQ ID NO: 438114 - RNA, 22 nt, Human
aguguugucaaacggcucagca

SEQ ID NO: 438115 - RNA, 22 nt, Human
ggggcaccuccucuuggcaauu

SEQ ID NO: 438116 - RNA, 22 nt, Human
caagagcucaccggagagcauu

SEQ ID NO: 438117 - RNA, 22 nt, Human
gaggggcuguggagcucucugg

SEQ ID NO: 438118 - RNA, 22 nt, Human
caagauuuauauuuucacacaa

SEQ ID NO: 438119 - RNA, 22 nt, Human
aaaucgcuugaacccaggaagu

SEQ ID NO: 438120 - RNA, 22 nt, Human
ugagguuauuuauuaugcauga

SEQ ID NO: 438121 - RNA, 22 nt, Human
cccagggaagccauuucugacu

SEQ ID NO: 438122 - RNA, 22 nt, Human
cagcuugggucaggugccugcu

SEQ ID NO: 438123 - RNA, 22 nt, Human
auugaacauacauauccacacc

SEQ ID NO: 438124 - RNA, 22 nt, Human
cccuggaggaaaaucugaggcu

SEQ ID NO: 438125 - RNA, 22 nt, Human
cuggguucuuggcacagcagga

SEQ ID NO: 438126 - RNA, 22 nt, Human
cagcugguuuuagcacaguuag

SEQ ID NO: 438127 - RNA, 19 nt, Human
gcaggucauuaggcuaggu

SEQ ID NO: 438128 - RNA, 22 nt, Human
auaggacagcagacaauuagua

SEQ ID NO: 438129 - RNA, 22 nt, Human
agggagcaugggugaagcaggc

SEQ ID NO: 438130 - RNA, 22 nt, Human
cugcccugucugcagccuggcu

SEQ ID NO: 438131 - RNA, 20 nt, Human
gcuccaggucagagaggacg

SEQ ID NO: 438132 - RNA, 22 nt, Human
ucaacacuggcuacaguuaugc

SEQ ID NO: 438133 - RNA, 22 nt, Human
gcuggccaguguggugaccacc

SEQ ID NO: 438134 - RNA, 22 nt, Human
ggccucaggguugggcccauua

SEQ ID NO: 438135 - RNA, 22 nt, Human
agcaguuuuagggagacacauu

SEQ ID NO: 438136 - RNA, 22 nt, Human
ccaaagaaacccaagcucaggg

SEQ ID NO: 438137 - RNA, 17 nt, Human
ucagagggaugagcagg

SEQ ID NO: 438138 - RNA, 22 nt, Human
ugcaggaccuugauccuggacu

SEQ ID NO: 438139 - RNA, 22 nt, Human
gccuggagugcaguggcgugau

SEQ ID NO: 438140 - RNA, 22 nt, Human
agcaggcuaagggaccuguuua

SEQ ID NO: 438141 - RNA, 22 nt, Human
uauuuugugccaugcacugccu

SEQ ID NO: 438142 - RNA, 22 nt, Human
ugcagcugccuccuucccuugu

SEQ ID NO: 438143 - RNA, 22 nt, Human
uuaacaauagaguuucuucagg

SEQ ID NO: 438144 - RNA, 22 nt, Human
ccugaggaugccagcaugggug

SEQ ID NO: 438145 - RNA, 22 nt, Human
uuugaaagaauuuauguacuuu

SEQ ID NO: 438146 - RNA, 22 nt, Human
agccugguguggggcugcagag

SEQ ID NO: 438147 - RNA, 22 nt, Human
ugcccuggcucuccacuaguuu

SEQ ID NO: 438148 - RNA, 21 nt, Human
ccaggcuggccaugguauuga

SEQ ID NO: 438149 - RNA, 22 nt, Human
ugcagcccugugcacauccccu

SEQ ID NO: 438150 - RNA, 22 nt, Human
ggcagccccagaaacaguucag

SEQ ID NO: 438151 - RNA, 22 nt, Human
ucuuugcaguucugauuaaaua

SEQ ID NO: 438152 - RNA, 22 nt, Human
gacccaggaagcuacuucuggu

SEQ ID NO: 438153 - RNA, 22 nt, Human
uacagacauucaauuuugaccc

SEQ ID NO: 438154 - RNA, 22 nt, Human
ugugugugcacaugcauauaca

SEQ ID NO: 438155 - RNA, 22 nt, Human
cugagccaguagucagggacaa

SEQ ID NO: 438156 - RNA, 22 nt, Human
ccuggagcacucucccuggcug

SEQ ID NO: 438157 - RNA, 22 nt, Human
agagcuguggauaguccuggau

SEQ ID NO: 438158 - RNA, 22 nt, Human
cacaggaaaauaaaagaucuaa

SEQ ID NO: 438159 - RNA, 22 nt, Human
uuuaucuggacugugauauaaa

SEQ ID NO: 438160 - RNA, 22 nt, Human
ucacucuguuuuacucacuguu

SEQ ID NO: 438161 - RNA, 22 nt, Human
aggacacacaaagagugagaac

SEQ ID NO: 438162 - RNA, 22 nt, Human
gcagaggaggacccaggaauua

SEQ ID NO: 438163 - RNA, 22 nt, Human
cagcagcaguggcugcagaaca

SEQ ID NO: 438164 - RNA, 19 nt, Human
gaguccugugcuccuuguu

SEQ ID NO: 438165 - RNA, 22 nt, Human
gcugccacucugagcuugcuuc

SEQ ID NO: 438166 - RNA, 22 nt, Human
aagaagcauggcuguagauucc

SEQ ID NO: 438167 - RNA, 22 nt, Human
uccuggaggcaaaugagcacau

SEQ ID NO: 438168 - RNA, 22 nt, Human
uccagcagaccaucaaggcuca

SEQ ID NO: 438169 - RNA, 22 nt, Human
ugccaggcauuugacagacacu

SEQ ID NO: 438170 - RNA, 22 nt, Human
accccagcccugcuucugggag

SEQ ID NO: 438171 - RNA, 22 nt, Human
acuuagcaauuugauuaaaaga

SEQ ID NO: 438172 - RNA, 19 nt, Human
ggaaacaggggccagagga

SEQ ID NO: 438173 - RNA, 22 nt, Human
aaacacaauguuucuuuguucu

SEQ ID NO: 438174 - RNA, 22 nt, Human
ccacaguaaagaaacaacuucg

SEQ ID NO: 438175 - RNA, 20 nt, Human
cuccaugacuugaauuagua

SEQ ID NO: 438176 - RNA, 22 nt, Human
uuuguaaauagcaguacucaug

SEQ ID NO: 438177 - RNA, 19 nt, Human
ccaccagugugaucuaaga

SEQ ID NO: 438178 - RNA, 22 nt, Human
acuauugcuuagagcaaugggg

SEQ ID NO: 438179 - RNA, 22 nt, Human
cugggaggacaacuuggagcuc

SEQ ID NO: 438180 - RNA, 22 nt, Human
ccugcagaccacacucaguccu

SEQ ID NO: 438181 - RNA, 22 nt, Human
ugugaggccucugcaggagcag

SEQ ID NO: 438182 - RNA, 22 nt, Human
ucccagccuuucuuuucugcug

SEQ ID NO: 438183 - RNA, 22 nt, Human
agagaccaagggaauagucuca

SEQ ID NO: 438184 - RNA, 22 nt, Human
auuuaauaccacuuggugcuuu

SEQ ID NO: 438185 - RNA, 22 nt, Human
uggugagaaguuuugagauucu

SEQ ID NO: 438186 - RNA, 21 nt, Human
gugcacaguccugcacacagg

SEQ ID NO: 438187 - RNA, 22 nt, Human
agcuuuuacauaaugaucuuga

SEQ ID NO: 438188 - RNA, 23 nt, Human
uguguguguauucuacgcaaggu

SEQ ID NO: 438189 - RNA, 22 nt, Human
aggugcagaaaaaaguccuuua

SEQ ID NO: 438190 - RNA, 22 nt, Human
agagcuguagcuuccuagagcc

SEQ ID NO: 438191 - RNA, 22 nt, Human
agcuguuuuccugguuagagac

SEQ ID NO: 438192 - RNA, 22 nt, Human
gcagagcugcagcgaggccugg

SEQ ID NO: 438193 - RNA, 22 nt, Human
gacaaggaaauuacuagcugga

SEQ ID NO: 438194 - RNA, 22 nt, Human
agccugagccccauccagcuga

SEQ ID NO: 438195 - RNA, 22 nt, Human
gcagggugugucucauacaguu

SEQ ID NO: 438196 - RNA, 22 nt, Human
aaggccucccucuuucauggga

SEQ ID NO: 438197 - RNA, 22 nt, Human
ccaggauggggagcagauagaa

SEQ ID NO: 438198 - RNA, 22 nt, Human
agcugccaaguuggaguagcaa

SEQ ID NO: 438199 - RNA, 22 nt, Human
gggcagaggcucuggcccaucc

SEQ ID NO: 438200 - RNA, 22 nt, Human
acaggcagggaccucuugaguu

SEQ ID NO: 438201 - RNA, 22 nt, Human
ggcaccaggaucagucugucau

SEQ ID NO: 438202 - RNA, 22 nt, Human
cuggguggcuguccagccagcc

SEQ ID NO: 438203 - RNA, 22 nt, Human
ccuuagcaacugucauagagca

SEQ ID NO: 438204 - RNA, 17 nt, Human
aucugcauuucuaauga

SEQ ID NO: 438205 - RNA, 22 nt, Human
ccugagguggcugcagcacugc

SEQ ID NO: 438206 - RNA, 22 nt, Human
cauguacaguuuuucuguccug

SEQ ID NO: 438207 - RNA, 22 nt, Human
ugguccugucucaaggagccuu

SEQ ID NO: 438208 - RNA, 22 nt, Human
ucuaccuggaguccguuguuaa

SEQ ID NO: 438209 - RNA, 22 nt, Human
agcagagcagaaugugaaggug

SEQ ID NO: 438210 - RNA, 22 nt, Human
cacagaacugguuaauagcaga

SEQ ID NO: 438211 - RNA, 22 nt, Human
gcccagcccagaaagguucgga

SEQ ID NO: 438212 - RNA, 22 nt, Human
agcaguuuggaaaauacuagaa

SEQ ID NO: 438213 - RNA, 22 nt, Human
ugaggccaaugacccugggcag

SEQ ID NO: 438214 - RNA, 22 nt, Human
cccaggaggaggaaaaagcucg

SEQ ID NO: 438215 - RNA, 22 nt, Human
ccugggucccugagagaugauu

SEQ ID NO: 438216 - RNA, 22 nt, Human
gcuguuucuaagcugguuccua

SEQ ID NO: 438217 - RNA, 22 nt, Human
caccuuccaucuccuuggcuag

SEQ ID NO: 438218 - RNA, 22 nt, Human
ccaauucaccuccuaugcacau

SEQ ID NO: 438219 - RNA, 18 nt, Human
acaggcuauugcaggaga

SEQ ID NO: 438220 - RNA, 22 nt, Human
uucacaguggcugugccauuug

SEQ ID NO: 438221 - RNA, 22 nt, Human
gucccuggggaaucagcuggag

SEQ ID NO: 438222 - RNA, 22 nt, Human
aaaauaacuucuacuauuugca

SEQ ID NO: 438223 - RNA, 23 nt, Human
auacaaaccuugcaggacauguu

SEQ ID NO: 438224 - RNA, 22 nt, Human
uucagaaugauuacauucuggu

SEQ ID NO: 438225 - RNA, 22 nt, Human
ccuccagcugccucagucucuu

SEQ ID NO: 438226 - RNA, 22 nt, Human
acagcagcuaaaggugucuccu

SEQ ID NO: 438227 - RNA, 22 nt, Human
aauuuuacuaaucugaguguga

SEQ ID NO: 438228 - RNA, 22 nt, Human
gcugggcaccggagagacccca

SEQ ID NO: 438229 - RNA, 22 nt, Human
acgcagaagggccuggcgugcc

SEQ ID NO: 438230 - RNA, 21 nt, Human
gcugccaccgcgugcuccagg

SEQ ID NO: 438231 - RNA, 22 nt, Human
ggcaggcaccagcucagcaaua

SEQ ID NO: 438232 - RNA, 22 nt, Human
gcugggcagccccuacagagag

SEQ ID NO: 438233 - RNA, 22 nt, Human
cugagcagcaacccagagccuc

SEQ ID NO: 438234 - RNA, 22 nt, Human
gggaagauaguguugagggccc

SEQ ID NO: 438235 - RNA, 22 nt, Human
cugagggcaugaacauuccaua

SEQ ID NO: 438236 - RNA, 22 nt, Human
ggggcagaguagcuggggugug

SEQ ID NO: 438237 - RNA, 22 nt, Human
cugggacccacaccuggaaucu

SEQ ID NO: 438238 - RNA, 22 nt, Human
agggcacuccuuggcagcucug

SEQ ID NO: 438239 - RNA, 19 nt, Human
aacaucauggcucuuucca

SEQ ID NO: 438240 - RNA, 19 nt, Human
uaaggcagcagugacaggc

SEQ ID NO: 438241 - RNA, 22 nt, Human
aaaguugagugcugaucugauu

SEQ ID NO: 438242 - RNA, 22 nt, Human
caagaucuuccucaauagaccu

SEQ ID NO: 438243 - RNA, 21 nt, Human
gggcagaggggccuccugggu

SEQ ID NO: 438244 - RNA, 22 nt, Human
ugaagcuggaagcaugcagacu

SEQ ID NO: 438245 - RNA, 22 nt, Human
uuguuuguaugcugagaagaau

SEQ ID NO: 438246 - RNA, 22 nt, Human
agggaugacucuuggcugauuc

SEQ ID NO: 438247 - RNA, 22 nt, Human
cagagcaguagaaaacagccuu

SEQ ID NO: 438248 - RNA, 20 nt, Human
aagaggugauaacaggugag

SEQ ID NO: 438249 - RNA, 22 nt, Human
aguggcaguggggcagggcccu

SEQ ID NO: 438250 - RNA, 22 nt, Human
ccugcaggcugcaggccaguuc

SEQ ID NO: 438251 - RNA, 22 nt, Human
gcagcugguuaaugggagaauu

SEQ ID NO: 438252 - RNA, 22 nt, Human
auacuuuggggguuaguguaga

SEQ ID NO: 438253 - RNA, 22 nt, Human
cagcccugaaacaaccuccucu

SEQ ID NO: 438254 - RNA, 21 nt, Human
ccaggcugggagggcaguucc

SEQ ID NO: 438255 - RNA, 23 nt, Human
uuugcaaauuggacacaaccaca

SEQ ID NO: 438256 - RNA, 22 nt, Human
ugcccuggcacacacacagcug

SEQ ID NO: 438257 - RNA, 22 nt, Human
uagcccugcugugaugugaagu

SEQ ID NO: 438258 - RNA, 22 nt, Human
cauuugcagagggugacacucu

SEQ ID NO: 438259 - RNA, 22 nt, Human
ggcuuugcccuggacugaggca

SEQ ID NO: 438260 - RNA, 20 nt, Human
cccagagguugcggcaggag

SEQ ID NO: 438261 - RNA, 22 nt, Human
caaauagacucuagaauuuauu

SEQ ID NO: 438262 - RNA, 22 nt, Human
auuuagcaagaguacaaaauaa

SEQ ID NO: 438263 - RNA, 22 nt, Human
uuugcuauuuuucugugcagcu

SEQ ID NO: 438264 - RNA, 22 nt, Human
guuuuauaggugaaauauuacu

SEQ ID NO: 438265 - RNA, 22 nt, Human
ccagggaguuuccaaucugaga

SEQ ID NO: 438266 - RNA, 22 nt, Human
guggccaggccgacugccaggc

SEQ ID NO: 438267 - RNA, 22 nt, Human
guccugggagaugggacccuga

SEQ ID NO: 438268 - RNA, 22 nt, Human
gggcuccagccaggugucccca

SEQ ID NO: 438269 - RNA, 22 nt, Human
uacaguacccugaugaacuaaa

SEQ ID NO: 438270 - RNA, 22 nt, Human
ccagccuuugcaucccccaucu

SEQ ID NO: 438271 - RNA, 21 nt, Human
acuuugcaucuaccuuggguu

SEQ ID NO: 438272 - RNA, 22 nt, Human
agcuaaugauacaugcuccaca

SEQ ID NO: 438273 - RNA, 20 nt, Human
augauuuugcacuaacuuca

SEQ ID NO: 438274 - RNA, 22 nt, Human
gggagcugagcuggaagagaau

SEQ ID NO: 438275 - RNA, 22 nt, Human
gagccaagggcgugcuggagag

SEQ ID NO: 438276 - RNA, 22 nt, Human
aggagcugaagucucugcacuc

SEQ ID NO: 438277 - RNA, 22 nt, Human
ucuuuauguuugaaaguacaau

SEQ ID NO: 438278 - RNA, 22 nt, Human
acaggacagucuaguaacagua

SEQ ID NO: 438279 - RNA, 22 nt, Human
ucucccaggcuggagugcagug

SEQ ID NO: 438280 - RNA, 22 nt, Human
ucacugcaaggaggcuucucaa

SEQ ID NO: 438281 - RNA, 22 nt, Human
ccggcaaaggccccuuccccag

SEQ ID NO: 438282 - RNA, 23 nt, Human
acagcugcaccuggccgccuggc

SEQ ID NO: 438283 - RNA, 22 nt, Human
uggagcuggaauuucugggccu

SEQ ID NO: 438284 - RNA, 22 nt, Human
uucuggagaggaacagaaaggu

SEQ ID NO: 438285 - RNA, 22 nt, Human
cucacucagacauccagugcag

SEQ ID NO: 438286 - RNA, 22 nt, Human
aauucagaaaaauucacuccua

SEQ ID NO: 438287 - RNA, 22 nt, Human
acaaagaucuugcuuuccuacu

SEQ ID NO: 438288 - RNA, 22 nt, Human
cauggcccucuucuggagcaau

SEQ ID NO: 438289 - RNA, 22 nt, Human
ugggcagaaaucaguaucagau

SEQ ID NO: 438290 - RNA, 22 nt, Human
uuaaauuagucaagcuucucug

SEQ ID NO: 438291 - RNA, 21 nt, Human
gaggaaugguuugcaaagcac

SEQ ID NO: 438292 - RNA, 22 nt, Human
uggccagcacuuagcccuuacc

SEQ ID NO: 438293 - RNA, 22 nt, Human
ucucuaaagauauuuauggcaa

SEQ ID NO: 438294 - RNA, 22 nt, Human
aaaugcauuaagucagaacaau

SEQ ID NO: 438295 - RNA, 22 nt, Human
ugcacacagaugguacaugcau

SEQ ID NO: 438296 - RNA, 22 nt, Human
acauuuuucacauuuguagggu

SEQ ID NO: 438297 - RNA, 22 nt, Human
ggccucacccaucggugccuuu

SEQ ID NO: 438298 - RNA, 20 nt, Human
ccacagaggacagggcugug

SEQ ID NO: 438299 - RNA, 22 nt, Human
uggcccugacuuggaggccuga

SEQ ID NO: 438300 - RNA, 22 nt, Human
agcagcaugaugacagagucuc

SEQ ID NO: 438301 - RNA, 22 nt, Human
aggccuggguguucaccagaag

SEQ ID NO: 438302 - RNA, 22 nt, Human
aguucuuugugauggaaauuua

SEQ ID NO: 438303 - RNA, 22 nt, Human
aguuuugauacuuucucuucau

SEQ ID NO: 438304 - RNA, 22 nt, Human
aaauaacuugguuucaucagag

SEQ ID NO: 438305 - RNA, 23 nt, Human
cagcccuggagaugugggaggca

SEQ ID NO: 438306 - RNA, 22 nt, Human
ugcacacacucguguauaugag

SEQ ID NO: 438307 - RNA, 19 nt, Human
ucuaacagaagugucgucc

SEQ ID NO: 438308 - RNA, 22 nt, Human
auguacaauucuccuugguagg

SEQ ID NO: 438309 - RNA, 22 nt, Human
cucacaggcaucucaucaggcu

SEQ ID NO: 438310 - RNA, 22 nt, Human
ccagagucauuuugagucauaa

SEQ ID NO: 438311 - RNA, 22 nt, Human
guuuuucuagacugggaguuug

SEQ ID NO: 438312 - RNA, 22 nt, Human
cagcagcagagauacugguuuc

SEQ ID NO: 438313 - RNA, 22 nt, Human
cagcugccccauaaaucacagu

SEQ ID NO: 438314 - RNA, 22 nt, Human
caggaugugaggaggccauuug

SEQ ID NO: 438315 - RNA, 22 nt, Human
cugguacauaguaagaacacaa

SEQ ID NO: 438316 - RNA, 23 nt, Human
auauggcuguuguguguuaacau

SEQ ID NO: 438317 - RNA, 22 nt, Human
uuucaaacauagaucugaauau

SEQ ID NO: 438318 - RNA, 22 nt, Human
auuaaauuggaucugcauaguu

SEQ ID NO: 438319 - RNA, 22 nt, Human
ccagcaagugcagauggccaag

SEQ ID NO: 438320 - RNA, 22 nt, Human
ggcugggcaggucugcacaggg

SEQ ID NO: 438321 - RNA, 18 nt, Human
ggccagccccaggccagc

SEQ ID NO: 438322 - RNA, 22 nt, Human
ggggggcagcuguccuggccau

SEQ ID NO: 438323 - RNA, 22 nt, Human
aggcagcucuguggccucccag

SEQ ID NO: 438324 - RNA, 22 nt, Human
caggccagagcgcgugguuggg

SEQ ID NO: 438325 - RNA, 22 nt, Human
gcucacugccauucucuagaug

SEQ ID NO: 438326 - RNA, 22 nt, Human
cuguacaaaagaaaguuccuau

SEQ ID NO: 438327 - RNA, 22 nt, Human
ucuuugcugaguacaucuccaa

SEQ ID NO: 438328 - RNA, 22 nt, Human
uauucaaaguaccuucauugcc

SEQ ID NO: 438329 - RNA, 22 nt, Human
ucugcuuucuugcgcagaugug

SEQ ID NO: 438330 - RNA, 22 nt, Human
agggaagcugcuggguccaccu

SEQ ID NO: 438331 - RNA, 22 nt, Human
uggaaagugcucuagacuuucu

SEQ ID NO: 438332 - RNA, 22 nt, Human
gccuucugugcuccuggccuuu

SEQ ID NO: 438333 - RNA, 16 nt, Human
ucaggccuggacgagc

SEQ ID NO: 438334 - RNA, 22 nt, Human
cccaggccagaacuugguugcu

SEQ ID NO: 438335 - RNA, 22 nt, Human
ggcagugcaaggcagccuggau

SEQ ID NO: 438336 - RNA, 22 nt, Human
aaugcacuuaguaugaaugccu

SEQ ID NO: 438337 - RNA, 22 nt, Human
caggacagaccaagaucgugcu

SEQ ID NO: 438338 - RNA, 22 nt, Human
gagcuaagagucuagaaaggcu

SEQ ID NO: 438339 - RNA, 19 nt, Human
ucucacaagcaacauuguu

SEQ ID NO: 438340 - RNA, 22 nt, Human
gcacacaucuuguaauccugag

SEQ ID NO: 438341 - RNA, 22 nt, Human
aggaaggggagaaguuaaagcu

SEQ ID NO: 438342 - RNA, 22 nt, Human
agagaccagaauccagcugccu

SEQ ID NO: 438343 - RNA, 22 nt, Human
ucucagaggugcccuggcaucu

SEQ ID NO: 438344 - RNA, 22 nt, Human
caggcuccacuguaggcagcuc

SEQ ID NO: 438345 - RNA, 22 nt, Human
cacugcagaucagaggcugaga

SEQ ID NO: 438346 - RNA, 22 nt, Human
ggccuguccagccugccuggcu

SEQ ID NO: 438347 - RNA, 22 nt, Human
cugaggcuggggaagggaagug

SEQ ID NO: 438348 - RNA, 22 nt, Human
gcccugguuuuagaggagcagg

SEQ ID NO: 438349 - RNA, 22 nt, Human
aacagaggauguuugaaauuca

SEQ ID NO: 438350 - RNA, 22 nt, Human
agcuggcuaugcccugugaacc

SEQ ID NO: 438351 - RNA, 22 nt, Human
cagccucugacaccacagucgu

SEQ ID NO: 438352 - RNA, 22 nt, Human
aaggcaauggcaagagaaagca

SEQ ID NO: 438353 - RNA, 22 nt, Human
auguagaagugggcauuauaga

SEQ ID NO: 438354 - RNA, 22 nt, Human
cugggcagaauuuuaggauggc

SEQ ID NO: 438355 - RNA, 22 nt, Human
uuuuuagauuacucagccacca

SEQ ID NO: 438356 - RNA, 22 nt, Human
ucuuuggcaucagggccagcua

SEQ ID NO: 438357 - RNA, 22 nt, Human
ugcaguggugguaaagaugcuc

SEQ ID NO: 438358 - RNA, 22 nt, Human
cugcucuguuucuuagcugggu

SEQ ID NO: 438359 - RNA, 22 nt, Human
ucaugccaaaauccaguggcuu

SEQ ID NO: 438360 - RNA, 22 nt, Human
ucucuuuaaaaauagugaaaua

SEQ ID NO: 438361 - RNA, 22 nt, Human
cagagacaguuucacagggucu

SEQ ID NO: 438362 - RNA, 22 nt, Human
agcagcuuccugcucuucgccu

SEQ ID NO: 438363 - RNA, 22 nt, Human
auuguauuuaggagaaaagggu

SEQ ID NO: 438364 - RNA, 22 nt, Human
guuucagaacaccccauuuggg

SEQ ID NO: 438365 - RNA, 20 nt, Human
acuccagguggcaugaggac

SEQ ID NO: 438366 - RNA, 22 nt, Human
cagagaacauucagagcuguag

SEQ ID NO: 438367 - RNA, 22 nt, Human
gcaucuaaaucacuuuaaugua

SEQ ID NO: 438368 - RNA, 22 nt, Human
cagugcuguguuugcugccugg

SEQ ID NO: 438369 - RNA, 22 nt, Human
uagcugccuaugugauaagaga

SEQ ID NO: 438370 - RNA, 22 nt, Human
auuaaggcugcacuggccuuaa

SEQ ID NO: 438371 - RNA, 22 nt, Human
uuugcaaaguuauuuagacuca

SEQ ID NO: 438372 - RNA, 22 nt, Human
agggacagucuacuguucacug

SEQ ID NO: 438373 - RNA, 22 nt, Human
ccagcaccuugaucuuggaguu

SEQ ID NO: 438374 - RNA, 22 nt, Human
ccacaggcugcugcaggucccg

SEQ ID NO: 438375 - RNA, 22 nt, Human
gaggcaggcacuguuaucagca

SEQ ID NO: 438376 - RNA, 22 nt, Human
ggcccuguuagagcucccacaa

SEQ ID NO: 438377 - RNA, 22 nt, Human
agaggcagcagucauacuacag

SEQ ID NO: 438378 - RNA, 22 nt, Human
uuugauaacagugaauaucaug

SEQ ID NO: 438379 - RNA, 22 nt, Human
uuuucuuaugugcagcuauaug

SEQ ID NO: 438380 - RNA, 22 nt, Human
ucagaggagcugcagaacgcug

SEQ ID NO: 438381 - RNA, 23 nt, Human
aggcagcagguuguccaggguga

SEQ ID NO: 438382 - RNA, 22 nt, Human
aaggcacagccacuugaucauc

SEQ ID NO: 438383 - RNA, 22 nt, Human
ggaggcagaauagagugugggu

SEQ ID NO: 438384 - RNA, 22 nt, Human
ugggcuccagcaccugugcucu

SEQ ID NO: 438385 - RNA, 22 nt, Human
ccugaggcuggcccuuccaucc

SEQ ID NO: 438386 - RNA, 20 nt, Human
ugcagguguuggagaaggua

SEQ ID NO: 438387 - RNA, 22 nt, Human
cagagacauuaagugccaugau

SEQ ID NO: 438388 - RNA, 22 nt, Human
agucccagugacuuggccagaa

SEQ ID NO: 438389 - RNA, 22 nt, Human
uaccauuuugaaacauuucauc

SEQ ID NO: 438390 - RNA, 22 nt, Human
caacagagggaauggaucucau

SEQ ID NO: 438391 - RNA, 22 nt, Human
cugccaggacugacgucuucag

SEQ ID NO: 438392 - RNA, 22 nt, Human
uucuaacuggugcagugcugca

SEQ ID NO: 438393 - RNA, 22 nt, Human
aauuuucuaaggugaugaucug

SEQ ID NO: 438394 - RNA, 22 nt, Human
agaauacaguaugcaaaaagau

SEQ ID NO: 438395 - RNA, 22 nt, Human
gcaguuuuauuaugauggaaau

SEQ ID NO: 438396 - RNA, 22 nt, Human
uaacugcagaggaaaugcaucu

SEQ ID NO: 438397 - RNA, 22 nt, Human
agcaggaguguccccuggcugu

SEQ ID NO: 438398 - RNA, 18 nt, Human
uacaggaagggguucucg

SEQ ID NO: 438399 - RNA, 22 nt, Human
uugaagcugucuuucagaauca

SEQ ID NO: 438400 - RNA, 22 nt, Human
ugugugaauggauuauucuauu

SEQ ID NO: 438401 - RNA, 22 nt, Human
ggcaggcauggggucugccauu

SEQ ID NO: 438402 - RNA, 22 nt, Human
gccugccugcugucaucugccu

SEQ ID NO: 438403 - RNA, 22 nt, Human
ccagccuggagggcaguggugg

SEQ ID NO: 438404 - RNA, 22 nt, Human
acaaaccagcuuaagcaagaug

SEQ ID NO: 438405 - RNA, 22 nt, Human
ccuccagacuuuggccauccuc

SEQ ID NO: 438406 - RNA, 22 nt, Human
uuccaugggucugggggcucca

SEQ ID NO: 438407 - RNA, 23 nt, Human
gggcagguuuuuauaggcuucag

SEQ ID NO: 438408 - RNA, 22 nt, Human
uucaaaguuucaaucuguauca

SEQ ID NO: 438409 - RNA, 22 nt, Human
aauggcaaaaggauaacaagga

SEQ ID NO: 438410 - RNA, 22 nt, Human
uugcuuuuuaauuaggaggcag

SEQ ID NO: 438411 - RNA, 22 nt, Human
ugagaagcucugaaacaguauc

SEQ ID NO: 438412 - RNA, 22 nt, Human
uacugcauguguuugaugaugg

SEQ ID NO: 438413 - RNA, 22 nt, Human
ugggggcagaggauucaggaau

SEQ ID NO: 438414 - RNA, 22 nt, Human
uuuuuauaugaaggauagugcg

SEQ ID NO: 438415 - RNA, 22 nt, Human
uucuagaaacacaugcaaacag

SEQ ID NO: 438416 - RNA, 22 nt, Human
caguacuugggaaugcugggga

SEQ ID NO: 438417 - RNA, 22 nt, Human
uggagcugauacagcuggcuuu

SEQ ID NO: 438418 - RNA, 20 nt, Human
ugcagcugcaggaggguggg

SEQ ID NO: 438419 - RNA, 17 nt, Human
gaacuuuuauuaaauuc

SEQ ID NO: 438420 - RNA, 22 nt, Human
aaggcugagacagcacaggucc

SEQ ID NO: 438421 - RNA, 22 nt, Human
gcuuugcauugugaugggaugc

SEQ ID NO: 438422 - RNA, 22 nt, Human
ugaggaagggugugacggcacc

SEQ ID NO: 438423 - RNA, 22 nt, Human
ucuaggaaccugacaucucuca

SEQ ID NO: 438424 - RNA, 22 nt, Human
cagcaaccuaaauccacuaacu

SEQ ID NO: 438425 - RNA, 22 nt, Human
ucucacuggguauaaaugagua

SEQ ID NO: 438426 - RNA, 22 nt, Human
cccaggcagcggggucuccuug

SEQ ID NO: 438427 - RNA, 20 nt, Human
caaggcagaccagagugagu

SEQ ID NO: 438428 - RNA, 22 nt, Human
ucagaauucugaccuuggguca

SEQ ID NO: 438429 - RNA, 22 nt, Human
cagaaugcaaauuuuauaauau

SEQ ID NO: 438430 - RNA, 22 nt, Human
ggcagaggagcuggaaacaugg

SEQ ID NO: 438431 - RNA, 22 nt, Human
gcaggagcccuggcauguucuu

SEQ ID NO: 438432 - RNA, 22 nt, Human
aagcccugggguugcacaaggc

SEQ ID NO: 438433 - RNA, 22 nt, Human
ucuggcagggguucugcacuug

SEQ ID NO: 438434 - RNA, 22 nt, Human
aacacuuuggaauagagauagg

SEQ ID NO: 438435 - RNA, 22 nt, Human
uccuggagccaaugugcugcug

SEQ ID NO: 438436 - RNA, 15 nt, Human
aaaguugauggcucu

SEQ ID NO: 438437 - RNA, 22 nt, Human
agcacagugcugggcacacagu

SEQ ID NO: 438438 - RNA, 22 nt, Human
uccuggacagauccccaucauc

SEQ ID NO: 438439 - RNA, 22 nt, Human
gaaggcaaggagggaagccacc

SEQ ID NO: 438440 - RNA, 22 nt, Human
cagcagcaacaauagcggucac

SEQ ID NO: 438441 - RNA, 22 nt, Human
acagcagguuauuguuauggca

SEQ ID NO: 438442 - RNA, 22 nt, Human
aaugcuuugagggaagaugaaa

SEQ ID NO: 438443 - RNA, 19 nt, Human
ugcuuugccuugauuagcu

SEQ ID NO: 438444 - RNA, 22 nt, Human
aucuaagauguauugagcacuu

SEQ ID NO: 438445 - RNA, 23 nt, Human
agcagcccaauggcaagcucugg

SEQ ID NO: 438446 - RNA, 22 nt, Human
gagggccacguucagggcucuc

SEQ ID NO: 438447 - RNA, 22 nt, Human
uauaauuuggggaaaguggugu

SEQ ID NO: 438448 - RNA, 22 nt, Human
gcucaggggaaugggcugccgu

SEQ ID NO: 438449 - RNA, 22 nt, Human
ccuccagaggguuucccaugaa

SEQ ID NO: 438450 - RNA, 22 nt, Human
ugggcagggucucuguuaucag

SEQ ID NO: 438451 - RNA, 22 nt, Human
agcugccugcuuaugagcucca

SEQ ID NO: 438452 - RNA, 20 nt, Human
agacaaugagugacagaguu

SEQ ID NO: 438453 - RNA, 22 nt, Human
ccuggagacgaggcuggaccau

SEQ ID NO: 438454 - RNA, 22 nt, Human
agcaggguuccaggaguugcag

SEQ ID NO: 438455 - RNA, 22 nt, Human
agcagcagauuauggucuacau

SEQ ID NO: 438456 - RNA, 22 nt, Human
ccaggccagcaggcacaccugc

SEQ ID NO: 438457 - RNA, 22 nt, Human
cccagcaucuccaggcauggcc

SEQ ID NO: 438458 - RNA, 22 nt, Human
ucuuugcaucccuuccauaguu

SEQ ID NO: 438459 - RNA, 21 nt, Human
agacuuugcuugcagagaguc

SEQ ID NO: 438460 - RNA, 22 nt, Human
uauaggaaacauacgugacuag

SEQ ID NO: 438461 - RNA, 22 nt, Human
aggcagcagggccacuggcuga

SEQ ID NO: 438462 - RNA, 22 nt, Human
uagugcauaccuaacauuuuug

SEQ ID NO: 438463 - RNA, 22 nt, Human
uuacacaguauccaagguucuu

SEQ ID NO: 438464 - RNA, 22 nt, Human
gccuggugcuaugagggccagc

SEQ ID NO: 438465 - RNA, 22 nt, Human
aaaauuauucauggcuuuugga

SEQ ID NO: 438466 - RNA, 22 nt, Human
gcuggccagggcugcucgcgga

SEQ ID NO: 438467 - RNA, 22 nt, Human
caucuaauaccucauuuaaucu

SEQ ID NO: 438468 - RNA, 22 nt, Human
cagugcuauuuggacacaggga

SEQ ID NO: 438469 - RNA, 21 nt, Human
ccaggaaggacugagcucccu

SEQ ID NO: 438470 - RNA, 22 nt, Human
aaugauaccgccaauauuacca

SEQ ID NO: 438471 - RNA, 22 nt, Human
caggcuaaagcuuugagcaugu

SEQ ID NO: 438472 - RNA, 22 nt, Human
cagcccuuuuuugguacaaccg

SEQ ID NO: 438473 - RNA, 21 nt, Human
uccuccuguagaggguccugg

SEQ ID NO: 438474 - RNA, 16 nt, Human
gaggcuggcagauguc

SEQ ID NO: 438475 - RNA, 22 nt, Human
ccagcagcccucuuccaagacu

SEQ ID NO: 438476 - RNA, 22 nt, Human
cuguggagaugcagaccaggcc

SEQ ID NO: 438477 - RNA, 22 nt, Human
cuccacagccccuccaguggca

SEQ ID NO: 438478 - RNA, 22 nt, Human
acaaugcaccuauuuuaaaacu

SEQ ID NO: 438479 - RNA, 22 nt, Human
uacauacuuuuucuugcaagca

SEQ ID NO: 438480 - RNA, 21 nt, Human
agaugaggauacugaggccua

SEQ ID NO: 438481 - RNA, 22 nt, Human
uggccuggcugcccugucugga

SEQ ID NO: 438482 - RNA, 22 nt, Human
cugcugggaaggucugcucagu

SEQ ID NO: 438483 - RNA, 22 nt, Human
ggcuuccagugaugccucuuug

SEQ ID NO: 438484 - RNA, 22 nt, Human
ggccccagcuucaaccccgugg

SEQ ID NO: 438485 - RNA, 22 nt, Human
auuugcaauuacucaugucauu

SEQ ID NO: 438486 - RNA, 22 nt, Human
ugcacaaaggcucccugcugag

SEQ ID NO: 438487 - RNA, 22 nt, Human
gcugucaguuuuacccacagac

SEQ ID NO: 438488 - RNA, 22 nt, Human
cucugcugcuuugccaguggaa

SEQ ID NO: 438489 - RNA, 22 nt, Human
agcugggcuggagcuccaagcg

SEQ ID NO: 438490 - RNA, 22 nt, Human
gagcagaacaggccggguggga

SEQ ID NO: 438491 - RNA, 22 nt, Human
uaugugcaaauuaauugcuaga

SEQ ID NO: 438492 - RNA, 22 nt, Human
gcagggcuguggacacuuuggu

SEQ ID NO: 438493 - RNA, 22 nt, Human
uggagcccagacacuggcauug

SEQ ID NO: 438494 - RNA, 22 nt, Human
uuugacaaccaggcagguaaga

SEQ ID NO: 438495 - RNA, 22 nt, Human
ugcuaaggacugggaggcaggg

SEQ ID NO: 438496 - RNA, 19 nt, Human
gcauccauggaggccgcuu

SEQ ID NO: 438497 - RNA, 22 nt, Human
gggaagaguaacuagcccaugu

SEQ ID NO: 438498 - RNA, 22 nt, Human
ccugcagguugcagaggcggaa

SEQ ID NO: 438499 - RNA, 22 nt, Human
aagcugccaccagcccagggca

SEQ ID NO: 438500 - RNA, 21 nt, Human
guucugaguuagaguuggcca

SEQ ID NO: 438501 - RNA, 19 nt, Human
gaggcaguagucaaagcuu

SEQ ID NO: 438502 - RNA, 22 nt, Human
uuggggcaccuccccagcauuu

SEQ ID NO: 438503 - RNA, 22 nt, Human
ccauguugucaaacuuagagua

SEQ ID NO: 438504 - RNA, 22 nt, Human
uuaaaugaggcugauguagauu

SEQ ID NO: 438505 - RNA, 22 nt, Human
uauggcaauauguaucaagauc

SEQ ID NO: 438506 - RNA, 22 nt, Human
uuucuuaugggguaguccuuua

SEQ ID NO: 438507 - RNA, 22 nt, Human
cucagcaagacccccaccgugu

SEQ ID NO: 438508 - RNA, 22 nt, Human
cugccccugccaggcagcuguc

SEQ ID NO: 438509 - RNA, 22 nt, Human
aggcauggcuuuaggcaggcgu

SEQ ID NO: 438510 - RNA, 22 nt, Human
aacuuuuagacuuggguauaaa

SEQ ID NO: 438511 - RNA, 22 nt, Human
gaagagagagcccugggguccg

SEQ ID NO: 438512 - RNA, 22 nt, Human
cagaaguaagauuacugugaga

SEQ ID NO: 438513 - RNA, 22 nt, Human
gugcucuguguauuaggauguc

SEQ ID NO: 438514 - RNA, 22 nt, Human
gagacauucuuaggaacaaugu

SEQ ID NO: 438515 - RNA, 22 nt, Human
agcucccagcagagcuggccac

SEQ ID NO: 438516 - RNA, 22 nt, Human
ggaggugggauuaggaccuaaa

SEQ ID NO: 438517 - RNA, 22 nt, Human
agagggccauaggugcauaguu

SEQ ID NO: 438518 - RNA, 22 nt, Human
ugcugagacaguggauaggggc

SEQ ID NO: 438519 - RNA, 22 nt, Human
gaaguagauucguugcaucuug

SEQ ID NO: 438520 - RNA, 22 nt, Human
uggaaauacuugccauaaaacu

SEQ ID NO: 438521 - RNA, 22 nt, Human
aagagguucuccuuggaguggg

SEQ ID NO: 438522 - RNA, 20 nt, Human
uccaguuuuggagacauucu

SEQ ID NO: 438523 - RNA, 22 nt, Human
agaggaaacauagguuuuuaaa

SEQ ID NO: 438524 - RNA, 22 nt, Human
cugugugucauuugucaauccu

SEQ ID NO: 438525 - RNA, 22 nt, Human
cuucccagacgggguggcagcc

SEQ ID NO: 438526 - RNA, 21 nt, Human
aggcucccagaaaugggcauc

SEQ ID NO: 438527 - RNA, 22 nt, Human
acccagagcugggcuuggcaaa

SEQ ID NO: 438528 - RNA, 22 nt, Human
aaaaucacaagcuugggucacu

SEQ ID NO: 438529 - RNA, 23 nt, Human
ccaggcaguagcuauugaaguga

SEQ ID NO: 438530 - RNA, 22 nt, Human
cagggcucagggacugcagaaa

SEQ ID NO: 438531 - RNA, 22 nt, Human
ucccuagucgcaucuguggaga

SEQ ID NO: 438532 - RNA, 22 nt, Human
aacugcacuguucuuuucuaca

SEQ ID NO: 438533 - RNA, 22 nt, Human
aagcagggugucuugacccaug

SEQ ID NO: 438534 - RNA, 22 nt, Human
gagcugagaagcagcgcuugau

SEQ ID NO: 438535 - RNA, 22 nt, Human
cagaggccucacuuccagccag

SEQ ID NO: 438536 - RNA, 22 nt, Human
aaggcaugauguaaucaaugau

SEQ ID NO: 438537 - RNA, 23 nt, Human
cagagcuggcucagagcugccug

SEQ ID NO: 438538 - RNA, 22 nt, Human
ggagcugucuguagggcacagg

SEQ ID NO: 438539 - RNA, 22 nt, Human
agacacaguacuugcccucaug

SEQ ID NO: 438540 - RNA, 22 nt, Human
agggccugugaauucucccugc

SEQ ID NO: 438541 - RNA, 22 nt, Human
agucaauaaaagcuuuagauuc

SEQ ID NO: 438542 - RNA, 22 nt, Human
auuacaaucgagagaaacaaau

SEQ ID NO: 438543 - RNA, 22 nt, Human
aagcaaaagguuacacuucugg

SEQ ID NO: 438544 - RNA, 22 nt, Human
auauccaagaaacaauuaauuc

SEQ ID NO: 438545 - RNA, 21 nt, Human
ggcaacagauauuuugcuuag

SEQ ID NO: 438546 - RNA, 22 nt, Human
ugcugccaccccucaccagagc

SEQ ID NO: 438547 - RNA, 22 nt, Human
acaggcagcgucauugcugcuc

SEQ ID NO: 438548 - RNA, 22 nt, Human
augcacagacccaaaggccauc

SEQ ID NO: 438549 - RNA, 22 nt, Human
aagcacauuaaggaacauugaa

SEQ ID NO: 438550 - RNA, 22 nt, Human
aagcccuguaaauugcccuuaa

SEQ ID NO: 438551 - RNA, 22 nt, Human
gcagaggaucaggcucuggaaa

SEQ ID NO: 438552 - RNA, 22 nt, Human
gugcuccucacaguguggcccu

SEQ ID NO: 438553 - RNA, 22 nt, Human
ccagcucugcuugcccagucag

SEQ ID NO: 438554 - RNA, 22 nt, Human
cuuuggcugacagguuucuggu

SEQ ID NO: 438555 - RNA, 20 nt, Human
uaaggcaucaaguuugggua

SEQ ID NO: 438556 - RNA, 22 nt, Human
agggcacaagacucugagcccc

SEQ ID NO: 438557 - RNA, 22 nt, Human
gcagcacugauccuaaacuuag

SEQ ID NO: 438558 - RNA, 22 nt, Human
ucaaacuggggaacuuauuuau

SEQ ID NO: 438559 - RNA, 22 nt, Human
ugaauacuauuucauaaugugg

SEQ ID NO: 438560 - RNA, 22 nt, Human
cagagcaguccuugucaaucag

SEQ ID NO: 438561 - RNA, 22 nt, Human
uuuaacccaaauaaccacagga

SEQ ID NO: 438562 - RNA, 22 nt, Human
uuuauccauucaccaguugaac

SEQ ID NO: 438563 - RNA, 22 nt, Human
caguggcgugaucucugcucac

SEQ ID NO: 438564 - RNA, 22 nt, Human
acaggacaaaaaucuggauggc

SEQ ID NO: 438565 - RNA, 22 nt, Human
agacaaagacagcaucucaggu

SEQ ID NO: 438566 - RNA, 22 nt, Human
gccccagcccuguggaccaugg

SEQ ID NO: 438567 - RNA, 22 nt, Human
ucccuguauaucacaagggcua

SEQ ID NO: 438568 - RNA, 22 nt, Human
auuauaggcuugagccaccgug

SEQ ID NO: 438569 - RNA, 22 nt, Human
ucugggagccugaaagugaaug

SEQ ID NO: 438570 - RNA, 22 nt, Human
ugcccuggagucaguggcuauu

SEQ ID NO: 438571 - RNA, 22 nt, Human
ccuccugguccagcaucucuuu

SEQ ID NO: 438572 - RNA, 22 nt, Human
aggcgcugcgcuggggccagaa

SEQ ID NO: 438573 - RNA, 21 nt, Human
aaggcuggagaugcaggucug

SEQ ID NO: 438574 - RNA, 22 nt, Human
aggggccucgcaggaccgcucc

SEQ ID NO: 438575 - RNA, 22 nt, Human
cuuucucuguguuucacaugcu

SEQ ID NO: 438576 - RNA, 22 nt, Human
cagagcuguccaaacccugaca

SEQ ID NO: 438577 - RNA, 22 nt, Human
uucaaguaaaucacuuuuuguc

SEQ ID NO: 438578 - RNA, 22 nt, Human
uguaugaauauguauuuucaua

SEQ ID NO: 438579 - RNA, 22 nt, Human
uuccugagggccccagaggagg

SEQ ID NO: 438580 - RNA, 22 nt, Human
uggccagcagaguucacucucu

SEQ ID NO: 438581 - RNA, 22 nt, Human
gacacagaugaucaggugugga

SEQ ID NO: 438582 - RNA, 22 nt, Human
uccagccaagggagguuacuag

SEQ ID NO: 438583 - RNA, 22 nt, Human
uuuucuaacaucuaguaauuug

SEQ ID NO: 438584 - RNA, 22 nt, Human
ggaggccaucagggagggcauu

SEQ ID NO: 438585 - RNA, 22 nt, Human
auccccacugcugcugguguag

SEQ ID NO: 438586 - RNA, 22 nt, Human
cagggaagaauaguuagcaaag

SEQ ID NO: 438587 - RNA, 21 nt, Human
agccugggaggcggagguugc

SEQ ID NO: 438588 - RNA, 22 nt, Human
ucacugguuagaagaaguaagc

SEQ ID NO: 438589 - RNA, 22 nt, Human
cccaggagagaggccaguuggc

SEQ ID NO: 438590 - RNA, 22 nt, Human
uuucagagucagcuccucucua

SEQ ID NO: 438591 - RNA, 22 nt, Human
cucacugcaaguuccaccuacc

SEQ ID NO: 438592 - RNA, 22 nt, Human
ucaggcugaaggaggccuaucu

SEQ ID NO: 438593 - RNA, 22 nt, Human
gcucucacuuuagguuggaccg

SEQ ID NO: 438594 - RNA, 22 nt, Human
cacuguggugugagggcugaug

SEQ ID NO: 438595 - RNA, 22 nt, Human
cuccccacacacuaggccugau

SEQ ID NO: 438596 - RNA, 22 nt, Human
auuuagcaagcaggcaaauuca

SEQ ID NO: 438597 - RNA, 20 nt, Human
aggcacaguuccuaguuggg

SEQ ID NO: 438598 - RNA, 22 nt, Human
aauuagaagggaguuauugaua

SEQ ID NO: 438599 - RNA, 20 nt, Human
gcugcuuucaaaugacacgu

SEQ ID NO: 438600 - RNA, 22 nt, Human
cccacaggcaggugcaugggcu

SEQ ID NO: 438601 - RNA, 22 nt, Human
cucagggacggcaucucauuuc

SEQ ID NO: 438602 - RNA, 22 nt, Human
cugccucagcguuguggcccua

SEQ ID NO: 438603 - RNA, 22 nt, Human
uaggcuggggguaggaauugag

SEQ ID NO: 438604 - RNA, 22 nt, Human
guuacaauguccuuacaugaaa

SEQ ID NO: 438605 - RNA, 22 nt, Human
cugggccugggaggccaggucu

SEQ ID NO: 438606 - RNA, 22 nt, Human
ugguacaauggcaucuaucuau

SEQ ID NO: 438607 - RNA, 22 nt, Human
aauugcccauauuugagaauga

SEQ ID NO: 438608 - RNA, 22 nt, Human
uggccuggugcucaggcaguag

SEQ ID NO: 438609 - RNA, 22 nt, Human
uggccagcccucuucccacacu

SEQ ID NO: 438610 - RNA, 22 nt, Human
uacaggaagcacucaagaaaug

SEQ ID NO: 438611 - RNA, 22 nt, Human
guuuguuuguagggaagccgug

SEQ ID NO: 438612 - RNA, 22 nt, Human
uucuuguuccaugaaagacaga

SEQ ID NO: 438613 - RNA, 19 nt, Human
uccugaagauuuccucagc

SEQ ID NO: 438614 - RNA, 16 nt, Human
caccaguccuuccugc

SEQ ID NO: 438615 - RNA, 22 nt, Human
ucaguauuccuggaaauacaag

SEQ ID NO: 438616 - RNA, 22 nt, Human
ucgcucaggcuugaguguagug

SEQ ID NO: 438617 - RNA, 22 nt, Human
cagagcugauuggauccagaga

SEQ ID NO: 438618 - RNA, 22 nt, Human
gagagcuguccggcugagcagc

SEQ ID NO: 438619 - RNA, 22 nt, Human
ggcacagcucaggucccagcuc

SEQ ID NO: 438620 - RNA, 17 nt, Human
gccuuccuuccuccaca

SEQ ID NO: 438621 - RNA, 22 nt, Human
augcauaugcauggacacucag

SEQ ID NO: 438622 - RNA, 22 nt, Human
gaauuucagaucagagaccauu

SEQ ID NO: 438623 - RNA, 22 nt, Human
agcccugcaggaugagggaggu

SEQ ID NO: 438624 - RNA, 22 nt, Human
agggcagagacaugcuuccuga

SEQ ID NO: 438625 - RNA, 22 nt, Human
ucugcccagggacccacaggga

SEQ ID NO: 438626 - RNA, 22 nt, Human
cuuugcaauagaggcacacaug

SEQ ID NO: 438627 - RNA, 22 nt, Human
gagcuaagcuauguuaugcagc

SEQ ID NO: 438628 - RNA, 22 nt, Human
cguguggucccggcaaggcaag

SEQ ID NO: 438629 - RNA, 22 nt, Human
gcaggcugauagaggauuccau

SEQ ID NO: 438630 - RNA, 22 nt, Human
acacugaauauacaaugaauau

SEQ ID NO: 438631 - RNA, 22 nt, Human
aacauaauguggccaaagucac

SEQ ID NO: 438632 - RNA, 21 nt, Human
cuuugcauacagaugccaauu

SEQ ID NO: 438633 - RNA, 22 nt, Human
ucuuggcuccucacagcaucag

SEQ ID NO: 438634 - RNA, 22 nt, Human
aaagguugaauucaggauccac

SEQ ID NO: 438635 - RNA, 22 nt, Human
uuuggcggacugagaacgcggg

SEQ ID NO: 438636 - RNA, 22 nt, Human
agcuccugcacccagccuugag

SEQ ID NO: 438637 - RNA, 22 nt, Human
ugagaaaauuacuauaauuguc

SEQ ID NO: 438638 - RNA, 22 nt, Human
gguacaaaguuagauuuaacuu

SEQ ID NO: 438639 - RNA, 22 nt, Human
cacugguacacugaauggcguu

SEQ ID NO: 438640 - RNA, 22 nt, Human
cugggcugcaggaguggggcaa

SEQ ID NO: 438641 - RNA, 22 nt, Human
uuaauuaauuaguuaagcaugu

SEQ ID NO: 438642 - RNA, 22 nt, Human
agcuguggaagacugucagggu

SEQ ID NO: 438643 - RNA, 22 nt, Human
auuacaauaagguuuauuugua

SEQ ID NO: 438644 - RNA, 22 nt, Human
ugccugucagggggagugggaa

SEQ ID NO: 438645 - RNA, 22 nt, Human
ugggcucuagacuuuagugugg

SEQ ID NO: 438646 - RNA, 22 nt, Human
uggagcuggaauuugagcugga

SEQ ID NO: 438647 - RNA, 22 nt, Human
aggcuccuaucgcuuucagcaa

SEQ ID NO: 438648 - RNA, 22 nt, Human
acaaauucuuucugccuauugg

SEQ ID NO: 438649 - RNA, 22 nt, Human
cuucaaaagccagaagccugcg

SEQ ID NO: 438650 - RNA, 22 nt, Human
ugagccagcaggccuccagugg

SEQ ID NO: 438651 - RNA, 22 nt, Human
gcuuugcagacaaaauuccagc

SEQ ID NO: 438652 - RNA, 22 nt, Human
cauuaaauaucaaccuagacua

SEQ ID NO: 438653 - RNA, 22 nt, Human
ugaggccaggaucccaggcucu

SEQ ID NO: 438654 - RNA, 22 nt, Human
agcucccugagaugccacagca

SEQ ID NO: 438655 - RNA, 22 nt, Human
uacagcagagugggaugcaucu

SEQ ID NO: 438656 - RNA, 22 nt, Human
guccuggguccccgcaggucag

SEQ ID NO: 438657 - RNA, 22 nt, Human
gauauuuucgcagggagaauuc

SEQ ID NO: 438658 - RNA, 22 nt, Human
aaaaugaauaaguuaacccagg

SEQ ID NO: 438659 - RNA, 22 nt, Human
acugcauucuuuaucccacaac

SEQ ID NO: 438660 - RNA, 22 nt, Human
aguuuaacuuuggaaaacuaua

SEQ ID NO: 438661 - RNA, 22 nt, Human
cagacccucgggugaguuggcc

SEQ ID NO: 438662 - RNA, 22 nt, Human
cuucuugauugcuuucaaacca

SEQ ID NO: 438663 - RNA, 22 nt, Human
uauugcagaauucgcuggaaca

SEQ ID NO: 438664 - RNA, 22 nt, Human
uccucagcaggucuguguacca

SEQ ID NO: 438665 - RNA, 22 nt, Human
uucguugcuuuaagccacuacg

SEQ ID NO: 438666 - RNA, 22 nt, Human
gguuccuguguacuguggcuua

SEQ ID NO: 438667 - RNA, 22 nt, Human
aggggauggagcuggaaggcag

SEQ ID NO: 438668 - RNA, 22 nt, Human
caguggcaugguugacugcagu

SEQ ID NO: 438669 - RNA, 22 nt, Human
aggccuuccucggagacaggga

SEQ ID NO: 438670 - RNA, 22 nt, Human
ccuggaaaacaugggaaucaca

SEQ ID NO: 438671 - RNA, 22 nt, Human
uccuccucuaucagacagugcc

SEQ ID NO: 438672 - RNA, 21 nt, Human
aaguaaaucagagaaauaacc

SEQ ID NO: 438673 - RNA, 22 nt, Human
ucagccuggcaggauggccugg

SEQ ID NO: 438674 - RNA, 22 nt, Human
augcuuuauacaaaacacuuaa

SEQ ID NO: 438675 - RNA, 18 nt, Human
agcaguagcgccaggugc

SEQ ID NO: 438676 - RNA, 22 nt, Human
cagaggaggccaccgcauaggc

SEQ ID NO: 438677 - RNA, 22 nt, Human
gcuggccauauauuuugcuguu

SEQ ID NO: 438678 - RNA, 22 nt, Human
ccucuggcaacuucacagccca

SEQ ID NO: 438679 - RNA, 23 nt, Human
ggcuggcccggggcugcuccuga

SEQ ID NO: 438680 - RNA, 22 nt, Human
aaguccuguuccucauacuucc

SEQ ID NO: 438681 - RNA, 19 nt, Human
aaguauucuuuguuagcag

SEQ ID NO: 438682 - RNA, 22 nt, Human
uuacaguagauuuugaaugugg

SEQ ID NO: 438683 - RNA, 21 nt, Human
ugcucacagaugugcucagug

SEQ ID NO: 438684 - RNA, 22 nt, Human
guccacauaggaacccagcuuc

SEQ ID NO: 438685 - RNA, 22 nt, Human
ugaaggcaaaacauguuacacc

SEQ ID NO: 438686 - RNA, 22 nt, Human
acuauuuacucaaaugagguug

SEQ ID NO: 438687 - RNA, 22 nt, Human
uagaucugauacaauucaucug

SEQ ID NO: 438688 - RNA, 18 nt, Human
acuuugcaggcucccauu

SEQ ID NO: 438689 - RNA, 22 nt, Human
auugaguaguaggaaaauaacu

SEQ ID NO: 438690 - RNA, 22 nt, Human
uucaacauuugaaaugaaugaa

SEQ ID NO: 438691 - RNA, 22 nt, Human
guccugguggagucucugggga

SEQ ID NO: 438692 - RNA, 22 nt, Human
ccagccuggggaggcagcuucu

SEQ ID NO: 438693 - RNA, 22 nt, Human
agcaggcuaggaaccucacugc

SEQ ID NO: 438694 - RNA, 22 nt, Human
caguggguggcuaaguggcuga

SEQ ID NO: 438695 - RNA, 22 nt, Human
uacaaaggagaauaggguagca

SEQ ID NO: 438696 - RNA, 23 nt, Human
ugggccuggccucccaguccagc

SEQ ID NO: 438697 - RNA, 22 nt, Human
ucagagacuggucugcagaugc

SEQ ID NO: 438698 - RNA, 22 nt, Human
ucuaaagauuuggauucauuug

SEQ ID NO: 438699 - RNA, 22 nt, Human
uucugaauuucuguguaucuua

SEQ ID NO: 438700 - RNA, 22 nt, Human
ggcaguggguuccccaaggcac

SEQ ID NO: 438701 - RNA, 22 nt, Human
aaguugauugcuucaaauuucu

SEQ ID NO: 438702 - RNA, 22 nt, Human
caggaagagaacauggaggcug

SEQ ID NO: 438703 - RNA, 22 nt, Human
cagacaaagcggaaacuguuua

SEQ ID NO: 438704 - RNA, 22 nt, Human
agggcacaggcuggcaggaucu

SEQ ID NO: 438705 - RNA, 22 nt, Human
uuaauaaacaggugcagcugaa

SEQ ID NO: 438706 - RNA, 22 nt, Human
uugauccaguugaaagugauga

SEQ ID NO: 438707 - RNA, 22 nt, Human
uuuaucaguagcaaaguuuuaa

SEQ ID NO: 438708 - RNA, 23 nt, Human
aggcuccacucccugggaugugg

SEQ ID NO: 438709 - RNA, 22 nt, Human
ggccuccucacccugcucaggc

SEQ ID NO: 438710 - RNA, 22 nt, Human
gggcacagucugcagcccccca

SEQ ID NO: 438711 - RNA, 22 nt, Human
cuuugcaguuagccuaggauug

SEQ ID NO: 438712 - RNA, 22 nt, Human
gcccagagagaugaagugaugg

SEQ ID NO: 438713 - RNA, 22 nt, Human
gagugcagaugccagccccagu

SEQ ID NO: 438714 - RNA, 22 nt, Human
acagggcagaaauguugcaucu

SEQ ID NO: 438715 - RNA, 22 nt, Human
acaugaaacccagccguggucc

SEQ ID NO: 438716 - RNA, 22 nt, Human
aagaaagcauuagacaggcauu

SEQ ID NO: 438717 - RNA, 22 nt, Human
cagaagaauggugucugagcuc

SEQ ID NO: 438718 - RNA, 22 nt, Human
ugaggaaggaauugagguuuua

SEQ ID NO: 438719 - RNA, 22 nt, Human
acccagagcccuuagcacagac

SEQ ID NO: 438720 - RNA, 22 nt, Human
augccuguaaucccagugcuuu

SEQ ID NO: 438721 - RNA, 22 nt, Human
cugcccugugcacaggaaacug

SEQ ID NO: 438722 - RNA, 22 nt, Human
uuuuuauaccaccucucacuua

SEQ ID NO: 438723 - RNA, 18 nt, Human
agcuggugaaauccagua

SEQ ID NO: 438724 - RNA, 23 nt, Human
ggagccuccggugugugagaggc

SEQ ID NO: 438725 - RNA, 22 nt, Human
gacaggaggcagagcucaggug

SEQ ID NO: 438726 - RNA, 22 nt, Human
agguccugucuuaucucuguaa

SEQ ID NO: 438727 - RNA, 21 nt, Human
cuugacauagccugucagcuu

SEQ ID NO: 438728 - RNA, 22 nt, Human
ggcucacgcaauuaucccggcc

SEQ ID NO: 438729 - RNA, 22 nt, Human
cucugagcugaaacaugagcau

SEQ ID NO: 438730 - RNA, 22 nt, Human
gcaggcaguuugcuuuucccuc

SEQ ID NO: 438731 - RNA, 22 nt, Human
aggccagcagacgugggacuga

SEQ ID NO: 438732 - RNA, 22 nt, Human
agcauucuguggucuucuaugg

SEQ ID NO: 438733 - RNA, 22 nt, Human
acugucucucuagcaguucagg

SEQ ID NO: 438734 - RNA, 22 nt, Human
gcaagcaggguuccuuagggca

SEQ ID NO: 438735 - RNA, 22 nt, Human
uguauucucucaauauuucaua

SEQ ID NO: 438736 - RNA, 22 nt, Human
ggccuggccuccagaugugggc

SEQ ID NO: 438737 - RNA, 22 nt, Human
aacagcaagggcggggucaaga

SEQ ID NO: 438738 - RNA, 22 nt, Human
cuguugcagaggggcggagagg

SEQ ID NO: 438739 - RNA, 23 nt, Human
agcagcuggggugcucuuuuguc

SEQ ID NO: 438740 - RNA, 22 nt, Human
acaaguucauggugcuuuccug

SEQ ID NO: 438741 - RNA, 22 nt, Human
caccagcuacagacuacugugu

SEQ ID NO: 438742 - RNA, 22 nt, Human
gcccagagggaagaggugucau

SEQ ID NO: 438743 - RNA, 22 nt, Human
ggaaaagacagaauucuagaau

SEQ ID NO: 438744 - RNA, 22 nt, Human
ucuggccaggauggcaagacca

SEQ ID NO: 438745 - RNA, 22 nt, Human
gccuccaccgaacgcucucuug

SEQ ID NO: 438746 - RNA, 22 nt, Human
cugggagagaagcgaagcuggg

SEQ ID NO: 438747 - RNA, 21 nt, Human
caucacauuacucaaaguccu

SEQ ID NO: 438748 - RNA, 22 nt, Human
ugcccuggcgcugucucuaugg

SEQ ID NO: 438749 - RNA, 23 nt, Human
agggcccaagccuggacagcagg

SEQ ID NO: 438750 - RNA, 22 nt, Human
uacagaaaucacaucgcuuuga

SEQ ID NO: 438751 - RNA, 20 nt, Human
agugucuggugcagggccuc

SEQ ID NO: 438752 - RNA, 18 nt, Human
gcugagguggugucagag

SEQ ID NO: 438753 - RNA, 22 nt, Human
augcauaucuccuaucuccuca

SEQ ID NO: 438754 - RNA, 22 nt, Human
uaagcacuuuauaugcuuuauc

SEQ ID NO: 438755 - RNA, 22 nt, Human
ucagcauuccugaagacaagca

SEQ ID NO: 438756 - RNA, 22 nt, Human
gagcugaggcucaggcuggcgu

SEQ ID NO: 438757 - RNA, 19 nt, Human
acaggcagaauugggugug

SEQ ID NO: 438758 - RNA, 22 nt, Human
agagggcuggacgcagguugga

SEQ ID NO: 438759 - RNA, 22 nt, Human
cuggugugauugagcccaggug

SEQ ID NO: 438760 - RNA, 22 nt, Human
cuuugacuuuguccucaggaaa

SEQ ID NO: 438761 - RNA, 22 nt, Human
caggcacuggggaugcugggau

SEQ ID NO: 438762 - RNA, 18 nt, Human
agaagcagguaaaauucu

SEQ ID NO: 438763 - RNA, 18 nt, Human
cagaugagaugcaaucuc

SEQ ID NO: 438764 - RNA, 22 nt, Human
acuccagggcugaacgaggccc

SEQ ID NO: 438765 - RNA, 22 nt, Human
ggccaaggaugguggcucuggu

SEQ ID NO: 438766 - RNA, 22 nt, Human
aaaaugaagcaaaggcauucag

SEQ ID NO: 438767 - RNA, 22 nt, Human
aaacauucacauuugcuaguaa

SEQ ID NO: 438768 - RNA, 22 nt, Human
augcacaggugcugaugcacgc

SEQ ID NO: 438769 - RNA, 22 nt, Human
gguccuugggucuccuguguuu

SEQ ID NO: 438770 - RNA, 22 nt, Human
acccaggagcaggcugggcagu

SEQ ID NO: 438771 - RNA, 22 nt, Human
uuugcagcuaagcacaguaauu

SEQ ID NO: 438772 - RNA, 22 nt, Human
caggguagacaguaggugucug

SEQ ID NO: 438773 - RNA, 22 nt, Human
ucucccagugucuggcagucag

SEQ ID NO: 438774 - RNA, 22 nt, Human
uaaaggaggaguuaaugagacu

SEQ ID NO: 438775 - RNA, 22 nt, Human
ggcaguuuggcaggauggaggg

SEQ ID NO: 438776 - RNA, 22 nt, Human
gucagcgugcucagccuauuau

SEQ ID NO: 438777 - RNA, 20 nt, Human
uuucaaaggcaccuaugaag

SEQ ID NO: 438778 - RNA, 22 nt, Human
cagcugguuggaagggagcuga

SEQ ID NO: 438779 - RNA, 22 nt, Human
gcucccugccuacacggaccuu

SEQ ID NO: 438780 - RNA, 22 nt, Human
aggagccaaauuacuagcucug

SEQ ID NO: 438781 - RNA, 22 nt, Human
acacagagccagggaauacagu

SEQ ID NO: 438782 - RNA, 22 nt, Human
gcaaauucuuaacuggacugug

SEQ ID NO: 438783 - RNA, 22 nt, Human
uggcucugcaccucaguguacc

SEQ ID NO: 438784 - RNA, 22 nt, Human
uuugguauugcacacugucuuc

SEQ ID NO: 438785 - RNA, 22 nt, Human
agccacagcuccuugguggaga

SEQ ID NO: 438786 - RNA, 18 nt, Human
uccucucuuuccccaggg

SEQ ID NO: 438787 - RNA, 22 nt, Human
gaugaaaaauugcugugucaua

SEQ ID NO: 438788 - RNA, 22 nt, Human
agguucaggcugcacaccugag

SEQ ID NO: 438789 - RNA, 22 nt, Human
acaggcuggugguccuggccau

SEQ ID NO: 438790 - RNA, 22 nt, Human
ugagaacauugggaaagcuaug

SEQ ID NO: 438791 - RNA, 22 nt, Human
gccuccuguuaugccaugugcc

SEQ ID NO: 438792 - RNA, 22 nt, Human
cagcuguucggggcuggcaugu

SEQ ID NO: 438793 - RNA, 22 nt, Human
agaaucucuacucaaguacuug

SEQ ID NO: 438794 - RNA, 22 nt, Human
cacauuuaaaaaauccacgauc

SEQ ID NO: 438795 - RNA, 22 nt, Human
caaacauuuuaaauaagggaua

SEQ ID NO: 438796 - RNA, 22 nt, Human
agugacuucuccuaaugucaua

SEQ ID NO: 438797 - RNA, 21 nt, Human
gccacugcacuccagccuggg

SEQ ID NO: 438798 - RNA, 22 nt, Human
gggcuggcaggaccugggcuga

SEQ ID NO: 438799 - RNA, 22 nt, Human
cgcaacagagcagguuugauga

SEQ ID NO: 438800 - RNA, 22 nt, Human
aaggcaauaguauuaaacugga

SEQ ID NO: 438801 - RNA, 22 nt, Human
uggaugaguucaaugaggcaga

SEQ ID NO: 438802 - RNA, 22 nt, Human
cugguucauauaggcaaguuua

SEQ ID NO: 438803 - RNA, 22 nt, Human
cuggcucccgaagcccucagug

SEQ ID NO: 438804 - RNA, 22 nt, Human
gugggccacaucccagggcucu

SEQ ID NO: 438805 - RNA, 22 nt, Human
gacaggcaugcuuucaggacua

SEQ ID NO: 438806 - RNA, 22 nt, Human
aaguugauagcauguuaagcuc

SEQ ID NO: 438807 - RNA, 22 nt, Human
gcugcaggggggucuggacuug

SEQ ID NO: 438808 - RNA, 22 nt, Human
ugaggcaguugagcuuccugag

SEQ ID NO: 438809 - RNA, 22 nt, Human
ggcagggcaggaaagucaggaa

SEQ ID NO: 438810 - RNA, 22 nt, Human
ggaagagagguucagcccuaag

SEQ ID NO: 438811 - RNA, 22 nt, Human
cagcaggcggcccgcgggcccg

SEQ ID NO: 438812 - RNA, 22 nt, Human
cagcagugaugugugaggguuc

SEQ ID NO: 438813 - RNA, 22 nt, Human
ucuagagacuauaauguguccu

SEQ ID NO: 438814 - RNA, 22 nt, Human
uuugacaaauauuuauuggcac

SEQ ID NO: 438815 - RNA, 22 nt, Human
cucagcaacccacacacggucu

SEQ ID NO: 438816 - RNA, 22 nt, Human
uuugaacaggaguaucuauagu

SEQ ID NO: 438817 - RNA, 22 nt, Human
uuuauuguugggucuuaagcug

SEQ ID NO: 438818 - RNA, 22 nt, Human
gcugucccuuucacaagguuuu

SEQ ID NO: 438819 - RNA, 22 nt, Human
cucagcaacagcgacuuaaggg

SEQ ID NO: 438820 - RNA, 20 nt, Human
ugacaaaugaucugauuuuc

SEQ ID NO: 438821 - RNA, 22 nt, Human
uuggccagaaucuuccuaguga

SEQ ID NO: 438822 - RNA, 22 nt, Human
ccugggcaaaugccagagacaa

SEQ ID NO: 438823 - RNA, 22 nt, Human
ggagcugcauuuagggagccuu

SEQ ID NO: 438824 - RNA, 22 nt, Human
agauuuuaguguagaggacuug

SEQ ID NO: 438825 - RNA, 22 nt, Human
ggauguagugcaaggagugaau

SEQ ID NO: 438826 - RNA, 22 nt, Human
agucaacaccugguucuauuac

SEQ ID NO: 438827 - RNA, 22 nt, Human
ccagagaagguggagcuugugu

SEQ ID NO: 438828 - RNA, 22 nt, Human
aacagucuuccuacggccauua

SEQ ID NO: 438829 - RNA, 22 nt, Human
uguauuuugugaggaucacucu

SEQ ID NO: 438830 - RNA, 22 nt, Human
ucuccggguggcggcgaaggga

SEQ ID NO: 438831 - RNA, 22 nt, Human
aaggcccuaauagagcacauau

SEQ ID NO: 438832 - RNA, 22 nt, Human
cacaggcugcccgcagcuggga

SEQ ID NO: 438833 - RNA, 22 nt, Human
ccuggcaggcuggggacagugc

SEQ ID NO: 438834 - RNA, 22 nt, Human
cauguacaaggaugcucagagu

SEQ ID NO: 438835 - RNA, 22 nt, Human
caggaaugggugacagucagcu

SEQ ID NO: 438836 - RNA, 22 nt, Human
ucaagcuacaaccauauucauu

SEQ ID NO: 438837 - RNA, 22 nt, Human
ggcagcaggcgacuucccuauu

SEQ ID NO: 438838 - RNA, 22 nt, Human
uccuucuuugacaaguggcaga

SEQ ID NO: 438839 - RNA, 22 nt, Human
ucaggaaggcaaauugcaugau

SEQ ID NO: 438840 - RNA, 22 nt, Human
agaagcaggccucacagaucug

SEQ ID NO: 438841 - RNA, 22 nt, Human
uugcaaagugucaugcaaagua

SEQ ID NO: 438842 - RNA, 22 nt, Human
ugggcagaggcucugaagucca

SEQ ID NO: 438843 - RNA, 22 nt, Human
agagcacacugacgucagucug

SEQ ID NO: 438844 - RNA, 22 nt, Human
ccaggccaaauucagucagcag

SEQ ID NO: 438845 - RNA, 22 nt, Human
caauucauguuaaacagaagca

SEQ ID NO: 438846 - RNA, 22 nt, Human
gcaaaaguacagccggauuucu

SEQ ID NO: 438847 - RNA, 22 nt, Human
uuuuaucaaucauuaagacauu

SEQ ID NO: 438848 - RNA, 22 nt, Human
agcagaaccacagcacuguuga

SEQ ID NO: 438849 - RNA, 22 nt, Human
agacauguccacaaagcauuca

SEQ ID NO: 438850 - RNA, 22 nt, Human
uuuacacaaaauguuaguagau

SEQ ID NO: 438851 - RNA, 22 nt, Human
agugacauuugcaccagcugcu

SEQ ID NO: 438852 - RNA, 22 nt, Human
gagcuaagaacugugccaggug

SEQ ID NO: 438853 - RNA, 22 nt, Human
acugcagcaaagcccgugucuu

SEQ ID NO: 438854 - RNA, 23 nt, Human
acagcaagaggaccagaugugag

SEQ ID NO: 438855 - RNA, 22 nt, Human
aauguauaauauuuaaugcuuu

SEQ ID NO: 438856 - RNA, 22 nt, Human
aacaggcaaacugugggauccc

SEQ ID NO: 438857 - RNA, 22 nt, Human
cugcccugugguuguggguucu

SEQ ID NO: 438858 - RNA, 22 nt, Human
uauucagauuacuugugccugc

SEQ ID NO: 438859 - RNA, 22 nt, Human
ucagagaacacagaggugaugu

SEQ ID NO: 438860 - RNA, 22 nt, Human
uugcauauauuucuaaggaggu

SEQ ID NO: 438861 - RNA, 22 nt, Human
augcauauguacccauguucug

SEQ ID NO: 438862 - RNA, 19 nt, Human
ugcaggaggacugagcaga

SEQ ID NO: 438863 - RNA, 22 nt, Human
gacagcaaagcagagccaaggc

SEQ ID NO: 438864 - RNA, 22 nt, Human
cuccaagggcucccagacgucu

SEQ ID NO: 438865 - RNA, 22 nt, Human
gagaggcagaggccugaaaccg

SEQ ID NO: 438866 - RNA, 22 nt, Human
acaggccugggguacaaguucu

SEQ ID NO: 438867 - RNA, 22 nt, Human
gccuggguuccaugaucuccag

SEQ ID NO: 438868 - RNA, 22 nt, Human
cacuggaaccauccacauagug

SEQ ID NO: 438869 - RNA, 18 nt, Human
ggacacagauagguacag

SEQ ID NO: 438870 - RNA, 22 nt, Human
cuggcccagagagcagagcuua

SEQ ID NO: 438871 - RNA, 22 nt, Human
agcucccaauugacuugaacua

SEQ ID NO: 438872 - RNA, 21 nt, Human
ccuggcugcacaguugcuggu

SEQ ID NO: 438873 - RNA, 22 nt, Human
uuuucauuagaaugacugagaa

SEQ ID NO: 438874 - RNA, 22 nt, Human
uacagaaagggaugauugaucu

SEQ ID NO: 438875 - RNA, 22 nt, Human
ugggccuggacaaggccacuag

SEQ ID NO: 438876 - RNA, 22 nt, Human
cagucaaacuuauaggcacauu

SEQ ID NO: 438877 - RNA, 17 nt, Human
cagacagauauccuggg

SEQ ID NO: 438878 - RNA, 22 nt, Human
auaaaggcuggcugcugugagc

SEQ ID NO: 438879 - RNA, 22 nt, Human
uccucacagcugguucauucag

SEQ ID NO: 438880 - RNA, 22 nt, Human
ccuuccuggagcccaugcagau

SEQ ID NO: 438881 - RNA, 22 nt, Human
uguacaaagccagaacucccaa

SEQ ID NO: 438882 - RNA, 22 nt, Human
cugagacacggagaggcugugu

SEQ ID NO: 438883 - RNA, 22 nt, Human
cacagguccuuccugcccuggg

SEQ ID NO: 438884 - RNA, 22 nt, Human
gggccuggggugacguaccccu

SEQ ID NO: 438885 - RNA, 22 nt, Human
cccagcaguuguuggugcacau

SEQ ID NO: 438886 - RNA, 22 nt, Human
gccuggagggauagaaugcaag

SEQ ID NO: 438887 - RNA, 20 nt, Human
accuugggugagugacgguc

SEQ ID NO: 438888 - RNA, 17 nt, Human
agacagaccucugcauc

SEQ ID NO: 438889 - RNA, 22 nt, Human
cagagcagcagagcuuccaugg

SEQ ID NO: 438890 - RNA, 22 nt, Human
ugagcccaggaguaugaggcug

SEQ ID NO: 438891 - RNA, 22 nt, Human
aaggccaggccuagcacggagg

SEQ ID NO: 438892 - RNA, 22 nt, Human
cugcccagaaucacucacucga

SEQ ID NO: 438893 - RNA, 22 nt, Human
aggccagggcacugcucuuuag

SEQ ID NO: 438894 - RNA, 19 nt, Human
uuuauuugagacaugccuu

SEQ ID NO: 438895 - RNA, 22 nt, Human
ccagcccugccucucagggccc

SEQ ID NO: 438896 - RNA, 22 nt, Human
ugaugagggcaguucuuguugc

SEQ ID NO: 438897 - RNA, 22 nt, Human
uuugcuuaacugguagaaugcg

SEQ ID NO: 438898 - RNA, 22 nt, Human
ccaggcagagggauccccaucc

SEQ ID NO: 438899 - RNA, 22 nt, Human
aacagagaggccaccucagcag

SEQ ID NO: 438900 - RNA, 22 nt, Human
agugcuggauuacaggcgugag

SEQ ID NO: 438901 - RNA, 22 nt, Human
gacaggcaguuuuccagaucag

SEQ ID NO: 438902 - RNA, 22 nt, Human
agaauuuccuaugagagauucc

SEQ ID NO: 438903 - RNA, 22 nt, Human
uaggcugggcauucuggccagg

SEQ ID NO: 438904 - RNA, 22 nt, Human
acugcacugauuuaucauccca

SEQ ID NO: 438905 - RNA, 23 nt, Human
ucaguacucugcuggguauagag

SEQ ID NO: 438906 - RNA, 22 nt, Human
auuauuguuuuaauaguagaga

SEQ ID NO: 438907 - RNA, 22 nt, Human
cugaggcaugaaugugggcuuu

SEQ ID NO: 438908 - RNA, 22 nt, Human
ggucccugcccaccugggagcu

SEQ ID NO: 438909 - RNA, 22 nt, Human
cugcugcaacucuuuagagggu

SEQ ID NO: 438910 - RNA, 22 nt, Human
aggcacguggcgccaggaguga

SEQ ID NO: 438911 - RNA, 22 nt, Human
caggaauguuugugcuccuuua

SEQ ID NO: 438912 - RNA, 22 nt, Human
acacaggagauauguaauggcu

SEQ ID NO: 438913 - RNA, 22 nt, Human
uagcacaagcaacuacugaagu

SEQ ID NO: 438914 - RNA, 22 nt, Human
gagagcugggggacuguggaug

SEQ ID NO: 438915 - RNA, 22 nt, Human
acacauaagccuaaucaucucc

SEQ ID NO: 438916 - RNA, 22 nt, Human
agagccuguaacaucuuucuua

SEQ ID NO: 438917 - RNA, 22 nt, Human
agcagagucugugugcacuuua

SEQ ID NO: 438918 - RNA, 22 nt, Human
cagcaaaguaagcugacaugua

SEQ ID NO: 438919 - RNA, 18 nt, Human
gugagcagagagcaucac

SEQ ID NO: 438920 - RNA, 22 nt, Human
acuuugcaaaauaaugcugauu

SEQ ID NO: 438921 - RNA, 22 nt, Human
aaugagcuagaccugcuuccuc

SEQ ID NO: 438922 - RNA, 19 nt, Human
aagaagcaauaagcuguga

SEQ ID NO: 438923 - RNA, 22 nt, Human
agaaauguauagugaauuuuuc

SEQ ID NO: 438924 - RNA, 22 nt, Human
cccagagacuuuguccgacgac

SEQ ID NO: 438925 - RNA, 20 nt, Human
ucugggcuucccccagcucc

SEQ ID NO: 438926 - RNA, 21 nt, Human
uuugaauagaaauagugcuua

SEQ ID NO: 438927 - RNA, 22 nt, Human
cacaggaaucugcauuuugacc

SEQ ID NO: 438928 - RNA, 22 nt, Human
aauagcaaaugcucauuugaaa

SEQ ID NO: 438929 - RNA, 22 nt, Human
uagagcuggaauuugcagcaag

SEQ ID NO: 438930 - RNA, 23 nt, Human
gaacauucauugguugcuuuaga

SEQ ID NO: 438931 - RNA, 22 nt, Human
gcugcugcaagagccagcucuu

SEQ ID NO: 438932 - RNA, 22 nt, Human
uacugcauuaaauuuagguuau

SEQ ID NO: 438933 - RNA, 22 nt, Human
caucugaagugaauugcuuuuu

SEQ ID NO: 438934 - RNA, 22 nt, Human
uuucacauaugguuguugauug

SEQ ID NO: 438935 - RNA, 22 nt, Human
ucauuuugggguuugucaucuu

SEQ ID NO: 438936 - RNA, 22 nt, Human
ugaugacagcaaaaaaugcuag

SEQ ID NO: 438937 - RNA, 22 nt, Human
ccagcucugcagggccuggggu

SEQ ID NO: 438938 - RNA, 22 nt, Human
cugaagcuuuacuucaaauaca

SEQ ID NO: 438939 - RNA, 22 nt, Human
gccaggcugacucccccggccu

SEQ ID NO: 438940 - RNA, 22 nt, Human
caggcagagacccucuccuaaa

SEQ ID NO: 438941 - RNA, 22 nt, Human
aaaguguugauaugugacaucc

SEQ ID NO: 438942 - RNA, 22 nt, Human
ugcucccaggcauucucuguug

SEQ ID NO: 438943 - RNA, 22 nt, Human
uggcagauuuugaagacagaga

SEQ ID NO: 438944 - RNA, 22 nt, Human
gacacaguagccagugcaguga

SEQ ID NO: 438945 - RNA, 20 nt, Human
uggaauggguccuugaaaaa

SEQ ID NO: 438946 - RNA, 22 nt, Human
aggccuggcuuugguuugcuga

SEQ ID NO: 438947 - RNA, 22 nt, Human
gugcccugacacaccuggugug

SEQ ID NO: 438948 - RNA, 22 nt, Human
uuucaaacugcccagcacaccu

SEQ ID NO: 438949 - RNA, 22 nt, Human
ugggcagagucguggggaauag

SEQ ID NO: 438950 - RNA, 22 nt, Human
aauaugcauguauacaugugua

SEQ ID NO: 438951 - RNA, 22 nt, Human
uaaggcaugaguuuauuucaua

SEQ ID NO: 438952 - RNA, 22 nt, Human
gucuuguuugggauguggaugg

SEQ ID NO: 438953 - RNA, 22 nt, Human
gcuuggcugccuuuggauguug

SEQ ID NO: 438954 - RNA, 21 nt, Human
ugcacagccauacccuccuug

SEQ ID NO: 438955 - RNA, 22 nt, Human
aggccugggcaagaaggggcgu

SEQ ID NO: 438956 - RNA, 22 nt, Human
cuguuucaugucuuccgcagcu

SEQ ID NO: 438957 - RNA, 22 nt, Human
agugucacagacccaaucagga

SEQ ID NO: 438958 - RNA, 22 nt, Human
augcaacaaauugugugcaaua

SEQ ID NO: 438959 - RNA, 22 nt, Human
uguuaaaaaugcagauuccuau

SEQ ID NO: 438960 - RNA, 22 nt, Human
agggcucugugacuaucacugc

SEQ ID NO: 438961 - RNA, 22 nt, Human
caguccuguuccuggaguaguu

SEQ ID NO: 438962 - RNA, 22 nt, Human
ucaacagacauuuuuaagcacu

SEQ ID NO: 438963 - RNA, 22 nt, Human
agccaggccagacucacacccu

SEQ ID NO: 438964 - RNA, 22 nt, Human
cccagcaguacccaagcccuug

SEQ ID NO: 438965 - RNA, 22 nt, Human
agcugccaaguuucucaguuua

SEQ ID NO: 438966 - RNA, 22 nt, Human
aggcaggcugcuauggaguaga

SEQ ID NO: 438967 - RNA, 22 nt, Human
agaaguggucugucuuccagau

SEQ ID NO: 438968 - RNA, 19 nt, Human
accaggcuuauggucagug

SEQ ID NO: 438969 - RNA, 22 nt, Human
gcagggcucauucuaguacaau

SEQ ID NO: 438970 - RNA, 22 nt, Human
gcugucacaaauauuucucagc

SEQ ID NO: 438971 - RNA, 22 nt, Human
cagcagugugcaggugugcugg

SEQ ID NO: 438972 - RNA, 22 nt, Human
uuuauccaaggguuuuaacugu

SEQ ID NO: 438973 - RNA, 22 nt, Human
ugauucagaccugucagacuuc

SEQ ID NO: 438974 - RNA, 22 nt, Human
ccugggcauucuuugaguucuc

SEQ ID NO: 438975 - RNA, 22 nt, Human
aaccaugcuagcaucaaaaugu

SEQ ID NO: 438976 - RNA, 22 nt, Human
agagcagcacguuguccccaca

SEQ ID NO: 438977 - RNA, 22 nt, Human
ugaggauggggagauggugucu

SEQ ID NO: 438978 - RNA, 22 nt, Human
cccuggagcaucucugcugucu

SEQ ID NO: 438979 - RNA, 22 nt, Human
uggcuccugcagaccaucugga

SEQ ID NO: 438980 - RNA, 22 nt, Human
uugcaaauguuucauaacagua

SEQ ID NO: 438981 - RNA, 22 nt, Human
accugagccuagggagguugag

SEQ ID NO: 438982 - RNA, 22 nt, Human
ggccccaggaccuccacggucc

SEQ ID NO: 438983 - RNA, 22 nt, Human
cuguggcucucagaggcugcug

SEQ ID NO: 438984 - RNA, 22 nt, Human
gagcugaggauacaucagugaa

SEQ ID NO: 438985 - RNA, 22 nt, Human
cauuuguacagaacagcuuuau

SEQ ID NO: 438986 - RNA, 22 nt, Human
aaucuuuugauucuagggcugu

SEQ ID NO: 438987 - RNA, 22 nt, Human
auuugcuggugaauguauagcu

SEQ ID NO: 438988 - RNA, 22 nt, Human
uuucuacaguacugauuucaua

SEQ ID NO: 438989 - RNA, 22 nt, Human
augagguuuuacugccauuuuc

SEQ ID NO: 438990 - RNA, 22 nt, Human
aaagcagaacugagagagcugg

SEQ ID NO: 438991 - RNA, 22 nt, Human
aaaugacacuaggcuuuuugca

SEQ ID NO: 438992 - RNA, 18 nt, Human
aggcuucccaggcaggcc

SEQ ID NO: 438993 - RNA, 22 nt, Human
cugcaaauaggggugugaauaa

SEQ ID NO: 438994 - RNA, 22 nt, Human
uacagaguauuuuuaauauggu

SEQ ID NO: 438995 - RNA, 22 nt, Human
uaaugacauuguauccacagag

SEQ ID NO: 438996 - RNA, 22 nt, Human
augcauugcugcuuucaaaaca

SEQ ID NO: 438997 - RNA, 20 nt, Human
ugugagcagaugcugaguga

SEQ ID NO: 438998 - RNA, 22 nt, Human
uaauacaauggaguugggcccc

SEQ ID NO: 438999 - RNA, 22 nt, Human
aggagacagccaggggccugag

SEQ ID NO: 439000 - RNA, 22 nt, Human
ggcacagcgacuaccaucgaaa

SEQ ID NO: 439001 - RNA, 22 nt, Human
augcccuguggcaguacauauu

SEQ ID NO: 439002 - RNA, 22 nt, Human
gccuucagcggccgcucgcugc

SEQ ID NO: 439003 - RNA, 22 nt, Human
gccugagcuacuagggagucug

SEQ ID NO: 439004 - RNA, 22 nt, Human
ugucccaggcugaaguacagug

SEQ ID NO: 439005 - RNA, 18 nt, Human
cuggagucacagugggga

SEQ ID NO: 439006 - RNA, 21 nt, Human
auacauucuauuaagcauuua

SEQ ID NO: 439007 - RNA, 22 nt, Human
agcagccaggaaucugcagagc

SEQ ID NO: 439008 - RNA, 22 nt, Human
guuuugaauacuacuagaacuu

SEQ ID NO: 439009 - RNA, 22 nt, Human
auuuugacagaagaggcccuaa

SEQ ID NO: 439010 - RNA, 22 nt, Human
cugcauuacagccuccuuagga

SEQ ID NO: 439011 - RNA, 22 nt, Human
cagagcugcacauucuaugaug

SEQ ID NO: 439012 - RNA, 22 nt, Human
acaaaugcaaguuuuaugucaa

SEQ ID NO: 439013 - RNA, 22 nt, Human
gcauuucauguagauugagaac

SEQ ID NO: 439014 - RNA, 22 nt, Human
aagaacauuuaugauggcauuu

SEQ ID NO: 439015 - RNA, 22 nt, Human
cagccugacaccagcuuugggc

SEQ ID NO: 439016 - RNA, 22 nt, Human
gaggcugggggcugccuuccuc

SEQ ID NO: 439017 - RNA, 22 nt, Human
gagaaagcuucuuucccacagg

SEQ ID NO: 439018 - RNA, 21 nt, Human
ugcaggcugugcgcuccugcc

SEQ ID NO: 439019 - RNA, 22 nt, Human
ugaauauguauuucuuauuuac

SEQ ID NO: 439020 - RNA, 22 nt, Human
gcugcucugugacagccuccgg

SEQ ID NO: 439021 - RNA, 22 nt, Human
gcucuggccagacccucagugg

SEQ ID NO: 439022 - RNA, 22 nt, Human
ucccagagacaucauuucuccg

SEQ ID NO: 439023 - RNA, 22 nt, Human
gcugauccuuuuaugucuagcu

SEQ ID NO: 439024 - RNA, 22 nt, Human
gcuguuucuaccagaagaauca

SEQ ID NO: 439025 - RNA, 22 nt, Human
gccaggcuggccagcaccuucu

SEQ ID NO: 439026 - RNA, 22 nt, Human
agcucagggcaaagacucaaau

SEQ ID NO: 439027 - RNA, 22 nt, Human
gaucggguggguucugccauca

SEQ ID NO: 439028 - RNA, 22 nt, Human
uuguuaaaauauuggagaaagg

SEQ ID NO: 439029 - RNA, 22 nt, Human
caaggaaacaugaaaugcauug

SEQ ID NO: 439030 - RNA, 22 nt, Human
cagguggggcagcugugggagc

SEQ ID NO: 439031 - RNA, 22 nt, Human
ugcaauaaguauugcuuacaug

SEQ ID NO: 439032 - RNA, 22 nt, Human
gagagcuggauucuggauaggu

SEQ ID NO: 439033 - RNA, 22 nt, Human
accuggagucauuugaggagua

SEQ ID NO: 439034 - RNA, 20 nt, Human
uauuuguauuugggaaaguu

SEQ ID NO: 439035 - RNA, 22 nt, Human
auguguccacaggugugagaga

SEQ ID NO: 439036 - RNA, 22 nt, Human
ggggcagagagaaggaagcuug

SEQ ID NO: 439037 - RNA, 22 nt, Human
agcagaacugaugagacuugag

SEQ ID NO: 439038 - RNA, 22 nt, Human
ccuggagaggcgcugcagagga

SEQ ID NO: 439039 - RNA, 22 nt, Human
agcagccauagauagcaugcaa

SEQ ID NO: 439040 - RNA, 22 nt, Human
gccugggagggcagcagugugg

SEQ ID NO: 439041 - RNA, 22 nt, Human
gaaguucaaugucagcaucuau

SEQ ID NO: 439042 - RNA, 22 nt, Human
cccagcaggugccaucacucug

SEQ ID NO: 439043 - RNA, 22 nt, Human
gcagagguggcaucugggcucu

SEQ ID NO: 439044 - RNA, 22 nt, Human
uuuacugaccuccaaucccacu

SEQ ID NO: 439045 - RNA, 22 nt, Human
aggacaaaggaccagaucugga

SEQ ID NO: 439046 - RNA, 22 nt, Human
cuggcuccagugacaagucgau

SEQ ID NO: 439047 - RNA, 22 nt, Human
ggcuuugcuucuccagaugcuu

SEQ ID NO: 439048 - RNA, 22 nt, Human
aaguuccucaaauaaaacauga

SEQ ID NO: 439049 - RNA, 22 nt, Human
aucaggugaagucacugagugg

SEQ ID NO: 439050 - RNA, 22 nt, Human
gaagaagcauucugcuguuuug

SEQ ID NO: 439051 - RNA, 22 nt, Human
ucagcuccucaugcaggggaua

SEQ ID NO: 439052 - RNA, 22 nt, Human
gggcagagaaauggacaguugg

SEQ ID NO: 439053 - RNA, 22 nt, Human
cagggcucccugcagccucugu

SEQ ID NO: 439054 - RNA, 22 nt, Human
ucugggcuugccugguugugca

SEQ ID NO: 439055 - RNA, 22 nt, Human
gagcugaggugauguggucguu

SEQ ID NO: 439056 - RNA, 22 nt, Human
ugagccugcugucgcuggaccc

SEQ ID NO: 439057 - RNA, 22 nt, Human
ucagcuggagaugagaaccgaa

SEQ ID NO: 439058 - RNA, 19 nt, Human
ggcagacacaguugacaug

SEQ ID NO: 439059 - RNA, 22 nt, Human
gaggcagcaggcugaggaggau

SEQ ID NO: 439060 - RNA, 22 nt, Human
gucucacacagaguagauuuug

SEQ ID NO: 439061 - RNA, 22 nt, Human
cugggcaggagggcucuaugga

SEQ ID NO: 439062 - RNA, 17 nt, Human
gggacucaagauggggu

SEQ ID NO: 439063 - RNA, 22 nt, Human
ugcagugggccggaggccaggg

SEQ ID NO: 439064 - RNA, 22 nt, Human
uggagcugacucacaccagcua

SEQ ID NO: 439065 - RNA, 22 nt, Human
caggcugccaaggcuggggagg

SEQ ID NO: 439066 - RNA, 22 nt, Human
ugcauuauaacugaauguuguu

SEQ ID NO: 439067 - RNA, 21 nt, Human
cagugcucaaucugacagugg

SEQ ID NO: 439068 - RNA, 22 nt, Human
guuauugacauguauuaagcac

SEQ ID NO: 439069 - RNA, 22 nt, Human
ucuccaggcuuuuugugaauug

SEQ ID NO: 439070 - RNA, 22 nt, Human
uauaggaaguguagugcuugga

SEQ ID NO: 439071 - RNA, 18 nt, Human
cuuugcaguuacagggca

SEQ ID NO: 439072 - RNA, 22 nt, Human
aagagacuguaaaggcgugagu

SEQ ID NO: 439073 - RNA, 22 nt, Human
ucagagacuguaggagcagccu

SEQ ID NO: 439074 - RNA, 22 nt, Human
aucugaauaaauuucuuuuagu

SEQ ID NO: 439075 - RNA, 22 nt, Human
gccucagcuguugcaggggccc

SEQ ID NO: 439076 - RNA, 18 nt, Human
ggaagaaaaggaacucag

SEQ ID NO: 439077 - RNA, 22 nt, Human
cuccauggaaccggggcugcuu

SEQ ID NO: 439078 - RNA, 19 nt, Human
uggcuaauuuuauagaggc

SEQ ID NO: 439079 - RNA, 22 nt, Human
uuugaagauaaauauggagaaa

SEQ ID NO: 439080 - RNA, 18 nt, Human
aggaaagaaaggcaggug

SEQ ID NO: 439081 - RNA, 22 nt, Human
ccaggcugaauauguuccaggg

SEQ ID NO: 439082 - RNA, 22 nt, Human
uuuuaguaccaaccagaagaug

SEQ ID NO: 439083 - RNA, 22 nt, Human
cgcaacagcguggcgcccagcu

SEQ ID NO: 439084 - RNA, 22 nt, Human
auuaacaugcagccagacacac

SEQ ID NO: 439085 - RNA, 22 nt, Human
agcagagccaggucucucugua

SEQ ID NO: 439086 - RNA, 22 nt, Human
gacagaaggcaucuagggcacg

SEQ ID NO: 439087 - RNA, 22 nt, Human
ucaggcuguuccuguccaaaau

SEQ ID NO: 439088 - RNA, 23 nt, Human
ucauaaauauuagcacaguagga

SEQ ID NO: 439089 - RNA, 18 nt, Human
auugcuuuuguaccaacc

SEQ ID NO: 439090 - RNA, 22 nt, Human
ucaaaauuaaaccaacguccag

SEQ ID NO: 439091 - RNA, 22 nt, Human
ggugcccuguaaaagccaugca

SEQ ID NO: 439092 - RNA, 22 nt, Human
aaaugugcuucuuacucucaau

SEQ ID NO: 439093 - RNA, 22 nt, Human
gcaugggcaagaggacuggggg

SEQ ID NO: 439094 - RNA, 22 nt, Human
cagcccuuguuugggaaggaug

SEQ ID NO: 439095 - RNA, 22 nt, Human
cagacagaccugcaagggcaca

SEQ ID NO: 439096 - RNA, 19 nt, Human
aggguacacgagagaagag

SEQ ID NO: 439097 - RNA, 20 nt, Human
uccugcaaaaggacaaguuu

SEQ ID NO: 439098 - RNA, 18 nt, Human
cagaagcaggcagugcag

SEQ ID NO: 439099 - RNA, 22 nt, Human
gcucuugaaauaauggcuaaug

SEQ ID NO: 439100 - RNA, 22 nt, Human
gcagcuggagaaauaccacccu

SEQ ID NO: 439101 - RNA, 22 nt, Human
acagaggaaggcugagcugccc

SEQ ID NO: 439102 - RNA, 22 nt, Human
augccaaauucuacuuucagca

SEQ ID NO: 439103 - RNA, 22 nt, Human
auuugucaauaagaugaacaua

SEQ ID NO: 439104 - RNA, 22 nt, Human
uuuuuuguagcaagcgcagaua

SEQ ID NO: 439105 - RNA, 22 nt, Human
uagcccuguccuuggccugugc

SEQ ID NO: 439106 - RNA, 22 nt, Human
acaugcaacuaaagggugccac

SEQ ID NO: 439107 - RNA, 22 nt, Human
cccaggcuggauuucgguggca

SEQ ID NO: 439108 - RNA, 22 nt, Human
cuucugaggcagcuauucaguu

SEQ ID NO: 439109 - RNA, 22 nt, Human
auaaggcagaaaugauucuagu

SEQ ID NO: 439110 - RNA, 22 nt, Human
cagaaauggagcccaggaaucu

SEQ ID NO: 439111 - RNA, 22 nt, Human
cacaacuuuaggaaccacauuc

SEQ ID NO: 439112 - RNA, 22 nt, Human
ucuuagcagugcugagaagaau

SEQ ID NO: 439113 - RNA, 21 nt, Human
cugcagcaaaacuuugcuccu

SEQ ID NO: 439114 - RNA, 22 nt, Human
agaccacuaaaacuuucucuau

SEQ ID NO: 439115 - RNA, 22 nt, Human
cagcccuuggcccagggcacag

SEQ ID NO: 439116 - RNA, 22 nt, Human
ggcaggcugcuugggucauguc

SEQ ID NO: 439117 - RNA, 22 nt, Human
ggccagaggccacagcuguguc

SEQ ID NO: 439118 - RNA, 22 nt, Human
caaggaaaagaaguauuucaga

SEQ ID NO: 439119 - RNA, 22 nt, Human
aggcugagggcuccugagggca

SEQ ID NO: 439120 - RNA, 22 nt, Human
uaaguagaugcaaaauggaguu

SEQ ID NO: 439121 - RNA, 22 nt, Human
aguccguggccagacucaagag

SEQ ID NO: 439122 - RNA, 22 nt, Human
gcaauaaaauguaaugauuggg

SEQ ID NO: 439123 - RNA, 22 nt, Human
uccaggcccagacggggugagg

SEQ ID NO: 439124 - RNA, 23 nt, Human
aagcccugaagguuucaggcccu

SEQ ID NO: 439125 - RNA, 22 nt, Human
aaauaaaggaacuguuuuccca

SEQ ID NO: 439126 - RNA, 22 nt, Human
gcucagggcuaaggcugagggg

SEQ ID NO: 439127 - RNA, 21 nt, Human
ugaggcuguuguaccagggag

SEQ ID NO: 439128 - RNA, 22 nt, Human
ggcaccuggagguuuacuggau

SEQ ID NO: 439129 - RNA, 22 nt, Human
caauugcaauagagaaaagagu

SEQ ID NO: 439130 - RNA, 22 nt, Human
cccuggguucuggcugggcugc

SEQ ID NO: 439131 - RNA, 22 nt, Human
ggcucugaggcagaucgauggg

SEQ ID NO: 439132 - RNA, 22 nt, Human
gcuguuucucucccaccccuuc

SEQ ID NO: 439133 - RNA, 22 nt, Human
ggagccccaauugagcaguacg

SEQ ID NO: 439134 - RNA, 22 nt, Human
gccuccugagaagccacaggcu

SEQ ID NO: 439135 - RNA, 22 nt, Human
uggcagugccccuugaccagug

SEQ ID NO: 439136 - RNA, 22 nt, Human
uuugcucugcuguugccaggug

SEQ ID NO: 439137 - RNA, 22 nt, Human
uuauuguuuaaagccauguaaa

SEQ ID NO: 439138 - RNA, 22 nt, Human
gaggaggcuaagugggcucugg

SEQ ID NO: 439139 - RNA, 22 nt, Human
gauggacaccuccugagguucu

SEQ ID NO: 439140 - RNA, 22 nt, Human
cugagccaaaaagcagagcuug

SEQ ID NO: 439141 - RNA, 22 nt, Human
ggagccuguuaguugagugcuc

SEQ ID NO: 439142 - RNA, 22 nt, Human
gcagcaggaauaggauaagcaa

SEQ ID NO: 439143 - RNA, 22 nt, Human
ucagaauuuuaaaccaaggaaa

SEQ ID NO: 439144 - RNA, 22 nt, Human
cacaauuuccaagucauguuau

SEQ ID NO: 439145 - RNA, 22 nt, Human
ucuaagaauacucauaucuucu

SEQ ID NO: 439146 - RNA, 19 nt, Human
ccuggguccacucagacua

SEQ ID NO: 439147 - RNA, 22 nt, Human
gcugagagugggugcagugcuu

SEQ ID NO: 439148 - RNA, 22 nt, Human
agagguucaaacuucauaauuu

SEQ ID NO: 439149 - RNA, 20 nt, Human
aguuuucagcagaacaccca

SEQ ID NO: 439150 - RNA, 22 nt, Human
accuucugaccaguuaucuuga

SEQ ID NO: 439151 - RNA, 22 nt, Human
uugcccugcggguccugcgcaa

SEQ ID NO: 439152 - RNA, 22 nt, Human
caggagcccagaguccucagcu

SEQ ID NO: 439153 - RNA, 22 nt, Human
ggauuuuagaguaccuaagugu

SEQ ID NO: 439154 - RNA, 22 nt, Human
gcagcuggggaggucgugggga

SEQ ID NO: 439155 - RNA, 22 nt, Human
acccagagcacagaugcaacgu

SEQ ID NO: 439156 - RNA, 22 nt, Human
agggugaaucucacaacucuua

SEQ ID NO: 439157 - RNA, 22 nt, Human
ggcacagaguuggcagagcugc

SEQ ID NO: 439158 - RNA, 22 nt, Human
aaauucaguuucuguccuggga

SEQ ID NO: 439159 - RNA, 22 nt, Human
gcuuugcugaggucugaggauu

SEQ ID NO: 439160 - RNA, 22 nt, Human
aaaaagggauuugugauccagg

SEQ ID NO: 439161 - RNA, 22 nt, Human
uuuagacaagauccuucugaau

SEQ ID NO: 439162 - RNA, 22 nt, Human
caagagcauuuaguuagcuggu

SEQ ID NO: 439163 - RNA, 22 nt, Human
uaggcaggugugcacugcccac

SEQ ID NO: 439164 - RNA, 22 nt, Human
gcccagcuggcuuccagcacau

SEQ ID NO: 439165 - RNA, 22 nt, Human
uuuauaguuauauacagauguu

SEQ ID NO: 439166 - RNA, 22 nt, Human
uuucacauuuaggcgugaauug

SEQ ID NO: 439167 - RNA, 20 nt, Human
gccugccucagcuagcugag

SEQ ID NO: 439168 - RNA, 22 nt, Human
augcccugcucucgggaaggga

SEQ ID NO: 439169 - RNA, 22 nt, Human
agcugguguggauuuuugaaug

SEQ ID NO: 439170 - RNA, 22 nt, Human
aguccuggguccagcagguccu

SEQ ID NO: 439171 - RNA, 22 nt, Human
caugggcccgugagaggcaggg

SEQ ID NO: 439172 - RNA, 22 nt, Human
aaaacauuuuacugccaucuca

SEQ ID NO: 439173 - RNA, 22 nt, Human
agucacauggacucaggaugac

SEQ ID NO: 439174 - RNA, 22 nt, Human
cuuucucuucacugucaugauc

SEQ ID NO: 439175 - RNA, 22 nt, Human
ugggcuacucugggagccuaac

SEQ ID NO: 439176 - RNA, 22 nt, Human
aggccuggugaaugaaguaucu

SEQ ID NO: 439177 - RNA, 19 nt, Human
gaauuuuaggacuucagca

SEQ ID NO: 439178 - RNA, 20 nt, Human
cugcugugugugccucagcc

SEQ ID NO: 439179 - RNA, 22 nt, Human
uagguuuaggagugaaggugaa

SEQ ID NO: 439180 - RNA, 22 nt, Human
gcagggcucaacaggacacccc

SEQ ID NO: 439181 - RNA, 22 nt, Human
uuuagggugauguaugugcagc

SEQ ID NO: 439182 - RNA, 21 nt, Human
uuaagacacacagauuaagga

SEQ ID NO: 439183 - RNA, 22 nt, Human
aagggcccauucucucagaaaa

SEQ ID NO: 439184 - RNA, 22 nt, Human
cagcagcauugcucuggauucc

SEQ ID NO: 439185 - RNA, 18 nt, Human
aguuucagggcaggaaac

SEQ ID NO: 439186 - RNA, 22 nt, Human
cccagccugaucucggccagcu

SEQ ID NO: 439187 - RNA, 22 nt, Human
gugcauauaugugcagcaucaa

SEQ ID NO: 439188 - RNA, 22 nt, Human
uggagcaggcaucuuucucucu

SEQ ID NO: 439189 - RNA, 22 nt, Human
gacuccagguguccaggccucc

SEQ ID NO: 439190 - RNA, 22 nt, Human
aucacauggaaugauuuuagac

SEQ ID NO: 439191 - RNA, 22 nt, Human
ugaagcaguuacuggguguuaa

SEQ ID NO: 439192 - RNA, 22 nt, Human
gaggcccugguaggucagagug

SEQ ID NO: 439193 - RNA, 22 nt, Human
ugggccugugaugcugggcuau

SEQ ID NO: 439194 - RNA, 22 nt, Human
aggcuggcggugacugcucuga

SEQ ID NO: 439195 - RNA, 22 nt, Human
aacauuucugagaauaucaguu

SEQ ID NO: 439196 - RNA, 22 nt, Human
caguccugggagacuuacccag

SEQ ID NO: 439197 - RNA, 22 nt, Human
aguccuguaucugagcugaguc

SEQ ID NO: 439198 - RNA, 22 nt, Human
auuccucaaagguagcccauua

SEQ ID NO: 439199 - RNA, 22 nt, Human
uugcaaaugugaauaauuacac

SEQ ID NO: 439200 - RNA, 22 nt, Human
ugggccugacucaccugccucc

SEQ ID NO: 439201 - RNA, 22 nt, Human
aaccaggagauuaaagaaaggu

SEQ ID NO: 439202 - RNA, 22 nt, Human
auuauugcugacaugguguuga

SEQ ID NO: 439203 - RNA, 22 nt, Human
cuggugagacucagggaugcuu

SEQ ID NO: 439204 - RNA, 19 nt, Human
augagcaauaguuuuaauc

SEQ ID NO: 439205 - RNA, 22 nt, Human
augcagcugacauuuucauguu

SEQ ID NO: 439206 - RNA, 22 nt, Human
ccagccaggcuggcuguggagg

SEQ ID NO: 439207 - RNA, 22 nt, Human
uauaggaaauuuaucuccuggg

SEQ ID NO: 439208 - RNA, 22 nt, Human
augcccugagcaggccuucaag

SEQ ID NO: 439209 - RNA, 22 nt, Human
ugcauuaucuuuaauguucuca

SEQ ID NO: 439210 - RNA, 22 nt, Human
uugaugaucuuacggcagagga

SEQ ID NO: 439211 - RNA, 22 nt, Human
ggagccuggcccggcccuuggc

SEQ ID NO: 439212 - RNA, 22 nt, Human
cggagcugcgccgggacacggg

SEQ ID NO: 439213 - RNA, 22 nt, Human
ggccaggagcaagccaggcucu

SEQ ID NO: 439214 - RNA, 22 nt, Human
caagucugucugcuccugugug

SEQ ID NO: 439215 - RNA, 22 nt, Human
aaggcaaugagggagauagagu

SEQ ID NO: 439216 - RNA, 22 nt, Human
acagagcauauaaagugcuuug

SEQ ID NO: 439217 - RNA, 22 nt, Human
ucaggagcuauggacugucaaa

SEQ ID NO: 439218 - RNA, 22 nt, Human
cugcagcuuauuugcuguguga

SEQ ID NO: 439219 - RNA, 22 nt, Human
ccuggagcuuuuccauccugga

SEQ ID NO: 439220 - RNA, 22 nt, Human
gcuuugcacuccagcuguggcc

SEQ ID NO: 439221 - RNA, 22 nt, Human
cucagagcccaggguacacccg

SEQ ID NO: 439222 - RNA, 22 nt, Human
aggacuaaaaagaugcucuccc

SEQ ID NO: 439223 - RNA, 22 nt, Human
ggacacaggcagcugggugggu

SEQ ID NO: 439224 - RNA, 22 nt, Human
gccugccuggagcuugagguga

SEQ ID NO: 439225 - RNA, 22 nt, Human
uuugcaaauucuugucuagccu

SEQ ID NO: 439226 - RNA, 18 nt, Human
ugggagugggaguggaua

SEQ ID NO: 439227 - RNA, 23 nt, Human
agcuaaugggacagauuccaugg

SEQ ID NO: 439228 - RNA, 22 nt, Human
gaaggccauugcguccugggau

SEQ ID NO: 439229 - RNA, 22 nt, Human
uaagaggcaaaagauacucaga

SEQ ID NO: 439230 - RNA, 22 nt, Human
cacaaaugugcagaaaugugag

SEQ ID NO: 439231 - RNA, 22 nt, Human
gccucacugcagccccaggaag

SEQ ID NO: 439232 - RNA, 22 nt, Human
acagagcucccagccaucuccu

SEQ ID NO: 439233 - RNA, 22 nt, Human
agaugcuauacauuguaagaca

SEQ ID NO: 439234 - RNA, 22 nt, Human
aggcagccaaucagaggcugac

SEQ ID NO: 439235 - RNA, 22 nt, Human
uacauuaaggauauggacauga

SEQ ID NO: 439236 - RNA, 22 nt, Human
ugcucacagcccagaacauaau

SEQ ID NO: 439237 - RNA, 22 nt, Human
aauaaagacucagaggcccagg

SEQ ID NO: 439238 - RNA, 22 nt, Human
uccugccucaggcucuggagua

SEQ ID NO: 439239 - RNA, 22 nt, Human
uuucagaguuggggaaaagcag

SEQ ID NO: 439240 - RNA, 22 nt, Human
auauacaggugguauguguaaa

SEQ ID NO: 439241 - RNA, 22 nt, Human
ggcacagcccucucuguggaca

SEQ ID NO: 439242 - RNA, 22 nt, Human
agccuggaauuaaggaaaugca

SEQ ID NO: 439243 - RNA, 22 nt, Human
gagagcugucagcguagcaccg

SEQ ID NO: 439244 - RNA, 22 nt, Human
ugcuauuucucugcuguaaaau

SEQ ID NO: 439245 - RNA, 22 nt, Human
guucaaauuuuggcuguacugc

SEQ ID NO: 439246 - RNA, 22 nt, Human
cauucuaaaguguuuuauaccu

SEQ ID NO: 439247 - RNA, 22 nt, Human
agccaagguaucaugagaggca

SEQ ID NO: 439248 - RNA, 22 nt, Human
ugugugacccccagugaagccu

SEQ ID NO: 439249 - RNA, 22 nt, Human
uuuauccaguguuggaauuuuu

SEQ ID NO: 439250 - RNA, 22 nt, Human
aagcccagaugugagaacugag

SEQ ID NO: 439251 - RNA, 22 nt, Human
cugccucucagccugaccgcca

SEQ ID NO: 439252 - RNA, 22 nt, Human
cuggucccagcucugccaccaa

SEQ ID NO: 439253 - RNA, 22 nt, Human
gcagggcagcugaagcuaggug

SEQ ID NO: 439254 - RNA, 22 nt, Human
gcuggcugcuaggacagcuaca

SEQ ID NO: 439255 - RNA, 22 nt, Human
gggccccaguccucccacgugg

SEQ ID NO: 439256 - RNA, 22 nt, Human
uguaccauauagaugguaccuu

SEQ ID NO: 439257 - RNA, 22 nt, Human
ucaggccugcaaggagaguccc

SEQ ID NO: 439258 - RNA, 22 nt, Human
ggagccugugcccaagcccaga

SEQ ID NO: 439259 - RNA, 17 nt, Human
gcacugaacaauccugu

SEQ ID NO: 439260 - RNA, 21 nt, Human
gcacagcaugaguguuggcau

SEQ ID NO: 439261 - RNA, 22 nt, Human
cugcccugcuugaugacagcga

SEQ ID NO: 439262 - RNA, 22 nt, Human
aagccgaggccacacagcagga

SEQ ID NO: 439263 - RNA, 22 nt, Human
aacaugaugugaagcaugaacu

SEQ ID NO: 439264 - RNA, 22 nt, Human
ucagaacuacauggacauguua

SEQ ID NO: 439265 - RNA, 21 nt, Human
ugggcacugagggugcugcuc

SEQ ID NO: 439266 - RNA, 22 nt, Human
cggcucagcuagcuuggcccca

SEQ ID NO: 439267 - RNA, 22 nt, Human
ucccugagcugagcucaacagc

SEQ ID NO: 439268 - RNA, 22 nt, Human
ggaagggcaaaagagaugaacu

SEQ ID NO: 439269 - RNA, 22 nt, Human
ucuuagcaaauacuacuuagaa

SEQ ID NO: 439270 - RNA, 22 nt, Human
guuucacagucugcagaauuuu

SEQ ID NO: 439271 - RNA, 22 nt, Human
aggcagguuggugagaagacug

SEQ ID NO: 439272 - RNA, 22 nt, Human
acaaucacacaugcaauuauac

SEQ ID NO: 439273 - RNA, 22 nt, Human
agaagcacaccaguagacaggg

SEQ ID NO: 439274 - RNA, 22 nt, Human
ccucagagaaaugucuauucaa

SEQ ID NO: 439275 - RNA, 18 nt, Human
uugagaaauaagcacuaa

SEQ ID NO: 439276 - RNA, 21 nt, Human
aggguccuacagggcucagga

SEQ ID NO: 439277 - RNA, 22 nt, Human
gucagcugucuccccagagugg

SEQ ID NO: 439278 - RNA, 22 nt, Human
ugucaccaguuccaggaaauaa

SEQ ID NO: 439279 - RNA, 22 nt, Human
gccuggccgcuccgagcuccgc

SEQ ID NO: 439280 - RNA, 22 nt, Human
gccuggcucacagagcagccuu

SEQ ID NO: 439281 - RNA, 22 nt, Human
caguggccugagccaggcuucc

SEQ ID NO: 439282 - RNA, 22 nt, Human
ucugggagagucacaggcauug

SEQ ID NO: 439283 - RNA, 22 nt, Human
gcacagccggaccgaggaaaag

SEQ ID NO: 439284 - RNA, 22 nt, Human
auuguuaaacugaagcauuacu

SEQ ID NO: 439285 - RNA, 22 nt, Human
uuaguuuucccaucuuuauggu

SEQ ID NO: 439286 - RNA, 22 nt, Human
guggcagggcaaugcucccucu

SEQ ID NO: 439287 - RNA, 22 nt, Human
caggcagcgcucguggccuggc

SEQ ID NO: 439288 - RNA, 22 nt, Human
cccuccucaacucuggcuucca

SEQ ID NO: 439289 - RNA, 22 nt, Human
aaaaagauguccugaaguuuag

SEQ ID NO: 439290 - RNA, 22 nt, Human
gaucugaagaguuauuuucuga

SEQ ID NO: 439291 - RNA, 22 nt, Human
agcauucaugaugacaacagga

SEQ ID NO: 439292 - RNA, 22 nt, Human
agaauuucaaaaggaagccagc

SEQ ID NO: 439293 - RNA, 22 nt, Human
uuugcaaagugcuugcagagua

SEQ ID NO: 439294 - RNA, 22 nt, Human
aggagaaguaaggcuagaugau

SEQ ID NO: 439295 - RNA, 22 nt, Human
uacagaggcacaugcaauuuuc

SEQ ID NO: 439296 - RNA, 22 nt, Human
uggagagaaaguugaauggagg

SEQ ID NO: 439297 - RNA, 22 nt, Human
ucagcacuuuuacucucuuugc

SEQ ID NO: 439298 - RNA, 22 nt, Human
ccaaacuguuucguauuuaugc

SEQ ID NO: 439299 - RNA, 18 nt, Human
gcuuugcacucauguugu

SEQ ID NO: 439300 - RNA, 19 nt, Human
gccugccuggguuucugag

SEQ ID NO: 439301 - RNA, 22 nt, Human
cugucucugucuuaacucccag

SEQ ID NO: 439302 - RNA, 22 nt, Human
agggaaggagguuagaacccac

SEQ ID NO: 439303 - RNA, 22 nt, Human
agcuagggcaaauaugagauac

SEQ ID NO: 439304 - RNA, 19 nt, Human
uagcccuggccaucaugag

SEQ ID NO: 439305 - RNA, 22 nt, Human
agcaacagggggauggccacug

SEQ ID NO: 439306 - RNA, 22 nt, Human
auaacuuaaugggucaugcucu

SEQ ID NO: 439307 - RNA, 22 nt, Human
ugcugccaugcagagcaacaga

SEQ ID NO: 439308 - RNA, 22 nt, Human
cuauugcauuugcaucuucauc

SEQ ID NO: 439309 - RNA, 22 nt, Human
cucaggccagguuucucccaca

SEQ ID NO: 439310 - RNA, 22 nt, Human
cucuguagaaacagggcagaag

SEQ ID NO: 439311 - RNA, 22 nt, Human
cccugggcaccaggccugguaa

SEQ ID NO: 439312 - RNA, 22 nt, Human
aaaaggaggcaaacagccuaga

SEQ ID NO: 439313 - RNA, 22 nt, Human
ucuguagucugugccauagcug

SEQ ID NO: 439314 - RNA, 22 nt, Human
aggaugagauugcuguguugua

SEQ ID NO: 439315 - RNA, 22 nt, Human
gggagggguugcauguuugagu

SEQ ID NO: 439316 - RNA, 23 nt, Human
ugguccugccaacggugccccuc

SEQ ID NO: 439317 - RNA, 20 nt, Human
uggugagagcaccugauggg

SEQ ID NO: 439318 - RNA, 20 nt, Human
gcuuccagaggaggccccgu

SEQ ID NO: 439319 - RNA, 17 nt, Human
ugcaggcuccugucccu

SEQ ID NO: 439320 - RNA, 21 nt, Human
aaaguugauuuagauugguga

SEQ ID NO: 439321 - RNA, 22 nt, Human
ucuccaggagaaauaugaagga

SEQ ID NO: 439322 - RNA, 22 nt, Human
gccuggagaagauggaacuagc

SEQ ID NO: 439323 - RNA, 22 nt, Human
gcugucaggaacaugccuuggu

SEQ ID NO: 439324 - RNA, 22 nt, Human
gcuggcagguaaagccccgggg

SEQ ID NO: 439325 - RNA, 22 nt, Human
agguccugaagauuuuacuaga

SEQ ID NO: 439326 - RNA, 22 nt, Human
cagcuguugaucucuuaagccu

SEQ ID NO: 439327 - RNA, 21 nt, Human
agaugcugugcuccaggagca

SEQ ID NO: 439328 - RNA, 22 nt, Human
cuugacaacuggcagauauaua

SEQ ID NO: 439329 - RNA, 22 nt, Human
gucuccuccauggagaugguau

SEQ ID NO: 439330 - RNA, 22 nt, Human
aggcagguuacaaaaacuuuau

SEQ ID NO: 439331 - RNA, 22 nt, Human
agcaaggccgagaggaugcuau

SEQ ID NO: 439332 - RNA, 22 nt, Human
cccugccuucuuggccuuuaaa

SEQ ID NO: 439333 - RNA, 22 nt, Human
aagagacuucuagauuuguuga

SEQ ID NO: 439334 - RNA, 23 nt, Human
cccagcagauuguaaagugucca

SEQ ID NO: 439335 - RNA, 19 nt, Human
agcagagcagggccguggg

SEQ ID NO: 439336 - RNA, 22 nt, Human
aaggcaauguuagcaacauaau

SEQ ID NO: 439337 - RNA, 22 nt, Human
uccccagguccugucggcuccu

SEQ ID NO: 439338 - RNA, 22 nt, Human
ugcaaauuucuuuaguacauaa

SEQ ID NO: 439339 - RNA, 22 nt, Human
acaagauuuaaugcaacccaag

SEQ ID NO: 439340 - RNA, 22 nt, Human
gccccucccagucaggagcacu

SEQ ID NO: 439341 - RNA, 22 nt, Human
uuuucauuuacauuagggaaga

SEQ ID NO: 439342 - RNA, 22 nt, Human
ugagaaaacaguuuguaauaau

SEQ ID NO: 439343 - RNA, 22 nt, Human
gcaguaagauguuucccagagc

SEQ ID NO: 439344 - RNA, 22 nt, Human
guuuuucucugaaauaguugac

SEQ ID NO: 439345 - RNA, 22 nt, Human
uaauuuaugguauguguguaau

SEQ ID NO: 439346 - RNA, 22 nt, Human
ugggcacuggaagccugcugug

SEQ ID NO: 439347 - RNA, 22 nt, Human
aucuuuuacauuacugcccaga

SEQ ID NO: 439348 - RNA, 22 nt, Human
gagaaggccaggaacccagugu

SEQ ID NO: 439349 - RNA, 22 nt, Human
aggcaccucagcugagccuggg

SEQ ID NO: 439350 - RNA, 22 nt, Human
gcagcugcagguggucccaugc

SEQ ID NO: 439351 - RNA, 22 nt, Human
uuuaagaugguauuuuauaaag

SEQ ID NO: 439352 - RNA, 22 nt, Human
acauucaaaauuagguuaguug

SEQ ID NO: 439353 - RNA, 22 nt, Human
cagucuugcuuuacugagaugg

SEQ ID NO: 439354 - RNA, 17 nt, Human
ccuuucucuuucaucuc

SEQ ID NO: 439355 - RNA, 22 nt, Human
uugcagcuucuaacagcuucag

SEQ ID NO: 439356 - RNA, 19 nt, Human
uauucaggaugauggcaca

SEQ ID NO: 439357 - RNA, 22 nt, Human
gcuggccauggccugcgccauc

SEQ ID NO: 439358 - RNA, 22 nt, Human
gaagaggcuuuccuagggcaag

SEQ ID NO: 439359 - RNA, 22 nt, Human
ccuggguuaguaucuguuucca

SEQ ID NO: 439360 - RNA, 22 nt, Human
caauuucaagauucuguucuuu

SEQ ID NO: 439361 - RNA, 22 nt, Human
ucccucagaugagcuccuagca

SEQ ID NO: 439362 - RNA, 22 nt, Human
uuaaaucaggcaucauuucagu

SEQ ID NO: 439363 - RNA, 22 nt, Human
gcacauauguaaauagcugccu

SEQ ID NO: 439364 - RNA, 22 nt, Human
auugaaaaaugacuauugcuua

SEQ ID NO: 439365 - RNA, 22 nt, Human
agcuaacacauuccagcuauuu

SEQ ID NO: 439366 - RNA, 22 nt, Human
ugcaucagcugugcuucuugac

SEQ ID NO: 439367 - RNA, 22 nt, Human
gaauuuggaucuuugauagagu

SEQ ID NO: 439368 - RNA, 22 nt, Human
acaggcaggcgggacagcccga

SEQ ID NO: 439369 - RNA, 22 nt, Human
aguugaauaauuagacauaucu

SEQ ID NO: 439370 - RNA, 22 nt, Human
ugcauauccacaccuuaucucu

SEQ ID NO: 439371 - RNA, 22 nt, Human
gcuuagcagugugugcuuuuga

SEQ ID NO: 439372 - RNA, 22 nt, Human
ugcagcagggcccaggcacaga

SEQ ID NO: 439373 - RNA, 22 nt, Human
uguuugaaaaguggagauuuau

SEQ ID NO: 439374 - RNA, 22 nt, Human
uugagcaaagcagccauucauu

SEQ ID NO: 439375 - RNA, 22 nt, Human
ggacaagccugugaguggguuu

SEQ ID NO: 439376 - RNA, 22 nt, Human
guaccauaaugagucucuuaaa

SEQ ID NO: 439377 - RNA, 22 nt, Human
caggcuggagugcagugucgcc

SEQ ID NO: 439378 - RNA, 22 nt, Human
uuacaguaugaucaacuuuuca

SEQ ID NO: 439379 - RNA, 22 nt, Human
augagggcagcuauguaagugu

SEQ ID NO: 439380 - RNA, 22 nt, Human
auuugcuucauagaucugugga

SEQ ID NO: 439381 - RNA, 22 nt, Human
agagaaucugggaagauguuaa

SEQ ID NO: 439382 - RNA, 22 nt, Human
caguuuaaagaaggaugggagu

SEQ ID NO: 439383 - RNA, 22 nt, Human
uuugaaauuaagauauugucca

SEQ ID NO: 439384 - RNA, 22 nt, Human
ggcagcugauuagcaucaagga

SEQ ID NO: 439385 - RNA, 22 nt, Human
acugggccggugcagaguaguu

SEQ ID NO: 439386 - RNA, 22 nt, Human
ugucccagcagcuggguucucu

SEQ ID NO: 439387 - RNA, 19 nt, Human
agcuccaggccuggaugcu

SEQ ID NO: 439388 - RNA, 22 nt, Human
auagcacugguuuuucuugguu

SEQ ID NO: 439389 - RNA, 22 nt, Human
ggcagcugcaaaucugcucugu

SEQ ID NO: 439390 - RNA, 22 nt, Human
uggccuccccuaacagccucuu

SEQ ID NO: 439391 - RNA, 22 nt, Human
aacauaaguggcacuuugccca

SEQ ID NO: 439392 - RNA, 22 nt, Human
acagagcuaauguugcauaggc

SEQ ID NO: 439393 - RNA, 22 nt, Human
ggcagccauggacacuggcuag

SEQ ID NO: 439394 - RNA, 22 nt, Human
uggcacugagcagccgcggcag

SEQ ID NO: 439395 - RNA, 22 nt, Human
cuuuacaaccuaaguugaagcu

SEQ ID NO: 439396 - RNA, 22 nt, Human
ccagcuccaaguuugggcauca

SEQ ID NO: 439397 - RNA, 22 nt, Human
gccaggcagcugggagggugcc

SEQ ID NO: 439398 - RNA, 22 nt, Human
gaaaggagugcuuuccaggucu

SEQ ID NO: 439399 - RNA, 22 nt, Human
uaguguuuaguacauaugcaua

SEQ ID NO: 439400 - RNA, 21 nt, Human
aacuuugcuuaacugugugga

SEQ ID NO: 439401 - RNA, 22 nt, Human
gcugagugagguccagagcuug

SEQ ID NO: 439402 - RNA, 22 nt, Human
aacaucuacagugagauguuag

SEQ ID NO: 439403 - RNA, 19 nt, Human
auguuuacacucaggggcu

SEQ ID NO: 439404 - RNA, 22 nt, Human
agagagguuggcuaggauguuu

SEQ ID NO: 439405 - RNA, 22 nt, Human
ugcuggcucuaggcugagacag

SEQ ID NO: 439406 - RNA, 22 nt, Human
ugcuuugcucucacuguaaggu

SEQ ID NO: 439407 - RNA, 22 nt, Human
agguccuguccuuggucucuga

SEQ ID NO: 439408 - RNA, 23 nt, Human
cucucccccuuugauguuagcuc

SEQ ID NO: 439409 - RNA, 22 nt, Human
gcccagcuccucugcagacccu

SEQ ID NO: 439410 - RNA, 22 nt, Human
ugccugggguuggcaaacugcu

SEQ ID NO: 439411 - RNA, 22 nt, Human
ucugucuccugccagugccucu

SEQ ID NO: 439412 - RNA, 22 nt, Human
gcugcucucagagcucaugcug

SEQ ID NO: 439413 - RNA, 22 nt, Human
uaguuuaauggucaacuaauga

SEQ ID NO: 439414 - RNA, 22 nt, Human
cuugccuucagugucccuuugc

SEQ ID NO: 439415 - RNA, 22 nt, Human
cugccuggggaaugugaggauu

SEQ ID NO: 439416 - RNA, 22 nt, Human
uagcugccauugcuccaggaag

SEQ ID NO: 439417 - RNA, 22 nt, Human
aaagccagcaaggugaguuuca

SEQ ID NO: 439418 - RNA, 22 nt, Human
agcugagcucaggcugauguaa

SEQ ID NO: 439419 - RNA, 21 nt, Human
ucaggaagagccaguucaugc

SEQ ID NO: 439420 - RNA, 22 nt, Human
aggaccagccuccaggucucuu

SEQ ID NO: 439421 - RNA, 22 nt, Human
ccagaagggcuauugcagugac

SEQ ID NO: 439422 - RNA, 18 nt, Human
uagauuaaaauugaauuc

SEQ ID NO: 439423 - RNA, 22 nt, Human
cugggccuagaggaagcugaca

SEQ ID NO: 439424 - RNA, 22 nt, Human
aguauauggggaauugcauaau

SEQ ID NO: 439425 - RNA, 22 nt, Human
cugagagguaagcagcgcagug

SEQ ID NO: 439426 - RNA, 22 nt, Human
uccucuccagcaaacuggcuau

SEQ ID NO: 439427 - RNA, 22 nt, Human
caggcugcggucggcucugguc

SEQ ID NO: 439428 - RNA, 22 nt, Human
cacugguagcaguuaaguuagg

SEQ ID NO: 439429 - RNA, 22 nt, Human
cagcaaauuuuaauacugcuuu

SEQ ID NO: 439430 - RNA, 21 nt, Human
agucacauuggggguuuaggg

SEQ ID NO: 439431 - RNA, 22 nt, Human
cccaguccuaaagcagacgcca

SEQ ID NO: 439432 - RNA, 22 nt, Human
caggaaugccaaccagugcaug

SEQ ID NO: 439433 - RNA, 22 nt, Human
gagcacagauccuggagccaca

SEQ ID NO: 439434 - RNA, 22 nt, Human
cucaggcuaagaaggccaagug

SEQ ID NO: 439435 - RNA, 22 nt, Human
ugaggauuuaaugggacucauu

SEQ ID NO: 439436 - RNA, 22 nt, Human
gucccugacacccggguggagg

SEQ ID NO: 439437 - RNA, 22 nt, Human
uuucacauuggcuucuauuucu

SEQ ID NO: 439438 - RNA, 22 nt, Human
aggcagcaugcucugcuucuac

SEQ ID NO: 439439 - RNA, 22 nt, Human
uuuggcacauucugucacauuc

SEQ ID NO: 439440 - RNA, 22 nt, Human
ggcaaacaggagaguaaagaga

SEQ ID NO: 439441 - RNA, 19 nt, Human
ugucacugucauggcccag

SEQ ID NO: 439442 - RNA, 22 nt, Human
aggaugaggcuggcaggucuug

SEQ ID NO: 439443 - RNA, 22 nt, Human
uugagacagugggguguugccg

SEQ ID NO: 439444 - RNA, 22 nt, Human
agaccacagucaggcuccuggu

SEQ ID NO: 439445 - RNA, 22 nt, Human
auaaauugugcuuuugacaucu

SEQ ID NO: 439446 - RNA, 22 nt, Human
uucuaacuuuugaggcaaugug

SEQ ID NO: 439447 - RNA, 22 nt, Human
cagagacaggaaucagcugcag

SEQ ID NO: 439448 - RNA, 22 nt, Human
uucuggcuuauccuaacucuaa

SEQ ID NO: 439449 - RNA, 22 nt, Human
agcaaggcuaaauuucaguuau

SEQ ID NO: 439450 - RNA, 20 nt, Human
guuuauacagaagaccccaa

SEQ ID NO: 439451 - RNA, 22 nt, Human
gcaaauaauauacuuugaucuc

SEQ ID NO: 439452 - RNA, 22 nt, Human
agauucaaagugaagaacuuaa

SEQ ID NO: 439453 - RNA, 22 nt, Human
gacaggcagaccugugcccugg

SEQ ID NO: 439454 - RNA, 22 nt, Human
agaguucacacucagugcaccc

SEQ ID NO: 439455 - RNA, 22 nt, Human
ugauacagagaaagcaucuuuu

SEQ ID NO: 439456 - RNA, 22 nt, Human
ccagaaaaggagcugcaggaug

SEQ ID NO: 439457 - RNA, 22 nt, Human
uuugcagaguaccugaagagga

SEQ ID NO: 439458 - RNA, 22 nt, Human
ggcaccagggaaggaaggcugg

SEQ ID NO: 439459 - RNA, 22 nt, Human
augggaggaucacuugaggcca

SEQ ID NO: 439460 - RNA, 22 nt, Human
auacaaguugugauaauguaaa

SEQ ID NO: 439461 - RNA, 22 nt, Human
ggagucaccugggaggacuggg

SEQ ID NO: 439462 - RNA, 20 nt, Human
caguccugccccuuggggac

SEQ ID NO: 439463 - RNA, 22 nt, Human
acauuacuuaccuuggguucua

SEQ ID NO: 439464 - RNA, 22 nt, Human
uucauucauguauugucuaugg

SEQ ID NO: 439465 - RNA, 19 nt, Human
uaaaguugaaaucaagucc

SEQ ID NO: 439466 - RNA, 22 nt, Human
agucccagccuaggcugugcug

SEQ ID NO: 439467 - RNA, 22 nt, Human
auuuuccucaagccucuggaag

SEQ ID NO: 439468 - RNA, 22 nt, Human
acacuuugaagauggaaacuug

SEQ ID NO: 439469 - RNA, 22 nt, Human
gugucacaugguuuacugcagc

SEQ ID NO: 439470 - RNA, 18 nt, Human
uccaguuuucccagcauc

SEQ ID NO: 439471 - RNA, 22 nt, Human
aagaggcgcuccucacuuccua

SEQ ID NO: 439472 - RNA, 22 nt, Human
gcagauggcagcccaggcuggg

SEQ ID NO: 439473 - RNA, 22 nt, Human
ggaaaaauagaguauacuuuaa

SEQ ID NO: 439474 - RNA, 22 nt, Human
gaagccaaguccucgaguuuca

SEQ ID NO: 439475 - RNA, 22 nt, Human
gggucaggccucaaggugggcu

SEQ ID NO: 439476 - RNA, 22 nt, Human
cccaggguagcugagcuggcag

SEQ ID NO: 439477 - RNA, 22 nt, Human
aggcuugggucagaaggcuugu

SEQ ID NO: 439478 - RNA, 22 nt, Human
aacucucauuuuagguguaagg

SEQ ID NO: 439479 - RNA, 22 nt, Human
acuuugcagguacaugagcauc

SEQ ID NO: 439480 - RNA, 22 nt, Human
uucuucccagccagcacagccc

SEQ ID NO: 439481 - RNA, 22 nt, Human
gaauucuagucacacacauuca

SEQ ID NO: 439482 - RNA, 22 nt, Human
uucaaacuaugacuucagcuac

SEQ ID NO: 439483 - RNA, 22 nt, Human
uuucuagaaauagagauagagu

SEQ ID NO: 439484 - RNA, 22 nt, Human
agggucugaccaccaguaggga

SEQ ID NO: 439485 - RNA, 22 nt, Human
gaguuaaauagcuuaggauuca

SEQ ID NO: 439486 - RNA, 22 nt, Human
uucuuauguucacauaauucca

SEQ ID NO: 439487 - RNA, 22 nt, Human
gaaggcugaugacagauucugc

SEQ ID NO: 439488 - RNA, 22 nt, Human
ucugggagguaaccaugcugau

SEQ ID NO: 439489 - RNA, 22 nt, Human
cagagccuuccuagcagacucu

SEQ ID NO: 439490 - RNA, 22 nt, Human
guguguguauauauacacacac

SEQ ID NO: 439491 - RNA, 22 nt, Human
uuuggaagauaguucggcaguu

SEQ ID NO: 439492 - RNA, 22 nt, Human
uuuacagcagcaugauuuauaa

SEQ ID NO: 439493 - RNA, 21 nt, Human
uccuggcuuuaugcuaccucu

SEQ ID NO: 439494 - RNA, 22 nt, Human
gaugccugcauuucaggagagu

SEQ ID NO: 439495 - RNA, 22 nt, Human
ugcaaaaaggcagacuggugau

SEQ ID NO: 439496 - RNA, 22 nt, Human
ugcugggcuugaaagcugcuaa

SEQ ID NO: 439497 - RNA, 19 nt, Human
ugaaggagggggauggcca

SEQ ID NO: 439498 - RNA, 22 nt, Human
agaguggguuauaggcagacuu

SEQ ID NO: 439499 - RNA, 22 nt, Human
cuggucccugaguaguuaugca

SEQ ID NO: 439500 - RNA, 22 nt, Human
aagagacuaagaaagggcaaua

SEQ ID NO: 439501 - RNA, 22 nt, Human
ggcagcaguggcugcuauuguc

SEQ ID NO: 439502 - RNA, 22 nt, Human
agcuggugccugcuuuugugug

SEQ ID NO: 439503 - RNA, 22 nt, Human
gccuggcaaggcccuguugacu

SEQ ID NO: 439504 - RNA, 22 nt, Human
uucuaaagccuguccuaucaga

SEQ ID NO: 439505 - RNA, 22 nt, Human
aaguccugccaccuauaagccu

SEQ ID NO: 439506 - RNA, 22 nt, Human
ucacacuuagagcgaauuguuu

SEQ ID NO: 439507 - RNA, 22 nt, Human
ugcaggcuggaggagggacuaa

SEQ ID NO: 439508 - RNA, 19 nt, Human
uccugcagaccagaccugu

SEQ ID NO: 439509 - RNA, 22 nt, Human
uguacuaaugcauuuaacuaac

SEQ ID NO: 439510 - RNA, 22 nt, Human
ccaggcugugcuuuucauaaau

SEQ ID NO: 439511 - RNA, 22 nt, Human
uacaggcacugaaaugcuuauu

SEQ ID NO: 439512 - RNA, 22 nt, Human
uggccuggcagagcaaggccug

SEQ ID NO: 439513 - RNA, 22 nt, Human
uaauuuauauggaauuguugcu

SEQ ID NO: 439514 - RNA, 22 nt, Human
ccuuagcauggcugugcugugu

SEQ ID NO: 439515 - RNA, 21 nt, Human
ccuggcagaagccugauaugc

SEQ ID NO: 439516 - RNA, 22 nt, Human
aucacuaugggcauuauauuua

SEQ ID NO: 439517 - RNA, 22 nt, Human
caauaacugcuaaauucccugu

SEQ ID NO: 439518 - RNA, 22 nt, Human
uuucagaggugcuuggaaugcu

SEQ ID NO: 439519 - RNA, 22 nt, Human
aucaaauacaaagggcauaagg

SEQ ID NO: 439520 - RNA, 22 nt, Human
ucacugcaaccucugccuuccg

SEQ ID NO: 439521 - RNA, 22 nt, Human
ugaaccagagucuccagugguu

SEQ ID NO: 439522 - RNA, 22 nt, Human
cuauuaaauacucuucaaauug

SEQ ID NO: 439523 - RNA, 22 nt, Human
gugcaugucggggugcauguca

SEQ ID NO: 439524 - RNA, 22 nt, Human
ccaggaaaauaccaagcuuuaa

SEQ ID NO: 439525 - RNA, 22 nt, Human
uggauaaaugugcagaugacau

SEQ ID NO: 439526 - RNA, 22 nt, Human
ggaagccagagugcugggcagg

SEQ ID NO: 439527 - RNA, 22 nt, Human
ugugugaaggaauauauacuca

SEQ ID NO: 439528 - RNA, 22 nt, Human
ucucagagcaucauuuucuuag

SEQ ID NO: 439529 - RNA, 22 nt, Human
uuuuccuuuggaagaugcauau

SEQ ID NO: 439530 - RNA, 20 nt, Human
uguaccauaaugacuggcuc

SEQ ID NO: 439531 - RNA, 22 nt, Human
uuccuuccauagcaaaacaugc

SEQ ID NO: 439532 - RNA, 22 nt, Human
agcaggcaggcccagcggcugg

SEQ ID NO: 439533 - RNA, 22 nt, Human
ucuacacuguagaauuauaagg

SEQ ID NO: 439534 - RNA, 22 nt, Human
ugcucaggccagccggacagag

SEQ ID NO: 439535 - RNA, 22 nt, Human
ucaggcugguccccacagugga

SEQ ID NO: 439536 - RNA, 22 nt, Human
aagagcauuuuguaaaauccuu

SEQ ID NO: 439537 - RNA, 22 nt, Human
cuccucagucaggucuaggguc

SEQ ID NO: 439538 - RNA, 22 nt, Human
ugugaauaaugccgcaauaaac

SEQ ID NO: 439539 - RNA, 23 nt, Human
agcuguuucauuauuacaacacc

SEQ ID NO: 439540 - RNA, 22 nt, Human
uucuggauauaacauucagucc

SEQ ID NO: 439541 - RNA, 22 nt, Human
gaguccugcccuuguguagucc

SEQ ID NO: 439542 - RNA, 22 nt, Human
auuuugaagggaauugaaguuc

SEQ ID NO: 439543 - RNA, 22 nt, Human
caguucuaauuaauaggaguaa

SEQ ID NO: 439544 - RNA, 22 nt, Human
uggccagccacaauauaaagua

SEQ ID NO: 439545 - RNA, 22 nt, Human
acagauuuuugguaaauaauuu

SEQ ID NO: 439546 - RNA, 22 nt, Human
cagccuccugggacacucaccg

SEQ ID NO: 439547 - RNA, 22 nt, Human
guuucagauuugguuucagaag

SEQ ID NO: 439548 - RNA, 22 nt, Human
uccucagcauuagcacagacau

SEQ ID NO: 439549 - RNA, 22 nt, Human
ugaugagggaacugguucauac

SEQ ID NO: 439550 - RNA, 22 nt, Human
auaaagcaucuagucugucacu

SEQ ID NO: 439551 - RNA, 22 nt, Human
uggaggcccacacuggguagau

SEQ ID NO: 439552 - RNA, 22 nt, Human
gugugugugcauauaacauaua

SEQ ID NO: 439553 - RNA, 22 nt, Human
gugcccuguucauuucucuccc

SEQ ID NO: 439554 - RNA, 22 nt, Human
ccuuagcagggagucuguccag

SEQ ID NO: 439555 - RNA, 22 nt, Human
uugcaaaugugguuagggcuuu

SEQ ID NO: 439556 - RNA, 22 nt, Human
ccagugcacagccaggcaggug

SEQ ID NO: 439557 - RNA, 20 nt, Human
uggaagacacugaagggcca

SEQ ID NO: 439558 - RNA, 22 nt, Human
uacaguaccagaaaugcuaaga

SEQ ID NO: 439559 - RNA, 22 nt, Human
augcuuuaaacuauaaauccac

SEQ ID NO: 439560 - RNA, 22 nt, Human
agugauauuagcaaaugguuau

SEQ ID NO: 439561 - RNA, 22 nt, Human
gagcucccaggccccagcaagg

SEQ ID NO: 439562 - RNA, 22 nt, Human
gcagcccagguguagcucuuug

SEQ ID NO: 439563 - RNA, 22 nt, Human
aaggcagauauaaagacuagag

SEQ ID NO: 439564 - RNA, 22 nt, Human
gcagaggugaccagcagcaggg

SEQ ID NO: 439565 - RNA, 22 nt, Human
gcaggagcugcucuccugacga

SEQ ID NO: 439566 - RNA, 22 nt, Human
ugcauuucacagacugagaaau

SEQ ID NO: 439567 - RNA, 22 nt, Human
ucagugucuugaccugggugug

SEQ ID NO: 439568 - RNA, 22 nt, Human
cugagccagcgggcucacuuuu

SEQ ID NO: 439569 - RNA, 22 nt, Human
ggccuuccuucccagccuacug

SEQ ID NO: 439570 - RNA, 22 nt, Human
cauaggaaaagcauucuucuug

SEQ ID NO: 439571 - RNA, 22 nt, Human
gagcaggaacugaaaaugagac

SEQ ID NO: 439572 - RNA, 22 nt, Human
ccagcuccccucagcagguaau

SEQ ID NO: 439573 - RNA, 22 nt, Human
ugagacaggcuuccuucuuggg

SEQ ID NO: 439574 - RNA, 22 nt, Human
ugagacagcccuucugcacagg

SEQ ID NO: 439575 - RNA, 22 nt, Human
uuucuaaacuggauucagccug

SEQ ID NO: 439576 - RNA, 22 nt, Human
gaaggcuguggcuggucucagu

SEQ ID NO: 439577 - RNA, 22 nt, Human
ugcuucacaagaauucaggacc

SEQ ID NO: 439578 - RNA, 22 nt, Human
cuggcucccucgcugaggugcu

SEQ ID NO: 439579 - RNA, 22 nt, Human
agaggggaaguaaugaaugaua

SEQ ID NO: 439580 - RNA, 22 nt, Human
acagucuaaucuuguguucugu

SEQ ID NO: 439581 - RNA, 22 nt, Human
ccaguccagugccaugcauggc

SEQ ID NO: 439582 - RNA, 22 nt, Human
cuggcuccaccccaggaggaug

SEQ ID NO: 439583 - RNA, 22 nt, Human
ugagaaggcucaggcuuagaga

SEQ ID NO: 439584 - RNA, 20 nt, Human
uccugcaguuccuaggaggg

SEQ ID NO: 439585 - RNA, 22 nt, Human
gcccaggggcagcgcauagugg

SEQ ID NO: 439586 - RNA, 23 nt, Human
gcucuggcagcuugugucagcac

SEQ ID NO: 439587 - RNA, 22 nt, Human
uuuauccacucauccaugccuc

SEQ ID NO: 439588 - RNA, 22 nt, Human
auuucaaggacuacuuuucaau

SEQ ID NO: 439589 - RNA, 22 nt, Human
uuucagaggaggaaggcaguua

SEQ ID NO: 439590 - RNA, 22 nt, Human
auuguauaagucuauuuacaau

SEQ ID NO: 439591 - RNA, 22 nt, Human
ucacgugagggaccugugucug

SEQ ID NO: 439592 - RNA, 19 nt, Human
acccucugccacaagccuc

SEQ ID NO: 439593 - RNA, 22 nt, Human
gaugcuuuggccccaucaugag

SEQ ID NO: 439594 - RNA, 22 nt, Human
gaggcucuuucuuuggacuuca

SEQ ID NO: 439595 - RNA, 22 nt, Human
gcuacagagcucugugaagaga

SEQ ID NO: 439596 - RNA, 17 nt, Human
guguacaagcagaaggc

SEQ ID NO: 439597 - RNA, 22 nt, Human
auucagaagcaaucacagugag

SEQ ID NO: 439598 - RNA, 22 nt, Human
agcuccaagguugaggagugag

SEQ ID NO: 439599 - RNA, 22 nt, Human
agccagcuggugggucagcugg

SEQ ID NO: 439600 - RNA, 22 nt, Human
gacuuucucuccucccaggugu

SEQ ID NO: 439601 - RNA, 22 nt, Human
gagccuguguuuccuguagcca

SEQ ID NO: 439602 - RNA, 22 nt, Human
gagcugggauuugaaccuggga

SEQ ID NO: 439603 - RNA, 22 nt, Human
cagcacuucaaugagcauuuca

SEQ ID NO: 439604 - RNA, 22 nt, Human
cauguacacucauguaacuaua

SEQ ID NO: 439605 - RNA, 22 nt, Human
gccuucucugugagcuccuagg

SEQ ID NO: 439606 - RNA, 22 nt, Human
acagagccacuuuggugccuac

SEQ ID NO: 439607 - RNA, 18 nt, Human
agcagcaauuugggauga

SEQ ID NO: 439608 - RNA, 22 nt, Human
uggagcugagagccaggcuggc

SEQ ID NO: 439609 - RNA, 22 nt, Human
gagccaggagauaccuaagggg

SEQ ID NO: 439610 - RNA, 22 nt, Human
ccugggauuuccugagcacucu

SEQ ID NO: 439611 - RNA, 22 nt, Human
agcaggcuccaggcuggccauc

SEQ ID NO: 439612 - RNA, 20 nt, Human
cucuggcaaaggaugccuau

SEQ ID NO: 439613 - RNA, 22 nt, Human
gcccuucugcuguuagguagcc

SEQ ID NO: 439614 - RNA, 22 nt, Human
aagacuuucccucaucagaacg

SEQ ID NO: 439615 - RNA, 22 nt, Human
cagcccagccuugucucuuuau

SEQ ID NO: 439616 - RNA, 19 nt, Human
ccaggagagcuuggagaag

SEQ ID NO: 439617 - RNA, 22 nt, Human
ugcacacacucugcauauacuu

SEQ ID NO: 439618 - RNA, 22 nt, Human
ggcaggcauugcaacauguaca

SEQ ID NO: 439619 - RNA, 22 nt, Human
uuuucaaagacuggaggcugau

SEQ ID NO: 439620 - RNA, 22 nt, Human
ugacagggccaugcugcacugc

SEQ ID NO: 439621 - RNA, 21 nt, Human
ugggagagggcucagcuaccc

SEQ ID NO: 439622 - RNA, 22 nt, Human
uaauuuauuucaacugccaagg

SEQ ID NO: 439623 - RNA, 18 nt, Human
ugacucacccugucagug

SEQ ID NO: 439624 - RNA, 22 nt, Human
aggcuguguuuccccuggagcu

SEQ ID NO: 439625 - RNA, 22 nt, Human
gcccaggaguugaagggcugac

SEQ ID NO: 439626 - RNA, 22 nt, Human
gugcucacugugagacguccug

SEQ ID NO: 439627 - RNA, 22 nt, Human
uuuggcacucacuuaucauugg

SEQ ID NO: 439628 - RNA, 22 nt, Human
uggcaauuuguagaguaaauua

SEQ ID NO: 439629 - RNA, 22 nt, Human
aguccugugaguuuuucuaguu

SEQ ID NO: 439630 - RNA, 22 nt, Human
aggcuaggguaacagauguggc

SEQ ID NO: 439631 - RNA, 22 nt, Human
cuucuugagcauggguaguacu

SEQ ID NO: 439632 - RNA, 22 nt, Human
auauagcacuuguuuugcaugu

SEQ ID NO: 439633 - RNA, 22 nt, Human
augcacaguauguagggucuau

SEQ ID NO: 439634 - RNA, 22 nt, Human
gccuggcaggggccugggagug

SEQ ID NO: 439635 - RNA, 22 nt, Human
agcuggccuuagugagcaccug

SEQ ID NO: 439636 - RNA, 22 nt, Human
cuggugucugcucccucacagc

SEQ ID NO: 439637 - RNA, 22 nt, Human
gagcuagguuuuccagucgcau

SEQ ID NO: 439638 - RNA, 22 nt, Human
agggcagauggaacuuccccga

SEQ ID NO: 439639 - RNA, 22 nt, Human
gaucuggaaucugaaggcugag

SEQ ID NO: 439640 - RNA, 22 nt, Human
gagacugauggggcucccagaa

SEQ ID NO: 439641 - RNA, 22 nt, Human
aguuccaccauuuaggaucugu

SEQ ID NO: 439642 - RNA, 22 nt, Human
gaagaggaugacaggagccggu

SEQ ID NO: 439643 - RNA, 19 nt, Human
cauguuaugcuguaguauc

SEQ ID NO: 439644 - RNA, 22 nt, Human
ggcagcugagcauggcuaccuu

SEQ ID NO: 439645 - RNA, 22 nt, Human
gcccuggccuucaucucagaca

SEQ ID NO: 439646 - RNA, 22 nt, Human
caaguucacguugcuuuuugag

SEQ ID NO: 439647 - RNA, 22 nt, Human
gaaggcccuguuuucccuauuu

SEQ ID NO: 439648 - RNA, 22 nt, Human
ucuagagaaaaaacucaaguga

SEQ ID NO: 439649 - RNA, 22 nt, Human
gccugccuuuuggaggcacauu

SEQ ID NO: 439650 - RNA, 22 nt, Human
ccaggcugagcaugauuggagc

SEQ ID NO: 439651 - RNA, 22 nt, Human
agagacugcuuuauauuguacu

SEQ ID NO: 439652 - RNA, 22 nt, Human
aaucagagcccucugagcuuca

SEQ ID NO: 439653 - RNA, 21 nt, Human
cuuaacauuuuaaaugaaagg

SEQ ID NO: 439654 - RNA, 22 nt, Human
acaaaugagaauguagacagag

SEQ ID NO: 439655 - RNA, 22 nt, Human
caggcuggucccagagcauugc

SEQ ID NO: 439656 - RNA, 22 nt, Human
cacauuuaagcagauguggacc

SEQ ID NO: 439657 - RNA, 22 nt, Human
agagucagcuuaugacacaguc

SEQ ID NO: 439658 - RNA, 22 nt, Human
aggccuccugcagggaugagug

SEQ ID NO: 439659 - RNA, 22 nt, Human
aggcacugaagaacucuuuuug

SEQ ID NO: 439660 - RNA, 22 nt, Human
ggcucuggagcacagacgucug

SEQ ID NO: 439661 - RNA, 23 nt, Human
ucucucuggcaaauuucacauau

SEQ ID NO: 439662 - RNA, 22 nt, Human
agugccaggagcaaggagcucc

SEQ ID NO: 439663 - RNA, 19 nt, Human
cccaggguuuccucucucc

SEQ ID NO: 439664 - RNA, 22 nt, Human
acacuuuacucuuacaccauug

SEQ ID NO: 439665 - RNA, 22 nt, Human
caggguccggcugccuggcugu

SEQ ID NO: 439666 - RNA, 22 nt, Human
gcuggcaccugcaccaagcagg

SEQ ID NO: 439667 - RNA, 22 nt, Human
ggugccagccuagugcaguggu

SEQ ID NO: 439668 - RNA, 22 nt, Human
ggcacagcacagagcacaugua

SEQ ID NO: 439669 - RNA, 22 nt, Human
caggaugagaggcccagggaag

SEQ ID NO: 439670 - RNA, 22 nt, Human
gagcccugugaggaaagagggu

SEQ ID NO: 439671 - RNA, 22 nt, Human
augucccagcugagagacaacu

SEQ ID NO: 439672 - RNA, 22 nt, Human
aggcagcugcccucuccuuccu

SEQ ID NO: 439673 - RNA, 22 nt, Human
agcagcugauggggaaggaguu

SEQ ID NO: 439674 - RNA, 22 nt, Human
gagucaggcuagggugacaggc

SEQ ID NO: 439675 - RNA, 22 nt, Human
gugccugguuuggggaguguuc

SEQ ID NO: 439676 - RNA, 22 nt, Human
ccagucugugugccagccugcg

SEQ ID NO: 439677 - RNA, 22 nt, Human
gagcuguccgccccugggccga

SEQ ID NO: 439678 - RNA, 22 nt, Human
cacuugaguucuuaauagucag

SEQ ID NO: 439679 - RNA, 22 nt, Human
acuuagcauuauguaauuacua

SEQ ID NO: 439680 - RNA, 22 nt, Human
uggcccagggucuacagccuca

SEQ ID NO: 439681 - RNA, 22 nt, Human
uacaagacgagggaaguucuuu

SEQ ID NO: 439682 - RNA, 22 nt, Human
aggcugagacugugcauuagug

SEQ ID NO: 439683 - RNA, 22 nt, Human
agcaggcaguguagagccuuca

SEQ ID NO: 439684 - RNA, 22 nt, Human
uguuucaggcuucugggauuuu

SEQ ID NO: 439685 - RNA, 20 nt, Human
ugugacaaaggcauauuuua

SEQ ID NO: 439686 - RNA, 22 nt, Human
ucuaggaauuucaucuaguucu

SEQ ID NO: 439687 - RNA, 22 nt, Human
agcuuugggccacuggcuggau

SEQ ID NO: 439688 - RNA, 22 nt, Human
ugcagugguguccagguguacu

SEQ ID NO: 439689 - RNA, 22 nt, Human
ucccacucacugucucugacac

SEQ ID NO: 439690 - RNA, 22 nt, Human
uaaaggccuaguaaguugagac

SEQ ID NO: 439691 - RNA, 22 nt, Human
cugacuucagggauaaaaagua

SEQ ID NO: 439692 - RNA, 22 nt, Human
auacacugaguccuuuucucau

SEQ ID NO: 439693 - RNA, 22 nt, Human
ucaggcuguggcuuugaccgca

SEQ ID NO: 439694 - RNA, 20 nt, Human
uuucuuguacuuggagaagg

SEQ ID NO: 439695 - RNA, 22 nt, Human
cagcauggagacaaagugggca

SEQ ID NO: 439696 - RNA, 22 nt, Human
gcgcaagccacacagccugggg

SEQ ID NO: 439697 - RNA, 22 nt, Human
cugccuguuagucuagcaguua

SEQ ID NO: 439698 - RNA, 22 nt, Human
cugccucuccccagaguggccc

SEQ ID NO: 439699 - RNA, 22 nt, Human
uguaccauaauguguauuuuaa

SEQ ID NO: 439700 - RNA, 22 nt, Human
gcaggcaccgcggcggcagguu

SEQ ID NO: 439701 - RNA, 22 nt, Human
acaucuuuauacuaguccuuga

SEQ ID NO: 439702 - RNA, 23 nt, Human
acugagccagggccugggucagc

SEQ ID NO: 439703 - RNA, 18 nt, Human
agaagcagguucucccag

SEQ ID NO: 439704 - RNA, 19 nt, Human
ccacuuugcuucucugggu

SEQ ID NO: 439705 - RNA, 22 nt, Human
aggcuaggccuugcccuggaac

SEQ ID NO: 439706 - RNA, 22 nt, Human
gccuguggccgacugagagccu

SEQ ID NO: 439707 - RNA, 22 nt, Human
uuacaauugagucuauuguaug

SEQ ID NO: 439708 - RNA, 22 nt, Human
gcaggcugaguugggaaaccaa

SEQ ID NO: 439709 - RNA, 22 nt, Human
ggaggcacaccucagacuggga

SEQ ID NO: 439710 - RNA, 22 nt, Human
uuguacaaguauuaugugaaca

SEQ ID NO: 439711 - RNA, 22 nt, Human
gugcacagaagcagaagcuaga

SEQ ID NO: 439712 - RNA, 22 nt, Human
acaggccuggaaaggaaggagu

SEQ ID NO: 439713 - RNA, 22 nt, Human
agcuguguaagucauguaggug

SEQ ID NO: 439714 - RNA, 22 nt, Human
gccugagcaggcguggaccaug

SEQ ID NO: 439715 - RNA, 18 nt, Human
agcaggcguugccuggga

SEQ ID NO: 439716 - RNA, 22 nt, Human
acauuugacuguagauacuugc

SEQ ID NO: 439717 - RNA, 22 nt, Human
ccugguguugugaaguagccgu

SEQ ID NO: 439718 - RNA, 22 nt, Human
agcaggcaggaggcuacuaagg

SEQ ID NO: 439719 - RNA, 22 nt, Human
agccuggguuuuuauuaaggag

SEQ ID NO: 439720 - RNA, 22 nt, Human
guggccaggagaccuugggcau

SEQ ID NO: 439721 - RNA, 22 nt, Human
gaggcagagguuguugcaguga

SEQ ID NO: 439722 - RNA, 22 nt, Human
gagaaggcuggucuuaagucga

SEQ ID NO: 439723 - RNA, 22 nt, Human
cgaggaagaaguuugagucaag

SEQ ID NO: 439724 - RNA, 22 nt, Human
uuauugaaggaacugaaauaaa

SEQ ID NO: 439725 - RNA, 22 nt, Human
uucugaggcauagaggaugaga

SEQ ID NO: 439726 - RNA, 22 nt, Human
uaaugaggcaagagucauggcu

SEQ ID NO: 439727 - RNA, 22 nt, Human
ugcagcuguuacggacccuguc

SEQ ID NO: 439728 - RNA, 22 nt, Human
aaggcugagagucacaguccua

SEQ ID NO: 439729 - RNA, 22 nt, Human
auguuuucuagaguuuaaaauc

SEQ ID NO: 439730 - RNA, 19 nt, Human
cgcaggagccgaggugacc

SEQ ID NO: 439731 - RNA, 22 nt, Human
ucuuuuuauauugacaaaaggu

SEQ ID NO: 439732 - RNA, 22 nt, Human
gaggcagcugggauacaaggga

SEQ ID NO: 439733 - RNA, 22 nt, Human
ccugaggcuccaccuccagaga

SEQ ID NO: 439734 - RNA, 22 nt, Human
acagagacugggagcaagaggc

SEQ ID NO: 439735 - RNA, 22 nt, Human
augcauauaaggcacauguauu

SEQ ID NO: 439736 - RNA, 22 nt, Human
caggcuggagugcaguugugca

SEQ ID NO: 439737 - RNA, 22 nt, Human
ccugagugaauucccucacugu

SEQ ID NO: 439738 - RNA, 19 nt, Human
gagcugccuuuugaagacc

SEQ ID NO: 439739 - RNA, 22 nt, Human
cuugcuuuccaaaugacucacu

SEQ ID NO: 439740 - RNA, 22 nt, Human
ugccagccagggaagcucaccc

SEQ ID NO: 439741 - RNA, 22 nt, Human
cauguacaugccuacuaucaau

SEQ ID NO: 439742 - RNA, 22 nt, Human
ggcugcagagcugggugggccu

SEQ ID NO: 439743 - RNA, 21 nt, Human
cagcuccacuaaagcagcugu

SEQ ID NO: 439744 - RNA, 23 nt, Human
gaggacacagcccagacagccgu

SEQ ID NO: 439745 - RNA, 22 nt, Human
ggcugagccuggagcaucuggu

SEQ ID NO: 439746 - RNA, 21 nt, Human
ucugggcuuucuuauaaggca

SEQ ID NO: 439747 - RNA, 23 nt, Human
cagaagcaccuguugacugcugc

SEQ ID NO: 439748 - RNA, 22 nt, Human
ugagacagccucugcacucaug

SEQ ID NO: 439749 - RNA, 22 nt, Human
accagcagccuagagcguucuu

SEQ ID NO: 439750 - RNA, 22 nt, Human
cagcaguggccaucuguguggu

SEQ ID NO: 439751 - RNA, 22 nt, Human
uagaaaugcccagauucugcua

SEQ ID NO: 439752 - RNA, 22 nt, Human
ucccugagggcagcucaagucc

SEQ ID NO: 439753 - RNA, 22 nt, Human
uuuaacauguucaagaaacaua

SEQ ID NO: 439754 - RNA, 20 nt, Human
ugaauaugaccuuauuugga

SEQ ID NO: 439755 - RNA, 22 nt, Human
aaguguauauaugacuuauaaa

SEQ ID NO: 439756 - RNA, 22 nt, Human
ucccugggccuaucuuagcucc

SEQ ID NO: 439757 - RNA, 22 nt, Human
gagcagcaggccagguugcagg

SEQ ID NO: 439758 - RNA, 22 nt, Human
ucugaggcauaaccuguucugc

SEQ ID NO: 439759 - RNA, 21 nt, Human
cacaagacacauaggguguuu

SEQ ID NO: 439760 - RNA, 23 nt, Human
agaauuucuaacucuagcucugu

SEQ ID NO: 439761 - RNA, 22 nt, Human
gggaucugggccucacacacau

SEQ ID NO: 439762 - RNA, 22 nt, Human
cagugggcugugauggauucac

SEQ ID NO: 439763 - RNA, 22 nt, Human
uucagagaguuugugaguccuu

SEQ ID NO: 439764 - RNA, 22 nt, Human
ggugggcaggucacucugccuc

SEQ ID NO: 439765 - RNA, 22 nt, Human
ggcaccaggacaugacucccag

SEQ ID NO: 439766 - RNA, 22 nt, Human
gagacacucaacaaagauauga

SEQ ID NO: 439767 - RNA, 22 nt, Human
uacaagagaacuaauguaaguc

SEQ ID NO: 439768 - RNA, 22 nt, Human
gcagucagacaggaggagcucc

SEQ ID NO: 439769 - RNA, 22 nt, Human
gaggcagcugaaggagugacag

SEQ ID NO: 439770 - RNA, 22 nt, Human
gcagggagguuugcugaccugg

SEQ ID NO: 439771 - RNA, 22 nt, Human
cuuagcuagugcucagcuguca

SEQ ID NO: 439772 - RNA, 22 nt, Human
ggcaggcuagcacugauguccu

SEQ ID NO: 439773 - RNA, 22 nt, Human
guacaauagcaguuuucccuuu

SEQ ID NO: 439774 - RNA, 22 nt, Human
uauggcuuuuuauucaucuuac

SEQ ID NO: 439775 - RNA, 22 nt, Human
gagcagaugugugccaggaugc

SEQ ID NO: 439776 - RNA, 22 nt, Human
gcucccagggcagcgcagaaga

SEQ ID NO: 439777 - RNA, 22 nt, Human
ucauugcauuuauucacuggca

SEQ ID NO: 439778 - RNA, 18 nt, Human
caggccucuugaucuucc

SEQ ID NO: 439779 - RNA, 22 nt, Human
cuguggugagcaacugacugaa

SEQ ID NO: 439780 - RNA, 22 nt, Human
agggaaauuaaugugagcaaug

SEQ ID NO: 439781 - RNA, 22 nt, Human
aggagacauggaauagugaggc

SEQ ID NO: 439782 - RNA, 23 nt, Human
gagcugaguguagggagacuagg

SEQ ID NO: 439783 - RNA, 22 nt, Human
ucaaaaauggucuuugagcugc

SEQ ID NO: 439784 - RNA, 22 nt, Human
gcagagcuucuguccuucagga

SEQ ID NO: 439785 - RNA, 22 nt, Human
acuuagcacgaacauuuacuuu

SEQ ID NO: 439786 - RNA, 22 nt, Human
gggcuccagcuguuugccauga

SEQ ID NO: 439787 - RNA, 22 nt, Human
aagcugccacacggugaguacu

SEQ ID NO: 439788 - RNA, 22 nt, Human
gagacacaggcacagaagaggc

SEQ ID NO: 439789 - RNA, 22 nt, Human
ugaagcaggaaccagcagcauu

SEQ ID NO: 439790 - RNA, 18 nt, Human
uucuaaauucuguuuuua

SEQ ID NO: 439791 - RNA, 22 nt, Human
ucuccccaaccauggcacucac

SEQ ID NO: 439792 - RNA, 22 nt, Human
uguguguauaauaaugucugca

SEQ ID NO: 439793 - RNA, 22 nt, Human
gagggaaggagaguuguagcug

SEQ ID NO: 439794 - RNA, 22 nt, Human
gugccugguuuggggaauguuc

SEQ ID NO: 439795 - RNA, 22 nt, Human
ggcaacaugggaaaauuaaccu

SEQ ID NO: 439796 - RNA, 22 nt, Human
ucuccacuauuuucuagcucuu

SEQ ID NO: 439797 - RNA, 22 nt, Human
ucuuugcaggagcccuuugaac

SEQ ID NO: 439798 - RNA, 22 nt, Human
ccaggaagccugugucucugga

SEQ ID NO: 439799 - RNA, 21 nt, Human
uggcagguucaaaggccuauc

SEQ ID NO: 439800 - RNA, 22 nt, Human
aauucagaagcacaaaaccuag

SEQ ID NO: 439801 - RNA, 18 nt, Human
caaauucagugcuggaag

SEQ ID NO: 439802 - RNA, 22 nt, Human
uuauugcacuauugauuuucua

SEQ ID NO: 439803 - RNA, 22 nt, Human
gggccugggaacuugcauuuag

SEQ ID NO: 439804 - RNA, 23 nt, Human
agcuguguggccuugggcaaguu

SEQ ID NO: 439805 - RNA, 22 nt, Human
auguacaaaaugccacugaauu

SEQ ID NO: 439806 - RNA, 22 nt, Human
uccccagaugacaucaaaaggc

SEQ ID NO: 439807 - RNA, 22 nt, Human
uucagaauauuauuuuaaaggc

SEQ ID NO: 439808 - RNA, 22 nt, Human
augcuuggccccuuuauagccu

SEQ ID NO: 439809 - RNA, 22 nt, Human
gaauuucauugcucugcugugu

SEQ ID NO: 439810 - RNA, 22 nt, Human
uugaugaugcacauuuauaauu

SEQ ID NO: 439811 - RNA, 22 nt, Human
aagaacaugauggccaugugca

SEQ ID NO: 439812 - RNA, 17 nt, Human
gccuuccagcauguggg

SEQ ID NO: 439813 - RNA, 22 nt, Human
ggagcugaugacgucaccaugg

SEQ ID NO: 439814 - RNA, 22 nt, Human
caguguguggauccucccagga

SEQ ID NO: 439815 - RNA, 22 nt, Human
agagauacuuuucuuuggaugc

SEQ ID NO: 439816 - RNA, 22 nt, Human
uucuuaagucaguaagaugcaa

SEQ ID NO: 439817 - RNA, 22 nt, Human
uguuuccuaagugucucugaag

SEQ ID NO: 439818 - RNA, 22 nt, Human
uacaggcauguagcauggugau

SEQ ID NO: 439819 - RNA, 19 nt, Human
uggggccuccugucccugg

SEQ ID NO: 439820 - RNA, 22 nt, Human
ucuccucuccuuucauguuguu

SEQ ID NO: 439821 - RNA, 22 nt, Human
uguaugaaaaggaauagauuga

SEQ ID NO: 439822 - RNA, 23 nt, Human
ucugggcugagacuuggaagguc

SEQ ID NO: 439823 - RNA, 22 nt, Human
cugucaccuguucacugcagca

SEQ ID NO: 439824 - RNA, 22 nt, Human
ucuccaggcccacugauuuaua

SEQ ID NO: 439825 - RNA, 22 nt, Human
cagccucuaagcacagccucuc

SEQ ID NO: 439826 - RNA, 22 nt, Human
aacagucuacugaauaucugcg

SEQ ID NO: 439827 - RNA, 22 nt, Human
ccagagaaagcucacaggcagu

SEQ ID NO: 439828 - RNA, 19 nt, Human
cagaguacaccagauagga

SEQ ID NO: 439829 - RNA, 22 nt, Human
ucagcagugugcccagaggcug

SEQ ID NO: 439830 - RNA, 22 nt, Human
cuagagaaaaugauagcaggaa

SEQ ID NO: 439831 - RNA, 22 nt, Human
cugcccugucuuuuucugauga

SEQ ID NO: 439832 - RNA, 19 nt, Human
agaggccucagcagcuggc

SEQ ID NO: 439833 - RNA, 22 nt, Human
agcucccauuaucuucugaaac

SEQ ID NO: 439834 - RNA, 22 nt, Human
cagcccuguccaaugucugcuc

SEQ ID NO: 439835 - RNA, 22 nt, Human
acauggaagauaaaaauacuca

SEQ ID NO: 439836 - RNA, 22 nt, Human
caggcccugccuuggcaugugu

SEQ ID NO: 439837 - RNA, 22 nt, Human
cagcugccuguauuguccucau

SEQ ID NO: 439838 - RNA, 22 nt, Human
aacaggaauugcaggcagaucu

SEQ ID NO: 439839 - RNA, 22 nt, Human
agcuugacagacagaugguagc

SEQ ID NO: 439840 - RNA, 17 nt, Human
agcugagcuggccaggg

SEQ ID NO: 439841 - RNA, 22 nt, Human
agcagcugagaugguaagauuc

SEQ ID NO: 439842 - RNA, 22 nt, Human
ucuuuaugcacauaaagaaacu

SEQ ID NO: 439843 - RNA, 22 nt, Human
cccagcauggagugaggacuca

SEQ ID NO: 439844 - RNA, 22 nt, Human
cugcccugcuucugagggaagc

SEQ ID NO: 439845 - RNA, 22 nt, Human
agccagcuggagaccacuguuu

SEQ ID NO: 439846 - RNA, 22 nt, Human
agcagagcccuuccauggccuu

SEQ ID NO: 439847 - RNA, 22 nt, Human
cagcaagggauaaacaaggacg

SEQ ID NO: 439848 - RNA, 22 nt, Human
uuuauugucuucguggugccua

SEQ ID NO: 439849 - RNA, 22 nt, Human
uuuuucucuucuguaaaguggu

SEQ ID NO: 439850 - RNA, 22 nt, Human
cacaggaaaaauggguccuuua

SEQ ID NO: 439851 - RNA, 22 nt, Human
ggcaaacagacuugaccaucuu

SEQ ID NO: 439852 - RNA, 22 nt, Human
guccagcauuuaggcuugcuga

SEQ ID NO: 439853 - RNA, 20 nt, Human
aagcagaagcugcucucagc

SEQ ID NO: 439854 - RNA, 22 nt, Human
cugaggugcuagggucccugcu

SEQ ID NO: 439855 - RNA, 22 nt, Human
ugguaucagagccaucuguauu

SEQ ID NO: 439856 - RNA, 22 nt, Human
cugcccuguccuucccgccggc

SEQ ID NO: 439857 - RNA, 22 nt, Human
uuacaguauuggucacguuugu

SEQ ID NO: 439858 - RNA, 22 nt, Human
ucuggcucacuucaggcuucac

SEQ ID NO: 439859 - RNA, 20 nt, Human
uggcccaguggggcagggug

SEQ ID NO: 439860 - RNA, 20 nt, Human
ugugcccaauguccagguuc

SEQ ID NO: 439861 - RNA, 22 nt, Human
cagaauuucccacacugggacu

SEQ ID NO: 439862 - RNA, 20 nt, Human
ggccugagcauggcuggcag

SEQ ID NO: 439863 - RNA, 22 nt, Human
uuugagaaaaccagaaagaucu

SEQ ID NO: 439864 - RNA, 22 nt, Human
ggagaggaaaugccagcacuuc

SEQ ID NO: 439865 - RNA, 22 nt, Human
cugaggcucugggugucacugu

SEQ ID NO: 439866 - RNA, 19 nt, Human
cuucagcaucuccggagcu

SEQ ID NO: 439867 - RNA, 22 nt, Human
aggugacugguuuaucuggcag

SEQ ID NO: 439868 - RNA, 22 nt, Human
aggauuuggggaagaaaacacu

SEQ ID NO: 439869 - RNA, 22 nt, Human
acaguucuuaaaacuugaauua

SEQ ID NO: 439870 - RNA, 22 nt, Human
augcauauggcuugagggaaua

SEQ ID NO: 439871 - RNA, 22 nt, Human
cugcccuguuuggacagcccgg

SEQ ID NO: 439872 - RNA, 22 nt, Human
agggccacaguggggccugaga

SEQ ID NO: 439873 - RNA, 22 nt, Human
agcugguggaagggagcccaaa

SEQ ID NO: 439874 - RNA, 22 nt, Human
acuauucacagauucaguguuc

SEQ ID NO: 439875 - RNA, 22 nt, Human
cccaggagguggagguugcagc

SEQ ID NO: 439876 - RNA, 22 nt, Human
caggcaaggaggcacugaggga

SEQ ID NO: 439877 - RNA, 22 nt, Human
cugcucagcggaaggaagagcg

SEQ ID NO: 439878 - RNA, 22 nt, Human
auuaaggcucccauuuccaauu

SEQ ID NO: 439879 - RNA, 22 nt, Human
aggcuccaugcaaaggcuguuu

SEQ ID NO: 439880 - RNA, 23 nt, Human
agagggagauguuuuucucaaga

SEQ ID NO: 439881 - RNA, 22 nt, Human
agccauuguugucuucaucuuc

SEQ ID NO: 439882 - RNA, 22 nt, Human
aaacugcaaugacagguaggag

SEQ ID NO: 439883 - RNA, 22 nt, Human
uaugacaagguggaguaugagu

SEQ ID NO: 439884 - RNA, 22 nt, Human
uggcagggucuugcuguguugc

SEQ ID NO: 439885 - RNA, 22 nt, Human
ggcucagcaaugaugagccccu

SEQ ID NO: 439886 - RNA, 19 nt, Human
caucuggaugauucuccug

SEQ ID NO: 439887 - RNA, 22 nt, Human
agcuccugugugcccaccugcu

SEQ ID NO: 439888 - RNA, 22 nt, Human
cuccuccagugggucccucagg

SEQ ID NO: 439889 - RNA, 22 nt, Human
ggcaggcuccaagcauccuaug

SEQ ID NO: 439890 - RNA, 23 nt, Human
gcucagagguuuuucucuggaug

SEQ ID NO: 439891 - RNA, 22 nt, Human
agugcacaccuuaguacaaagu

SEQ ID NO: 439892 - RNA, 22 nt, Human
gaaguuccucguaggagucucu

SEQ ID NO: 439893 - RNA, 22 nt, Human
ucacauuuguuccucugcacuu

SEQ ID NO: 439894 - RNA, 22 nt, Human
uagacagauuucuuguuagaca

SEQ ID NO: 439895 - RNA, 22 nt, Human
aggcccaguuauccuacuuguu

SEQ ID NO: 439896 - RNA, 22 nt, Human
ugggaugauagguaaguaauua

SEQ ID NO: 439897 - RNA, 18 nt, Human
uaacauguuuucauuaag

SEQ ID NO: 439898 - RNA, 22 nt, Human
uccaggcaugucugaguccuuc

SEQ ID NO: 439899 - RNA, 22 nt, Human
uacugcauuaucaaggggaagg

SEQ ID NO: 439900 - RNA, 22 nt, Human
uagaguccugugugcucugugg

SEQ ID NO: 439901 - RNA, 22 nt, Human
gguggcagaggugcaucagccc

SEQ ID NO: 439902 - RNA, 22 nt, Human
augucaaaucaguuuuaucaga

SEQ ID NO: 439903 - RNA, 22 nt, Human
ucaaauaccagcuuuuccagaa

SEQ ID NO: 439904 - RNA, 22 nt, Human
acaugaggugcuauaggucuac

SEQ ID NO: 439905 - RNA, 22 nt, Human
aggccuggccugggcggcauug

SEQ ID NO: 439906 - RNA, 22 nt, Human
gcacagccacguaaugugguca

SEQ ID NO: 439907 - RNA, 22 nt, Human
uguuugcauuguuaauucaguc

SEQ ID NO: 439908 - RNA, 22 nt, Human
uuucuccccagucuaaucugga

SEQ ID NO: 439909 - RNA, 22 nt, Human
acuugcucaaugcuugaagcca

SEQ ID NO: 439910 - RNA, 22 nt, Human
caggcugggaacgccacccgcu

SEQ ID NO: 439911 - RNA, 22 nt, Human
aauaauguuuauuuguauucuc

SEQ ID NO: 439912 - RNA, 22 nt, Human
agcugagcuaguaguuccagug

SEQ ID NO: 439913 - RNA, 22 nt, Human
aggcuaagaggccuucagauac

SEQ ID NO: 439914 - RNA, 22 nt, Human
caaacaucugcaccuugaccgg

SEQ ID NO: 439915 - RNA, 22 nt, Human
cagaaguaagauuacugugagu

SEQ ID NO: 439916 - RNA, 22 nt, Human
aguuuauuucuccauuuaccua

SEQ ID NO: 439917 - RNA, 22 nt, Human
uguaguguagcagggugggaca

SEQ ID NO: 439918 - RNA, 22 nt, Human
ugaacaaaugaaucaguguagc

SEQ ID NO: 439919 - RNA, 20 nt, Human
uccagcugucuuucagagac

SEQ ID NO: 439920 - RNA, 22 nt, Human
aggcaggaggaucauggaugca

SEQ ID NO: 439921 - RNA, 22 nt, Human
auccaguuccaaagaucauuua

SEQ ID NO: 439922 - RNA, 22 nt, Human
augcacaggcugugggcugguu

SEQ ID NO: 439923 - RNA, 22 nt, Human
gcugagguaggagguugcagug

SEQ ID NO: 439924 - RNA, 22 nt, Human
ugagacaguuuuucuauuucca

SEQ ID NO: 439925 - RNA, 22 nt, Human
auucuuuaguuggcuucuugcc

SEQ ID NO: 439926 - RNA, 22 nt, Human
uaaauucagugaguaauuucug

SEQ ID NO: 439927 - RNA, 22 nt, Human
gcucaugggcccagagcagccc

SEQ ID NO: 439928 - RNA, 22 nt, Human
ccagcagagcauggggaggaag

SEQ ID NO: 439929 - RNA, 22 nt, Human
cugcccaggcugaaggaacauc

SEQ ID NO: 439930 - RNA, 22 nt, Human
uguccuguucuugcuguguccu

SEQ ID NO: 439931 - RNA, 17 nt, Human
acacagagauuaacaca

SEQ ID NO: 439932 - RNA, 22 nt, Human
agaaggaguguacaggucaugc

SEQ ID NO: 439933 - RNA, 22 nt, Human
aagcccugauaggaaaaugcug

SEQ ID NO: 439934 - RNA, 22 nt, Human
guccugggcccaggggcugccu

SEQ ID NO: 439935 - RNA, 22 nt, Human
ugugccugucacccucagagag

SEQ ID NO: 439936 - RNA, 22 nt, Human
ucuggauggucagcucuuccug

SEQ ID NO: 439937 - RNA, 22 nt, Human
cugugccuuuguagcugugccu

SEQ ID NO: 439938 - RNA, 22 nt, Human
ugcaucauuuauaaugucuuug

SEQ ID NO: 439939 - RNA, 17 nt, Human
agcuccugcccauggcu

SEQ ID NO: 439940 - RNA, 22 nt, Human
gucugaggcgaggccugagaac

SEQ ID NO: 439941 - RNA, 21 nt, Human
ccagacuggccuaugugguag

SEQ ID NO: 439942 - RNA, 22 nt, Human
ccagaggggcugagcaggucac

SEQ ID NO: 439943 - RNA, 21 nt, Human
auucagaaagggaauaaacuc

SEQ ID NO: 439944 - RNA, 17 nt, Human
ucaggcugggugcagug

SEQ ID NO: 439945 - RNA, 22 nt, Human
acagcagggaauaugggaauug

SEQ ID NO: 439946 - RNA, 22 nt, Human
ucagaguuccucauagauccag

SEQ ID NO: 439947 - RNA, 23 nt, Human
ugugcacaucugacgggugaagg

SEQ ID NO: 439948 - RNA, 22 nt, Human
agcaacaggaccauggagccca

SEQ ID NO: 439949 - RNA, 22 nt, Human
caauuucucuuuauaucucaca

SEQ ID NO: 439950 - RNA, 22 nt, Human
uauuucaacguaugaaaagcug

SEQ ID NO: 439951 - RNA, 22 nt, Human
gaaguacaaaggacauggaaac

SEQ ID NO: 439952 - RNA, 22 nt, Human
cacaagauggucacauaagugc

SEQ ID NO: 439953 - RNA, 22 nt, Human
ugccaggcugucaauucaccca

SEQ ID NO: 439954 - RNA, 22 nt, Human
uaaggaaaguacauguuuugac

SEQ ID NO: 439955 - RNA, 22 nt, Human
agacuggguuugagacuuagca

SEQ ID NO: 439956 - RNA, 21 nt, Human
ccccugggagcccugucagua

SEQ ID NO: 439957 - RNA, 22 nt, Human
cuccugggagcagggauggaug

SEQ ID NO: 439958 - RNA, 22 nt, Human
uuccaugaaauguguuaugcuu

SEQ ID NO: 439959 - RNA, 22 nt, Human
augucuuucucauacaagccca

SEQ ID NO: 439960 - RNA, 22 nt, Human
ccagagugacgugaagugugaa

SEQ ID NO: 439961 - RNA, 22 nt, Human
ucaaauaccagcaauuucaugu

SEQ ID NO: 439962 - RNA, 22 nt, Human
gccugggagugcacagugaggu

SEQ ID NO: 439963 - RNA, 22 nt, Human
agaggccuccgaaaggugggcu

SEQ ID NO: 439964 - RNA, 20 nt, Human
gcaacuagggagacacagcu

SEQ ID NO: 439965 - RNA, 22 nt, Human
ucaaaauucuagggagaauggu

SEQ ID NO: 439966 - RNA, 22 nt, Human
aacuuugcaagggggcccugcg

SEQ ID NO: 439967 - RNA, 22 nt, Human
aaggaagagucuagaacaggca

SEQ ID NO: 439968 - RNA, 22 nt, Human
uaacacuuuggauuaaaauucu

SEQ ID NO: 439969 - RNA, 20 nt, Human
aguacaauguaugauucaga

SEQ ID NO: 439970 - RNA, 22 nt, Human
caugcagccugugaacaguguc

SEQ ID NO: 439971 - RNA, 22 nt, Human
ucuuuuuuuccugugcagagcu

SEQ ID NO: 439972 - RNA, 22 nt, Human
uccccagacagcgggaggccug

SEQ ID NO: 439973 - RNA, 22 nt, Human
cccuuucuccagaacugucuga

SEQ ID NO: 439974 - RNA, 22 nt, Human
gggccuggggacaccaccauga

SEQ ID NO: 439975 - RNA, 22 nt, Human
gccccagauggaggaagcuggg

SEQ ID NO: 439976 - RNA, 22 nt, Human
auaauggcuugugguguuauuc

SEQ ID NO: 439977 - RNA, 22 nt, Human
agucugaguaucucugagccag

SEQ ID NO: 439978 - RNA, 22 nt, Human
gucuccucuucauauaccuguu

SEQ ID NO: 439979 - RNA, 22 nt, Human
uucccugguuaaccauuuucug

SEQ ID NO: 439980 - RNA, 22 nt, Human
uuaauacagucuccagaaguaa

SEQ ID NO: 439981 - RNA, 22 nt, Human
uguacaaauucauugaacugua

SEQ ID NO: 439982 - RNA, 22 nt, Human
acuauugcaauacgugucagca

SEQ ID NO: 439983 - RNA, 22 nt, Human
cacugugggguuuggcuggaac

SEQ ID NO: 439984 - RNA, 22 nt, Human
uuauagaaggagcauucacuua

SEQ ID NO: 439985 - RNA, 22 nt, Human
aaagcacagggugcuagagagu

SEQ ID NO: 439986 - RNA, 22 nt, Human
acaggcccagcucuucaccaga

SEQ ID NO: 439987 - RNA, 22 nt, Human
gauuucuaguaagucaugaagg

SEQ ID NO: 439988 - RNA, 22 nt, Human
uuuuuacagucauggucacuca

SEQ ID NO: 439989 - RNA, 21 nt, Human
guuuacaaggcuuugcuccug

SEQ ID NO: 439990 - RNA, 22 nt, Human
uggcccaggucucucugagccc

SEQ ID NO: 439991 - RNA, 22 nt, Human
gcagcagcccagggcucucaga

SEQ ID NO: 439992 - RNA, 22 nt, Human
cugucaguucuuccagauagag

SEQ ID NO: 439993 - RNA, 19 nt, Human
auguaccauuugaaguucu

SEQ ID NO: 439994 - RNA, 21 nt, Human
agagacugucacugcaguacc

SEQ ID NO: 439995 - RNA, 22 nt, Human
gcaggagaaaugaagauugggu

SEQ ID NO: 439996 - RNA, 22 nt, Human
gaaggcaacaccaggaugcacu

SEQ ID NO: 439997 - RNA, 22 nt, Human
ccucucccacguggcagaggcu

SEQ ID NO: 439998 - RNA, 21 nt, Human
cccuucuugggucaaaguaua

SEQ ID NO: 439999 - RNA, 22 nt, Human
aaagagaaacuuagaagccuga

SEQ ID NO: 440000 - RNA, 22 nt, Human
cacagggaaccaaggcugggcc

SEQ ID NO: 440001 - RNA, 22 nt, Human
cugaggcugggcauggggucca

SEQ ID NO: 440002 - RNA, 22 nt, Human
ucaccagggcuccagccagccu

SEQ ID NO: 440003 - RNA, 23 nt, Human
ugcauuauccucucugaagacca

SEQ ID NO: 440004 - RNA, 22 nt, Human
ucuagaugaaugugaggauauc

SEQ ID NO: 440005 - RNA, 22 nt, Human
ucaggaaagguuuguugaaugg

SEQ ID NO: 440006 - RNA, 22 nt, Human
cagcaaagcuuaauuuauaucu

SEQ ID NO: 440007 - RNA, 22 nt, Human
cagcccugcagagggcgcuccu

SEQ ID NO: 440008 - RNA, 22 nt, Human
agggccuggaacuggagaccac

SEQ ID NO: 440009 - RNA, 22 nt, Human
uuacaguuuaguccaagccaga

SEQ ID NO: 440010 - RNA, 22 nt, Human
uucucccaucucagucuuacau

SEQ ID NO: 440011 - RNA, 22 nt, Human
cacaguauucacugggcagauu

SEQ ID NO: 440012 - RNA, 22 nt, Human
ggcagcagggcugucucccuac

SEQ ID NO: 440013 - RNA, 22 nt, Human
caggcagagacgucaguguagg

SEQ ID NO: 440014 - RNA, 22 nt, Human
gucuuaccgcaccucaugaacu

SEQ ID NO: 440015 - RNA, 22 nt, Human
ccuggcagcuguuuggcuuggc

SEQ ID NO: 440016 - RNA, 23 nt, Human
agcuucugguucaggucaagcag

SEQ ID NO: 440017 - RNA, 22 nt, Human
gcagggcagaaggugcugagga

SEQ ID NO: 440018 - RNA, 22 nt, Human
acaccauacucauguugguucc

SEQ ID NO: 440019 - RNA, 22 nt, Human
gauuucuaaguuuuaccacaaa

SEQ ID NO: 440020 - RNA, 22 nt, Human
uggaagcucaaggcagggugag

SEQ ID NO: 440021 - RNA, 21 nt, Human
aaaauguagacuuuucccuga

SEQ ID NO: 440022 - RNA, 22 nt, Human
cagagucagagcuccauggagu

SEQ ID NO: 440023 - RNA, 22 nt, Human
ccagggugugagaaggaaguag

SEQ ID NO: 440024 - RNA, 22 nt, Human
augcccugggagugcuguacca

SEQ ID NO: 440025 - RNA, 22 nt, Human
uccugugugggcaggaugagaa

SEQ ID NO: 440026 - RNA, 22 nt, Human
uuccaugacugaagcaggggcg

SEQ ID NO: 440027 - RNA, 23 nt, Human
uuauugcaagguaaaauugcuga

SEQ ID NO: 440028 - RNA, 22 nt, Human
gucuggcuuuauauuugcuauu

SEQ ID NO: 440029 - RNA, 22 nt, Human
caagagcuggagaggcagucua

SEQ ID NO: 440030 - RNA, 22 nt, Human
uucuagaauccuugucuacuuu

SEQ ID NO: 440031 - RNA, 22 nt, Human
uggcagccuggaaucucucagc

SEQ ID NO: 440032 - RNA, 22 nt, Human
cggucaggugcagcguuggcac

SEQ ID NO: 440033 - RNA, 22 nt, Human
ucuggccagugaaaugcagaau

SEQ ID NO: 440034 - RNA, 22 nt, Human
uuucucccagucuccugagaca

SEQ ID NO: 440035 - RNA, 22 nt, Human
aaggcacaacacaagaggguga

SEQ ID NO: 440036 - RNA, 22 nt, Human
ccugggcugcaugauggcauuu

SEQ ID NO: 440037 - RNA, 21 nt, Human
uacaagauagagguaauauau

SEQ ID NO: 440038 - RNA, 22 nt, Human
ucaugcaggacuuacaagagau

SEQ ID NO: 440039 - RNA, 22 nt, Human
ucucuucccuuuaugguaugug

SEQ ID NO: 440040 - RNA, 22 nt, Human
accacagaggaauuugaagagg

SEQ ID NO: 440041 - RNA, 21 nt, Human
uggcacugcuuagcagguucc

SEQ ID NO: 440042 - RNA, 22 nt, Human
aaggacugaauaauucucuuuc

SEQ ID NO: 440043 - RNA, 22 nt, Human
gccuugggccagcugcucugga

SEQ ID NO: 440044 - RNA, 22 nt, Human
uuugcuuugacugucagcaagu

SEQ ID NO: 440045 - RNA, 22 nt, Human
uugucaaauccuugucaucugc

SEQ ID NO: 440046 - RNA, 17 nt, Human
ggcagcugugugcaugc

SEQ ID NO: 440047 - RNA, 22 nt, Human
uggcaggaaggagacucagccc

SEQ ID NO: 440048 - RNA, 22 nt, Human
ucuuggaaucuccauagaguga

SEQ ID NO: 440049 - RNA, 22 nt, Human
ucuaaacuaggguuaaaggaaa

SEQ ID NO: 440050 - RNA, 22 nt, Human
gugcccuggagggguugaaggg

SEQ ID NO: 440051 - RNA, 22 nt, Human
ucaggcuguuagccaccuccuc

SEQ ID NO: 440052 - RNA, 22 nt, Human
agcaaauuaggucaaggagaug

SEQ ID NO: 440053 - RNA, 21 nt, Human
ggcagcccgcccucuccuggc

SEQ ID NO: 440054 - RNA, 22 nt, Human
agagaaucuagaauguuuauac

SEQ ID NO: 440055 - RNA, 22 nt, Human
acaggccuggugcugcugacag

SEQ ID NO: 440056 - RNA, 22 nt, Human
uuaguugaucauucaacauggg

SEQ ID NO: 440057 - RNA, 18 nt, Human
gcagggacacagggucac

SEQ ID NO: 440058 - RNA, 23 nt, Human
gaagucagcccuacagagagcag

SEQ ID NO: 440059 - RNA, 22 nt, Human
gcagccagaagacucagaacaa

SEQ ID NO: 440060 - RNA, 22 nt, Human
ucagaggauagaaauacuuauu

SEQ ID NO: 440061 - RNA, 22 nt, Human
agcaggaggguuuuguagaguc

SEQ ID NO: 440062 - RNA, 22 nt, Human
aaggagcugggagggacacaug

SEQ ID NO: 440063 - RNA, 22 nt, Human
ucccagaggucucugcugguuc

SEQ ID NO: 440064 - RNA, 22 nt, Human
auguggcuccuuacucaucagc

SEQ ID NO: 440065 - RNA, 22 nt, Human
aaauucagcagugaaaugcccc

SEQ ID NO: 440066 - RNA, 22 nt, Human
gcccauggacacccaagugcca

SEQ ID NO: 440067 - RNA, 19 nt, Human
guucaaacacugauucagc

SEQ ID NO: 440068 - RNA, 22 nt, Human
aaaucucaguguucuaagcauu

SEQ ID NO: 440069 - RNA, 22 nt, Human
auuuguuucagggccuugguau

SEQ ID NO: 440070 - RNA, 22 nt, Human
ucagaauuacacagggccuuga

SEQ ID NO: 440071 - RNA, 22 nt, Human
ugguacaauuaaaauaauuuug

SEQ ID NO: 440072 - RNA, 22 nt, Human
ggcuuugcuuuggcuguuucag

SEQ ID NO: 440073 - RNA, 22 nt, Human
ccagcucuagccccauguggcu

SEQ ID NO: 440074 - RNA, 22 nt, Human
augcauaugccguagaauaagu

SEQ ID NO: 440075 - RNA, 22 nt, Human
aagucacaagcauauaugcauu

SEQ ID NO: 440076 - RNA, 22 nt, Human
gcagacagccagacugcacugg

SEQ ID NO: 440077 - RNA, 22 nt, Human
ccagggugugggcgucggcacg

SEQ ID NO: 440078 - RNA, 22 nt, Human
cugggaggcacuauucaggagg

SEQ ID NO: 440079 - RNA, 22 nt, Human
ggugagaaagggauuccuguuc

SEQ ID NO: 440080 - RNA, 22 nt, Human
cucugggcuccuucagcccuuu

SEQ ID NO: 440081 - RNA, 22 nt, Human
cuuauaaaguccaucugaacaa

SEQ ID NO: 440082 - RNA, 22 nt, Human
gaggcaguggucugaugcaagg

SEQ ID NO: 440083 - RNA, 22 nt, Human
uuugugaacaaacaugaagaug

SEQ ID NO: 440084 - RNA, 22 nt, Human
agcuggugaggguugaggggua

SEQ ID NO: 440085 - RNA, 22 nt, Human
auuaaggcguuggcgugcuuau

SEQ ID NO: 440086 - RNA, 22 nt, Human
uacuuucuagcucuccccaguu

SEQ ID NO: 440087 - RNA, 22 nt, Human
gcaacagcauucucauugacau

SEQ ID NO: 440088 - RNA, 19 nt, Human
uccugggcugggccagguc

SEQ ID NO: 440089 - RNA, 22 nt, Human
ugggcagaguagcucagaagaa

SEQ ID NO: 440090 - RNA, 22 nt, Human
gacauucauugaugucuuccuc

SEQ ID NO: 440091 - RNA, 22 nt, Human
aaggcuggaguacagugcagug

SEQ ID NO: 440092 - RNA, 22 nt, Human
cagagcuguugcggggcuuggc

SEQ ID NO: 440093 - RNA, 22 nt, Human
cagucccaaggaggaagcaguc

SEQ ID NO: 440094 - RNA, 22 nt, Human
gcagagcugucuaagucacuuc

SEQ ID NO: 440095 - RNA, 22 nt, Human
ucaggaagugguaaaggauguu

SEQ ID NO: 440096 - RNA, 22 nt, Human
ugccagccuccugauaucaucc

SEQ ID NO: 440097 - RNA, 22 nt, Human
cagggagcacugcgagcggcag

SEQ ID NO: 440098 - RNA, 20 nt, Human
acacaguagcaauuagugca

SEQ ID NO: 440099 - RNA, 20 nt, Human
aggaggaaaaaaugacgagc

SEQ ID NO: 440100 - RNA, 22 nt, Human
uauauucaaugauuaguaucag

SEQ ID NO: 440101 - RNA, 22 nt, Human
gcuguuucuugaggcuacuccu

SEQ ID NO: 440102 - RNA, 22 nt, Human
cagcccaggacugcagguguuu

SEQ ID NO: 440103 - RNA, 22 nt, Human
acuaaugauuauugucauugug

SEQ ID NO: 440104 - RNA, 22 nt, Human
ccacaaguuucagcacccagag

SEQ ID NO: 440105 - RNA, 21 nt, Human
agcaggcuuuggaguggggcu

SEQ ID NO: 440106 - RNA, 22 nt, Human
uccaccagcagccugucagccu

SEQ ID NO: 440107 - RNA, 22 nt, Human
aaggcagagggcuggaucagag

SEQ ID NO: 440108 - RNA, 22 nt, Human
uucuggauagggguauggagcu

SEQ ID NO: 440109 - RNA, 22 nt, Human
gucugggcucccagggucggcg

SEQ ID NO: 440110 - RNA, 22 nt, Human
cagcugccccuccagggcuggg

SEQ ID NO: 440111 - RNA, 22 nt, Human
gcaugcaggaagggcuugggga

SEQ ID NO: 440112 - RNA, 22 nt, Human
uccccaccuacacacugcuccu

SEQ ID NO: 440113 - RNA, 22 nt, Human
ugcagcccuuccuuccucuggg

SEQ ID NO: 440114 - RNA, 22 nt, Human
uaggccaguggcagguugugug

SEQ ID NO: 440115 - RNA, 22 nt, Human
uuuucuaagggaaacguccucc

SEQ ID NO: 440116 - RNA, 22 nt, Human
guggccucuguuggcuccuagg

SEQ ID NO: 440117 - RNA, 22 nt, Human
gagcugaggccagagucuucug

SEQ ID NO: 440118 - RNA, 22 nt, Human
aaauuuuaguaaggaaguugag

SEQ ID NO: 440119 - RNA, 22 nt, Human
agaggccaccacugucagggac

SEQ ID NO: 440120 - RNA, 22 nt, Human
aauuuuacauaggggauauggg

SEQ ID NO: 440121 - RNA, 22 nt, Human
uguauuucgcuagguacucccu

SEQ ID NO: 440122 - RNA, 22 nt, Human
aacagaaaucauuuagggcucu

SEQ ID NO: 440123 - RNA, 22 nt, Human
uggagcugagaaguggagcucu

SEQ ID NO: 440124 - RNA, 22 nt, Human
ucugggcugucuacagguuggc

SEQ ID NO: 440125 - RNA, 22 nt, Human
uuccugaauugagcuuuagaaa

SEQ ID NO: 440126 - RNA, 22 nt, Human
ccaggaaggcaggccuccccgc

SEQ ID NO: 440127 - RNA, 22 nt, Human
acaugaaaagacuaucugauua

SEQ ID NO: 440128 - RNA, 22 nt, Human
gaaggcaagcagcauaaauguc

SEQ ID NO: 440129 - RNA, 22 nt, Human
caggccucuauggucagcugag

SEQ ID NO: 440130 - RNA, 19 nt, Human
gccaggcuccauagccggc

SEQ ID NO: 440131 - RNA, 22 nt, Human
uggaguccccgagaggccugca

SEQ ID NO: 440132 - RNA, 22 nt, Human
ucaagacauauuaaaugugcga

SEQ ID NO: 440133 - RNA, 22 nt, Human
acaggaguuucugacagagaca

SEQ ID NO: 440134 - RNA, 22 nt, Human
uaugacauuuucccagauuuau

SEQ ID NO: 440135 - RNA, 22 nt, Human
aagcugccugccacgcuagaua

SEQ ID NO: 440136 - RNA, 22 nt, Human
cugggacacccaaggaaagagc

SEQ ID NO: 440137 - RNA, 22 nt, Human
agcagacauaucucaugucaca

SEQ ID NO: 440138 - RNA, 22 nt, Human
ggagaagcagcuucuugaugaa

SEQ ID NO: 440139 - RNA, 22 nt, Human
gaggcagcauucgcauagacag

SEQ ID NO: 440140 - RNA, 22 nt, Human
gagggcucaacuacuacuaggc

SEQ ID NO: 440141 - RNA, 22 nt, Human
cuggccagcauuuuugcuuuag

SEQ ID NO: 440142 - RNA, 22 nt, Human
aaauacucucaauaaagaaagu

SEQ ID NO: 440143 - RNA, 22 nt, Human
ggcggcccugcacgugcugagg

SEQ ID NO: 440144 - RNA, 22 nt, Human
ccaggccugcaucugcugcgca

SEQ ID NO: 440145 - RNA, 22 nt, Human
ucauuguuucugcuuuucauga

SEQ ID NO: 440146 - RNA, 22 nt, Human
auuauucaacacuugagaaauu

SEQ ID NO: 440147 - RNA, 22 nt, Human
cucacugucuguacuagcugau

SEQ ID NO: 440148 - RNA, 22 nt, Human
cagccagcugaauguaccauga

SEQ ID NO: 440149 - RNA, 22 nt, Human
uauuccaaaaucccaaacugcc

SEQ ID NO: 440150 - RNA, 23 nt, Human
gaggcuugaucagcuuccuccac

SEQ ID NO: 440151 - RNA, 21 nt, Human
aaugaugaaagaugacagagu

SEQ ID NO: 440152 - RNA, 22 nt, Human
gcuggugcucugggcccugagg

SEQ ID NO: 440153 - RNA, 22 nt, Human
ccagcccugaacccugcugcau

SEQ ID NO: 440154 - RNA, 22 nt, Human
caaaggaaauacuaaucuggaa

SEQ ID NO: 440155 - RNA, 22 nt, Human
cugcccuguaucuucucccaau

SEQ ID NO: 440156 - RNA, 22 nt, Human
ugcugcagcuaaggugaggugc

SEQ ID NO: 440157 - RNA, 22 nt, Human
aaaguguugggaagaaagugca

SEQ ID NO: 440158 - RNA, 22 nt, Human
agcaguggcuggauggugugcu

SEQ ID NO: 440159 - RNA, 22 nt, Human
cuccauggggaaaugaaggugg

SEQ ID NO: 440160 - RNA, 21 nt, Human
ugcaggcaggcagagaugcug

SEQ ID NO: 440161 - RNA, 22 nt, Human
ccugggagagccaucuguggcc

SEQ ID NO: 440162 - RNA, 22 nt, Human
uggagcagagaugggagcccaa

SEQ ID NO: 440163 - RNA, 22 nt, Human
uucacaacugccauagccagug

SEQ ID NO: 440164 - RNA, 22 nt, Human
cagcuguggcugccacugcucc

SEQ ID NO: 440165 - RNA, 22 nt, Human
agcagguggauuuagacgggag

SEQ ID NO: 440166 - RNA, 22 nt, Human
gagagcacggucuugggcaugg

SEQ ID NO: 440167 - RNA, 22 nt, Human
gccagcaguccugcugugugcc

SEQ ID NO: 440168 - RNA, 21 nt, Human
uucaauacuauuucaauaguc

SEQ ID NO: 440169 - RNA, 22 nt, Human
aggcugagauagguggaucauu

SEQ ID NO: 440170 - RNA, 22 nt, Human
ccagccuggacugggucuugug

SEQ ID NO: 440171 - RNA, 22 nt, Human
gcaggcaguuauuuaguagaau

SEQ ID NO: 440172 - RNA, 22 nt, Human
auuuuaacccucuuauauauac

SEQ ID NO: 440173 - RNA, 22 nt, Human
agcacagguaauacagaguaac

SEQ ID NO: 440174 - RNA, 22 nt, Human
cauucaaaagcuccauguuugu

SEQ ID NO: 440175 - RNA, 22 nt, Human
cuuggcuguugggcauugagaa

SEQ ID NO: 440176 - RNA, 22 nt, Human
ugggugggagcacccugucugg

SEQ ID NO: 440177 - RNA, 23 nt, Human
ccagcccuccaccagcucuaggc

SEQ ID NO: 440178 - RNA, 22 nt, Human
guggccagucccgaugcuuguu

SEQ ID NO: 440179 - RNA, 22 nt, Human
guggcaggucccauuggagcag

SEQ ID NO: 440180 - RNA, 22 nt, Human
acuuagcagguggugacucgaa

SEQ ID NO: 440181 - RNA, 22 nt, Human
ugcauugagucauuucaguaug

SEQ ID NO: 440182 - RNA, 22 nt, Human
auucaacauauucugaguaaaa

SEQ ID NO: 440183 - RNA, 22 nt, Human
uggcucaggggucuggcucugu

SEQ ID NO: 440184 - RNA, 22 nt, Human
aaguuuuugauucuaagagaga

SEQ ID NO: 440185 - RNA, 22 nt, Human
cauuuuaccuagaagcugaaag

SEQ ID NO: 440186 - RNA, 22 nt, Human
uugugagcaggcugcacaaacc

SEQ ID NO: 440187 - RNA, 22 nt, Human
uuggcuuuagaccugagacugu

SEQ ID NO: 440188 - RNA, 22 nt, Human
ccacagcugaccgcaggugagc

SEQ ID NO: 440189 - RNA, 22 nt, Human
ucucccagaggaucccagugga

SEQ ID NO: 440190 - RNA, 22 nt, Human
gagggaaggacccauuuuaagu

SEQ ID NO: 440191 - RNA, 22 nt, Human
ugcagccaggaaauauuugcug

SEQ ID NO: 440192 - RNA, 22 nt, Human
acuuugcaaauaaacucucuaa

SEQ ID NO: 440193 - RNA, 22 nt, Human
ugagacagggucuugcucuguu

SEQ ID NO: 440194 - RNA, 19 nt, Human
uggcauugguccagauaaa

SEQ ID NO: 440195 - RNA, 22 nt, Human
uagaaaagccccagcuggaggg

SEQ ID NO: 440196 - RNA, 22 nt, Human
cugcccuggccacugugcccag

SEQ ID NO: 440197 - RNA, 22 nt, Human
cagggccacuguagaugaggag

SEQ ID NO: 440198 - RNA, 22 nt, Human
uuugggcaggcuuuucccuaga

SEQ ID NO: 440199 - RNA, 22 nt, Human
uucagaaugacuuauguaaggc

SEQ ID NO: 440200 - RNA, 22 nt, Human
ugaacacacacaucuuaauaau

SEQ ID NO: 440201 - RNA, 22 nt, Human
uuuguguguauauguauauaga

SEQ ID NO: 440202 - RNA, 22 nt, Human
ccacagagagugucagccuuug

SEQ ID NO: 440203 - RNA, 22 nt, Human
ucagcuggugccacucagucaa

SEQ ID NO: 440204 - RNA, 19 nt, Human
aaaguugagaaacaaugga

SEQ ID NO: 440205 - RNA, 20 nt, Human
uauuuagauucaaguaugga

SEQ ID NO: 440206 - RNA, 22 nt, Human
uggccugggccggcagauauac

SEQ ID NO: 440207 - RNA, 22 nt, Human
acaaaauuguguuaaacuuuau

SEQ ID NO: 440208 - RNA, 22 nt, Human
acaggcugguuuguaaaagaug

SEQ ID NO: 440209 - RNA, 23 nt, Human
gccugggacugguagugugaccu

SEQ ID NO: 440210 - RNA, 22 nt, Human
aucuaagauuuugcuaagauca

SEQ ID NO: 440211 - RNA, 22 nt, Human
ccauucaauaccuuagagaaaa

SEQ ID NO: 440212 - RNA, 22 nt, Human
cugggucugggccuccuggagu

SEQ ID NO: 440213 - RNA, 22 nt, Human
agaccagcugccucccagggcc

SEQ ID NO: 440214 - RNA, 22 nt, Human
gcaggcucccuugcagagcagg

SEQ ID NO: 440215 - RNA, 22 nt, Human
uuguacaaauaggaaccucuga

SEQ ID NO: 440216 - RNA, 22 nt, Human
agccucugcuggcccuggcacu

SEQ ID NO: 440217 - RNA, 22 nt, Human
ccuuugcaauccuguaggccuu

SEQ ID NO: 440218 - RNA, 19 nt, Human
ugccagcauuaggcugaag

SEQ ID NO: 440219 - RNA, 22 nt, Human
cggacaggcuccuggagcuccu

SEQ ID NO: 440220 - RNA, 22 nt, Human
cucuuuuaauugucauaacaac

SEQ ID NO: 440221 - RNA, 22 nt, Human
agugucugaaccaccggggcau

SEQ ID NO: 440222 - RNA, 21 nt, Human
accagucccuagucuuauccu

SEQ ID NO: 440223 - RNA, 20 nt, Human
ucugugugccaucaccuaac

SEQ ID NO: 440224 - RNA, 21 nt, Human
ucaugcaggcagaguuuggua

SEQ ID NO: 440225 - RNA, 20 nt, Human
aucaaaggcugauucagucc

SEQ ID NO: 440226 - RNA, 22 nt, Human
aaggccugggaggccucucuuc

SEQ ID NO: 440227 - RNA, 22 nt, Human
gcaauaaaguagcagcucauca

SEQ ID NO: 440228 - RNA, 22 nt, Human
uacaggcaugaaugaaaucugu

SEQ ID NO: 440229 - RNA, 22 nt, Human
ucagaggagaccaaggggaaua

SEQ ID NO: 440230 - RNA, 22 nt, Human
ucagcagggaggcucugugccc

SEQ ID NO: 440231 - RNA, 22 nt, Human
ucagaagacuacuaggacacau

SEQ ID NO: 440232 - RNA, 21 nt, Human
uucuucuuggacuguuuuggc

SEQ ID NO: 440233 - RNA, 22 nt, Human
uggagcagcaucacuuugagcu

SEQ ID NO: 440234 - RNA, 23 nt, Human
cuggcucuguagguggcauccuu

SEQ ID NO: 440235 - RNA, 22 nt, Human
gucuggaagcucuaggggagaa

SEQ ID NO: 440236 - RNA, 22 nt, Human
ugcagcagucagucaggccugg

SEQ ID NO: 440237 - RNA, 22 nt, Human
cacacaugaaucccuaguaccu

SEQ ID NO: 440238 - RNA, 22 nt, Human
aaacuccagugaauacuagaau

SEQ ID NO: 440239 - RNA, 22 nt, Human
cagggagccccaauuccaugcc

SEQ ID NO: 440240 - RNA, 22 nt, Human
agacacugauguucagcucaau

SEQ ID NO: 440241 - RNA, 22 nt, Human
gacagcagagcagacuaaugga

SEQ ID NO: 440242 - RNA, 22 nt, Human
uccagaggcagcugcggucagg

SEQ ID NO: 440243 - RNA, 22 nt, Human
auaaggcauauagucacuuuuu

SEQ ID NO: 440244 - RNA, 22 nt, Human
agcagcaggcuuaaggaaaagu

SEQ ID NO: 440245 - RNA, 22 nt, Human
gcaggaguuaggcgucguggau

SEQ ID NO: 440246 - RNA, 22 nt, Human
aguucaauagaaaaauauauua

SEQ ID NO: 440247 - RNA, 22 nt, Human
uaguuaaaauaauggagauguu

SEQ ID NO: 440248 - RNA, 22 nt, Human
uccccagggucccugcuuccau

SEQ ID NO: 440249 - RNA, 22 nt, Human
cuugaugaaugaccuggguggu

SEQ ID NO: 440250 - RNA, 22 nt, Human
gaggcuaaggugccagacgaau

SEQ ID NO: 440251 - RNA, 22 nt, Human
aaaugccucauuuucucucacu

SEQ ID NO: 440252 - RNA, 21 nt, Human
ggcugguguuuagcugugaua

SEQ ID NO: 440253 - RNA, 22 nt, Human
augauacaagcaaaacuaauca

SEQ ID NO: 440254 - RNA, 22 nt, Human
agcuggcugccuucuccuuagg

SEQ ID NO: 440255 - RNA, 22 nt, Human
aaggcagcacagcaacugcuca

SEQ ID NO: 440256 - RNA, 22 nt, Human
cugcaucuuagucaaaaucugu

SEQ ID NO: 440257 - RNA, 22 nt, Human
ugaggacauugagacuggagac

SEQ ID NO: 440258 - RNA, 22 nt, Human
ugcuucagcacuuugagagccu

SEQ ID NO: 440259 - RNA, 22 nt, Human
ggccuagggaguggccaugccu

SEQ ID NO: 440260 - RNA, 22 nt, Human
guccuuccugcagggauggaug

SEQ ID NO: 440261 - RNA, 22 nt, Human
aggaaaaauaaggcagcagggc

SEQ ID NO: 440262 - RNA, 22 nt, Human
cagcucccagagugaccagcag

SEQ ID NO: 440263 - RNA, 22 nt, Human
aguagaaaguugcaggaggaau

SEQ ID NO: 440264 - RNA, 22 nt, Human
uuugacaaauccuucagcaaug

SEQ ID NO: 440265 - RNA, 22 nt, Human
ccagcccuucccaacuggccag

SEQ ID NO: 440266 - RNA, 22 nt, Human
cccagugucaccaacaggacac

SEQ ID NO: 440267 - RNA, 18 nt, Human
gcagcugcaguuguagcu

SEQ ID NO: 440268 - RNA, 22 nt, Human
ccagcugcagguguuccagaug

SEQ ID NO: 440269 - RNA, 22 nt, Human
aauaaauguuuguuggauguuu

SEQ ID NO: 440270 - RNA, 22 nt, Human
aagcccugaccugagaguccgu

SEQ ID NO: 440271 - RNA, 22 nt, Human
gagcugcagcggcugacgcaac

SEQ ID NO: 440272 - RNA, 22 nt, Human
cccaggagcuucucucugccuc

SEQ ID NO: 440273 - RNA, 22 nt, Human
cugcagugcaagcccagaugga

SEQ ID NO: 440274 - RNA, 22 nt, Human
cagcagugcuucagugugagau

SEQ ID NO: 440275 - RNA, 22 nt, Human
ucagaggagaaguugggaaaau

SEQ ID NO: 440276 - RNA, 22 nt, Human
uucacauaggagcaugguuuuu

SEQ ID NO: 440277 - RNA, 22 nt, Human
cuguggcuuucucugccuccuu

SEQ ID NO: 440278 - RNA, 22 nt, Human
ugcaggcuguaaucugaggcua

SEQ ID NO: 440279 - RNA, 22 nt, Human
uuguacaaaugcauauuccugg

SEQ ID NO: 440280 - RNA, 22 nt, Human
cauuaaauuccuuguucucaaa

SEQ ID NO: 440281 - RNA, 22 nt, Human
aguuuacaugacguguauuuca

SEQ ID NO: 440282 - RNA, 22 nt, Human
uuaugcaaggacuuauuacagu

SEQ ID NO: 440283 - RNA, 22 nt, Human
gcuguuucugugguguauagcc

SEQ ID NO: 440284 - RNA, 21 nt, Human
agcaggcaaaggugaagucuu

SEQ ID NO: 440285 - RNA, 23 nt, Human
uucauauguugcugaaaacagca

SEQ ID NO: 440286 - RNA, 23 nt, Human
cagcucagcacauaggagguacu

SEQ ID NO: 440287 - RNA, 20 nt, Human
uguguguguacuucuaaaua

SEQ ID NO: 440288 - RNA, 22 nt, Human
uaaaggcaaacucuccaaggau

SEQ ID NO: 440289 - RNA, 22 nt, Human
agggcacaggcuccggguccag

SEQ ID NO: 440290 - RNA, 22 nt, Human
uauuuuacagacuacuuuagau

SEQ ID NO: 440291 - RNA, 22 nt, Human
aggggcacuucucaggcugugg

SEQ ID NO: 440292 - RNA, 22 nt, Human
cuucuuauuaauccuucucugu

SEQ ID NO: 440293 - RNA, 22 nt, Human
agccuucuaggaugucaucugc

SEQ ID NO: 440294 - RNA, 22 nt, Human
uuaaauuuuagaaacagacucu

SEQ ID NO: 440295 - RNA, 22 nt, Human
guuuacaacaugccaacugggc

SEQ ID NO: 440296 - RNA, 22 nt, Human
uggaaggaagccaaggaagguu

SEQ ID NO: 440297 - RNA, 22 nt, Human
agagccugugauugucaucacc

SEQ ID NO: 440298 - RNA, 22 nt, Human
agcuagagaaugacagagucug

SEQ ID NO: 440299 - RNA, 22 nt, Human
gcacagccugucccuguccugg

SEQ ID NO: 440300 - RNA, 22 nt, Human
acaggaaagagcuaggcauagg

SEQ ID NO: 440301 - RNA, 22 nt, Human
ucuuugcaaacuauggagugug

SEQ ID NO: 440302 - RNA, 22 nt, Human
ggcucuggcguccaauggagcg

SEQ ID NO: 440303 - RNA, 22 nt, Human
cccaggagaccugugaaaggac

SEQ ID NO: 440304 - RNA, 19 nt, Human
agcagcuguagauagacac

SEQ ID NO: 440305 - RNA, 22 nt, Human
ccugccugauuccaggauggcu

SEQ ID NO: 440306 - RNA, 22 nt, Human
uuaagacauucagauauuucua

SEQ ID NO: 440307 - RNA, 22 nt, Human
uggagcccaggagaggauaaac

SEQ ID NO: 440308 - RNA, 22 nt, Human
agagugcuagccugagggaggu

SEQ ID NO: 440309 - RNA, 21 nt, Human
agcugccacccuagcuucuga

SEQ ID NO: 440310 - RNA, 22 nt, Human
uauucccacuccucagcaauuu

SEQ ID NO: 440311 - RNA, 22 nt, Human
gaguccugaauccuguggcaac

SEQ ID NO: 440312 - RNA, 22 nt, Human
ugagccugggagauggaggcug

SEQ ID NO: 440313 - RNA, 22 nt, Human
uggcaggcagugugggagcugg

SEQ ID NO: 440314 - RNA, 21 nt, Human
agucuucuccagaggcugggg

SEQ ID NO: 440315 - RNA, 22 nt, Human
cacagaggaaugcaucagcaga

SEQ ID NO: 440316 - RNA, 21 nt, Human
uacacaaagcgugguccagag

SEQ ID NO: 440317 - RNA, 22 nt, Human
ugggaacaccugcugcccagug

SEQ ID NO: 440318 - RNA, 22 nt, Human
accagcuguguccuggcugcag

SEQ ID NO: 440319 - RNA, 22 nt, Human
gaucaugcuggcugcccuguug

SEQ ID NO: 440320 - RNA, 22 nt, Human
cagagaacuccaguggcuggcg

SEQ ID NO: 440321 - RNA, 22 nt, Human
cagaguccugcaccagcuccag

SEQ ID NO: 440322 - RNA, 22 nt, Human
agcaggagcccuuaucaccagg

SEQ ID NO: 440323 - RNA, 22 nt, Human
acagcaauaggaaauacuugca

SEQ ID NO: 440324 - RNA, 22 nt, Human
aggagaggcaucaagaaaaucg

SEQ ID NO: 440325 - RNA, 22 nt, Human
caaauucaaauuucaucagugu

SEQ ID NO: 440326 - RNA, 22 nt, Human
ccugagcuggcagugaccugga

SEQ ID NO: 440327 - RNA, 22 nt, Human
cugaggcugggcugaggguaua

SEQ ID NO: 440328 - RNA, 22 nt, Human
acauggagaccagauggaagua

SEQ ID NO: 440329 - RNA, 22 nt, Human
caucuuuugguaggagccgggc

SEQ ID NO: 440330 - RNA, 22 nt, Human
ugugccagccucuggcuguguc

SEQ ID NO: 440331 - RNA, 22 nt, Human
ccucacuggccagccaggggug

SEQ ID NO: 440332 - RNA, 22 nt, Human
guuucagagguguucauuuuca

SEQ ID NO: 440333 - RNA, 22 nt, Human
gcagcaggcuuuucauaccuug

SEQ ID NO: 440334 - RNA, 22 nt, Human
ggcagggacuuugcaaaucuuu

SEQ ID NO: 440335 - RNA, 22 nt, Human
cuggcucucugagauauugagu

SEQ ID NO: 440336 - RNA, 21 nt, Human
gcugagagguugggaaguuca

SEQ ID NO: 440337 - RNA, 22 nt, Human
auauuacuuccugguauaaaau

SEQ ID NO: 440338 - RNA, 22 nt, Human
ccagcugcgggcaucgagaguu

SEQ ID NO: 440339 - RNA, 22 nt, Human
ccugggguauauaggugaauau

SEQ ID NO: 440340 - RNA, 22 nt, Human
gcagggucuugagaggcagcca

SEQ ID NO: 440341 - RNA, 22 nt, Human
cccuccucucccuaagagucac

SEQ ID NO: 440342 - RNA, 22 nt, Human
caggcagagcugaagauagaug

SEQ ID NO: 440343 - RNA, 22 nt, Human
augagggaggcaaggagaugcu

SEQ ID NO: 440344 - RNA, 19 nt, Human
gcagccaggugcucuaccu

SEQ ID NO: 440345 - RNA, 22 nt, Human
gagccgaggcgcacagcucggg

SEQ ID NO: 440346 - RNA, 22 nt, Human
agagcagcuggggcagagacca

SEQ ID NO: 440347 - RNA, 23 nt, Human
agacagaggcugaggcuggccgc

SEQ ID NO: 440348 - RNA, 22 nt, Human
uagagcuggaaaacugcaggua

SEQ ID NO: 440349 - RNA, 22 nt, Human
gcagucaguaaggcagccagaa

SEQ ID NO: 440350 - RNA, 22 nt, Human
cauccaaagcaaauaucuuaaa

SEQ ID NO: 440351 - RNA, 22 nt, Human
cugaagcuaggucaaaaaaggg

SEQ ID NO: 440352 - RNA, 22 nt, Human
uugugaauagugccgcaauaaa

SEQ ID NO: 440353 - RNA, 22 nt, Human
guuuuauaugucucugcugaca

SEQ ID NO: 440354 - RNA, 22 nt, Human
aggagcuggaguccaggcaagu

SEQ ID NO: 440355 - RNA, 22 nt, Human
ggcugcaggcuucccuccagca

SEQ ID NO: 440356 - RNA, 22 nt, Human
aacugcauuugcauaaguccau

SEQ ID NO: 440357 - RNA, 22 nt, Human
aucuagaagccugagccaagau

SEQ ID NO: 440358 - RNA, 22 nt, Human
aaggcagucaguuguuuugaaa

SEQ ID NO: 440359 - RNA, 22 nt, Human
ucuggccucuugggaugcuccc

SEQ ID NO: 440360 - RNA, 22 nt, Human
auuauccagcaccaaugucaga

SEQ ID NO: 440361 - RNA, 22 nt, Human
gccuggagugguccugcugccc

SEQ ID NO: 440362 - RNA, 22 nt, Human
uugauuuuaaaauagugacacu

SEQ ID NO: 440363 - RNA, 22 nt, Human
acauucaacauggcuggucuag

SEQ ID NO: 440364 - RNA, 23 nt, Human
ggcagcugggcagcacucauggg

SEQ ID NO: 440365 - RNA, 22 nt, Human
aagaacauuuuguagaaugaca

SEQ ID NO: 440366 - RNA, 22 nt, Human
uguaccauaggucuaucauucu

SEQ ID NO: 440367 - RNA, 22 nt, Human
aaguucaaggaagccuccaguu

SEQ ID NO: 440368 - RNA, 22 nt, Human
acagcagggggagcuguuggac

SEQ ID NO: 440369 - RNA, 22 nt, Human
aaugugaggccuugguaguuau

SEQ ID NO: 440370 - RNA, 20 nt, Human
cagccuccacucacucagcu

SEQ ID NO: 440371 - RNA, 22 nt, Human
gcacaggaugauggguugaggg

SEQ ID NO: 440372 - RNA, 22 nt, Human
ggcacagcuacuugcucacucu

SEQ ID NO: 440373 - RNA, 22 nt, Human
cuuaaauuggaugaguuaaguu

SEQ ID NO: 440374 - RNA, 22 nt, Human
auaaucuggucuuuguaugagu

SEQ ID NO: 440375 - RNA, 22 nt, Human
uaugugcauaugcauacacaca

SEQ ID NO: 440376 - RNA, 20 nt, Human
uugcaaagugaauagcaauu

SEQ ID NO: 440377 - RNA, 22 nt, Human
gagagcugggcuuugggugaag

SEQ ID NO: 440378 - RNA, 22 nt, Human
cuugcuuuugcugaugauuaag

SEQ ID NO: 440379 - RNA, 22 nt, Human
cagcugcccaggccaccuggag

SEQ ID NO: 440380 - RNA, 22 nt, Human
guccucaggcuugaguguuuau

SEQ ID NO: 440381 - RNA, 22 nt, Human
cauggcaggaaaaugaacaggc

SEQ ID NO: 440382 - RNA, 22 nt, Human
ggcuccaguuugugccuucagc

SEQ ID NO: 440383 - RNA, 22 nt, Human
aggaagcuuggggcagggcuac

SEQ ID NO: 440384 - RNA, 22 nt, Human
cauuucaccuuagagaauuauu

SEQ ID NO: 440385 - RNA, 22 nt, Human
gggcccagcacuggcugggauc

SEQ ID NO: 440386 - RNA, 22 nt, Human
auuccagagagguucuggaggu

SEQ ID NO: 440387 - RNA, 22 nt, Human
cugagccaaccacagcaggagc

SEQ ID NO: 440388 - RNA, 22 nt, Human
acacauuaucucauuaaauacu

SEQ ID NO: 440389 - RNA, 22 nt, Human
cacagggaggcagccaugcucc

SEQ ID NO: 440390 - RNA, 22 nt, Human
ucugaggcaaacagaggagugu

SEQ ID NO: 440391 - RNA, 22 nt, Human
gagaguggauggagcugcgaag

SEQ ID NO: 440392 - RNA, 22 nt, Human
uugaaugaauucuacuuccaga

SEQ ID NO: 440393 - RNA, 22 nt, Human
uccuccaggucuaggguggcuu

SEQ ID NO: 440394 - RNA, 22 nt, Human
uggagaggagcaccauggccau

SEQ ID NO: 440395 - RNA, 19 nt, Human
uacaggcaguuucuacaau

SEQ ID NO: 440396 - RNA, 22 nt, Human
ugagccuggcggaagcagcgug

SEQ ID NO: 440397 - RNA, 22 nt, Human
ucaggccuuugaacuuggagug

SEQ ID NO: 440398 - RNA, 22 nt, Human
ugcaggcagcugaaaggugccu

SEQ ID NO: 440399 - RNA, 22 nt, Human
caccacuucauaggcuuuaagg

SEQ ID NO: 440400 - RNA, 22 nt, Human
cugggaggugcagcaaaaauca

SEQ ID NO: 440401 - RNA, 22 nt, Human
uauagcaagcucuuuguaacca

SEQ ID NO: 440402 - RNA, 22 nt, Human
agcauucauugcuagaauguaa

SEQ ID NO: 440403 - RNA, 22 nt, Human
agacaggacacaagcugcauaa

SEQ ID NO: 440404 - RNA, 22 nt, Human
ugggcagagucauacaggagac

SEQ ID NO: 440405 - RNA, 22 nt, Human
ugaggucuguccugucuuugga

SEQ ID NO: 440406 - RNA, 22 nt, Human
ucccagagacagagccuccucc

SEQ ID NO: 440407 - RNA, 20 nt, Human
cugccgaccacagccaugga

SEQ ID NO: 440408 - RNA, 22 nt, Human
caacagaaggaagcagggucag

SEQ ID NO: 440409 - RNA, 22 nt, Human
aguugaaaauuaagugaauuuc

SEQ ID NO: 440410 - RNA, 21 nt, Human
gcagcaaaugacaacagugag

SEQ ID NO: 440411 - RNA, 22 nt, Human
uuuuuguucccagagaauuugu

SEQ ID NO: 440412 - RNA, 22 nt, Human
agaggaauguauuucccugcaa

SEQ ID NO: 440413 - RNA, 22 nt, Human
auacacuuguacauuuuuuaau

SEQ ID NO: 440414 - RNA, 22 nt, Human
gugugccaccagucaaggugaa

SEQ ID NO: 440415 - RNA, 22 nt, Human
ccucagagguguggcaucucug

SEQ ID NO: 440416 - RNA, 22 nt, Human
agguuaggaagauacagaaugu

SEQ ID NO: 440417 - RNA, 19 nt, Human
gaggcgaggcgugcaggag

SEQ ID NO: 440418 - RNA, 22 nt, Human
uguccucacaggaaugaacuuu

SEQ ID NO: 440419 - RNA, 22 nt, Human
gccagacacuccccugggcagg

SEQ ID NO: 440420 - RNA, 22 nt, Human
acccacgaagaugagcggcaug

SEQ ID NO: 440421 - RNA, 20 nt, Human
ugcacacacccuguccucca

SEQ ID NO: 440422 - RNA, 22 nt, Human
ugugaggcgaggccagugagcu

SEQ ID NO: 440423 - RNA, 22 nt, Human
uccccagaggugaggcagcuuu

SEQ ID NO: 440424 - RNA, 22 nt, Human
aucugggccagccccaagagac

SEQ ID NO: 440425 - RNA, 22 nt, Human
ucaguacuucaguagauggagc

SEQ ID NO: 440426 - RNA, 22 nt, Human
cagcuccugcagcugcugccgu

SEQ ID NO: 440427 - RNA, 22 nt, Human
agagaagcauucuucucagggc

SEQ ID NO: 440428 - RNA, 22 nt, Human
uuucaaauggaucccucagccu

SEQ ID NO: 440429 - RNA, 22 nt, Human
gccuggagggcucuagagaggc

SEQ ID NO: 440430 - RNA, 22 nt, Human
ugccugggggacuaaggccaaa

SEQ ID NO: 440431 - RNA, 22 nt, Human
uccgggagcugaacgucuugcg

SEQ ID NO: 440432 - RNA, 22 nt, Human
gacaauaaagugauacauggga

SEQ ID NO: 440433 - RNA, 22 nt, Human
ucacaguacaugauucaguggu

SEQ ID NO: 440434 - RNA, 22 nt, Human
uucaauacaaagaaaggaauuu

SEQ ID NO: 440435 - RNA, 22 nt, Human
agccuggaagaaccugaagucu

SEQ ID NO: 440436 - RNA, 22 nt, Human
gcacagaacacuggugaguccc

SEQ ID NO: 440437 - RNA, 22 nt, Human
cuucaaauacaaguagauuaug

SEQ ID NO: 440438 - RNA, 22 nt, Human
uauugcuuauaauuuguugcaa

SEQ ID NO: 440439 - RNA, 22 nt, Human
uuugggcaagcucacugauuca

SEQ ID NO: 440440 - RNA, 22 nt, Human
ucagaauuugauuccugggaua

SEQ ID NO: 440441 - RNA, 22 nt, Human
ucaaguauaucuagucauuagg

SEQ ID NO: 440442 - RNA, 22 nt, Human
uggcuccugcauuugugcuaac

SEQ ID NO: 440443 - RNA, 22 nt, Human
ugcaguggaaucuggagagcag

SEQ ID NO: 440444 - RNA, 19 nt, Human
gcucagagggcccugugcu

SEQ ID NO: 440445 - RNA, 22 nt, Human
aggcauggauggauccagggcu

SEQ ID NO: 440446 - RNA, 18 nt, Human
agcagcugucagaaugcc

SEQ ID NO: 440447 - RNA, 22 nt, Human
gcccucccuacagccuauuucu

SEQ ID NO: 440448 - RNA, 22 nt, Human
gcagagcagugcuugcccagcg

SEQ ID NO: 440449 - RNA, 22 nt, Human
uccacagaauguaagauccaca

SEQ ID NO: 440450 - RNA, 22 nt, Human
aguaacaucuuugacauuuguu

SEQ ID NO: 440451 - RNA, 22 nt, Human
ucaaacugaauuaaacacuugu

SEQ ID NO: 440452 - RNA, 22 nt, Human
aggccuagaggaauggccaggg

SEQ ID NO: 440453 - RNA, 22 nt, Human
agcagcauauugugucuucaua

SEQ ID NO: 440454 - RNA, 22 nt, Human
uccuggaguauuucuguggugu

SEQ ID NO: 440455 - RNA, 22 nt, Human
ggcugcaggcaggguauccacu

SEQ ID NO: 440456 - RNA, 22 nt, Human
aggggaauggguagacuguuga

SEQ ID NO: 440457 - RNA, 22 nt, Human
cagcacuaugacauuuaauucu

SEQ ID NO: 440458 - RNA, 22 nt, Human
uucacaguggcccucucugagu

SEQ ID NO: 440459 - RNA, 22 nt, Human
gcaaacaugcugagaaauaaga

SEQ ID NO: 440460 - RNA, 22 nt, Human
ugcagccccuaucgcggacagg

SEQ ID NO: 440461 - RNA, 17 nt, Human
ugcagcaguucccaucu

SEQ ID NO: 440462 - RNA, 22 nt, Human
uaaggcaaaggggaaguuauca

SEQ ID NO: 440463 - RNA, 22 nt, Human
aguuucucucaguauagaauag

SEQ ID NO: 440464 - RNA, 22 nt, Human
gcugccaccguggagaugagug

SEQ ID NO: 440465 - RNA, 22 nt, Human
gaggcagcaucuauggugggaa

SEQ ID NO: 440466 - RNA, 22 nt, Human
agcaggcuugguccccagccuc

SEQ ID NO: 440467 - RNA, 22 nt, Human
uuuugcagaaugggaagguagu

SEQ ID NO: 440468 - RNA, 22 nt, Human
auggcagggacuguggcccuug

SEQ ID NO: 440469 - RNA, 22 nt, Human
auuuugaaucaccuuggaagaa

SEQ ID NO: 440470 - RNA, 22 nt, Human
cagaccuggaaaacaggcuugc

SEQ ID NO: 440471 - RNA, 22 nt, Human
gggcccuggggccugauuugca

SEQ ID NO: 440472 - RNA, 22 nt, Human
uuuaucagaggcuauguuucau

SEQ ID NO: 440473 - RNA, 22 nt, Human
agagaauccucuacauguuuuu

SEQ ID NO: 440474 - RNA, 22 nt, Human
gagcagcugagcuggaaugaga

SEQ ID NO: 440475 - RNA, 22 nt, Human
aaguccugaagacacagaaaag

SEQ ID NO: 440476 - RNA, 20 nt, Human
agguccuguuccuugucucc

SEQ ID NO: 440477 - RNA, 22 nt, Human
agcuccugauacaugcaggaau

SEQ ID NO: 440478 - RNA, 22 nt, Human
ugaaacagaguggauacaguga

SEQ ID NO: 440479 - RNA, 22 nt, Human
uaguauuuccuguaagcuauag

SEQ ID NO: 440480 - RNA, 22 nt, Human
ugaaagaacuagcaucuucaag

SEQ ID NO: 440481 - RNA, 22 nt, Human
auccugagcuacaccugcuccu

SEQ ID NO: 440482 - RNA, 22 nt, Human
cuggcccucggaguccagcugc

SEQ ID NO: 440483 - RNA, 22 nt, Human
ggguacaguucuuccaguguca

SEQ ID NO: 440484 - RNA, 22 nt, Human
ugaauucugggucagcagcuug

SEQ ID NO: 440485 - RNA, 22 nt, Human
agguaagggucacaguucauau

SEQ ID NO: 440486 - RNA, 22 nt, Human
ggcagcugcacguugucccguc

SEQ ID NO: 440487 - RNA, 22 nt, Human
ccagccaguccagcauuggugu

SEQ ID NO: 440488 - RNA, 22 nt, Human
agauauacagagaauuauucac

SEQ ID NO: 440489 - RNA, 19 nt, Human
uugcauuucauguuugauu

SEQ ID NO: 440490 - RNA, 22 nt, Human
cuggccuggggccucagcugcu

SEQ ID NO: 440491 - RNA, 22 nt, Human
uuucacaauuuuaaggagcaaa

SEQ ID NO: 440492 - RNA, 22 nt, Human
gucuggcuuugcucagaugcug

SEQ ID NO: 440493 - RNA, 22 nt, Human
ucuugaugcuuuuucuaaaugu

SEQ ID NO: 440494 - RNA, 22 nt, Human
ccagccagucccgcaugaccgc

SEQ ID NO: 440495 - RNA, 22 nt, Human
ugugugaacucucugauguaca

SEQ ID NO: 440496 - RNA, 21 nt, Human
uggcucugcucagagcagucc

SEQ ID NO: 440497 - RNA, 22 nt, Human
aagagacuuugcagugucccua

SEQ ID NO: 440498 - RNA, 22 nt, Human
cagcugagaagugauagcugca

SEQ ID NO: 440499 - RNA, 22 nt, Human
aucuggaagucagagguuugca

SEQ ID NO: 440500 - RNA, 22 nt, Human
agucagugaaggcauugcucaa

SEQ ID NO: 440501 - RNA, 17 nt, Human
aggugcuggagcaucag

SEQ ID NO: 440502 - RNA, 22 nt, Human
uugcagcuucaagcagguugac

SEQ ID NO: 440503 - RNA, 22 nt, Human
aaaguuugcaauuuauguuaau

SEQ ID NO: 440504 - RNA, 22 nt, Human
cugugccuggggggcagagcug

SEQ ID NO: 440505 - RNA, 22 nt, Human
ucuuugcaaaauacaacaaugg

SEQ ID NO: 440506 - RNA, 22 nt, Human
gacauagucucugucuucaugg

SEQ ID NO: 440507 - RNA, 22 nt, Human
acugggcugcuugagugccuuc

SEQ ID NO: 440508 - RNA, 20 nt, Human
ccugucuggagacaaagaga

SEQ ID NO: 440509 - RNA, 22 nt, Human
guccucaguaagagggccucug

SEQ ID NO: 440510 - RNA, 22 nt, Human
uggagggaacaaaggaguccca

SEQ ID NO: 440511 - RNA, 20 nt, Human
auaggaaagggaggggcuuu

SEQ ID NO: 440512 - RNA, 22 nt, Human
aggcagauuuaggagaaaagaa

SEQ ID NO: 440513 - RNA, 20 nt, Human
uggggccuguuucugugguu

SEQ ID NO: 440514 - RNA, 22 nt, Human
gugccuggcaugcgccggugcu

SEQ ID NO: 440515 - RNA, 22 nt, Human
ggcagcuggccuccucgcccac

SEQ ID NO: 440516 - RNA, 22 nt, Human
gcaggcagagagggguuuccag

SEQ ID NO: 440517 - RNA, 22 nt, Human
acacacaacucauuguguaaua

SEQ ID NO: 440518 - RNA, 22 nt, Human
agccuauuccaggaugagcuca

SEQ ID NO: 440519 - RNA, 22 nt, Human
gcugcagggcucucacaggggg

SEQ ID NO: 440520 - RNA, 22 nt, Human
gagcaacaaauuagggggauuu

SEQ ID NO: 440521 - RNA, 19 nt, Human
ugcagccacgugagagacu

SEQ ID NO: 440522 - RNA, 22 nt, Human
gaguagaacugguuaucuaaua

SEQ ID NO: 440523 - RNA, 22 nt, Human
ucagaggacagcagcuaaauaa

SEQ ID NO: 440524 - RNA, 22 nt, Human
ucccagccuuucuuucuccagc

SEQ ID NO: 440525 - RNA, 22 nt, Human
uguguguguaaaagcauuuaua

SEQ ID NO: 440526 - RNA, 22 nt, Human
cugcccugcagcuccacggacu

SEQ ID NO: 440527 - RNA, 22 nt, Human
cacauguacagaagcaggcugg

SEQ ID NO: 440528 - RNA, 22 nt, Human
ucugcaacauuccucuccccac

SEQ ID NO: 440529 - RNA, 22 nt, Human
gaggcagaaguugcagugagca

SEQ ID NO: 440530 - RNA, 22 nt, Human
ugcacacauucuauggggcuga

SEQ ID NO: 440531 - RNA, 22 nt, Human
gcugccuggagcucagccugcc

SEQ ID NO: 440532 - RNA, 19 nt, Human
cccagagagaucucuugcc

SEQ ID NO: 440533 - RNA, 22 nt, Human
auuccucauuauuuacugagga

SEQ ID NO: 440534 - RNA, 22 nt, Human
gcagccaggaaagcuggacccu

SEQ ID NO: 440535 - RNA, 22 nt, Human
agcuugccaguugaagaucuuc

SEQ ID NO: 440536 - RNA, 22 nt, Human
ugcaauuuuaauacauuagagg

SEQ ID NO: 440537 - RNA, 22 nt, Human
gaggccugggagaacuguuuuu

SEQ ID NO: 440538 - RNA, 22 nt, Human
ucuucuuuggaugaaagaauau

SEQ ID NO: 440539 - RNA, 21 nt, Human
cagugccagccacaggacgcc

SEQ ID NO: 440540 - RNA, 22 nt, Human
aaaggcuuugagaaguccugca

SEQ ID NO: 440541 - RNA, 20 nt, Human
aauuuacucacagaaugaau

SEQ ID NO: 440542 - RNA, 22 nt, Human
ugccaggcauguaguagacuug

SEQ ID NO: 440543 - RNA, 22 nt, Human
auauaguuuagguucgaauggg

SEQ ID NO: 440544 - RNA, 22 nt, Human
cagacacaccaggcccauucug

SEQ ID NO: 440545 - RNA, 23 nt, Human
ucugggcugagcucgaguguaga

SEQ ID NO: 440546 - RNA, 19 nt, Human
ucuagcaacccacugcaug

SEQ ID NO: 440547 - RNA, 22 nt, Human
gugacccagaggcugacuaaca

SEQ ID NO: 440548 - RNA, 22 nt, Human
uaaauggcaaccccuagagcug

SEQ ID NO: 440549 - RNA, 22 nt, Human
aggaagcaguuuauaaugcauu

SEQ ID NO: 440550 - RNA, 22 nt, Human
gacagacaggagcucacaggca

SEQ ID NO: 440551 - RNA, 22 nt, Human
uugcccacucagcccuguggag

SEQ ID NO: 440552 - RNA, 22 nt, Human
guauucuuauacucagugagcu

SEQ ID NO: 440553 - RNA, 21 nt, Human
cugaggcagcacagcuaguca

SEQ ID NO: 440554 - RNA, 22 nt, Human
ugcuuuaaaauggacuguuuug

SEQ ID NO: 440555 - RNA, 22 nt, Human
uggaugaggcuggguuaggcag

SEQ ID NO: 440556 - RNA, 22 nt, Human
gcagcugucgcuaggagcugug

SEQ ID NO: 440557 - RNA, 22 nt, Human
aguguccccuccaagggccugg

SEQ ID NO: 440558 - RNA, 18 nt, Human
uacaggaaaaguguuaca

SEQ ID NO: 440559 - RNA, 22 nt, Human
ccugcugggccugagcaaugag

SEQ ID NO: 440560 - RNA, 22 nt, Human
agaggcuccuucacucuggcac

SEQ ID NO: 440561 - RNA, 22 nt, Human
ucuguguccugcuagcugucuu

SEQ ID NO: 440562 - RNA, 22 nt, Human
uucaaaucccugcuccacuauu

SEQ ID NO: 440563 - RNA, 22 nt, Human
cuggaaggagaaggaggcugug

SEQ ID NO: 440564 - RNA, 19 nt, Human
aggccugggguuuugcacu

SEQ ID NO: 440565 - RNA, 23 nt, Human
aaugugcuguauucauuucugga

SEQ ID NO: 440566 - RNA, 22 nt, Human
gagcccugcugggccuugucuc

SEQ ID NO: 440567 - RNA, 22 nt, Human
cugggaggcaccgcgucgugcu

SEQ ID NO: 440568 - RNA, 19 nt, Human
augauacaggugaaaauug

SEQ ID NO: 440569 - RNA, 22 nt, Human
cucacauuccacuugugccaac

SEQ ID NO: 440570 - RNA, 22 nt, Human
cccagcagccagaaugaggagc

SEQ ID NO: 440571 - RNA, 22 nt, Human
ugcccucccacauuauggcugu

SEQ ID NO: 440572 - RNA, 22 nt, Human
aaggcugguuuccuugauguuu

SEQ ID NO: 440573 - RNA, 22 nt, Human
aaggcaauguaaauuacagcuu

SEQ ID NO: 440574 - RNA, 22 nt, Human
cgaggcagaggcugaaacggcu

SEQ ID NO: 440575 - RNA, 19 nt, Human
auuccucaaggacagaaau

SEQ ID NO: 440576 - RNA, 22 nt, Human
gagguggcacugugaggagcac

SEQ ID NO: 440577 - RNA, 22 nt, Human
gucagggauccacugcucuucu

SEQ ID NO: 440578 - RNA, 22 nt, Human
cacaggaaguggucagugccag

SEQ ID NO: 440579 - RNA, 22 nt, Human
uccagccaagccuugguagcug

SEQ ID NO: 440580 - RNA, 22 nt, Human
gaguaagagcuggcuuuggugu

SEQ ID NO: 440581 - RNA, 22 nt, Human
aauccuggcaugugccuuggga

SEQ ID NO: 440582 - RNA, 22 nt, Human
auuagaaugaaguauaggauuu

SEQ ID NO: 440583 - RNA, 22 nt, Human
acauucaaaauugugguuuaga

SEQ ID NO: 440584 - RNA, 22 nt, Human
guauuuauaggggaaugagagu

SEQ ID NO: 440585 - RNA, 22 nt, Human
aggaaagguagcgugccagcag

SEQ ID NO: 440586 - RNA, 22 nt, Human
ggaagggccucgggcgugggac

SEQ ID NO: 440587 - RNA, 22 nt, Human
ggguccugcgugggcccaggac

SEQ ID NO: 440588 - RNA, 22 nt, Human
ccagagaaauaaggggaaaaug

SEQ ID NO: 440589 - RNA, 22 nt, Human
gcagugcuuuagucuguccuuu

SEQ ID NO: 440590 - RNA, 23 nt, Human
agcagcugugguuuaccuuagua

SEQ ID NO: 440591 - RNA, 22 nt, Human
gcuggaggauggacuggaagaa

SEQ ID NO: 440592 - RNA, 22 nt, Human
uaaggcagugagaagaaacagg

SEQ ID NO: 440593 - RNA, 22 nt, Human
uucauuaauucauucagugacu

SEQ ID NO: 440594 - RNA, 22 nt, Human
ucccugggguuccuccagccac

SEQ ID NO: 440595 - RNA, 22 nt, Human
gaaugcuaagcaugugggaguu

SEQ ID NO: 440596 - RNA, 22 nt, Human
caguaucuccacauguaaagug

SEQ ID NO: 440597 - RNA, 22 nt, Human
gguggcaggcccugagcauccc

SEQ ID NO: 440598 - RNA, 22 nt, Human
ugacaagucacuguucuucaau

SEQ ID NO: 440599 - RNA, 22 nt, Human
cagcagcagcuuaguggucccc

SEQ ID NO: 440600 - RNA, 22 nt, Human
gaugauggguugaugugaaggg

SEQ ID NO: 440601 - RNA, 22 nt, Human
uauuuucuggggagagugaacc

SEQ ID NO: 440602 - RNA, 22 nt, Human
guagaaauauuuaucucugaga

SEQ ID NO: 440603 - RNA, 22 nt, Human
auuguaauuuuagagaaagugg

SEQ ID NO: 440604 - RNA, 22 nt, Human
aucccugcccucauggagcuua

SEQ ID NO: 440605 - RNA, 22 nt, Human
acaggcaggcuucggccagagc

SEQ ID NO: 440606 - RNA, 22 nt, Human
aagagcugauuaagucaugagg

SEQ ID NO: 440607 - RNA, 22 nt, Human
caguuccaucuucaucuuuccc

SEQ ID NO: 440608 - RNA, 22 nt, Human
guccaggccaugguggacacag

SEQ ID NO: 440609 - RNA, 21 nt, Human
agggccagaucaccaaggagc

SEQ ID NO: 440610 - RNA, 22 nt, Human
aacagucuaaauuauacccuuu

SEQ ID NO: 440611 - RNA, 22 nt, Human
ccuggcagcauugguagagauu

SEQ ID NO: 440612 - RNA, 22 nt, Human
cucuacucuuaacacagcuagg

SEQ ID NO: 440613 - RNA, 22 nt, Human
agaaauaugcugauuagaugaa

SEQ ID NO: 440614 - RNA, 22 nt, Human
ggagcugcucagagccaguccc

SEQ ID NO: 440615 - RNA, 19 nt, Human
agagaaggauccuaugguu

SEQ ID NO: 440616 - RNA, 22 nt, Human
ccagcauggcaccugagaugag

SEQ ID NO: 440617 - RNA, 22 nt, Human
cacugaacuccuuguuuguccu

SEQ ID NO: 440618 - RNA, 22 nt, Human
gugccugugccaggggugugcu

SEQ ID NO: 440619 - RNA, 22 nt, Human
caguacuuguccucagguguua

SEQ ID NO: 440620 - RNA, 22 nt, Human
gugccagcaguuauggugauuu

SEQ ID NO: 440621 - RNA, 22 nt, Human
acaggacauguaccaggugguc

SEQ ID NO: 440622 - RNA, 20 nt, Human
ugggccucuggugccucugg

SEQ ID NO: 440623 - RNA, 18 nt, Human
acccucuggcuucugagc

SEQ ID NO: 440624 - RNA, 22 nt, Human
uuccucagcuguuugggcucau

SEQ ID NO: 440625 - RNA, 19 nt, Human
ggcucagugacauaggugc

SEQ ID NO: 440626 - RNA, 22 nt, Human
agggccugacacccuugccagc

SEQ ID NO: 440627 - RNA, 22 nt, Human
aggcugaggcagguggaucacu

SEQ ID NO: 440628 - RNA, 22 nt, Human
aauuuuauuaacuggauguagc

SEQ ID NO: 440629 - RNA, 22 nt, Human
gauauuuacauuaagcacauug

SEQ ID NO: 440630 - RNA, 22 nt, Human
cuccugggagcuguggcagagc

SEQ ID NO: 440631 - RNA, 22 nt, Human
cgcaccacugaauuccagccug

SEQ ID NO: 440632 - RNA, 22 nt, Human
cugcagcagccuccagccuugg

SEQ ID NO: 440633 - RNA, 22 nt, Human
aaguuaaguaguacucucuuca

SEQ ID NO: 440634 - RNA, 22 nt, Human
uacuuccuguuuccaugucugu

SEQ ID NO: 440635 - RNA, 22 nt, Human
cuuugcagcaauuucuguuaaa

SEQ ID NO: 440636 - RNA, 22 nt, Human
augugcaugcacuuacaugugu

SEQ ID NO: 440637 - RNA, 22 nt, Human
uagaaacaugagagaaacucuu

SEQ ID NO: 440638 - RNA, 22 nt, Human
uuugcaaacggcccugaguccc

SEQ ID NO: 440639 - RNA, 22 nt, Human
caauucauuacauugcaaagac

SEQ ID NO: 440640 - RNA, 22 nt, Human
agcuguuuuacucagaaacaua

SEQ ID NO: 440641 - RNA, 22 nt, Human
aggucccaggcauagcuggucu

SEQ ID NO: 440642 - RNA, 22 nt, Human
ggagggcagaguccccugcuga

SEQ ID NO: 440643 - RNA, 22 nt, Human
gucuggcuagagacacccuccc

SEQ ID NO: 440644 - RNA, 22 nt, Human
uugcaaguuaaaaauuauuagu

SEQ ID NO: 440645 - RNA, 22 nt, Human
ccaggaggcagagguuguagug

SEQ ID NO: 440646 - RNA, 21 nt, Human
cuggagucuggggguggcagu

SEQ ID NO: 440647 - RNA, 22 nt, Human
ccugggcucaagugauccuccu

SEQ ID NO: 440648 - RNA, 21 nt, Human
aaggcagaagcauggaaugag

SEQ ID NO: 440649 - RNA, 22 nt, Human
gccuguggccacugcgucugca

SEQ ID NO: 440650 - RNA, 22 nt, Human
ucuuuauugcuacugguuuguc

SEQ ID NO: 440651 - RNA, 23 nt, Human
ucacacagcuggucagguacaga

SEQ ID NO: 440652 - RNA, 22 nt, Human
cuagcacuuagggauuguuaug

SEQ ID NO: 440653 - RNA, 19 nt, Human
aggcacagguugucuggac

SEQ ID NO: 440654 - RNA, 22 nt, Human
auaggugaaauauucaaaaugu

SEQ ID NO: 440655 - RNA, 22 nt, Human
uguucacacacggaggccacag

SEQ ID NO: 440656 - RNA, 22 nt, Human
agcccugggcagccaaggaagc

SEQ ID NO: 440657 - RNA, 22 nt, Human
agggugcagaaggagccuagga

SEQ ID NO: 440658 - RNA, 22 nt, Human
cuggcuccaggucaugcacuca

SEQ ID NO: 440659 - RNA, 22 nt, Human
uccugaaguauuguuugaguaa

SEQ ID NO: 440660 - RNA, 22 nt, Human
aggcaguuuauccccagagccu

SEQ ID NO: 440661 - RNA, 22 nt, Human
aauaucuuggcccaacuccaga

SEQ ID NO: 440662 - RNA, 23 nt, Human
uaugugcauauguguaagaauac

SEQ ID NO: 440663 - RNA, 22 nt, Human
uuuuauguuccugaagcuaucu

SEQ ID NO: 440664 - RNA, 22 nt, Human
agaaaauauucauugagaggcu

SEQ ID NO: 440665 - RNA, 22 nt, Human
aagagcuggauugugcugcaga

SEQ ID NO: 440666 - RNA, 22 nt, Human
caucugcuguuccuuggacuca

SEQ ID NO: 440667 - RNA, 22 nt, Human
cccagcccacgguccugggugg

SEQ ID NO: 440668 - RNA, 22 nt, Human
acagagcuuaggaugacuccca

SEQ ID NO: 440669 - RNA, 22 nt, Human
gaauauaggaccucugggaaca

SEQ ID NO: 440670 - RNA, 22 nt, Human
ggaccaucucuagccagagcuu

SEQ ID NO: 440671 - RNA, 22 nt, Human
acaauacuagccaagguuauua

SEQ ID NO: 440672 - RNA, 22 nt, Human
uaaaaaguagugagaauggcgc

SEQ ID NO: 440673 - RNA, 22 nt, Human
gaggcgagaagcuggagauggu

SEQ ID NO: 440674 - RNA, 22 nt, Human
ucacaggcuccagggccuggau

SEQ ID NO: 440675 - RNA, 19 nt, Human
gcuggggccugaccagaca

SEQ ID NO: 440676 - RNA, 22 nt, Human
aucuuuuuacuaacacugcuua

SEQ ID NO: 440677 - RNA, 22 nt, Human
gcuguuucugaguagcuaggcu

SEQ ID NO: 440678 - RNA, 22 nt, Human
ucccugggucauucucuggcac

SEQ ID NO: 440679 - RNA, 22 nt, Human
caaagggcucuagacucagcag

SEQ ID NO: 440680 - RNA, 22 nt, Human
agagcuuguaauugagucaggu

SEQ ID NO: 440681 - RNA, 22 nt, Human
gugcauauguaccugugaucau

SEQ ID NO: 440682 - RNA, 22 nt, Human
uaacacuaagaaucuaaauuua

SEQ ID NO: 440683 - RNA, 22 nt, Human
gggcacugcuggaggcucccug

SEQ ID NO: 440684 - RNA, 22 nt, Human
auugaguauuguaaauaaaaca

SEQ ID NO: 440685 - RNA, 22 nt, Human
ucugucacuuauuaagauggau

SEQ ID NO: 440686 - RNA, 22 nt, Human
uugcccuguggggccuccagcc

SEQ ID NO: 440687 - RNA, 22 nt, Human
uguaguguggccuaucuuugcc

SEQ ID NO: 440688 - RNA, 22 nt, Human
acaaacugaauggguuuucugu

SEQ ID NO: 440689 - RNA, 22 nt, Human
agcaagauuuuucagguuagua

SEQ ID NO: 440690 - RNA, 22 nt, Human
ggagcugcuuugaucugaagaa

SEQ ID NO: 440691 - RNA, 22 nt, Human
ugggcaaaugucacuuucuuuu

SEQ ID NO: 440692 - RNA, 22 nt, Human
gccuugggaaagugggaggaga

SEQ ID NO: 440693 - RNA, 22 nt, Human
uuugcaaagugacuauuauaug

SEQ ID NO: 440694 - RNA, 22 nt, Human
ugcugagcgcauccggcggccg

SEQ ID NO: 440695 - RNA, 22 nt, Human
cugggcacaaguggcccuggau

SEQ ID NO: 440696 - RNA, 22 nt, Human
uggagcaggugggaugucguga

SEQ ID NO: 440697 - RNA, 22 nt, Human
cauuuaauccucacaagccuau

SEQ ID NO: 440698 - RNA, 22 nt, Human
gcagcugcuggaaguuccugcc

SEQ ID NO: 440699 - RNA, 22 nt, Human
uuaauacaagcauaugcacaca

SEQ ID NO: 440700 - RNA, 22 nt, Human
acuuucucaggaauucacagac

SEQ ID NO: 440701 - RNA, 22 nt, Human
uugcuucauuuugggacucuag

SEQ ID NO: 440702 - RNA, 21 nt, Human
agcuggugucagagcucuggg

SEQ ID NO: 440703 - RNA, 22 nt, Human
uuacaguauuguuaaacucuuu

SEQ ID NO: 440704 - RNA, 22 nt, Human
cacugcauggcugugaggcagc

SEQ ID NO: 440705 - RNA, 22 nt, Human
augcuuuuccaggagaaauaua

SEQ ID NO: 440706 - RNA, 22 nt, Human
cuguggagugcuuggcucagug

SEQ ID NO: 440707 - RNA, 18 nt, Human
aggaaagacgaagagggc

SEQ ID NO: 440708 - RNA, 22 nt, Human
aaggcccagcgugaccucagug

SEQ ID NO: 440709 - RNA, 22 nt, Human
cacagaggcaaccuucuggggu

SEQ ID NO: 440710 - RNA, 22 nt, Human
agaacauuugucgaucaauuug

SEQ ID NO: 440711 - RNA, 22 nt, Human
aaggacagaaacagauugcugg

SEQ ID NO: 440712 - RNA, 22 nt, Human
ccagcccuguuuaugugucacu

SEQ ID NO: 440713 - RNA, 23 nt, Human
ugccucaguggaaugugagggug

SEQ ID NO: 440714 - RNA, 17 nt, Human
gcagccagugcagcagg

SEQ ID NO: 440715 - RNA, 22 nt, Human
gauuuucaugauaaacuuguga

SEQ ID NO: 440716 - RNA, 22 nt, Human
cugugcuggagaugggccagag

SEQ ID NO: 440717 - RNA, 22 nt, Human
auugcaaauaacuguacugaau

SEQ ID NO: 440718 - RNA, 22 nt, Human
cagcucugggugacaggagggc

SEQ ID NO: 440719 - RNA, 22 nt, Human
gggcacugcuuugcucugucac

SEQ ID NO: 440720 - RNA, 22 nt, Human
guggucaggggcugaggugccc

SEQ ID NO: 440721 - RNA, 22 nt, Human
ugcaugcaaagugucugcuuug

SEQ ID NO: 440722 - RNA, 22 nt, Human
ggccucugggguccugagccca

SEQ ID NO: 440723 - RNA, 22 nt, Human
uaguuuaguaagaggagagcug

SEQ ID NO: 440724 - RNA, 22 nt, Human
ucaugcagcuuuuccauucagc

SEQ ID NO: 440725 - RNA, 22 nt, Human
uaaauugaaaaucuacagaaca

SEQ ID NO: 440726 - RNA, 23 nt, Human
gagcagagcgggcggggguccug

SEQ ID NO: 440727 - RNA, 22 nt, Human
caggguggaaaagcuaguugga

SEQ ID NO: 440728 - RNA, 22 nt, Human
gcaggagaacaaagcaagcugc

SEQ ID NO: 440729 - RNA, 22 nt, Human
uucagauaucauuaauuuagua

SEQ ID NO: 440730 - RNA, 19 nt, Human
ugcagcuguaugagcuuaa

SEQ ID NO: 440731 - RNA, 22 nt, Human
uucuagaaauccguaagugaau

SEQ ID NO: 440732 - RNA, 22 nt, Human
cagagcugguguuacaagucca

SEQ ID NO: 440733 - RNA, 22 nt, Human
uaauggcagagucaugcuuucu

SEQ ID NO: 440734 - RNA, 22 nt, Human
gcaggggcugagcaccagcggg

SEQ ID NO: 440735 - RNA, 22 nt, Human
cuaggcugagcugggcugagcu

SEQ ID NO: 440736 - RNA, 22 nt, Human
gcuggccauagaagccaaagag

SEQ ID NO: 440737 - RNA, 22 nt, Human
agaagaaaugugaaggccacug

SEQ ID NO: 440738 - RNA, 22 nt, Human
uuucugaagggcagcagacucu

SEQ ID NO: 440739 - RNA, 22 nt, Human
agugugugccuuuggauaccug

SEQ ID NO: 440740 - RNA, 17 nt, Human
ugauucaacuagaaacu

SEQ ID NO: 440741 - RNA, 22 nt, Human
caggaaggaccguccagaucag

SEQ ID NO: 440742 - RNA, 20 nt, Human
uaggcagagcugugcagccu

SEQ ID NO: 440743 - RNA, 22 nt, Human
acuuguguaacacagaaagaac

SEQ ID NO: 440744 - RNA, 22 nt, Human
gaccaggcccaggugcaaggga

SEQ ID NO: 440745 - RNA, 22 nt, Human
agagcuggccagggaucacucu

SEQ ID NO: 440746 - RNA, 18 nt, Human
caauagaaacaguaggaa

SEQ ID NO: 440747 - RNA, 22 nt, Human
cagcuguuaugagguguacaug

SEQ ID NO: 440748 - RNA, 22 nt, Human
aagagaauaucgauagcacucu

SEQ ID NO: 440749 - RNA, 22 nt, Human
augcccugugguucaugugaga

SEQ ID NO: 440750 - RNA, 22 nt, Human
ggcaccagcaggcaccgaugcc

SEQ ID NO: 440751 - RNA, 22 nt, Human
uccagccaccaccuugauugcc

SEQ ID NO: 440752 - RNA, 22 nt, Human
uggaccugcuggaugggcaggu

SEQ ID NO: 440753 - RNA, 22 nt, Human
ccacccugagccgcaagagcag

SEQ ID NO: 440754 - RNA, 22 nt, Human
uccugagggcgauucagcaggu

SEQ ID NO: 440755 - RNA, 22 nt, Human
ucaaauacauggucaaucaacu

SEQ ID NO: 440756 - RNA, 23 nt, Human
ccaggccucucagagggugugcc

SEQ ID NO: 440757 - RNA, 22 nt, Human
aagggccuccuggggagccugg

SEQ ID NO: 440758 - RNA, 22 nt, Human
ucuuugcagaauuuaacuuugc

SEQ ID NO: 440759 - RNA, 21 nt, Human
aauaaccacuaauauaguggc

SEQ ID NO: 440760 - RNA, 22 nt, Human
ggcuagggacuccuccucaggg

SEQ ID NO: 440761 - RNA, 19 nt, Human
aggcaggugcagagguccc

SEQ ID NO: 440762 - RNA, 19 nt, Human
gggcacagccuccccccag

SEQ ID NO: 440763 - RNA, 22 nt, Human
gaggaaggaaugcaguguaugc

SEQ ID NO: 440764 - RNA, 22 nt, Human
gccaccagggggcuccagugag

SEQ ID NO: 440765 - RNA, 22 nt, Human
agaaaagggcaggagggauaca

SEQ ID NO: 440766 - RNA, 22 nt, Human
acuagauuuuggccauuauaca

SEQ ID NO: 440767 - RNA, 22 nt, Human
ugcuuugcagugucuaacagaa

SEQ ID NO: 440768 - RNA, 22 nt, Human
uguggaagugccaaugacaaau

SEQ ID NO: 440769 - RNA, 22 nt, Human
cagcagcugggaaggaggcuga

SEQ ID NO: 440770 - RNA, 18 nt, Human
gaugaggcugucugagaa

SEQ ID NO: 440771 - RNA, 22 nt, Human
ugaaggcaaccucugugguccu

SEQ ID NO: 440772 - RNA, 22 nt, Human
aggcagccauccaggaggcuca

SEQ ID NO: 440773 - RNA, 22 nt, Human
ugcaaauugcgauuuuuauuag

SEQ ID NO: 440774 - RNA, 22 nt, Human
gacacagcuugaugagggcuuu

SEQ ID NO: 440775 - RNA, 22 nt, Human
uuuugugacagaaagauuaagu

SEQ ID NO: 440776 - RNA, 22 nt, Human
guuaaggcugagcaggacacug

SEQ ID NO: 440777 - RNA, 22 nt, Human
gaguguggugaacaggagcacc

SEQ ID NO: 440778 - RNA, 22 nt, Human
cagagucagagcaccugggauu

SEQ ID NO: 440779 - RNA, 20 nt, Human
ggcagccaaucagcgugccg

SEQ ID NO: 440780 - RNA, 22 nt, Human
gagcaggcucugccuguguguc

SEQ ID NO: 440781 - RNA, 22 nt, Human
cuguccugauggugccacuggu

SEQ ID NO: 440782 - RNA, 22 nt, Human
caagggcagauagcugguccaa

SEQ ID NO: 440783 - RNA, 18 nt, Human
cugaggcuuagagagguu

SEQ ID NO: 440784 - RNA, 22 nt, Human
cccaagaucuuucgugcacuaa

SEQ ID NO: 440785 - RNA, 22 nt, Human
gcauccagagguagccacugug

SEQ ID NO: 440786 - RNA, 22 nt, Human
gccagagaggccuuagaaucca

SEQ ID NO: 440787 - RNA, 22 nt, Human
gucaggcccuggcagccgugac

SEQ ID NO: 440788 - RNA, 22 nt, Human
ugucaguguauacauacaguau

SEQ ID NO: 440789 - RNA, 23 nt, Human
aaguucaagucacagccugucuu

SEQ ID NO: 440790 - RNA, 22 nt, Human
ggugugguuugaagggagaugg

SEQ ID NO: 440791 - RNA, 22 nt, Human
acaguguccuuguggucccugu

SEQ ID NO: 440792 - RNA, 22 nt, Human
cugccagcaaugugaccaugcu

SEQ ID NO: 440793 - RNA, 22 nt, Human
caaauugcuaacugucagacua

SEQ ID NO: 440794 - RNA, 22 nt, Human
uuucugaagucuucuaacagau

SEQ ID NO: 440795 - RNA, 22 nt, Human
uuuauaccucauucuuagcaaa

SEQ ID NO: 440796 - RNA, 20 nt, Human
cauuauuguaaucagcugua

SEQ ID NO: 440797 - RNA, 22 nt, Human
agggcagagggugccucaccug

SEQ ID NO: 440798 - RNA, 22 nt, Human
uuucacaacugcuuauuugaga

SEQ ID NO: 440799 - RNA, 21 nt, Human
agcugagcccagaagacuggu

SEQ ID NO: 440800 - RNA, 22 nt, Human
aguggcagagcaggugcuggaa

SEQ ID NO: 440801 - RNA, 22 nt, Human
gcuuugcauuguuuaaucagga

SEQ ID NO: 440802 - RNA, 22 nt, Human
ucaccaggcuggaaugcagugg

SEQ ID NO: 440803 - RNA, 22 nt, Human
cacaugcaggagccaauguaca

SEQ ID NO: 440804 - RNA, 22 nt, Human
gucuggaaagagcugagguuca

SEQ ID NO: 440805 - RNA, 22 nt, Human
ugcccacauggugccauggcca

SEQ ID NO: 440806 - RNA, 22 nt, Human
guugcuuuacagcuggugacag

SEQ ID NO: 440807 - RNA, 22 nt, Human
cucagagcaaugaacaugcaaa

SEQ ID NO: 440808 - RNA, 22 nt, Human
augcaauuuacuguacauaaau

SEQ ID NO: 440809 - RNA, 22 nt, Human
uugcaaauugcaagaguuggau

SEQ ID NO: 440810 - RNA, 22 nt, Human
ugccuggaugugcuggccucac

SEQ ID NO: 440811 - RNA, 22 nt, Human
gugugugugccugcacacacac

SEQ ID NO: 440812 - RNA, 20 nt, Human
cucucccagcacagcuuccu

SEQ ID NO: 440813 - RNA, 22 nt, Human
uccagccuucucaaggcuggcu

SEQ ID NO: 440814 - RNA, 21 nt, Human
ugucagaaauaagcaugugau

SEQ ID NO: 440815 - RNA, 19 nt, Human
cauuuagaaguacauauua

SEQ ID NO: 440816 - RNA, 17 nt, Human
gucaauauuguugacag

SEQ ID NO: 440817 - RNA, 20 nt, Human
cacaggccuugugagcagac

SEQ ID NO: 440818 - RNA, 19 nt, Human
agcugggcugucacaguga

SEQ ID NO: 440819 - RNA, 22 nt, Human
ugguaauuauggauacuuaaau

SEQ ID NO: 440820 - RNA, 22 nt, Human
cagcugccuucugcgggaaguc

SEQ ID NO: 440821 - RNA, 22 nt, Human
gugaggugguacaauauuaacu

SEQ ID NO: 440822 - RNA, 22 nt, Human
gagugcagaaauucccuuccug

SEQ ID NO: 440823 - RNA, 22 nt, Human
uguauuuucugaagauaaucaa

SEQ ID NO: 440824 - RNA, 18 nt, Human
aaggcaguaugauugcac

SEQ ID NO: 440825 - RNA, 22 nt, Human
acagacagauuuugucugaugu

SEQ ID NO: 440826 - RNA, 22 nt, Human
cagcucccuauggugaggcgac

SEQ ID NO: 440827 - RNA, 22 nt, Human
ugcacacaaguuggagaaugaa

SEQ ID NO: 440828 - RNA, 22 nt, Human
cuuuuuguuguauaagcccuuu

SEQ ID NO: 440829 - RNA, 22 nt, Human
agggcuggagccacagcuggga

SEQ ID NO: 440830 - RNA, 22 nt, Human
aguuuucuguucuacaauuuga

SEQ ID NO: 440831 - RNA, 22 nt, Human
ugugccuggaucucugugacaa

SEQ ID NO: 440832 - RNA, 23 nt, Human
acaacaggaaaucagaccugaac

SEQ ID NO: 440833 - RNA, 22 nt, Human
auugaguaccuccagauucaua

SEQ ID NO: 440834 - RNA, 22 nt, Human
aagacaauuugauacuaguugc

SEQ ID NO: 440835 - RNA, 22 nt, Human
agcagcuggugcaacucuaaga

SEQ ID NO: 440836 - RNA, 22 nt, Human
agucccagaucuacaggaggga

SEQ ID NO: 440837 - RNA, 22 nt, Human
ucagcaguucaaccccgucaga

SEQ ID NO: 440838 - RNA, 22 nt, Human
ccuggccucgugcucacggcuc

SEQ ID NO: 440839 - RNA, 17 nt, Human
uacaggagagcaggaac

SEQ ID NO: 440840 - RNA, 19 nt, Human
aaggcugguaccauagguu

SEQ ID NO: 440841 - RNA, 22 nt, Human
uggccagccuugucaucgcuuu

SEQ ID NO: 440842 - RNA, 22 nt, Human
uuaaaggcgauaaggcaguguu

SEQ ID NO: 440843 - RNA, 22 nt, Human
aggaagaggguggcagauaauc

SEQ ID NO: 440844 - RNA, 17 nt, Human
uggcacagaggugcuau

SEQ ID NO: 440845 - RNA, 22 nt, Human
agcauguugggaugagaaggaa

SEQ ID NO: 440846 - RNA, 22 nt, Human
auuaucuauguagaaugauuuu

SEQ ID NO: 440847 - RNA, 22 nt, Human
uaugcaaacaguucaggugaca

SEQ ID NO: 440848 - RNA, 17 nt, Human
ugcagcugcucccaggc

SEQ ID NO: 440849 - RNA, 22 nt, Human
ugacacagaauuuggcuaucac

SEQ ID NO: 440850 - RNA, 22 nt, Human
aaaaguaauugcaauuuuguag

SEQ ID NO: 440851 - RNA, 22 nt, Human
agcagcuggugagcaagcucag

SEQ ID NO: 440852 - RNA, 22 nt, Human
ccagucuguacuuugcucuguu

SEQ ID NO: 440853 - RNA, 22 nt, Human
cccugcccaccacaugcuggga

SEQ ID NO: 440854 - RNA, 22 nt, Human
aacaucauuauguccauuaaug

SEQ ID NO: 440855 - RNA, 22 nt, Human
uucagcaaauggacuguucagg

SEQ ID NO: 440856 - RNA, 22 nt, Human
cccugcccuggagacacuuaaa

SEQ ID NO: 440857 - RNA, 22 nt, Human
aaugcauacguguuuguggcaa

SEQ ID NO: 440858 - RNA, 22 nt, Human
aucaggaaaaauugugaaaggg

SEQ ID NO: 440859 - RNA, 22 nt, Human
gggcuaggcuuggccagcacug

SEQ ID NO: 440860 - RNA, 22 nt, Human
agggacccugaugacugaggag

SEQ ID NO: 440861 - RNA, 22 nt, Human
ugcugccauggucgcugguguc

SEQ ID NO: 440862 - RNA, 23 nt, Human
ugcagcugccucuggcgggccgg

SEQ ID NO: 440863 - RNA, 22 nt, Human
uuagggaaggacagugaagaaa

SEQ ID NO: 440864 - RNA, 22 nt, Human
gcagaaggucuggcacuucagg

SEQ ID NO: 440865 - RNA, 22 nt, Human
uagcacuuguguuaugccuugu

SEQ ID NO: 440866 - RNA, 22 nt, Human
gcugucacaucaaggcacuaaa

SEQ ID NO: 440867 - RNA, 22 nt, Human
uucaucaccuugguagcacucc

SEQ ID NO: 440868 - RNA, 22 nt, Human
caggccuugaaggccugcggga

SEQ ID NO: 440869 - RNA, 22 nt, Human
ugcaggcaggggaugagcagcc

SEQ ID NO: 440870 - RNA, 22 nt, Human
gagacagagaucuugcugaguc

SEQ ID NO: 440871 - RNA, 22 nt, Human
auuucagaguagaucguuauuu

SEQ ID NO: 440872 - RNA, 22 nt, Human
ggcaggcucagcagccaaggag

SEQ ID NO: 440873 - RNA, 22 nt, Human
ucuuuaagccaagauauauuua

SEQ ID NO: 440874 - RNA, 22 nt, Human
cugcaggggccucgagcacagg

SEQ ID NO: 440875 - RNA, 22 nt, Human
gagacacaagacgcaacucugu

SEQ ID NO: 440876 - RNA, 20 nt, Human
auuagcucaggugaggucau

SEQ ID NO: 440877 - RNA, 22 nt, Human
ggucccagcugcucaagaggcu

SEQ ID NO: 440878 - RNA, 22 nt, Human
cccaaagaaaacaguaccucag

SEQ ID NO: 440879 - RNA, 22 nt, Human
agggacuccgugcacagugguu

SEQ ID NO: 440880 - RNA, 22 nt, Human
acaggccuacgaagucaggugc

SEQ ID NO: 440881 - RNA, 22 nt, Human
ucccaggcaggugacaggggga

SEQ ID NO: 440882 - RNA, 20 nt, Human
uccagacaucuagcucaguu

SEQ ID NO: 440883 - RNA, 22 nt, Human
acugaaacauauauuugaguuu

SEQ ID NO: 440884 - RNA, 22 nt, Human
cagaauuuagaaaacaacauaa

SEQ ID NO: 440885 - RNA, 22 nt, Human
aaaugccuguguaaauucuagc

SEQ ID NO: 440886 - RNA, 22 nt, Human
agagaggcugggcguagggcuu

SEQ ID NO: 440887 - RNA, 22 nt, Human
uguuuuuccaugugcagaacaa

SEQ ID NO: 440888 - RNA, 22 nt, Human
cuucuggggauggagcccagaa

SEQ ID NO: 440889 - RNA, 22 nt, Human
aaggccucccugugugcaggug

SEQ ID NO: 440890 - RNA, 22 nt, Human
ccaggcaggcagcguucucagg

SEQ ID NO: 440891 - RNA, 22 nt, Human
ccaugccuggacuccacucuca

SEQ ID NO: 440892 - RNA, 22 nt, Human
aagcccugacuaugaagacaua

SEQ ID NO: 440893 - RNA, 22 nt, Human
gagcaggcauucuaguggcuga

SEQ ID NO: 440894 - RNA, 22 nt, Human
cagagcugugauaaauagauau

SEQ ID NO: 440895 - RNA, 22 nt, Human
ucugggagagcugcugucagag

SEQ ID NO: 440896 - RNA, 22 nt, Human
gcagcagugugggcugaaccua

SEQ ID NO: 440897 - RNA, 22 nt, Human
cugggcuggagugcaauggcgc

SEQ ID NO: 440898 - RNA, 17 nt, Human
gaaaggaggcaacacug

SEQ ID NO: 440899 - RNA, 22 nt, Human
cugugaggccuuuggccagaua

SEQ ID NO: 440900 - RNA, 23 nt, Human
cuucagcagaaacauaaauucuc

SEQ ID NO: 440901 - RNA, 22 nt, Human
cuguuucaaaggguacugugag

SEQ ID NO: 440902 - RNA, 22 nt, Human
gcucagggagagagggcagccg

SEQ ID NO: 440903 - RNA, 22 nt, Human
augcuuggaugcugccauggga

SEQ ID NO: 440904 - RNA, 22 nt, Human
cuggguuuagggucuccccuug

SEQ ID NO: 440905 - RNA, 22 nt, Human
cugagucucccggcaguggagg

SEQ ID NO: 440906 - RNA, 22 nt, Human
gcagcccucgcuagcucucccc

SEQ ID NO: 440907 - RNA, 22 nt, Human
cagaugcaggucugcucaccug

SEQ ID NO: 440908 - RNA, 22 nt, Human
aagacauugucauuuuauaauu

SEQ ID NO: 440909 - RNA, 22 nt, Human
gaaauguaggcauaauuauuuu

SEQ ID NO: 440910 - RNA, 22 nt, Human
gacaagacugguuuauuuaagg

SEQ ID NO: 440911 - RNA, 22 nt, Human
uucuuuauagcuauuggaugag

SEQ ID NO: 440912 - RNA, 22 nt, Human
aaauggcaggcucuuugcuagu

SEQ ID NO: 440913 - RNA, 22 nt, Human
agccuggagaagauguguauug

SEQ ID NO: 440914 - RNA, 22 nt, Human
agggccagccccacccucucug

SEQ ID NO: 440915 - RNA, 22 nt, Human
gcaagcugugccuucucaggau

SEQ ID NO: 440916 - RNA, 22 nt, Human
cagagguugagcaaaaaugaua

SEQ ID NO: 440917 - RNA, 22 nt, Human
ccugggagguggagguugcagc

SEQ ID NO: 440918 - RNA, 22 nt, Human
gggugcaggcagcccaggcagg

SEQ ID NO: 440919 - RNA, 22 nt, Human
agcugaggcauggacaggcugc

SEQ ID NO: 440920 - RNA, 22 nt, Human
ugcagugccucggcagugcagc

SEQ ID NO: 440921 - RNA, 22 nt, Human
cugcccugagucaugccagaug

SEQ ID NO: 440922 - RNA, 22 nt, Human
auuuugaaauacuugaaggaaa

SEQ ID NO: 440923 - RNA, 22 nt, Human
gcagacuguaucaaugucagua

SEQ ID NO: 440924 - RNA, 22 nt, Human
aagugaauuucauuccaauucu

SEQ ID NO: 440925 - RNA, 22 nt, Human
aggcagcuuucagugucucuca

SEQ ID NO: 440926 - RNA, 22 nt, Human
aggagacauaacuaugaugaga

SEQ ID NO: 440927 - RNA, 22 nt, Human
ucucucagaggaagaggcagug

SEQ ID NO: 440928 - RNA, 22 nt, Human
ggcaccugcucaucuggacuca

SEQ ID NO: 440929 - RNA, 22 nt, Human
agcacauuaagugaguucaugu

SEQ ID NO: 440930 - RNA, 22 nt, Human
uaggcugggcugagcuggacgg

SEQ ID NO: 440931 - RNA, 22 nt, Human
agccacagcgaaccucucuucc

SEQ ID NO: 440932 - RNA, 22 nt, Human
aagaguuuucuauaaucuuggc

SEQ ID NO: 440933 - RNA, 22 nt, Human
acauuucucagggaguuuugcu

SEQ ID NO: 440934 - RNA, 22 nt, Human
aacaucuaguuccuauauaaua

SEQ ID NO: 440935 - RNA, 22 nt, Human
uagagcuguaucaaagagccuu

SEQ ID NO: 440936 - RNA, 22 nt, Human
uccucggcugggccccaggcuu

SEQ ID NO: 440937 - RNA, 22 nt, Human
uucaaacacagacagcagcaug

SEQ ID NO: 440938 - RNA, 22 nt, Human
caggcagcaggagcccugcucg

SEQ ID NO: 440939 - RNA, 22 nt, Human
gguuucuagcagagucucuuua

SEQ ID NO: 440940 - RNA, 22 nt, Human
ccaggagguggagauugcagug

SEQ ID NO: 440941 - RNA, 22 nt, Human
gagcccugugauucuguugugu

SEQ ID NO: 440942 - RNA, 22 nt, Human
gcuggcugaguucugucgucug

SEQ ID NO: 440943 - RNA, 22 nt, Human
aaauguaccuugauaguuuggu

SEQ ID NO: 440944 - RNA, 22 nt, Human
ugcaggcuggggaggcagacuu

SEQ ID NO: 440945 - RNA, 23 nt, Human
cagcuccagugcacucagguagc

SEQ ID NO: 440946 - RNA, 22 nt, Human
cugacaggguagacagagggca

SEQ ID NO: 440947 - RNA, 22 nt, Human
acuuagcaccuauggcauuuuu

SEQ ID NO: 440948 - RNA, 22 nt, Human
gaggcacaguguuuggucagug

SEQ ID NO: 440949 - RNA, 22 nt, Human
aauaacuucauguaacauuuaa

SEQ ID NO: 440950 - RNA, 22 nt, Human
uaucuagaacuccagaauguag

SEQ ID NO: 440951 - RNA, 22 nt, Human
cagcugccccgcuggcugacca

SEQ ID NO: 440952 - RNA, 22 nt, Human
cccagcagggucucugugucua

SEQ ID NO: 440953 - RNA, 22 nt, Human
agcagguuguuuuguggccagg

SEQ ID NO: 440954 - RNA, 22 nt, Human
aggaauuuuguauggauacugu

SEQ ID NO: 440955 - RNA, 22 nt, Human
cagagcaggaauaggguguuga

SEQ ID NO: 440956 - RNA, 20 nt, Human
gaugagacccaugcaugaga

SEQ ID NO: 440957 - RNA, 22 nt, Human
cauaaugaacauuagcuacugu

SEQ ID NO: 440958 - RNA, 22 nt, Human
aggcauggauguagcagugacc

SEQ ID NO: 440959 - RNA, 21 nt, Human
gcagacugcccugcugucccc

SEQ ID NO: 440960 - RNA, 15 nt, Human
ucugggcugugagca

SEQ ID NO: 440961 - RNA, 23 nt, Human
gggcaccaggagcaccggacagg

SEQ ID NO: 440962 - RNA, 22 nt, Human
ucccagcauuaaugccugucag

SEQ ID NO: 440963 - RNA, 20 nt, Human
aggcaugggaugcccagauu

SEQ ID NO: 440964 - RNA, 22 nt, Human
acugaaguguagguguuuuccu

SEQ ID NO: 440965 - RNA, 22 nt, Human
ccucagaggugaacaucagugc

SEQ ID NO: 440966 - RNA, 22 nt, Human
caaaauucugcauuucuaauaa

SEQ ID NO: 440967 - RNA, 22 nt, Human
guuccacagagucucacuauga

SEQ ID NO: 440968 - RNA, 22 nt, Human
ugugugccugagccgugccugg

SEQ ID NO: 440969 - RNA, 23 nt, Human
ugagcccaggaggucaaggcugc

SEQ ID NO: 440970 - RNA, 22 nt, Human
gaauacaaauaauaccaaggug

SEQ ID NO: 440971 - RNA, 22 nt, Human
uauuuauaacagugagaacggg

SEQ ID NO: 440972 - RNA, 22 nt, Human
ugggccuggcccuguggaggag

SEQ ID NO: 440973 - RNA, 22 nt, Human
agugggcagcccaggaggucuu

SEQ ID NO: 440974 - RNA, 22 nt, Human
cagggcccaggccacuggguug

SEQ ID NO: 440975 - RNA, 22 nt, Human
aaguucaaguguaaucuuuauu

SEQ ID NO: 440976 - RNA, 22 nt, Human
gaaaccuuugccgauggggucc

SEQ ID NO: 440977 - RNA, 20 nt, Human
ccagacagcaccugccuggu

SEQ ID NO: 440978 - RNA, 22 nt, Human
ugcagcugguuuagaacuagau

SEQ ID NO: 440979 - RNA, 22 nt, Human
agcagggcaaagucaggcuaac

SEQ ID NO: 440980 - RNA, 22 nt, Human
aaagcacuugaaaucuggcagu

SEQ ID NO: 440981 - RNA, 22 nt, Human
agggcuggcaucucuaaugcug

SEQ ID NO: 440982 - RNA, 21 nt, Human
agaggaagugauuggucuggc

SEQ ID NO: 440983 - RNA, 22 nt, Human
gccaggcuccaggcccuccuga

SEQ ID NO: 440984 - RNA, 18 nt, Human
uaucuuuuccagugguau

SEQ ID NO: 440985 - RNA, 22 nt, Human
gaggcaguuccugagugacaag

SEQ ID NO: 440986 - RNA, 22 nt, Human
cagcccuuaaauagauauacag

SEQ ID NO: 440987 - RNA, 18 nt, Human
augcauauuuuaaguugu

SEQ ID NO: 440988 - RNA, 22 nt, Human
agaugagggguagaaaggacuu

SEQ ID NO: 440989 - RNA, 22 nt, Human
uacagaguggugagaucuuuug

SEQ ID NO: 440990 - RNA, 22 nt, Human
gagcccuggcagucugggaugg

SEQ ID NO: 440991 - RNA, 22 nt, Human
cuucaaaucccccugaguuuga

SEQ ID NO: 440992 - RNA, 22 nt, Human
uguugcagagcuggggagggug

SEQ ID NO: 440993 - RNA, 22 nt, Human
gccugccucaaaaucccaguuc

SEQ ID NO: 440994 - RNA, 22 nt, Human
gaggccuugggaugugccacgg

SEQ ID NO: 440995 - RNA, 22 nt, Human
gcugucacucuccggccuuccc

SEQ ID NO: 440996 - RNA, 22 nt, Human
agcacugauuuaaacuggauuu

SEQ ID NO: 440997 - RNA, 22 nt, Human
aaggcaauaucaagagaauucg

SEQ ID NO: 440998 - RNA, 23 nt, Human
gcagcugguuagaagggaaggag

SEQ ID NO: 440999 - RNA, 22 nt, Human
caacaguuuauaguguuaucuu

SEQ ID NO: 441000 - RNA, 22 nt, Human
ucagaggugcaagaaguucuga

SEQ ID NO: 441001 - RNA, 22 nt, Human
ucauugaagugacugaaagauu

SEQ ID NO: 441002 - RNA, 22 nt, Human
cuguugcuaaguagugcaggua

SEQ ID NO: 441003 - RNA, 22 nt, Human
guagcccaccuggggagggcga

SEQ ID NO: 441004 - RNA, 22 nt, Human
cuggagcccaggccuggugucu

SEQ ID NO: 441005 - RNA, 22 nt, Human
gcuguuuccauuuaagugaauc

SEQ ID NO: 441006 - RNA, 22 nt, Human
ugcauauuauguguaucugucu

SEQ ID NO: 441007 - RNA, 22 nt, Human
agccuugaaugcgcugcauugg

SEQ ID NO: 441008 - RNA, 22 nt, Human
uuugcucugacagugccagaga

SEQ ID NO: 441009 - RNA, 18 nt, Human
gagcugagaagaggaugc

SEQ ID NO: 441010 - RNA, 22 nt, Human
cagccagggagcaaagaguuga

SEQ ID NO: 441011 - RNA, 21 nt, Human
gagacagacuuucguccccug

SEQ ID NO: 441012 - RNA, 22 nt, Human
cugcagcauccuagggucugug

SEQ ID NO: 441013 - RNA, 23 nt, Human
ggaggcacuuaggcagagcagag

SEQ ID NO: 441014 - RNA, 22 nt, Human
acauagaacuucccagugagca

SEQ ID NO: 441015 - RNA, 22 nt, Human
ccagcugcugugaggaccacag

SEQ ID NO: 441016 - RNA, 20 nt, Human
ucaggcuggugggcuuuccc

SEQ ID NO: 441017 - RNA, 22 nt, Human
cagggagaaaucuccaggaggu

SEQ ID NO: 441018 - RNA, 22 nt, Human
gcacagggagcaggucucuggu

SEQ ID NO: 441019 - RNA, 22 nt, Human
aggcacaggaggugguaagaag

SEQ ID NO: 441020 - RNA, 22 nt, Human
aaguuucaaauguugauuaugc

SEQ ID NO: 441021 - RNA, 22 nt, Human
gcuggguuuccagcaggcagga

SEQ ID NO: 441022 - RNA, 22 nt, Human
guacauauuaaaggucuauaaa

SEQ ID NO: 441023 - RNA, 19 nt, Human
uauaggaagugugguuaag

SEQ ID NO: 441024 - RNA, 22 nt, Human
aaggcagcaugaaucccuguac

SEQ ID NO: 441025 - RNA, 22 nt, Human
ucagagugcagggaguagcagc

SEQ ID NO: 441026 - RNA, 22 nt, Human
agccucugguccucccucagcu

SEQ ID NO: 441027 - RNA, 22 nt, Human
cuuugcagaaauaaacuugaug

SEQ ID NO: 441028 - RNA, 23 nt, Human
cugaggccugcugcguucagguu

SEQ ID NO: 441029 - RNA, 23 nt, Human
gagagcugacugucaagacuguu

SEQ ID NO: 441030 - RNA, 21 nt, Human
gcucugccacuuaccagauuu

SEQ ID NO: 441031 - RNA, 22 nt, Human
ucaggcugcagcugucagcagc

SEQ ID NO: 441032 - RNA, 22 nt, Human
gguuaaaacugauauuaugggu

SEQ ID NO: 441033 - RNA, 23 nt, Human
aaguacauauauuuagauaguga

SEQ ID NO: 441034 - RNA, 17 nt, Human
gguacaaacccauuuuu

SEQ ID NO: 441035 - RNA, 22 nt, Human
cccuggagaucgggagaggaag

SEQ ID NO: 441036 - RNA, 22 nt, Human
ucccuggcacaagaaggcuguc

SEQ ID NO: 441037 - RNA, 22 nt, Human
uggggcuggcacagucucuauu

SEQ ID NO: 441038 - RNA, 22 nt, Human
gccaccagguuagauccagccu

SEQ ID NO: 441039 - RNA, 22 nt, Human
uggagcaggacugcugcccuca

SEQ ID NO: 441040 - RNA, 22 nt, Human
aaguugaucaaguagcgaguuc

SEQ ID NO: 441041 - RNA, 22 nt, Human
gcugccugauguccagcaggac

SEQ ID NO: 441042 - RNA, 22 nt, Human
caggcaggagccagggauucca

SEQ ID NO: 441043 - RNA, 22 nt, Human
cagcuguuguguaucaggcaga

SEQ ID NO: 441044 - RNA, 18 nt, Human
ucugucucuguccuugcu

SEQ ID NO: 441045 - RNA, 22 nt, Human
accugccuauggagccacaugg

SEQ ID NO: 441046 - RNA, 22 nt, Human
gaggcacaucacuuggugcauu

SEQ ID NO: 441047 - RNA, 22 nt, Human
cagagagggcggcccuggcuuc

SEQ ID NO: 441048 - RNA, 18 nt, Human
cccagcccaccauuucuc

SEQ ID NO: 441049 - RNA, 22 nt, Human
auauuuuguaacuuggaauagg

SEQ ID NO: 441050 - RNA, 22 nt, Human
agccucugggggagcugggagc

SEQ ID NO: 441051 - RNA, 22 nt, Human
aauuggcaagcagauuuccacu

SEQ ID NO: 441052 - RNA, 22 nt, Human
agagaagacuuacagccacagu

SEQ ID NO: 441053 - RNA, 22 nt, Human
aacaaauuaguugcaagacugg

SEQ ID NO: 441054 - RNA, 17 nt, Human
accagccucuccugggg

SEQ ID NO: 441055 - RNA, 22 nt, Human
agcagcugguaggaguggccac

SEQ ID NO: 441056 - RNA, 22 nt, Human
cauuuuacgacauagggcaggc

SEQ ID NO: 441057 - RNA, 20 nt, Human
aggaagcugagauguagagg

SEQ ID NO: 441058 - RNA, 22 nt, Human
aaacugcaauuauuuuugcaau

SEQ ID NO: 441059 - RNA, 22 nt, Human
aaggaagaugcuggccugggga

SEQ ID NO: 441060 - RNA, 22 nt, Human
ggagccuggccuggcucugugu

SEQ ID NO: 441061 - RNA, 22 nt, Human
ccuuucucuuggauaccgauug

SEQ ID NO: 441062 - RNA, 22 nt, Human
acugggcaauaaauucagagaa

SEQ ID NO: 441063 - RNA, 22 nt, Human
cuuuaacaguuccauucaauuu

SEQ ID NO: 441064 - RNA, 22 nt, Human
aucaugcagguuucuccuuucu

SEQ ID NO: 441065 - RNA, 21 nt, Human
agaguuacugucauccuaggu

SEQ ID NO: 441066 - RNA, 20 nt, Human
agcccaucucccacagcuac

SEQ ID NO: 441067 - RNA, 22 nt, Human
cccagcuccgagcuccgagccg

SEQ ID NO: 441068 - RNA, 22 nt, Human
aggcagaaaauagucauccaaa

SEQ ID NO: 441069 - RNA, 22 nt, Human
ggaagagaaaugagucaagacu

SEQ ID NO: 441070 - RNA, 18 nt, Human
ucacaugacagcuguugc

SEQ ID NO: 441071 - RNA, 22 nt, Human
gcugugcugauucauucccugc

SEQ ID NO: 441072 - RNA, 17 nt, Human
agcacuaaaaugcuucc

SEQ ID NO: 441073 - RNA, 22 nt, Human
aguugauuuuucuggcucagcc

SEQ ID NO: 441074 - RNA, 22 nt, Human
ucuaaagauguuuauugacaua

SEQ ID NO: 441075 - RNA, 22 nt, Human
accccagcucugagccacacca

SEQ ID NO: 441076 - RNA, 22 nt, Human
cuggucccagcagagcucugag

SEQ ID NO: 441077 - RNA, 22 nt, Human
augcugagacuggagcagcugg

SEQ ID NO: 441078 - RNA, 22 nt, Human
ggucccagcuggucacugucag

SEQ ID NO: 441079 - RNA, 22 nt, Human
aacauucuuaagauuugugucu

SEQ ID NO: 441080 - RNA, 22 nt, Human
ucucagaguuugaaucuggagu

SEQ ID NO: 441081 - RNA, 19 nt, Human
gcucagagccaugggggcu

SEQ ID NO: 441082 - RNA, 22 nt, Human
guuauauugccaaguauauugu

SEQ ID NO: 441083 - RNA, 22 nt, Human
gcagcagcagggagucugacuu

SEQ ID NO: 441084 - RNA, 22 nt, Human
gcucaggcucucccaggggaau

SEQ ID NO: 441085 - RNA, 22 nt, Human
ucucagaguuuagagcugagcc

SEQ ID NO: 441086 - RNA, 23 nt, Human
ggacagggcccugcccuauggcc

SEQ ID NO: 441087 - RNA, 22 nt, Human
ugagugccuaccaagugcugga

SEQ ID NO: 441088 - RNA, 22 nt, Human
cagcagcuuugccaagucagcc

SEQ ID NO: 441089 - RNA, 21 nt, Human
agcagacagaugcacgcacac

SEQ ID NO: 441090 - RNA, 22 nt, Human
ggaacauuuccuggcagagagg

SEQ ID NO: 441091 - RNA, 22 nt, Human
gagggaagucauaauguucuag

SEQ ID NO: 441092 - RNA, 22 nt, Human
cugcugagcccuggcacaggug

SEQ ID NO: 441093 - RNA, 22 nt, Human
agcuccuccugugccaggccag

SEQ ID NO: 441094 - RNA, 22 nt, Human
cugaacuuauugagugcuugcu

SEQ ID NO: 441095 - RNA, 22 nt, Human
ucugagaagcaccuucuggaca

SEQ ID NO: 441096 - RNA, 22 nt, Human
uuuucuaaaauauccaggacag

SEQ ID NO: 441097 - RNA, 22 nt, Human
auucuuuaauucaauugaagga

SEQ ID NO: 441098 - RNA, 22 nt, Human
aauucagagacaugaagugaca

SEQ ID NO: 441099 - RNA, 22 nt, Human
gagcuagcuucuuccagguuuc

SEQ ID NO: 441100 - RNA, 23 nt, Human
auggaagucacuguuuucuuguc

SEQ ID NO: 441101 - RNA, 22 nt, Human
ucagacagauuuugacacuugc

SEQ ID NO: 441102 - RNA, 22 nt, Human
cacauuuauuugaggcuaauug

SEQ ID NO: 441103 - RNA, 19 nt, Human
aggaaaggaucaaaauagc

SEQ ID NO: 441104 - RNA, 22 nt, Human
gcacagcccuggucggggcccc

SEQ ID NO: 441105 - RNA, 22 nt, Human
gagccuggauugucaccgacuu

SEQ ID NO: 441106 - RNA, 22 nt, Human
uauuucuauuccccaggcaagu

SEQ ID NO: 441107 - RNA, 22 nt, Human
gacagcaaccucaugagaaacu

SEQ ID NO: 441108 - RNA, 22 nt, Human
gacacugaccccaagcuguccu

SEQ ID NO: 441109 - RNA, 22 nt, Human
cccuccaggccugucauguucc

SEQ ID NO: 441110 - RNA, 17 nt, Human
gcugagaggcagcacag

SEQ ID NO: 441111 - RNA, 17 nt, Human
ucagcaggggccaagcu

SEQ ID NO: 441112 - RNA, 22 nt, Human
auguguguguauauacacacau

SEQ ID NO: 441113 - RNA, 22 nt, Human
aggcauggcauggggcagaugu

SEQ ID NO: 441114 - RNA, 22 nt, Human
ggcaccagccaccuauuucuag

SEQ ID NO: 441115 - RNA, 22 nt, Human
acacuaaucuuuuauuugguuu

SEQ ID NO: 441116 - RNA, 22 nt, Human
cgcugccaggucaccaggggua

SEQ ID NO: 441117 - RNA, 22 nt, Human
cagggagcagcgcuggggccuc

SEQ ID NO: 441118 - RNA, 22 nt, Human
uucaaguacuguagauuucagg

SEQ ID NO: 441119 - RNA, 22 nt, Human
accugccucagugcagcuggau

SEQ ID NO: 441120 - RNA, 22 nt, Human
ccacaguaggaacaaguugucg

SEQ ID NO: 441121 - RNA, 22 nt, Human
aguccaauaaccucuuuccuuc

SEQ ID NO: 441122 - RNA, 22 nt, Human
aacccacaagcagcuguagccc

SEQ ID NO: 441123 - RNA, 22 nt, Human
gcuccuggcaggcagugugugu

SEQ ID NO: 441124 - RNA, 22 nt, Human
ugacaaaccaguagcaauaaag

SEQ ID NO: 441125 - RNA, 22 nt, Human
cagcccuggccucuucgcuuuc

SEQ ID NO: 441126 - RNA, 22 nt, Human
gaauuucaacaguccucaaaug

SEQ ID NO: 441127 - RNA, 22 nt, Human
gauggcacacagacauccccgc

SEQ ID NO: 441128 - RNA, 22 nt, Human
ccccagcagacucagggcaggu

SEQ ID NO: 441129 - RNA, 22 nt, Human
cccaggaggcagaaguugcagu

SEQ ID NO: 441130 - RNA, 21 nt, Human
auuguucuggaggaaaggauu

SEQ ID NO: 441131 - RNA, 22 nt, Human
augcagcuagauuuuccagugu

SEQ ID NO: 441132 - RNA, 22 nt, Human
ugcagcugcucauucucucagu

SEQ ID NO: 441133 - RNA, 22 nt, Human
uuuucuucuaccugcuguccaa

SEQ ID NO: 441134 - RNA, 22 nt, Human
ccauccauguggcagggcuggc

SEQ ID NO: 441135 - RNA, 22 nt, Human
ggcccuguccuggcugucuccg

SEQ ID NO: 441136 - RNA, 21 nt, Human
agcagaggggacauguuugau

SEQ ID NO: 441137 - RNA, 20 nt, Human
aacagggggcugcagagggc

SEQ ID NO: 441138 - RNA, 22 nt, Human
uuuggcagaggaagaaggcaca

SEQ ID NO: 441139 - RNA, 22 nt, Human
aggaagagcuggaccagaggac

SEQ ID NO: 441140 - RNA, 22 nt, Human
gcaggcuggaggcuguucuggg

SEQ ID NO: 441141 - RNA, 22 nt, Human
uaccauaacguaaugaacuuga

SEQ ID NO: 441142 - RNA, 22 nt, Human
acauagaguucaauuuucaguc

SEQ ID NO: 441143 - RNA, 22 nt, Human
gcaaacauaauaugaagacacu

SEQ ID NO: 441144 - RNA, 22 nt, Human
aaacugcaauuauguuugcaga

SEQ ID NO: 441145 - RNA, 22 nt, Human
acaacauuauacauagaaagcu

SEQ ID NO: 441146 - RNA, 22 nt, Human
ugcauuaucgucuugauccucu

SEQ ID NO: 441147 - RNA, 22 nt, Human
uauauucaacaggcuaauguca

SEQ ID NO: 441148 - RNA, 22 nt, Human
augacaauauagcuuugauuuu

SEQ ID NO: 441149 - RNA, 22 nt, Human
aagcugccauagaacgagaggu

SEQ ID NO: 441150 - RNA, 22 nt, Human
aaguugauuuaaacuacuaguc

SEQ ID NO: 441151 - RNA, 20 nt, Human
uuuauucacagagaagaguu

SEQ ID NO: 441152 - RNA, 22 nt, Human
cucuuuuucagccuuaccaaag

SEQ ID NO: 441153 - RNA, 21 nt, Human
aggagcuguguuagcuggucg

SEQ ID NO: 441154 - RNA, 22 nt, Human
cagcugacaagaguccuuggag

SEQ ID NO: 441155 - RNA, 22 nt, Human
ccagggaggagcauuucauggu

SEQ ID NO: 441156 - RNA, 22 nt, Human
uggaugagauuaaagugagguu

SEQ ID NO: 441157 - RNA, 22 nt, Human
uucaaguagucacacaugauau

SEQ ID NO: 441158 - RNA, 22 nt, Human
aagauucuuaccuauacccagu

SEQ ID NO: 441159 - RNA, 22 nt, Human
ccagcucuuggugcacuuacau

SEQ ID NO: 441160 - RNA, 22 nt, Human
ucagcacugauguuucagaaga

SEQ ID NO: 441161 - RNA, 22 nt, Human
uccuggauucugcccugaaggc

SEQ ID NO: 441162 - RNA, 22 nt, Human
ugguacaaguucuggcauguga

SEQ ID NO: 441163 - RNA, 22 nt, Human
caaugcuucucauuagccaaug

SEQ ID NO: 441164 - RNA, 22 nt, Human
auuauuuagaaaucgauugaaa

SEQ ID NO: 441165 - RNA, 22 nt, Human
auguacaagcuguuuuacugca

SEQ ID NO: 441166 - RNA, 22 nt, Human
uugucugaaucuggagcucucu

SEQ ID NO: 441167 - RNA, 22 nt, Human
agcagcuggguccggcggagca

SEQ ID NO: 441168 - RNA, 22 nt, Human
uccugaagagguugucuuuaua

SEQ ID NO: 441169 - RNA, 22 nt, Human
uuauaacaucaaucagaguuaa

SEQ ID NO: 441170 - RNA, 22 nt, Human
ccgggccucgggacaccgggua

SEQ ID NO: 441171 - RNA, 22 nt, Human
aaaggaagugccacucuucuuc

SEQ ID NO: 441172 - RNA, 22 nt, Human
agcugguguccuccuggagcug

SEQ ID NO: 441173 - RNA, 22 nt, Human
cauuggucuucuaacagagaga

SEQ ID NO: 441174 - RNA, 16 nt, Human
uucagaauuuguagaa

SEQ ID NO: 441175 - RNA, 22 nt, Human
aauucagaguccuggccccacg

SEQ ID NO: 441176 - RNA, 22 nt, Human
cccagggagagcgcggaggcgg

SEQ ID NO: 441177 - RNA, 22 nt, Human
aaaaguuuaagacucauucuag

SEQ ID NO: 441178 - RNA, 22 nt, Human
agacagggucuugaucagagcu

SEQ ID NO: 441179 - RNA, 22 nt, Human
uuuauucauuguuucgucgcag

SEQ ID NO: 441180 - RNA, 19 nt, Human
ccauggcaaugaucugaug

SEQ ID NO: 441181 - RNA, 22 nt, Human
uuacaguacagaaaauaacaga

SEQ ID NO: 441182 - RNA, 22 nt, Human
ugaaggagaaauggaaaguggg

SEQ ID NO: 441183 - RNA, 22 nt, Human
ugccacagaggugaagcccacu

SEQ ID NO: 441184 - RNA, 22 nt, Human
aauaacuuaagaaauuucccca

SEQ ID NO: 441185 - RNA, 22 nt, Human
ugcugccacaaauucagcugcc

SEQ ID NO: 441186 - RNA, 22 nt, Human
ggcuuugcaaaaucggcuucug

SEQ ID NO: 441187 - RNA, 22 nt, Human
caggcuggaguacaauugugug

SEQ ID NO: 441188 - RNA, 22 nt, Human
uccuuccagguccagggaugug

SEQ ID NO: 441189 - RNA, 22 nt, Human
agggaagaggaccagagucucu

SEQ ID NO: 441190 - RNA, 22 nt, Human
caaguauucuguaaaaagucaa

SEQ ID NO: 441191 - RNA, 22 nt, Human
ucaguccucacuugguucuaag

SEQ ID NO: 441192 - RNA, 22 nt, Human
gagggggcgugcaaggcuccgc

SEQ ID NO: 441193 - RNA, 22 nt, Human
uagauggaggcuagaugcaggg

SEQ ID NO: 441194 - RNA, 22 nt, Human
guggccugggguuuguucugag

SEQ ID NO: 441195 - RNA, 22 nt, Human
caaguauuugcggaguuccacg

SEQ ID NO: 441196 - RNA, 22 nt, Human
agcuaaggccgcguugggguaa

SEQ ID NO: 441197 - RNA, 22 nt, Human
aggugccaauuuucagugaaca

SEQ ID NO: 441198 - RNA, 22 nt, Human
aagagcccugguugaaaauaac

SEQ ID NO: 441199 - RNA, 22 nt, Human
ucuggagauaagacagacagau

SEQ ID NO: 441200 - RNA, 22 nt, Human
caggccugagacaucugagaua

SEQ ID NO: 441201 - RNA, 22 nt, Human
cuggcugguccucggggacagc

SEQ ID NO: 441202 - RNA, 22 nt, Human
caacagucucuauagcuccuug

SEQ ID NO: 441203 - RNA, 22 nt, Human
auauucaaauuacauuuacuaa

SEQ ID NO: 441204 - RNA, 22 nt, Human
agccugagugcuuaggacuguu

SEQ ID NO: 441205 - RNA, 22 nt, Human
uuccugaaaauacagggagaga

SEQ ID NO: 441206 - RNA, 22 nt, Human
agacccugguaaacacuccagg

SEQ ID NO: 441207 - RNA, 22 nt, Human
ccacacagucaguuuccaagaa

SEQ ID NO: 441208 - RNA, 22 nt, Human
caggccugacccugagcuucac

SEQ ID NO: 441209 - RNA, 23 nt, Human
ugggccagggaguccgguuucuu

SEQ ID NO: 441210 - RNA, 22 nt, Human
ccugugccauccugagcauccc

SEQ ID NO: 441211 - RNA, 22 nt, Human
aaagacauauuucuaaguuuau

SEQ ID NO: 441212 - RNA, 22 nt, Human
aaacugcaggucaugacccauu

SEQ ID NO: 441213 - RNA, 22 nt, Human
uuugcaaacauucagggcucca

SEQ ID NO: 441214 - RNA, 22 nt, Human
agcaagcuaccuagauagucua

SEQ ID NO: 441215 - RNA, 22 nt, Human
ggagcuguaacgagccauugcu

SEQ ID NO: 441216 - RNA, 22 nt, Human
gcagggaccuugcccacccucc

SEQ ID NO: 441217 - RNA, 22 nt, Human
gcugcagcuguaggacacaauu

SEQ ID NO: 441218 - RNA, 22 nt, Human
ggaggagacggagugauuagug

SEQ ID NO: 441219 - RNA, 21 nt, Human
ucacuggacgugagccagggg

SEQ ID NO: 441220 - RNA, 22 nt, Human
agggcagcucucaccucuggcc

SEQ ID NO: 441221 - RNA, 22 nt, Human
ucacagcaaaagugugcagagc

SEQ ID NO: 441222 - RNA, 22 nt, Human
gcacacaggcaguuuccagcca

SEQ ID NO: 441223 - RNA, 22 nt, Human
gccuguucugcccugagagccu

SEQ ID NO: 441224 - RNA, 21 nt, Human
ucaggcugucugcugguucca

SEQ ID NO: 441225 - RNA, 22 nt, Human
agucccagugagaugaaccagg

SEQ ID NO: 441226 - RNA, 22 nt, Human
aacauguaaccagcauucaucu

SEQ ID NO: 441227 - RNA, 22 nt, Human
agagaaugcagggcuucggaca

SEQ ID NO: 441228 - RNA, 23 nt, Human
guuaacaugguccauggaagagc

SEQ ID NO: 441229 - RNA, 22 nt, Human
auauauuuugcggucacguggc

SEQ ID NO: 441230 - RNA, 22 nt, Human
caucagucccacggagcagccc

SEQ ID NO: 441231 - RNA, 22 nt, Human
aaauggcaauuuaguuuauuua

SEQ ID NO: 441232 - RNA, 22 nt, Human
aaggcugaguaaaacagagaac

SEQ ID NO: 441233 - RNA, 22 nt, Human
uuuucuuauagagcuuaaaguu

SEQ ID NO: 441234 - RNA, 22 nt, Human
aggggccuggacauggacgcgc

SEQ ID NO: 441235 - RNA, 22 nt, Human
cagcuggggcagccacgugcgg

SEQ ID NO: 441236 - RNA, 22 nt, Human
uuuuguuuguguccacugcagu

SEQ ID NO: 441237 - RNA, 22 nt, Human
uuuguacacugucuacuaugaa

SEQ ID NO: 441238 - RNA, 22 nt, Human
gagguggcuggcucagagccag

SEQ ID NO: 441239 - RNA, 22 nt, Human
cagcagugucuccagcaucaca

SEQ ID NO: 441240 - RNA, 22 nt, Human
gcacugcagguggguggagagg

SEQ ID NO: 441241 - RNA, 22 nt, Human
ugcagcagacugaguaugagaa

SEQ ID NO: 441242 - RNA, 22 nt, Human
uaaaaaguugaaaggacuuauc

SEQ ID NO: 441243 - RNA, 22 nt, Human
ccauggccugaaggagugcauc

SEQ ID NO: 441244 - RNA, 22 nt, Human
ucccaggcuggggccaggugac

SEQ ID NO: 441245 - RNA, 22 nt, Human
caguccugugucccuugguggg

SEQ ID NO: 441246 - RNA, 22 nt, Human
auguacaaucuaucacaagaag

SEQ ID NO: 441247 - RNA, 22 nt, Human
ucggagcuguagaugaaacccu

SEQ ID NO: 441248 - RNA, 22 nt, Human
gggcacaguacuccaaucaacu

SEQ ID NO: 441249 - RNA, 22 nt, Human
ccugagcaacuucaagggccug

SEQ ID NO: 441250 - RNA, 22 nt, Human
cuuuauucugcaaauugccuug

SEQ ID NO: 441251 - RNA, 22 nt, Human
accaggaacaagccauggagga

SEQ ID NO: 441252 - RNA, 22 nt, Human
ccacugucagaggggcugugcc

SEQ ID NO: 441253 - RNA, 22 nt, Human
agcaacaggaauauuauggcaa

SEQ ID NO: 441254 - RNA, 22 nt, Human
gcugaggcaaaccaagaaugua

SEQ ID NO: 441255 - RNA, 21 nt, Human
agccagauccauuuugcaugg

SEQ ID NO: 441256 - RNA, 21 nt, Human
ugcagcuggguucugguuugc

SEQ ID NO: 441257 - RNA, 22 nt, Human
augcaacauacauucugaagcu

SEQ ID NO: 441258 - RNA, 22 nt, Human
aggcaauagaauaugccugagg

SEQ ID NO: 441259 - RNA, 22 nt, Human
cacugccauguugauagaugug

SEQ ID NO: 441260 - RNA, 22 nt, Human
ucuaaugagggugaaggcccag

SEQ ID NO: 441261 - RNA, 22 nt, Human
aggcucuccuccccaggaccau

SEQ ID NO: 441262 - RNA, 22 nt, Human
ucauugaaugagaugcaauaga

SEQ ID NO: 441263 - RNA, 22 nt, Human
agucugcacucagguggagguc

SEQ ID NO: 441264 - RNA, 22 nt, Human
aucaugcagcaacaagcaaggc

SEQ ID NO: 441265 - RNA, 22 nt, Human
agggacaguuacaucaucagac

SEQ ID NO: 441266 - RNA, 21 nt, Human
ucccagagugcuugggacugc

SEQ ID NO: 441267 - RNA, 22 nt, Human
cauguucagugacaguuauuga

SEQ ID NO: 441268 - RNA, 22 nt, Human
ggccuggaaugcuuuccuacca

SEQ ID NO: 441269 - RNA, 22 nt, Human
ugauuuuauugaaacuucacuu

SEQ ID NO: 441270 - RNA, 22 nt, Human
uuuauucacucauucagccagu

SEQ ID NO: 441271 - RNA, 22 nt, Human
auacuuaugauaaauaauugcu

SEQ ID NO: 441272 - RNA, 22 nt, Human
aaguccugugcuagagacaccu

SEQ ID NO: 441273 - RNA, 22 nt, Human
caggcagcaucagucugcugua

SEQ ID NO: 441274 - RNA, 22 nt, Human
uacaugaauuugagucagagga

SEQ ID NO: 441275 - RNA, 22 nt, Human
ggcugagcucaggggcagcagg

SEQ ID NO: 441276 - RNA, 22 nt, Human
uuaacauuguccuuagcagauu

SEQ ID NO: 441277 - RNA, 22 nt, Human
cugugucccccucagccaggug

SEQ ID NO: 441278 - RNA, 17 nt, Human
cucagagcaggacagaa

SEQ ID NO: 441279 - RNA, 22 nt, Human
cccaggagacauauagaaggac

SEQ ID NO: 441280 - RNA, 22 nt, Human
uuuuuuguuggguagaacggaa

SEQ ID NO: 441281 - RNA, 22 nt, Human
uucaaguaacacaaaugcaccc

SEQ ID NO: 441282 - RNA, 19 nt, Human
cacauuuugagucugagau

SEQ ID NO: 441283 - RNA, 22 nt, Human
gcccacaguuaguuugcauggc

SEQ ID NO: 441284 - RNA, 22 nt, Human
uaauuacagguccaaaacaauc

SEQ ID NO: 441285 - RNA, 22 nt, Human
aaugcauaccaugucaucuuug

SEQ ID NO: 441286 - RNA, 22 nt, Human
gccuggcccagggcucuuguug

SEQ ID NO: 441287 - RNA, 22 nt, Human
cuuauuguguguauuuucuagu

SEQ ID NO: 441288 - RNA, 22 nt, Human
ggcuaggggaauaaucuguggu

SEQ ID NO: 441289 - RNA, 22 nt, Human
uuuauugucuaugaacugcuug

SEQ ID NO: 441290 - RNA, 22 nt, Human
uuugggcauauagcuguucccu

SEQ ID NO: 441291 - RNA, 20 nt, Human
ugcagagcuggcuggcuccu

SEQ ID NO: 441292 - RNA, 22 nt, Human
ggcuuauguuugucaagcaauc

SEQ ID NO: 441293 - RNA, 22 nt, Human
cagaagcaagagccggagcuag

SEQ ID NO: 441294 - RNA, 22 nt, Human
ccauggcaaaggagauguuuuc

SEQ ID NO: 441295 - RNA, 22 nt, Human
ggcagcugagaucaugcuguug

SEQ ID NO: 441296 - RNA, 21 nt, Human
guggccugauuaugaaugggu

SEQ ID NO: 441297 - RNA, 22 nt, Human
guuuuucugugagcgguaaagg

SEQ ID NO: 441298 - RNA, 22 nt, Human
acagcagccugcagcccugugu

SEQ ID NO: 441299 - RNA, 22 nt, Human
caauauucaguggaaaagccau

SEQ ID NO: 441300 - RNA, 22 nt, Human
uguuuuaagcucuagaagggga

SEQ ID NO: 441301 - RNA, 22 nt, Human
gcagagccccauugcuggcggg

SEQ ID NO: 441302 - RNA, 22 nt, Human
gcucagggaacuuuuugcaggc

SEQ ID NO: 441303 - RNA, 22 nt, Human
uuggccagacugaggugcuggg

SEQ ID NO: 441304 - RNA, 22 nt, Human
uucucccacuccgugcuucagu

SEQ ID NO: 441305 - RNA, 23 nt, Human
cagggccaggcagcagcugucac

SEQ ID NO: 441306 - RNA, 22 nt, Human
uuuaaccugucaauuugcaugc

SEQ ID NO: 441307 - RNA, 22 nt, Human
gagcacugauuuauuuuugucu

SEQ ID NO: 441308 - RNA, 22 nt, Human
augcauauuggauuagcagcca

SEQ ID NO: 441309 - RNA, 22 nt, Human
cccagguggguuggccucuguc

SEQ ID NO: 441310 - RNA, 22 nt, Human
gagcuccaccaccuucaggcag

SEQ ID NO: 441311 - RNA, 22 nt, Human
uuugggcaguagauguaucacu

SEQ ID NO: 441312 - RNA, 22 nt, Human
uuagacauguuugcuaaaauga

SEQ ID NO: 441313 - RNA, 20 nt, Human
ugcccacaucacucaggagu

SEQ ID NO: 441314 - RNA, 22 nt, Human
uuacaauaguuccuucuuuugu

SEQ ID NO: 441315 - RNA, 22 nt, Human
ugagcccuugacaucgcccacu

SEQ ID NO: 441316 - RNA, 22 nt, Human
agggaagccaagccuuagagaa

SEQ ID NO: 441317 - RNA, 22 nt, Human
cuucugugcuucacaguugcca

SEQ ID NO: 441318 - RNA, 22 nt, Human
gcucuggcuacuguggcuaccg

SEQ ID NO: 441319 - RNA, 21 nt, Human
gggcuccagagauguagcuuc

SEQ ID NO: 441320 - RNA, 22 nt, Human
ugaagccagcuuuggaagacac

SEQ ID NO: 441321 - RNA, 22 nt, Human
uuuauccagaaucaggauuuuu

SEQ ID NO: 441322 - RNA, 22 nt, Human
cugucccaggagcuguaagaca

SEQ ID NO: 441323 - RNA, 22 nt, Human
ccagagaagucuugccuggauu

SEQ ID NO: 441324 - RNA, 22 nt, Human
gcugucccaugguugcaagaug

SEQ ID NO: 441325 - RNA, 22 nt, Human
ccuaggcccucaaagagcauaa

SEQ ID NO: 441326 - RNA, 22 nt, Human
uaaagucaagguacuguuucac

SEQ ID NO: 441327 - RNA, 22 nt, Human
aauacuauguagccaaaauaau

SEQ ID NO: 441328 - RNA, 22 nt, Human
uuuccuuugggagcaugaauuu

SEQ ID NO: 441329 - RNA, 22 nt, Human
ccaggcuggagugcaauggugc

SEQ ID NO: 441330 - RNA, 22 nt, Human
agcagcagaagggagacccagg

SEQ ID NO: 441331 - RNA, 22 nt, Human
aaagaggcaaucaauguagcaa

SEQ ID NO: 441332 - RNA, 22 nt, Human
gcacagggagacagccguggcc

SEQ ID NO: 441333 - RNA, 22 nt, Human
agaacagcaguuaugguucauu

SEQ ID NO: 441334 - RNA, 22 nt, Human
cuuugcagcucuagguggaagc

SEQ ID NO: 441335 - RNA, 22 nt, Human
ccucccagugccggggccggcu

SEQ ID NO: 441336 - RNA, 22 nt, Human
ggcagaaggccucccagcuccu

SEQ ID NO: 441337 - RNA, 21 nt, Human
uaauuuauucagcacaguguu

SEQ ID NO: 441338 - RNA, 22 nt, Human
guuccuuagaguugauauggua

SEQ ID NO: 441339 - RNA, 19 nt, Human
ccaggccuccugggagguc

SEQ ID NO: 441340 - RNA, 22 nt, Human
ugaggcagaaaauagcaguuca

SEQ ID NO: 441341 - RNA, 22 nt, Human
cagcaggccaugcugcuuuuca

SEQ ID NO: 441342 - RNA, 22 nt, Human
gcagcugggucugugugggcug

SEQ ID NO: 441343 - RNA, 22 nt, Human
aaaauucauuccucagacugcc

SEQ ID NO: 441344 - RNA, 22 nt, Human
agcucccagaaggcccugcgcc

SEQ ID NO: 441345 - RNA, 22 nt, Human
cagcucugaugaaauguaccag

SEQ ID NO: 441346 - RNA, 20 nt, Human
uuucagagugucuuuccauu

SEQ ID NO: 441347 - RNA, 22 nt, Human
uccugcagugugucuccugcac

SEQ ID NO: 441348 - RNA, 22 nt, Human
uugcaaaagccgaggcacucca

SEQ ID NO: 441349 - RNA, 22 nt, Human
aacagcuauuagaacuucaugg

SEQ ID NO: 441350 - RNA, 22 nt, Human
auucagagucugcacaacagca

SEQ ID NO: 441351 - RNA, 22 nt, Human
cagcuguccaaacacauuaacu

SEQ ID NO: 441352 - RNA, 18 nt, Human
agcagagcccaugcauuc

SEQ ID NO: 441353 - RNA, 22 nt, Human
ccacuuugagaagcugaugaaa

SEQ ID NO: 441354 - RNA, 22 nt, Human
uguaugaagacuucuucugugu

SEQ ID NO: 441355 - RNA, 19 nt, Human
cuuugcaaagcccugugua

SEQ ID NO: 441356 - RNA, 22 nt, Human
cugcugggucuaugcaagugga

SEQ ID NO: 441357 - RNA, 22 nt, Human
acugggcuagaguggaagcugg

SEQ ID NO: 441358 - RNA, 22 nt, Human
agugggugauaagaccaaggag

SEQ ID NO: 441359 - RNA, 22 nt, Human
uccucagacacccugcuggcuu

SEQ ID NO: 441360 - RNA, 22 nt, Human
aggcaauauuccauguggaacu

SEQ ID NO: 441361 - RNA, 22 nt, Human
cagaaugcauugcuucugaugg

SEQ ID NO: 441362 - RNA, 22 nt, Human
ucccagagucagagguggggcc

SEQ ID NO: 441363 - RNA, 22 nt, Human
ugcagccaucgcagagucugua

SEQ ID NO: 441364 - RNA, 22 nt, Human
uaacaugaaacuccaaauggua

SEQ ID NO: 441365 - RNA, 22 nt, Human
cuaggcugcagaugcauggaau

SEQ ID NO: 441366 - RNA, 22 nt, Human
acauuucucagguaagucauuu

SEQ ID NO: 441367 - RNA, 22 nt, Human
aacagugucaggauuacagaua

SEQ ID NO: 441368 - RNA, 22 nt, Human
agcuguuuaugcacuccugccu

SEQ ID NO: 441369 - RNA, 22 nt, Human
ggugagaaaaaugaguaugauu

SEQ ID NO: 441370 - RNA, 20 nt, Human
ccugucuccucuuaccuggc

SEQ ID NO: 441371 - RNA, 22 nt, Human
ugcagcugcugguggcugaaag

SEQ ID NO: 441372 - RNA, 23 nt, Human
gcacagagcaguuaggggaagau

SEQ ID NO: 441373 - RNA, 22 nt, Human
uuauacgcucaauccuaucauc

SEQ ID NO: 441374 - RNA, 22 nt, Human
cuauuacauuucuggacauuca

SEQ ID NO: 441375 - RNA, 23 nt, Human
acagggcauugcuggccucgagg

SEQ ID NO: 441376 - RNA, 22 nt, Human
uucagaauguacugauagaaca

SEQ ID NO: 441377 - RNA, 23 nt, Human
cagcccuuccugcauguuuuugu

SEQ ID NO: 441378 - RNA, 22 nt, Human
ugagauaguauauggaaagagu

SEQ ID NO: 441379 - RNA, 22 nt, Human
uugaaugaaugguccauauaga

SEQ ID NO: 441380 - RNA, 22 nt, Human
ggcaauaaugacauuuuaaaaa

SEQ ID NO: 441381 - RNA, 22 nt, Human
augggaggguggaaaggcucug

SEQ ID NO: 441382 - RNA, 22 nt, Human
ccugggaagagcugacaggagg

SEQ ID NO: 441383 - RNA, 22 nt, Human
caacauuucaaggucuuuagga

SEQ ID NO: 441384 - RNA, 22 nt, Human
gcacagcacagcaacauguuuu

SEQ ID NO: 441385 - RNA, 19 nt, Human
cagagcagugguuccugaa

SEQ ID NO: 441386 - RNA, 23 nt, Human
uuucacauuaauguuuagcagga

SEQ ID NO: 441387 - RNA, 22 nt, Human
gcaggcaccucguggaguggaa

SEQ ID NO: 441388 - RNA, 22 nt, Human
ucaggcuggagugcaguggcgc

SEQ ID NO: 441389 - RNA, 22 nt, Human
gccucagccggcggacgccagg

SEQ ID NO: 441390 - RNA, 22 nt, Human
gcccuggaugcucauggcauca

SEQ ID NO: 441391 - RNA, 22 nt, Human
cuuauugugucuuugaauaagu

SEQ ID NO: 441392 - RNA, 23 nt, Human
ucugucacuuucugcuguggagu

SEQ ID NO: 441393 - RNA, 22 nt, Human
auaaugcauuuagaauaauuca

SEQ ID NO: 441394 - RNA, 22 nt, Human
gcugguccagggccucuguggg

SEQ ID NO: 441395 - RNA, 22 nt, Human
aacaggcuuuuggaaaguuaca

SEQ ID NO: 441396 - RNA, 22 nt, Human
gcuggagccuucugcucuguug

SEQ ID NO: 441397 - RNA, 22 nt, Human
agacacaguauaagcacaacaa

SEQ ID NO: 441398 - RNA, 22 nt, Human
agaggggagagcuaagcaauuc

SEQ ID NO: 441399 - RNA, 22 nt, Human
ucugggcucuuaguguacccuc

SEQ ID NO: 441400 - RNA, 22 nt, Human
cagaggccuuucuacagugaua

SEQ ID NO: 441401 - RNA, 22 nt, Human
ccagcagcucccucaggguccg

SEQ ID NO: 441402 - RNA, 22 nt, Human
aggcccuggcccccagagauuc

SEQ ID NO: 441403 - RNA, 22 nt, Human
cccuggaguagcacugggucgc

SEQ ID NO: 441404 - RNA, 20 nt, Human
auuuguuucuacucucugac

SEQ ID NO: 441405 - RNA, 22 nt, Human
cugaagcucuccaguuuguuuc

SEQ ID NO: 441406 - RNA, 22 nt, Human
cuugaugagguaugaaccucuc

SEQ ID NO: 441407 - RNA, 22 nt, Human
ugccuggguguaaagggccaac

SEQ ID NO: 441408 - RNA, 22 nt, Human
aagcccugcagucucugccaca

SEQ ID NO: 441409 - RNA, 22 nt, Human
gggucaggcucagcagggcagc

SEQ ID NO: 441410 - RNA, 22 nt, Human
gaggccucaggcgugggaaggg

SEQ ID NO: 441411 - RNA, 22 nt, Human
aguuucacacaacauuugcaug

SEQ ID NO: 441412 - RNA, 22 nt, Human
ucuuuggaugcguuacuuuuac

SEQ ID NO: 441413 - RNA, 22 nt, Human
agcugagguugaagagugaacg

SEQ ID NO: 441414 - RNA, 22 nt, Human
aaaguuuuuaagcaagacccuu

SEQ ID NO: 441415 - RNA, 22 nt, Human
ggguccccucaucauggagacu

SEQ ID NO: 441416 - RNA, 22 nt, Human
aguauucuggaauucuauguga

SEQ ID NO: 441417 - RNA, 19 nt, Human
augcuuuauguuauuucuu

SEQ ID NO: 441418 - RNA, 22 nt, Human
aauucaaauuacaauaguuguu

SEQ ID NO: 441419 - RNA, 22 nt, Human
uuugcagcuucugguggccucu

SEQ ID NO: 441420 - RNA, 22 nt, Human
cacaggagagcugggaggugcc

SEQ ID NO: 441421 - RNA, 22 nt, Human
uguuucaggaccuaucuuuuag

SEQ ID NO: 441422 - RNA, 22 nt, Human
auucugucuuuuuaaaauaaua

SEQ ID NO: 441423 - RNA, 22 nt, Human
aaggcaauuuguugugaggauu

SEQ ID NO: 441424 - RNA, 22 nt, Human
uuaacacuugaacucuacaugu

SEQ ID NO: 441425 - RNA, 22 nt, Human
ccaggaagccucagaugcugag

SEQ ID NO: 441426 - RNA, 22 nt, Human
ucaaacuggcagacuucuacuu

SEQ ID NO: 441427 - RNA, 22 nt, Human
caggcagagaacucauccguga

SEQ ID NO: 441428 - RNA, 22 nt, Human
ugaggacauuaggaagugaagg

SEQ ID NO: 441429 - RNA, 21 nt, Human
cacugcauuaagucuguaggu

SEQ ID NO: 441430 - RNA, 22 nt, Human
cugcugagcaucagggcugccc

SEQ ID NO: 441431 - RNA, 22 nt, Human
aacaaucaaguuucuaaaugac

SEQ ID NO: 441432 - RNA, 23 nt, Human
uagcagcauuuuuagccucuguc

SEQ ID NO: 441433 - RNA, 22 nt, Human
aaaaugcaugagaaugugcucg

SEQ ID NO: 441434 - RNA, 22 nt, Human
acagaguagcucaagaagauug

SEQ ID NO: 441435 - RNA, 21 nt, Human
uccagaggaggacagacucag

SEQ ID NO: 441436 - RNA, 22 nt, Human
gaggauggaggugugagcuaug

SEQ ID NO: 441437 - RNA, 22 nt, Human
ucugccuggguguggagcagag

SEQ ID NO: 441438 - RNA, 22 nt, Human
ccucaugaguucuucugcccau

SEQ ID NO: 441439 - RNA, 22 nt, Human
uuccugggugguccugguagag

SEQ ID NO: 441440 - RNA, 22 nt, Human
acuuuggaggguguuguagaug

SEQ ID NO: 441441 - RNA, 22 nt, Human
uugcaaaugggcaaagcagauc

SEQ ID NO: 441442 - RNA, 22 nt, Human
acaggcagcacuaaucucuggu

SEQ ID NO: 441443 - RNA, 22 nt, Human
gcuggguggaucggaggcucug

SEQ ID NO: 441444 - RNA, 22 nt, Human
ccagcccuugcugaaggguggc

SEQ ID NO: 441445 - RNA, 22 nt, Human
agccuggauccuaggcucagcu

SEQ ID NO: 441446 - RNA, 22 nt, Human
aaggcaaugaauacuguuuuug

SEQ ID NO: 441447 - RNA, 22 nt, Human
uggugagagcagaccuucuuuu

SEQ ID NO: 441448 - RNA, 22 nt, Human
aggcagucuaguccccaggcaa

SEQ ID NO: 441449 - RNA, 22 nt, Human
gcaagagcgcucucuuucauua

SEQ ID NO: 441450 - RNA, 22 nt, Human
ucacugcagacaaccucaguca

SEQ ID NO: 441451 - RNA, 22 nt, Human
aggaaaaaagucugugauuaua

SEQ ID NO: 441452 - RNA, 22 nt, Human
ucauucagguugggcaaguguc

SEQ ID NO: 441453 - RNA, 22 nt, Human
ucaaucacguguuccauguucu

SEQ ID NO: 441454 - RNA, 22 nt, Human
ugcauauuguccuugauauuau

SEQ ID NO: 441455 - RNA, 22 nt, Human
uggcucugagacacaggcucuc

SEQ ID NO: 441456 - RNA, 22 nt, Human
ggcugagggucccagacccuaa

SEQ ID NO: 441457 - RNA, 22 nt, Human
agggcugagacuaaggccagau

SEQ ID NO: 441458 - RNA, 23 nt, Human
agguuaugauuauagagcgagga

SEQ ID NO: 441459 - RNA, 22 nt, Human
cuauuauuagauaaucuacuug

SEQ ID NO: 441460 - RNA, 19 nt, Human
ugacacagcuagguuugcu

SEQ ID NO: 441461 - RNA, 22 nt, Human
aauaauuuugagagccuggaaa

SEQ ID NO: 441462 - RNA, 22 nt, Human
ucuggccaggggucccugaagg

SEQ ID NO: 441463 - RNA, 22 nt, Human
gcucagagagaggcucaccauu

SEQ ID NO: 441464 - RNA, 18 nt, Human
gccagugcccuggcucac

SEQ ID NO: 441465 - RNA, 22 nt, Human
ucacaguaguuguucucuguuu

SEQ ID NO: 441466 - RNA, 22 nt, Human
uuaaaugagauguucagauauu

SEQ ID NO: 441467 - RNA, 22 nt, Human
gcaggccugcccagcaggaugg

SEQ ID NO: 441468 - RNA, 22 nt, Human
auauuguacuaggguuacaugu

SEQ ID NO: 441469 - RNA, 22 nt, Human
cauguaaugcugggagcugggc

SEQ ID NO: 441470 - RNA, 22 nt, Human
ucccagagcucugacaccagcu

SEQ ID NO: 441471 - RNA, 22 nt, Human
ggcagaagaaaggcuaagucuc

SEQ ID NO: 441472 - RNA, 22 nt, Human
ugcagaccucccauggcugccu

SEQ ID NO: 441473 - RNA, 22 nt, Human
ccaggucuuguuugacaucaau

SEQ ID NO: 441474 - RNA, 22 nt, Human
gcugucacacaugggaucucag

SEQ ID NO: 441475 - RNA, 22 nt, Human
gccugagcccaggugugcagag

SEQ ID NO: 441476 - RNA, 22 nt, Human
aggcucccaugguguggcagga

SEQ ID NO: 441477 - RNA, 22 nt, Human
ccaguacugucuccaauauucc

SEQ ID NO: 441478 - RNA, 22 nt, Human
gcucagggaaugagaagauguu

SEQ ID NO: 441479 - RNA, 22 nt, Human
auguacaaucuaggguuugcau

SEQ ID NO: 441480 - RNA, 22 nt, Human
aaacugcagagccaugguucaa

SEQ ID NO: 441481 - RNA, 22 nt, Human
cagcaggguuaagugacucacc

SEQ ID NO: 441482 - RNA, 22 nt, Human
uaaggcagagguaccacuaggc

SEQ ID NO: 441483 - RNA, 22 nt, Human
acuucaaauuuucagaagaaau

SEQ ID NO: 441484 - RNA, 22 nt, Human
uuuuacaaaugaggagcuggag

SEQ ID NO: 441485 - RNA, 23 nt, Human
agcagcaaaaauuuaucuuucug

SEQ ID NO: 441486 - RNA, 22 nt, Human
cugggacaugauagaaacagau

SEQ ID NO: 441487 - RNA, 22 nt, Human
uggccagcugagauuuagcaca

SEQ ID NO: 441488 - RNA, 22 nt, Human
ccagcugcaggggagcagugga

SEQ ID NO: 441489 - RNA, 22 nt, Human
uugagaaacaucuaaucuuugu

SEQ ID NO: 441490 - RNA, 22 nt, Human
gcuggagcugcagccugggccu

SEQ ID NO: 441491 - RNA, 22 nt, Human
ucaacauuuaugaagcuguggc

SEQ ID NO: 441492 - RNA, 22 nt, Human
uccagaguacggaagagucauc

SEQ ID NO: 441493 - RNA, 22 nt, Human
ccuccuggugggcgcuucuggc

SEQ ID NO: 441494 - RNA, 22 nt, Human
ugcagccccccagauggccgua

SEQ ID NO: 441495 - RNA, 22 nt, Human
ucuuucucucuaaucaagcaca

SEQ ID NO: 441496 - RNA, 22 nt, Human
cgucccagcagauaaaugagga

SEQ ID NO: 441497 - RNA, 22 nt, Human
augagcugugggauuccagagg

SEQ ID NO: 441498 - RNA, 22 nt, Human
ugcaaauuggugaggaccacuu

SEQ ID NO: 441499 - RNA, 22 nt, Human
gauuuuauuagcccaaacuuug

SEQ ID NO: 441500 - RNA, 22 nt, Human
cauguacacacaaagggacaau

SEQ ID NO: 441501 - RNA, 19 nt, Human
uaugacaaguacuaguucu

SEQ ID NO: 441502 - RNA, 18 nt, Human
gagaaggccacuuguuuu

SEQ ID NO: 441503 - RNA, 22 nt, Human
acagagaaagugggcugaagau

SEQ ID NO: 441504 - RNA, 22 nt, Human
aagcacuggguauagcaaugau

SEQ ID NO: 441505 - RNA, 22 nt, Human
guguguguucaauaaauuuaag

SEQ ID NO: 441506 - RNA, 22 nt, Human
gaccacugaaugcacuucuaau

SEQ ID NO: 441507 - RNA, 22 nt, Human
cacugguagagagaagacaagg

SEQ ID NO: 441508 - RNA, 20 nt, Human
agcuggugaauuaaagacug

SEQ ID NO: 441509 - RNA, 22 nt, Human
gccagcagcugugggguggcca

SEQ ID NO: 441510 - RNA, 22 nt, Human
auacauacauguacacauaaau

SEQ ID NO: 441511 - RNA, 22 nt, Human
ggcagagacuggguuggcagag

SEQ ID NO: 441512 - RNA, 22 nt, Human
ucugaggccccugggcaggaug

SEQ ID NO: 441513 - RNA, 22 nt, Human
uggaguugugucaucuuuguaa

SEQ ID NO: 441514 - RNA, 22 nt, Human
gagcaggaaggccagaaggguc

SEQ ID NO: 441515 - RNA, 22 nt, Human
ugcaguggaggccgugagacag

SEQ ID NO: 441516 - RNA, 22 nt, Human
augcauaucagugauuguuugc

SEQ ID NO: 441517 - RNA, 22 nt, Human
cagcaguaauuagugcugcaug

SEQ ID NO: 441518 - RNA, 22 nt, Human
gccagcugccaaguugugagau

SEQ ID NO: 441519 - RNA, 22 nt, Human
gcagcuggucuggccuagagua

SEQ ID NO: 441520 - RNA, 22 nt, Human
auuagcaauugugcaucuagua

SEQ ID NO: 441521 - RNA, 22 nt, Human
ggacccacagauucuucauucu

SEQ ID NO: 441522 - RNA, 22 nt, Human
aaacuuuuuuagguucauaggc

SEQ ID NO: 441523 - RNA, 22 nt, Human
augcccugccaagcaggcuaaa

SEQ ID NO: 441524 - RNA, 22 nt, Human
aucauaauugcuccagugauau

SEQ ID NO: 441525 - RNA, 22 nt, Human
ggcuccaacacuaaauguguuu

SEQ ID NO: 441526 - RNA, 22 nt, Human
augcaauaccuucugaaaauaa

SEQ ID NO: 441527 - RNA, 22 nt, Human
cuugcuuuaucugguuucucau

SEQ ID NO: 441528 - RNA, 22 nt, Human
agcagggguaacagaaggaaag

SEQ ID NO: 441529 - RNA, 22 nt, Human
ccaggguggggcaggcccacug

SEQ ID NO: 441530 - RNA, 22 nt, Human
cagcagcugguugaauccuucu

SEQ ID NO: 441531 - RNA, 22 nt, Human
ugucccaguuuugcagguuaga

SEQ ID NO: 441532 - RNA, 22 nt, Human
uuucaaacauaucuucauuacu

SEQ ID NO: 441533 - RNA, 20 nt, Human
cccagggaccugagcuccau

SEQ ID NO: 441534 - RNA, 22 nt, Human
ugcagcugcuggcccaggugcu

SEQ ID NO: 441535 - RNA, 22 nt, Human
ggaagggcggauaguauaaguu

SEQ ID NO: 441536 - RNA, 22 nt, Human
guguauccuuauucacacacau

SEQ ID NO: 441537 - RNA, 21 nt, Human
gcccacagugaggaggauccc

SEQ ID NO: 441538 - RNA, 22 nt, Human
gagggcucacugagaaagcagu

SEQ ID NO: 441539 - RNA, 22 nt, Human
ugaaacaggcaaaacugcagau

SEQ ID NO: 441540 - RNA, 18 nt, Human
cugaggcuggcaggagcc

SEQ ID NO: 441541 - RNA, 22 nt, Human
ggcuccucucuggccgcucccg

SEQ ID NO: 441542 - RNA, 22 nt, Human
uggcagauuuucucuggaggag

SEQ ID NO: 441543 - RNA, 22 nt, Human
cugcccuggaaaacguaucuua

SEQ ID NO: 441544 - RNA, 22 nt, Human
cccagcuaccucugcuaggaga

SEQ ID NO: 441545 - RNA, 22 nt, Human
ugcccaggcuucacccucagag

SEQ ID NO: 441546 - RNA, 20 nt, Human
agugaauagagacauugccc

SEQ ID NO: 441547 - RNA, 22 nt, Human
cagcagcagccccaggaagguu

SEQ ID NO: 441548 - RNA, 22 nt, Human
uccagggaguuggcuggauagu

SEQ ID NO: 441549 - RNA, 22 nt, Human
cauuucacuauucacuaaaagg

SEQ ID NO: 441550 - RNA, 22 nt, Human
uugagcuguauaccuaugacug

SEQ ID NO: 441551 - RNA, 22 nt, Human
ugaucuuugggccauuaauaaa

SEQ ID NO: 441552 - RNA, 22 nt, Human
uugcaaauuaaagaggauagca

SEQ ID NO: 441553 - RNA, 22 nt, Human
aaauacauaaagguuguaccag

SEQ ID NO: 441554 - RNA, 22 nt, Human
uuuguuuacucauucauugaug

SEQ ID NO: 441555 - RNA, 22 nt, Human
cagcucuggcuuuggggagcuu

SEQ ID NO: 441556 - RNA, 22 nt, Human
cauaauuacugauaugcugauu

SEQ ID NO: 441557 - RNA, 22 nt, Human
agucccagcuacucaagaggcu

SEQ ID NO: 441558 - RNA, 22 nt, Human
aaggccugcucagcugucugug

SEQ ID NO: 441559 - RNA, 22 nt, Human
ccuggcucugggaucuucgcuu

SEQ ID NO: 441560 - RNA, 22 nt, Human
gaugcugcucgggugccuggga

SEQ ID NO: 441561 - RNA, 22 nt, Human
accugccuaucagcugccugcu

SEQ ID NO: 441562 - RNA, 22 nt, Human
auuuugaugcuaucuaaugaau

SEQ ID NO: 441563 - RNA, 22 nt, Human
gcuuagcacagaaugagaguuc

SEQ ID NO: 441564 - RNA, 22 nt, Human
ugguggcagucuccuggcugug

SEQ ID NO: 441565 - RNA, 22 nt, Human
ccacccuggacaggccucugag

SEQ ID NO: 441566 - RNA, 22 nt, Human
agacacuguucucacaugcuug

SEQ ID NO: 441567 - RNA, 22 nt, Human
augaagcuguuuauuuuagcag

SEQ ID NO: 441568 - RNA, 22 nt, Human
augggucccuggccgcccucgg

SEQ ID NO: 441569 - RNA, 22 nt, Human
guuccugaaagaugaguaauua

SEQ ID NO: 441570 - RNA, 22 nt, Human
gaucugggcuggagacugagaa

SEQ ID NO: 441571 - RNA, 18 nt, Human
ucaagacaucaugaaaua

SEQ ID NO: 441572 - RNA, 22 nt, Human
ggaugugaaucugggcugagac

SEQ ID NO: 441573 - RNA, 22 nt, Human
cucccagagagcaggugggccg

SEQ ID NO: 441574 - RNA, 22 nt, Human
caggcugggcagccuccccggc

SEQ ID NO: 441575 - RNA, 22 nt, Human
caugaaauguguuaaucucuug

SEQ ID NO: 441576 - RNA, 23 nt, Human
agcaacagugggugaguguugcu

SEQ ID NO: 441577 - RNA, 22 nt, Human
guguguguaucugccuaucaca

SEQ ID NO: 441578 - RNA, 22 nt, Human
uugcaauagccuuauuuccaaa

SEQ ID NO: 441579 - RNA, 22 nt, Human
uacaguacacagguaccaagcu

SEQ ID NO: 441580 - RNA, 22 nt, Human
ugggcagacgggagcuugccuu

SEQ ID NO: 441581 - RNA, 22 nt, Human
guggaaggaauuaacagacuag

SEQ ID NO: 441582 - RNA, 22 nt, Human
ggcucagggaaugaggaagaau

SEQ ID NO: 441583 - RNA, 22 nt, Human
gugcccaggcccaaggcaccac

SEQ ID NO: 441584 - RNA, 22 nt, Human
agcugccgaugcccagcugcau

SEQ ID NO: 441585 - RNA, 22 nt, Human
cacaggaaaugauucugcagca

SEQ ID NO: 441586 - RNA, 21 nt, Human
aggcagcuggaaggccuggcu

SEQ ID NO: 441587 - RNA, 22 nt, Human
cccaggaauuggaggcugcagu

SEQ ID NO: 441588 - RNA, 22 nt, Human
ccaguggguaggccauggugag

SEQ ID NO: 441589 - RNA, 22 nt, Human
uguaugaaucucauuuguuuaa

SEQ ID NO: 441590 - RNA, 22 nt, Human
aaaggcaugcauggucugcucc

SEQ ID NO: 441591 - RNA, 22 nt, Human
aaggcacauauuuuagagucac

SEQ ID NO: 441592 - RNA, 17 nt, Human
cccagagaugcugccuu

SEQ ID NO: 441593 - RNA, 22 nt, Human
cugcagcuguagaggacagugg

SEQ ID NO: 441594 - RNA, 19 nt, Human
agcagagcccugaagaucc

SEQ ID NO: 441595 - RNA, 22 nt, Human
auuuuacuuugugaauauugac

SEQ ID NO: 441596 - RNA, 22 nt, Human
auuuuuuauauaccaagguggg

SEQ ID NO: 441597 - RNA, 21 nt, Human
ucuugaaaaguuagauucucu

SEQ ID NO: 441598 - RNA, 22 nt, Human
aaguucaaggcagguccugagg

SEQ ID NO: 441599 - RNA, 22 nt, Human
aauguauaaaguguuaauaacu

SEQ ID NO: 441600 - RNA, 22 nt, Human
augggacacguuuuaaggaaaa

SEQ ID NO: 441601 - RNA, 22 nt, Human
gcucagagaaaacuggggcuug

SEQ ID NO: 441602 - RNA, 22 nt, Human
cagugggugaaagauggcuaag

SEQ ID NO: 441603 - RNA, 22 nt, Human
cugaggcucccucgggucugcu

SEQ ID NO: 441604 - RNA, 22 nt, Human
ugcccagccuaaacuuggcaag

SEQ ID NO: 441605 - RNA, 22 nt, Human
agagcagugcugaagaguaggg

SEQ ID NO: 441606 - RNA, 22 nt, Human
acagccagaggugguccugggu

SEQ ID NO: 441607 - RNA, 22 nt, Human
guucaaguuucugagcuuuaau

SEQ ID NO: 441608 - RNA, 22 nt, Human
gcugcccaggguggagccggcu

SEQ ID NO: 441609 - RNA, 22 nt, Human
ucaggccucagcagcccacagg

SEQ ID NO: 441610 - RNA, 22 nt, Human
aaggcuggucagauguggugaa

SEQ ID NO: 441611 - RNA, 22 nt, Human
uucaaaucagaccgaaggcaac

SEQ ID NO: 441612 - RNA, 22 nt, Human
agucaguggcuccgagccuggu

SEQ ID NO: 441613 - RNA, 22 nt, Human
cagugguuucugaacagugugc

SEQ ID NO: 441614 - RNA, 22 nt, Human
auaacuuagaguaggcaaaagu

SEQ ID NO: 441615 - RNA, 22 nt, Human
ggcagauggaagaggcuggguc

SEQ ID NO: 441616 - RNA, 22 nt, Human
gccucuggggcagcugagucau

SEQ ID NO: 441617 - RNA, 22 nt, Human
ucccugggaccggcagcucaca

SEQ ID NO: 441618 - RNA, 22 nt, Human
agcugggccugagcuggaagcu

SEQ ID NO: 441619 - RNA, 22 nt, Human
gcagagcaguacucucuugacu

SEQ ID NO: 441620 - RNA, 22 nt, Human
aauacauaauaaguuuugucug

SEQ ID NO: 441621 - RNA, 22 nt, Human
uuguuuaaaauguagcaagaaa

SEQ ID NO: 441622 - RNA, 22 nt, Human
gaggacaaggccuugcaauucu

SEQ ID NO: 441623 - RNA, 22 nt, Human
uucacacuguuuuucauagugg

SEQ ID NO: 441624 - RNA, 18 nt, Human
agcagcuuugugcuugau

SEQ ID NO: 441625 - RNA, 22 nt, Human
ugaggcagugcugggaagccug

SEQ ID NO: 441626 - RNA, 18 nt, Human
ugaagacaugagguuagu

SEQ ID NO: 441627 - RNA, 22 nt, Human
cccugggacccgcugcagaggc

SEQ ID NO: 441628 - RNA, 22 nt, Human
cagacauggcgccaagugcuag

SEQ ID NO: 441629 - RNA, 18 nt, Human
uuugcuuuccuucuucag

SEQ ID NO: 441630 - RNA, 22 nt, Human
caaugcauuauucucccacuuc

SEQ ID NO: 441631 - RNA, 22 nt, Human
gagcaacagggcgaggagaacu

SEQ ID NO: 441632 - RNA, 22 nt, Human
ggcauccaguucugaucaacaa

SEQ ID NO: 441633 - RNA, 22 nt, Human
uauacagucuuuugcuauauuc

SEQ ID NO: 441634 - RNA, 22 nt, Human
aauguuacgaucaacaacacau

SEQ ID NO: 441635 - RNA, 17 nt, Human
ggcaccagacggagagu

SEQ ID NO: 441636 - RNA, 22 nt, Human
ucccaggaucugagggcagaga

SEQ ID NO: 441637 - RNA, 22 nt, Human
cuucuugaaaguggugacccuc

SEQ ID NO: 441638 - RNA, 19 nt, Human
ggccccagccaggguauca

SEQ ID NO: 441639 - RNA, 18 nt, Human
agccucuggcagagagaa

SEQ ID NO: 441640 - RNA, 22 nt, Human
ggcaggacauugacuacaguga

SEQ ID NO: 441641 - RNA, 19 nt, Human
uccagccugcuguuucucu

SEQ ID NO: 441642 - RNA, 22 nt, Human
gagucaggcaugaagguaauua

SEQ ID NO: 441643 - RNA, 22 nt, Human
aguuuacaucuucaaucucauu

SEQ ID NO: 441644 - RNA, 22 nt, Human
gcugcuuuuuggauuuggcaca

SEQ ID NO: 441645 - RNA, 22 nt, Human
cuuggccugacauguggcaggg

SEQ ID NO: 441646 - RNA, 22 nt, Human
cauuuuggcuauuguaaauagu

SEQ ID NO: 441647 - RNA, 22 nt, Human
gcaaacauguugugagauacca

SEQ ID NO: 441648 - RNA, 22 nt, Human
cuggucccugcagugugcuggg

SEQ ID NO: 441649 - RNA, 22 nt, Human
ggggcagaaagcccacagagug

SEQ ID NO: 441650 - RNA, 22 nt, Human
ucaauacuuaagcuuaauucua

SEQ ID NO: 441651 - RNA, 22 nt, Human
gcauauuuucacaagcucuugg

SEQ ID NO: 441652 - RNA, 22 nt, Human
uuguuaaaauuggagccgagag

SEQ ID NO: 441653 - RNA, 17 nt, Human
agauggcaggaggcaga

SEQ ID NO: 441654 - RNA, 22 nt, Human
cagcacugcuucgcagccaggg

SEQ ID NO: 441655 - RNA, 22 nt, Human
agcuucuggaaggcaaggcuug

SEQ ID NO: 441656 - RNA, 22 nt, Human
agacaaguucugugggucaccu

SEQ ID NO: 441657 - RNA, 22 nt, Human
uggaaggaaagguagcagagaa

SEQ ID NO: 441658 - RNA, 20 nt, Human
uucagaguuuacucaaacug

SEQ ID NO: 441659 - RNA, 22 nt, Human
uccucagcuuuuauuucacuug

SEQ ID NO: 441660 - RNA, 22 nt, Human
guacagagguugcuggaggcuc

SEQ ID NO: 441661 - RNA, 22 nt, Human
ccagcagacacacaggcguggg

SEQ ID NO: 441662 - RNA, 22 nt, Human
ucuccccuguuggccagguuuu

SEQ ID NO: 441663 - RNA, 22 nt, Human
aggcuggcagccaccucagcag

SEQ ID NO: 441664 - RNA, 22 nt, Human
gugucccagccccacaggccug

SEQ ID NO: 441665 - RNA, 21 nt, Human
cagagggcuuuucucuguucu

SEQ ID NO: 441666 - RNA, 22 nt, Human
ucacaccuguaaucccaggccu

SEQ ID NO: 441667 - RNA, 22 nt, Human
augcuuuacaguuuuccaaaca

SEQ ID NO: 441668 - RNA, 22 nt, Human
gacacuuuauuaagcuguuguu

SEQ ID NO: 441669 - RNA, 22 nt, Human
gcaaggaagcagaguugcuauc

SEQ ID NO: 441670 - RNA, 22 nt, Human
cuguggcuggccugucugacau

SEQ ID NO: 441671 - RNA, 22 nt, Human
gagcaguugggcucuaggaagu

SEQ ID NO: 441672 - RNA, 22 nt, Human
ugggcagaauugugguaguuaa

SEQ ID NO: 441673 - RNA, 22 nt, Human
cuuuacaaauuagcucucggga

SEQ ID NO: 441674 - RNA, 22 nt, Human
ucagggaccccucugaguggag

SEQ ID NO: 441675 - RNA, 22 nt, Human
ccagcuggagcucgcagauagg

SEQ ID NO: 441676 - RNA, 22 nt, Human
aagcaacauucucuguggcauu

SEQ ID NO: 441677 - RNA, 22 nt, Human
aguacuuuagcauaaagcaguu

SEQ ID NO: 441678 - RNA, 22 nt, Human
augucccaagauacagcuagag

SEQ ID NO: 441679 - RNA, 22 nt, Human
ucagcagggcugggagcuguga

SEQ ID NO: 441680 - RNA, 22 nt, Human
ccccaccuugcaauuguucccu

SEQ ID NO: 441681 - RNA, 22 nt, Human
aaaagaggagugguuuaugaca

SEQ ID NO: 441682 - RNA, 22 nt, Human
gugcaauagacugugguauuaa

SEQ ID NO: 441683 - RNA, 22 nt, Human
cuggcuccaaggaagagguuuu

SEQ ID NO: 441684 - RNA, 22 nt, Human
ucagaggaaaggucagauggcu

SEQ ID NO: 441685 - RNA, 23 nt, Human
aauuaaauugcuagauccagggc

SEQ ID NO: 441686 - RNA, 22 nt, Human
gcacacagccagcugagggcua

SEQ ID NO: 441687 - RNA, 22 nt, Human
ucacugcucucuaagcaucgcc

SEQ ID NO: 441688 - RNA, 22 nt, Human
cacauguaguaagcaggcaaug

SEQ ID NO: 441689 - RNA, 22 nt, Human
cagagccagcuguccuuggcau

SEQ ID NO: 441690 - RNA, 22 nt, Human
ucagggaaaagucacacugggu

SEQ ID NO: 441691 - RNA, 22 nt, Human
cgucuccuguguucgagccauu

SEQ ID NO: 441692 - RNA, 22 nt, Human
cagucuaagacucacgccaaga

SEQ ID NO: 441693 - RNA, 22 nt, Human
cugagaucuuuauacgaggcac

SEQ ID NO: 441694 - RNA, 22 nt, Human
gcuuugcauucuugugugauca

SEQ ID NO: 441695 - RNA, 22 nt, Human
uuaguacauugauucauuaugu

SEQ ID NO: 441696 - RNA, 22 nt, Human
uggagcaggugcucaggguaau

SEQ ID NO: 441697 - RNA, 22 nt, Human
ugcccuguggguaucugauggc

SEQ ID NO: 441698 - RNA, 22 nt, Human
ugcuuugcucugucucuagcua

SEQ ID NO: 441699 - RNA, 23 nt, Human
uggaagcagaaguuucaauaucc

SEQ ID NO: 441700 - RNA, 22 nt, Human
agcaggcacgcucccugcgcga

SEQ ID NO: 441701 - RNA, 22 nt, Human
ucuuauaagcaaacugcugaga

SEQ ID NO: 441702 - RNA, 22 nt, Human
gucccagaaacauauugcuggu

SEQ ID NO: 441703 - RNA, 22 nt, Human
ucucagagaggggccgggccuu

SEQ ID NO: 441704 - RNA, 22 nt, Human
cagcccugagagaaccaucuau

SEQ ID NO: 441705 - RNA, 22 nt, Human
aggagcagaccguaguccugca

SEQ ID NO: 441706 - RNA, 21 nt, Human
agcugcuccagggagcucagg

SEQ ID NO: 441707 - RNA, 22 nt, Human
agcuuuaccugaaauuugaucc

SEQ ID NO: 441708 - RNA, 23 nt, Human
aggaaguuaugaagggagaauag

SEQ ID NO: 441709 - RNA, 20 nt, Human
cagucccaauccagggccag

SEQ ID NO: 441710 - RNA, 22 nt, Human
aaaguauucaaaaauauuuggu

SEQ ID NO: 441711 - RNA, 22 nt, Human
agaauaaacugcuuuagggcag

SEQ ID NO: 441712 - RNA, 22 nt, Human
aaggguggauuucugagcucua

SEQ ID NO: 441713 - RNA, 22 nt, Human
uuuuguuuucuuagaaaccugg

SEQ ID NO: 441714 - RNA, 22 nt, Human
uauugacaauaggcaacugagg

SEQ ID NO: 441715 - RNA, 22 nt, Human
gacagcaaugacggggcagcug

SEQ ID NO: 441716 - RNA, 22 nt, Human
agauucauuaucuucuuuguac

SEQ ID NO: 441717 - RNA, 22 nt, Human
acuuugcaaaaggaaaucaccu

SEQ ID NO: 441718 - RNA, 22 nt, Human
gcuuaugauguuuacauaaaag

SEQ ID NO: 441719 - RNA, 22 nt, Human
cagaagcuuugcucauaaccau

SEQ ID NO: 441720 - RNA, 22 nt, Human
cugccuccucacguccacagug

SEQ ID NO: 441721 - RNA, 22 nt, Human
agaagcaaggucugucaguaua

SEQ ID NO: 441722 - RNA, 22 nt, Human
aagggcaggaaaagauggaugu

SEQ ID NO: 441723 - RNA, 22 nt, Human
aacagaaucuuggguucuuuuc

SEQ ID NO: 441724 - RNA, 22 nt, Human
agcugcagccgcagcuguggcc

SEQ ID NO: 441725 - RNA, 22 nt, Human
gaggaccacagaugagccugca

SEQ ID NO: 441726 - RNA, 22 nt, Human
ugcaaaaagagcgaggagcccu

SEQ ID NO: 441727 - RNA, 22 nt, Human
caaguaugagaaagcuauuacc

SEQ ID NO: 441728 - RNA, 22 nt, Human
cuuauuguucagauagagauga

SEQ ID NO: 441729 - RNA, 22 nt, Human
cucagaggucaagagcagagcu

SEQ ID NO: 441730 - RNA, 22 nt, Human
uggccuggggaagaccaugggc

SEQ ID NO: 441731 - RNA, 22 nt, Human
gaggacagcuuagggcuuccug

SEQ ID NO: 441732 - RNA, 22 nt, Human
cugggcugucccaaccccaucc

SEQ ID NO: 441733 - RNA, 22 nt, Human
agccacaggaaacagagacagc

SEQ ID NO: 441734 - RNA, 22 nt, Human
acaaguuuuggaagucuuaagg

SEQ ID NO: 441735 - RNA, 22 nt, Human
cuguuauuucugaaugccaucc

SEQ ID NO: 441736 - RNA, 22 nt, Human
uuuuccuucuagagcagauuuc

SEQ ID NO: 441737 - RNA, 22 nt, Human
auucuaacacaugcucuaagaa

SEQ ID NO: 441738 - RNA, 22 nt, Human
cacccccaccugugggcuccug

SEQ ID NO: 441739 - RNA, 22 nt, Human
cagccagcuucagauccaagcc

SEQ ID NO: 441740 - RNA, 22 nt, Human
auuagacaucauaugauucagc

SEQ ID NO: 441741 - RNA, 22 nt, Human
auucagcaaugagcuuggauuu

SEQ ID NO: 441742 - RNA, 22 nt, Human
aacagggacaaggauagagaaa

SEQ ID NO: 441743 - RNA, 22 nt, Human
uuucuacagcuggugcaacuuu

SEQ ID NO: 441744 - RNA, 22 nt, Human
ucagaggaucaugucccuacuc

SEQ ID NO: 441745 - RNA, 17 nt, Human
gagagcugcugcuuccg

SEQ ID NO: 441746 - RNA, 22 nt, Human
ggugugugaggagucacuuagu

SEQ ID NO: 441747 - RNA, 22 nt, Human
gcagcaaacuuccacaaguaga

SEQ ID NO: 441748 - RNA, 22 nt, Human
cauguaaaaaauuaggucaucu

SEQ ID NO: 441749 - RNA, 22 nt, Human
auguccaggaagucuuaacuca

SEQ ID NO: 441750 - RNA, 22 nt, Human
caauagaaaacucaauacuuaa

SEQ ID NO: 441751 - RNA, 22 nt, Human
cuuauuaauggaauccuaauga

SEQ ID NO: 441752 - RNA, 22 nt, Human
uuuucuuacugucugugauccu

SEQ ID NO: 441753 - RNA, 22 nt, Human
gaggcuucccgcccaugcugga

SEQ ID NO: 441754 - RNA, 22 nt, Human
gaugauuuuguuggugauucaa

SEQ ID NO: 441755 - RNA, 22 nt, Human
guccucagggaauguggcgggu

SEQ ID NO: 441756 - RNA, 22 nt, Human
gccuggcaggccugggccagca

SEQ ID NO: 441757 - RNA, 22 nt, Human
ggagaggcgaugagucacagcc

SEQ ID NO: 441758 - RNA, 22 nt, Human
uuuuguuuaaaauccuggaugg

SEQ ID NO: 441759 - RNA, 22 nt, Human
ggagugugggauggagcucagg

SEQ ID NO: 441760 - RNA, 22 nt, Human
cagggcuccaugcagggacucc

SEQ ID NO: 441761 - RNA, 22 nt, Human
gcaaggcugaccucucuagacu

SEQ ID NO: 441762 - RNA, 22 nt, Human
cagggacagcgggacucugaca

SEQ ID NO: 441763 - RNA, 22 nt, Human
agaacagccaauaaaagagggg

SEQ ID NO: 441764 - RNA, 22 nt, Human
guggugcauccuugaguaagcu

SEQ ID NO: 441765 - RNA, 22 nt, Human
gcaggcuccaaggccugggaga

SEQ ID NO: 441766 - RNA, 19 nt, Human
ugcuauuugaagaagugua

SEQ ID NO: 441767 - RNA, 22 nt, Human
uauuuguugaguuguuaugucu

SEQ ID NO: 441768 - RNA, 22 nt, Human
cuguggcucucugcaggguccc

SEQ ID NO: 441769 - RNA, 22 nt, Human
agcagguggccacgaggaggag

SEQ ID NO: 441770 - RNA, 22 nt, Human
auagaaacagggaagcaaagca

SEQ ID NO: 441771 - RNA, 22 nt, Human
cagcaggcagccauuucacugu

SEQ ID NO: 441772 - RNA, 22 nt, Human
ggggggugacaaguagagguug

SEQ ID NO: 441773 - RNA, 22 nt, Human
agcugccauccuguucagcacc

SEQ ID NO: 441774 - RNA, 22 nt, Human
ugugcaaucuugagcaauuuau

SEQ ID NO: 441775 - RNA, 22 nt, Human
gggcacuguacacugugcaugg

SEQ ID NO: 441776 - RNA, 17 nt, Human
auuuccucagggcugag

SEQ ID NO: 441777 - RNA, 22 nt, Human
aguuuauuuuugauaagucuug

SEQ ID NO: 441778 - RNA, 22 nt, Human
uuuucauuguuacuaugagcua

SEQ ID NO: 441779 - RNA, 22 nt, Human
ugggcacagaauagauggccca

SEQ ID NO: 441780 - RNA, 22 nt, Human
agccagacauggcuccugcucc

SEQ ID NO: 441781 - RNA, 22 nt, Human
gccuggcacauugcaguggauu

SEQ ID NO: 441782 - RNA, 22 nt, Human
cugguguccagcauguguggaa

SEQ ID NO: 441783 - RNA, 22 nt, Human
ccugcccuaugaccagcuucac

SEQ ID NO: 441784 - RNA, 22 nt, Human
gaagcagagccuaaggcagaca

SEQ ID NO: 441785 - RNA, 23 nt, Human
ugggcaucuccucugugccaggc

SEQ ID NO: 441786 - RNA, 22 nt, Human
uugaagcuccgguguauaggaa

SEQ ID NO: 441787 - RNA, 22 nt, Human
uaggacaggaucaugaugcugg

SEQ ID NO: 441788 - RNA, 22 nt, Human
ugcccuccacaguggcuccacc

SEQ ID NO: 441789 - RNA, 22 nt, Human
uuccaguaaugugacuuugagc

SEQ ID NO: 441790 - RNA, 22 nt, Human
agauauacacccauaucacaua

SEQ ID NO: 441791 - RNA, 22 nt, Human
gucacuguauccagguuccagc

SEQ ID NO: 441792 - RNA, 22 nt, Human
cagcagcaaggugaggguggag

SEQ ID NO: 441793 - RNA, 22 nt, Human
gcagcauuuguggaaugggccc

SEQ ID NO: 441794 - RNA, 22 nt, Human
uuugcagcaaggagagagcauu

SEQ ID NO: 441795 - RNA, 22 nt, Human
cccuggcaaaaucccugguaca

SEQ ID NO: 441796 - RNA, 20 nt, Human
ucaugcagguguucuagguu

SEQ ID NO: 441797 - RNA, 22 nt, Human
uuccaugaaagugaaauggagc

SEQ ID NO: 441798 - RNA, 21 nt, Human
uggagcugaauuuuuggcauc

SEQ ID NO: 441799 - RNA, 22 nt, Human
accuuccucuaagacauuuagc

SEQ ID NO: 441800 - RNA, 22 nt, Human
uuagagacaggcuucccaagga

SEQ ID NO: 441801 - RNA, 22 nt, Human
gcccagcugcacccuggugggu

SEQ ID NO: 441802 - RNA, 22 nt, Human
uggcccuguggaggucagugag

SEQ ID NO: 441803 - RNA, 22 nt, Human
ccuggcucugcgugcagcuccg

SEQ ID NO: 441804 - RNA, 22 nt, Human
uggccagcuguagguugugcag

SEQ ID NO: 441805 - RNA, 22 nt, Human
gaaauauacauugcaggaagag

SEQ ID NO: 441806 - RNA, 22 nt, Human
ucugacccagauggcaccgugg

SEQ ID NO: 441807 - RNA, 22 nt, Human
uccugcagccaagggucaucga

SEQ ID NO: 441808 - RNA, 22 nt, Human
ugcucaguucaaggaaggugga

SEQ ID NO: 441809 - RNA, 19 nt, Human
uuuauucaccuuuaccuug

SEQ ID NO: 441810 - RNA, 22 nt, Human
gcaguggcaugaugugggcuca

SEQ ID NO: 441811 - RNA, 22 nt, Human
cagcacagugaccagacccacu

SEQ ID NO: 441812 - RNA, 22 nt, Human
aaaaauguuaucuacuguccga

SEQ ID NO: 441813 - RNA, 22 nt, Human
agucacauaguguuuuggaauc

SEQ ID NO: 441814 - RNA, 22 nt, Human
ucccuguaguucguggucuuug

SEQ ID NO: 441815 - RNA, 22 nt, Human
ggugagaggcagugcuguggaa

SEQ ID NO: 441816 - RNA, 22 nt, Human
uguacacaguaugaggcaucuu

SEQ ID NO: 441817 - RNA, 22 nt, Human
aggaagcauguuggauccacuu

SEQ ID NO: 441818 - RNA, 22 nt, Human
gaggcugcggggaggagccugc

SEQ ID NO: 441819 - RNA, 22 nt, Human
ccagggugcucuguggcgucgc

SEQ ID NO: 441820 - RNA, 20 nt, Human
gccugagcuccgccuccugu

SEQ ID NO: 441821 - RNA, 22 nt, Human
aggccagcuaugacucugcucc

SEQ ID NO: 441822 - RNA, 22 nt, Human
cuuccugaaggauggcagccuc

SEQ ID NO: 441823 - RNA, 22 nt, Human
auuugcugugugcuuuagagac

SEQ ID NO: 441824 - RNA, 22 nt, Human
cauuuguaucugggcugcugug

SEQ ID NO: 441825 - RNA, 17 nt, Human
acacagccagguucucc

SEQ ID NO: 441826 - RNA, 22 nt, Human
aaggcugauuagacugauagcu

SEQ ID NO: 441827 - RNA, 18 nt, Human
ggccucuggacuggcagc

SEQ ID NO: 441828 - RNA, 22 nt, Human
aagacauuccaaaguggcuaau

SEQ ID NO: 441829 - RNA, 22 nt, Human
cagggcacagaucggggcgcac

SEQ ID NO: 441830 - RNA, 22 nt, Human
uuggccagagguuucucucaug

SEQ ID NO: 441831 - RNA, 22 nt, Human
ucuccaggugagggugguuaga

SEQ ID NO: 441832 - RNA, 20 nt, Human
aauuuuacuguccuauagag

SEQ ID NO: 441833 - RNA, 22 nt, Human
gaagcagaaguacgauuuacua

SEQ ID NO: 441834 - RNA, 22 nt, Human
cagcugaacauguagagcaucu

SEQ ID NO: 441835 - RNA, 22 nt, Human
aagauuuuuuuccacagacuca

SEQ ID NO: 441836 - RNA, 22 nt, Human
gcacugguuuauuuaagaacaa

SEQ ID NO: 441837 - RNA, 22 nt, Human
agugucugccagcugccaggug

SEQ ID NO: 441838 - RNA, 22 nt, Human
gcuggagcugaguucccugggc

SEQ ID NO: 441839 - RNA, 22 nt, Human
acccagcucuuugauggucuug

SEQ ID NO: 441840 - RNA, 23 nt, Human
cagcccugaaaucgaggugacac

SEQ ID NO: 441841 - RNA, 22 nt, Human
cugucacacugauaucaggcuu

SEQ ID NO: 441842 - RNA, 22 nt, Human
acagagcuucccagccugagca

SEQ ID NO: 441843 - RNA, 22 nt, Human
aaacacuucuuaggucuuaagu

SEQ ID NO: 441844 - RNA, 22 nt, Human
ggcucuuguucguaccauggcu

SEQ ID NO: 441845 - RNA, 22 nt, Human
gcuguauuccugcacuguauag

SEQ ID NO: 441846 - RNA, 20 nt, Human
gccuguccugagugucaugg

SEQ ID NO: 441847 - RNA, 22 nt, Human
agcaggcuacuccuguguucgu

SEQ ID NO: 441848 - RNA, 23 nt, Human
ucucagaaaggagaaguaauuug

SEQ ID NO: 441849 - RNA, 22 nt, Human
gcacugcagccucagauggugg

SEQ ID NO: 441850 - RNA, 18 nt, Human
agcaccagucacuaacag

SEQ ID NO: 441851 - RNA, 22 nt, Human
cuuugcaguuucagaacccuga

SEQ ID NO: 441852 - RNA, 19 nt, Human
gagcaggccacacaugugu

SEQ ID NO: 441853 - RNA, 22 nt, Human
uuuacagagaauguacauaaag

SEQ ID NO: 441854 - RNA, 22 nt, Human
agucuccacaacagcccugaua

SEQ ID NO: 441855 - RNA, 20 nt, Human
gcuguggcaagugcucacug

SEQ ID NO: 441856 - RNA, 22 nt, Human
agccaacuaggagauuaaggua

SEQ ID NO: 441857 - RNA, 22 nt, Human
caggaagggaaaauaguucggg

SEQ ID NO: 441858 - RNA, 22 nt, Human
uaguuuaggucguacaagcaaa

SEQ ID NO: 441859 - RNA, 22 nt, Human
cuaaggcagacagaauauuugg

SEQ ID NO: 441860 - RNA, 19 nt, Human
agcagccaucgaccaugga

SEQ ID NO: 441861 - RNA, 22 nt, Human
ucugggagguguuuugagaacu

SEQ ID NO: 441862 - RNA, 22 nt, Human
cgcagcuguccauguguggggg

SEQ ID NO: 441863 - RNA, 17 nt, Human
agaaaagagaccagcag

SEQ ID NO: 441864 - RNA, 22 nt, Human
ggcuggagugggcuccagaguu

SEQ ID NO: 441865 - RNA, 22 nt, Human
cacauuuaaagguugaagcuga

SEQ ID NO: 441866 - RNA, 22 nt, Human
cccuggaggcggagcuugcagu

SEQ ID NO: 441867 - RNA, 22 nt, Human
uaugcaauucucuuaauauucu

SEQ ID NO: 441868 - RNA, 22 nt, Human
ggccucggcccacugcugcggu

SEQ ID NO: 441869 - RNA, 22 nt, Human
acaggcagagaacucagccaga

SEQ ID NO: 441870 - RNA, 22 nt, Human
aguauucugguuuuucaggugg

SEQ ID NO: 441871 - RNA, 21 nt, Human
caggccccaggccuggggugc

SEQ ID NO: 441872 - RNA, 22 nt, Human
cauuuauauaaaauguccagaa

SEQ ID NO: 441873 - RNA, 22 nt, Human
ugacaaguuggaaagcagugca

SEQ ID NO: 441874 - RNA, 22 nt, Human
uucagcaaugggauggugcagg

SEQ ID NO: 441875 - RNA, 22 nt, Human
cuggggccacaacggcgcacgc

SEQ ID NO: 441876 - RNA, 23 nt, Human
ugcaaauuaggccgggacucagc

SEQ ID NO: 441877 - RNA, 20 nt, Human
augcauauauguggugucug

SEQ ID NO: 441878 - RNA, 22 nt, Human
ggcaggaaaugggauaagggcu

SEQ ID NO: 441879 - RNA, 22 nt, Human
cugagccauaagggaggcuggg

SEQ ID NO: 441880 - RNA, 22 nt, Human
guuauccauagaauaagucauc

SEQ ID NO: 441881 - RNA, 22 nt, Human
cccagagagcacaggugguggg

SEQ ID NO: 441882 - RNA, 22 nt, Human
uaauuuuaugacaguguauuuu

SEQ ID NO: 441883 - RNA, 22 nt, Human
aggcagcaugggccccagcucc

SEQ ID NO: 441884 - RNA, 22 nt, Human
cagcugacacuuugaccuagag

SEQ ID NO: 441885 - RNA, 22 nt, Human
aaguaaauaucuguuuauagca

SEQ ID NO: 441886 - RNA, 22 nt, Human
caggcuggcaaugcgucaagca

SEQ ID NO: 441887 - RNA, 22 nt, Human
guucucaguggggagcaggguu

SEQ ID NO: 441888 - RNA, 22 nt, Human
uuacaaacaacagacauuuauu

SEQ ID NO: 441889 - RNA, 22 nt, Human
aagcaggcauuccagagacaau

SEQ ID NO: 441890 - RNA, 22 nt, Human
cacagcccccuugacacucugg

SEQ ID NO: 441891 - RNA, 22 nt, Human
uggcagcuggaucccaaggcag

SEQ ID NO: 441892 - RNA, 22 nt, Human
uuuacagauguggaaagugagc

SEQ ID NO: 441893 - RNA, 22 nt, Human
cagcuucccuuggcugagcaga

SEQ ID NO: 441894 - RNA, 18 nt, Human
uugcaaauucuucccugu

SEQ ID NO: 441895 - RNA, 22 nt, Human
aggaguuuauccgagggcauaa

SEQ ID NO: 441896 - RNA, 21 nt, Human
cauuucaaagagcuggaaauc

SEQ ID NO: 441897 - RNA, 22 nt, Human
acacugaaucagaaauuguugg

SEQ ID NO: 441898 - RNA, 22 nt, Human
gcuccugaaggcucugcagggu

SEQ ID NO: 441899 - RNA, 22 nt, Human
ucuaaugaggacuuuauagaga

SEQ ID NO: 441900 - RNA, 22 nt, Human
ccuccugggacaggcuggcaca

SEQ ID NO: 441901 - RNA, 22 nt, Human
uauuuauucauucagcaagcau

SEQ ID NO: 441902 - RNA, 19 nt, Human
cuggaaggagggacuguuc

SEQ ID NO: 441903 - RNA, 22 nt, Human
cugcgcagggguggcgccagaa

SEQ ID NO: 441904 - RNA, 22 nt, Human
gcaggggcugcugggaacucgg

SEQ ID NO: 441905 - RNA, 19 nt, Human
ugccugucaguagaucuca

SEQ ID NO: 441906 - RNA, 22 nt, Human
ccaggccauucccagaguugcu

SEQ ID NO: 441907 - RNA, 22 nt, Human
cugggccugguagggcuugaaa

SEQ ID NO: 441908 - RNA, 22 nt, Human
aacacuuagauuuuuaagguuu

SEQ ID NO: 441909 - RNA, 22 nt, Human
gugcugagaacaaaaguggaca

SEQ ID NO: 441910 - RNA, 22 nt, Human
cacauaauaaauguuccugaug

SEQ ID NO: 441911 - RNA, 22 nt, Human
ugaggcagcccacuuuccuuag

SEQ ID NO: 441912 - RNA, 22 nt, Human
acuuugcagagccagaagagaa

SEQ ID NO: 441913 - RNA, 22 nt, Human
ccaggagaugggagcaucuaaa

SEQ ID NO: 441914 - RNA, 22 nt, Human
uacuauuuuugcaacguauaca

SEQ ID NO: 441915 - RNA, 23 nt, Human
ccaggaagaggccauccacaguc

SEQ ID NO: 441916 - RNA, 22 nt, Human
ccuggcuccugccucugcaggg

SEQ ID NO: 441917 - RNA, 22 nt, Human
cgucccaguuccagccgcgcug

SEQ ID NO: 441918 - RNA, 22 nt, Human
ucagugcuucggcgagcaccua

SEQ ID NO: 441919 - RNA, 22 nt, Human
aacacugagaggggaguggcac

SEQ ID NO: 441920 - RNA, 22 nt, Human
ugagcccauguagcacuuccau

SEQ ID NO: 441921 - RNA, 22 nt, Human
gcacaggcucucuuggggacac

SEQ ID NO: 441922 - RNA, 18 nt, Human
cugccuguugcugagagg

SEQ ID NO: 441923 - RNA, 22 nt, Human
ucccagaggacuguuggugcua

SEQ ID NO: 441924 - RNA, 22 nt, Human
ugagcaguaggucugaauagug

SEQ ID NO: 441925 - RNA, 20 nt, Human
agcauucauucagcaagccu

SEQ ID NO: 441926 - RNA, 22 nt, Human
cagcuguuacucugaguaaaug

SEQ ID NO: 441927 - RNA, 22 nt, Human
ggcagcugcugcauuacguugu

SEQ ID NO: 441928 - RNA, 22 nt, Human
uagcagcauguaagugaguaga

SEQ ID NO: 441929 - RNA, 22 nt, Human
gcagggcagcuuagucccuguc

SEQ ID NO: 441930 - RNA, 22 nt, Human
uagcugagaggccaauugaacu

SEQ ID NO: 441931 - RNA, 22 nt, Human
uaugagaacaagaacaaucucc

SEQ ID NO: 441932 - RNA, 22 nt, Human
cagagcuguuacuauucaugaa

SEQ ID NO: 441933 - RNA, 22 nt, Human
gaaaaaggauaaauacaguguu

SEQ ID NO: 441934 - RNA, 22 nt, Human
uaggcuggaggaagcagugccu

SEQ ID NO: 441935 - RNA, 21 nt, Human
ugcuuugcagguggauuuagu

SEQ ID NO: 441936 - RNA, 21 nt, Human
uccucuccaugaucuguuugu

SEQ ID NO: 441937 - RNA, 22 nt, Human
ucauucccuccagcuguggcua

SEQ ID NO: 441938 - RNA, 22 nt, Human
agucaguguagaaagcccaggc

SEQ ID NO: 441939 - RNA, 22 nt, Human
uuggaaagaccgaauuccuguu

SEQ ID NO: 441940 - RNA, 22 nt, Human
cauacugucagagccugaaggg

SEQ ID NO: 441941 - RNA, 21 nt, Human
ugcagcagaagucucuguguc

SEQ ID NO: 441942 - RNA, 22 nt, Human
ugggugccaaccucugguggcc

SEQ ID NO: 441943 - RNA, 22 nt, Human
cugccugcuucugagccagagg

SEQ ID NO: 441944 - RNA, 22 nt, Human
cccaguggggagcugagguuca

SEQ ID NO: 441945 - RNA, 22 nt, Human
ugaggccugcccuggggaaguu

SEQ ID NO: 441946 - RNA, 22 nt, Human
ucugauuucucuuguggaugcu

SEQ ID NO: 441947 - RNA, 22 nt, Human
cugcagcuuuggaaaccuguuu

SEQ ID NO: 441948 - RNA, 22 nt, Human
cuggguggcagagccugcagug

SEQ ID NO: 441949 - RNA, 22 nt, Human
agcuaaugggagacccuuucac

SEQ ID NO: 441950 - RNA, 22 nt, Human
gaaggaagucauuagugcagac

SEQ ID NO: 441951 - RNA, 22 nt, Human
aacugcauaauauaucaugcag

SEQ ID NO: 441952 - RNA, 22 nt, Human
gguccuggaaauugacggaaag

SEQ ID NO: 441953 - RNA, 18 nt, Human
ucauuuguuuugcaugaa

SEQ ID NO: 441954 - RNA, 22 nt, Human
cagcugugagagugcauugaag

SEQ ID NO: 441955 - RNA, 22 nt, Human
cagguucccuagcagcaaagcc

SEQ ID NO: 441956 - RNA, 22 nt, Human
cuggagcuccagggucuccucu

SEQ ID NO: 441957 - RNA, 22 nt, Human
uauauuaaagugcuuugcagug

SEQ ID NO: 441958 - RNA, 22 nt, Human
cucucuguuaugcuuucaugaa

SEQ ID NO: 441959 - RNA, 22 nt, Human
ugggcugcacccucagccucug

SEQ ID NO: 441960 - RNA, 22 nt, Human
uuuauucaucaucuguucauau

SEQ ID NO: 441961 - RNA, 22 nt, Human
gcuagccugcaguggcuauggu

SEQ ID NO: 441962 - RNA, 22 nt, Human
agagggaaaaacucaugucauu

SEQ ID NO: 441963 - RNA, 22 nt, Human
ucaggcugauuucuuuugaggg

SEQ ID NO: 441964 - RNA, 22 nt, Human
gacaguacagguagaagucacu

SEQ ID NO: 441965 - RNA, 22 nt, Human
uuccagagcaguuuucagauca

SEQ ID NO: 441966 - RNA, 22 nt, Human
aaguucaaucagaugaaaaagc

SEQ ID NO: 441967 - RNA, 22 nt, Human
gaggcaggcccugaaugaguca

SEQ ID NO: 441968 - RNA, 22 nt, Human
gcaggcagagaaggaacauuua

SEQ ID NO: 441969 - RNA, 22 nt, Human
uuuccaaagguggcaggaacaa

SEQ ID NO: 441970 - RNA, 22 nt, Human
gaggggagacagggaaaucagu

SEQ ID NO: 441971 - RNA, 22 nt, Human
caaagagguuuugagggcagcu

SEQ ID NO: 441972 - RNA, 21 nt, Human
uuuucuccagcugugauuuua

SEQ ID NO: 441973 - RNA, 22 nt, Human
gcagcccuucaggugaggggca

SEQ ID NO: 441974 - RNA, 22 nt, Human
cagcugccaugacauguccugc

SEQ ID NO: 441975 - RNA, 22 nt, Human
cugcccugauaugauuuagaac

SEQ ID NO: 441976 - RNA, 22 nt, Human
cauuucaauacuaucugagaau

SEQ ID NO: 441977 - RNA, 22 nt, Human
ucugaggccugaagcagcagag

SEQ ID NO: 441978 - RNA, 22 nt, Human
gcaaagcaagauucagauguag

SEQ ID NO: 441979 - RNA, 21 nt, Human
uucaaaguuugccuaaagauu

SEQ ID NO: 441980 - RNA, 22 nt, Human
gcugugcagccaagugccucug

SEQ ID NO: 441981 - RNA, 20 nt, Human
ucagagaaggagcuuuccug

SEQ ID NO: 441982 - RNA, 22 nt, Human
gaacaugaaaagucuuacacgc

SEQ ID NO: 441983 - RNA, 22 nt, Human
caguacugcuugugggagcaga

SEQ ID NO: 441984 - RNA, 22 nt, Human
auuauugugauaggugucagug

SEQ ID NO: 441985 - RNA, 22 nt, Human
gcuuuggaaauauagacucaag

SEQ ID NO: 441986 - RNA, 22 nt, Human
ucagagaagguaagugaccugc

SEQ ID NO: 441987 - RNA, 22 nt, Human
aagcacuaggucacacaaguua

SEQ ID NO: 441988 - RNA, 22 nt, Human
aaguuuauguugguaagauauc

SEQ ID NO: 441989 - RNA, 22 nt, Human
cccuggcucuucaccaccugcc

SEQ ID NO: 441990 - RNA, 22 nt, Human
ugcaggcuggcagugcugaaau

SEQ ID NO: 441991 - RNA, 22 nt, Human
gaacuuuaccauuuagguaacu

SEQ ID NO: 441992 - RNA, 22 nt, Human
uaaggcaaagugauuucuuaaa

SEQ ID NO: 441993 - RNA, 22 nt, Human
ugaauaugauugcaaauuuggc

SEQ ID NO: 441994 - RNA, 22 nt, Human
ugggaggcagguaggugaugau

SEQ ID NO: 441995 - RNA, 22 nt, Human
uuaaaugaacgagauaugcaac

SEQ ID NO: 441996 - RNA, 22 nt, Human
cugggcucagcaggccaaggcc

SEQ ID NO: 441997 - RNA, 22 nt, Human
ccuuucucauuuuaagcauuag

SEQ ID NO: 441998 - RNA, 22 nt, Human
uucuggagucccacagccaggg

SEQ ID NO: 441999 - RNA, 19 nt, Human
gcccugcaggagguggggc

SEQ ID NO: 442000 - RNA, 22 nt, Human
ucaguacuucugcaucuuccag

SEQ ID NO: 442001 - RNA, 22 nt, Human
cagcugguugaagaggagcugg

SEQ ID NO: 442002 - RNA, 22 nt, Human
uaccuauagguacaauuacaag

SEQ ID NO: 442003 - RNA, 22 nt, Human
ggagccuggcaaugcugcgucc

SEQ ID NO: 442004 - RNA, 22 nt, Human
gagcagugggaaggaacagggu

SEQ ID NO: 442005 - RNA, 22 nt, Human
uguccugugaccuggcaccaca

SEQ ID NO: 442006 - RNA, 22 nt, Human
uucuaaauggggauccuuucug

SEQ ID NO: 442007 - RNA, 22 nt, Human
acagaguaggugcugucgacug

SEQ ID NO: 442008 - RNA, 21 nt, Human
cacugguagauggcccgcagg

SEQ ID NO: 442009 - RNA, 20 nt, Human
uguucacaguaguugcugcu

SEQ ID NO: 442010 - RNA, 22 nt, Human
aauguaaacagcaagagaaggg

SEQ ID NO: 442011 - RNA, 22 nt, Human
cccagggacagaugggcagcua

SEQ ID NO: 442012 - RNA, 22 nt, Human
cuggagucagcaaggacgaggc

SEQ ID NO: 442013 - RNA, 23 nt, Human
ucccagccucuucucuugcauac

SEQ ID NO: 442014 - RNA, 22 nt, Human
aucucuuugauggcuccuguga

SEQ ID NO: 442015 - RNA, 22 nt, Human
ucuggcaguuccuuguugauau

SEQ ID NO: 442016 - RNA, 22 nt, Human
auuugcaagaguaagaauuucu

SEQ ID NO: 442017 - RNA, 22 nt, Human
uugcuuuguuuaaaagugguau

SEQ ID NO: 442018 - RNA, 22 nt, Human
uuugaucagcaagauaaauaga

SEQ ID NO: 442019 - RNA, 22 nt, Human
aauuucaaagcucacuggcaua

SEQ ID NO: 442020 - RNA, 22 nt, Human
caggagaggaggcuacuucuua

SEQ ID NO: 442021 - RNA, 22 nt, Human
ucagaauugucuggggaauguu

SEQ ID NO: 442022 - RNA, 22 nt, Human
ccagcagcuguggcuuugccuc

SEQ ID NO: 442023 - RNA, 22 nt, Human
uugugaaguguucugagacagg

SEQ ID NO: 442024 - RNA, 22 nt, Human
aggcucagaggugagcaucugc

SEQ ID NO: 442025 - RNA, 22 nt, Human
cugcagcaaauguuaagugacu

SEQ ID NO: 442026 - RNA, 22 nt, Human
agcaguggcugaagauguuccu

SEQ ID NO: 442027 - RNA, 17 nt, Human
gaacaguguaagacacu

SEQ ID NO: 442028 - RNA, 22 nt, Human
ccaguacuuugugcaacaaaug

SEQ ID NO: 442029 - RNA, 22 nt, Human
uccugagguggauugagcagag

SEQ ID NO: 442030 - RNA, 22 nt, Human
ugaggccucugaggccuaggcu

SEQ ID NO: 442031 - RNA, 22 nt, Human
acagccagggcauugucgccga

SEQ ID NO: 442032 - RNA, 22 nt, Human
ggugggugagcccugggagcug

SEQ ID NO: 442033 - RNA, 22 nt, Human
ugggcuauuaggaccaggccau

SEQ ID NO: 442034 - RNA, 22 nt, Human
uugcauuugagaaaguucuccu

SEQ ID NO: 442035 - RNA, 17 nt, Human
gcugcagcgguaggcag

SEQ ID NO: 442036 - RNA, 23 nt, Human
guggccuccccggaaugccucgc

SEQ ID NO: 442037 - RNA, 22 nt, Human
agccugguuuaagcauuuuaua

SEQ ID NO: 442038 - RNA, 22 nt, Human
gcacagggcccugugcguaggu

SEQ ID NO: 442039 - RNA, 22 nt, Human
ccugaguggugcuaagcagaua

SEQ ID NO: 442040 - RNA, 22 nt, Human
uacugcaugaaggcaccuauuu

SEQ ID NO: 442041 - RNA, 22 nt, Human
cagcaagggauaaagaguuacu

SEQ ID NO: 442042 - RNA, 22 nt, Human
gagggcaccuucaguaauagcu

SEQ ID NO: 442043 - RNA, 22 nt, Human
aaacaucauaggcaugcaugau

SEQ ID NO: 442044 - RNA, 22 nt, Human
uugcagcuagaagauucacugu

SEQ ID NO: 442045 - RNA, 22 nt, Human
gaggaaaauaacaacuaagggc

SEQ ID NO: 442046 - RNA, 23 nt, Human
uauucagcagugggauuuguugu

SEQ ID NO: 442047 - RNA, 22 nt, Human
aaggaaagacaggacggaauuc

SEQ ID NO: 442048 - RNA, 22 nt, Human
caggccuggcccccggcacacc

SEQ ID NO: 442049 - RNA, 22 nt, Human
guuuaauaauguugaauuacua

SEQ ID NO: 442050 - RNA, 22 nt, Human
augugugugaugggcgccgcca

SEQ ID NO: 442051 - RNA, 22 nt, Human
aauuugaaacauagucaccacu

SEQ ID NO: 442052 - RNA, 22 nt, Human
gacuuugcugugucagcuucag

SEQ ID NO: 442053 - RNA, 22 nt, Human
gccuggagcccaguguggggcu

SEQ ID NO: 442054 - RNA, 22 nt, Human
cugggagucaccaggagcaagg

SEQ ID NO: 442055 - RNA, 22 nt, Human
ugguaauuuacgcauuucugua

SEQ ID NO: 442056 - RNA, 22 nt, Human
ccuggagcacauggcaggaggc

SEQ ID NO: 442057 - RNA, 22 nt, Human
ucucccaguggugcagaaagca

SEQ ID NO: 442058 - RNA, 22 nt, Human
augcugaggacaaagagaucaa

SEQ ID NO: 442059 - RNA, 22 nt, Human
ggcagcugggucacaccgaucu

SEQ ID NO: 442060 - RNA, 17 nt, Human
gcccacccuuaggagcu

SEQ ID NO: 442061 - RNA, 22 nt, Human
ucccaccccuugacucuuuaag

SEQ ID NO: 442062 - RNA, 22 nt, Human
agagaguuguaccacacucaua

SEQ ID NO: 442063 - RNA, 21 nt, Human
uacuuugcaauguaucuccuu

SEQ ID NO: 442064 - RNA, 22 nt, Human
ccugggagggcaagugcugaug

SEQ ID NO: 442065 - RNA, 22 nt, Human
aggagcugggagaaggacuaaa

SEQ ID NO: 442066 - RNA, 22 nt, Human
ggcuuccaagguccucuccacc

SEQ ID NO: 442067 - RNA, 22 nt, Human
guaaaggcccauucaaacagcu

SEQ ID NO: 442068 - RNA, 22 nt, Human
auuaagacuauugauauuuaca

SEQ ID NO: 442069 - RNA, 22 nt, Human
cccuaggcccaaagggugacau

SEQ ID NO: 442070 - RNA, 22 nt, Human
aucugggcucgaauccuagcuc

SEQ ID NO: 442071 - RNA, 22 nt, Human
cuggaagaccccccaggacuca

SEQ ID NO: 442072 - RNA, 22 nt, Human
agcaggacacgaugcggcagga

SEQ ID NO: 442073 - RNA, 22 nt, Human
agcagacaggcugccacagugc

SEQ ID NO: 442074 - RNA, 22 nt, Human
aguguccuccucugggagccag

SEQ ID NO: 442075 - RNA, 22 nt, Human
aggcuggcuuugguagcauggu

SEQ ID NO: 442076 - RNA, 18 nt, Human
cugcccagagcauuucau

SEQ ID NO: 442077 - RNA, 22 nt, Human
agccuggagguaaugaggaaac

SEQ ID NO: 442078 - RNA, 19 nt, Human
gagcugagaguagcacugg

SEQ ID NO: 442079 - RNA, 22 nt, Human
uauauucauauuguugucucuc

SEQ ID NO: 442080 - RNA, 22 nt, Human
uugcaaauuauuuuagucccuu

SEQ ID NO: 442081 - RNA, 22 nt, Human
uucuaguccuagaaacuacaug

SEQ ID NO: 442082 - RNA, 22 nt, Human
uccuggguccauggcagccgaa

SEQ ID NO: 442083 - RNA, 22 nt, Human
gugcaaaagcaauugcaguuuu

SEQ ID NO: 442084 - RNA, 22 nt, Human
caggcacacaggcucccugggc

SEQ ID NO: 442085 - RNA, 22 nt, Human
caacagucagaaugaagcugag

SEQ ID NO: 442086 - RNA, 22 nt, Human
agaugauauacuacauggcuuc

SEQ ID NO: 442087 - RNA, 22 nt, Human
ggcugcccucggggucgcaggc

SEQ ID NO: 442088 - RNA, 18 nt, Human
gcagagcaucaaggguua

SEQ ID NO: 442089 - RNA, 22 nt, Human
uuucacaucagagguagauuag

SEQ ID NO: 442090 - RNA, 22 nt, Human
agcaacauugagacugcaguug

SEQ ID NO: 442091 - RNA, 20 nt, Human
gaaaggagugucccugugag

SEQ ID NO: 442092 - RNA, 21 nt, Human
aaagagguuaauauuguaagu

SEQ ID NO: 442093 - RNA, 22 nt, Human
ugucccaguuuaucugggacug

SEQ ID NO: 442094 - RNA, 22 nt, Human
ucuaaacuucacuuuaagugcu

SEQ ID NO: 442095 - RNA, 22 nt, Human
cacacaguaggcacucauuaau

SEQ ID NO: 442096 - RNA, 22 nt, Human
gggcugccaagccugccugccu

SEQ ID NO: 442097 - RNA, 22 nt, Human
uagacagaauccagcccacgcc

SEQ ID NO: 442098 - RNA, 22 nt, Human
aggucgaguuucggggcuacuu

SEQ ID NO: 442099 - RNA, 22 nt, Human
cagcugucugaagcaggagucc

SEQ ID NO: 442100 - RNA, 23 nt, Human
gcagcuugugguuuaguagaggg

SEQ ID NO: 442101 - RNA, 22 nt, Human
accucuaaaaaauuagaagccu

SEQ ID NO: 442102 - RNA, 19 nt, Human
cagagcugcuggccucguc

SEQ ID NO: 442103 - RNA, 22 nt, Human
ugccuugggauauauggacacu

SEQ ID NO: 442104 - RNA, 22 nt, Human
gguggcaggcuggcauuggcaa

SEQ ID NO: 442105 - RNA, 22 nt, Human
cugcauuauuggggccuguuuc

SEQ ID NO: 442106 - RNA, 20 nt, Human
guuaaaagaguaauuugagg

SEQ ID NO: 442107 - RNA, 22 nt, Human
ucacauuugcaauugcauuguu

SEQ ID NO: 442108 - RNA, 21 nt, Human
ggccucugccuugccccacuc

SEQ ID NO: 442109 - RNA, 22 nt, Human
gauaaagcagguaggagaagau

SEQ ID NO: 442110 - RNA, 22 nt, Human
uuuucuaacuuuacacucgaaa

SEQ ID NO: 442111 - RNA, 22 nt, Human
cagcccuucagggggcugcagg

SEQ ID NO: 442112 - RNA, 22 nt, Human
aggcagcugugaggacuggauu

SEQ ID NO: 442113 - RNA, 22 nt, Human
aguacuuuuuugauaucugagu

SEQ ID NO: 442114 - RNA, 20 nt, Human
gcagcugugcauucuuagga

SEQ ID NO: 442115 - RNA, 22 nt, Human
aagccagauagaagaacucauu

SEQ ID NO: 442116 - RNA, 22 nt, Human
ucuggagaagcccagggagcug

SEQ ID NO: 442117 - RNA, 22 nt, Human
auuuguagugaagugaaaauaa

SEQ ID NO: 442118 - RNA, 22 nt, Human
ucagcagugugcuuggaaugga

SEQ ID NO: 442119 - RNA, 22 nt, Human
gaaggcaagaucucaguggagg

SEQ ID NO: 442120 - RNA, 22 nt, Human
uccugaagcucucuuaaggaaa

SEQ ID NO: 442121 - RNA, 22 nt, Human
cagcugagcucccaggccauca

SEQ ID NO: 442122 - RNA, 22 nt, Human
uuguuuccauugcagacugugu

SEQ ID NO: 442123 - RNA, 22 nt, Human
agagcacaggcucaccauuguu

SEQ ID NO: 442124 - RNA, 22 nt, Human
agccugagagccaagcugugca

SEQ ID NO: 442125 - RNA, 22 nt, Human
cugagcagcagggagacuggug

SEQ ID NO: 442126 - RNA, 22 nt, Human
uccugccucuccaugcuaacua

SEQ ID NO: 442127 - RNA, 22 nt, Human
agcuguuuuugugggcauguga

SEQ ID NO: 442128 - RNA, 22 nt, Human
aagagagggguugcauggaaau

SEQ ID NO: 442129 - RNA, 22 nt, Human
gaggccugguuuccagcauccu

SEQ ID NO: 442130 - RNA, 22 nt, Human
auucagacuaugaacacgucag

SEQ ID NO: 442131 - RNA, 22 nt, Human
aggagcugcauggauaccuggu

SEQ ID NO: 442132 - RNA, 22 nt, Human
ucaaguauuauauucucauuuu

SEQ ID NO: 442133 - RNA, 22 nt, Human
aauaguuguaguaucuaucucg

SEQ ID NO: 442134 - RNA, 22 nt, Human
gagcaacacuccacauugcuag

SEQ ID NO: 442135 - RNA, 22 nt, Human
acaggccuuggcaggcauguga

SEQ ID NO: 442136 - RNA, 22 nt, Human
gaugcaaagauaaaacagacgc

SEQ ID NO: 442137 - RNA, 22 nt, Human
gacaggaauguguggaugcgga

SEQ ID NO: 442138 - RNA, 22 nt, Human
uuugagaagauaggggaauacu

SEQ ID NO: 442139 - RNA, 18 nt, Human
auauccaauaaugaacac

SEQ ID NO: 442140 - RNA, 22 nt, Human
ugugggcucccccucacucugu

SEQ ID NO: 442141 - RNA, 22 nt, Human
acuucucugcuaccugcaaaga

SEQ ID NO: 442142 - RNA, 22 nt, Human
auaucuuucaaagccaaaagua

SEQ ID NO: 442143 - RNA, 22 nt, Human
ggaugaggaagauuacugagaa

SEQ ID NO: 442144 - RNA, 22 nt, Human
ugaggacauuggucaggacaug

SEQ ID NO: 442145 - RNA, 22 nt, Human
ugaccaaagaguugcuuguauu

SEQ ID NO: 442146 - RNA, 22 nt, Human
gauuucuaguucauuaucuauu

SEQ ID NO: 442147 - RNA, 22 nt, Human
ucuuugcacugugcaagcagaa

SEQ ID NO: 442148 - RNA, 22 nt, Human
gaagcacaaaguguaguuccga

SEQ ID NO: 442149 - RNA, 22 nt, Human
uauauucacuuguguccaacca

SEQ ID NO: 442150 - RNA, 22 nt, Human
guucaaauuuucuaggugggug

SEQ ID NO: 442151 - RNA, 21 nt, Human
ggaagggcucugaggacggcu

SEQ ID NO: 442152 - RNA, 22 nt, Human
ugcucccagggacucuggcugg

SEQ ID NO: 442153 - RNA, 18 nt, Human
cagagcaguaugaauguu

SEQ ID NO: 442154 - RNA, 23 nt, Human
ugucccagagggagggauaggcu

SEQ ID NO: 442155 - RNA, 22 nt, Human
ugacagagugacacucuugucu

SEQ ID NO: 442156 - RNA, 22 nt, Human
augggaagguuuugagagcggg

SEQ ID NO: 442157 - RNA, 18 nt, Human
ugagacagcuaccacuug

SEQ ID NO: 442158 - RNA, 20 nt, Human
uggcuccuggcuccucccuc

SEQ ID NO: 442159 - RNA, 22 nt, Human
cuggagaguuggaagauggacu

SEQ ID NO: 442160 - RNA, 22 nt, Human
ccuggugcaccaaguaagggug

SEQ ID NO: 442161 - RNA, 22 nt, Human
ccuggcuccagcugccuguccu

SEQ ID NO: 442162 - RNA, 19 nt, Human
ugggaguggggaagguccu

SEQ ID NO: 442163 - RNA, 22 nt, Human
uaugugcauuaucuaguucauu

SEQ ID NO: 442164 - RNA, 22 nt, Human
cucagcaagauuaagcagcuug

SEQ ID NO: 442165 - RNA, 22 nt, Human
gaggcacagaguaggugcacac

SEQ ID NO: 442166 - RNA, 22 nt, Human
gggccugcagguucugagaggc

SEQ ID NO: 442167 - RNA, 22 nt, Human
ccagagaaaagaggccaaggau

SEQ ID NO: 442168 - RNA, 22 nt, Human
ccagagaaccaucugcuugagg

SEQ ID NO: 442169 - RNA, 22 nt, Human
ugugcucuugucugugacuaac

SEQ ID NO: 442170 - RNA, 22 nt, Human
acucucucacagcuuggcugau

SEQ ID NO: 442171 - RNA, 22 nt, Human
ugccugucuuggaguccuggcc

SEQ ID NO: 442172 - RNA, 22 nt, Human
uucauacucuucccugggcaaa

SEQ ID NO: 442173 - RNA, 22 nt, Human
ccucuggguaucuguggaagua

SEQ ID NO: 442174 - RNA, 22 nt, Human
uuauuauagauuaugcaagauu

SEQ ID NO: 442175 - RNA, 22 nt, Human
gaggcccuccagcugucagcug

SEQ ID NO: 442176 - RNA, 22 nt, Human
ggguguguuccuaaggaaacca

SEQ ID NO: 442177 - RNA, 22 nt, Human
acagggcaaccucugggagacu

SEQ ID NO: 442178 - RNA, 22 nt, Human
auauagaaggugcuauuuacau

SEQ ID NO: 442179 - RNA, 22 nt, Human
cugggaggauucauugagguga

SEQ ID NO: 442180 - RNA, 22 nt, Human
uguuuaaccaccauucuauucu

SEQ ID NO: 442181 - RNA, 22 nt, Human
acuaggggcucaggcccaggga

SEQ ID NO: 442182 - RNA, 22 nt, Human
cugagcagugguucuugagcgc

SEQ ID NO: 442183 - RNA, 22 nt, Human
gccuggagacaaggacaaaggg

SEQ ID NO: 442184 - RNA, 19 nt, Human
ugcaaauucuaaaaacuga

SEQ ID NO: 442185 - RNA, 22 nt, Human
aaggaaagacauauaaaugacu

SEQ ID NO: 442186 - RNA, 22 nt, Human
aucauuuuauggcugagaggac

SEQ ID NO: 442187 - RNA, 22 nt, Human
aaggaagguacucagugauucu

SEQ ID NO: 442188 - RNA, 22 nt, Human
gcacagagagcagugggggaca

SEQ ID NO: 442189 - RNA, 20 nt, Human
ucuggcaggugaacgagcug

SEQ ID NO: 442190 - RNA, 23 nt, Human
augaaugaauaaggcaggaaagc

SEQ ID NO: 442191 - RNA, 22 nt, Human
gccuggagacagcagaggcggc

SEQ ID NO: 442192 - RNA, 19 nt, Human
gugggccaggcagaaggcu

SEQ ID NO: 442193 - RNA, 22 nt, Human
augcacuuucuagagauucuga

SEQ ID NO: 442194 - RNA, 18 nt, Human
cacaggaaggggaauauc

SEQ ID NO: 442195 - RNA, 22 nt, Human
ggcagcugucucauucacaccu

SEQ ID NO: 442196 - RNA, 22 nt, Human
uugaacaguuuugucagguuca

SEQ ID NO: 442197 - RNA, 22 nt, Human
gugagagggcugggcucaugau

SEQ ID NO: 442198 - RNA, 22 nt, Human
cugcccugcuuguuuccagugg

SEQ ID NO: 442199 - RNA, 22 nt, Human
ucccagagcccaaguuggagag

SEQ ID NO: 442200 - RNA, 22 nt, Human
ugcugggcuagaagcugaggcc

SEQ ID NO: 442201 - RNA, 22 nt, Human
gcccuggggaaggugucuccaa

SEQ ID NO: 442202 - RNA, 22 nt, Human
acuuguuuacaagcaguucuga

SEQ ID NO: 442203 - RNA, 22 nt, Human
gaauuucacaaggugaggauaa

SEQ ID NO: 442204 - RNA, 22 nt, Human
aggagaaggaagugcaucacua

SEQ ID NO: 442205 - RNA, 20 nt, Human
aggaggggauagaaucaaag

SEQ ID NO: 442206 - RNA, 22 nt, Human
uugcccugucaguagaagugca

SEQ ID NO: 442207 - RNA, 22 nt, Human
ugcccugguuacacuggagucc

SEQ ID NO: 442208 - RNA, 22 nt, Human
agcagggccaacaguaaacacc

SEQ ID NO: 442209 - RNA, 22 nt, Human
ggcugcagguugguuggcagcu

SEQ ID NO: 442210 - RNA, 22 nt, Human
agcaguggagcgagauguuuaa

SEQ ID NO: 442211 - RNA, 22 nt, Human
uccugaaguauggguauggagu

SEQ ID NO: 442212 - RNA, 22 nt, Human
auacaguaaccacauucuauag

SEQ ID NO: 442213 - RNA, 22 nt, Human
ugcaccugagaggucucugagg

SEQ ID NO: 442214 - RNA, 21 nt, Human
cugggcuuucucucaaagaca

SEQ ID NO: 442215 - RNA, 22 nt, Human
uucuugaugaaugcuaagaacu

SEQ ID NO: 442216 - RNA, 22 nt, Human
cuccuggggccauggaaggaac

SEQ ID NO: 442217 - RNA, 22 nt, Human
agcugucugucuccugaggaga

SEQ ID NO: 442218 - RNA, 22 nt, Human
agcuguuuucuaaugcauuuga

SEQ ID NO: 442219 - RNA, 22 nt, Human
acagguaccggucagauuacgg

SEQ ID NO: 442220 - RNA, 22 nt, Human
ggcaggaggaagaguuagcacc

SEQ ID NO: 442221 - RNA, 22 nt, Human
aagaacauugacuaagaggggc

SEQ ID NO: 442222 - RNA, 22 nt, Human
aggcacaggaaugucauccagu

SEQ ID NO: 442223 - RNA, 21 nt, Human
ggcagaaguagcauggacggg

SEQ ID NO: 442224 - RNA, 22 nt, Human
gugucccaggagaggagacaau

SEQ ID NO: 442225 - RNA, 18 nt, Human
gaggcagcuagcaauuuu

SEQ ID NO: 442226 - RNA, 22 nt, Human
agugccuggaccccaugacaua

SEQ ID NO: 442227 - RNA, 22 nt, Human
auauuuauaaggcaggcaagua

SEQ ID NO: 442228 - RNA, 22 nt, Human
cagggccucgaagccucugggc

SEQ ID NO: 442229 - RNA, 22 nt, Human
cuggcuccaaauucugauguuc

SEQ ID NO: 442230 - RNA, 22 nt, Human
ugcugugagguugagaaggaag

SEQ ID NO: 442231 - RNA, 22 nt, Human
ggcugcagggcagcuggugugg

SEQ ID NO: 442232 - RNA, 22 nt, Human
aaaugcuagggagaaacucucc

SEQ ID NO: 442233 - RNA, 22 nt, Human
uauaauuuuucuguggccaguu

SEQ ID NO: 442234 - RNA, 23 nt, Human
aggcuggcuucaggagccucucc

SEQ ID NO: 442235 - RNA, 22 nt, Human
cagcaucuuucucuucuggagu

SEQ ID NO: 442236 - RNA, 22 nt, Human
uuuggcggggcaauucugaagc

SEQ ID NO: 442237 - RNA, 22 nt, Human
uuuguuuugaacuagcucagaa

SEQ ID NO: 442238 - RNA, 17 nt, Human
uccaggagaggcaaugg

SEQ ID NO: 442239 - RNA, 23 nt, Human
uuuuaauuuggacauaagaagau

SEQ ID NO: 442240 - RNA, 22 nt, Human
agccucugucaagcuuuucaaa

SEQ ID NO: 442241 - RNA, 23 nt, Human
aggugccaacugagagcugagag

SEQ ID NO: 442242 - RNA, 22 nt, Human
ccugggcuuucaaaaccagccu

SEQ ID NO: 442243 - RNA, 22 nt, Human
ugcccucagcagcagcuccugc

SEQ ID NO: 442244 - RNA, 22 nt, Human
ccugugaggucuugcaugugaa

SEQ ID NO: 442245 - RNA, 22 nt, Human
aagcaggcaggguggagaguuu

SEQ ID NO: 442246 - RNA, 22 nt, Human
uugcaaauggaggccuggcagc

SEQ ID NO: 442247 - RNA, 22 nt, Human
uuggaaaagugaaacuagaugc

SEQ ID NO: 442248 - RNA, 22 nt, Human
agcuccugggccaagcccaugc

SEQ ID NO: 442249 - RNA, 22 nt, Human
gagagcugcauucucagacaca

SEQ ID NO: 442250 - RNA, 22 nt, Human
ccagcucuggcuucuugcuggg

SEQ ID NO: 442251 - RNA, 20 nt, Human
cguguguggcuauuuugggu

SEQ ID NO: 442252 - RNA, 22 nt, Human
augcaaaugcuagagaauguug

SEQ ID NO: 442253 - RNA, 22 nt, Human
ucaaaggaaacacaagcuucug

SEQ ID NO: 442254 - RNA, 22 nt, Human
ccaggccuagccccugagggua

SEQ ID NO: 442255 - RNA, 22 nt, Human
acccagcaugacaccugcacau

SEQ ID NO: 442256 - RNA, 22 nt, Human
acgauguggccugaaucaggca

SEQ ID NO: 442257 - RNA, 22 nt, Human
acagcucugguccuuuagagag

SEQ ID NO: 442258 - RNA, 22 nt, Human
ugcaaaaacugcaauugcuuuu

SEQ ID NO: 442259 - RNA, 22 nt, Human
ugauuuuacuuagcaugauguu

SEQ ID NO: 442260 - RNA, 22 nt, Human
auaauauuuggauaggacagua

SEQ ID NO: 442261 - RNA, 22 nt, Human
uaaggcagccucaggguagggu

SEQ ID NO: 442262 - RNA, 22 nt, Human
accucagcuauuucaaaacaga

SEQ ID NO: 442263 - RNA, 22 nt, Human
aagagcuggucacagguccauu

SEQ ID NO: 442264 - RNA, 22 nt, Human
gaguccuguaacuuucuuccua

SEQ ID NO: 442265 - RNA, 23 nt, Human
gcagacagagcagacuaagacaa

SEQ ID NO: 442266 - RNA, 18 nt, Human
gggcacuggggacuggag

SEQ ID NO: 442267 - RNA, 22 nt, Human
gcacccagaauaaggacaggac

SEQ ID NO: 442268 - RNA, 22 nt, Human
aauggcaagcugaacucagaag

SEQ ID NO: 442269 - RNA, 22 nt, Human
aggaugaggcuggacacuucuu

SEQ ID NO: 442270 - RNA, 22 nt, Human
auuagcugaccucuaaggagcc

SEQ ID NO: 442271 - RNA, 22 nt, Human
acccacacaucucuaauucagu

SEQ ID NO: 442272 - RNA, 22 nt, Human
gucccugcaucaccacgggacu

SEQ ID NO: 442273 - RNA, 19 nt, Human
ccugcagggaugagagguu

SEQ ID NO: 442274 - RNA, 22 nt, Human
uuaugacauaugaguacaagua

SEQ ID NO: 442275 - RNA, 22 nt, Human
aaacagagggccacugaggcuc

SEQ ID NO: 442276 - RNA, 21 nt, Human
uucaugagauaaccagcugua

SEQ ID NO: 442277 - RNA, 23 nt, Human
cucagaggccuguccaggguggu

SEQ ID NO: 442278 - RNA, 22 nt, Human
ggcagcgcccgaguccgcagcu

SEQ ID NO: 442279 - RNA, 22 nt, Human
cagcauggugccagugagucca

SEQ ID NO: 442280 - RNA, 22 nt, Human
cuguacaaguccuucaucaggg

SEQ ID NO: 442281 - RNA, 20 nt, Human
cugagcgucuaagaggugag

SEQ ID NO: 442282 - RNA, 22 nt, Human
uguugauuaguguuuagacuua

SEQ ID NO: 442283 - RNA, 22 nt, Human
ucaugcaggaccaccccagcau

SEQ ID NO: 442284 - RNA, 22 nt, Human
cuccucccacggucucaggaag

SEQ ID NO: 442285 - RNA, 22 nt, Human
ccaggcuguaaacaccuucaaa

SEQ ID NO: 442286 - RNA, 18 nt, Human
cugagggcaacagaggcu

SEQ ID NO: 442287 - RNA, 22 nt, Human
ccugccugcaccuucucugggg

SEQ ID NO: 442288 - RNA, 23 nt, Human
auucagaauuguguguuuguaua

SEQ ID NO: 442289 - RNA, 22 nt, Human
aacacuuugggcauggccuucc

SEQ ID NO: 442290 - RNA, 22 nt, Human
agcuguguggugucugacagcu

SEQ ID NO: 442291 - RNA, 20 nt, Human
ugcagcagaagcccaugcuc

SEQ ID NO: 442292 - RNA, 22 nt, Human
ugcaaauuuaaugaaacuaugu

SEQ ID NO: 442293 - RNA, 22 nt, Human
ugggccuguggcuuggcucuag

SEQ ID NO: 442294 - RNA, 22 nt, Human
uccuguguaaauagaucugguu

SEQ ID NO: 442295 - RNA, 22 nt, Human
uuuaagacuuagauuuauuggg

SEQ ID NO: 442296 - RNA, 22 nt, Human
uuguacagaaaaaauucuuggu

SEQ ID NO: 442297 - RNA, 22 nt, Human
gagcaggcaaagaugaaaggag

SEQ ID NO: 442298 - RNA, 22 nt, Human
gcagggacuuuggcaacaggug

SEQ ID NO: 442299 - RNA, 22 nt, Human
agaaggaagccaggagggugca

SEQ ID NO: 442300 - RNA, 22 nt, Human
guuccucaaaaaggagagcccc

SEQ ID NO: 442301 - RNA, 23 nt, Human
ucaaacuguuauauugccagagu

SEQ ID NO: 442302 - RNA, 22 nt, Human
aggcagucagcccugcuagggu

SEQ ID NO: 442303 - RNA, 22 nt, Human
agaaggcacucacacuggcacg

SEQ ID NO: 442304 - RNA, 22 nt, Human
uuggaaaugcaaauauauugaa

SEQ ID NO: 442305 - RNA, 22 nt, Human
cugggcacagcguugggcucuu

SEQ ID NO: 442306 - RNA, 22 nt, Human
uggcacagacauuuaauagccu

SEQ ID NO: 442307 - RNA, 21 nt, Human
guucaagugauccuccugucu

SEQ ID NO: 442308 - RNA, 22 nt, Human
accccagaggcggaggcugcag

SEQ ID NO: 442309 - RNA, 22 nt, Human
uauauuaaccauaggguucuag

SEQ ID NO: 442310 - RNA, 22 nt, Human
gccugucaauuuuguguacaau

SEQ ID NO: 442311 - RNA, 22 nt, Human
ucucugggugauggcagggcac

SEQ ID NO: 442312 - RNA, 23 nt, Human
ugcaauaugucagugcaaagugg

SEQ ID NO: 442313 - RNA, 23 nt, Human
agucaguguaaguuuggaaugca

SEQ ID NO: 442314 - RNA, 22 nt, Human
augcagcuucaggauuaugaug

SEQ ID NO: 442315 - RNA, 22 nt, Human
aggugcaccugagggugucauc

SEQ ID NO: 442316 - RNA, 22 nt, Human
cugguacaguguuacaaaaugg

SEQ ID NO: 442317 - RNA, 22 nt, Human
agagauuuacacaugccuuuuc

SEQ ID NO: 442318 - RNA, 22 nt, Human
cuuuggcuacaagcgcugcaau

SEQ ID NO: 442319 - RNA, 21 nt, Human
ugcagccauucagcccuaugc

SEQ ID NO: 442320 - RNA, 22 nt, Human
gccuggcaggccucaugagggg

SEQ ID NO: 442321 - RNA, 22 nt, Human
ccagguggaaggucugugcucu

SEQ ID NO: 442322 - RNA, 22 nt, Human
uuccuuccacuucaggauuuug

SEQ ID NO: 442323 - RNA, 22 nt, Human
ggcacagagcuccagccuuggc

SEQ ID NO: 442324 - RNA, 22 nt, Human
ccagccagcugcccuuggggcc

SEQ ID NO: 442325 - RNA, 22 nt, Human
gggcaagcacagcgagcgugcg

SEQ ID NO: 442326 - RNA, 22 nt, Human
ugggcacaggggaauggaugaa

SEQ ID NO: 442327 - RNA, 22 nt, Human
cucaggcucuggccauccaagg

SEQ ID NO: 442328 - RNA, 22 nt, Human
aaaguucagugccuucuauaca

SEQ ID NO: 442329 - RNA, 22 nt, Human
ucugaggcuauguucaggcuaa

SEQ ID NO: 442330 - RNA, 18 nt, Human
gcacagcuaggagggucc

SEQ ID NO: 442331 - RNA, 22 nt, Human
caggguuucaccauguuagcag

SEQ ID NO: 442332 - RNA, 22 nt, Human
cuuagaaauaaugguuucaguu

SEQ ID NO: 442333 - RNA, 22 nt, Human
aaguucaaguaguguuacaugg

SEQ ID NO: 442334 - RNA, 22 nt, Human
ggggccuuggaucugugccccg

SEQ ID NO: 442335 - RNA, 22 nt, Human
cuguacaauguuaccuauuuau

SEQ ID NO: 442336 - RNA, 22 nt, Human
aggagccaggaaaccugcucug

SEQ ID NO: 442337 - RNA, 19 nt, Human
uugagaacaccaaguacug

SEQ ID NO: 442338 - RNA, 22 nt, Human
agggcagaaaucgauuacaccu

SEQ ID NO: 442339 - RNA, 22 nt, Human
ggcucucuggaggagcucaccc

SEQ ID NO: 442340 - RNA, 20 nt, Human
gcucagggccugggucugga

SEQ ID NO: 442341 - RNA, 22 nt, Human
auacagaagccuguauuucugg

SEQ ID NO: 442342 - RNA, 22 nt, Human
ucacaguaacuuuguugcuuuu

SEQ ID NO: 442343 - RNA, 22 nt, Human
ugcaggcugggaagagggacaa

SEQ ID NO: 442344 - RNA, 22 nt, Human
cccagcuccagagccagaaaca

SEQ ID NO: 442345 - RNA, 22 nt, Human
uaguggaggggaugcaaagcuu

SEQ ID NO: 442346 - RNA, 22 nt, Human
uuccuacauuuguacaauaaga

SEQ ID NO: 442347 - RNA, 18 nt, Human
gaggauggaaggagaugc

SEQ ID NO: 442348 - RNA, 22 nt, Human
agcagcaaaguauugggcaaga

SEQ ID NO: 442349 - RNA, 22 nt, Human
uggagacagagauagccaauug

SEQ ID NO: 442350 - RNA, 22 nt, Human
gcaggagccacuucagggaugc

SEQ ID NO: 442351 - RNA, 22 nt, Human
ucaaaacaacacucagguguaa

SEQ ID NO: 442352 - RNA, 21 nt, Human
cucugcccagggccuccugcc

SEQ ID NO: 442353 - RNA, 22 nt, Human
uuacuuuaucuccuagauucca

SEQ ID NO: 442354 - RNA, 22 nt, Human
ugccugucucugacugccauua

SEQ ID NO: 442355 - RNA, 22 nt, Human
ucugucuccucugaggugccag

SEQ ID NO: 442356 - RNA, 22 nt, Human
aguccuagacuuuucugccacu

SEQ ID NO: 442357 - RNA, 22 nt, Human
gggcacuguggggcccaugcug

SEQ ID NO: 442358 - RNA, 22 nt, Human
cucuggggaagcagccagcugg

SEQ ID NO: 442359 - RNA, 22 nt, Human
aaguggcucauguggcuucugc

SEQ ID NO: 442360 - RNA, 22 nt, Human
ucucuaaagccuggaagaggag

SEQ ID NO: 442361 - RNA, 22 nt, Human
cagagugaaaacugagcucaaa

SEQ ID NO: 442362 - RNA, 22 nt, Human
uagguuuacugaauuaguggaa

SEQ ID NO: 442363 - RNA, 22 nt, Human
aggcuggggaauugaauuugcu

SEQ ID NO: 442364 - RNA, 22 nt, Human
uggcucuggugcgggcuccugc

SEQ ID NO: 442365 - RNA, 22 nt, Human
uccagcagccacaccucuggac

SEQ ID NO: 442366 - RNA, 22 nt, Human
uuugacaacagcaaaugucaca

SEQ ID NO: 442367 - RNA, 22 nt, Human
aaucuagauucggaucaaaggg

SEQ ID NO: 442368 - RNA, 22 nt, Human
acaggacuuaagucauuuauaa

SEQ ID NO: 442369 - RNA, 22 nt, Human
agaaugucaacagccucucaag

SEQ ID NO: 442370 - RNA, 22 nt, Human
gccugugcuuaacugacgugag

SEQ ID NO: 442371 - RNA, 22 nt, Human
gcccacagucuaucaguuugcg

SEQ ID NO: 442372 - RNA, 22 nt, Human
aaguacuuuaggauauguaacu

SEQ ID NO: 442373 - RNA, 22 nt, Human
agguccugaggguucgucugca

SEQ ID NO: 442374 - RNA, 22 nt, Human
ccuccugggccuugcucuguga

SEQ ID NO: 442375 - RNA, 21 nt, Human
uaucagaagagaaagaaugau

SEQ ID NO: 442376 - RNA, 22 nt, Human
ggcugccauaacagaguaccac

SEQ ID NO: 442377 - RNA, 22 nt, Human
uacuguaugaauuauguuauuu

SEQ ID NO: 442378 - RNA, 22 nt, Human
aggggagguggcagaaaugugc

SEQ ID NO: 442379 - RNA, 17 nt, Human
uaucuguguuccuggcu

SEQ ID NO: 442380 - RNA, 22 nt, Human
uuucagagcucagcagcuagag

SEQ ID NO: 442381 - RNA, 22 nt, Human
gaaauauuguacuggagauguu

SEQ ID NO: 442382 - RNA, 22 nt, Human
gggcuucucucaggggcaugag

SEQ ID NO: 442383 - RNA, 19 nt, Human
ucuugaugagguuucucca

SEQ ID NO: 442384 - RNA, 22 nt, Human
ugcacacaguucucaggaaaga

SEQ ID NO: 442385 - RNA, 22 nt, Human
aacagcgucuuuccagcuguuc

SEQ ID NO: 442386 - RNA, 19 nt, Human
ugcccccagcaccucccug

SEQ ID NO: 442387 - RNA, 22 nt, Human
caauuucaauacaaaauacauu

SEQ ID NO: 442388 - RNA, 21 nt, Human
aggcauggaaauggcacacug

SEQ ID NO: 442389 - RNA, 22 nt, Human
uucuuuauuaguuuagugagcu

SEQ ID NO: 442390 - RNA, 22 nt, Human
cucccagguuccgacgccucuu

SEQ ID NO: 442391 - RNA, 22 nt, Human
uucuccuugguuuaugggacau

SEQ ID NO: 442392 - RNA, 22 nt, Human
acccagcuggaugcauggaggc

SEQ ID NO: 442393 - RNA, 22 nt, Human
ugcccacaggaagacaccagcg

SEQ ID NO: 442394 - RNA, 22 nt, Human
gaaguucucaaggaucacagaa

SEQ ID NO: 442395 - RNA, 22 nt, Human
acagccugagaguggagcuggc

SEQ ID NO: 442396 - RNA, 22 nt, Human
uaaggcauuagagugaaagcaa

SEQ ID NO: 442397 - RNA, 22 nt, Human
gcuuuagauacucccaaugucc

SEQ ID NO: 442398 - RNA, 22 nt, Human
uugacccaguuguaaaagagcu

SEQ ID NO: 442399 - RNA, 22 nt, Human
ccagcuccgggaguugcugcug

SEQ ID NO: 442400 - RNA, 22 nt, Human
uacuuuaaaaacugauaauuca

SEQ ID NO: 442401 - RNA, 22 nt, Human
aacacuuaaggagagaucaaau

SEQ ID NO: 442402 - RNA, 22 nt, Human
uagaguccuucauucugugcag

SEQ ID NO: 442403 - RNA, 22 nt, Human
gaagguccagcguggccaaguc

SEQ ID NO: 442404 - RNA, 22 nt, Human
agggccagcacuccuggcagga

SEQ ID NO: 442405 - RNA, 22 nt, Human
aggcucucagaucagccacauu

SEQ ID NO: 442406 - RNA, 22 nt, Human
uugacaaauacccauuagacca

SEQ ID NO: 442407 - RNA, 22 nt, Human
aagucagaaauaucugccauca

SEQ ID NO: 442408 - RNA, 22 nt, Human
caggaaagguagucacaaugua

SEQ ID NO: 442409 - RNA, 20 nt, Human
uggcuccugcgguggaacca

SEQ ID NO: 442410 - RNA, 22 nt, Human
agcaguagugauggccccugag

SEQ ID NO: 442411 - RNA, 22 nt, Human
cagcagcaugaauucgagccac

SEQ ID NO: 442412 - RNA, 22 nt, Human
ggaugcaggacggcauggaugu

SEQ ID NO: 442413 - RNA, 22 nt, Human
cagacagguagggacagaacau

SEQ ID NO: 442414 - RNA, 22 nt, Human
acagcagguuuuaacuuugaag

SEQ ID NO: 442415 - RNA, 18 nt, Human
uaggcugggggcuguagu

SEQ ID NO: 442416 - RNA, 22 nt, Human
ggcaggugcaccugagccaucu

SEQ ID NO: 442417 - RNA, 22 nt, Human
uagcaacauaagaaacauuuug

SEQ ID NO: 442418 - RNA, 22 nt, Human
agacagcagcagaggggcuccc

SEQ ID NO: 442419 - RNA, 22 nt, Human
cucugagguccuucccagcucu

SEQ ID NO: 442420 - RNA, 22 nt, Human
ugggcacaaacaucugccuguu

SEQ ID NO: 442421 - RNA, 22 nt, Human
aaauacaaaaauuagccaggca

SEQ ID NO: 442422 - RNA, 22 nt, Human
agguccuguuucuucccugggg

SEQ ID NO: 442423 - RNA, 22 nt, Human
acacaaguucuaaagauugcgc

SEQ ID NO: 442424 - RNA, 22 nt, Human
cagcuguugucaccucacaucc

SEQ ID NO: 442425 - RNA, 22 nt, Human
uacaaacuuguuuuaaguaagu

SEQ ID NO: 442426 - RNA, 22 nt, Human
ucagcaguggcucucaugcagu

SEQ ID NO: 442427 - RNA, 22 nt, Human
cauuucuaagaagaucugggua

SEQ ID NO: 442428 - RNA, 22 nt, Human
uuaguacaagagauuaauuacu

SEQ ID NO: 442429 - RNA, 21 nt, Human
agacagcagauagucgaaagg

SEQ ID NO: 442430 - RNA, 22 nt, Human
ucuggccugaaaguccaugcuu

SEQ ID NO: 442431 - RNA, 22 nt, Human
auuucagaauguccuaauuuag

SEQ ID NO: 442432 - RNA, 22 nt, Human
aaggcagcuuuaaaaaagaugc

SEQ ID NO: 442433 - RNA, 22 nt, Human
ggagggaaugucuagcauucuu

SEQ ID NO: 442434 - RNA, 22 nt, Human
agcucccagagcucgagaguaa

SEQ ID NO: 442435 - RNA, 22 nt, Human
uuguuuuggaagaacuuacucu

SEQ ID NO: 442436 - RNA, 22 nt, Human
ccagcucccugaagccuggucu

SEQ ID NO: 442437 - RNA, 22 nt, Human
uucagcaagaccaccauguacc

SEQ ID NO: 442438 - RNA, 22 nt, Human
cagagcugcucaugguggccag

SEQ ID NO: 442439 - RNA, 22 nt, Human
aauucagauggaagauucuggc

SEQ ID NO: 442440 - RNA, 22 nt, Human
uuacaauguaaggcaugguucu

SEQ ID NO: 442441 - RNA, 22 nt, Human
cuaaggcagguccauuccagga

SEQ ID NO: 442442 - RNA, 22 nt, Human
acugcaggagacacagcugcug

SEQ ID NO: 442443 - RNA, 22 nt, Human
guacuuuguuaccauagcucca

SEQ ID NO: 442444 - RNA, 21 nt, Human
cagaggccuaucacagacucc

SEQ ID NO: 442445 - RNA, 22 nt, Human
caggaagccacaggacagguag

SEQ ID NO: 442446 - RNA, 19 nt, Human
agccuggcuuugcucugcu

SEQ ID NO: 442447 - RNA, 23 nt, Human
gugacccaaggaccuuccagaau

SEQ ID NO: 442448 - RNA, 22 nt, Human
gagggaauggugugcaagaggu

SEQ ID NO: 442449 - RNA, 22 nt, Human
cccagccucuggauucugcccu

SEQ ID NO: 442450 - RNA, 22 nt, Human
gcaggccuaagagaaggcauug

SEQ ID NO: 442451 - RNA, 23 nt, Human
gugcgccaggacaaccugacgga

SEQ ID NO: 442452 - RNA, 22 nt, Human
caguauucaucuaaggagcuug

SEQ ID NO: 442453 - RNA, 22 nt, Human
cagcccugcucuuagugucucc

SEQ ID NO: 442454 - RNA, 22 nt, Human
caauaagauguauugagcagag

SEQ ID NO: 442455 - RNA, 22 nt, Human
caggcaugagccaggccccucc

SEQ ID NO: 442456 - RNA, 22 nt, Human
uuuggccacuucauagaucauu

SEQ ID NO: 442457 - RNA, 22 nt, Human
cagcauaggauguggagccagg

SEQ ID NO: 442458 - RNA, 22 nt, Human
gcagcagcagcaauuuucuguc

SEQ ID NO: 442459 - RNA, 22 nt, Human
ucaggcugcuggccagcaggcu

SEQ ID NO: 442460 - RNA, 22 nt, Human
cucugugggggagaggcagcug

SEQ ID NO: 442461 - RNA, 22 nt, Human
ugccauccugugucaugcucau

SEQ ID NO: 442462 - RNA, 22 nt, Human
augucauuaaaauugugcugca

SEQ ID NO: 442463 - RNA, 22 nt, Human
ccaggaaaaacacauugaagag

SEQ ID NO: 442464 - RNA, 22 nt, Human
auuuuucucuuuccacugagau

SEQ ID NO: 442465 - RNA, 22 nt, Human
ucagacaggccucuccagccuc

SEQ ID NO: 442466 - RNA, 22 nt, Human
gcuuugcacagugcuguguuaa

SEQ ID NO: 442467 - RNA, 22 nt, Human
ugaggccuggagggaggaguuu

SEQ ID NO: 442468 - RNA, 22 nt, Human
cccuggugguacggcacuggca

SEQ ID NO: 442469 - RNA, 22 nt, Human
ugaggcaggacugagcgggaug

SEQ ID NO: 442470 - RNA, 22 nt, Human
cccaggaaguugagacugcagu

SEQ ID NO: 442471 - RNA, 22 nt, Human
gaggcugcccaacuggagugga

SEQ ID NO: 442472 - RNA, 22 nt, Human
gugcauauauaugggagggagc

SEQ ID NO: 442473 - RNA, 22 nt, Human
uucacauuuacugguuuguccg

SEQ ID NO: 442474 - RNA, 22 nt, Human
auuauuguguaaaaugaggcuu

SEQ ID NO: 442475 - RNA, 22 nt, Human
agauucagaaaugaggagggcc

SEQ ID NO: 442476 - RNA, 23 nt, Human
agguagguuauugcugcuaccug

SEQ ID NO: 442477 - RNA, 22 nt, Human
uuucuaaacaaagggaguuugg

SEQ ID NO: 442478 - RNA, 22 nt, Human
cccaggaggugugcccaacucg

SEQ ID NO: 442479 - RNA, 22 nt, Human
auuccagagaaaggccuggcug

SEQ ID NO: 442480 - RNA, 22 nt, Human
caggcagcguccugcuuccugu

SEQ ID NO: 442481 - RNA, 22 nt, Human
uaacauuccauggaucugcaga

SEQ ID NO: 442482 - RNA, 19 nt, Human
aggcagcauucuggggcuu

SEQ ID NO: 442483 - RNA, 22 nt, Human
cucuggcucccgcagcccccau

SEQ ID NO: 442484 - RNA, 22 nt, Human
agugcaauagcaaagaacaaca

SEQ ID NO: 442485 - RNA, 22 nt, Human
agcccaagcuaugaggugaccu

SEQ ID NO: 442486 - RNA, 22 nt, Human
uggcuccuggcagguguuucaa

SEQ ID NO: 442487 - RNA, 22 nt, Human
auuuuccuucuaagaggaaggu

SEQ ID NO: 442488 - RNA, 19 nt, Human
acacugaauguagaauugg

SEQ ID NO: 442489 - RNA, 22 nt, Human
uagcacaagaaguacacauaga

SEQ ID NO: 442490 - RNA, 22 nt, Human
ucaggcuguggcuucaguucuu

SEQ ID NO: 442491 - RNA, 21 nt, Human
auccuugaucagaagagugcu

SEQ ID NO: 442492 - RNA, 19 nt, Human
gcaccagauugagugacac

SEQ ID NO: 442493 - RNA, 22 nt, Human
ggagaggagauuguggcauuuu

SEQ ID NO: 442494 - RNA, 22 nt, Human
gggcacagccuaacuauggaga

SEQ ID NO: 442495 - RNA, 22 nt, Human
aagcugcccaagacugaagcau

SEQ ID NO: 442496 - RNA, 18 nt, Human
agcuccuggucucaggga

SEQ ID NO: 442497 - RNA, 22 nt, Human
cagcccugagaaggaggaucuc

SEQ ID NO: 442498 - RNA, 22 nt, Human
uacaauucuuuguaaggugguc

SEQ ID NO: 442499 - RNA, 22 nt, Human
gugggccaguuccucacaggua

SEQ ID NO: 442500 - RNA, 22 nt, Human
ggcaucaggguaggaagguauc

SEQ ID NO: 442501 - RNA, 22 nt, Human
caagggaaggcuaagggcaaca

SEQ ID NO: 442502 - RNA, 23 nt, Human
aaauuauugcucuucaauugccu

SEQ ID NO: 442503 - RNA, 22 nt, Human
gccaggcaaauuaaggaaugca

SEQ ID NO: 442504 - RNA, 22 nt, Human
cccagggagcuuggagaacggg

SEQ ID NO: 442505 - RNA, 22 nt, Human
aagagcuggauggaaucuggga

SEQ ID NO: 442506 - RNA, 22 nt, Human
uugcugagagcgugucaacaag

SEQ ID NO: 442507 - RNA, 22 nt, Human
uaaggcagguaugguaccaggc

SEQ ID NO: 442508 - RNA, 22 nt, Human
uugaagcuaggcugugcauaug

SEQ ID NO: 442509 - RNA, 22 nt, Human
agcagggccucuggcacugguc

SEQ ID NO: 442510 - RNA, 20 nt, Human
ugcuugucaugcacucaggc

SEQ ID NO: 442511 - RNA, 22 nt, Human
aggacacagguaagccagugga

SEQ ID NO: 442512 - RNA, 22 nt, Human
cacagggaggcggucacuggcu

SEQ ID NO: 442513 - RNA, 22 nt, Human
agucagugaaaacuagaauguu

SEQ ID NO: 442514 - RNA, 22 nt, Human
aggcuccauuuuccugcagcug

SEQ ID NO: 442515 - RNA, 22 nt, Human
ggccugccucacagucagcacc

SEQ ID NO: 442516 - RNA, 18 nt, Human
uaaggcauucuuauguga

SEQ ID NO: 442517 - RNA, 22 nt, Human
agggcagcacaaggcauggacu

SEQ ID NO: 442518 - RNA, 22 nt, Human
ccuagggagccugagagcagug

SEQ ID NO: 442519 - RNA, 22 nt, Human
cugccaaggcuggggaggacaa

SEQ ID NO: 442520 - RNA, 22 nt, Human
ggcugccucaaagcucaagcuc

SEQ ID NO: 442521 - RNA, 22 nt, Human
cagcaagagaggcagggcaaau

SEQ ID NO: 442522 - RNA, 22 nt, Human
acaugcacacgauucagucugg

SEQ ID NO: 442523 - RNA, 22 nt, Human
cagcccuggcuagggcgagggc

SEQ ID NO: 442524 - RNA, 20 nt, Human
ucuguagucuaugaggcuua

SEQ ID NO: 442525 - RNA, 22 nt, Human
ugggcagcaaagacugugugcu

SEQ ID NO: 442526 - RNA, 22 nt, Human
gaauugcucugccuggccagcc

SEQ ID NO: 442527 - RNA, 22 nt, Human
ugaagcaguucucagaaguggg

SEQ ID NO: 442528 - RNA, 22 nt, Human
cugccugugccaaugcuccuuu

SEQ ID NO: 442529 - RNA, 22 nt, Human
gaguauucaauauauacaaaug

SEQ ID NO: 442530 - RNA, 22 nt, Human
gggcuggaucuccugcaggcag

SEQ ID NO: 442531 - RNA, 22 nt, Human
ugcauuaucaucuggaagcuug

SEQ ID NO: 442532 - RNA, 22 nt, Human
uaacaucuuauuggcaaagaua

SEQ ID NO: 442533 - RNA, 22 nt, Human
cugugugugagaagcagguuga

SEQ ID NO: 442534 - RNA, 22 nt, Human
gccagugcuuguggagcuggca

SEQ ID NO: 442535 - RNA, 22 nt, Human
uucuggaagccccagagucaga

SEQ ID NO: 442536 - RNA, 18 nt, Human
cccagaggaaugccugga

SEQ ID NO: 442537 - RNA, 22 nt, Human
cuguggcacucaagaagccucc

SEQ ID NO: 442538 - RNA, 22 nt, Human
uacugaggguaugaagccaagg

SEQ ID NO: 442539 - RNA, 22 nt, Human
uccugagggacugguuccucgc

SEQ ID NO: 442540 - RNA, 22 nt, Human
agccaaggagugcagguggcuu

SEQ ID NO: 442541 - RNA, 22 nt, Human
ucaucuuuguaucccuaacaca

SEQ ID NO: 442542 - RNA, 22 nt, Human
ccugcuggccaguggagggcug

SEQ ID NO: 442543 - RNA, 22 nt, Human
aacaggcaacaguugacucuga

SEQ ID NO: 442544 - RNA, 22 nt, Human
cauuaaaucuuccagaccucac

SEQ ID NO: 442545 - RNA, 22 nt, Human
acacaggaagagagauaauaau

SEQ ID NO: 442546 - RNA, 22 nt, Human
cuccucagcugggaggaguccc

SEQ ID NO: 442547 - RNA, 22 nt, Human
ccaggcccugcuccucacacca

SEQ ID NO: 442548 - RNA, 22 nt, Human
aaauuuuagaccaggcaaaacu

SEQ ID NO: 442549 - RNA, 22 nt, Human
uucacauuauaaucaguucugc

SEQ ID NO: 442550 - RNA, 22 nt, Human
uagagcuggccgggacagcugg

SEQ ID NO: 442551 - RNA, 22 nt, Human
agauggcuuagccuggcuccca

SEQ ID NO: 442552 - RNA, 22 nt, Human
aagugaugcuacgacuuugaca

SEQ ID NO: 442553 - RNA, 22 nt, Human
acaauuuuaagccagagugggu

SEQ ID NO: 442554 - RNA, 22 nt, Human
cacuguguaagaagaugggcuu

SEQ ID NO: 442555 - RNA, 22 nt, Human
cagcugguucagugucugguga

SEQ ID NO: 442556 - RNA, 22 nt, Human
uucaaguacauuguguuuuccu

SEQ ID NO: 442557 - RNA, 22 nt, Human
gucugggcaccuggccugggaa

SEQ ID NO: 442558 - RNA, 22 nt, Human
cagggcuucgcuccuggugcac

SEQ ID NO: 442559 - RNA, 22 nt, Human
uuucagagccuuuaucucucua

SEQ ID NO: 442560 - RNA, 22 nt, Human
agcaguggccuggggcucugug

SEQ ID NO: 442561 - RNA, 22 nt, Human
uaggaauuuuuguaaugguacu

SEQ ID NO: 442562 - RNA, 22 nt, Human
cggcugagcagugcugauggaa

SEQ ID NO: 442563 - RNA, 22 nt, Human
aaacugcaauuacuuuugcacc

SEQ ID NO: 442564 - RNA, 21 nt, Human
ucccugcuuucuggcccaguc

SEQ ID NO: 442565 - RNA, 22 nt, Human
ugcauuuggggcagacuagcag

SEQ ID NO: 442566 - RNA, 22 nt, Human
uaaggcagcugagcuucuaaca

SEQ ID NO: 442567 - RNA, 22 nt, Human
ggcagggaaacagcugauccca

SEQ ID NO: 442568 - RNA, 22 nt, Human
acaggccugaugccuuggcugg

SEQ ID NO: 442569 - RNA, 22 nt, Human
ggaaggucgagcugcaucuggc

SEQ ID NO: 442570 - RNA, 22 nt, Human
uuggaauuucauguaagugacu

SEQ ID NO: 442571 - RNA, 22 nt, Human
aggccugcagcaggagcaaacc

SEQ ID NO: 442572 - RNA, 18 nt, Human
uuuggccaugaccuggcu

SEQ ID NO: 442573 - RNA, 22 nt, Human
ugguccagacauuucugaggua

SEQ ID NO: 442574 - RNA, 22 nt, Human
gggccuggugcuucugacuccu

SEQ ID NO: 442575 - RNA, 19 nt, Human
cacuuuauuucuguuuugu

SEQ ID NO: 442576 - RNA, 22 nt, Human
aagcaacagaaacauucuaaua

SEQ ID NO: 442577 - RNA, 22 nt, Human
ucaggccuggagaaaggaauga

SEQ ID NO: 442578 - RNA, 21 nt, Human
ugggcagauggcaguguggcu

SEQ ID NO: 442579 - RNA, 22 nt, Human
aaaggcuacgggggccgugugc

SEQ ID NO: 442580 - RNA, 22 nt, Human
ggcugccacgucgaggguccaa

SEQ ID NO: 442581 - RNA, 22 nt, Human
cgaggcagacaaaaguuggaag

SEQ ID NO: 442582 - RNA, 22 nt, Human
acugauuaugcguacucucuac

SEQ ID NO: 442583 - RNA, 22 nt, Human
gaggccuggaccagccacagag

SEQ ID NO: 442584 - RNA, 22 nt, Human
cugagcuggucuauggacuugg

SEQ ID NO: 442585 - RNA, 22 nt, Human
ucagagaaaugcugagcucaug

SEQ ID NO: 442586 - RNA, 22 nt, Human
aauggcaagagccacagaggcg

SEQ ID NO: 442587 - RNA, 22 nt, Human
uuucaaacuaugugucaggcag

SEQ ID NO: 442588 - RNA, 22 nt, Human
agugaaaacacuaguucuugcc

SEQ ID NO: 442589 - RNA, 22 nt, Human
aaauuagucgguuuaggaauuu

SEQ ID NO: 442590 - RNA, 22 nt, Human
gaguccugcuuucaauucuuuu

SEQ ID NO: 442591 - RNA, 19 nt, Human
aucagcaagguaggaugug

SEQ ID NO: 442592 - RNA, 22 nt, Human
uugcuuugccaccagaagucua

SEQ ID NO: 442593 - RNA, 22 nt, Human
ugagccuggagucguggagggg

SEQ ID NO: 442594 - RNA, 22 nt, Human
caaagggcauuuuagugaacug

SEQ ID NO: 442595 - RNA, 22 nt, Human
cccuggagggacagcugcucua

SEQ ID NO: 442596 - RNA, 17 nt, Human
agcacuugaaaauuucu

SEQ ID NO: 442597 - RNA, 22 nt, Human
uuauguguaccucaaucugagg

SEQ ID NO: 442598 - RNA, 22 nt, Human
aacuuuaucggaacagguacuc

SEQ ID NO: 442599 - RNA, 20 nt, Human
agcaguccaaaagggcagac

SEQ ID NO: 442600 - RNA, 22 nt, Human
auacacauguguaugugcaugc

SEQ ID NO: 442601 - RNA, 17 nt, Human
uggagcugcguguguuc

SEQ ID NO: 442602 - RNA, 22 nt, Human
gucuggaaccaagacguguagc

SEQ ID NO: 442603 - RNA, 22 nt, Human
cuuguggcccauggcuuccugc

SEQ ID NO: 442604 - RNA, 23 nt, Human
uacuauaacgcugugucagcucc

SEQ ID NO: 442605 - RNA, 22 nt, Human
gggccugugcacaguucuguua

SEQ ID NO: 442606 - RNA, 22 nt, Human
ggcagcccuuucuggccagcuc

SEQ ID NO: 442607 - RNA, 22 nt, Human
ucaggccuuucuucagagcuuc

SEQ ID NO: 442608 - RNA, 22 nt, Human
ugagcccaggaguuggagaccg

SEQ ID NO: 442609 - RNA, 22 nt, Human
guucugaguccuccuuugaagg

SEQ ID NO: 442610 - RNA, 22 nt, Human
agcagcaaggaagcgaggaugg

SEQ ID NO: 442611 - RNA, 22 nt, Human
ccugccugcguccucugagggc

SEQ ID NO: 442612 - RNA, 19 nt, Human
cuauugcacauagcugaag

SEQ ID NO: 442613 - RNA, 22 nt, Human
gcucagagaaguugugccuggc

SEQ ID NO: 442614 - RNA, 22 nt, Human
ugggcagaguugugaugaacug

SEQ ID NO: 442615 - RNA, 22 nt, Human
uggcucugaucagauguccagu

SEQ ID NO: 442616 - RNA, 22 nt, Human
gggcagccugcuuucugaucca

SEQ ID NO: 442617 - RNA, 22 nt, Human
gcagcccuuucugggcagggga

SEQ ID NO: 442618 - RNA, 22 nt, Human
ugcagaagauggucugagcacc

SEQ ID NO: 442619 - RNA, 22 nt, Human
aagaccuugucuaaacauguag

SEQ ID NO: 442620 - RNA, 22 nt, Human
aaguucaaaaauguaaucagug

SEQ ID NO: 442621 - RNA, 22 nt, Human
gagcugccaagauuacaaucag

SEQ ID NO: 442622 - RNA, 22 nt, Human
aagcugccagauucagucugcu

SEQ ID NO: 442623 - RNA, 22 nt, Human
aggcuggcuucccaagcguccu

SEQ ID NO: 442624 - RNA, 22 nt, Human
agacgagggcccccaggacagc

SEQ ID NO: 442625 - RNA, 22 nt, Human
uuuacagaugaggauacugagg

SEQ ID NO: 442626 - RNA, 22 nt, Human
cagaguaaaccugucaucaaga

SEQ ID NO: 442627 - RNA, 22 nt, Human
ucaagacaucacugugcauuuu

SEQ ID NO: 442628 - RNA, 23 nt, Human
aggagccaggugcagcccuugug

SEQ ID NO: 442629 - RNA, 22 nt, Human
gcagacagaugagggugcuggg

SEQ ID NO: 442630 - RNA, 22 nt, Human
gagagcugauagaugagcuacu

SEQ ID NO: 442631 - RNA, 22 nt, Human
ugucagugaguuaguugcaagu

SEQ ID NO: 442632 - RNA, 22 nt, Human
ugggccuggagcccuggagagu

SEQ ID NO: 442633 - RNA, 22 nt, Human
accauacuugaaauggauagga

SEQ ID NO: 442634 - RNA, 22 nt, Human
ugucccauggauaccaggcuau

SEQ ID NO: 442635 - RNA, 22 nt, Human
uauuggaugaagaaaggaagga

SEQ ID NO: 442636 - RNA, 22 nt, Human
aggcaaaucugagacauuuaaa

SEQ ID NO: 442637 - RNA, 22 nt, Human
ggagccagaggcugcugcugug

SEQ ID NO: 442638 - RNA, 22 nt, Human
ucuuugcagucugggcuuguuu

SEQ ID NO: 442639 - RNA, 22 nt, Human
aggacuaaggaacagcugauuc

SEQ ID NO: 442640 - RNA, 22 nt, Human
caaaagucuguccuuuaacuuc

SEQ ID NO: 442641 - RNA, 19 nt, Human
cuucuugauaagguucuuu

SEQ ID NO: 442642 - RNA, 22 nt, Human
guuccugaagggacuggugcag

SEQ ID NO: 442643 - RNA, 22 nt, Human
uugugagagccaaacauguaag

SEQ ID NO: 442644 - RNA, 22 nt, Human
gcuuugcuggaaucaacgaaug

SEQ ID NO: 442645 - RNA, 22 nt, Human
aauacuugucagaugaauaaga

SEQ ID NO: 442646 - RNA, 22 nt, Human
aggauuuggccauggcuucggg

SEQ ID NO: 442647 - RNA, 22 nt, Human
gcugugcagucuuuggugugcc

SEQ ID NO: 442648 - RNA, 22 nt, Human
ucaguguagcagacuuguagcc

SEQ ID NO: 442649 - RNA, 22 nt, Human
cccagcucuuuuagcggcaucu

SEQ ID NO: 442650 - RNA, 22 nt, Human
ugcauugaggggcucucuuccu

SEQ ID NO: 442651 - RNA, 22 nt, Human
agguuccucuuccucuggccug

SEQ ID NO: 442652 - RNA, 22 nt, Human
acaaucuuauuaguaguauaga

SEQ ID NO: 442653 - RNA, 22 nt, Human
cauugguugucauggcaggagg

SEQ ID NO: 442654 - RNA, 22 nt, Human
uugaaauauggauugaccuuga

SEQ ID NO: 442655 - RNA, 22 nt, Human
ccagcagcccacaggcgucccu

SEQ ID NO: 442656 - RNA, 22 nt, Human
ggcauccaaauaccaagaugua

SEQ ID NO: 442657 - RNA, 23 nt, Human
agaagcagcuucuggaguaucgg

SEQ ID NO: 442658 - RNA, 22 nt, Human
agacaggcagaggcugcagagg

SEQ ID NO: 442659 - RNA, 22 nt, Human
ugcagcaggagccaggccuggu

SEQ ID NO: 442660 - RNA, 22 nt, Human
gaggccugguuugcaugagaau

SEQ ID NO: 442661 - RNA, 22 nt, Human
ggcuagaugguauauaaggaug

SEQ ID NO: 442662 - RNA, 22 nt, Human
cuggcuggccggaggcaucccu

SEQ ID NO: 442663 - RNA, 22 nt, Human
ugcaauuucaaauaucagaaag

SEQ ID NO: 442664 - RNA, 22 nt, Human
gagccuggagcuggaacgaagc

SEQ ID NO: 442665 - RNA, 22 nt, Human
ugaggcacugggagagcacacu

SEQ ID NO: 442666 - RNA, 22 nt, Human
aggcuucugugagcucauacaa

SEQ ID NO: 442667 - RNA, 22 nt, Human
agagacaggaauggcauuaaga

SEQ ID NO: 442668 - RNA, 22 nt, Human
gccagggugagggcugagaggu

SEQ ID NO: 442669 - RNA, 22 nt, Human
ccccaacccugguuccguggcg

SEQ ID NO: 442670 - RNA, 22 nt, Human
aaacagagagauguauguggag

SEQ ID NO: 442671 - RNA, 21 nt, Human
ugcauauucuucugguggcug

SEQ ID NO: 442672 - RNA, 22 nt, Human
cagcaggucucagcagcuccuu

SEQ ID NO: 442673 - RNA, 22 nt, Human
cugagccacugcuuguucagug

SEQ ID NO: 442674 - RNA, 22 nt, Human
guuaugauggcaccacugcacu

SEQ ID NO: 442675 - RNA, 22 nt, Human
uggucaggauucucagcccuuc

SEQ ID NO: 442676 - RNA, 18 nt, Human
aggccugggaagcugagg

SEQ ID NO: 442677 - RNA, 22 nt, Human
agcucccagcuccuuugagaga

SEQ ID NO: 442678 - RNA, 22 nt, Human
acuggcuuugccucugccucuc

SEQ ID NO: 442679 - RNA, 22 nt, Human
cugcccuguagcuguucuagca

SEQ ID NO: 442680 - RNA, 22 nt, Human
ugagaaggguuggagaaauaau

SEQ ID NO: 442681 - RNA, 22 nt, Human
acagauggaauguguuauggga

SEQ ID NO: 442682 - RNA, 17 nt, Human
gcaggcacugcugccug

SEQ ID NO: 442683 - RNA, 22 nt, Human
gcucccaggaagagaagggcca

SEQ ID NO: 442684 - RNA, 22 nt, Human
cagcccagcagucuuagccugc

SEQ ID NO: 442685 - RNA, 22 nt, Human
agcaccugcacaguggaggaaa

SEQ ID NO: 442686 - RNA, 22 nt, Human
ucugggcucacgagucuggaca

SEQ ID NO: 442687 - RNA, 22 nt, Human
uauuuaauaaaacuauggcaug

SEQ ID NO: 442688 - RNA, 22 nt, Human
acagaauacuacagacugguua

SEQ ID NO: 442689 - RNA, 22 nt, Human
uuacaguaauguauuauuuaac

SEQ ID NO: 442690 - RNA, 22 nt, Human
ggccauggaccccgagcugacc

SEQ ID NO: 442691 - RNA, 22 nt, Human
cauuuguauguuccuccuuagg

SEQ ID NO: 442692 - RNA, 22 nt, Human
ugaggcagaaauuccuguuuuc

SEQ ID NO: 442693 - RNA, 19 nt, Human
acagcagguguggggauaa

SEQ ID NO: 442694 - RNA, 22 nt, Human
ucagccuugcuucuggacuggu

SEQ ID NO: 442695 - RNA, 22 nt, Human
ggcaguuucaucaggagaaaag

SEQ ID NO: 442696 - RNA, 22 nt, Human
cugagccauccauaccagcuua

SEQ ID NO: 442697 - RNA, 22 nt, Human
gaugcagggcuggcaggagcuu

SEQ ID NO: 442698 - RNA, 22 nt, Human
ggagggcaucaaucaggccugg

SEQ ID NO: 442699 - RNA, 22 nt, Human
uuuucuuauggugaagcacaaa

SEQ ID NO: 442700 - RNA, 22 nt, Human
uaauacaaggcaggaagcagua

SEQ ID NO: 442701 - RNA, 22 nt, Human
aagaacaugcuauaauuaucuu

SEQ ID NO: 442702 - RNA, 22 nt, Human
ccagcuggaacggcagcccagc

SEQ ID NO: 442703 - RNA, 22 nt, Human
auuuuugagcugugaacauagc

SEQ ID NO: 442704 - RNA, 22 nt, Human
acaauacaggcuucuggacuua

SEQ ID NO: 442705 - RNA, 22 nt, Human
uuguacaauggaugccagauga

SEQ ID NO: 442706 - RNA, 22 nt, Human
cccuccagcucaaagcaaccgg

SEQ ID NO: 442707 - RNA, 22 nt, Human
gggaaagagagguggacgcagg

SEQ ID NO: 442708 - RNA, 22 nt, Human
gagcaggcuugcagagaagggg

SEQ ID NO: 442709 - RNA, 22 nt, Human
acagcagguuacaguggcacag

SEQ ID NO: 442710 - RNA, 22 nt, Human
aggcagcauccagaggagaaug

SEQ ID NO: 442711 - RNA, 22 nt, Human
agaugaauccacacauggcaaa

SEQ ID NO: 442712 - RNA, 23 nt, Human
auguuauuauuagcagucuugcc

SEQ ID NO: 442713 - RNA, 19 nt, Human
gcucagagacaccuguugc

SEQ ID NO: 442714 - RNA, 22 nt, Human
ggcuccaaagggcagugugagg

SEQ ID NO: 442715 - RNA, 22 nt, Human
cacagaggagugcacacucucu

SEQ ID NO: 442716 - RNA, 22 nt, Human
ccugggaguggcacucacagca

SEQ ID NO: 442717 - RNA, 22 nt, Human
uggagcugaacuuugaggccag

SEQ ID NO: 442718 - RNA, 23 nt, Human
cuggggcuuucaaaucugggcag

SEQ ID NO: 442719 - RNA, 22 nt, Human
uucaugaaagacagcaacugug

SEQ ID NO: 442720 - RNA, 20 nt, Human
caauagaauguggagauaag

SEQ ID NO: 442721 - RNA, 22 nt, Human
aaguucaauggaaaagcuuuag

SEQ ID NO: 442722 - RNA, 22 nt, Human
agaaaugcauuagcacauauag

SEQ ID NO: 442723 - RNA, 22 nt, Human
gagcaacacauugaaugaggau

SEQ ID NO: 442724 - RNA, 22 nt, Human
aggcagcuuuguaguaaagcua

SEQ ID NO: 442725 - RNA, 22 nt, Human
cccagcagcuugcacagugcug

SEQ ID NO: 442726 - RNA, 22 nt, Human
ucagaggaacacuguuucaugc

SEQ ID NO: 442727 - RNA, 22 nt, Human
ugcaggcugugucauuuaguga

SEQ ID NO: 442728 - RNA, 22 nt, Human
auugcaaagaaauacaugcuua

SEQ ID NO: 442729 - RNA, 22 nt, Human
gaggcagcggcucacagagaaa

SEQ ID NO: 442730 - RNA, 22 nt, Human
aaaacaguuuaggcaucacagu

SEQ ID NO: 442731 - RNA, 22 nt, Human
aauacuuugccaaguucgaaga

SEQ ID NO: 442732 - RNA, 23 nt, Human
ggucccaguggagaggccucacc

SEQ ID NO: 442733 - RNA, 22 nt, Human
gucucugagcucugagcuggcu

SEQ ID NO: 442734 - RNA, 22 nt, Human
ggcugccaggagggaggccagu

SEQ ID NO: 442735 - RNA, 22 nt, Human
cacaggagguuaggaagugguc

SEQ ID NO: 442736 - RNA, 22 nt, Human
acugugugaaacaucaaugugu

SEQ ID NO: 442737 - RNA, 22 nt, Human
ugcacagcugccuccucucugc

SEQ ID NO: 442738 - RNA, 22 nt, Human
ccagcagagggucuuggccauu

SEQ ID NO: 442739 - RNA, 22 nt, Human
ccaccagcuucagcagccgcgg

SEQ ID NO: 442740 - RNA, 22 nt, Human
uugcagcuucuaccacuguuuc

SEQ ID NO: 442741 - RNA, 22 nt, Human
caaaugcagucccuuuguugcu

SEQ ID NO: 442742 - RNA, 22 nt, Human
aagacacacacauaugcugagu

SEQ ID NO: 442743 - RNA, 22 nt, Human
cuucaaaugugauuuuaauaac

SEQ ID NO: 442744 - RNA, 22 nt, Human
uauuauuauauuggaugagacu

SEQ ID NO: 442745 - RNA, 22 nt, Human
cagcagaggcacgucugugaau

SEQ ID NO: 442746 - RNA, 22 nt, Human
ggcccugucccuggccgucugu

SEQ ID NO: 442747 - RNA, 22 nt, Human
gcuguuucuuugaugauggaau

SEQ ID NO: 442748 - RNA, 22 nt, Human
cuuauugucuuacaguaauaga

SEQ ID NO: 442749 - RNA, 17 nt, Human
gagauggguggaucacc

SEQ ID NO: 442750 - RNA, 22 nt, Human
uuuaaugaauaauucaaaucug

SEQ ID NO: 442751 - RNA, 22 nt, Human
gcuggccacauugugccguccu

SEQ ID NO: 442752 - RNA, 22 nt, Human
cugggcucaguggcucauggcu

SEQ ID NO: 442753 - RNA, 22 nt, Human
gaggccagaaugagcugaaugc

SEQ ID NO: 442754 - RNA, 22 nt, Human
uugcaaaucagaaguauagauu

SEQ ID NO: 442755 - RNA, 22 nt, Human
acaugaaauucuagcugaaccc

SEQ ID NO: 442756 - RNA, 22 nt, Human
gacagcagacagccuggccccu

SEQ ID NO: 442757 - RNA, 22 nt, Human
ucagaccauccugcuguuagug

SEQ ID NO: 442758 - RNA, 22 nt, Human
agagcugugcuuugcaccacgu

SEQ ID NO: 442759 - RNA, 22 nt, Human
gccucccuguuuccugcuccaa

SEQ ID NO: 442760 - RNA, 22 nt, Human
ucugacccguggcucugccucc

SEQ ID NO: 442761 - RNA, 17 nt, Human
uuacacaggagagcucu

SEQ ID NO: 442762 - RNA, 22 nt, Human
ucacaggacccugaggguggcg

SEQ ID NO: 442763 - RNA, 23 nt, Human
ugauuuuaaaaaguaaguuauca

SEQ ID NO: 442764 - RNA, 23 nt, Human
gugcaugugucuuuacaguagca

SEQ ID NO: 442765 - RNA, 22 nt, Human
acagcagcuaaccccugggcca

SEQ ID NO: 442766 - RNA, 22 nt, Human
uggaaaaaacccagacucuaga

SEQ ID NO: 442767 - RNA, 21 nt, Human
gugugaguagcaugugucuca

SEQ ID NO: 442768 - RNA, 22 nt, Human
cagaggcucagauggcccuggc

SEQ ID NO: 442769 - RNA, 22 nt, Human
augccaaagcccaaguucauca

SEQ ID NO: 442770 - RNA, 22 nt, Human
auuucagauucagaaauguagg

SEQ ID NO: 442771 - RNA, 22 nt, Human
gcagcccucggguacucacgug

SEQ ID NO: 442772 - RNA, 22 nt, Human
ucauugaggaaagguaguggcu

SEQ ID NO: 442773 - RNA, 23 nt, Human
ugggauggauucaccagugugcu

SEQ ID NO: 442774 - RNA, 22 nt, Human
cagggcagaacauauagauagu

SEQ ID NO: 442775 - RNA, 22 nt, Human
aggaaagggguagguguggacg

SEQ ID NO: 442776 - RNA, 22 nt, Human
gauggacagccuggaaggaaag

SEQ ID NO: 442777 - RNA, 20 nt, Human
uuguuagaggaaugccauag

SEQ ID NO: 442778 - RNA, 23 nt, Human
aaacuacaacgccaggcacugag

SEQ ID NO: 442779 - RNA, 21 nt, Human
ucugucucuccacugcccugc

SEQ ID NO: 442780 - RNA, 23 nt, Human
acagaggcuuaaaugaguggcag

SEQ ID NO: 442781 - RNA, 17 nt, Human
guuugcaugguguuaac

SEQ ID NO: 442782 - RNA, 22 nt, Human
cccagggacucgggauucuagg

SEQ ID NO: 442783 - RNA, 22 nt, Human
gauuucaaagguucugcaugcc

SEQ ID NO: 442784 - RNA, 22 nt, Human
caugcagcggcguuugguuuaa

SEQ ID NO: 442785 - RNA, 22 nt, Human
uucauacucacuccaauaacug

SEQ ID NO: 442786 - RNA, 22 nt, Human
gcaggaugagugaguacauuua

SEQ ID NO: 442787 - RNA, 22 nt, Human
acaggccugugugcacacgagg

SEQ ID NO: 442788 - RNA, 22 nt, Human
aaacugcaauuacuuuugcagc

SEQ ID NO: 442789 - RNA, 21 nt, Human
agacagcuuuaaagacacagg

SEQ ID NO: 442790 - RNA, 22 nt, Human
ugucacuucaggaaugcaggga

SEQ ID NO: 442791 - RNA, 22 nt, Human
uuccaugaguagcaguauuucc

SEQ ID NO: 442792 - RNA, 22 nt, Human
uggcuccucccugugugugcgu

SEQ ID NO: 442793 - RNA, 22 nt, Human
gaggcagcucuucugaaugggg

SEQ ID NO: 442794 - RNA, 22 nt, Human
ucccucagcuugucuccaugca

SEQ ID NO: 442795 - RNA, 23 nt, Human
agagaaagggauaacacguugaa

SEQ ID NO: 442796 - RNA, 22 nt, Human
aguuuacaguucucaucgcaac

SEQ ID NO: 442797 - RNA, 22 nt, Human
ucuaagacacuguacuuucagu

SEQ ID NO: 442798 - RNA, 22 nt, Human
cugggcuggcgcauccgacacg

SEQ ID NO: 442799 - RNA, 22 nt, Human
gaggggcagaaugugaucaggg

SEQ ID NO: 442800 - RNA, 22 nt, Human
cacuauaucucuuucaucuuuu

SEQ ID NO: 442801 - RNA, 22 nt, Human
gggcuggcucugucuagaaagg

SEQ ID NO: 442802 - RNA, 22 nt, Human
cucagcuccagcccucagcagc

SEQ ID NO: 442803 - RNA, 22 nt, Human
ugguacaaucacagcucacugu

SEQ ID NO: 442804 - RNA, 22 nt, Human
agugcuaaugugcaauauagag

SEQ ID NO: 442805 - RNA, 22 nt, Human
ccucaggcugggcugccccugg

SEQ ID NO: 442806 - RNA, 22 nt, Human
gccagccuucuguggccugcaa

SEQ ID NO: 442807 - RNA, 22 nt, Human
uggcaggguacaccuuaacacc

SEQ ID NO: 442808 - RNA, 22 nt, Human
ggcaguuuuaacagagguagua

SEQ ID NO: 442809 - RNA, 22 nt, Human
uuauccaagcagaagcugcaca

SEQ ID NO: 442810 - RNA, 22 nt, Human
ucccagagcugauaagccuuua

SEQ ID NO: 442811 - RNA, 22 nt, Human
gagcagggagacaacucuggug

SEQ ID NO: 442812 - RNA, 22 nt, Human
ccugacccuuuccaguguuggc

SEQ ID NO: 442813 - RNA, 22 nt, Human
uggcacagggcuuggucgcuca

SEQ ID NO: 442814 - RNA, 22 nt, Human
ucugggcuuuguaaugggaggu

SEQ ID NO: 442815 - RNA, 22 nt, Human
cccagaggugacaucccauucu

SEQ ID NO: 442816 - RNA, 22 nt, Human
ucaucuaagagucuuacauuua

SEQ ID NO: 442817 - RNA, 22 nt, Human
aggcuggagguuuguugcggcu

SEQ ID NO: 442818 - RNA, 22 nt, Human
cgcugggggaacuucagccaau

SEQ ID NO: 442819 - RNA, 21 nt, Human
gagcccaggcaucucauuaau

SEQ ID NO: 442820 - RNA, 22 nt, Human
ugagcagagacgggggccucca

SEQ ID NO: 442821 - RNA, 22 nt, Human
agcauggggcaaugcaugugcu

SEQ ID NO: 442822 - RNA, 22 nt, Human
ggcaaaaaccacaauuacuuuu

SEQ ID NO: 442823 - RNA, 22 nt, Human
uuguauuugauugucauaucgu

SEQ ID NO: 442824 - RNA, 22 nt, Human
cauggcagcuuugggaggagga

SEQ ID NO: 442825 - RNA, 22 nt, Human
aauucaaucuguagauugugau

SEQ ID NO: 442826 - RNA, 22 nt, Human
gcuguuucuccaggucaggaag

SEQ ID NO: 442827 - RNA, 20 nt, Human
agucacauugagcuuuugga

SEQ ID NO: 442828 - RNA, 18 nt, Human
gcagagugcgucucugug

SEQ ID NO: 442829 - RNA, 21 nt, Human
gggccuggcugcgcaggacgg

SEQ ID NO: 442830 - RNA, 22 nt, Human
ggcccugggcagaggagugggc

SEQ ID NO: 442831 - RNA, 22 nt, Human
uccaggcccacucagcugaaau

SEQ ID NO: 442832 - RNA, 22 nt, Human
gcccacagguccuaccucuuuc

SEQ ID NO: 442833 - RNA, 22 nt, Human
caggccuggggcuggcuuccag

SEQ ID NO: 442834 - RNA, 22 nt, Human
cugaggcuuggaggggucuggu

SEQ ID NO: 442835 - RNA, 22 nt, Human
cuuauucagaaggagaaaugga

SEQ ID NO: 442836 - RNA, 23 nt, Human
agcacaaaguguuuuccuuguag

SEQ ID NO: 442837 - RNA, 22 nt, Human
aaguuaaggcacaugcuuugga

SEQ ID NO: 442838 - RNA, 22 nt, Human
cuuugcagagggggugggagcu

SEQ ID NO: 442839 - RNA, 22 nt, Human
guggccagaggucccauguguc

SEQ ID NO: 442840 - RNA, 19 nt, Human
agcuccuguucagcagcuc

SEQ ID NO: 442841 - RNA, 22 nt, Human
ccaggagacccagggaaggagc

SEQ ID NO: 442842 - RNA, 22 nt, Human
auuucaagggguccuugcuugg

SEQ ID NO: 442843 - RNA, 22 nt, Human
cuggucccauccuggcuucaug

SEQ ID NO: 442844 - RNA, 22 nt, Human
ugaugagggagauuugagccca

SEQ ID NO: 442845 - RNA, 22 nt, Human
uucuuaagcguaugauaaugaa

SEQ ID NO: 442846 - RNA, 22 nt, Human
cugagcugggaguagagacucu

SEQ ID NO: 442847 - RNA, 22 nt, Human
uagcaauagaaacauauaaagu

SEQ ID NO: 442848 - RNA, 22 nt, Human
ucagcugcucuguugagcugaa

SEQ ID NO: 442849 - RNA, 22 nt, Human
cuggggucagggaucagagagc

SEQ ID NO: 442850 - RNA, 23 nt, Human
aacacaaagcugauuccaguggc

SEQ ID NO: 442851 - RNA, 22 nt, Human
gucuccuggcugcagcuaagac

SEQ ID NO: 442852 - RNA, 22 nt, Human
cagagcccauccuauacucucc

SEQ ID NO: 442853 - RNA, 19 nt, Human
agaggcugucaccuguagc

SEQ ID NO: 442854 - RNA, 22 nt, Human
ugagcccagagcccuuguaggg

SEQ ID NO: 442855 - RNA, 22 nt, Human
aggggcugggacagagccaagc

SEQ ID NO: 442856 - RNA, 20 nt, Human
ccucucugaagaggucaucu

SEQ ID NO: 442857 - RNA, 22 nt, Human
ccagcagagucuaggaaggagg

SEQ ID NO: 442858 - RNA, 22 nt, Human
uaauuuuuccacguacacuggg

SEQ ID NO: 442859 - RNA, 22 nt, Human
gggacacagguaucucaaauga

SEQ ID NO: 442860 - RNA, 22 nt, Human
agcugguggagaagcagaccuc

SEQ ID NO: 442861 - RNA, 22 nt, Human
auguacaaaauguuuugaaaug

SEQ ID NO: 442862 - RNA, 22 nt, Human
agagaaggcauagaacuugagu

SEQ ID NO: 442863 - RNA, 22 nt, Human
cgcagcagccccgugguaggug

SEQ ID NO: 442864 - RNA, 22 nt, Human
ugagacagcagauuagcaauga

SEQ ID NO: 442865 - RNA, 22 nt, Human
aggucagcugugugugcaugag

SEQ ID NO: 442866 - RNA, 22 nt, Human
uuccagcccgcgacuuguucag

SEQ ID NO: 442867 - RNA, 21 nt, Human
gcugcagggcccagggcaccc

SEQ ID NO: 442868 - RNA, 22 nt, Human
cagcugcccaagccccagaugu

SEQ ID NO: 442869 - RNA, 22 nt, Human
gcaaauucaacagcacauucuc

SEQ ID NO: 442870 - RNA, 22 nt, Human
agccacagggggugagggacaa

SEQ ID NO: 442871 - RNA, 22 nt, Human
uacaugaagaugaauguauggc

SEQ ID NO: 442872 - RNA, 22 nt, Human
gcaggcagaucaccugucagga

SEQ ID NO: 442873 - RNA, 22 nt, Human
cagaggaaggcucugggaaugu

SEQ ID NO: 442874 - RNA, 22 nt, Human
aaggcugguuccaucccuggug

SEQ ID NO: 442875 - RNA, 22 nt, Human
acuguguguuugucuagcacag

SEQ ID NO: 442876 - RNA, 20 nt, Human
ucucccaggcucagggaaga

SEQ ID NO: 442877 - RNA, 21 nt, Human
ccucaaagaugaugggguuuc

SEQ ID NO: 442878 - RNA, 22 nt, Human
aagcucugggguacacaucugc

SEQ ID NO: 442879 - RNA, 22 nt, Human
accugccucuaagcagcaggug

SEQ ID NO: 442880 - RNA, 22 nt, Human
ccacaguacaggaaaucuuguu

SEQ ID NO: 442881 - RNA, 22 nt, Human
uuuguugggagaaacauuauuu

SEQ ID NO: 442882 - RNA, 22 nt, Human
caggccucaccagcggagcugc

SEQ ID NO: 442883 - RNA, 22 nt, Human
gcagagcagagccugcauuggc

SEQ ID NO: 442884 - RNA, 22 nt, Human
aggaacagaagagcaaugcagg

SEQ ID NO: 442885 - RNA, 22 nt, Human
acacaagaaguuaaugggcaaa

SEQ ID NO: 442886 - RNA, 22 nt, Human
gcuggcccagggucaccuagga

SEQ ID NO: 442887 - RNA, 22 nt, Human
uuccucuguaugcuuugcugcu

SEQ ID NO: 442888 - RNA, 22 nt, Human
cacuggugacuucugagcugga

SEQ ID NO: 442889 - RNA, 22 nt, Human
aggcaagcauugggaacagggc

SEQ ID NO: 442890 - RNA, 22 nt, Human
gcagggcuguucaggagggugg

SEQ ID NO: 442891 - RNA, 22 nt, Human
aaguccuggauauuaaauugau

SEQ ID NO: 442892 - RNA, 22 nt, Human
ucccuggguuaccuuucaaggu

SEQ ID NO: 442893 - RNA, 22 nt, Human
ucaggaagggugguccacaggg

SEQ ID NO: 442894 - RNA, 22 nt, Human
ugcauauuuuauaaagauggaa

SEQ ID NO: 442895 - RNA, 22 nt, Human
uuagcuuuuaagugugcuacau

SEQ ID NO: 442896 - RNA, 22 nt, Human
augauauuugcaaugugcuugc

SEQ ID NO: 442897 - RNA, 22 nt, Human
cagcuguuaccaaucuuagggc

SEQ ID NO: 442898 - RNA, 19 nt, Human
aacaccagagucaggaguc

SEQ ID NO: 442899 - RNA, 22 nt, Human
ucacaauggcauaguauaaaau

SEQ ID NO: 442900 - RNA, 22 nt, Human
auucacuggcagacagaacuca

SEQ ID NO: 442901 - RNA, 22 nt, Human
cauguacagccaggguugagaa

SEQ ID NO: 442902 - RNA, 22 nt, Human
aguacuuugcacuuugcucaga

SEQ ID NO: 442903 - RNA, 22 nt, Human
agagaugucgccuugcccaggg

SEQ ID NO: 442904 - RNA, 22 nt, Human
ccuuagcaacacuuagcaacug

SEQ ID NO: 442905 - RNA, 22 nt, Human
ugcauuauacuuuuagaaauuu

SEQ ID NO: 442906 - RNA, 21 nt, Human
ccugggagaauuggguguggc

SEQ ID NO: 442907 - RNA, 22 nt, Human
ggccuuggggaggauggugucc

SEQ ID NO: 442908 - RNA, 22 nt, Human
gugagcaggauuucauggugua

SEQ ID NO: 442909 - RNA, 22 nt, Human
cauuucaagcauugacuucuau

SEQ ID NO: 442910 - RNA, 22 nt, Human
gacagcaguccuggaguuccca

SEQ ID NO: 442911 - RNA, 20 nt, Human
uacagaaacaggacuuuugg

SEQ ID NO: 442912 - RNA, 22 nt, Human
gccuggucucuuucaugucagu

SEQ ID NO: 442913 - RNA, 22 nt, Human
ggccugucucacccccgggugc

SEQ ID NO: 442914 - RNA, 22 nt, Human
ggcaccuguguaagaucuggaa

SEQ ID NO: 442915 - RNA, 22 nt, Human
uucugggcaggacuggggaccc

SEQ ID NO: 442916 - RNA, 22 nt, Human
guucaaauugagaugguauaaa

SEQ ID NO: 442917 - RNA, 22 nt, Human
acagcagcuuccugacuguacu

SEQ ID NO: 442918 - RNA, 19 nt, Human
gguuccucacgcuaagggc

SEQ ID NO: 442919 - RNA, 22 nt, Human
uauacaauggcugaaucaucca

SEQ ID NO: 442920 - RNA, 22 nt, Human
agaggcuguuacacucccagau

SEQ ID NO: 442921 - RNA, 22 nt, Human
agaggccaccuucucuugagaa

SEQ ID NO: 442922 - RNA, 22 nt, Human
acagagguaggacaugagauau

SEQ ID NO: 442923 - RNA, 22 nt, Human
acaggaagaaagugcaguagau

SEQ ID NO: 442924 - RNA, 22 nt, Human
auucucuggcuaaaaccugaag

SEQ ID NO: 442925 - RNA, 22 nt, Human
ucuuauacagaagauguuuaau

SEQ ID NO: 442926 - RNA, 22 nt, Human
ucucugggaauucacaagcccu

SEQ ID NO: 442927 - RNA, 22 nt, Human
gcacaauaauucuuguuuugcu

SEQ ID NO: 442928 - RNA, 22 nt, Human
cuaggaaagacacagagaguuu

SEQ ID NO: 442929 - RNA, 21 nt, Human
acagaugggaugagcacacug

SEQ ID NO: 442930 - RNA, 22 nt, Human
cugcagcugggccagggccacc

SEQ ID NO: 442931 - RNA, 21 nt, Human
uagcaaauggagaguaagaga

SEQ ID NO: 442932 - RNA, 22 nt, Human
agcuccuggggguuccaagcag

SEQ ID NO: 442933 - RNA, 22 nt, Human
uguaucuuagugugaaaauauu

SEQ ID NO: 442934 - RNA, 22 nt, Human
uuccccaggcuggagugcagug

SEQ ID NO: 442935 - RNA, 22 nt, Human
gccgagcacagugcagcugccu

SEQ ID NO: 442936 - RNA, 22 nt, Human
agcuccuggcuuuccucucacc

SEQ ID NO: 442937 - RNA, 22 nt, Human
gacauucagguguucaaugcca

SEQ ID NO: 442938 - RNA, 22 nt, Human
agaggcugggaaggguccccgg

SEQ ID NO: 442939 - RNA, 15 nt, Human
gcuaaggcauuggua

SEQ ID NO: 442940 - RNA, 22 nt, Human
ccaggcuggaguguagucgcau

SEQ ID NO: 442941 - RNA, 22 nt, Human
gggccuggcaugcagccccguu

SEQ ID NO: 442942 - RNA, 22 nt, Human
gccuugggauucuuggaugcuc

SEQ ID NO: 442943 - RNA, 22 nt, Human
guggccaggacauugccaggca

SEQ ID NO: 442944 - RNA, 18 nt, Human
ucaggcuggaaguuugcc

SEQ ID NO: 442945 - RNA, 22 nt, Human
ucagcuggauguggaagugcua

SEQ ID NO: 442946 - RNA, 21 nt, Human
uuguuucccagagcucgcucc

SEQ ID NO: 442947 - RNA, 22 nt, Human
ugccaccuaguggucuuuaguc

SEQ ID NO: 442948 - RNA, 22 nt, Human
uugcagcuggugguggccgugu

SEQ ID NO: 442949 - RNA, 22 nt, Human
uggccuguggcuuaaggucugu

SEQ ID NO: 442950 - RNA, 22 nt, Human
ccaggcuguaagagugauguug

SEQ ID NO: 442951 - RNA, 22 nt, Human
cugaggcucaagggcagguggg

SEQ ID NO: 442952 - RNA, 22 nt, Human
gugcagugacccuggagagcug

SEQ ID NO: 442953 - RNA, 22 nt, Human
agacugguuuuuaacuucaccu

SEQ ID NO: 442954 - RNA, 22 nt, Human
guguguguacucuguauauaaa

SEQ ID NO: 442955 - RNA, 17 nt, Human
cccugccaccaggaagc

SEQ ID NO: 442956 - RNA, 18 nt, Human
ccugaagccugugucuuu

SEQ ID NO: 442957 - RNA, 22 nt, Human
cuuagcuagaggcaauuauguu

SEQ ID NO: 442958 - RNA, 22 nt, Human
augcccugaggaaugucacgcu

SEQ ID NO: 442959 - RNA, 22 nt, Human
ucagaggaccuuacugagaacc

SEQ ID NO: 442960 - RNA, 22 nt, Human
ggcucaggcuggagugcagugg

SEQ ID NO: 442961 - RNA, 22 nt, Human
uuccuuccagcuugugacaguc

SEQ ID NO: 442962 - RNA, 22 nt, Human
ccugggagccaagccucugugu

SEQ ID NO: 442963 - RNA, 22 nt, Human
gcaagcaaaaugggagauuccc

SEQ ID NO: 442964 - RNA, 22 nt, Human
gcccuccuuugcuucuccuagu

SEQ ID NO: 442965 - RNA, 20 nt, Human
ccagcauguacacaugugga

SEQ ID NO: 442966 - RNA, 22 nt, Human
gcugagagaucaaggcaggauu

SEQ ID NO: 442967 - RNA, 22 nt, Human
uugugugucuucuucacugccc

SEQ ID NO: 442968 - RNA, 21 nt, Human
aguuuucugaguuauaaaaua

SEQ ID NO: 442969 - RNA, 21 nt, Human
cacuccacuuagaacaggguu

SEQ ID NO: 442970 - RNA, 22 nt, Human
auuuaaaugcuuaagaggguuu

SEQ ID NO: 442971 - RNA, 22 nt, Human
auggacagugugaagcagauag

SEQ ID NO: 442972 - RNA, 22 nt, Human
auaaucugagcuauuucaugag

SEQ ID NO: 442973 - RNA, 22 nt, Human
agauuuauguggucacacucag

SEQ ID NO: 442974 - RNA, 22 nt, Human
gccacagggcgagcggaggcca

SEQ ID NO: 442975 - RNA, 22 nt, Human
auugcaaaugguuuggucaucu

SEQ ID NO: 442976 - RNA, 23 nt, Human
ucaugcagccuggaaccucccag

SEQ ID NO: 442977 - RNA, 22 nt, Human
cagcugggagcuccauuagaua

SEQ ID NO: 442978 - RNA, 22 nt, Human
ucuggcagugagcaacuugaca

SEQ ID NO: 442979 - RNA, 22 nt, Human
gacacaaaguuugucagaaauu

SEQ ID NO: 442980 - RNA, 22 nt, Human
cugaggcaggauggccuggcug

SEQ ID NO: 442981 - RNA, 22 nt, Human
cagcccugcugguuuugggcaa

SEQ ID NO: 442982 - RNA, 22 nt, Human
ccuuugcauuauccuugauuga

SEQ ID NO: 442983 - RNA, 22 nt, Human
aaaguuugaaugauauauuagu

SEQ ID NO: 442984 - RNA, 19 nt, Human
ugagaaggcaguggggagc

SEQ ID NO: 442985 - RNA, 20 nt, Human
gccuggaggcaaugggaaga

SEQ ID NO: 442986 - RNA, 22 nt, Human
ggcuagggaaaaugauuggaua

SEQ ID NO: 442987 - RNA, 22 nt, Human
aggcucugugaugugccaggca

SEQ ID NO: 442988 - RNA, 22 nt, Human
aagcccugccacccauucacug

SEQ ID NO: 442989 - RNA, 22 nt, Human
aggugccagaugcacagcugaa

SEQ ID NO: 442990 - RNA, 20 nt, Human
cccuccagcaaccaggacuu

SEQ ID NO: 442991 - RNA, 22 nt, Human
ggaaacagcucuuuggggcugu

SEQ ID NO: 442992 - RNA, 22 nt, Human
ucuuuauuuaagucuguuguaa

SEQ ID NO: 442993 - RNA, 22 nt, Human
uuaauuaagagauacugcagua

SEQ ID NO: 442994 - RNA, 22 nt, Human
auuuuacauaaggaagguuuaa

SEQ ID NO: 442995 - RNA, 22 nt, Human
ggacacagauaaucacacagau

SEQ ID NO: 442996 - RNA, 22 nt, Human
cagcuggcaaguggagcagggu

SEQ ID NO: 442997 - RNA, 22 nt, Human
uuguguccugauuugacacaau

SEQ ID NO: 442998 - RNA, 22 nt, Human
uaaggcagaaauaugagcaggg

SEQ ID NO: 442999 - RNA, 19 nt, Human
gccaggaaagaaucaggcg

SEQ ID NO: 443000 - RNA, 22 nt, Human
cuggagccacugggucuuguau

SEQ ID NO: 443001 - RNA, 22 nt, Human
gcugagguggagauugcaguga

SEQ ID NO: 443002 - RNA, 22 nt, Human
gaguccugauccuuagcucucc

SEQ ID NO: 443003 - RNA, 22 nt, Human
ggccuuggugcucuguguugca

SEQ ID NO: 443004 - RNA, 22 nt, Human
acaaauauuuacugaauccacu

SEQ ID NO: 443005 - RNA, 22 nt, Human
agcuagagcugagaagcacuug

SEQ ID NO: 443006 - RNA, 22 nt, Human
gggcuccuggcagucaugcuca

SEQ ID NO: 443007 - RNA, 22 nt, Human
gcugcccauuccacuggauggu

SEQ ID NO: 443008 - RNA, 22 nt, Human
aggcuguggcccuggucuagca

SEQ ID NO: 443009 - RNA, 22 nt, Human
agcugccacugagggugcacag

SEQ ID NO: 443010 - RNA, 22 nt, Human
ucacagagcacguaucaugccu

SEQ ID NO: 443011 - RNA, 23 nt, Human
ugcuggagacaagugugagaagg

SEQ ID NO: 443012 - RNA, 22 nt, Human
uucuggaacauagcaagaaguu

SEQ ID NO: 443013 - RNA, 22 nt, Human
gcugucucauacaaggcccugc

SEQ ID NO: 443014 - RNA, 22 nt, Human
ugaagcuagaauguccauauuu

SEQ ID NO: 443015 - RNA, 22 nt, Human
uugauuaaacaggcauauucaa

SEQ ID NO: 443016 - RNA, 22 nt, Human
gccagugccucgccgcgcuccu

SEQ ID NO: 443017 - RNA, 22 nt, Human
cagugucucaguuucacuugaa

SEQ ID NO: 443018 - RNA, 22 nt, Human
ugauuauauuaacuauguuccu

SEQ ID NO: 443019 - RNA, 19 nt, Human
cagaggccagaagcacagg

SEQ ID NO: 443020 - RNA, 22 nt, Human
aguggacccggaacagaggccc

SEQ ID NO: 443021 - RNA, 22 nt, Human
agcaggaccaagaaggggaaaa

SEQ ID NO: 443022 - RNA, 22 nt, Human
uuguacaaaggauuuggaagag

SEQ ID NO: 443023 - RNA, 22 nt, Human
gcagucagguuaaggccuuccc

SEQ ID NO: 443024 - RNA, 22 nt, Human
ucccucagagggcaagcgcaga

SEQ ID NO: 443025 - RNA, 22 nt, Human
ccaaauucuguguucaaacuca

SEQ ID NO: 443026 - RNA, 22 nt, Human
gguggccucgguggugcacagg

SEQ ID NO: 443027 - RNA, 22 nt, Human
ugcugccacugguagucucauu

SEQ ID NO: 443028 - RNA, 22 nt, Human
gagaaggcuucuuuuccucuga

SEQ ID NO: 443029 - RNA, 22 nt, Human
aagagcuggaagugaagauaac

SEQ ID NO: 443030 - RNA, 22 nt, Human
cagacaugagauacagcugcua

SEQ ID NO: 443031 - RNA, 19 nt, Human
agcuccugggcucugggcc

SEQ ID NO: 443032 - RNA, 22 nt, Human
uaucauuuguuauuauuagugg

SEQ ID NO: 443033 - RNA, 22 nt, Human
gagucccaugaugauagccaca

SEQ ID NO: 443034 - RNA, 23 nt, Human
uccggcaacuucacuccucccgc

SEQ ID NO: 443035 - RNA, 22 nt, Human
gaggcagcugaagcuucaaaga

SEQ ID NO: 443036 - RNA, 22 nt, Human
aggcugaggcagguggaucacc

SEQ ID NO: 443037 - RNA, 22 nt, Human
aguuucaguguugacagauggu

SEQ ID NO: 443038 - RNA, 22 nt, Human
uccuggaggagauccaaucuga

SEQ ID NO: 443039 - RNA, 19 nt, Human
agcauuuggaauucuacac

SEQ ID NO: 443040 - RNA, 22 nt, Human
gggcacaggaauuugggaugug

SEQ ID NO: 443041 - RNA, 22 nt, Human
aucuucuacuuugccaaucagg

SEQ ID NO: 443042 - RNA, 22 nt, Human
gcagagccugugucugagcaaa

SEQ ID NO: 443043 - RNA, 21 nt, Human
uccucagggccccagagcacu

SEQ ID NO: 443044 - RNA, 22 nt, Human
aaggcaauugcaguuuuugcca

SEQ ID NO: 443045 - RNA, 22 nt, Human
gaccacuggcgcugcgagaccc

SEQ ID NO: 443046 - RNA, 22 nt, Human
cuggcagguggagguugcagug

SEQ ID NO: 443047 - RNA, 22 nt, Human
gggcagguggagggcccagcca

SEQ ID NO: 443048 - RNA, 22 nt, Human
gugucacaagagcccaggaaac

SEQ ID NO: 443049 - RNA, 19 nt, Human
ggagaggcuggagggaugc

SEQ ID NO: 443050 - RNA, 22 nt, Human
gagggcugcaaugagacagaga

SEQ ID NO: 443051 - RNA, 22 nt, Human
gcaccugggacccagaggcacc

SEQ ID NO: 443052 - RNA, 22 nt, Human
cugcacaguggacagugaagau

SEQ ID NO: 443053 - RNA, 22 nt, Human
cuuuuguuaggagaaaacauca

SEQ ID NO: 443054 - RNA, 22 nt, Human
uucagcaccuggaauagcaccu

SEQ ID NO: 443055 - RNA, 22 nt, Human
acaaaaguguaggaauuccuua

SEQ ID NO: 443056 - RNA, 22 nt, Human
ucaggcaggcucagaggaaaac

SEQ ID NO: 443057 - RNA, 22 nt, Human
aagcauucugcauuuucaaaga

SEQ ID NO: 443058 - RNA, 22 nt, Human
agcagacaacccagaugaccca

SEQ ID NO: 443059 - RNA, 19 nt, Human
cuccuucccugguuucugu

SEQ ID NO: 443060 - RNA, 22 nt, Human
uucagagguaagggucucagaa

SEQ ID NO: 443061 - RNA, 22 nt, Human
aagcaggcaugggaggccaucc

SEQ ID NO: 443062 - RNA, 22 nt, Human
cccaggcagugcugaucccuca

SEQ ID NO: 443063 - RNA, 22 nt, Human
ucagaggagccaaaguucugag

SEQ ID NO: 443064 - RNA, 22 nt, Human
ugcugccagccaggccauggag

SEQ ID NO: 443065 - RNA, 22 nt, Human
agcaggcuuaugguugaaggga

SEQ ID NO: 443066 - RNA, 18 nt, Human
gaugggagcaagagaaga

SEQ ID NO: 443067 - RNA, 22 nt, Human
uggaauaugcaauugcauuuca

SEQ ID NO: 443068 - RNA, 22 nt, Human
acaggcagguccugucccagcu

SEQ ID NO: 443069 - RNA, 22 nt, Human
agcacuguggggaacucacaga

SEQ ID NO: 443070 - RNA, 22 nt, Human
cagcugccuaugaccuagccuc

SEQ ID NO: 443071 - RNA, 22 nt, Human
agcagcuggaacauaugaagaa

SEQ ID NO: 443072 - RNA, 22 nt, Human
uucuguuagaauuuugaaaaua

SEQ ID NO: 443073 - RNA, 22 nt, Human
uggcucagcgguggcagcagac

SEQ ID NO: 443074 - RNA, 22 nt, Human
uugcuuuaaugagauuuugcca

SEQ ID NO: 443075 - RNA, 22 nt, Human
uucaaacuguguaauuuauaaa

SEQ ID NO: 443076 - RNA, 22 nt, Human
aacacuuuccugccuuucugau

SEQ ID NO: 443077 - RNA, 22 nt, Human
uauuuuggcugauucaucaugu

SEQ ID NO: 443078 - RNA, 22 nt, Human
agccagaggucaugagcacagg

SEQ ID NO: 443079 - RNA, 18 nt, Human
uggcuccugccuccugca

SEQ ID NO: 443080 - RNA, 22 nt, Human
gcuuccagacgaucauguaaga

SEQ ID NO: 443081 - RNA, 22 nt, Human
gugcugagugcagagugcagag

SEQ ID NO: 443082 - RNA, 22 nt, Human
auugcuuuagaaagaaaaauau

SEQ ID NO: 443083 - RNA, 22 nt, Human
gccuggaguggacuuggccccu

SEQ ID NO: 443084 - RNA, 22 nt, Human
caguauaugcucuuucaucaaa

SEQ ID NO: 443085 - RNA, 22 nt, Human
uucagaaugugaccuuauuugg

SEQ ID NO: 443086 - RNA, 22 nt, Human
cugggcacauuuugacuagugu

SEQ ID NO: 443087 - RNA, 22 nt, Human
gcagggugaaggucacauagaa

SEQ ID NO: 443088 - RNA, 22 nt, Human
gugcaaaaguaauggcaguuuu

SEQ ID NO: 443089 - RNA, 22 nt, Human
aaauuucuaagucaagaagaac

SEQ ID NO: 443090 - RNA, 22 nt, Human
uaaggguucagaaugcaguggu

SEQ ID NO: 443091 - RNA, 22 nt, Human
ggagcuggagaguacagaguuu

SEQ ID NO: 443092 - RNA, 22 nt, Human
augcagcaguuuacaaagcaau

SEQ ID NO: 443093 - RNA, 22 nt, Human
uccuucccccucaagagaacuu

SEQ ID NO: 443094 - RNA, 22 nt, Human
gauuuacagguuagguccugua

SEQ ID NO: 443095 - RNA, 22 nt, Human
gcagauggacuguaugaccuga

SEQ ID NO: 443096 - RNA, 22 nt, Human
cucaccacagagccuguccagc

SEQ ID NO: 443097 - RNA, 22 nt, Human
cuuuggcuaacaaaucagcuug

SEQ ID NO: 443098 - RNA, 22 nt, Human
uagcacaaagagucuuucagag

SEQ ID NO: 443099 - RNA, 22 nt, Human
ucugagccaauuucugugucca

SEQ ID NO: 443100 - RNA, 22 nt, Human
cuuucauucuuagauauuagug

SEQ ID NO: 443101 - RNA, 22 nt, Human
ugggccugaguuugggaacugg

SEQ ID NO: 443102 - RNA, 22 nt, Human
ugaauauggcaacucuuguaac

SEQ ID NO: 443103 - RNA, 22 nt, Human
gcaggccuccccugcuggagcu

SEQ ID NO: 443104 - RNA, 22 nt, Human
ccugggucacucaggcaggcgg

SEQ ID NO: 443105 - RNA, 22 nt, Human
cacagcaauagcuaacugauac

SEQ ID NO: 443106 - RNA, 22 nt, Human
auaaauuuucuugcuguacuua

SEQ ID NO: 443107 - RNA, 22 nt, Human
agcuccagaagccugcaaggua

SEQ ID NO: 443108 - RNA, 22 nt, Human
gcagcuguagaggggagaaaga

SEQ ID NO: 443109 - RNA, 22 nt, Human
ccaaacugugucgucugcauag

SEQ ID NO: 443110 - RNA, 22 nt, Human
agaggaugauuuuaaggacacu

SEQ ID NO: 443111 - RNA, 22 nt, Human
ccaggaggcggaagguacagug

SEQ ID NO: 443112 - RNA, 22 nt, Human
uguauuuuuagaccuuuagacc

SEQ ID NO: 443113 - RNA, 22 nt, Human
acaauucaagcaagagagacaa

SEQ ID NO: 443114 - RNA, 22 nt, Human
cuagaucugcccacugaaguuc

SEQ ID NO: 443115 - RNA, 22 nt, Human
cugggcugagccugggcugugu

SEQ ID NO: 443116 - RNA, 22 nt, Human
ucugggugaugaaaugcacugu

SEQ ID NO: 443117 - RNA, 22 nt, Human
uuagaaaugucacagaucugau

SEQ ID NO: 443118 - RNA, 22 nt, Human
uuuauuguuguuagucauaagu

SEQ ID NO: 443119 - RNA, 22 nt, Human
ccaggcugcucacaagcugccc

SEQ ID NO: 443120 - RNA, 22 nt, Human
uugugaaauguuucaaaauagu

SEQ ID NO: 443121 - RNA, 22 nt, Human
ugagacaguaucgccccaaggc

SEQ ID NO: 443122 - RNA, 22 nt, Human
ugagccagccuugcagcugugc

SEQ ID NO: 443123 - RNA, 22 nt, Human
aaguugaaugcguacgugacau

SEQ ID NO: 443124 - RNA, 22 nt, Human
aagcacagauaaaacaggauuc

SEQ ID NO: 443125 - RNA, 22 nt, Human
uguggagcucagaaguagcagu

SEQ ID NO: 443126 - RNA, 22 nt, Human
uagcugccagaccauucuuacu

SEQ ID NO: 443127 - RNA, 22 nt, Human
agcuggugcugaagcucuugag

SEQ ID NO: 443128 - RNA, 22 nt, Human
ggccccaguucacuccuggccg

SEQ ID NO: 443129 - RNA, 22 nt, Human
ucagaagagcuggugcugccug

SEQ ID NO: 443130 - RNA, 18 nt, Human
uaaauugcuucaccugag

SEQ ID NO: 443131 - RNA, 22 nt, Human
uucacauuguuuuaaugugaau

SEQ ID NO: 443132 - RNA, 22 nt, Human
ccaggccuccugugaguggacc

SEQ ID NO: 443133 - RNA, 22 nt, Human
agagcagguggcaacucuggga

SEQ ID NO: 443134 - RNA, 22 nt, Human
guugaauaucguguucuuguuu

SEQ ID NO: 443135 - RNA, 22 nt, Human
cugcauaugagaauaggagaaa

SEQ ID NO: 443136 - RNA, 22 nt, Human
cuggguggcgucuggggccagu

SEQ ID NO: 443137 - RNA, 22 nt, Human
ggagugaaucacuagaugcaga

SEQ ID NO: 443138 - RNA, 22 nt, Human
agggcagcagcggcccaggccu

SEQ ID NO: 443139 - RNA, 21 nt, Human
aggcaggauucaaacacagag

SEQ ID NO: 443140 - RNA, 22 nt, Human
gcuggaggcuggagugcagugg

SEQ ID NO: 443141 - RNA, 22 nt, Human
ccugggugaaaucucuccugca

SEQ ID NO: 443142 - RNA, 22 nt, Human
cagggacagcacuaaacucuug

SEQ ID NO: 443143 - RNA, 22 nt, Human
acaggccucaaauagggugccu

SEQ ID NO: 443144 - RNA, 22 nt, Human
cuuugcaaagucuuuggcaaga

SEQ ID NO: 443145 - RNA, 17 nt, Human
gggcagggacuccuggg

SEQ ID NO: 443146 - RNA, 22 nt, Human
ccucucccgggugccgcugggc

SEQ ID NO: 443147 - RNA, 22 nt, Human
cacuuugcaggguggugggagg

SEQ ID NO: 443148 - RNA, 22 nt, Human
ugugaggccuagacagccuggg

SEQ ID NO: 443149 - RNA, 22 nt, Human
ugcuggagaagcuccugggacu

SEQ ID NO: 443150 - RNA, 22 nt, Human
gacccugccaugagugacaggg

SEQ ID NO: 443151 - RNA, 22 nt, Human
caaagaggugagaggagccuuu

SEQ ID NO: 443152 - RNA, 22 nt, Human
agauuccuaaaguaagauauca

SEQ ID NO: 443153 - RNA, 22 nt, Human
aucagagucagaggcuagagcu

SEQ ID NO: 443154 - RNA, 22 nt, Human
agggaagaaucacugggauguu

SEQ ID NO: 443155 - RNA, 22 nt, Human
acagaauaacucuugcuugagu

SEQ ID NO: 443156 - RNA, 22 nt, Human
agauacaacuguuuaaacauua

SEQ ID NO: 443157 - RNA, 22 nt, Human
caggagaugacagggaagaacc

SEQ ID NO: 443158 - RNA, 22 nt, Human
ggagacagugacuuagagacug

SEQ ID NO: 443159 - RNA, 21 nt, Human
ggcagcugaccgcgcggugca

SEQ ID NO: 443160 - RNA, 22 nt, Human
gcacuuaugcucaccuuguucu

SEQ ID NO: 443161 - RNA, 22 nt, Human
agaauuucaaauggaaguuuua

SEQ ID NO: 443162 - RNA, 22 nt, Human
augcauuugacgggauauauuu

SEQ ID NO: 443163 - RNA, 22 nt, Human
acucacagucccuguaggagug

SEQ ID NO: 443164 - RNA, 22 nt, Human
augagaugugucuaauggaacc

SEQ ID NO: 443165 - RNA, 22 nt, Human
agcacuuaacugacaguacuau

SEQ ID NO: 443166 - RNA, 22 nt, Human
gaggacagagccgccuggcaag

SEQ ID NO: 443167 - RNA, 22 nt, Human
ucuacagacuccuauguaacac

SEQ ID NO: 443168 - RNA, 22 nt, Human
auagcacuuauuguaugcugag

SEQ ID NO: 443169 - RNA, 22 nt, Human
cuggcugguuacuauuucuggu

SEQ ID NO: 443170 - RNA, 22 nt, Human
auggacagcuggccucaaggga

SEQ ID NO: 443171 - RNA, 22 nt, Human
gcuggccugggcagccugucgg

SEQ ID NO: 443172 - RNA, 22 nt, Human
uuauuacacugaaagaauugcg

SEQ ID NO: 443173 - RNA, 22 nt, Human
uuugcaaagaaauuauugcugu

SEQ ID NO: 443174 - RNA, 22 nt, Human
ggacugggucacuaagauagua

SEQ ID NO: 443175 - RNA, 22 nt, Human
ugcagccccugaaaauggcagc

SEQ ID NO: 443176 - RNA, 22 nt, Human
cucugcccgcggaugccacguc

SEQ ID NO: 443177 - RNA, 23 nt, Human
gggcuccagucucugcucaguug

SEQ ID NO: 443178 - RNA, 22 nt, Human
ugauucaauuaucugaugcuuu

SEQ ID NO: 443179 - RNA, 22 nt, Human
cugccucugcgucccacagagu

SEQ ID NO: 443180 - RNA, 22 nt, Human
aagcaggugugagccagugggc

SEQ ID NO: 443181 - RNA, 22 nt, Human
ugcaggcugaggcuggcucaac

SEQ ID NO: 443182 - RNA, 22 nt, Human
aacaugauuggaaaaugcuguc

SEQ ID NO: 443183 - RNA, 22 nt, Human
agaguccauauauugauuuguu

SEQ ID NO: 443184 - RNA, 18 nt, Human
agcaugagagaggcugug

SEQ ID NO: 443185 - RNA, 22 nt, Human
cugccucuauaggaguccacca

SEQ ID NO: 443186 - RNA, 22 nt, Human
ccaggaguuugaggcugcagug

SEQ ID NO: 443187 - RNA, 22 nt, Human
cacaaugcguacauauaucaaa

SEQ ID NO: 443188 - RNA, 22 nt, Human
aauucauacucuauauugcuuu

SEQ ID NO: 443189 - RNA, 22 nt, Human
agccuggaggccaggagacagu

SEQ ID NO: 443190 - RNA, 22 nt, Human
uucagaauauccguuuaaguuu

SEQ ID NO: 443191 - RNA, 22 nt, Human
ggcaaaaaccauaauuacuuuu

SEQ ID NO: 443192 - RNA, 22 nt, Human
agcccuuuccaauuugauuuau

SEQ ID NO: 443193 - RNA, 22 nt, Human
ccagggcaauuauuuggagggu

SEQ ID NO: 443194 - RNA, 22 nt, Human
uccaggcccgagaugggcugga

SEQ ID NO: 443195 - RNA, 22 nt, Human
ccugccuguaagauggguacaa

SEQ ID NO: 443196 - RNA, 22 nt, Human
ugcccuggaaccaucuacaguc

SEQ ID NO: 443197 - RNA, 22 nt, Human
cauuaugugcguacauguaucu

SEQ ID NO: 443198 - RNA, 22 nt, Human
augggaggcagacacuaaguuc

SEQ ID NO: 443199 - RNA, 22 nt, Human
ucuucccccgugcuccagugca

SEQ ID NO: 443200 - RNA, 22 nt, Human
ugccaggcauauggccucuuug

SEQ ID NO: 443201 - RNA, 22 nt, Human
acaaaaagggagaugagguaga

SEQ ID NO: 443202 - RNA, 22 nt, Human
gggccggagcugggucccgcgc

SEQ ID NO: 443203 - RNA, 22 nt, Human
caaaggaggugauaggcccucu

SEQ ID NO: 443204 - RNA, 22 nt, Human
cugggccuagcaacagaggagu

SEQ ID NO: 443205 - RNA, 22 nt, Human
uuauuuaaugugaucugaagag

SEQ ID NO: 443206 - RNA, 22 nt, Human
uucuaaagugcaaucugacaga

SEQ ID NO: 443207 - RNA, 22 nt, Human
agcuggugauguggucccucac

SEQ ID NO: 443208 - RNA, 19 nt, Human
aggcugcaagguggugggc

SEQ ID NO: 443209 - RNA, 22 nt, Human
uggccacagccucugccaguuc

SEQ ID NO: 443210 - RNA, 21 nt, Human
agggaaagaaaaugagcuaau

SEQ ID NO: 443211 - RNA, 22 nt, Human
acauguacauacacauauguaa

SEQ ID NO: 443212 - RNA, 22 nt, Human
ugcaggcugcucaagacuuagu

SEQ ID NO: 443213 - RNA, 22 nt, Human
cugcccugggugcuggggaucc

SEQ ID NO: 443214 - RNA, 22 nt, Human
ucaagacaggguuuaagguuga

SEQ ID NO: 443215 - RNA, 22 nt, Human
gaauacaagccugccaccugga

SEQ ID NO: 443216 - RNA, 22 nt, Human
acuugacuuugucauuugugcu

SEQ ID NO: 443217 - RNA, 22 nt, Human
cagugagggaagaucucagcac

SEQ ID NO: 443218 - RNA, 22 nt, Human
uaauauaccaaacuguaauuuu

SEQ ID NO: 443219 - RNA, 22 nt, Human
gugcacaggugggaaaaugagu

SEQ ID NO: 443220 - RNA, 22 nt, Human
cugguacaaaaugcugauauca

SEQ ID NO: 443221 - RNA, 22 nt, Human
cccagagggcugaggauaugaa

SEQ ID NO: 443222 - RNA, 22 nt, Human
gugaagcagggaaggaaaggau

SEQ ID NO: 443223 - RNA, 21 nt, Human
uuugagaauuggucagagugc

SEQ ID NO: 443224 - RNA, 20 nt, Human
gcagcagugcaaguccucuu

SEQ ID NO: 443225 - RNA, 22 nt, Human
uuucaaauagaaucuuuccaaa

SEQ ID NO: 443226 - RNA, 22 nt, Human
ggcugccauaacugauaccaua

SEQ ID NO: 443227 - RNA, 22 nt, Human
auaugcuuugggauuagaucau

SEQ ID NO: 443228 - RNA, 22 nt, Human
uggcagcucauuuggaaaugga

SEQ ID NO: 443229 - RNA, 22 nt, Human
ugccucuguggaaauggugguc

SEQ ID NO: 443230 - RNA, 22 nt, Human
uuugggcaauucagugggaccu

SEQ ID NO: 443231 - RNA, 22 nt, Human
acagugcuaaugaugccaagau

SEQ ID NO: 443232 - RNA, 22 nt, Human
aggaagaguguuaccuaugggu

SEQ ID NO: 443233 - RNA, 22 nt, Human
uugcugauucaugauuugagaa

SEQ ID NO: 443234 - RNA, 22 nt, Human
cauggccucaaaggacugcaga

SEQ ID NO: 443235 - RNA, 22 nt, Human
cuugaugauagcaggcagggaa

SEQ ID NO: 443236 - RNA, 22 nt, Human
augcauucauucauucuuucua

SEQ ID NO: 443237 - RNA, 22 nt, Human
acauagaacuucgaugucuuuu

SEQ ID NO: 443238 - RNA, 22 nt, Human
acauucuaacauuguacagaua

SEQ ID NO: 443239 - RNA, 23 nt, Human
uugaaaaauauagucccauuguc

SEQ ID NO: 443240 - RNA, 22 nt, Human
ccagcuggaagagugcagaacu

SEQ ID NO: 443241 - RNA, 22 nt, Human
ugugcacaaugugcagguuugu

SEQ ID NO: 443242 - RNA, 22 nt, Human
gcagugggagcuuaggcagugc

SEQ ID NO: 443243 - RNA, 22 nt, Human
gaugcugaagugaagugaucuu

SEQ ID NO: 443244 - RNA, 22 nt, Human
cuggagcccugaaugggcagga

SEQ ID NO: 443245 - RNA, 22 nt, Human
gcucagagggaacaaggggcug

SEQ ID NO: 443246 - RNA, 22 nt, Human
gccuggagcagacgugucccgg

SEQ ID NO: 443247 - RNA, 22 nt, Human
cacuugguuugggaguacauaa

SEQ ID NO: 443248 - RNA, 22 nt, Human
augcauaugcaucuguguacau

SEQ ID NO: 443249 - RNA, 22 nt, Human
ggcaggcaggagcgugcuuggg

SEQ ID NO: 443250 - RNA, 21 nt, Human
accuucugaauuaccuaccaa

SEQ ID NO: 443251 - RNA, 22 nt, Human
uucuaaagacucauggaagugg

SEQ ID NO: 443252 - RNA, 22 nt, Human
ugaggcaggaguuaaugugcuc

SEQ ID NO: 443253 - RNA, 22 nt, Human
gcagaggugugggaggggccac

SEQ ID NO: 443254 - RNA, 20 nt, Human
ugucagugccugaggcacag

SEQ ID NO: 443255 - RNA, 22 nt, Human
augcauauugucauuuaguccu

SEQ ID NO: 443256 - RNA, 19 nt, Human
ucugagggagcacgaaggc

SEQ ID NO: 443257 - RNA, 19 nt, Human
cugacccaggacaccacgg

SEQ ID NO: 443258 - RNA, 22 nt, Human
augcagcucauuuguuuaaaag

SEQ ID NO: 443259 - RNA, 22 nt, Human
agcucaagugcaagcauucuau

SEQ ID NO: 443260 - RNA, 22 nt, Human
acagggcagcaacuuugugccu

SEQ ID NO: 443261 - RNA, 23 nt, Human
uguuuguuucuaugagagauagc

SEQ ID NO: 443262 - RNA, 22 nt, Human
ggcagcugucucugaguuagca

SEQ ID NO: 443263 - RNA, 22 nt, Human
cagcccuguccagcagagggug

SEQ ID NO: 443264 - RNA, 22 nt, Human
aggaugagaagauuggaaucuu

SEQ ID NO: 443265 - RNA, 22 nt, Human
cuggggcuggugaggcaggcuc

SEQ ID NO: 443266 - RNA, 22 nt, Human
cagagagaggccacugcuauua

SEQ ID NO: 443267 - RNA, 22 nt, Human
ggccucugccccagccacaccu

SEQ ID NO: 443268 - RNA, 22 nt, Human
ggagguucugauuugucacaac

SEQ ID NO: 443269 - RNA, 22 nt, Human
ggcucuggugugaagcagccuc

SEQ ID NO: 443270 - RNA, 22 nt, Human
caggcugggcuccggagauaaa

SEQ ID NO: 443271 - RNA, 22 nt, Human
gaggcugguucccuugaucuuu

SEQ ID NO: 443272 - RNA, 22 nt, Human
uugcaaaucacaagagcagagc

SEQ ID NO: 443273 - RNA, 22 nt, Human
cauacuuucuuuuucacgcaua

SEQ ID NO: 443274 - RNA, 22 nt, Human
ucuauauuccagauacagauua

SEQ ID NO: 443275 - RNA, 22 nt, Human
agacaggccacucuggucuggu

SEQ ID NO: 443276 - RNA, 22 nt, Human
agcaggcagccuaggaagugaa

SEQ ID NO: 443277 - RNA, 22 nt, Human
ugaugagguggauucaaagcag

SEQ ID NO: 443278 - RNA, 22 nt, Human
uugggcagggaaaggacaggca

SEQ ID NO: 443279 - RNA, 22 nt, Human
aacugcauuagcuaacgugagu

SEQ ID NO: 443280 - RNA, 22 nt, Human
ccaccccaaaugaagaccucuc

SEQ ID NO: 443281 - RNA, 22 nt, Human
cuggagaacuaguuaaacacgu

SEQ ID NO: 443282 - RNA, 22 nt, Human
uuuagcaaguauuuacugacua

SEQ ID NO: 443283 - RNA, 19 nt, Human
uuuacaaguucuuuguaug

SEQ ID NO: 443284 - RNA, 22 nt, Human
guaacauuauucaugagauaca

SEQ ID NO: 443285 - RNA, 22 nt, Human
aagauauucaaagauuuauuag

SEQ ID NO: 443286 - RNA, 22 nt, Human
gagccuggauagccuuguucca

SEQ ID NO: 443287 - RNA, 22 nt, Human
agucaguugcaaacaucaggca

SEQ ID NO: 443288 - RNA, 22 nt, Human
gcugucacacauggccccagcu

SEQ ID NO: 443289 - RNA, 22 nt, Human
agucccagaugacccagcuacu

SEQ ID NO: 443290 - RNA, 22 nt, Human
augcaguuuucaaagacuauuc

SEQ ID NO: 443291 - RNA, 22 nt, Human
caaggccugacugcuugucuaa

SEQ ID NO: 443292 - RNA, 22 nt, Human
uggaggacaggacuggacagcc

SEQ ID NO: 443293 - RNA, 21 nt, Human
ucagcagcaucugccuagagu

SEQ ID NO: 443294 - RNA, 22 nt, Human
gcaggacauucagugaaugggc

SEQ ID NO: 443295 - RNA, 20 nt, Human
uccaggcagacagcuauggg

SEQ ID NO: 443296 - RNA, 22 nt, Human
aaagcacaugaguaguguagua

SEQ ID NO: 443297 - RNA, 22 nt, Human
cauggcagggcugugggcaggu

SEQ ID NO: 443298 - RNA, 22 nt, Human
ucaggaaggcgccccaucagga

SEQ ID NO: 443299 - RNA, 22 nt, Human
accugagcaugccaggagagug

SEQ ID NO: 443300 - RNA, 22 nt, Human
uccugaagccugagugaugacu

SEQ ID NO: 443301 - RNA, 22 nt, Human
agaacagcaacaucagacaaag

SEQ ID NO: 443302 - RNA, 22 nt, Human
acagugucaugucguguucccc

SEQ ID NO: 443303 - RNA, 22 nt, Human
uguggaggauucugaugccagc

SEQ ID NO: 443304 - RNA, 22 nt, Human
uagcugguuaaugcagaaggag

SEQ ID NO: 443305 - RNA, 22 nt, Human
aagcuccccgaaacccaccucu

SEQ ID NO: 443306 - RNA, 22 nt, Human
uggccugguccuugucaaggca

SEQ ID NO: 443307 - RNA, 22 nt, Human
aaggcacucauucaaggagaua

SEQ ID NO: 443308 - RNA, 22 nt, Human
ucagaauuaagcucuuggucag

SEQ ID NO: 443309 - RNA, 22 nt, Human
uccuggagaauccugccaccug

SEQ ID NO: 443310 - RNA, 22 nt, Human
ggccucugccucaucugggcac

SEQ ID NO: 443311 - RNA, 22 nt, Human
gcugcaggcucugcaggaauug

SEQ ID NO: 443312 - RNA, 22 nt, Human
ucugaggcccugcaggcagugu

SEQ ID NO: 443313 - RNA, 22 nt, Human
cagcugccugcaacacaagcuu

SEQ ID NO: 443314 - RNA, 22 nt, Human
uuguguguguaacuuuaugaga

SEQ ID NO: 443315 - RNA, 22 nt, Human
cugagcugcggcaggcaccugg

SEQ ID NO: 443316 - RNA, 22 nt, Human
gggugggccacugagcagcgug

SEQ ID NO: 443317 - RNA, 22 nt, Human
ccccacccucgcuccauuucgg

SEQ ID NO: 443318 - RNA, 20 nt, Human
aggaaaaauggaaacuggag

SEQ ID NO: 443319 - RNA, 22 nt, Human
uauuacaguucgaguuucuagg

SEQ ID NO: 443320 - RNA, 22 nt, Human
gcacaauggaccgugugcucug

SEQ ID NO: 443321 - RNA, 22 nt, Human
auggcuuuccugggacaugggc

SEQ ID NO: 443322 - RNA, 22 nt, Human
auuacagauagacuuugaagcu

SEQ ID NO: 443323 - RNA, 22 nt, Human
gugcaugugucuuuauaguagc

SEQ ID NO: 443324 - RNA, 22 nt, Human
ugagccuggggccugggcagcg

SEQ ID NO: 443325 - RNA, 19 nt, Human
gcagcagcauuugguaaua

SEQ ID NO: 443326 - RNA, 22 nt, Human
aaggcaauugagaagaaacaga

SEQ ID NO: 443327 - RNA, 22 nt, Human
agccagagacugugucuguaau

SEQ ID NO: 443328 - RNA, 23 nt, Human
ugagaagccauuagagcaggugg

SEQ ID NO: 443329 - RNA, 22 nt, Human
aaagacauugaagaaggacuua

SEQ ID NO: 443330 - RNA, 22 nt, Human
uggcucucagcucccagcagcc

SEQ ID NO: 443331 - RNA, 22 nt, Human
uggccagccuggugcuugcucc

SEQ ID NO: 443332 - RNA, 22 nt, Human
cagucccaggguugguucagcu

SEQ ID NO: 443333 - RNA, 22 nt, Human
cccagggucccugcucucugug

SEQ ID NO: 443334 - RNA, 23 nt, Human
ugaaagcaaugggucuauaguau

SEQ ID NO: 443335 - RNA, 22 nt, Human
acuccagguaggcacauugaca

SEQ ID NO: 443336 - RNA, 22 nt, Human
caggcucuuccauccugcugag

SEQ ID NO: 443337 - RNA, 22 nt, Human
uucaaaacaaucuguuugcauu

SEQ ID NO: 443338 - RNA, 22 nt, Human
ugcugagguuucugacuaugga

SEQ ID NO: 443339 - RNA, 23 nt, Human
agcuccagcugacgugggcagcc

SEQ ID NO: 443340 - RNA, 22 nt, Human
augcaaaaguaauugcaauuuu

SEQ ID NO: 443341 - RNA, 18 nt, Human
ggacccagggccucaccc

SEQ ID NO: 443342 - RNA, 19 nt, Human
aggcagcacccaguccuug

SEQ ID NO: 443343 - RNA, 22 nt, Human
gaagcuccguacuaugacuuuu

SEQ ID NO: 443344 - RNA, 22 nt, Human
cagagccucugcccugggcacu

SEQ ID NO: 443345 - RNA, 22 nt, Human
cagcuggcgacucuccucgaug

SEQ ID NO: 443346 - RNA, 22 nt, Human
aggcugaggcagguggaucauu

SEQ ID NO: 443347 - RNA, 22 nt, Human
cugagccccaucugaggugccc

SEQ ID NO: 443348 - RNA, 22 nt, Human
cugagaggaugcugcaguggag

SEQ ID NO: 443349 - RNA, 22 nt, Human
uguugcaguaaaaauggagagg

SEQ ID NO: 443350 - RNA, 22 nt, Human
guucagagacacuuauuggaaa

SEQ ID NO: 443351 - RNA, 21 nt, Human
agaaggcaaaagcagacaucu

SEQ ID NO: 443352 - RNA, 23 nt, Human
gcuguccccaugcuccaucccug

SEQ ID NO: 443353 - RNA, 22 nt, Human
cugcccugcuaaugaguuccaa

SEQ ID NO: 443354 - RNA, 22 nt, Human
uacacugaaagagaggauugaa

SEQ ID NO: 443355 - RNA, 22 nt, Human
agcugccugggcuuguacaccu

SEQ ID NO: 443356 - RNA, 22 nt, Human
auucagaauggcaaacuucuag

SEQ ID NO: 443357 - RNA, 22 nt, Human
aucuggugcuaacaaaugugga

SEQ ID NO: 443358 - RNA, 22 nt, Human
acauugaugugaugcagaagug

SEQ ID NO: 443359 - RNA, 22 nt, Human
gagggaagaggguuugaauuca

SEQ ID NO: 443360 - RNA, 22 nt, Human
aaagucacaguuuaggggauau

SEQ ID NO: 443361 - RNA, 22 nt, Human
acuuucuucuuaugcauuaagg

SEQ ID NO: 443362 - RNA, 22 nt, Human
cagggcucuuccggagcaggga

SEQ ID NO: 443363 - RNA, 22 nt, Human
cagagaacuuagcuaguuuucc

SEQ ID NO: 443364 - RNA, 22 nt, Human
aggcaaagaggauauuuugggg

SEQ ID NO: 443365 - RNA, 22 nt, Human
gaaggaaaaauacucuguaagg

SEQ ID NO: 443366 - RNA, 23 nt, Human
gcacugccaugugcucugcaggc

SEQ ID NO: 443367 - RNA, 22 nt, Human
ugagccagaggaggcugugugg

SEQ ID NO: 443368 - RNA, 22 nt, Human
uuggcacagagcugcagccugg

SEQ ID NO: 443369 - RNA, 22 nt, Human
ugagauaauuaaaucaaaaccu

SEQ ID NO: 443370 - RNA, 22 nt, Human
auauuuguaguggguaagaagu

SEQ ID NO: 443371 - RNA, 22 nt, Human
uggauaaaaugacauuaccuga

SEQ ID NO: 443372 - RNA, 22 nt, Human
ucccagaggcuccagucucuau

SEQ ID NO: 443373 - RNA, 22 nt, Human
cauuacaaccccaaauuacaaa

SEQ ID NO: 443374 - RNA, 22 nt, Human
ccaggcacugcucgaggugcua

SEQ ID NO: 443375 - RNA, 22 nt, Human
cagggccugcaagagaccuggg

SEQ ID NO: 443376 - RNA, 22 nt, Human
cagcacuuugagggcucuuaau

SEQ ID NO: 443377 - RNA, 22 nt, Human
gcuuccagagacugagcucuuc

SEQ ID NO: 443378 - RNA, 22 nt, Human
uuucaaacuuuacucuugaauc

SEQ ID NO: 443379 - RNA, 22 nt, Human
gacagcugcauccucagacaca

SEQ ID NO: 443380 - RNA, 22 nt, Human
agugcuguccaguuucacaggu

SEQ ID NO: 443381 - RNA, 22 nt, Human
gcagcuguggugcugagauagg

SEQ ID NO: 443382 - RNA, 22 nt, Human
uagcccagagucccaauuccag

SEQ ID NO: 443383 - RNA, 22 nt, Human
gcucugggauuaccagccuuag

SEQ ID NO: 443384 - RNA, 22 nt, Human
uaggaacaacugcagguacaag

SEQ ID NO: 443385 - RNA, 23 nt, Human
ccugugugcccuuaauucacagc

SEQ ID NO: 443386 - RNA, 22 nt, Human
cucaggcuugggaggaggccca

SEQ ID NO: 443387 - RNA, 22 nt, Human
ccucuuccacugggccccaucc

SEQ ID NO: 443388 - RNA, 22 nt, Human
ggcuguggucugggugcucccc

SEQ ID NO: 443389 - RNA, 22 nt, Human
acagacaguaaauaguguggcu

SEQ ID NO: 443390 - RNA, 21 nt, Human
ugcagacagggacagaaugga

SEQ ID NO: 443391 - RNA, 22 nt, Human
ugccuggguucccaccccaaag

SEQ ID NO: 443392 - RNA, 22 nt, Human
gagcugagcagggagccucacu

SEQ ID NO: 443393 - RNA, 17 nt, Human
uccagcccugcccgacg

SEQ ID NO: 443394 - RNA, 22 nt, Human
ccagcuccagguagaugggcag

SEQ ID NO: 443395 - RNA, 22 nt, Human
ugcccacauucugaagcucccu

SEQ ID NO: 443396 - RNA, 22 nt, Human
cagcugguagguagcagauuug

SEQ ID NO: 443397 - RNA, 22 nt, Human
acuuugacagcauuuuaauuau

SEQ ID NO: 443398 - RNA, 21 nt, Human
ccagcccagcugugucccagc

SEQ ID NO: 443399 - RNA, 22 nt, Human
cagugccaugucugagccccua

SEQ ID NO: 443400 - RNA, 22 nt, Human
uagcagcacagaaagccuggag

SEQ ID NO: 443401 - RNA, 22 nt, Human
agucccagacuccaguuuucug

SEQ ID NO: 443402 - RNA, 22 nt, Human
guguguccaggcgggagucaag

SEQ ID NO: 443403 - RNA, 22 nt, Human
cagcaacaugugguaguguagg

SEQ ID NO: 443404 - RNA, 22 nt, Human
uuuugaaagggugauuuggcuu

SEQ ID NO: 443405 - RNA, 22 nt, Human
gucugucucucuccagagugca

SEQ ID NO: 443406 - RNA, 22 nt, Human
ucagaggaagccuuggugggag

SEQ ID NO: 443407 - RNA, 22 nt, Human
ucaggcugcaucuguaagggug

SEQ ID NO: 443408 - RNA, 22 nt, Human
uuucaaaccuacuuguauguuu

SEQ ID NO: 443409 - RNA, 22 nt, Human
agcuguucccucacugcaguca

SEQ ID NO: 443410 - RNA, 22 nt, Human
gagggcaccagaagagccagau

SEQ ID NO: 443411 - RNA, 22 nt, Human
cugggaggugaacagaaaaacu

SEQ ID NO: 443412 - RNA, 22 nt, Human
ugcugaggcauuuggacagagu

SEQ ID NO: 443413 - RNA, 22 nt, Human
agaaugauaaugccaugaugga

SEQ ID NO: 443414 - RNA, 22 nt, Human
ucaaacugaacuaagauccaac

SEQ ID NO: 443415 - RNA, 22 nt, Human
ucagaggacuaccuucuccagu

SEQ ID NO: 443416 - RNA, 18 nt, Human
gcaaacauucuuccaguc

SEQ ID NO: 443417 - RNA, 22 nt, Human
uaaggaagagcuugguaauagg

SEQ ID NO: 443418 - RNA, 22 nt, Human
gggguuaacaguauugcucaug

SEQ ID NO: 443419 - RNA, 22 nt, Human
ucaggaacauaaugugagucag

SEQ ID NO: 443420 - RNA, 20 nt, Human
cugggaggucuuccaaauca

SEQ ID NO: 443421 - RNA, 22 nt, Human
uuucaacagaauaugaucagag

SEQ ID NO: 443422 - RNA, 22 nt, Human
ggcuccaggagaugcugggcag

SEQ ID NO: 443423 - RNA, 22 nt, Human
uggugagagcugaccgugcgag

SEQ ID NO: 443424 - RNA, 22 nt, Human
gcagggaggaagagaugcuucc

SEQ ID NO: 443425 - RNA, 20 nt, Human
uccugcagucgcuagcgccc

SEQ ID NO: 443426 - RNA, 22 nt, Human
cugccucuguugggcauggucu

SEQ ID NO: 443427 - RNA, 22 nt, Human
aaggaagaaaugaauaggugga

SEQ ID NO: 443428 - RNA, 22 nt, Human
cagcugccacaggacuuucuga

SEQ ID NO: 443429 - RNA, 22 nt, Human
uggcacagacagaucaggaguc

SEQ ID NO: 443430 - RNA, 22 nt, Human
aacacaaaaauucucaggggca

SEQ ID NO: 443431 - RNA, 22 nt, Human
cucuccccacacccucugcaug

SEQ ID NO: 443432 - RNA, 22 nt, Human
uauuuuacaugacagguguuua

SEQ ID NO: 443433 - RNA, 20 nt, Human
cugaaagacguaacagugca

SEQ ID NO: 443434 - RNA, 22 nt, Human
ugacagaggcugaguuagucug

SEQ ID NO: 443435 - RNA, 22 nt, Human
auuuucugaguccagaauuuac

SEQ ID NO: 443436 - RNA, 22 nt, Human
gcugugugacugagagccuggc

SEQ ID NO: 443437 - RNA, 23 nt, Human
cugugugugccgaggguggccac

SEQ ID NO: 443438 - RNA, 22 nt, Human
guuuuucuagaaaucuccuccu

SEQ ID NO: 443439 - RNA, 23 nt, Human
uccucagcauguuuugucaugua

SEQ ID NO: 443440 - RNA, 22 nt, Human
acaggcagagucagguuggguu

SEQ ID NO: 443441 - RNA, 22 nt, Human
auguccagaguguccuggaaag

SEQ ID NO: 443442 - RNA, 22 nt, Human
cuggguagaagauuccucagga

SEQ ID NO: 443443 - RNA, 22 nt, Human
uggugcaagucucugaggaggg

SEQ ID NO: 443444 - RNA, 22 nt, Human
agagucugaggcagcugcagcc

SEQ ID NO: 443445 - RNA, 22 nt, Human
auuuguuuaucgucgauuguag

SEQ ID NO: 443446 - RNA, 22 nt, Human
caggaagagguggggcuaaagu

SEQ ID NO: 443447 - RNA, 22 nt, Human
aacagcuauucacuacuauggg

SEQ ID NO: 443448 - RNA, 22 nt, Human
ccuggagcuuuuccaguugaca

SEQ ID NO: 443449 - RNA, 22 nt, Human
accuucuggucugccugacagc

SEQ ID NO: 443450 - RNA, 22 nt, Human
ugagcaguaacagcucacaggg

SEQ ID NO: 443451 - RNA, 22 nt, Human
aauagaaaggaggggcucuugu

SEQ ID NO: 443452 - RNA, 22 nt, Human
agaaggccuaacuugggggcaa

SEQ ID NO: 443453 - RNA, 22 nt, Human
cagcugagagacaaugagucau

SEQ ID NO: 443454 - RNA, 22 nt, Human
ugacagaaauaguucuuaauuu

SEQ ID NO: 443455 - RNA, 22 nt, Human
uagcagcauccuguggugaugg

SEQ ID NO: 443456 - RNA, 22 nt, Human
uggauaaauggugcuaucaccc

SEQ ID NO: 443457 - RNA, 22 nt, Human
agcagcugcagagggcuccccc

SEQ ID NO: 443458 - RNA, 22 nt, Human
aauucagagacucauucuggag

SEQ ID NO: 443459 - RNA, 22 nt, Human
cuuugcaaacugucacacuuuc

SEQ ID NO: 443460 - RNA, 22 nt, Human
ugcagcugauaauuacauguuc

SEQ ID NO: 443461 - RNA, 19 nt, Human
cacuuugcugaacucuucu

SEQ ID NO: 443462 - RNA, 22 nt, Human
gcagccuguuguaccagccugu

SEQ ID NO: 443463 - RNA, 22 nt, Human
gggcacagcccagugggguccc

SEQ ID NO: 443464 - RNA, 22 nt, Human
ggcaggugugagaucgaggcca

SEQ ID NO: 443465 - RNA, 22 nt, Human
uuuaacuuaaucugcuugauga

SEQ ID NO: 443466 - RNA, 22 nt, Human
augggaggaagagaagaugucu

SEQ ID NO: 443467 - RNA, 22 nt, Human
cagagccuggcgaugucaugga

SEQ ID NO: 443468 - RNA, 22 nt, Human
aggcugagugcuccccuagaug

SEQ ID NO: 443469 - RNA, 22 nt, Human
cuccucaggaaguagcaugugu

SEQ ID NO: 443470 - RNA, 22 nt, Human
gugaaguuuuaguauauguaga

SEQ ID NO: 443471 - RNA, 22 nt, Human
aauuucaaguggcaucuuugau

SEQ ID NO: 443472 - RNA, 22 nt, Human
acuggcaguggcagcagaaaga

SEQ ID NO: 443473 - RNA, 22 nt, Human
uggccuggcucacagugagauu

SEQ ID NO: 443474 - RNA, 22 nt, Human
gcaggcaggcuuccuugaacug

SEQ ID NO: 443475 - RNA, 22 nt, Human
cuggagccccagacagggagag

SEQ ID NO: 443476 - RNA, 22 nt, Human
uaugcaaacuaaguuguuuccu

SEQ ID NO: 443477 - RNA, 22 nt, Human
ugaaauacacaaauuuaguaag

SEQ ID NO: 443478 - RNA, 22 nt, Human
gccacaggucggcuagaggguc

SEQ ID NO: 443479 - RNA, 22 nt, Human
auucauuuagguauucacuuac

SEQ ID NO: 443480 - RNA, 22 nt, Human
aagcccuguccggggggaagaa

SEQ ID NO: 443481 - RNA, 22 nt, Human
aaaguuuucugccuucauuaga

SEQ ID NO: 443482 - RNA, 20 nt, Human
agcaccuguguagaagcauc

SEQ ID NO: 443483 - RNA, 22 nt, Human
ucagaaaagguagcugugacaa

SEQ ID NO: 443484 - RNA, 19 nt, Human
uuuacagggaauggagacc

SEQ ID NO: 443485 - RNA, 22 nt, Human
ccaggcccaccuuggccacuua

SEQ ID NO: 443486 - RNA, 22 nt, Human
guccagcaggaugcaagugcca

SEQ ID NO: 443487 - RNA, 22 nt, Human
gagguggcaauuuaaugcaguc

SEQ ID NO: 443488 - RNA, 20 nt, Human
uucaugguguauuucuuucu

SEQ ID NO: 443489 - RNA, 22 nt, Human
acuguauuuccaacagacaaau

SEQ ID NO: 443490 - RNA, 22 nt, Human
ugccucugguuaucugguaccu

SEQ ID NO: 443491 - RNA, 22 nt, Human
gcugccuguggcccuucugggu

SEQ ID NO: 443492 - RNA, 21 nt, Human
aggcccagcuuuccucuugcu

SEQ ID NO: 443493 - RNA, 19 nt, Human
uccucccuuugguguccug

SEQ ID NO: 443494 - RNA, 22 nt, Human
ggcaauaaucuacucugccacu

SEQ ID NO: 443495 - RNA, 17 nt, Human
auaaaggcaaguauuau

SEQ ID NO: 443496 - RNA, 22 nt, Human
gcucagggaguuucacagugua

SEQ ID NO: 443497 - RNA, 22 nt, Human
cacaggaagaucucccagaggu

SEQ ID NO: 443498 - RNA, 22 nt, Human
ucucacaggugcacguggcugu

SEQ ID NO: 443499 - RNA, 22 nt, Human
uggcuaauggcauuuccugggu

SEQ ID NO: 443500 - RNA, 22 nt, Human
gaggccucuucuuuguuaaccu

SEQ ID NO: 443501 - RNA, 22 nt, Human
gaggcuggacgugcauuucuac

SEQ ID NO: 443502 - RNA, 22 nt, Human
ucaacauuggaggcaacauuca

SEQ ID NO: 443503 - RNA, 22 nt, Human
ucaugcagauuuggagguauuu

SEQ ID NO: 443504 - RNA, 22 nt, Human
cugccagggcauccuguggugg

SEQ ID NO: 443505 - RNA, 20 nt, Human
agguccugguucucugggau

SEQ ID NO: 443506 - RNA, 21 nt, Human
gcagcuggucucagagcuugc

SEQ ID NO: 443507 - RNA, 22 nt, Human
acaucugaccauuacaagacau

SEQ ID NO: 443508 - RNA, 19 nt, Human
caggaacauggagggaggg

SEQ ID NO: 443509 - RNA, 22 nt, Human
uuccucagagggcgcuggggaa

SEQ ID NO: 443510 - RNA, 22 nt, Human
aggagcucugggcagggccucc

SEQ ID NO: 443511 - RNA, 22 nt, Human
gccucugcaugcucagcaccca

SEQ ID NO: 443512 - RNA, 21 nt, Human
ugcaggagucugugagucagg

SEQ ID NO: 443513 - RNA, 22 nt, Human
auugaacagaaaaacucagaga

SEQ ID NO: 443514 - RNA, 22 nt, Human
acagaguuaauggauaggcagg

SEQ ID NO: 443515 - RNA, 22 nt, Human
gcagcaguggucuguagaagga

SEQ ID NO: 443516 - RNA, 22 nt, Human
cccagagaaccuucugugccac

SEQ ID NO: 443517 - RNA, 22 nt, Human
ccaggcuggaaucaauauucug

SEQ ID NO: 443518 - RNA, 22 nt, Human
caaggcaggaagccugucuuau

SEQ ID NO: 443519 - RNA, 22 nt, Human
cagcugguguccagggaagugg

SEQ ID NO: 443520 - RNA, 22 nt, Human
ccagaggucuccugcacgggau

SEQ ID NO: 443521 - RNA, 22 nt, Human
ccugggcagccugcucaaggac

SEQ ID NO: 443522 - RNA, 22 nt, Human
gaagagagccgcgggacaucag

SEQ ID NO: 443523 - RNA, 23 nt, Human
acuauaaaguuguucugauuuac

SEQ ID NO: 443524 - RNA, 22 nt, Human
ugaagccacagagcaucugccu

SEQ ID NO: 443525 - RNA, 22 nt, Human
gcacugcaucuacuggcaagua

SEQ ID NO: 443526 - RNA, 22 nt, Human
ccagggugggaggcugaaggcg

SEQ ID NO: 443527 - RNA, 22 nt, Human
aaaaguuugugcaaacacucag

SEQ ID NO: 443528 - RNA, 22 nt, Human
cugggcugcagcgggagcgacg

SEQ ID NO: 443529 - RNA, 22 nt, Human
acuguauuuggauauaagaucu

SEQ ID NO: 443530 - RNA, 22 nt, Human
cccaggaggcagagcuugcagu

SEQ ID NO: 443531 - RNA, 22 nt, Human
gggcacugugcuaggugcugag

SEQ ID NO: 443532 - RNA, 22 nt, Human
gcauguguggaggagaugugcu

SEQ ID NO: 443533 - RNA, 22 nt, Human
uagcugccuagacagcuauagc

SEQ ID NO: 443534 - RNA, 22 nt, Human
ucaggcugaggucaucugcauc

SEQ ID NO: 443535 - RNA, 23 nt, Human
acugggcuuaugaggaggcuugu

SEQ ID NO: 443536 - RNA, 22 nt, Human
auuucucaguguacauuauguu

SEQ ID NO: 443537 - RNA, 22 nt, Human
ucugggcugggagcguguggac

SEQ ID NO: 443538 - RNA, 22 nt, Human
gcagcuggaagugacacucugu

SEQ ID NO: 443539 - RNA, 18 nt, Human
uuugcaaaggaaguaugg

SEQ ID NO: 443540 - RNA, 22 nt, Human
agaauaaaugcuaccuaucaca

SEQ ID NO: 443541 - RNA, 22 nt, Human
ccacaguagcauccaaacagua

SEQ ID NO: 443542 - RNA, 20 nt, Human
uaaaugcaucuguucaacug

SEQ ID NO: 443543 - RNA, 22 nt, Human
uacaugaaauaggauucuggag

SEQ ID NO: 443544 - RNA, 22 nt, Human
ggguggcaucucucugagcugu

SEQ ID NO: 443545 - RNA, 20 nt, Human
ugcagaagaacguucugguu

SEQ ID NO: 443546 - RNA, 22 nt, Human
ugcagaagaaaacagcugugug

SEQ ID NO: 443547 - RNA, 22 nt, Human
uggcucuccagagccuauggua

SEQ ID NO: 443548 - RNA, 22 nt, Human
cugccuucuuucaaggguaagc

SEQ ID NO: 443549 - RNA, 22 nt, Human
acaggcacaccuuccugcaggc

SEQ ID NO: 443550 - RNA, 22 nt, Human
ugaagcaaugauagcagaauga

SEQ ID NO: 443551 - RNA, 22 nt, Human
gaggucaggcuugcagcagggu

SEQ ID NO: 443552 - RNA, 19 nt, Human
ccagcagaagccacuccug

SEQ ID NO: 443553 - RNA, 22 nt, Human
gacaugauggaaaaaaaugcuc

SEQ ID NO: 443554 - RNA, 22 nt, Human
aggagcugagggagcgcccuug

SEQ ID NO: 443555 - RNA, 22 nt, Human
acaauaugggauauacauuuua

SEQ ID NO: 443556 - RNA, 22 nt, Human
gcaguaggaguuuccagggugg

SEQ ID NO: 443557 - RNA, 22 nt, Human
gcccacagcucguuccucuccu

SEQ ID NO: 443558 - RNA, 22 nt, Human
gguccaguccugcucaccacuu

SEQ ID NO: 443559 - RNA, 22 nt, Human
ggcacugggagaggugagacgg

SEQ ID NO: 443560 - RNA, 22 nt, Human
cagaggaaguuccuugaugaga

SEQ ID NO: 443561 - RNA, 22 nt, Human
auauacagggagaaacagcuua

SEQ ID NO: 443562 - RNA, 20 nt, Human
cagcccuugauuuacaaucc

SEQ ID NO: 443563 - RNA, 22 nt, Human
gcaguacuuuaagggaugaagc

SEQ ID NO: 443564 - RNA, 23 nt, Human
ucagaauuccaguuucuuugaag

SEQ ID NO: 443565 - RNA, 22 nt, Human
cuugaugagccuagugcuuaga

SEQ ID NO: 443566 - RNA, 22 nt, Human
aaaggcaaaggcugguauggcu

SEQ ID NO: 443567 - RNA, 23 nt, Human
gaauacaaagcagaugguccagc

SEQ ID NO: 443568 - RNA, 22 nt, Human
uugcauaugaagcugacuuaaa

SEQ ID NO: 443569 - RNA, 22 nt, Human
uuucacauucuucugaaucuac

SEQ ID NO: 443570 - RNA, 19 nt, Human
cugagccucaguuuccuag

SEQ ID NO: 443571 - RNA, 22 nt, Human
uucauaugcagauuaacaaaua

SEQ ID NO: 443572 - RNA, 22 nt, Human
agugugugaccuuuuaauuuaa

SEQ ID NO: 443573 - RNA, 22 nt, Human
acuuauuagacaucuucauugu

SEQ ID NO: 443574 - RNA, 20 nt, Human
cccaggcagagcuagcggca

SEQ ID NO: 443575 - RNA, 22 nt, Human
augccaaagauguuugauagaa

SEQ ID NO: 443576 - RNA, 22 nt, Human
agagguaagcaguggcaagugc

SEQ ID NO: 443577 - RNA, 22 nt, Human
uuuauccaccagggacuaggac

SEQ ID NO: 443578 - RNA, 22 nt, Human
augaauguaaguggauuucuuu

SEQ ID NO: 443579 - RNA, 22 nt, Human
gaaagagaaccugggccuagau

SEQ ID NO: 443580 - RNA, 22 nt, Human
cugagccuuauucaccagcccu

SEQ ID NO: 443581 - RNA, 22 nt, Human
gcucccagacugaccagaggug

SEQ ID NO: 443582 - RNA, 22 nt, Human
cugggagguggagguugcauug

SEQ ID NO: 443583 - RNA, 22 nt, Human
uucauacuaaaguguaagaugu

SEQ ID NO: 443584 - RNA, 22 nt, Human
agagacuucugccuuagcaaga

SEQ ID NO: 443585 - RNA, 22 nt, Human
aaagcagaggugauaugacuua

SEQ ID NO: 443586 - RNA, 19 nt, Human
ggaaggccacggcaggcuu

SEQ ID NO: 443587 - RNA, 22 nt, Human
agauauguuuguauauauuugu

SEQ ID NO: 443588 - RNA, 21 nt, Human
ucagaguguguuacagcaagc

SEQ ID NO: 443589 - RNA, 22 nt, Human
gacagaggguuccaaaauugau

SEQ ID NO: 443590 - RNA, 22 nt, Human
ccugucauacuaacguaguggg

SEQ ID NO: 443591 - RNA, 22 nt, Human
ucuuggauuuuaauggaucaaa

SEQ ID NO: 443592 - RNA, 22 nt, Human
cagcuguucuugggacagacag

SEQ ID NO: 443593 - RNA, 22 nt, Human
acagccuguuugaucuggugcu

SEQ ID NO: 443594 - RNA, 22 nt, Human
caauagaaggcacagauaggua

SEQ ID NO: 443595 - RNA, 22 nt, Human
accagccugucugagucguggg

SEQ ID NO: 443596 - RNA, 22 nt, Human
cucaggaggugguagaggcccu

SEQ ID NO: 443597 - RNA, 22 nt, Human
uggagcagccaugaugacagag

SEQ ID NO: 443598 - RNA, 22 nt, Human
auuuaaauuuucugauggagag

SEQ ID NO: 443599 - RNA, 22 nt, Human
uugaacaaucaaaagaauucau

SEQ ID NO: 443600 - RNA, 22 nt, Human
augcccuggggcuaccucugag

SEQ ID NO: 443601 - RNA, 22 nt, Human
ucauccugaagaaccugcuucc

SEQ ID NO: 443602 - RNA, 22 nt, Human
gcagcugccuauucagggcuug

SEQ ID NO: 443603 - RNA, 22 nt, Human
agaagcugccuacaugaccagc

SEQ ID NO: 443604 - RNA, 20 nt, Human
cugccaugauugauagagug

SEQ ID NO: 443605 - RNA, 22 nt, Human
acacugaaggcuacaagguuga

SEQ ID NO: 443606 - RNA, 22 nt, Human
acagaacugagaauucucuauc

SEQ ID NO: 443607 - RNA, 22 nt, Human
gccagcagguugucaaggagcu

SEQ ID NO: 443608 - RNA, 22 nt, Human
cacuaaguugguguuaauuagu

SEQ ID NO: 443609 - RNA, 22 nt, Human
aggaagcucggagagggcaaau

SEQ ID NO: 443610 - RNA, 19 nt, Human
uggcucuguuucucuggag

SEQ ID NO: 443611 - RNA, 22 nt, Human
aacaggcaauuuaggacucuuu

SEQ ID NO: 443612 - RNA, 22 nt, Human
ucaggcugcccguucagggcuc

SEQ ID NO: 443613 - RNA, 22 nt, Human
cacccagccuucacacaggagu

SEQ ID NO: 443614 - RNA, 22 nt, Human
gcaggaacccagacaaccaggg

SEQ ID NO: 443615 - RNA, 22 nt, Human
aggcuccuugcucacaggcuca

SEQ ID NO: 443616 - RNA, 22 nt, Human
ugccagugggugugcagagacu

SEQ ID NO: 443617 - RNA, 22 nt, Human
uggcaccugaacuuagaggugu

SEQ ID NO: 443618 - RNA, 22 nt, Human
aaguugauggcgucuuugagau

SEQ ID NO: 443619 - RNA, 17 nt, Human
agaaagaggauccacag

SEQ ID NO: 443620 - RNA, 22 nt, Human
aaauucaguguucuucccguaa

SEQ ID NO: 443621 - RNA, 22 nt, Human
gaggccugaaaggggaccuaug

SEQ ID NO: 443622 - RNA, 22 nt, Human
uuuuuguugcagagaggccacu

SEQ ID NO: 443623 - RNA, 19 nt, Human
ugggaugaugcagaaggua

SEQ ID NO: 443624 - RNA, 22 nt, Human
gcaggaugaaggcagaggcuga

SEQ ID NO: 443625 - RNA, 22 nt, Human
uuauugugugcguuagccuaug

SEQ ID NO: 443626 - RNA, 22 nt, Human
ucugucacaauuugcuuacucu

SEQ ID NO: 443627 - RNA, 22 nt, Human
agacagcaugauacaugaugcu

SEQ ID NO: 443628 - RNA, 22 nt, Human
cccagcauuucugggcugcacu

SEQ ID NO: 443629 - RNA, 22 nt, Human
cuggagcugcuguccuugggug

SEQ ID NO: 443630 - RNA, 20 nt, Human
ggccucugaggacaaggaga

SEQ ID NO: 443631 - RNA, 22 nt, Human
gugcauauaugcacauaugugu

SEQ ID NO: 443632 - RNA, 22 nt, Human
uaggaggccauccagccugccu

SEQ ID NO: 443633 - RNA, 22 nt, Human
cagaacauuccaugugcccugc

SEQ ID NO: 443634 - RNA, 22 nt, Human
acugcaaagccagauauuauca

SEQ ID NO: 443635 - RNA, 22 nt, Human
gggcaggggucaguggccccaa

SEQ ID NO: 443636 - RNA, 22 nt, Human
auauuacauaaacaugagugaa

SEQ ID NO: 443637 - RNA, 22 nt, Human
gcucagugcaucauuccaggcu

SEQ ID NO: 443638 - RNA, 17 nt, Human
agaugcuggccacaugu

SEQ ID NO: 443639 - RNA, 22 nt, Human
cucaggacccaccuuauuagga

SEQ ID NO: 443640 - RNA, 22 nt, Human
ccagcagcugcuaugugguuuu

SEQ ID NO: 443641 - RNA, 22 nt, Human
uugauuuuuccagcuucuagag

SEQ ID NO: 443642 - RNA, 22 nt, Human
gcugaggcuccucgggaggaca

SEQ ID NO: 443643 - RNA, 22 nt, Human
uuucagaaggggagaaagguca

SEQ ID NO: 443644 - RNA, 20 nt, Human
agcaggcugcagggugaaau

SEQ ID NO: 443645 - RNA, 22 nt, Human
uugcauuguugcaaugaaguau

SEQ ID NO: 443646 - RNA, 22 nt, Human
gcuggugagauuuuauguuucc

SEQ ID NO: 443647 - RNA, 22 nt, Human
agaggcugaaugaugucaucau

SEQ ID NO: 443648 - RNA, 22 nt, Human
gagcugccagacaugggaauga

SEQ ID NO: 443649 - RNA, 22 nt, Human
uucuaagucacucagauuuugg

SEQ ID NO: 443650 - RNA, 23 nt, Human
agcaggcaucuguggcacaaggc

SEQ ID NO: 443651 - RNA, 22 nt, Human
acccucccauuuccauguagca

SEQ ID NO: 443652 - RNA, 22 nt, Human
guuaacauucaauuaaacaguc

SEQ ID NO: 443653 - RNA, 22 nt, Human
gaaaguuuauagguuauauaau

SEQ ID NO: 443654 - RNA, 22 nt, Human
ugcuggagaacugcucuguguu

SEQ ID NO: 443655 - RNA, 22 nt, Human
agcaacccguccuugggggacu

SEQ ID NO: 443656 - RNA, 22 nt, Human
caagaucaaggugucagcaggu

SEQ ID NO: 443657 - RNA, 22 nt, Human
caagaucaagguaucagcagau

SEQ ID NO: 443658 - RNA, 22 nt, Human
agcuggugugccacuguugggg

SEQ ID NO: 443659 - RNA, 22 nt, Human
ccaucugacugccacccaggcc

SEQ ID NO: 443660 - RNA, 22 nt, Human
aacaaguuagggucuuuuacuu

SEQ ID NO: 443661 - RNA, 23 nt, Human
aucugaaaaggcauuuucuuccc

SEQ ID NO: 443662 - RNA, 22 nt, Human
ugcacacauguuuacaagcauc

SEQ ID NO: 443663 - RNA, 22 nt, Human
gaggcagaggaagguggucucu

SEQ ID NO: 443664 - RNA, 22 nt, Human
uucuacaugagaaaauguauuu

SEQ ID NO: 443665 - RNA, 22 nt, Human
agcagcugaccagugaguccug

SEQ ID NO: 443666 - RNA, 22 nt, Human
aagcacaguaaaagcagauuuu

SEQ ID NO: 443667 - RNA, 22 nt, Human
cuggaggcugaguugggucucc

SEQ ID NO: 443668 - RNA, 22 nt, Human
gauugcuuauacacaagaugaa

SEQ ID NO: 443669 - RNA, 22 nt, Human
uuuccucacacagaagaucuug

SEQ ID NO: 443670 - RNA, 22 nt, Human
cuggagucggcgccccaacaga

SEQ ID NO: 443671 - RNA, 22 nt, Human
cccaggcugaugggaugggcca

SEQ ID NO: 443672 - RNA, 22 nt, Human
agagacagaucugagggaccuc

SEQ ID NO: 443673 - RNA, 22 nt, Human
gcucagggccuggcugcggacu

SEQ ID NO: 443674 - RNA, 22 nt, Human
gacccagcuuaagucacauguu

SEQ ID NO: 443675 - RNA, 20 nt, Human
gccuggaggcagagauaaag

SEQ ID NO: 443676 - RNA, 22 nt, Human
gucugggcuccuggcaggcagc

SEQ ID NO: 443677 - RNA, 22 nt, Human
cccagcucucugcucuuagccu

SEQ ID NO: 443678 - RNA, 19 nt, Human
agcaggcuaggcugccucu

SEQ ID NO: 443679 - RNA, 22 nt, Human
auuagcaauugcccugugcaau

SEQ ID NO: 443680 - RNA, 22 nt, Human
acagcugugacuuagagaaguu

SEQ ID NO: 443681 - RNA, 22 nt, Human
agaaaggaggaagaaugaccuc

SEQ ID NO: 443682 - RNA, 22 nt, Human
ugcacacaguggacaagucuug

SEQ ID NO: 443683 - RNA, 22 nt, Human
uugcccacuggcuguuggucag

SEQ ID NO: 443684 - RNA, 22 nt, Human
ggaagccaggccaaugagaaca

SEQ ID NO: 443685 - RNA, 22 nt, Human
cccaggcuggaauuccaggccu

SEQ ID NO: 443686 - RNA, 22 nt, Human
uaggcuggaacuuaggcagagg

SEQ ID NO: 443687 - RNA, 22 nt, Human
cccugccuacaggguuuucuuu

SEQ ID NO: 443688 - RNA, 22 nt, Human
aggccuggcaugagaccugaga

SEQ ID NO: 443689 - RNA, 22 nt, Human
gauuucuaaggaggcugaacuu

SEQ ID NO: 443690 - RNA, 22 nt, Human
gugccagcuguccauguuccuc

SEQ ID NO: 443691 - RNA, 20 nt, Human
acaauuuccucacuauaugc

SEQ ID NO: 443692 - RNA, 22 nt, Human
cuaaaggcuaggucugaacuca

SEQ ID NO: 443693 - RNA, 22 nt, Human
agcuguuuuuuccucaccacuu

SEQ ID NO: 443694 - RNA, 22 nt, Human
aguaucuuuacuuaaauaguca

SEQ ID NO: 443695 - RNA, 19 nt, Human
uccugcugugugaagggga

SEQ ID NO: 443696 - RNA, 22 nt, Human
cagcauuuaucuuguagcagga

SEQ ID NO: 443697 - RNA, 22 nt, Human
guaugguuuauagggaaauugu

SEQ ID NO: 443698 - RNA, 22 nt, Human
cugaggagcaaccccgugcccu

SEQ ID NO: 443699 - RNA, 22 nt, Human
acaguucaagacaucaguauga

SEQ ID NO: 443700 - RNA, 22 nt, Human
cagagacaggaucucgaagacu

SEQ ID NO: 443701 - RNA, 22 nt, Human
gcuggagccauuggcuuggccu

SEQ ID NO: 443702 - RNA, 22 nt, Human
agcccuaaauuaucuuuauuuu

SEQ ID NO: 443703 - RNA, 22 nt, Human
ccacaguaaauggauucagacc

SEQ ID NO: 443704 - RNA, 22 nt, Human
agcagagcuauucuugugcaau

SEQ ID NO: 443705 - RNA, 22 nt, Human
gcugugcuuuugguagauccca

SEQ ID NO: 443706 - RNA, 22 nt, Human
gcagcccaauggacugagacag

SEQ ID NO: 443707 - RNA, 18 nt, Human
auaugcuugagcuaagga

SEQ ID NO: 443708 - RNA, 22 nt, Human
gugaagaucugagcccucaggu

SEQ ID NO: 443709 - RNA, 22 nt, Human
ccagagcugagggagccugagc

SEQ ID NO: 443710 - RNA, 22 nt, Human
agagugggacacgggcgcuguc

SEQ ID NO: 443711 - RNA, 22 nt, Human
cagcugaguggacccuagaggc

SEQ ID NO: 443712 - RNA, 22 nt, Human
augagacuaccuguaauguggc

SEQ ID NO: 443713 - RNA, 22 nt, Human
gagaagcaaucaguggccaccc

SEQ ID NO: 443714 - RNA, 22 nt, Human
agcugcccuggcggagcugcuc

SEQ ID NO: 443715 - RNA, 22 nt, Human
ucuuggcugcagagccggcaag

SEQ ID NO: 443716 - RNA, 22 nt, Human
ugaaagacaagguuuuuucaga

SEQ ID NO: 443717 - RNA, 22 nt, Human
uucuuauagaagcaaccauugu

SEQ ID NO: 443718 - RNA, 22 nt, Human
ugagaaggccugugugacaggg

SEQ ID NO: 443719 - RNA, 22 nt, Human
ucagcuucuccaagugacaugg

SEQ ID NO: 443720 - RNA, 22 nt, Human
gcaaacauucaggaguacagga

SEQ ID NO: 443721 - RNA, 22 nt, Human
cuucuugaaaccugcucccuca

SEQ ID NO: 443722 - RNA, 23 nt, Human
uggcucugagagguucagaugcu

SEQ ID NO: 443723 - RNA, 19 nt, Human
gcaggcaguggcauucgga

SEQ ID NO: 443724 - RNA, 22 nt, Human
uuuguacagugauguuguaugc

SEQ ID NO: 443725 - RNA, 22 nt, Human
guauaugagaaccauggaggug

SEQ ID NO: 443726 - RNA, 22 nt, Human
accagggcagccgagguguguc

SEQ ID NO: 443727 - RNA, 22 nt, Human
caaggcaguuccccagagggcu

SEQ ID NO: 443728 - RNA, 22 nt, Human
aauggcuuuaggaauccagugc

SEQ ID NO: 443729 - RNA, 22 nt, Human
gcuuggcuggaaauagguugag

SEQ ID NO: 443730 - RNA, 22 nt, Human
ggcugcagcggauuggggauug

SEQ ID NO: 443731 - RNA, 18 nt, Human
uccagcgugcuccagggc

SEQ ID NO: 443732 - RNA, 22 nt, Human
uacccagcuucaagucaggacu

SEQ ID NO: 443733 - RNA, 22 nt, Human
ugucacauguguggcauuuuuc

SEQ ID NO: 443734 - RNA, 23 nt, Human
ucaugaguggcugcggggcugag

SEQ ID NO: 443735 - RNA, 18 nt, Human
uaaaugcauguuaauaac

SEQ ID NO: 443736 - RNA, 22 nt, Human
gggaaguuugugggaggaauau

SEQ ID NO: 443737 - RNA, 22 nt, Human
gggcccuggauuuaagcaugga

SEQ ID NO: 443738 - RNA, 22 nt, Human
uggggcuggcuauugucucccu

SEQ ID NO: 443739 - RNA, 22 nt, Human
auaaggcaagcugucaguuugu

SEQ ID NO: 443740 - RNA, 22 nt, Human
gcugucaggccaugugggccuu

SEQ ID NO: 443741 - RNA, 21 nt, Human
ucuaaugacauccucugacaa

SEQ ID NO: 443742 - RNA, 22 nt, Human
gguuccugugccucuagcuggc

SEQ ID NO: 443743 - RNA, 19 nt, Human
gacaggaaggcuaccagua

SEQ ID NO: 443744 - RNA, 22 nt, Human
acccugagggguauagcagaag

SEQ ID NO: 443745 - RNA, 18 nt, Human
caguccuguuucuacagg

SEQ ID NO: 443746 - RNA, 22 nt, Human
cauguaaaaagaagaaucugga

SEQ ID NO: 443747 - RNA, 22 nt, Human
agagcugcaggguggacccagg

SEQ ID NO: 443748 - RNA, 22 nt, Human
cagcauggggcuuggagucagc

SEQ ID NO: 443749 - RNA, 21 nt, Human
ugaggaugugcagcagcagga

SEQ ID NO: 443750 - RNA, 22 nt, Human
cugggagcugaggcugacgcug

SEQ ID NO: 443751 - RNA, 22 nt, Human
gagagcuggccagcuucaguau

SEQ ID NO: 443752 - RNA, 22 nt, Human
ggcaggagauaaaauauuaguu

SEQ ID NO: 443753 - RNA, 21 nt, Human
guggcucugccaggacugaaa

SEQ ID NO: 443754 - RNA, 18 nt, Human
caggccuuugagacagaa

SEQ ID NO: 443755 - RNA, 22 nt, Human
ccaguccugcucccugaccacc

SEQ ID NO: 443756 - RNA, 22 nt, Human
cugggcuuuugagucacaaggg

SEQ ID NO: 443757 - RNA, 22 nt, Human
uuuacacauaccucuuuaaagu

SEQ ID NO: 443758 - RNA, 22 nt, Human
gcaacauucauguucuguaacc

SEQ ID NO: 443759 - RNA, 22 nt, Human
gcaucuaaacuugcaucauugu

SEQ ID NO: 443760 - RNA, 20 nt, Human
uucaugggagcaaagaggcc

SEQ ID NO: 443761 - RNA, 22 nt, Human
gcccaaggucccauggcagcac

SEQ ID NO: 443762 - RNA, 22 nt, Human
ugcuagggauguagcagugaag

SEQ ID NO: 443763 - RNA, 22 nt, Human
ugcauuaugcuacccagaagcu

SEQ ID NO: 443764 - RNA, 22 nt, Human
aguuuuuccugauuuuacagaa

SEQ ID NO: 443765 - RNA, 22 nt, Human
gccagcugaggccgugcaggcu

SEQ ID NO: 443766 - RNA, 22 nt, Human
uuaacacuaucugucauaauua

SEQ ID NO: 443767 - RNA, 22 nt, Human
aagagcuguaugccauaugauu

SEQ ID NO: 443768 - RNA, 22 nt, Human
ugauucaacuuucauaacaaaa

SEQ ID NO: 443769 - RNA, 22 nt, Human
uauaauuuuaagugguaaauua

SEQ ID NO: 443770 - RNA, 22 nt, Human
ccuggcagucaggggaguccuu

SEQ ID NO: 443771 - RNA, 22 nt, Human
ucaugcagaggaaggcuaguuu

SEQ ID NO: 443772 - RNA, 22 nt, Human
ccuguguguaggccaggggagu

SEQ ID NO: 443773 - RNA, 22 nt, Human
ugcagcccaggcgucagguggu

SEQ ID NO: 443774 - RNA, 22 nt, Human
uacagcaaugcuacaagaugac

SEQ ID NO: 443775 - RNA, 22 nt, Human
acugccucuuggugcugagaga

SEQ ID NO: 443776 - RNA, 19 nt, Human
ccaggccugcgggcguugg

SEQ ID NO: 443777 - RNA, 22 nt, Human
auaaaggcaacaccaggguaug

SEQ ID NO: 443778 - RNA, 22 nt, Human
ucuggcuucccacucugccggg

SEQ ID NO: 443779 - RNA, 22 nt, Human
uuagacauuaaaugccauuuaa

SEQ ID NO: 443780 - RNA, 22 nt, Human
ggagcccucaccggcgagugcc

SEQ ID NO: 443781 - RNA, 17 nt, Human
cagaaggaagcauggca

SEQ ID NO: 443782 - RNA, 22 nt, Human
cagauucaaccuaagacaaucu

SEQ ID NO: 443783 - RNA, 22 nt, Human
ugggcagagaguagaggcaacg

SEQ ID NO: 443784 - RNA, 22 nt, Human
cuuuuguugcccuugucgcagg

SEQ ID NO: 443785 - RNA, 22 nt, Human
acccagaggugucuagcaagcu

SEQ ID NO: 443786 - RNA, 22 nt, Human
cugagcagcaauugcuggccca

SEQ ID NO: 443787 - RNA, 22 nt, Human
cugugugugaacacagcccagc

SEQ ID NO: 443788 - RNA, 22 nt, Human
agauaugucccugucuaauauu

SEQ ID NO: 443789 - RNA, 22 nt, Human
gccuggaggggacagucucugg

SEQ ID NO: 443790 - RNA, 22 nt, Human
cagagcaguggagaguaggucu

SEQ ID NO: 443791 - RNA, 22 nt, Human
caaaugaauagggagugugaug

SEQ ID NO: 443792 - RNA, 19 nt, Human
cccaguccuuguccugggc

SEQ ID NO: 443793 - RNA, 22 nt, Human
agacacagucugucuggaggag

SEQ ID NO: 443794 - RNA, 22 nt, Human
guugauuugaagagcagaaagu

SEQ ID NO: 443795 - RNA, 22 nt, Human
ccugaagcaaggguaggcaggu

SEQ ID NO: 443796 - RNA, 22 nt, Human
augcuugcccauguuucugaag

SEQ ID NO: 443797 - RNA, 22 nt, Human
gcagcuggacccacacggcuua

SEQ ID NO: 443798 - RNA, 22 nt, Human
gaggccuuccucucaagcacau

SEQ ID NO: 443799 - RNA, 22 nt, Human
aaugaggccaguagaaggaagu

SEQ ID NO: 443800 - RNA, 22 nt, Human
ugagccugcaauaagcacagcc

SEQ ID NO: 443801 - RNA, 22 nt, Human
cuucauuggcuuccauagaugc

SEQ ID NO: 443802 - RNA, 23 nt, Human
agguccuggacauaugugcauca

SEQ ID NO: 443803 - RNA, 22 nt, Human
agggggcaucagguccuggcuc

SEQ ID NO: 443804 - RNA, 22 nt, Human
gagcucugggaaacaaagugua

SEQ ID NO: 443805 - RNA, 23 nt, Human
uggcagugaucaaaagcuuacau

SEQ ID NO: 443806 - RNA, 22 nt, Human
ucagcccuggcacugucuccca

SEQ ID NO: 443807 - RNA, 22 nt, Human
cagaggcugcucuggguggcau

SEQ ID NO: 443808 - RNA, 22 nt, Human
ugugcuauuuuugcauaugugu

SEQ ID NO: 443809 - RNA, 21 nt, Human
gauuaaauuuaagcuacaugc

SEQ ID NO: 443810 - RNA, 22 nt, Human
cugcccugaccugccucagagu

SEQ ID NO: 443811 - RNA, 22 nt, Human
gagcagggccacuucuguaccu

SEQ ID NO: 443812 - RNA, 22 nt, Human
gcuguuucugguucuguuccua

SEQ ID NO: 443813 - RNA, 22 nt, Human
uuccuuccucuuucacaacagc

SEQ ID NO: 443814 - RNA, 22 nt, Human
uugauuuucaauucauugacaa

SEQ ID NO: 443815 - RNA, 22 nt, Human
ucccagccacagguguagcccu

SEQ ID NO: 443816 - RNA, 22 nt, Human
cagcaguggcugcaggcagcug

SEQ ID NO: 443817 - RNA, 22 nt, Human
ucaaaaauguuuuauauuggua

SEQ ID NO: 443818 - RNA, 17 nt, Human
ccagagcuacugagacu

SEQ ID NO: 443819 - RNA, 22 nt, Human
ugcagcugaaccuagagucugu

SEQ ID NO: 443820 - RNA, 22 nt, Human
guagccagaucugcugugucug

SEQ ID NO: 443821 - RNA, 22 nt, Human
uucuggagaaucaccaccaggc

SEQ ID NO: 443822 - RNA, 22 nt, Human
uuugcaaaccggagcucugcaa

SEQ ID NO: 443823 - RNA, 22 nt, Human
gcccacacaccagcucaggagg

SEQ ID NO: 443824 - RNA, 22 nt, Human
auugcugaaaguauuuuaugac

SEQ ID NO: 443825 - RNA, 22 nt, Human
ggguugaggcggaugucggcgg

SEQ ID NO: 443826 - RNA, 22 nt, Human
uuugcaaauaccaugaaacuug

SEQ ID NO: 443827 - RNA, 17 nt, Human
ugcugccaagucccaac

SEQ ID NO: 443828 - RNA, 22 nt, Human
gcccagcacauugcugaggacc

SEQ ID NO: 443829 - RNA, 22 nt, Human
aucaaauauaauaauuuucgcu

SEQ ID NO: 443830 - RNA, 22 nt, Human
gcugugugaaaacugggccugg

SEQ ID NO: 443831 - RNA, 22 nt, Human
caggcagcagccacucugguau

SEQ ID NO: 443832 - RNA, 22 nt, Human
ugugugugaaccauugagggcu

SEQ ID NO: 443833 - RNA, 22 nt, Human
ccuggcugugcauugccggccc

SEQ ID NO: 443834 - RNA, 22 nt, Human
gccuggagaauuaaaaggaagg

SEQ ID NO: 443835 - RNA, 22 nt, Human
gcaauaaacucucucaagccac

SEQ ID NO: 443836 - RNA, 22 nt, Human
ggagaaugauucuuugcucacu

SEQ ID NO: 443837 - RNA, 22 nt, Human
uuaacacuccuaacuacagucu

SEQ ID NO: 443838 - RNA, 22 nt, Human
ccaggccccagggcuggcuuuc

SEQ ID NO: 443839 - RNA, 22 nt, Human
uuucagagguaugcugcuuauc

SEQ ID NO: 443840 - RNA, 22 nt, Human
aggcauggcacugagcagcuuc

SEQ ID NO: 443841 - RNA, 22 nt, Human
cagccagccucucaaccaugca

SEQ ID NO: 443842 - RNA, 22 nt, Human
cugggcuacguguugacagcau

SEQ ID NO: 443843 - RNA, 22 nt, Human
acaagagauuaucuacagauga

SEQ ID NO: 443844 - RNA, 22 nt, Human
cuggguuccauguagccaagag

SEQ ID NO: 443845 - RNA, 22 nt, Human
uuuuaaaggauacucuugucua

SEQ ID NO: 443846 - RNA, 22 nt, Human
ucugggaggggcugccauugcu

SEQ ID NO: 443847 - RNA, 22 nt, Human
gagcugaguaugaaggauguga

SEQ ID NO: 443848 - RNA, 22 nt, Human
uacaggaaggagcacaucggga

SEQ ID NO: 443849 - RNA, 22 nt, Human
cuacugaguccuucagcugcca

SEQ ID NO: 443850 - RNA, 22 nt, Human
aggacuccauguguccuggaga

SEQ ID NO: 443851 - RNA, 22 nt, Human
aaguucaagucuccugaguaua

SEQ ID NO: 443852 - RNA, 22 nt, Human
gagggaagauuccccauauggg

SEQ ID NO: 443853 - RNA, 23 nt, Human
uagagcagggaaaucugucagag

SEQ ID NO: 443854 - RNA, 21 nt, Human
gacaggggaagaagcaaggag

SEQ ID NO: 443855 - RNA, 22 nt, Human
cuaaauuauuugcacauuagag

SEQ ID NO: 443856 - RNA, 22 nt, Human
aggcugaggagggauguugcuu

SEQ ID NO: 443857 - RNA, 22 nt, Human
ggucccugaagaggccuggggu

SEQ ID NO: 443858 - RNA, 23 nt, Human
ggccuguguuuugucugaaguac

SEQ ID NO: 443859 - RNA, 17 nt, Human
ugguggcuggagucagg

SEQ ID NO: 443860 - RNA, 22 nt, Human
uucuuauaaguuaauauuucca

SEQ ID NO: 443861 - RNA, 22 nt, Human
ucuggccacuugcuucacacug

SEQ ID NO: 443862 - RNA, 21 nt, Human
acagcagggcuggcaugacag

SEQ ID NO: 443863 - RNA, 22 nt, Human
cuuucuagacuguccagaugau

SEQ ID NO: 443864 - RNA, 22 nt, Human
gaggcuggagauauuccaaucu

SEQ ID NO: 443865 - RNA, 22 nt, Human
gagggggcucccugaagccagu

SEQ ID NO: 443866 - RNA, 22 nt, Human
cccaggguccggauaacccugg

SEQ ID NO: 443867 - RNA, 22 nt, Human
uucuaacuaauuggaaauggaa

SEQ ID NO: 443868 - RNA, 22 nt, Human
gguucugacaagcugggauggu

SEQ ID NO: 443869 - RNA, 23 nt, Human
cccagcuuucccacugccgagag

SEQ ID NO: 443870 - RNA, 22 nt, Human
ucuugaauuguacucccauaag

SEQ ID NO: 443871 - RNA, 23 nt, Human
aguuuuucugcaugguucuguau

SEQ ID NO: 443872 - RNA, 22 nt, Human
aaaauuuugcccuauccuucau

SEQ ID NO: 443873 - RNA, 22 nt, Human
aaugaugguuaaacacuggagg

SEQ ID NO: 443874 - RNA, 22 nt, Human
cugcagaggccucgccuccucu

SEQ ID NO: 443875 - RNA, 22 nt, Human
ggacugggagaauggaggcaag

SEQ ID NO: 443876 - RNA, 22 nt, Human
cagcagcaggcgcacggccguc

SEQ ID NO: 443877 - RNA, 22 nt, Human
aagcucugaggugagcaaucgg

SEQ ID NO: 443878 - RNA, 22 nt, Human
ggugugccuggggcuuagcugc

SEQ ID NO: 443879 - RNA, 22 nt, Human
aggaggccgggauucuggagau

SEQ ID NO: 443880 - RNA, 22 nt, Human
uguacaaagaguauagcuuuga

SEQ ID NO: 443881 - RNA, 22 nt, Human
auucauuagccacuaacuagca

SEQ ID NO: 443882 - RNA, 21 nt, Human
gcagccacagccaccaagcua

SEQ ID NO: 443883 - RNA, 22 nt, Human
auuauauugaguauaaccagag

SEQ ID NO: 443884 - RNA, 21 nt, Human
cugcaaauaccuaguuaucug

SEQ ID NO: 443885 - RNA, 22 nt, Human
augugugugcauuucucucccu

SEQ ID NO: 443886 - RNA, 22 nt, Human
uggaaugacagagagucugaau

SEQ ID NO: 443887 - RNA, 22 nt, Human
ccucugaggugagcccagcugg

SEQ ID NO: 443888 - RNA, 19 nt, Human
aagagucacaggcagcccu

SEQ ID NO: 443889 - RNA, 22 nt, Human
ccuccugggcuccugucugcac

SEQ ID NO: 443890 - RNA, 22 nt, Human
gaaaggagucagucuuacugaa

SEQ ID NO: 443891 - RNA, 22 nt, Human
ggagguagccucaaaagcagcu

SEQ ID NO: 443892 - RNA, 22 nt, Human
uucacaagucuggaauaugcua

SEQ ID NO: 443893 - RNA, 22 nt, Human
ugauuucuuccuugucauuaga

SEQ ID NO: 443894 - RNA, 22 nt, Human
uucuagaagugucuaugucugu

SEQ ID NO: 443895 - RNA, 22 nt, Human
cucuccccgguacgagcggccg

SEQ ID NO: 443896 - RNA, 22 nt, Human
gagcugccuguugcauagcaac

SEQ ID NO: 443897 - RNA, 22 nt, Human
aaugcaaacuucuuguuacuug

SEQ ID NO: 443898 - RNA, 22 nt, Human
ggcccugggcccucuagcuugu

SEQ ID NO: 443899 - RNA, 22 nt, Human
gcugaagcagauccaggugugg

SEQ ID NO: 443900 - RNA, 22 nt, Human
aauagcauguaaguuuaaaaga

SEQ ID NO: 443901 - RNA, 22 nt, Human
uaaaugcaguuaguacuugcca

SEQ ID NO: 443902 - RNA, 22 nt, Human
cugcaggcaucuaacugugggc

SEQ ID NO: 443903 - RNA, 22 nt, Human
gcaaaugcucuccuuggucagg

SEQ ID NO: 443904 - RNA, 22 nt, Human
gugcaauauugccauguucuug

SEQ ID NO: 443905 - RNA, 22 nt, Human
ggcucuggaaaguguccuugau

SEQ ID NO: 443906 - RNA, 22 nt, Human
ccagagcugcauccagcagguu

SEQ ID NO: 443907 - RNA, 22 nt, Human
acaggccuauguuccauugcag

SEQ ID NO: 443908 - RNA, 22 nt, Human
uguggccaccagagcugcuauu

SEQ ID NO: 443909 - RNA, 22 nt, Human
auaugacauaaaaucauuuuug

SEQ ID NO: 443910 - RNA, 22 nt, Human
cgcagcugcacggggcugagcc

SEQ ID NO: 443911 - RNA, 22 nt, Human
gcacagagggcagugagccucu

SEQ ID NO: 443912 - RNA, 22 nt, Human
uuucucaaguacugcacaugaa

SEQ ID NO: 443913 - RNA, 22 nt, Human
cccugccugugggcaucaacau

SEQ ID NO: 443914 - RNA, 22 nt, Human
uuauuuacaacucuucucuucc

SEQ ID NO: 443915 - RNA, 22 nt, Human
gccagagcacaggcugguagua

SEQ ID NO: 443916 - RNA, 22 nt, Human
auucagcaugcaauuagguaau

SEQ ID NO: 443917 - RNA, 22 nt, Human
aggcuggcugagcugcagccug

SEQ ID NO: 443918 - RNA, 22 nt, Human
acuguguggaccacucugaggc

SEQ ID NO: 443919 - RNA, 22 nt, Human
uuuauacauggagaauuuuugc

SEQ ID NO: 443920 - RNA, 22 nt, Human
ugcagaagugagucaugaggaa

SEQ ID NO: 443921 - RNA, 22 nt, Human
gccuggugguauccuggcaaga

SEQ ID NO: 443922 - RNA, 22 nt, Human
acuuugcagcugaggacauuuc

SEQ ID NO: 443923 - RNA, 19 nt, Human
ccuccccuuggaccagcaa

SEQ ID NO: 443924 - RNA, 22 nt, Human
ucaggagcagggggaagcucug

SEQ ID NO: 443925 - RNA, 22 nt, Human
ugggugcuucgucagcucugag

SEQ ID NO: 443926 - RNA, 22 nt, Human
gcuggugcauuagcugcaguuc

SEQ ID NO: 443927 - RNA, 22 nt, Human
cagguccuuuaguguccagaac

SEQ ID NO: 443928 - RNA, 22 nt, Human
ugaggcaggaguucaggcugcg

SEQ ID NO: 443929 - RNA, 22 nt, Human
ugcccagcugucaaaguagaua

SEQ ID NO: 443930 - RNA, 22 nt, Human
ccauuuugucuccugaaaucua

SEQ ID NO: 443931 - RNA, 22 nt, Human
cgccggcuugaggcaggcggca

SEQ ID NO: 443932 - RNA, 22 nt, Human
agcccuccuuuguucaugcugc

SEQ ID NO: 443933 - RNA, 22 nt, Human
uauuguacugaggaauaaagcu

SEQ ID NO: 443934 - RNA, 22 nt, Human
uuuuuugucuugaagaaauggu

SEQ ID NO: 443935 - RNA, 22 nt, Human
gaacacugagaaagucagcuuu

SEQ ID NO: 443936 - RNA, 22 nt, Human
agaggcaggagguugacuugag

SEQ ID NO: 443937 - RNA, 22 nt, Human
uggaaagagguagaggaucugg

SEQ ID NO: 443938 - RNA, 22 nt, Human
aagcagagcaagcguauuuauu

SEQ ID NO: 443939 - RNA, 20 nt, Human
guaaaauauggucuuugggu

SEQ ID NO: 443940 - RNA, 20 nt, Human
aacuuugcauuuuauucucc

SEQ ID NO: 443941 - RNA, 22 nt, Human
uuauaguaugugcauaugugug

SEQ ID NO: 443942 - RNA, 22 nt, Human
aguuuucucacaucaaaaauga

SEQ ID NO: 443943 - RNA, 22 nt, Human
aggggcugccuggcuuggcacu

SEQ ID NO: 443944 - RNA, 22 nt, Human
ggcagcagaacuggcccuguau

SEQ ID NO: 443945 - RNA, 22 nt, Human
cauguuuucuaggcuuucacaa

SEQ ID NO: 443946 - RNA, 22 nt, Human
ugugaauaccuugaauucauca

SEQ ID NO: 443947 - RNA, 22 nt, Human
acauaauaggugccugaauauu

SEQ ID NO: 443948 - RNA, 22 nt, Human
ggccugggcccacugucaagag

SEQ ID NO: 443949 - RNA, 22 nt, Human
agugcaggccccaggccaggcc

SEQ ID NO: 443950 - RNA, 17 nt, Human
ugagaaguaggcaucau

SEQ ID NO: 443951 - RNA, 22 nt, Human
caguaucuugcuuauagacaca

SEQ ID NO: 443952 - RNA, 20 nt, Human
ccacaggaguccagucgacc

SEQ ID NO: 443953 - RNA, 23 nt, Human
uuauugcauccaaaugcauuccu

SEQ ID NO: 443954 - RNA, 21 nt, Human
ugcagcagaguaagcagggga

SEQ ID NO: 443955 - RNA, 22 nt, Human
auugaagagaagcuaaauagag

SEQ ID NO: 443956 - RNA, 22 nt, Human
cagcugagaccagaaugcaggu

SEQ ID NO: 443957 - RNA, 22 nt, Human
cagcugagaaaggcaggcucac

SEQ ID NO: 443958 - RNA, 22 nt, Human
cacauuuaagugcuuguucaga

SEQ ID NO: 443959 - RNA, 22 nt, Human
ucaguccucucuggguuucuua

SEQ ID NO: 443960 - RNA, 22 nt, Human
guggcagagguuccucagugug

SEQ ID NO: 443961 - RNA, 22 nt, Human
ggccaggugcgguggcucacac

SEQ ID NO: 443962 - RNA, 22 nt, Human
uuugguuuuuaccugcugagag

SEQ ID NO: 443963 - RNA, 22 nt, Human
gcaagcagcccagaacagcucu

SEQ ID NO: 443964 - RNA, 22 nt, Human
acugcauuugguaaagucaaga

SEQ ID NO: 443965 - RNA, 22 nt, Human
ugagcaauaugugaauuuucuu

SEQ ID NO: 443966 - RNA, 22 nt, Human
cugaggucaauuaaucaacaac

SEQ ID NO: 443967 - RNA, 22 nt, Human
uucuaaauuuuggaagaugcag

SEQ ID NO: 443968 - RNA, 19 nt, Human
agccuggagggcuggucac

SEQ ID NO: 443969 - RNA, 22 nt, Human
gguggcagcgucuaucugacau

SEQ ID NO: 443970 - RNA, 22 nt, Human
uucagagaugacaccugguguu

SEQ ID NO: 443971 - RNA, 22 nt, Human
auuugcauaauagugauuugua

SEQ ID NO: 443972 - RNA, 22 nt, Human
gagcucuggcagggcaggucug

SEQ ID NO: 443973 - RNA, 22 nt, Human
aaggaagaggcagguuuugcug

SEQ ID NO: 443974 - RNA, 22 nt, Human
auguagaacagguuaaugacag

SEQ ID NO: 443975 - RNA, 22 nt, Human
uggagcaggccggaaguggcuu

SEQ ID NO: 443976 - RNA, 19 nt, Human
cugcugggugcugagggag

SEQ ID NO: 443977 - RNA, 22 nt, Human
cuuuauuccuacaagauuuucu

SEQ ID NO: 443978 - RNA, 22 nt, Human
aagcacaggagacgcacagcca

SEQ ID NO: 443979 - RNA, 22 nt, Human
aaaacacugccugcuugacuga

SEQ ID NO: 443980 - RNA, 22 nt, Human
aagaacugugcuccaggcucca

SEQ ID NO: 443981 - RNA, 22 nt, Human
cccccaggcucugacacaggag

SEQ ID NO: 443982 - RNA, 22 nt, Human
ccugggcuggaguacagcagug

SEQ ID NO: 443983 - RNA, 22 nt, Human
gcucuccaaacccuguggcuuu

SEQ ID NO: 443984 - RNA, 22 nt, Human
uggcauuugcucccuuguguuc

SEQ ID NO: 443985 - RNA, 22 nt, Human
auuugcaaagucguaucuguga

SEQ ID NO: 443986 - RNA, 22 nt, Human
cuggcuccacucccugccugac

SEQ ID NO: 443987 - RNA, 22 nt, Human
acugcauuaucaccaagaugua

SEQ ID NO: 443988 - RNA, 22 nt, Human
uccucagcaaacacuucacucu

SEQ ID NO: 443989 - RNA, 22 nt, Human
aggucucugaguacugcuggac

SEQ ID NO: 443990 - RNA, 22 nt, Human
acagcagccagccacugugagc

SEQ ID NO: 443991 - RNA, 22 nt, Human
ugggcagauguccucugaagug

SEQ ID NO: 443992 - RNA, 23 nt, Human
ggcaccaggccauggagcgggag

SEQ ID NO: 443993 - RNA, 22 nt, Human
acaaaugaacauauaagcuuga

SEQ ID NO: 443994 - RNA, 22 nt, Human
cagcagcacucugcgggucccc

SEQ ID NO: 443995 - RNA, 22 nt, Human
uuuguaaaggccugaauuucag

SEQ ID NO: 443996 - RNA, 22 nt, Human
ccucagggucugaggagaccgu

SEQ ID NO: 443997 - RNA, 22 nt, Human
aguuggguuugugucaguugca

SEQ ID NO: 443998 - RNA, 22 nt, Human
cauucagagcuuucuuaucaua

SEQ ID NO: 443999 - RNA, 22 nt, Human
ggaaaagaaagggacugauugg

SEQ ID NO: 444000 - RNA, 22 nt, Human
cacaggaauaagucaaacuuca

SEQ ID NO: 444001 - RNA, 22 nt, Human
aaacaucaccauuuuaccuaau

SEQ ID NO: 444002 - RNA, 22 nt, Human
agccaagcacucaacuccugga

SEQ ID NO: 444003 - RNA, 22 nt, Human
ucaggcuggaaugcaguggggc

SEQ ID NO: 444004 - RNA, 22 nt, Human
uggggacagggcucagcaauuu

SEQ ID NO: 444005 - RNA, 19 nt, Human
ugagaagguuuccgugggu

SEQ ID NO: 444006 - RNA, 22 nt, Human
cccugggcagucugcacuucag

SEQ ID NO: 444007 - RNA, 22 nt, Human
auggaggaugugcagcaugggc

SEQ ID NO: 444008 - RNA, 22 nt, Human
guguaaguaucuuuguaucuuu

SEQ ID NO: 444009 - RNA, 22 nt, Human
gagaggaacucccagugccugg

SEQ ID NO: 444010 - RNA, 19 nt, Human
uuggaaggagccagagugg

SEQ ID NO: 444011 - RNA, 22 nt, Human
gcaacauugcuucugaacauag

SEQ ID NO: 444012 - RNA, 22 nt, Human
gagacacaagaagacaugcaca

SEQ ID NO: 444013 - RNA, 22 nt, Human
agccaaagaucagugugcaagu

SEQ ID NO: 444014 - RNA, 22 nt, Human
cccugggcaagcccuauuuucc

SEQ ID NO: 444015 - RNA, 22 nt, Human
aaugcuuugucugcuccagacu

SEQ ID NO: 444016 - RNA, 22 nt, Human
aaaagugaugggauggcacuuc

SEQ ID NO: 444017 - RNA, 22 nt, Human
uugacaaagauauauucaugcu

SEQ ID NO: 444018 - RNA, 20 nt, Human
gaggccucagccucagcucc

SEQ ID NO: 444019 - RNA, 22 nt, Human
uucaauagaaaugacauucuuu

SEQ ID NO: 444020 - RNA, 22 nt, Human
ugaauucugcuguagcaagucc

SEQ ID NO: 444021 - RNA, 22 nt, Human
ugaauaugcuuugcaauccuaa

SEQ ID NO: 444022 - RNA, 22 nt, Human
uggggcagggaugggaaacuau

SEQ ID NO: 444023 - RNA, 22 nt, Human
ccagcucuaaacggcucugugg

SEQ ID NO: 444024 - RNA, 22 nt, Human
ccagaaaacucuacaugcuugu

SEQ ID NO: 444025 - RNA, 22 nt, Human
uccugugucucagcgugaagca

SEQ ID NO: 444026 - RNA, 22 nt, Human
uaacacuauccagauaugauaa

SEQ ID NO: 444027 - RNA, 22 nt, Human
ugcagcuguaacagaggccuca

SEQ ID NO: 444028 - RNA, 22 nt, Human
uucaaguagcuaaauuagcugc

SEQ ID NO: 444029 - RNA, 22 nt, Human
acagcaagccagcuugucacug

SEQ ID NO: 444030 - RNA, 22 nt, Human
gcccugcugucuucagaguaua

SEQ ID NO: 444031 - RNA, 22 nt, Human
auaauggcuucugaguauuagg

SEQ ID NO: 444032 - RNA, 20 nt, Human
gcaaggcacagugaggaggg

SEQ ID NO: 444033 - RNA, 22 nt, Human
cauuugcauaugaagaaguaag

SEQ ID NO: 444034 - RNA, 22 nt, Human
ucccagagcucuggagguugga

SEQ ID NO: 444035 - RNA, 22 nt, Human
gccuggaguacuccuugaagug

SEQ ID NO: 444036 - RNA, 22 nt, Human
cuuugcaagggauuucaugucu

SEQ ID NO: 444037 - RNA, 22 nt, Human
ugacacagaaauuaagcuguca

SEQ ID NO: 444038 - RNA, 22 nt, Human
auucacacacauuuagagcaga

SEQ ID NO: 444039 - RNA, 22 nt, Human
ugccagggagcccugcugacca

SEQ ID NO: 444040 - RNA, 22 nt, Human
ggcagaggaaggaugaauucac

SEQ ID NO: 444041 - RNA, 18 nt, Human
cugugggcuggugcauga

SEQ ID NO: 444042 - RNA, 22 nt, Human
cagagggccaucucuaucuuca

SEQ ID NO: 444043 - RNA, 22 nt, Human
ugugaauauacuuaaugccacu

SEQ ID NO: 444044 - RNA, 22 nt, Human
uuacaguaccuguauggccacu

SEQ ID NO: 444045 - RNA, 22 nt, Human
uugcagcuguuacugauagaua

SEQ ID NO: 444046 - RNA, 22 nt, Human
uguauuucaauuuuagcaccaa

SEQ ID NO: 444047 - RNA, 22 nt, Human
cugucaguaggcucccaucauu

SEQ ID NO: 444048 - RNA, 22 nt, Human
auugcuuuuagugaaauuauau

SEQ ID NO: 444049 - RNA, 22 nt, Human
acauggugugcugagaaugaca

SEQ ID NO: 444050 - RNA, 22 nt, Human
agucaguguucuccggagaggc

SEQ ID NO: 444051 - RNA, 16 nt, Human
ugggcagaugagaaga

SEQ ID NO: 444052 - RNA, 22 nt, Human
cguguguguaccugcgcauuua

SEQ ID NO: 444053 - RNA, 22 nt, Human
acaggucaacgagagcaggcaa

SEQ ID NO: 444054 - RNA, 22 nt, Human
aguguccaacucagcuugucaa

SEQ ID NO: 444055 - RNA, 18 nt, Human
uguuuccuccuggaggcu

SEQ ID NO: 444056 - RNA, 22 nt, Human
gagggcacucgagacuacggca

SEQ ID NO: 444057 - RNA, 22 nt, Human
aaaugcauguauguaauaugcu

SEQ ID NO: 444058 - RNA, 22 nt, Human
uugcagaagggcacagugauca

SEQ ID NO: 444059 - RNA, 22 nt, Human
ucagucuauccagcucagaucc

SEQ ID NO: 444060 - RNA, 18 nt, Human
cagucccaaaccuuagga

SEQ ID NO: 444061 - RNA, 22 nt, Human
uuaauuuauguccaaaccagau

SEQ ID NO: 444062 - RNA, 22 nt, Human
aguuucuagcaaggauuguuga

SEQ ID NO: 444063 - RNA, 22 nt, Human
aaauuuuguauucuaguucuag

SEQ ID NO: 444064 - RNA, 22 nt, Human
caguguccucagccagcagcua

SEQ ID NO: 444065 - RNA, 22 nt, Human
guguuaaaaaucccaugauaug

SEQ ID NO: 444066 - RNA, 22 nt, Human
auaugacagcggauucacauau

SEQ ID NO: 444067 - RNA, 22 nt, Human
ucugaggcauacccaggccccc

SEQ ID NO: 444068 - RNA, 22 nt, Human
aaggcaauuuggaagaggcaga

SEQ ID NO: 444069 - RNA, 22 nt, Human
gaggagcuggcagcgucuccgc

SEQ ID NO: 444070 - RNA, 22 nt, Human
cacagaaguguguauaacucuu

SEQ ID NO: 444071 - RNA, 20 nt, Human
ucugucucugagcuagacuu

SEQ ID NO: 444072 - RNA, 22 nt, Human
aggccagcaagaaagagagucu

SEQ ID NO: 444073 - RNA, 22 nt, Human
aauuucaauuacuuuugcacca

SEQ ID NO: 444074 - RNA, 22 nt, Human
acuaggagaaaacuuacacuga

SEQ ID NO: 444075 - RNA, 22 nt, Human
agacccugcaccucucgugggc

SEQ ID NO: 444076 - RNA, 22 nt, Human
aggaaaggccuuugcauuuggu

SEQ ID NO: 444077 - RNA, 23 nt, Human
cucccuggaguuucuggaagaug

SEQ ID NO: 444078 - RNA, 22 nt, Human
aggcagcuggaggcagagacua

SEQ ID NO: 444079 - RNA, 22 nt, Human
uuaacauccuguuuaaauuugg

SEQ ID NO: 444080 - RNA, 22 nt, Human
aggcacagauuuggggaaagca

SEQ ID NO: 444081 - RNA, 22 nt, Human
auauucacuggguacuaaaaag

SEQ ID NO: 444082 - RNA, 22 nt, Human
acagcagagacacucaggaggc

SEQ ID NO: 444083 - RNA, 22 nt, Human
gugcauaugguuacagcaccgc

SEQ ID NO: 444084 - RNA, 22 nt, Human
acuucucuucauagguggcaau

SEQ ID NO: 444085 - RNA, 22 nt, Human
aauaaauguuaagauugucuca

SEQ ID NO: 444086 - RNA, 22 nt, Human
agcagccccucggcgggugcgc

SEQ ID NO: 444087 - RNA, 22 nt, Human
agagggagcccagucauagcug

SEQ ID NO: 444088 - RNA, 22 nt, Human
ggcaagcauaaccuguacagcc

SEQ ID NO: 444089 - RNA, 22 nt, Human
aaggcagaaagggaugugagug

SEQ ID NO: 444090 - RNA, 22 nt, Human
cagcccaggccgacaguuccuc

SEQ ID NO: 444091 - RNA, 22 nt, Human
agggaugauggaaagaagcagg

SEQ ID NO: 444092 - RNA, 22 nt, Human
cuuaaucucaccugcaaagucc

SEQ ID NO: 444093 - RNA, 22 nt, Human
uuaagcauuuauuaugugccag

SEQ ID NO: 444094 - RNA, 22 nt, Human
cgcugccaggauccccugccgg

SEQ ID NO: 444095 - RNA, 22 nt, Human
aagccagauuucacucuuaauu

SEQ ID NO: 444096 - RNA, 22 nt, Human
acuuggcaaguaucuauaaagu

SEQ ID NO: 444097 - RNA, 22 nt, Human
cagaacugggcagggagcagag

SEQ ID NO: 444098 - RNA, 22 nt, Human
aaaugcacagguuuuaaauccu

SEQ ID NO: 444099 - RNA, 22 nt, Human
ccuggagcaggagcugcagagg

SEQ ID NO: 444100 - RNA, 22 nt, Human
agcagggcugcagugugucuuu

SEQ ID NO: 444101 - RNA, 22 nt, Human
cucucuggaagggggagcugau

SEQ ID NO: 444102 - RNA, 22 nt, Human
acagaguauuggaaaggcagug

SEQ ID NO: 444103 - RNA, 16 nt, Human
uugcccacuuguucau

SEQ ID NO: 444104 - RNA, 22 nt, Human
cagagcuggguuugggaaaccu

SEQ ID NO: 444105 - RNA, 22 nt, Human
caguccucucacucaggccuuu

SEQ ID NO: 444106 - RNA, 20 nt, Human
agcccuguuuccuggagaga

SEQ ID NO: 444107 - RNA, 22 nt, Human
gagcagugacuggagcaugaga

SEQ ID NO: 444108 - RNA, 22 nt, Human
cugggaggcggagguuguagug

SEQ ID NO: 444109 - RNA, 22 nt, Human
ugcaggcucaccugccagggcc

SEQ ID NO: 444110 - RNA, 23 nt, Human
uugcaaauuucaguuaguucaug

SEQ ID NO: 444111 - RNA, 22 nt, Human
agauuccuaguguuauuucugu

SEQ ID NO: 444112 - RNA, 22 nt, Human
acacauuucuaaauuuuuaccg

SEQ ID NO: 444113 - RNA, 22 nt, Human
caguuacucaauaauucuugcg

SEQ ID NO: 444114 - RNA, 16 nt, Human
ggcagcagcuccgugc

SEQ ID NO: 444115 - RNA, 22 nt, Human
caugcagcaggaucucauuccc

SEQ ID NO: 444116 - RNA, 22 nt, Human
uaaaggcacugcgucccucaaa

SEQ ID NO: 444117 - RNA, 22 nt, Human
gcaggcugccaccuucugaguu

SEQ ID NO: 444118 - RNA, 20 nt, Human
gugucuggaguacuagagag

SEQ ID NO: 444119 - RNA, 22 nt, Human
guaggcagucucucaggugauc

SEQ ID NO: 444120 - RNA, 22 nt, Human
uuaauaaaguaugaauuggaaa

SEQ ID NO: 444121 - RNA, 22 nt, Human
aaugacaagacauagucucuga

SEQ ID NO: 444122 - RNA, 22 nt, Human
aggcagcguagcaaggcuagua

SEQ ID NO: 444123 - RNA, 22 nt, Human
gagauggcucucagaucuuuga

SEQ ID NO: 444124 - RNA, 22 nt, Human
ucccagccaggcucuaccacuu

SEQ ID NO: 444125 - RNA, 22 nt, Human
gcuggccauucucuuugagaug

SEQ ID NO: 444126 - RNA, 22 nt, Human
gcucagagguuguucuuggguu

SEQ ID NO: 444127 - RNA, 22 nt, Human
gcaacaggcaguuugcucaugu

SEQ ID NO: 444128 - RNA, 22 nt, Human
acaagguauccacauuaaaugu

SEQ ID NO: 444129 - RNA, 17 nt, Human
ccacacccuuuccuucc

SEQ ID NO: 444130 - RNA, 22 nt, Human
uauauuaacacccacuugccuc

SEQ ID NO: 444131 - RNA, 22 nt, Human
cccagcucaucaggagccgccc

SEQ ID NO: 444132 - RNA, 22 nt, Human
ugggcagaucuuugguggcuag

SEQ ID NO: 444133 - RNA, 22 nt, Human
cccugagcauucaugugagcuu

SEQ ID NO: 444134 - RNA, 18 nt, Human
aaaauaacaaaguuggcu

SEQ ID NO: 444135 - RNA, 22 nt, Human
ugcaacaggcugugacauggaa

SEQ ID NO: 444136 - RNA, 22 nt, Human
ucuuccucccuacagagcucag

SEQ ID NO: 444137 - RNA, 22 nt, Human
uugcagcuucgagucuaucugu

SEQ ID NO: 444138 - RNA, 22 nt, Human
uggcuacagaauuggcccuguu

SEQ ID NO: 444139 - RNA, 22 nt, Human
auuccucagcaggccuuuuguu

SEQ ID NO: 444140 - RNA, 22 nt, Human
uucacaauuucccuucaucagg

SEQ ID NO: 444141 - RNA, 22 nt, Human
aggccuggccuuuauguucaag

SEQ ID NO: 444142 - RNA, 22 nt, Human
ccugggcucugaggagggaguc

SEQ ID NO: 444143 - RNA, 22 nt, Human
cuucugggcauucagcugcaca

SEQ ID NO: 444144 - RNA, 22 nt, Human
acagcaguggguugccaguggg

SEQ ID NO: 444145 - RNA, 22 nt, Human
gugacccaugcagugguuuugg

SEQ ID NO: 444146 - RNA, 22 nt, Human
cccuggcucugccucagagccc

SEQ ID NO: 444147 - RNA, 21 nt, Human
uguccaagguaugcacugggg

SEQ ID NO: 444148 - RNA, 22 nt, Human
cuccaaggaagccccaagggau

SEQ ID NO: 444149 - RNA, 22 nt, Human
ucaggaaaauacugcuuaucca

SEQ ID NO: 444150 - RNA, 22 nt, Human
caggagcagaggguggucagca

SEQ ID NO: 444151 - RNA, 23 nt, Human
aggaaguuaaggcagacagacag

SEQ ID NO: 444152 - RNA, 22 nt, Human
guggagcaugugaggacugagu

SEQ ID NO: 444153 - RNA, 22 nt, Human
ggcaguggcuccucucuacucc

SEQ ID NO: 444154 - RNA, 23 nt, Human
ggccauggagacuuagaaugggc

SEQ ID NO: 444155 - RNA, 22 nt, Human
agggcagaggcggacacggaag

SEQ ID NO: 444156 - RNA, 19 nt, Human
uguggccaugguucagcug

SEQ ID NO: 444157 - RNA, 22 nt, Human
aaagucacuuccuucugucagc

SEQ ID NO: 444158 - RNA, 22 nt, Human
gcuccagggacccaagagaaaa

SEQ ID NO: 444159 - RNA, 22 nt, Human
cuagggucaggggccugcgucg

SEQ ID NO: 444160 - RNA, 22 nt, Human
uaacuuuaguguaugagguaag

SEQ ID NO: 444161 - RNA, 22 nt, Human
cugggcacuuuggggagccuac

SEQ ID NO: 444162 - RNA, 22 nt, Human
gccugccugaaggcuguaccag

SEQ ID NO: 444163 - RNA, 22 nt, Human
ccagcagaggggcggagugcag

SEQ ID NO: 444164 - RNA, 22 nt, Human
guuaacauaggaguuuguugua

SEQ ID NO: 444165 - RNA, 22 nt, Human
aggaagggcuguuucuccaaga

SEQ ID NO: 444166 - RNA, 22 nt, Human
cagcaggcccaggugcugguga

SEQ ID NO: 444167 - RNA, 22 nt, Human
augaggagucaaggagucggag

SEQ ID NO: 444168 - RNA, 22 nt, Human
gaagcaaaaugucugcacauau

SEQ ID NO: 444169 - RNA, 22 nt, Human
ccagcccuugaggucuguccau

SEQ ID NO: 444170 - RNA, 22 nt, Human
ugucagugaguuggguccugag

SEQ ID NO: 444171 - RNA, 22 nt, Human
ggcagggucuggacugaaagcu

SEQ ID NO: 444172 - RNA, 22 nt, Human
caggcuguggaucaggagccuu

SEQ ID NO: 444173 - RNA, 22 nt, Human
gggacuggcacagggcugggag

SEQ ID NO: 444174 - RNA, 22 nt, Human
gugacagaguuuuagaucucau

SEQ ID NO: 444175 - RNA, 22 nt, Human
gcacagcucgagcucaggaggg

SEQ ID NO: 444176 - RNA, 22 nt, Human
gagccucguggcggccacugcg

SEQ ID NO: 444177 - RNA, 22 nt, Human
gaccacugaugacaugaggaga

SEQ ID NO: 444178 - RNA, 22 nt, Human
ugcagaaguauuccaggcccca

SEQ ID NO: 444179 - RNA, 22 nt, Human
gugcauguuaaugguguacaaa

SEQ ID NO: 444180 - RNA, 22 nt, Human
acagauguaaucuauucacauu

SEQ ID NO: 444181 - RNA, 22 nt, Human
ugaguccuaaagcugugcccuu

SEQ ID NO: 444182 - RNA, 22 nt, Human
uuaacaguuaaacaauuggcua

SEQ ID NO: 444183 - RNA, 22 nt, Human
ggcaaacacaccucggugagaa

SEQ ID NO: 444184 - RNA, 22 nt, Human
caauuucagaccuuuccuugga

SEQ ID NO: 444185 - RNA, 22 nt, Human
ucagaaaccagcucucucaauu

SEQ ID NO: 444186 - RNA, 22 nt, Human
uuuacagucaccaaacuuugcu

SEQ ID NO: 444187 - RNA, 22 nt, Human
ggcaggacagucccaguucaaa

SEQ ID NO: 444188 - RNA, 21 nt, Human
ggugcucgcugaugaggagug

SEQ ID NO: 444189 - RNA, 22 nt, Human
cugaggccucucuccugggcuu

SEQ ID NO: 444190 - RNA, 22 nt, Human
aagcccuguucuuucucucacc

SEQ ID NO: 444191 - RNA, 22 nt, Human
augcauauagaacauuugacau

SEQ ID NO: 444192 - RNA, 22 nt, Human
aaaguuuuguugauuguggaau

SEQ ID NO: 444193 - RNA, 23 nt, Human
gcucagguggcucagggacugau

SEQ ID NO: 444194 - RNA, 22 nt, Human
agagaugacugauggcugauua

SEQ ID NO: 444195 - RNA, 22 nt, Human
cuggcagucugguggaaggccu

SEQ ID NO: 444196 - RNA, 21 nt, Human
agggcagauuagcuguaagag

SEQ ID NO: 444197 - RNA, 22 nt, Human
caggcauggagaggcagagacu

SEQ ID NO: 444198 - RNA, 22 nt, Human
uuuggggcucagcaggcuguuu

SEQ ID NO: 444199 - RNA, 22 nt, Human
uucaacauguucuacauaaggg

SEQ ID NO: 444200 - RNA, 17 nt, Human
ugaggccugcaucagug

SEQ ID NO: 444201 - RNA, 22 nt, Human
gcucccaccuccagccugaguu

SEQ ID NO: 444202 - RNA, 22 nt, Human
aacuuuuaaaauacacagacaa

SEQ ID NO: 444203 - RNA, 22 nt, Human
aggaagcugccugggaugggaa

SEQ ID NO: 444204 - RNA, 22 nt, Human
guuuauacagugcaugguguua

SEQ ID NO: 444205 - RNA, 22 nt, Human
cuucaguucuaaaguagaaugu

SEQ ID NO: 444206 - RNA, 22 nt, Human
uuuagcaauuagaauccagcau

SEQ ID NO: 444207 - RNA, 22 nt, Human
ccugccugcuuucugcuuugca

SEQ ID NO: 444208 - RNA, 22 nt, Human
uugcaaauuauauaagggaugc

SEQ ID NO: 444209 - RNA, 22 nt, Human
uauugcaagcaauuccaaaagg

SEQ ID NO: 444210 - RNA, 22 nt, Human
acaguaauuaaacauucugauu

SEQ ID NO: 444211 - RNA, 22 nt, Human
aagagcugcaucuaagccauga

SEQ ID NO: 444212 - RNA, 22 nt, Human
cagcuuguuaccgagggagggu

SEQ ID NO: 444213 - RNA, 22 nt, Human
gcuggcuggagugagcuacccu

SEQ ID NO: 444214 - RNA, 22 nt, Human
gcccagcaggacagagugguuu

SEQ ID NO: 444215 - RNA, 22 nt, Human
ugagacagcagucagggaaaua

SEQ ID NO: 444216 - RNA, 22 nt, Human
gggugagacagaaagagcaaaa

SEQ ID NO: 444217 - RNA, 22 nt, Human
aaugcagaguaaauauuuaauu

SEQ ID NO: 444218 - RNA, 22 nt, Human
agcuccugugugaagccucccu

SEQ ID NO: 444219 - RNA, 23 nt, Human
aauucaaauucagugugacuagg

SEQ ID NO: 444220 - RNA, 21 nt, Human
gaucuuuacuuuccuacuuac

SEQ ID NO: 444221 - RNA, 22 nt, Human
cagcccuuggcuggcuccuugc

SEQ ID NO: 444222 - RNA, 22 nt, Human
gcacagagcuuguuuacauuug

SEQ ID NO: 444223 - RNA, 22 nt, Human
ggacagcauaucagcagggcag

SEQ ID NO: 444224 - RNA, 22 nt, Human
gagccagccuucuucugagguc

SEQ ID NO: 444225 - RNA, 22 nt, Human
ugcacaaagcauucuagacgca

SEQ ID NO: 444226 - RNA, 22 nt, Human
gggcuucucccuaaggacucug

SEQ ID NO: 444227 - RNA, 22 nt, Human
auauuaaugggauuuagucagg

SEQ ID NO: 444228 - RNA, 22 nt, Human
agcccuucaaccugccuacucc

SEQ ID NO: 444229 - RNA, 22 nt, Human
uucccuuuguuaaauuggaaga

SEQ ID NO: 444230 - RNA, 22 nt, Human
aauagcaaacagacaugcacaa

SEQ ID NO: 444231 - RNA, 22 nt, Human
caagaauauaaauacuuucaaa

SEQ ID NO: 444232 - RNA, 22 nt, Human
cuguggagcuuguggcaguggg

SEQ ID NO: 444233 - RNA, 18 nt, Human
auacaagcucuguuacuu

SEQ ID NO: 444234 - RNA, 22 nt, Human
cauguucaucagaucaauugua

SEQ ID NO: 444235 - RNA, 22 nt, Human
agacagggccacucauccucac

SEQ ID NO: 444236 - RNA, 22 nt, Human
caguacuuggucaaggaagcag

SEQ ID NO: 444237 - RNA, 22 nt, Human
caggcacacauccgugagagau

SEQ ID NO: 444238 - RNA, 22 nt, Human
gacagucugggcacacaugaaa

SEQ ID NO: 444239 - RNA, 22 nt, Human
agcaguuuuuauaacacuggaa

SEQ ID NO: 444240 - RNA, 22 nt, Human
ugccagcaguagcaguaggcca

SEQ ID NO: 444241 - RNA, 22 nt, Human
cagcucccgccaucgggaggca

SEQ ID NO: 444242 - RNA, 22 nt, Human
gcuuugcacucugauccuuccc

SEQ ID NO: 444243 - RNA, 22 nt, Human
cgcagcugcugcucugaaacag

SEQ ID NO: 444244 - RNA, 22 nt, Human
gaaaggagugaauauuugugac

SEQ ID NO: 444245 - RNA, 22 nt, Human
cacaguacgcacccgauacaug

SEQ ID NO: 444246 - RNA, 22 nt, Human
aagcaggcucacgccaggcagu

SEQ ID NO: 444247 - RNA, 22 nt, Human
ugcaauaaggaguaauaguaaa

SEQ ID NO: 444248 - RNA, 22 nt, Human
ugggcucugguuuccuggcugg

SEQ ID NO: 444249 - RNA, 22 nt, Human
aguuuuucuccccuggcuucau

SEQ ID NO: 444250 - RNA, 19 nt, Human
cucagucuggcucugccug

SEQ ID NO: 444251 - RNA, 22 nt, Human
cccgagugucuacucacuccca

SEQ ID NO: 444252 - RNA, 20 nt, Human
guuuuucuugggcgagcuau

SEQ ID NO: 444253 - RNA, 21 nt, Human
agcagcagcaguggggcuucu

SEQ ID NO: 444254 - RNA, 22 nt, Human
auaaaggccaaaauuugcauuu

SEQ ID NO: 444255 - RNA, 22 nt, Human
ucuuaagaaagugacaaauagg

SEQ ID NO: 444256 - RNA, 22 nt, Human
uggcaggcaaguucagcuccac

SEQ ID NO: 444257 - RNA, 22 nt, Human
agagcugaggauccagcugagc

SEQ ID NO: 444258 - RNA, 22 nt, Human
uuucuaguaaucaauauaaagu

SEQ ID NO: 444259 - RNA, 22 nt, Human
ucaugcaguuucuuaucugcca

SEQ ID NO: 444260 - RNA, 19 nt, Human
gcuuuggagggagguucua

SEQ ID NO: 444261 - RNA, 22 nt, Human
ucauucaagauuucaauagauu

SEQ ID NO: 444262 - RNA, 22 nt, Human
cuugaugagucagaacugaagg

SEQ ID NO: 444263 - RNA, 22 nt, Human
ucuuuaugagaaaaagauugua

SEQ ID NO: 444264 - RNA, 22 nt, Human
uauuuccagaggaguauagaag

SEQ ID NO: 444265 - RNA, 22 nt, Human
cuggcuccucaguauuccacuu

SEQ ID NO: 444266 - RNA, 22 nt, Human
gacaggcaggccagggcugugg

SEQ ID NO: 444267 - RNA, 22 nt, Human
ugcaaauauuccaugcuguuca

SEQ ID NO: 444268 - RNA, 22 nt, Human
agagccugaggccaggaaaaug

SEQ ID NO: 444269 - RNA, 22 nt, Human
acaauuucugaucagugaauuu

SEQ ID NO: 444270 - RNA, 22 nt, Human
ucuuauaaucucuauuuuaaug

SEQ ID NO: 444271 - RNA, 22 nt, Human
gaaguauagcagauguuauuua

SEQ ID NO: 444272 - RNA, 22 nt, Human
uggccagcccuucagccaugcc

SEQ ID NO: 444273 - RNA, 22 nt, Human
ugacagcauaacacuggucuug

SEQ ID NO: 444274 - RNA, 22 nt, Human
auguuaaaugguuuauuauuaa

SEQ ID NO: 444275 - RNA, 22 nt, Human
acuaauugagugcaugaucuuu

SEQ ID NO: 444276 - RNA, 22 nt, Human
ugucccagguccuagaugacca

SEQ ID NO: 444277 - RNA, 22 nt, Human
auuuuacuaaguggauaucugu

SEQ ID NO: 444278 - RNA, 22 nt, Human
auacauucagcagugcucauga

SEQ ID NO: 444279 - RNA, 22 nt, Human
cccagggagguagcaggagaaa

SEQ ID NO: 444280 - RNA, 22 nt, Human
caggcccucguggugagcuggg

SEQ ID NO: 444281 - RNA, 22 nt, Human
cagugcauagauccugaggccu

SEQ ID NO: 444282 - RNA, 22 nt, Human
gcucagggaaagagcuccuguc

SEQ ID NO: 444283 - RNA, 19 nt, Human
ggcagaagguguaggggga

SEQ ID NO: 444284 - RNA, 22 nt, Human
agaaggaaggcugagugcugau

SEQ ID NO: 444285 - RNA, 22 nt, Human
agaggcuggauugagcauagac

SEQ ID NO: 444286 - RNA, 22 nt, Human
agcgagggaggucugaggacag

SEQ ID NO: 444287 - RNA, 22 nt, Human
ugacucuguaccugucugccuu

SEQ ID NO: 444288 - RNA, 22 nt, Human
uucaaacuuaaggagcagcaga

SEQ ID NO: 444289 - RNA, 22 nt, Human
aaguacauuauaugagcagaau

SEQ ID NO: 444290 - RNA, 22 nt, Human
ucacucaauaucccaguggggc

SEQ ID NO: 444291 - RNA, 22 nt, Human
acacugaauguuuaagaacuug

SEQ ID NO: 444292 - RNA, 22 nt, Human
agccccaggcccggacgccucu

SEQ ID NO: 444293 - RNA, 22 nt, Human
guggcagagccaaggcuggagc

SEQ ID NO: 444294 - RNA, 22 nt, Human
gaggugaaaguuauucauuuau

SEQ ID NO: 444295 - RNA, 22 nt, Human
caggcagcccugcaccaagugu

SEQ ID NO: 444296 - RNA, 22 nt, Human
ucuuuaaucauaaccaagaugg

SEQ ID NO: 444297 - RNA, 21 nt, Human
aaaaguuugacaggaaaggga

SEQ ID NO: 444298 - RNA, 22 nt, Human
agggcagagauuaauuaagaca

SEQ ID NO: 444299 - RNA, 22 nt, Human
ccugcacuaccuggggcugcug

SEQ ID NO: 444300 - RNA, 22 nt, Human
gagcccugcgugucugggggca

SEQ ID NO: 444301 - RNA, 22 nt, Human
agcuccugaaaauccagacugg

SEQ ID NO: 444302 - RNA, 22 nt, Human
aggccagcucacccuggcuccu

SEQ ID NO: 444303 - RNA, 22 nt, Human
uaaaacagcagggcagagaagu

SEQ ID NO: 444304 - RNA, 22 nt, Human
uuugaacaugcugcaugauaau

SEQ ID NO: 444305 - RNA, 22 nt, Human
cagcccuugggccauccuagaa

SEQ ID NO: 444306 - RNA, 22 nt, Human
aucucuaauuuaaaaaguaaca

SEQ ID NO: 444307 - RNA, 22 nt, Human
ucuccaggacugagcuccagcc

SEQ ID NO: 444308 - RNA, 22 nt, Human
ugccugggagugaccaagacuc

SEQ ID NO: 444309 - RNA, 22 nt, Human
cagaggaagcuggguguggagu

SEQ ID NO: 444310 - RNA, 22 nt, Human
uccuuuaucugcucagaaagua

SEQ ID NO: 444311 - RNA, 22 nt, Human
uucuuuuaauagagauccugug

SEQ ID NO: 444312 - RNA, 22 nt, Human
ugggccuggaguuuguccagag

SEQ ID NO: 444313 - RNA, 21 nt, Human
aggucccagguuugggcagca

SEQ ID NO: 444314 - RNA, 22 nt, Human
uggcacugggacagaugcucuc

SEQ ID NO: 444315 - RNA, 22 nt, Human
acagggaaggagcauagaaaaa

SEQ ID NO: 444316 - RNA, 22 nt, Human
aacaggaaacaaguuguuagga

SEQ ID NO: 444317 - RNA, 22 nt, Human
agcuggcccucgagagccaauu

SEQ ID NO: 444318 - RNA, 22 nt, Human
caauucaugugagcggacucuu

SEQ ID NO: 444319 - RNA, 22 nt, Human
gcuuugcaggaaaccagugcau

SEQ ID NO: 444320 - RNA, 22 nt, Human
uaaggcaugcuagcaguaugaa

SEQ ID NO: 444321 - RNA, 22 nt, Human
ucaauagaaaugcagagucuca

SEQ ID NO: 444322 - RNA, 22 nt, Human
gagggcccuggcuggcuccagc

SEQ ID NO: 444323 - RNA, 22 nt, Human
augacuucguuuucucucugca

SEQ ID NO: 444324 - RNA, 22 nt, Human
ugcauguggaccccuggugccu

SEQ ID NO: 444325 - RNA, 22 nt, Human
gcuuuagaaauaucacugugga

SEQ ID NO: 444326 - RNA, 19 nt, Human
acccagagcccuuugcagg

SEQ ID NO: 444327 - RNA, 22 nt, Human
ccugccuggaucagccauccug

SEQ ID NO: 444328 - RNA, 22 nt, Human
aggcccuuaggaccccugcgug

SEQ ID NO: 444329 - RNA, 22 nt, Human
aaguacaacgcauacagagaaa

SEQ ID NO: 444330 - RNA, 22 nt, Human
uaagagacuauugagcaucuug

SEQ ID NO: 444331 - RNA, 22 nt, Human
augacaaacccaggauguaaca

SEQ ID NO: 444332 - RNA, 22 nt, Human
ugccaaggguaugggcaagaua

SEQ ID NO: 444333 - RNA, 22 nt, Human
aaauucagcauccugcacugga

SEQ ID NO: 444334 - RNA, 17 nt, Human
cagcccugccguuccca

SEQ ID NO: 444335 - RNA, 22 nt, Human
aaugacaauaaucauuaacuuu

SEQ ID NO: 444336 - RNA, 22 nt, Human
cugcccagaagccagaugggca

SEQ ID NO: 444337 - RNA, 22 nt, Human
cagcacugcugcuguacacaca

SEQ ID NO: 444338 - RNA, 22 nt, Human
aucuugaaugaaugacucuuua

SEQ ID NO: 444339 - RNA, 22 nt, Human
cagcccuggugagguuggcuau

SEQ ID NO: 444340 - RNA, 22 nt, Human
ggccaggcuggucucagacuuc

SEQ ID NO: 444341 - RNA, 22 nt, Human
ggcagcugugaagugccucaca

SEQ ID NO: 444342 - RNA, 22 nt, Human
agagacagacacaucgggcugc

SEQ ID NO: 444343 - RNA, 22 nt, Human
cacagaggcucaaagccaggug

SEQ ID NO: 444344 - RNA, 21 nt, Human
agcagaggcagaauguaugca

SEQ ID NO: 444345 - RNA, 22 nt, Human
ggagggcugccagguggagcgg

SEQ ID NO: 444346 - RNA, 22 nt, Human
uucuguuacaagugaaaaaaug

SEQ ID NO: 444347 - RNA, 22 nt, Human
ccagcccuuugugguucacuga

SEQ ID NO: 444348 - RNA, 17 nt, Human
ucaggcugugccuggua

SEQ ID NO: 444349 - RNA, 22 nt, Human
ucagcagcagcucagcauguuu

SEQ ID NO: 444350 - RNA, 22 nt, Human
ccaccagcuuugccacccugcu

SEQ ID NO: 444351 - RNA, 22 nt, Human
gaggugaguggaucacgagguc

SEQ ID NO: 444352 - RNA, 22 nt, Human
uugguuuugggauguacaaagg

SEQ ID NO: 444353 - RNA, 22 nt, Human
gcacuucacaugccuuuuccug

SEQ ID NO: 444354 - RNA, 20 nt, Human
aggaagccaaaggcugucuu

SEQ ID NO: 444355 - RNA, 21 nt, Human
ugaaagaggauguggucauuc

SEQ ID NO: 444356 - RNA, 20 nt, Human
agcuguuuacauggauuucu

SEQ ID NO: 444357 - RNA, 22 nt, Human
uccuggguagagaccugaugaa

SEQ ID NO: 444358 - RNA, 22 nt, Human
caagguuccagaauuaugcucu

SEQ ID NO: 444359 - RNA, 22 nt, Human
aggcagcugaggucuggcgccc

SEQ ID NO: 444360 - RNA, 22 nt, Human
uggcagcuggagggcaauggcc

SEQ ID NO: 444361 - RNA, 22 nt, Human
uccaaguauaaauuagauacug

SEQ ID NO: 444362 - RNA, 20 nt, Human
caaggccuggaucuaguugc

SEQ ID NO: 444363 - RNA, 22 nt, Human
ugucuuaacauaaaaggaaauc

SEQ ID NO: 444364 - RNA, 22 nt, Human
agcagcaggaggccauugucuu

SEQ ID NO: 444365 - RNA, 22 nt, Human
cuuaacaugggggguaagucug

SEQ ID NO: 444366 - RNA, 22 nt, Human
acucugugugaguagagccugu

SEQ ID NO: 444367 - RNA, 22 nt, Human
ggcucugccauuuccuagcugc

SEQ ID NO: 444368 - RNA, 22 nt, Human
aagcugccuuccaugugaggaa

SEQ ID NO: 444369 - RNA, 22 nt, Human
ggcugccucugaugugcagacg

SEQ ID NO: 444370 - RNA, 22 nt, Human
ccugagagcccuagccaggcgc

SEQ ID NO: 444371 - RNA, 22 nt, Human
gcugccuguguggccacucacu

SEQ ID NO: 444372 - RNA, 22 nt, Human
auuucagaugaccaaauggaaa

SEQ ID NO: 444373 - RNA, 22 nt, Human
cugucaucacaguugagcagcc

SEQ ID NO: 444374 - RNA, 22 nt, Human
uugacuucagccuguacuugua

SEQ ID NO: 444375 - RNA, 22 nt, Human
aguucacagggaagguuauugu

SEQ ID NO: 444376 - RNA, 22 nt, Human
uuauucuucuucucuugccagg

SEQ ID NO: 444377 - RNA, 22 nt, Human
ucaggcccagagucacggaucc

SEQ ID NO: 444378 - RNA, 22 nt, Human
auucuuuagccagcagguauau

SEQ ID NO: 444379 - RNA, 19 nt, Human
caggacaguuugccaagaa

SEQ ID NO: 444380 - RNA, 22 nt, Human
gaauuuuaauaaagguuuauca

SEQ ID NO: 444381 - RNA, 22 nt, Human
guuuuguugcugcagagcucaa

SEQ ID NO: 444382 - RNA, 22 nt, Human
cagguggggggcuuccgagccu

SEQ ID NO: 444383 - RNA, 22 nt, Human
gacuuugccacugaccuccaac

SEQ ID NO: 444384 - RNA, 22 nt, Human
ugaagcuacaaaagauuauugc

SEQ ID NO: 444385 - RNA, 22 nt, Human
augcaguuuaaggcacaauuag

SEQ ID NO: 444386 - RNA, 22 nt, Human
caggccugucugcacaugaggc

SEQ ID NO: 444387 - RNA, 22 nt, Human
aauuucuaauugaaucucucuu

SEQ ID NO: 444388 - RNA, 22 nt, Human
gcucccagcaauugaggcagcc

SEQ ID NO: 444389 - RNA, 22 nt, Human
ggcagcccaccagcccacgucu

SEQ ID NO: 444390 - RNA, 22 nt, Human
guuuuacaagguuaaucagcag

SEQ ID NO: 444391 - RNA, 22 nt, Human
gguuccuggcagauguagggcu

SEQ ID NO: 444392 - RNA, 22 nt, Human
ccagcuggucugugcucauguu

SEQ ID NO: 444393 - RNA, 22 nt, Human
aagcagaaguugaucuaccaua

SEQ ID NO: 444394 - RNA, 22 nt, Human
uuguguguacugguuaugggca

SEQ ID NO: 444395 - RNA, 22 nt, Human
uuucagagaggcuucaaaucuu

SEQ ID NO: 444396 - RNA, 22 nt, Human
ugcugucccuaagucucuucaa

SEQ ID NO: 444397 - RNA, 22 nt, Human
gaggcugauucggggaacagca

SEQ ID NO: 444398 - RNA, 22 nt, Human
agcccugggcguuacugggaug

SEQ ID NO: 444399 - RNA, 22 nt, Human
ugggaggcccaggccuggcagg

SEQ ID NO: 444400 - RNA, 22 nt, Human
agcuaaggaugacuaguacuuc

SEQ ID NO: 444401 - RNA, 23 nt, Human
uuuauccaacucuguaaucucuc

SEQ ID NO: 444402 - RNA, 22 nt, Human
guugaugaaaaugaauugcaug

SEQ ID NO: 444403 - RNA, 21 nt, Human
ucgugcagcagcugaggcuug

SEQ ID NO: 444404 - RNA, 22 nt, Human
cagugguugcuugcauggcucc

SEQ ID NO: 444405 - RNA, 22 nt, Human
cuggagccaugucuugacugcu

SEQ ID NO: 444406 - RNA, 22 nt, Human
cuggccugugggcugucuccgg

SEQ ID NO: 444407 - RNA, 22 nt, Human
ucucacugcaaauauuauguau

SEQ ID NO: 444408 - RNA, 23 nt, Human
ucacuuugauguaauugaaaagc

SEQ ID NO: 444409 - RNA, 22 nt, Human
cucuccucagaacaggcccucu

SEQ ID NO: 444410 - RNA, 22 nt, Human
ggccuuccagggaagacagggc

SEQ ID NO: 444411 - RNA, 22 nt, Human
cugugcccuggccaggccucuc

SEQ ID NO: 444412 - RNA, 22 nt, Human
cugagggagaagucacgggcag

SEQ ID NO: 444413 - RNA, 22 nt, Human
ccaggaggcagaaguugcagug

SEQ ID NO: 444414 - RNA, 22 nt, Human
uuuaacacuaguuucuuuaacu

SEQ ID NO: 444415 - RNA, 22 nt, Human
aaagacauuagcuuagauguca

SEQ ID NO: 444416 - RNA, 22 nt, Human
caaggccugccucuggcagaaa

SEQ ID NO: 444417 - RNA, 22 nt, Human
cagggagaggccucuguugccc

SEQ ID NO: 444418 - RNA, 22 nt, Human
uacaguaccugccacguuguug

SEQ ID NO: 444419 - RNA, 22 nt, Human
auuugguaguccugauaagauu

SEQ ID NO: 444420 - RNA, 22 nt, Human
aggcuccugagaggcagaggcu

SEQ ID NO: 444421 - RNA, 22 nt, Human
ucagcugccucucccuggaaga

SEQ ID NO: 444422 - RNA, 18 nt, Human
gagcccugggagaucucu

SEQ ID NO: 444423 - RNA, 22 nt, Human
agcuaaggacuggaggguuucu

SEQ ID NO: 444424 - RNA, 22 nt, Human
cugcagcagggcuugcccaccu

SEQ ID NO: 444425 - RNA, 22 nt, Human
uccugaagagcccugcucugug

SEQ ID NO: 444426 - RNA, 22 nt, Human
auuccaaagguuaaugcccauu

SEQ ID NO: 444427 - RNA, 22 nt, Human
ccuggcagacugugagggcagg

SEQ ID NO: 444428 - RNA, 22 nt, Human
ugcugcagaaauucugugagga

SEQ ID NO: 444429 - RNA, 22 nt, Human
uucagaauaacuuuuuauugaa

SEQ ID NO: 444430 - RNA, 22 nt, Human
aagcaggcuagauugaagggcu

SEQ ID NO: 444431 - RNA, 20 nt, Human
uggcucucucuaguaagugg

SEQ ID NO: 444432 - RNA, 22 nt, Human
uucagaaguagcuaagcaguca

SEQ ID NO: 444433 - RNA, 22 nt, Human
aagcagguuacauacauuaucu

SEQ ID NO: 444434 - RNA, 22 nt, Human
ugauaauguucgagaaugaaga

SEQ ID NO: 444435 - RNA, 20 nt, Human
acaugcacguguguauauau

SEQ ID NO: 444436 - RNA, 18 nt, Human
gcagccccucuuccuucc

SEQ ID NO: 444437 - RNA, 21 nt, Human
ggggcagagcuaggcccugca

SEQ ID NO: 444438 - RNA, 22 nt, Human
agcagcaguguguggucauguu

SEQ ID NO: 444439 - RNA, 22 nt, Human
ucuacaaagaagaauuaauguc

SEQ ID NO: 444440 - RNA, 22 nt, Human
gcagccagccccucugaccucu

SEQ ID NO: 444441 - RNA, 17 nt, Human
guauucuuugccuucca

SEQ ID NO: 444442 - RNA, 22 nt, Human
agcugccaccucugccuuuggg

SEQ ID NO: 444443 - RNA, 22 nt, Human
ugagcugaguggcaggucucag

SEQ ID NO: 444444 - RNA, 22 nt, Human
agcagcucuggcacuguagcau

SEQ ID NO: 444445 - RNA, 22 nt, Human
ugggcaggggcccugcuuccgu

SEQ ID NO: 444446 - RNA, 22 nt, Human
aaacacaucauucaugucguca

SEQ ID NO: 444447 - RNA, 23 nt, Human
gccugggacucaggaggagcuca

SEQ ID NO: 444448 - RNA, 22 nt, Human
ucagaauugcagggagggcagg

SEQ ID NO: 444449 - RNA, 22 nt, Human
acauguacuguuggugaagagg

SEQ ID NO: 444450 - RNA, 22 nt, Human
cccagcucucgcacuuacuagc

SEQ ID NO: 444451 - RNA, 22 nt, Human
agggaugggucuaacccagaac

SEQ ID NO: 444452 - RNA, 23 nt, Human
acuaaauggggcuuugcuuaaag

SEQ ID NO: 444453 - RNA, 22 nt, Human
gcaggagugacauggaugugga

SEQ ID NO: 444454 - RNA, 22 nt, Human
cuucuccucugaguccugggag

SEQ ID NO: 444455 - RNA, 22 nt, Human
uugggaguaauaaaaaauucca

SEQ ID NO: 444456 - RNA, 22 nt, Human
aggcugagucgggaggaucacu

SEQ ID NO: 444457 - RNA, 22 nt, Human
uugcuuuagguauagaauccau

SEQ ID NO: 444458 - RNA, 22 nt, Human
gugcugagauuggagugagcag

SEQ ID NO: 444459 - RNA, 22 nt, Human
cuuuggcuguccucuuggcugg

SEQ ID NO: 444460 - RNA, 22 nt, Human
cagcuagucagaggcagggcca

SEQ ID NO: 444461 - RNA, 22 nt, Human
aacaggaaugaggagaaaaggu

SEQ ID NO: 444462 - RNA, 20 nt, Human
gcucccugguagaaauguuu

SEQ ID NO: 444463 - RNA, 22 nt, Human
cccaccaguacagaugguagau

SEQ ID NO: 444464 - RNA, 22 nt, Human
ugcaaauuugacuucacacauc

SEQ ID NO: 444465 - RNA, 22 nt, Human
aaaggcaucuagccaaguugag

SEQ ID NO: 444466 - RNA, 22 nt, Human
agagguggagcucuuggcauca

SEQ ID NO: 444467 - RNA, 22 nt, Human
uauaggaaauaggucuucugug

SEQ ID NO: 444468 - RNA, 22 nt, Human
ugcucacugaacucuugcuguc

SEQ ID NO: 444469 - RNA, 22 nt, Human
gcaaauucuaggccccucucca

SEQ ID NO: 444470 - RNA, 22 nt, Human
cugggcagugguggcaucuuug

SEQ ID NO: 444471 - RNA, 22 nt, Human
agcaggcugcuggcguugaagu

SEQ ID NO: 444472 - RNA, 22 nt, Human
cacugcauggaugauggcugua

SEQ ID NO: 444473 - RNA, 22 nt, Human
caaacuuacuguguuuaaagag

SEQ ID NO: 444474 - RNA, 22 nt, Human
gcacccaggccggcgacugcag

SEQ ID NO: 444475 - RNA, 22 nt, Human
uugcauauccuccaacacaugg

SEQ ID NO: 444476 - RNA, 20 nt, Human
gugggcagcaggcauacugg

SEQ ID NO: 444477 - RNA, 22 nt, Human
gcagcugugggccucggagagc

SEQ ID NO: 444478 - RNA, 22 nt, Human
aagagcaucaaugacucgcagu

SEQ ID NO: 444479 - RNA, 22 nt, Human
gaggcugguuugccuuuuggca

SEQ ID NO: 444480 - RNA, 22 nt, Human
agagacaggguuuugccauguu

SEQ ID NO: 444481 - RNA, 22 nt, Human
gagguaacacuguucagugggc

SEQ ID NO: 444482 - RNA, 21 nt, Human
aaucagaggcuuccuaguugg

SEQ ID NO: 444483 - RNA, 22 nt, Human
uggaggaaguugcuggaaguca

SEQ ID NO: 444484 - RNA, 22 nt, Human
ugcaggagaaaguacggagcgu

SEQ ID NO: 444485 - RNA, 22 nt, Human
aagaugauagaucugucaaugu

SEQ ID NO: 444486 - RNA, 22 nt, Human
cuacagcuggccuuggaaaacu

SEQ ID NO: 444487 - RNA, 22 nt, Human
caguuucuguggucucuuuuca

SEQ ID NO: 444488 - RNA, 22 nt, Human
ucagaggaagcaucaaguucuc

SEQ ID NO: 444489 - RNA, 22 nt, Human
acaauuuauccauuguauaguu

SEQ ID NO: 444490 - RNA, 22 nt, Human
gcaauaaauaacauggaagaca

SEQ ID NO: 444491 - RNA, 22 nt, Human
caggcugggcugguguuagagu

SEQ ID NO: 444492 - RNA, 23 nt, Human
augcccuguagaggcugcugacc

SEQ ID NO: 444493 - RNA, 22 nt, Human
uauguacauauacacgugugug

SEQ ID NO: 444494 - RNA, 22 nt, Human
gaccagagaaaggcacuggaag

SEQ ID NO: 444495 - RNA, 22 nt, Human
acauacuugaagcaagugauca

SEQ ID NO: 444496 - RNA, 17 nt, Human
gcuuuggaaagccuucc

SEQ ID NO: 444497 - RNA, 22 nt, Human
ucacuuugaugacauuguagcu

SEQ ID NO: 444498 - RNA, 22 nt, Human
uucagcaaggcaugugcaggag

SEQ ID NO: 444499 - RNA, 22 nt, Human
agcaccugucacaagcagaagg

SEQ ID NO: 444500 - RNA, 22 nt, Human
caggccuggcugcagcucgccu

SEQ ID NO: 444501 - RNA, 22 nt, Human
ugggagugaggcagagucuauc

SEQ ID NO: 444502 - RNA, 22 nt, Human
ccugccuguacuagagacccag

SEQ ID NO: 444503 - RNA, 17 nt, Human
agcagaagucagaggga

SEQ ID NO: 444504 - RNA, 22 nt, Human
uccucccugggagcuucugagu

SEQ ID NO: 444505 - RNA, 22 nt, Human
ucugcccacugcucugcugccc

SEQ ID NO: 444506 - RNA, 22 nt, Human
aggcagcaaagaaaugaugcug

SEQ ID NO: 444507 - RNA, 22 nt, Human
uaugccaaggaucaauauguau

SEQ ID NO: 444508 - RNA, 22 nt, Human
uacaaugagcugagccagaggc

SEQ ID NO: 444509 - RNA, 22 nt, Human
caauacuuuaguaaaauggccc

SEQ ID NO: 444510 - RNA, 22 nt, Human
ugggcagaaggaagagccaccu

SEQ ID NO: 444511 - RNA, 22 nt, Human
agcugagguuaguauaaaugug

SEQ ID NO: 444512 - RNA, 22 nt, Human
gcccucuggcacagagaugcag

SEQ ID NO: 444513 - RNA, 22 nt, Human
ugacaauacagagagagcaaaa

SEQ ID NO: 444514 - RNA, 22 nt, Human
caguggguccuaaguacaguuc

SEQ ID NO: 444515 - RNA, 22 nt, Human
uacagcgaaaauuuagcuugau

SEQ ID NO: 444516 - RNA, 22 nt, Human
ggcugccaggagaagcucagug

SEQ ID NO: 444517 - RNA, 22 nt, Human
guccucagagugggcagguccu

SEQ ID NO: 444518 - RNA, 22 nt, Human
ucccaaggcacagggcagggac

SEQ ID NO: 444519 - RNA, 22 nt, Human
caauuucauuaauagauauaga

SEQ ID NO: 444520 - RNA, 20 nt, Human
uaacaguugaagaacaagga

SEQ ID NO: 444521 - RNA, 22 nt, Human
cagagacaaccugguagagaaa

SEQ ID NO: 444522 - RNA, 22 nt, Human
cuguuuucaaagagagagaaug

SEQ ID NO: 444523 - RNA, 22 nt, Human
agcagugggugacagagcugag

SEQ ID NO: 444524 - RNA, 22 nt, Human
cccagggauguggcagauguua

SEQ ID NO: 444525 - RNA, 22 nt, Human
acuggcaguuugagaaugcauu

SEQ ID NO: 444526 - RNA, 22 nt, Human
aggaaaaaccuguuaaugguag

SEQ ID NO: 444527 - RNA, 22 nt, Human
cgcagcugcaaaggaaacauuu

SEQ ID NO: 444528 - RNA, 22 nt, Human
uccaacauuuaucaagguuguu

SEQ ID NO: 444529 - RNA, 22 nt, Human
cagaagagaugaaauaguauua

SEQ ID NO: 444530 - RNA, 22 nt, Human
agcacaauauaaagugaacgca

SEQ ID NO: 444531 - RNA, 22 nt, Human
auaauggcaugacaguuauaua

SEQ ID NO: 444532 - RNA, 22 nt, Human
aucuaagagagagagcaugucu

SEQ ID NO: 444533 - RNA, 21 nt, Human
gugcccuguucccacaugccc

SEQ ID NO: 444534 - RNA, 22 nt, Human
ucaggccucagaaauugcacug

SEQ ID NO: 444535 - RNA, 22 nt, Human
acaggcagagaguggcggacuc

SEQ ID NO: 444536 - RNA, 22 nt, Human
ucucccaggucauacacagaga

SEQ ID NO: 444537 - RNA, 22 nt, Human
uauguacaugauuucauuugcu

SEQ ID NO: 444538 - RNA, 22 nt, Human
ugcaaauaaauuucuguucauu

SEQ ID NO: 444539 - RNA, 22 nt, Human
gcugaguguaaugauggcagag

SEQ ID NO: 444540 - RNA, 21 nt, Human
agacacugguuuagcauucau

SEQ ID NO: 444541 - RNA, 22 nt, Human
ugaacagaucaauagaacugac

SEQ ID NO: 444542 - RNA, 22 nt, Human
gcagugggcaacaagagcugga

SEQ ID NO: 444543 - RNA, 22 nt, Human
cuagaggggaaaaaggucuugu

SEQ ID NO: 444544 - RNA, 15 nt, Human
aacaggcauuuauau

SEQ ID NO: 444545 - RNA, 22 nt, Human
gucccaggcagagucaggaggg

SEQ ID NO: 444546 - RNA, 22 nt, Human
guuuacaacaucuuguccuuca

SEQ ID NO: 444547 - RNA, 22 nt, Human
ugcuggcuggagugccucugga

SEQ ID NO: 444548 - RNA, 22 nt, Human
aagagcaaguggguagugaagc

SEQ ID NO: 444549 - RNA, 21 nt, Human
acaggccuuaggggccauuca

SEQ ID NO: 444550 - RNA, 22 nt, Human
acagcaggcacacaaggauaga

SEQ ID NO: 444551 - RNA, 22 nt, Human
uacaaugacucucaguuuggcu

SEQ ID NO: 444552 - RNA, 22 nt, Human
ggcuggcauuuacacaaugcau

SEQ ID NO: 444553 - RNA, 22 nt, Human
agagcuguucaacguagcaaug

SEQ ID NO: 444554 - RNA, 22 nt, Human
uucaacauuuaucaguuuauca

SEQ ID NO: 444555 - RNA, 22 nt, Human
gacagcagcauguuuacaggcc

SEQ ID NO: 444556 - RNA, 22 nt, Human
caugagaucugcagggaugggc

SEQ ID NO: 444557 - RNA, 22 nt, Human
uaagaaauuuaguuauagaaug

SEQ ID NO: 444558 - RNA, 22 nt, Human
ucaugcagcaauaugcauuagg

SEQ ID NO: 444559 - RNA, 22 nt, Human
augcauaucacagucuccaugu

SEQ ID NO: 444560 - RNA, 22 nt, Human
accagggcuuacagcaguagcu

SEQ ID NO: 444561 - RNA, 22 nt, Human
uauuccaacugucauagucaua

SEQ ID NO: 444562 - RNA, 22 nt, Human
caacagcuuuagaaacacuuuc

SEQ ID NO: 444563 - RNA, 22 nt, Human
gaggccagccccucuugaaggc

SEQ ID NO: 444564 - RNA, 22 nt, Human
auucacaaugauacauaagcga

SEQ ID NO: 444565 - RNA, 17 nt, Human
ggagacagggucuuuaa

SEQ ID NO: 444566 - RNA, 20 nt, Human
aagcucugcuucaugugguc

SEQ ID NO: 444567 - RNA, 22 nt, Human
agcugggaggugggcagugaga

SEQ ID NO: 444568 - RNA, 22 nt, Human
cuugcuuuguccagaaauucag

SEQ ID NO: 444569 - RNA, 22 nt, Human
caauagcagcuucugaaugcaa

SEQ ID NO: 444570 - RNA, 22 nt, Human
caaggcagcguuccuuucugga

SEQ ID NO: 444571 - RNA, 22 nt, Human
ugagcaauuaacagagucuaaa

SEQ ID NO: 444572 - RNA, 22 nt, Human
aggaggcccuagagcucuagag

SEQ ID NO: 444573 - RNA, 22 nt, Human
cagcccuggugccaagguuccc

SEQ ID NO: 444574 - RNA, 22 nt, Human
cuuuacaaagcaauuuugucuc

SEQ ID NO: 444575 - RNA, 22 nt, Human
agaagggcuacacgggcucucc

SEQ ID NO: 444576 - RNA, 22 nt, Human
acccagagauggaccuggcugc

SEQ ID NO: 444577 - RNA, 22 nt, Human
ugguggcaauguccuggagaag

SEQ ID NO: 444578 - RNA, 22 nt, Human
uccuccagugucuggggccuug

SEQ ID NO: 444579 - RNA, 22 nt, Human
ccuguggcugccacuuggguga

SEQ ID NO: 444580 - RNA, 22 nt, Human
auaaagcauacuuuguaugacu

SEQ ID NO: 444581 - RNA, 22 nt, Human
aaggaagacucgcaggucuaug

SEQ ID NO: 444582 - RNA, 22 nt, Human
acugggccuugccauggcagcc

SEQ ID NO: 444583 - RNA, 22 nt, Human
uagcaacagcaauagugguauu

SEQ ID NO: 444584 - RNA, 22 nt, Human
ccugggcugcucauggggauga

SEQ ID NO: 444585 - RNA, 22 nt, Human
uccuggacaagcccuucacccu

SEQ ID NO: 444586 - RNA, 22 nt, Human
ugugggacagggacagcaagag

SEQ ID NO: 444587 - RNA, 22 nt, Human
uggaccucacugucugcuggua

SEQ ID NO: 444588 - RNA, 22 nt, Human
cugggacuuuacccuguggccc

SEQ ID NO: 444589 - RNA, 22 nt, Human
gcaggauggugcccuuucugcc

SEQ ID NO: 444590 - RNA, 22 nt, Human
cagcaggggaacugugggccag

SEQ ID NO: 444591 - RNA, 22 nt, Human
acuuagcagaguugaauguacu

SEQ ID NO: 444592 - RNA, 17 nt, Human
gcuugggcugccuguug

SEQ ID NO: 444593 - RNA, 22 nt, Human
uucaacuaauguuuauuuuaug

SEQ ID NO: 444594 - RNA, 22 nt, Human
uaauaccacugugcucauuaua

SEQ ID NO: 444595 - RNA, 22 nt, Human
cccaggaaaagcagugccagca

SEQ ID NO: 444596 - RNA, 22 nt, Human
guggccuggcgagcuggcgcgg

SEQ ID NO: 444597 - RNA, 22 nt, Human
cuauucagccucuaagacaagu

SEQ ID NO: 444598 - RNA, 21 nt, Human
agugucauuugaucauuguua

SEQ ID NO: 444599 - RNA, 22 nt, Human
agcauuuagucuuuauugcagc

SEQ ID NO: 444600 - RNA, 22 nt, Human
gcugagggcagccuccuagguc

SEQ ID NO: 444601 - RNA, 22 nt, Human
uuccuuucucuggacugcagcc

SEQ ID NO: 444602 - RNA, 22 nt, Human
ucugucacccagagugcagugg

SEQ ID NO: 444603 - RNA, 22 nt, Human
cagcagggcccccgggugcgcc

SEQ ID NO: 444604 - RNA, 22 nt, Human
ucugagagucucugaggcagau

SEQ ID NO: 444605 - RNA, 22 nt, Human
ccugccugcaaaaugggacaag

SEQ ID NO: 444606 - RNA, 20 nt, Human
cugacccaaucucugucccc

SEQ ID NO: 444607 - RNA, 22 nt, Human
uggucaguugcaucagagaagu

SEQ ID NO: 444608 - RNA, 22 nt, Human
gaaggagcuaaagggagcccug

SEQ ID NO: 444609 - RNA, 20 nt, Human
guggccuguccuguuguggg

SEQ ID NO: 444610 - RNA, 22 nt, Human
gcucuugacagcuacaucuggc

SEQ ID NO: 444611 - RNA, 22 nt, Human
cacauuuacuuuuaucccuugg

SEQ ID NO: 444612 - RNA, 22 nt, Human
ugaauacaggaaaauauacuga

SEQ ID NO: 444613 - RNA, 22 nt, Human
gcaagcuggcuguuagaggaug

SEQ ID NO: 444614 - RNA, 22 nt, Human
acucagagcuuggcuccuugcu

SEQ ID NO: 444615 - RNA, 22 nt, Human
gccaccccauagguguuaggug

SEQ ID NO: 444616 - RNA, 22 nt, Human
uggagaguguagacuucagagu

SEQ ID NO: 444617 - RNA, 22 nt, Human
gcaggccugggagucaucuugu

SEQ ID NO: 444618 - RNA, 22 nt, Human
aaugaauggguuuaauauuuua

SEQ ID NO: 444619 - RNA, 22 nt, Human
acagcaguuaacgaucagacuc

SEQ ID NO: 444620 - RNA, 20 nt, Human
uuggaagguggagaagagga

SEQ ID NO: 444621 - RNA, 22 nt, Human
gaggugagaagggggucagaug

SEQ ID NO: 444622 - RNA, 22 nt, Human
augcuuuauuguuaggucaugu

SEQ ID NO: 444623 - RNA, 22 nt, Human
cccuggcugccagucaccagac

SEQ ID NO: 444624 - RNA, 22 nt, Human
augaacaugugacucagaccug

SEQ ID NO: 444625 - RNA, 22 nt, Human
gaggcugcuuugaugacaggag

SEQ ID NO: 444626 - RNA, 22 nt, Human
caguagcuuacuuuucuugauc

SEQ ID NO: 444627 - RNA, 22 nt, Human
augcccaaugucacaauuuuug

SEQ ID NO: 444628 - RNA, 22 nt, Human
augcaauauagggaagauagau

SEQ ID NO: 444629 - RNA, 22 nt, Human
uuccucagaaaauacuguccaa

SEQ ID NO: 444630 - RNA, 22 nt, Human
uuggcagggcaucagacacgug

SEQ ID NO: 444631 - RNA, 23 nt, Human
uggagcugacagucagagggagg

SEQ ID NO: 444632 - RNA, 22 nt, Human
gaagagguagcauuggcaggug

SEQ ID NO: 444633 - RNA, 22 nt, Human
gcagccaggcuacagcgggcuu

SEQ ID NO: 444634 - RNA, 22 nt, Human
ggaaaagaauugcagugaagua

SEQ ID NO: 444635 - RNA, 22 nt, Human
agcaggcagccauuuggaaggc

SEQ ID NO: 444636 - RNA, 22 nt, Human
gcagcacaaaguccccagggac

SEQ ID NO: 444637 - RNA, 22 nt, Human
uugcuuuacuuugccauucguu

SEQ ID NO: 444638 - RNA, 22 nt, Human
auggcccuguuuaugguaaggc

SEQ ID NO: 444639 - RNA, 22 nt, Human
gcuggcagaagagcugguucaa

SEQ ID NO: 444640 - RNA, 22 nt, Human
ucagcucuacacacaccugugu

SEQ ID NO: 444641 - RNA, 17 nt, Human
uuguguguaguucugau

SEQ ID NO: 444642 - RNA, 22 nt, Human
cagucagggacaccagcuagga

SEQ ID NO: 444643 - RNA, 22 nt, Human
gggcuccugccuccuggcaccu

SEQ ID NO: 444644 - RNA, 22 nt, Human
ccuguguggccaggcuggaguc

SEQ ID NO: 444645 - RNA, 22 nt, Human
ccacagaaaguugucuagagua

SEQ ID NO: 444646 - RNA, 18 nt, Human
agcuuagcauacuuuucc

SEQ ID NO: 444647 - RNA, 22 nt, Human
aaacauucucagcccugcuugc

SEQ ID NO: 444648 - RNA, 22 nt, Human
uuucaaacuguacuuuccccua

SEQ ID NO: 444649 - RNA, 22 nt, Human
uggggcagccacauagacaaca

SEQ ID NO: 444650 - RNA, 23 nt, Human
ccacagagcugccaauuccugug

SEQ ID NO: 444651 - RNA, 22 nt, Human
aaguucaaauuggggccuguga

SEQ ID NO: 444652 - RNA, 22 nt, Human
uuucaaaggaggcugagaggau

SEQ ID NO: 444653 - RNA, 22 nt, Human
ucaaguauuuauuucugcuggc

SEQ ID NO: 444654 - RNA, 22 nt, Human
augcccuggacuagcuauacuu

SEQ ID NO: 444655 - RNA, 22 nt, Human
uguguguguccucauuugcaga

SEQ ID NO: 444656 - RNA, 22 nt, Human
uuauccaaacuggugaaucauu

SEQ ID NO: 444657 - RNA, 22 nt, Human
acucccagguugccuggcaggc

SEQ ID NO: 444658 - RNA, 18 nt, Human
gaggccugagaaccaggu

SEQ ID NO: 444659 - RNA, 22 nt, Human
ccugggucuucagucugcuggu

SEQ ID NO: 444660 - RNA, 22 nt, Human
gcaggccuguaaugaagggaca

SEQ ID NO: 444661 - RNA, 22 nt, Human
cuccucugucuaccacgagggu

SEQ ID NO: 444662 - RNA, 22 nt, Human
ugcccagccaauuuguuauguu

SEQ ID NO: 444663 - RNA, 22 nt, Human
gccucugucauagcucauguga

SEQ ID NO: 444664 - RNA, 22 nt, Human
ccacagaguuacaaaacaguca

SEQ ID NO: 444665 - RNA, 22 nt, Human
guuuuucuaggaccaugugauu

SEQ ID NO: 444666 - RNA, 17 nt, Human
ggcagcugccacuuuuu

SEQ ID NO: 444667 - RNA, 22 nt, Human
agaaacagaaccaggugucauu

SEQ ID NO: 444668 - RNA, 22 nt, Human
uguggccagcagguggcugugu

SEQ ID NO: 444669 - RNA, 22 nt, Human
uuucucccaaagugcaaccaca

SEQ ID NO: 444670 - RNA, 22 nt, Human
agauugggauuagagaucugua

SEQ ID NO: 444671 - RNA, 22 nt, Human
ccugccugucaucgccugcgcc

SEQ ID NO: 444672 - RNA, 22 nt, Human
cuuacagugacccugcagauuu

SEQ ID NO: 444673 - RNA, 22 nt, Human
uucuuuuaauguucugaaguuu

SEQ ID NO: 444674 - RNA, 22 nt, Human
uuugcucaguucucuguauuuu

SEQ ID NO: 444675 - RNA, 22 nt, Human
cacugcaaaggggaaagaagca

SEQ ID NO: 444676 - RNA, 23 nt, Human
gugcacagucaagcccagcuuag

SEQ ID NO: 444677 - RNA, 22 nt, Human
uuuaaaaccaaagaaagccucu

SEQ ID NO: 444678 - RNA, 22 nt, Human
agcaguggaccucagugcuauu

SEQ ID NO: 444679 - RNA, 22 nt, Human
agcaggcugccuuccaaagccu

SEQ ID NO: 444680 - RNA, 22 nt, Human
gccugguguccagaggcgagug

SEQ ID NO: 444681 - RNA, 22 nt, Human
augcccugcugccaucuggccg

SEQ ID NO: 444682 - RNA, 21 nt, Human
ucagaauuaccccuggaucug

SEQ ID NO: 444683 - RNA, 22 nt, Human
gagcccugagaguugugaggcc

SEQ ID NO: 444684 - RNA, 22 nt, Human
uagaaacacagagagacccaug

SEQ ID NO: 444685 - RNA, 22 nt, Human
caggcagcugggucaccguccc

SEQ ID NO: 444686 - RNA, 20 nt, Human
acaugaaaggaaacaggaaa

SEQ ID NO: 444687 - RNA, 22 nt, Human
caggggccaaggguccagaccu

SEQ ID NO: 444688 - RNA, 22 nt, Human
ugccugucuuuccucccucgua

SEQ ID NO: 444689 - RNA, 22 nt, Human
gccagcagcucuugggcgggca

SEQ ID NO: 444690 - RNA, 22 nt, Human
aauucacaggagguauuugucc

SEQ ID NO: 444691 - RNA, 22 nt, Human
cuugugcaaauccucgagcaca

SEQ ID NO: 444692 - RNA, 23 nt, Human
gccaggcuccggucuguggccac

SEQ ID NO: 444693 - RNA, 22 nt, Human
gcagauuucuaauaagcaaugu

SEQ ID NO: 444694 - RNA, 22 nt, Human
uacuucaugaguuaauaugcag

SEQ ID NO: 444695 - RNA, 22 nt, Human
ggcugcagcagagggacucacg

SEQ ID NO: 444696 - RNA, 22 nt, Human
uuucacaacguuguggugagag

SEQ ID NO: 444697 - RNA, 22 nt, Human
caggcagcucgaugccuuguug

SEQ ID NO: 444698 - RNA, 22 nt, Human
aaaguucacugaccagcacugg

SEQ ID NO: 444699 - RNA, 22 nt, Human
cagcccuuccaggcagaauucu

SEQ ID NO: 444700 - RNA, 22 nt, Human
aaaggaggaauggagagaugcu

SEQ ID NO: 444701 - RNA, 22 nt, Human
ucugcagcgugcaggcuggugc

SEQ ID NO: 444702 - RNA, 17 nt, Human
acaaugcagucucuagu

SEQ ID NO: 444703 - RNA, 22 nt, Human
gagcccugcggagccccgaggc

SEQ ID NO: 444704 - RNA, 20 nt, Human
uugaaaaugcauugugcagu

SEQ ID NO: 444705 - RNA, 22 nt, Human
acaggccugacacacagagggc

SEQ ID NO: 444706 - RNA, 22 nt, Human
auccugaggaaggugcagagau

SEQ ID NO: 444707 - RNA, 22 nt, Human
gauucuuaugagugaacuuuac

SEQ ID NO: 444708 - RNA, 22 nt, Human
gauuuuaucgucauccuucugg

SEQ ID NO: 444709 - RNA, 22 nt, Human
cucuggcuguuugcagcucaag

SEQ ID NO: 444710 - RNA, 22 nt, Human
aauguacaauaagacaaagagg

SEQ ID NO: 444711 - RNA, 22 nt, Human
ucugucaccgagggcauccaaa

SEQ ID NO: 444712 - RNA, 22 nt, Human
agcccuggggcuggugcuuacc

SEQ ID NO: 444713 - RNA, 23 nt, Human
cugcagccgcguggggacgugga

SEQ ID NO: 444714 - RNA, 22 nt, Human
uaauuuuaacugugcuguuugg

SEQ ID NO: 444715 - RNA, 22 nt, Human
caggcagcugcuggguucagcc

SEQ ID NO: 444716 - RNA, 22 nt, Human
aacaggaaaacagcacaauagc

SEQ ID NO: 444717 - RNA, 22 nt, Human
ggcagcuggguuggccagaaac

SEQ ID NO: 444718 - RNA, 19 nt, Human
cacaauuaugagacacuua

SEQ ID NO: 444719 - RNA, 22 nt, Human
cccaggaggcagagguugcagu

SEQ ID NO: 444720 - RNA, 22 nt, Human
aguggcuuuuuaguggcagaug

SEQ ID NO: 444721 - RNA, 22 nt, Human
ccagcuccuucugucuguggag

SEQ ID NO: 444722 - RNA, 22 nt, Human
ccaagaggcagaaugcagagaa

SEQ ID NO: 444723 - RNA, 22 nt, Human
gaggcccaggucaagcagccac

SEQ ID NO: 444724 - RNA, 22 nt, Human
gagggcucuaccaaguaacucu

SEQ ID NO: 444725 - RNA, 22 nt, Human
cagcagcuucuguugaucagaa

SEQ ID NO: 444726 - RNA, 22 nt, Human
ugcuuucagauaucuguuucaa

SEQ ID NO: 444727 - RNA, 22 nt, Human
acaggaguuuaagaaauauuuc

SEQ ID NO: 444728 - RNA, 22 nt, Human
agacaucucccaugcauuuuua

SEQ ID NO: 444729 - RNA, 22 nt, Human
uuacuuuggauggucaagaaag

SEQ ID NO: 444730 - RNA, 22 nt, Human
agcugcauuucagugaaauauu

SEQ ID NO: 444731 - RNA, 22 nt, Human
ugcagcuggaacuuagaggaga

SEQ ID NO: 444732 - RNA, 22 nt, Human
agcuggugcucaggggcaugga

SEQ ID NO: 444733 - RNA, 22 nt, Human
cagaggcagaggucaucucugg

SEQ ID NO: 444734 - RNA, 21 nt, Human
ccuggcuccagaacuuccggu

SEQ ID NO: 444735 - RNA, 22 nt, Human
acacacuucacccuugagcuaa

SEQ ID NO: 444736 - RNA, 22 nt, Human
caggugccgggaaugcagcaau

SEQ ID NO: 444737 - RNA, 22 nt, Human
ugcaauaauguaugucacuccc

SEQ ID NO: 444738 - RNA, 22 nt, Human
acauuuaaguuaaaaccucagu

SEQ ID NO: 444739 - RNA, 22 nt, Human
gugugccagacaugaugcuaug

SEQ ID NO: 444740 - RNA, 22 nt, Human
guucaagugucaaguguuggaa

SEQ ID NO: 444741 - RNA, 22 nt, Human
auguagcagauauuugugcaca

SEQ ID NO: 444742 - RNA, 22 nt, Human
ugcaauaaagugcuauaaaucc

SEQ ID NO: 444743 - RNA, 22 nt, Human
ugagaagcagcuuacagguguc

SEQ ID NO: 444744 - RNA, 22 nt, Human
augcccugcugcuggggcagug

SEQ ID NO: 444745 - RNA, 22 nt, Human
cuauuuugccugccuagaaauc

SEQ ID NO: 444746 - RNA, 22 nt, Human
aggcagcuagagagugaaacug

SEQ ID NO: 444747 - RNA, 22 nt, Human
uagcaacaagugacuaucuaua

SEQ ID NO: 444748 - RNA, 22 nt, Human
caggagccccaggcugacaaua

SEQ ID NO: 444749 - RNA, 22 nt, Human
cugucccucaucaccucugggu

SEQ ID NO: 444750 - RNA, 22 nt, Human
cgcagcugaccuuuuacaaaac

SEQ ID NO: 444751 - RNA, 23 nt, Human
gguuccugagcagggaucuggaa

SEQ ID NO: 444752 - RNA, 22 nt, Human
gagccuggccuccugccucagc

SEQ ID NO: 444753 - RNA, 22 nt, Human
aagacagagggaagcaaugaug

SEQ ID NO: 444754 - RNA, 22 nt, Human
auccugggcagugugucacucu

SEQ ID NO: 444755 - RNA, 22 nt, Human
gaauugcuaaccaauucaaaau

SEQ ID NO: 444756 - RNA, 22 nt, Human
cacuucaaauauggcuucauga

SEQ ID NO: 444757 - RNA, 22 nt, Human
ucuaaugaguuagauaauuuug

SEQ ID NO: 444758 - RNA, 22 nt, Human
guggccuggaaaggcuggucug

SEQ ID NO: 444759 - RNA, 22 nt, Human
ugaggacaugagugggacagag

SEQ ID NO: 444760 - RNA, 22 nt, Human
acacggaaaaggagacagaggg

SEQ ID NO: 444761 - RNA, 22 nt, Human
aagugcaauuugaaauucugca

SEQ ID NO: 444762 - RNA, 22 nt, Human
agcugccagggacugggcaugg

SEQ ID NO: 444763 - RNA, 21 nt, Human
ugccagcauguaggcuaguug

SEQ ID NO: 444764 - RNA, 22 nt, Human
gaagagagaacauuacauaaac

SEQ ID NO: 444765 - RNA, 22 nt, Human
ucaggccuccagguuaccauuu

SEQ ID NO: 444766 - RNA, 19 nt, Human
gcuguauuaaagauacaug

SEQ ID NO: 444767 - RNA, 22 nt, Human
ucagcaguuauuccccuacaga

SEQ ID NO: 444768 - RNA, 22 nt, Human
ggaugcugacuuuggagcaugg

SEQ ID NO: 444769 - RNA, 22 nt, Human
uuuucauuuuuguagaugcaag

SEQ ID NO: 444770 - RNA, 21 nt, Human
aaauugccacacauuucuucc

SEQ ID NO: 444771 - RNA, 22 nt, Human
aacucaaagaugcaugacgcuu

SEQ ID NO: 444772 - RNA, 22 nt, Human
gacaggugugaugauuuaggcu

SEQ ID NO: 444773 - RNA, 22 nt, Human
uaagagcagaacagcaacauau

SEQ ID NO: 444774 - RNA, 22 nt, Human
agagacaggaguucuguuucca

SEQ ID NO: 444775 - RNA, 22 nt, Human
aauuggaaaaugcuacauauca

SEQ ID NO: 444776 - RNA, 22 nt, Human
gcuggcugaggucuagcucuuu

SEQ ID NO: 444777 - RNA, 21 nt, Human
aacauuucugggagaacucac

SEQ ID NO: 444778 - RNA, 22 nt, Human
gaggccagcgcgcagcacuuuu

SEQ ID NO: 444779 - RNA, 22 nt, Human
guguccagggccguguugucuu

SEQ ID NO: 444780 - RNA, 22 nt, Human
ugggaacaacaugcacugccac

SEQ ID NO: 444781 - RNA, 22 nt, Human
ccagcagcucagcuacugguca

SEQ ID NO: 444782 - RNA, 17 nt, Human
uagcugccccgaaugcu

SEQ ID NO: 444783 - RNA, 22 nt, Human
auacagccuauucuuaccauug

SEQ ID NO: 444784 - RNA, 23 nt, Human
ccccucugguggcucagcuccug

SEQ ID NO: 444785 - RNA, 18 nt, Human
acacugcagcagucugcu

SEQ ID NO: 444786 - RNA, 22 nt, Human
ccaggccuggccaggggaugcc

SEQ ID NO: 444787 - RNA, 22 nt, Human
gcagggaccugccacugcuguc

SEQ ID NO: 444788 - RNA, 22 nt, Human
ggcugggcaaacaagacucuuc

SEQ ID NO: 444789 - RNA, 22 nt, Human
ucucagcaacgauccggaguaa

SEQ ID NO: 444790 - RNA, 22 nt, Human
acacagagcuggaacugcuuca

SEQ ID NO: 444791 - RNA, 22 nt, Human
agccaugcuccuuccccucugg

SEQ ID NO: 444792 - RNA, 22 nt, Human
gcagggugauagugaggcucag

SEQ ID NO: 444793 - RNA, 22 nt, Human
gggauuugugggauggccagug

SEQ ID NO: 444794 - RNA, 22 nt, Human
uggcccugcuggccaaaggcua

SEQ ID NO: 444795 - RNA, 22 nt, Human
ucccugggccuccugcuaugca

SEQ ID NO: 444796 - RNA, 22 nt, Human
aguucaagcaaugcuggaagaa

SEQ ID NO: 444797 - RNA, 22 nt, Human
auaaggcagugacuucaucuau

SEQ ID NO: 444798 - RNA, 22 nt, Human
agacaucuugcacacauauacu

SEQ ID NO: 444799 - RNA, 22 nt, Human
uggaaaggacaguugcugauag

SEQ ID NO: 444800 - RNA, 22 nt, Human
gugcacaucgugcagguuuguu

SEQ ID NO: 444801 - RNA, 22 nt, Human
auagcuuuuugucauagagucu

SEQ ID NO: 444802 - RNA, 23 nt, Human
gccuucagcucgggaaggcuccc

SEQ ID NO: 444803 - RNA, 22 nt, Human
aagcacauugccuggcacauag

SEQ ID NO: 444804 - RNA, 22 nt, Human
cauuuaauccauagaggaaugu

SEQ ID NO: 444805 - RNA, 22 nt, Human
gaggcuucuggaaagccuggca

SEQ ID NO: 444806 - RNA, 22 nt, Human
aagucccugguuccuagcaaaa

SEQ ID NO: 444807 - RNA, 22 nt, Human
agccaggcugcaguuggcuggc

SEQ ID NO: 444808 - RNA, 21 nt, Human
gggugcuguggucaugcagga

SEQ ID NO: 444809 - RNA, 22 nt, Human
ggcuccuguccuccuggagcuc

SEQ ID NO: 444810 - RNA, 18 nt, Human
agacuuugaguuagaggg

SEQ ID NO: 444811 - RNA, 22 nt, Human
uccugccuugccugggacauca

SEQ ID NO: 444812 - RNA, 22 nt, Human
aggacagcauuuucagcaucuc

SEQ ID NO: 444813 - RNA, 22 nt, Human
gggagggaaagcuugaucuguc

SEQ ID NO: 444814 - RNA, 22 nt, Human
agcugguggggaagcugcaggu

SEQ ID NO: 444815 - RNA, 22 nt, Human
cuggcagcuuagcacucugguu

SEQ ID NO: 444816 - RNA, 22 nt, Human
aggcugucugaccccagagccc

SEQ ID NO: 444817 - RNA, 22 nt, Human
agauuauuuaagacaggaacca

SEQ ID NO: 444818 - RNA, 22 nt, Human
agguccugaugaucucugagag

SEQ ID NO: 444819 - RNA, 22 nt, Human
uuccaugaagggcagccucuca

SEQ ID NO: 444820 - RNA, 22 nt, Human
ucucugcucugugccucaguuu

SEQ ID NO: 444821 - RNA, 22 nt, Human
auggguuuauagguggacuuuu

SEQ ID NO: 444822 - RNA, 22 nt, Human
cugccuggguucaaguccuguu

SEQ ID NO: 444823 - RNA, 22 nt, Human
cauugcaacuucaaacuccugg

SEQ ID NO: 444824 - RNA, 22 nt, Human
uauguacaaucagcaguucaua

SEQ ID NO: 444825 - RNA, 22 nt, Human
ucagagaaauaauugcugaguu

SEQ ID NO: 444826 - RNA, 17 nt, Human
ugagcaguagaagaugc

SEQ ID NO: 444827 - RNA, 22 nt, Human
agggacaguauccaucucacag

SEQ ID NO: 444828 - RNA, 22 nt, Human
cucauuaaaggaaaucaccugc

SEQ ID NO: 444829 - RNA, 22 nt, Human
cuuugcagaagaaaccuacaaa

SEQ ID NO: 444830 - RNA, 22 nt, Human
cagagcuggagcuugaauggag

SEQ ID NO: 444831 - RNA, 22 nt, Human
ugcauuauuugcaugugccugu

SEQ ID NO: 444832 - RNA, 22 nt, Human
auagacauuauaacacagagcu

SEQ ID NO: 444833 - RNA, 22 nt, Human
guguacaaaaugucuccaugga

SEQ ID NO: 444834 - RNA, 22 nt, Human
ucucacugggucacagcagagg

SEQ ID NO: 444835 - RNA, 22 nt, Human
acagagcaauucuuggguguuu

SEQ ID NO: 444836 - RNA, 22 nt, Human
cauuucacacauaaacuugggu

SEQ ID NO: 444837 - RNA, 22 nt, Human
cgcagcugccuugucagccguu

SEQ ID NO: 444838 - RNA, 22 nt, Human
ggcccugugguuuugcaaaguc

SEQ ID NO: 444839 - RNA, 22 nt, Human
auccccagaaaauaggugccua

SEQ ID NO: 444840 - RNA, 22 nt, Human
ugagcuggagucuguggcuccu

SEQ ID NO: 444841 - RNA, 22 nt, Human
cagcagcaacaacggaagccuu

SEQ ID NO: 444842 - RNA, 22 nt, Human
aaguucaagucugcaucuuuuu

SEQ ID NO: 444843 - RNA, 22 nt, Human
uaaauuguuuucuagaaguugu

SEQ ID NO: 444844 - RNA, 22 nt, Human
gagaugagugggggaucucuca

SEQ ID NO: 444845 - RNA, 23 nt, Human
ugcagccacucaggagcucagug

SEQ ID NO: 444846 - RNA, 22 nt, Human
ccaguccugccacccugucuau

SEQ ID NO: 444847 - RNA, 22 nt, Human
guuucagauauauuuguacuua

SEQ ID NO: 444848 - RNA, 22 nt, Human
aggcugccucgugagcucgcug

SEQ ID NO: 444849 - RNA, 22 nt, Human
cagagcugacccaaggauugaa

SEQ ID NO: 444850 - RNA, 22 nt, Human
ccuggggagccgccugagcccc

SEQ ID NO: 444851 - RNA, 22 nt, Human
gauuuuucaguauaaaauauau

SEQ ID NO: 444852 - RNA, 20 nt, Human
agugcaagaaagcacagcug

SEQ ID NO: 444853 - RNA, 22 nt, Human
ugcucaggaggaggcugugagg

SEQ ID NO: 444854 - RNA, 22 nt, Human
ugcaaauagccuauauuuauag

SEQ ID NO: 444855 - RNA, 22 nt, Human
gaucuuuagccaagacacacca

SEQ ID NO: 444856 - RNA, 22 nt, Human
gcugggaaccaugggaaggcag

SEQ ID NO: 444857 - RNA, 21 nt, Human
gucuggaugcccuucucuugg

SEQ ID NO: 444858 - RNA, 22 nt, Human
uucucacaguaccuaacaugua

SEQ ID NO: 444859 - RNA, 23 nt, Human
uccugccagaugacuccuuucuu

SEQ ID NO: 444860 - RNA, 22 nt, Human
auuccaaacucuuucccugucg

SEQ ID NO: 444861 - RNA, 22 nt, Human
gccuuccaccuaggccucugcu

SEQ ID NO: 444862 - RNA, 22 nt, Human
gugcccugaaagaguuaauuca

SEQ ID NO: 444863 - RNA, 22 nt, Human
gcagagugaagggagaggugug

SEQ ID NO: 444864 - RNA, 22 nt, Human
ugaagcuacagaccuucgcggu

SEQ ID NO: 444865 - RNA, 22 nt, Human
auuugacaacuucugguggcau

SEQ ID NO: 444866 - RNA, 22 nt, Human
agcugagcugcagaugacugua

SEQ ID NO: 444867 - RNA, 22 nt, Human
uuucuacauguuuucuauugaa

SEQ ID NO: 444868 - RNA, 22 nt, Human
auuaguugaacaaguuaaguaa

SEQ ID NO: 444869 - RNA, 22 nt, Human
aaauuaguacauugcaaagucc

SEQ ID NO: 444870 - RNA, 22 nt, Human
cacaggaauuagcagccuaaaa

SEQ ID NO: 444871 - RNA, 22 nt, Human
gccugucugcagggcugucauu

SEQ ID NO: 444872 - RNA, 21 nt, Human
ccagcagcucaaggaucucuu

SEQ ID NO: 444873 - RNA, 22 nt, Human
aaacuuuuccugcucuuguccu

SEQ ID NO: 444874 - RNA, 22 nt, Human
gccuggaguucagccaaguccc

SEQ ID NO: 444875 - RNA, 22 nt, Human
aacaggcuauuucuuuacaaac

SEQ ID NO: 444876 - RNA, 22 nt, Human
aggugccagcucucaggcagga

SEQ ID NO: 444877 - RNA, 22 nt, Human
gccuguccuggaugcucugcaa

SEQ ID NO: 444878 - RNA, 22 nt, Human
aguucaaagcugcaguaaugga

SEQ ID NO: 444879 - RNA, 22 nt, Human
ucccagcccagacuucuccagu

SEQ ID NO: 444880 - RNA, 22 nt, Human
ugcacaguaaacaugacuggag

SEQ ID NO: 444881 - RNA, 22 nt, Human
cacagaggcggaaaauucugaa

SEQ ID NO: 444882 - RNA, 22 nt, Human
cuagggagacucgcaggacuca

SEQ ID NO: 444883 - RNA, 22 nt, Human
uuuagacacuagggaugcagug

SEQ ID NO: 444884 - RNA, 22 nt, Human
ugaacagauggcccagcagagg

SEQ ID NO: 444885 - RNA, 22 nt, Human
cugagacccagacaccugagga

SEQ ID NO: 444886 - RNA, 19 nt, Human
ccuggccagacuucugccc

SEQ ID NO: 444887 - RNA, 22 nt, Human
uauacacaaggugugcauuugu

SEQ ID NO: 444888 - RNA, 22 nt, Human
uugugugugagccuucaccaca

SEQ ID NO: 444889 - RNA, 22 nt, Human
acaggcugacuuccugccaugu

SEQ ID NO: 444890 - RNA, 22 nt, Human
ggugggcagcucuuggcaggca

SEQ ID NO: 444891 - RNA, 22 nt, Human
uaucuuuugaguucucaagaug

SEQ ID NO: 444892 - RNA, 22 nt, Human
cagcugccugucuggaggcaau

SEQ ID NO: 444893 - RNA, 22 nt, Human
aggccucuguagggcccugaag

SEQ ID NO: 444894 - RNA, 22 nt, Human
guucuacaugacacucaacauu

SEQ ID NO: 444895 - RNA, 22 nt, Human
auggaguggggacugcagugga

SEQ ID NO: 444896 - RNA, 22 nt, Human
aaaggaaaauaaguaguuccau

SEQ ID NO: 444897 - RNA, 22 nt, Human
auggcuugucuaugagugcucu

SEQ ID NO: 444898 - RNA, 22 nt, Human
gcugucaccaaagcaggcacug

SEQ ID NO: 444899 - RNA, 22 nt, Human
cagaggcucuuccucacugccc

SEQ ID NO: 444900 - RNA, 22 nt, Human
uugagaaauaagcaugucuaga

SEQ ID NO: 444901 - RNA, 22 nt, Human
gcaagcugcuuaagcucauugu

SEQ ID NO: 444902 - RNA, 20 nt, Human
uuugucuguuaaguguuucu

SEQ ID NO: 444903 - RNA, 22 nt, Human
gcccugugcgacucuagagguu

SEQ ID NO: 444904 - RNA, 22 nt, Human
ugggggugcccuaugaggaagc

SEQ ID NO: 444905 - RNA, 22 nt, Human
cugagaggcggagguugcagug

SEQ ID NO: 444906 - RNA, 22 nt, Human
aauaguauuuauuuggaaaaag

SEQ ID NO: 444907 - RNA, 22 nt, Human
cuucaauaccugcguugcuagu

SEQ ID NO: 444908 - RNA, 22 nt, Human
cugccacuuucacccagugcuc

SEQ ID NO: 444909 - RNA, 22 nt, Human
aggagacauacuauaggaauau

SEQ ID NO: 444910 - RNA, 22 nt, Human
auugugauuagagaauauagag

SEQ ID NO: 444911 - RNA, 22 nt, Human
ucuggccacccgaggccccugc

SEQ ID NO: 444912 - RNA, 22 nt, Human
cagcuguuugggcauggccaga

SEQ ID NO: 444913 - RNA, 22 nt, Human
cagcccugucccugagggaccu

SEQ ID NO: 444914 - RNA, 22 nt, Human
aagagacuuguccgaaguugua

SEQ ID NO: 444915 - RNA, 22 nt, Human
gcuuugcuggcuugaaaugcug

SEQ ID NO: 444916 - RNA, 22 nt, Human
ccucgcggcacucgggccggau

SEQ ID NO: 444917 - RNA, 22 nt, Human
uuauauccaaaggcaaggagga

SEQ ID NO: 444918 - RNA, 21 nt, Human
gcucuugaauaagcauaauaa

SEQ ID NO: 444919 - RNA, 18 nt, Human
aagccagagaccacugcc

SEQ ID NO: 444920 - RNA, 22 nt, Human
acagaugguuauugucauuucu

SEQ ID NO: 444921 - RNA, 22 nt, Human
caccacuggaggucuuggcuuu

SEQ ID NO: 444922 - RNA, 22 nt, Human
cuauuauuauguuaacuggacu

SEQ ID NO: 444923 - RNA, 22 nt, Human
uugacaaaggaccuugcuauuu

SEQ ID NO: 444924 - RNA, 20 nt, Human
gugcccugugggcuauuuuc

SEQ ID NO: 444925 - RNA, 22 nt, Human
aauuucaaugcacucaugguug

SEQ ID NO: 444926 - RNA, 19 nt, Human
uuucacaaagagagcguga

SEQ ID NO: 444927 - RNA, 22 nt, Human
gccucugcaucaucacuccagc

SEQ ID NO: 444928 - RNA, 22 nt, Human
gaggcugcugagagcccuguuu

SEQ ID NO: 444929 - RNA, 22 nt, Human
ucagcaguugcccccucccagc

SEQ ID NO: 444930 - RNA, 22 nt, Human
aagccagguuccauggaggagc

SEQ ID NO: 444931 - RNA, 22 nt, Human
gcccacaggggaccugguggcu

SEQ ID NO: 444932 - RNA, 22 nt, Human
cuuaacauccugcauuuuucuu

SEQ ID NO: 444933 - RNA, 18 nt, Human
uggcucugcagccagaug

SEQ ID NO: 444934 - RNA, 19 nt, Human
ccaggccuggcgucuccgc

SEQ ID NO: 444935 - RNA, 22 nt, Human
ugcauuuguucagugaaauguu

SEQ ID NO: 444936 - RNA, 22 nt, Human
agaagcagcaagcccuucaaag

SEQ ID NO: 444937 - RNA, 22 nt, Human
aaggcuggcaauauauuuguua

SEQ ID NO: 444938 - RNA, 22 nt, Human
cagaggaggcgguauacacugc

SEQ ID NO: 444939 - RNA, 22 nt, Human
cuucccugauaagagccucaga

SEQ ID NO: 444940 - RNA, 22 nt, Human
uacagcccaagaaguuuauacg

SEQ ID NO: 444941 - RNA, 22 nt, Human
uuggaaauacgaguaguaucau

SEQ ID NO: 444942 - RNA, 23 nt, Human
uagcaggcuuucuuuucucucac

SEQ ID NO: 444943 - RNA, 22 nt, Human
uuauugcaaaggaagagcuuga

SEQ ID NO: 444944 - RNA, 22 nt, Human
ccaggccuggaccaugccaggg

SEQ ID NO: 444945 - RNA, 22 nt, Human
gagacugucacuugggaccugu

SEQ ID NO: 444946 - RNA, 22 nt, Human
agcugccacagagccuggccag

SEQ ID NO: 444947 - RNA, 22 nt, Human
aucaugcaugguacucuugugc

SEQ ID NO: 444948 - RNA, 22 nt, Human
gucaugccuggcuucuuagaca

SEQ ID NO: 444949 - RNA, 22 nt, Human
aauguggcauugucauuauugg

SEQ ID NO: 444950 - RNA, 22 nt, Human
ccugugucaucagcuguggcua

SEQ ID NO: 444951 - RNA, 22 nt, Human
gccuuggccuuccuaggccuga

SEQ ID NO: 444952 - RNA, 19 nt, Human
ugcauugagggcugucuca

SEQ ID NO: 444953 - RNA, 22 nt, Human
gucccagggaugcagacaugag

SEQ ID NO: 444954 - RNA, 22 nt, Human
cccauggcagucagagauaaga

SEQ ID NO: 444955 - RNA, 22 nt, Human
ucauguacauguaagucagaaa

SEQ ID NO: 444956 - RNA, 22 nt, Human
gggcuggugaggcugcccugca

SEQ ID NO: 444957 - RNA, 22 nt, Human
aggacacacuucugaggucuuu

SEQ ID NO: 444958 - RNA, 22 nt, Human
auguuuuauguuccacucaagg

SEQ ID NO: 444959 - RNA, 22 nt, Human
gggcucuggaguucuagaaaga

SEQ ID NO: 444960 - RNA, 22 nt, Human
agagauguucauucagcauguu

SEQ ID NO: 444961 - RNA, 21 nt, Human
uuaauuuauucaugauagcua

SEQ ID NO: 444962 - RNA, 22 nt, Human
gggaugagaguagggugugaaa

SEQ ID NO: 444963 - RNA, 22 nt, Human
ugccucagagugggcuugcuau

SEQ ID NO: 444964 - RNA, 22 nt, Human
ccugccuggagcugagugugga

SEQ ID NO: 444965 - RNA, 22 nt, Human
ggcagcuguuuguccuccuguu

SEQ ID NO: 444966 - RNA, 21 nt, Human
gagcauggcuuacaucagcag

SEQ ID NO: 444967 - RNA, 22 nt, Human
gaagccaagccagcugauggag

SEQ ID NO: 444968 - RNA, 20 nt, Human
agcuggccuguccuaggccu

SEQ ID NO: 444969 - RNA, 21 nt, Human
cacagaggcgcuguauggcug

SEQ ID NO: 444970 - RNA, 22 nt, Human
gcuguguccucacacagccuuu

SEQ ID NO: 444971 - RNA, 22 nt, Human
ggcucugcuucucaccuguucc

SEQ ID NO: 444972 - RNA, 22 nt, Human
uuucagaguugucuucuugacc

SEQ ID NO: 444973 - RNA, 23 nt, Human
agcaggcugcuucuccacagcug

SEQ ID NO: 444974 - RNA, 22 nt, Human
aauucauauggauaugcuagua

SEQ ID NO: 444975 - RNA, 22 nt, Human
caaaugaagggagcugaagucu

SEQ ID NO: 444976 - RNA, 22 nt, Human
caauucaucuggguagguagcc

SEQ ID NO: 444977 - RNA, 16 nt, Human
uugcccugaggggagg

SEQ ID NO: 444978 - RNA, 22 nt, Human
acguuugcuuucuuuggccugg

SEQ ID NO: 444979 - RNA, 22 nt, Human
cagcccuggcagcuuucagggu

SEQ ID NO: 444980 - RNA, 22 nt, Human
agugcuggaaagggacggagga

SEQ ID NO: 444981 - RNA, 21 nt, Human
acacuucaguuuuuaaaggga

SEQ ID NO: 444982 - RNA, 22 nt, Human
uggcccagggaguucauggugu

SEQ ID NO: 444983 - RNA, 22 nt, Human
uuuccucauuuaucugcuggga

SEQ ID NO: 444984 - RNA, 22 nt, Human
uuuauguaauuucauaggugug

SEQ ID NO: 444985 - RNA, 22 nt, Human
guguugaugacauuuuagaaac

SEQ ID NO: 444986 - RNA, 22 nt, Human
uacaacacugguucgacaugug

SEQ ID NO: 444987 - RNA, 22 nt, Human
uuguuuuggagaugagcuaaaa

SEQ ID NO: 444988 - RNA, 22 nt, Human
auuuuaucugcuuacuuucagg

SEQ ID NO: 444989 - RNA, 22 nt, Human
ugcagcugcucuucauuucccc

SEQ ID NO: 444990 - RNA, 19 nt, Human
ugagacagggauucaggug

SEQ ID NO: 444991 - RNA, 22 nt, Human
aaaguucuauuggauagugcug

SEQ ID NO: 444992 - RNA, 22 nt, Human
ugggcacagggguaggaaugag

SEQ ID NO: 444993 - RNA, 22 nt, Human
cauuagcacucuaaggaagaga

SEQ ID NO: 444994 - RNA, 22 nt, Human
aaaguugauuuggagggauauu

SEQ ID NO: 444995 - RNA, 22 nt, Human
gcagcuguaaagcagaaauagu

SEQ ID NO: 444996 - RNA, 22 nt, Human
cagccugcagggcugccuguug

SEQ ID NO: 444997 - RNA, 22 nt, Human
uuacaguaaucgaguguugugg

SEQ ID NO: 444998 - RNA, 22 nt, Human
cggagcugccugccaagccugc

SEQ ID NO: 444999 - RNA, 22 nt, Human
gcagccaggaagcccaggacac

SEQ ID NO: 445000 - RNA, 22 nt, Human
acauuuaaccaaacuguuuaau

SEQ ID NO: 445001 - RNA, 22 nt, Human
cugacccauauaagaguggagg

SEQ ID NO: 445002 - RNA, 22 nt, Human
aagcaggcaucuuggaggucaa

SEQ ID NO: 445003 - RNA, 20 nt, Human
ucacaggagggaaggcaggu

SEQ ID NO: 445004 - RNA, 22 nt, Human
auauuaauuauuuacacaugag

SEQ ID NO: 445005 - RNA, 22 nt, Human
ccagaggaucaguacuggcugg

SEQ ID NO: 445006 - RNA, 22 nt, Human
aggaaaggauuggcuucucugu

SEQ ID NO: 445007 - RNA, 19 nt, Human
cuccaagugccaaggacag

SEQ ID NO: 445008 - RNA, 22 nt, Human
ggaaggaagugaccaggauauc

SEQ ID NO: 445009 - RNA, 22 nt, Human
uuagcaauaugaaugcauuugc

SEQ ID NO: 445010 - RNA, 22 nt, Human
caacaaguguucguaaagugcc

SEQ ID NO: 445011 - RNA, 22 nt, Human
cauuuggccauuccagucacau

SEQ ID NO: 445012 - RNA, 22 nt, Human
cugcuuugauuagaagaguaca

SEQ ID NO: 445013 - RNA, 22 nt, Human
cagcuguuguuaugucugcagg

SEQ ID NO: 445014 - RNA, 22 nt, Human
ccucccuggccagagcagcagc

SEQ ID NO: 445015 - RNA, 22 nt, Human
aauugcccgcacauugagaggu

SEQ ID NO: 445016 - RNA, 22 nt, Human
uuaaggcauagcuuguguugac

SEQ ID NO: 445017 - RNA, 22 nt, Human
acauuaaauuucauagugauua

SEQ ID NO: 445018 - RNA, 22 nt, Human
acagcagcgugaaguguguuau

SEQ ID NO: 445019 - RNA, 20 nt, Human
ucccucccuccagcucuggg

SEQ ID NO: 445020 - RNA, 22 nt, Human
ccugccugggcucacuugccag

SEQ ID NO: 445021 - RNA, 22 nt, Human
aaggcagcuucaccacagcauu

SEQ ID NO: 445022 - RNA, 22 nt, Human
gaagaauauauaaugauuuugu

SEQ ID NO: 445023 - RNA, 20 nt, Human
ccugccugccucggcucauu

SEQ ID NO: 445024 - RNA, 22 nt, Human
cagcugccacuugcucucggcu

SEQ ID NO: 445025 - RNA, 22 nt, Human
cuuuggcagccucagcugcagg

SEQ ID NO: 445026 - RNA, 22 nt, Human
cagccagguucaaguccuuaua

SEQ ID NO: 445027 - RNA, 22 nt, Human
aggcagacuuccugcuuggauc

SEQ ID NO: 445028 - RNA, 22 nt, Human
agcagagccagaauuggaccag

SEQ ID NO: 445029 - RNA, 22 nt, Human
uuuuaguuacugcaguagcaaa

SEQ ID NO: 445030 - RNA, 22 nt, Human
augccaggccccacgcugggca

SEQ ID NO: 445031 - RNA, 20 nt, Human
ccuggcugcauucaggacgg

SEQ ID NO: 445032 - RNA, 22 nt, Human
uagcaacagaaaauaggagugc

SEQ ID NO: 445033 - RNA, 22 nt, Human
aggaagagcccgggugacauaa

SEQ ID NO: 445034 - RNA, 22 nt, Human
cuguguggccucaagccagccu

SEQ ID NO: 445035 - RNA, 22 nt, Human
cuggagccuagguugaccuggg

SEQ ID NO: 445036 - RNA, 22 nt, Human
uaaacaucugaauccugcuucc

SEQ ID NO: 445037 - RNA, 22 nt, Human
gcugcccagcaggccccagggg

SEQ ID NO: 445038 - RNA, 22 nt, Human
ucagcaguagagggggcacagu

SEQ ID NO: 445039 - RNA, 20 nt, Human
uucagagucagcaaaugcag

SEQ ID NO: 445040 - RNA, 22 nt, Human
uugaaugauccuaucuagcaca

SEQ ID NO: 445041 - RNA, 22 nt, Human
ugagccuggguggucgaggcug

SEQ ID NO: 445042 - RNA, 22 nt, Human
ggggcagagcauagcuccaauu

SEQ ID NO: 445043 - RNA, 22 nt, Human
auuaaauuaaguggcuaauuua

SEQ ID NO: 445044 - RNA, 19 nt, Human
ucuccaggcaggugagcga

SEQ ID NO: 445045 - RNA, 20 nt, Human
auucagaauaggcauguaaa

SEQ ID NO: 445046 - RNA, 22 nt, Human
cuauucagguguccauuaaucc

SEQ ID NO: 445047 - RNA, 22 nt, Human
guuucagaguuagugcuggcug

SEQ ID NO: 445048 - RNA, 22 nt, Human
ggguaauuggaaauauuaauag

SEQ ID NO: 445049 - RNA, 22 nt, Human
gcacuucaugacuuugucaaau

SEQ ID NO: 445050 - RNA, 19 nt, Human
cuggugcuugagugaguca

SEQ ID NO: 445051 - RNA, 22 nt, Human
cuuugcagugauuguucuugga

SEQ ID NO: 445052 - RNA, 22 nt, Human
acauaacacucuucucuaguga

SEQ ID NO: 445053 - RNA, 22 nt, Human
uggcucugugcuucuaguaucu

SEQ ID NO: 445054 - RNA, 22 nt, Human
ggcccagccggcgagucucgcg

SEQ ID NO: 445055 - RNA, 22 nt, Human
gagggguguggagccaucaguu

SEQ ID NO: 445056 - RNA, 22 nt, Human
agggcuggcuaggugcguuccc

SEQ ID NO: 445057 - RNA, 22 nt, Human
uucucuaaaauuaagugaggua

SEQ ID NO: 445058 - RNA, 22 nt, Human
cugauuccugauucaugcucuu

SEQ ID NO: 445059 - RNA, 22 nt, Human
ugacuggauugucauuacgacg

SEQ ID NO: 445060 - RNA, 22 nt, Human
gccagucucccucaguccucug

SEQ ID NO: 445061 - RNA, 22 nt, Human
cuggggcugcgguggaggagcc

SEQ ID NO: 445062 - RNA, 22 nt, Human
gcucagaguggccuggcuaggg

SEQ ID NO: 445063 - RNA, 22 nt, Human
aaguacaugcuguaaugauugg

SEQ ID NO: 445064 - RNA, 22 nt, Human
gagacagaugcugcuggagcau

SEQ ID NO: 445065 - RNA, 22 nt, Human
acugcaucugaaacauggguca

SEQ ID NO: 445066 - RNA, 22 nt, Human
ggcaggcacugugcuaggcgcu

SEQ ID NO: 445067 - RNA, 22 nt, Human
agcugcaggcccaugcucaguc

SEQ ID NO: 445068 - RNA, 22 nt, Human
guucaaauugauuuugguaaag

SEQ ID NO: 445069 - RNA, 22 nt, Human
ugaagagaagaaaauuaucuuu

SEQ ID NO: 445070 - RNA, 22 nt, Human
uuugcaaacacuuaagaagaga

SEQ ID NO: 445071 - RNA, 17 nt, Human
agcaggaccccagagca

SEQ ID NO: 445072 - RNA, 22 nt, Human
aggcaagcagucagucuaugag

SEQ ID NO: 445073 - RNA, 22 nt, Human
ugcagcucauugcuggggucug

SEQ ID NO: 445074 - RNA, 23 nt, Human
uaggccucccuggagcacccagc

SEQ ID NO: 445075 - RNA, 22 nt, Human
uaauguauaacaaauacucauc

SEQ ID NO: 445076 - RNA, 20 nt, Human
agcagcuguguuuucauccu

SEQ ID NO: 445077 - RNA, 22 nt, Human
ccucacagcccuuggcccagga

SEQ ID NO: 445078 - RNA, 22 nt, Human
uccauuauacuucugauucaaa

SEQ ID NO: 445079 - RNA, 22 nt, Human
guucugaggcaaaggcagcagc

SEQ ID NO: 445080 - RNA, 23 nt, Human
guggagccacaucacaggcuccu

SEQ ID NO: 445081 - RNA, 22 nt, Human
auuguuaacuauagcaucuggu

SEQ ID NO: 445082 - RNA, 22 nt, Human
agguucgggcacuuacaaaugg

SEQ ID NO: 445083 - RNA, 22 nt, Human
uuucaaagucaauaucauuacc

SEQ ID NO: 445084 - RNA, 22 nt, Human
gugggccucuugaggguggcua

SEQ ID NO: 445085 - RNA, 20 nt, Human
ugaauagagagcacauaugc

SEQ ID NO: 445086 - RNA, 22 nt, Human
uguccugugcacuguagcaugu

SEQ ID NO: 445087 - RNA, 22 nt, Human
agccuccuguagcccucaccca

SEQ ID NO: 445088 - RNA, 19 nt, Human
ucucuggggacacuuucac

SEQ ID NO: 445089 - RNA, 22 nt, Human
cccagagagguaaaacagccuu

SEQ ID NO: 445090 - RNA, 22 nt, Human
agccagagaacagcaggaaaug

SEQ ID NO: 445091 - RNA, 22 nt, Human
auucaaagcccaguaaacauug

SEQ ID NO: 445092 - RNA, 22 nt, Human
ggcaggcgugguggccucagaa

SEQ ID NO: 445093 - RNA, 22 nt, Human
caagauucauuuuguccuuguc

SEQ ID NO: 445094 - RNA, 22 nt, Human
aggcuucuugggcuucauucug

SEQ ID NO: 445095 - RNA, 22 nt, Human
uucuuuuagaauuuccuaaggu

SEQ ID NO: 445096 - RNA, 22 nt, Human
gcagugcuaaguagcuggccca

SEQ ID NO: 445097 - RNA, 22 nt, Human
agcccuucaagagcucuguccu

SEQ ID NO: 445098 - RNA, 22 nt, Human
cagcccagagccaguucccgcu

SEQ ID NO: 445099 - RNA, 22 nt, Human
gaaaggagaggguuaaggagcu

SEQ ID NO: 445100 - RNA, 22 nt, Human
ccauacugaggacacauuguga

SEQ ID NO: 445101 - RNA, 22 nt, Human
aagcugccuagaguugaauguc

SEQ ID NO: 445102 - RNA, 22 nt, Human
cuggcucccggggaucgagcac

SEQ ID NO: 445103 - RNA, 22 nt, Human
ugcagcugguaucccauggauu

SEQ ID NO: 445104 - RNA, 23 nt, Human
ugcaggcuaggaagagagccuuc

SEQ ID NO: 445105 - RNA, 22 nt, Human
cucucuccuuagcugcagacca

SEQ ID NO: 445106 - RNA, 19 nt, Human
ggcagucacggucaggagc

SEQ ID NO: 445107 - RNA, 20 nt, Human
ugggccugagccugugggcu

SEQ ID NO: 445108 - RNA, 22 nt, Human
auggcauuauagcaaugguuug

SEQ ID NO: 445109 - RNA, 22 nt, Human
caacauucaaccaacauuuaug

SEQ ID NO: 445110 - RNA, 22 nt, Human
caggaacauguuggaaagaaau

SEQ ID NO: 445111 - RNA, 22 nt, Human
agacauagaaaaucauuaggaa

SEQ ID NO: 445112 - RNA, 22 nt, Human
agcaggcuaaucuugcugaaca

SEQ ID NO: 445113 - RNA, 23 nt, Human
gugugccaagcacugugccagga

SEQ ID NO: 445114 - RNA, 22 nt, Human
gauacagcucuggccagaugug

SEQ ID NO: 445115 - RNA, 22 nt, Human
auaaugcaccuuugaguauggc

SEQ ID NO: 445116 - RNA, 22 nt, Human
aggcagccauuaccaagggcau

SEQ ID NO: 445117 - RNA, 22 nt, Human
ccugccugaaggucagccaccc

SEQ ID NO: 445118 - RNA, 21 nt, Human
uacaugaagcugguguuuguc

SEQ ID NO: 445119 - RNA, 22 nt, Human
agcaacaggcauaauguguuga

SEQ ID NO: 445120 - RNA, 22 nt, Human
uauguacaagcacacaugugac

SEQ ID NO: 445121 - RNA, 20 nt, Human
gcacugaaauucaauguuug

SEQ ID NO: 445122 - RNA, 22 nt, Human
uuacaaugagaaaugguuggca

SEQ ID NO: 445123 - RNA, 22 nt, Human
guccuggggauuauagaguguu

SEQ ID NO: 445124 - RNA, 22 nt, Human
gacccuguuucuacaaauaauu

SEQ ID NO: 445125 - RNA, 22 nt, Human
gggcucugggauucagagcaag

SEQ ID NO: 445126 - RNA, 22 nt, Human
gcagagauuaugccauggaaag

SEQ ID NO: 445127 - RNA, 22 nt, Human
aggcacagcacaccuggccccc

SEQ ID NO: 445128 - RNA, 22 nt, Human
uuucuaguaaaagcuaauuacc

SEQ ID NO: 445129 - RNA, 22 nt, Human
uauaauuuaucaugucacaguu

SEQ ID NO: 445130 - RNA, 22 nt, Human
cucugucccagacccaccucuc

SEQ ID NO: 445131 - RNA, 22 nt, Human
auugauaaauugcaauggggcu

SEQ ID NO: 445132 - RNA, 22 nt, Human
aacccacaaaggauuucagcuc

SEQ ID NO: 445133 - RNA, 22 nt, Human
gccaggcugcuggcugcugucc

SEQ ID NO: 445134 - RNA, 22 nt, Human
cugcccugugaggguccuuggg

SEQ ID NO: 445135 - RNA, 22 nt, Human
guuuuacaaaugacggcauuca

SEQ ID NO: 445136 - RNA, 19 nt, Human
ucucccagcugagaagggc

SEQ ID NO: 445137 - RNA, 22 nt, Human
ccaggaggaugguuguuaggug

SEQ ID NO: 445138 - RNA, 22 nt, Human
agcagcugccagagagaguucc

SEQ ID NO: 445139 - RNA, 22 nt, Human
uaaaguuggaccugauuuuauu

SEQ ID NO: 445140 - RNA, 22 nt, Human
uggagcugggaguccugggcug

SEQ ID NO: 445141 - RNA, 22 nt, Human
ugaggccuuaguaacccugcac

SEQ ID NO: 445142 - RNA, 22 nt, Human
uguuucagucccuguguucaau

SEQ ID NO: 445143 - RNA, 22 nt, Human
uaguaaaucucagaaaaagauc

SEQ ID NO: 445144 - RNA, 22 nt, Human
gcccagaaguugaggcugcagu

SEQ ID NO: 445145 - RNA, 22 nt, Human
uuuaaaaaacuagucugagucu

SEQ ID NO: 445146 - RNA, 22 nt, Human
ucuauacaaguuucacuuugac

SEQ ID NO: 445147 - RNA, 22 nt, Human
uauugcuuuuauuucuauggac

SEQ ID NO: 445148 - RNA, 22 nt, Human
ccagcccucacugaggccucuc

SEQ ID NO: 445149 - RNA, 22 nt, Human
ggaaucagaugaggggcagagc

SEQ ID NO: 445150 - RNA, 22 nt, Human
gguguccugggcaggcagcuga

SEQ ID NO: 445151 - RNA, 20 nt, Human
agugucugggccucaggccc

SEQ ID NO: 445152 - RNA, 22 nt, Human
gcucagagcaucccagugaaug

SEQ ID NO: 445153 - RNA, 22 nt, Human
ggcacacaaaggcagcauuuga

SEQ ID NO: 445154 - RNA, 22 nt, Human
gugccugggguugagcuaugaa

SEQ ID NO: 445155 - RNA, 22 nt, Human
cuaugaccccagcaugaauaag

SEQ ID NO: 445156 - RNA, 22 nt, Human
ucugcagcuuuuugguggggug

SEQ ID NO: 445157 - RNA, 22 nt, Human
uaggacaggcuaaaagggauaa

SEQ ID NO: 445158 - RNA, 22 nt, Human
agcagcugucccuuaacaucag

SEQ ID NO: 445159 - RNA, 22 nt, Human
auaguuuacaaaaaugaugcau

SEQ ID NO: 445160 - RNA, 22 nt, Human
ggaggacacuggcucugccuuc

SEQ ID NO: 445161 - RNA, 22 nt, Human
uuauuugcccauguuuagcaga

SEQ ID NO: 445162 - RNA, 22 nt, Human
agugggcaugaucuggugucug

SEQ ID NO: 445163 - RNA, 22 nt, Human
ucaggcugcaguggcaaaagac

SEQ ID NO: 445164 - RNA, 22 nt, Human
gaagcuaaugauuuauuuucug

SEQ ID NO: 445165 - RNA, 22 nt, Human
uugcaaauucgucacuguuaaa

SEQ ID NO: 445166 - RNA, 22 nt, Human
gacagcaggaugugaggggaug

SEQ ID NO: 445167 - RNA, 20 nt, Human
uuuagcaaaagggacugcuc

SEQ ID NO: 445168 - RNA, 22 nt, Human
ugggccugauucuugaauccug

SEQ ID NO: 445169 - RNA, 22 nt, Human
ggcuuggagucauacugagaau

SEQ ID NO: 445170 - RNA, 22 nt, Human
aaacugcacacgaugugccuga

SEQ ID NO: 445171 - RNA, 19 nt, Human
aaggcagcaguagcaucca

SEQ ID NO: 445172 - RNA, 22 nt, Human
ucacaggccuggggcagagggc

SEQ ID NO: 445173 - RNA, 22 nt, Human
uuauaacaacaguuuacuuuaa

SEQ ID NO: 445174 - RNA, 22 nt, Human
ggcagcagggucuagauugaug

SEQ ID NO: 445175 - RNA, 22 nt, Human
aguucuuuucuagauucuggau

SEQ ID NO: 445176 - RNA, 22 nt, Human
uacuuugcaugcuugugugauc

SEQ ID NO: 445177 - RNA, 22 nt, Human
uggacaggugagugacucaggg

SEQ ID NO: 445178 - RNA, 22 nt, Human
uugcuugcccugcagcauacuu

SEQ ID NO: 445179 - RNA, 22 nt, Human
aaaugccucuggguuauucuag

SEQ ID NO: 445180 - RNA, 22 nt, Human
gccuggugugcgccgcgcagcu

SEQ ID NO: 445181 - RNA, 22 nt, Human
agacaacaccaaaugcuagugu

SEQ ID NO: 445182 - RNA, 22 nt, Human
aauuuccugggauaaaaagcca

SEQ ID NO: 445183 - RNA, 22 nt, Human
cagcugugauuccugcugucca

SEQ ID NO: 445184 - RNA, 22 nt, Human
ugacaaguuuccuggugauuuu

SEQ ID NO: 445185 - RNA, 22 nt, Human
augcauauugauuauagauuca

SEQ ID NO: 445186 - RNA, 22 nt, Human
uaaggcagauguggaaucaauu

SEQ ID NO: 445187 - RNA, 20 nt, Human
uggagcuguaaucuugucug

SEQ ID NO: 445188 - RNA, 22 nt, Human
ugguacaaagccucuuugccuc

SEQ ID NO: 445189 - RNA, 21 nt, Human
aagagacauuucucaucagca

SEQ ID NO: 445190 - RNA, 22 nt, Human
gagacagaucucggcuccaugc

SEQ ID NO: 445191 - RNA, 22 nt, Human
cccagcagccuggauguucuuu

SEQ ID NO: 445192 - RNA, 22 nt, Human
aggcacagagagguuaaaugca

SEQ ID NO: 445193 - RNA, 22 nt, Human
gcugggaggaucucucccuguc

SEQ ID NO: 445194 - RNA, 22 nt, Human
ccacaggaccagaggagaucac

SEQ ID NO: 445195 - RNA, 22 nt, Human
auguaaauuguacugacacacg

SEQ ID NO: 445196 - RNA, 22 nt, Human
guuaaauucgaugauggauaaa

SEQ ID NO: 445197 - RNA, 22 nt, Human
acucugcaauguggcaagaaca

SEQ ID NO: 445198 - RNA, 22 nt, Human
uuucucccuuuauaagacugua

SEQ ID NO: 445199 - RNA, 22 nt, Human
agcagcugaucaaagcacuuau

SEQ ID NO: 445200 - RNA, 22 nt, Human
gcuggagaccucagagaaccca

SEQ ID NO: 445201 - RNA, 18 nt, Human
ucucucagggaaacagaa

SEQ ID NO: 445202 - RNA, 22 nt, Human
gcaaacaucuuuauuuggcaag

SEQ ID NO: 445203 - RNA, 20 nt, Human
uuucucccaagugcaagggu

SEQ ID NO: 445204 - RNA, 22 nt, Human
agggucuguggaugcaucuggg

SEQ ID NO: 445205 - RNA, 22 nt, Human
ccaggcauccauugcuuccucu

SEQ ID NO: 445206 - RNA, 22 nt, Human
gaacacaacucagaaugcuggu

SEQ ID NO: 445207 - RNA, 22 nt, Human
ugugugugacucauacuagaac

SEQ ID NO: 445208 - RNA, 22 nt, Human
uauuuccauguuagaacuaagu

SEQ ID NO: 445209 - RNA, 22 nt, Human
agguaaggaaauugaggcaauu

SEQ ID NO: 445210 - RNA, 22 nt, Human
uaaagccaacacuuuacugcuc

SEQ ID NO: 445211 - RNA, 22 nt, Human
ugcaggcugcagucucaggugg

SEQ ID NO: 445212 - RNA, 22 nt, Human
ugucauauguugaugaaagaga

SEQ ID NO: 445213 - RNA, 22 nt, Human
uagagcugcuggacuguaacag

SEQ ID NO: 445214 - RNA, 22 nt, Human
gcccuguauccaagucccaucu

SEQ ID NO: 445215 - RNA, 21 nt, Human
guggcccugguguggcugcac

SEQ ID NO: 445216 - RNA, 22 nt, Human
ucacauuuuaucuauuuuaagu

SEQ ID NO: 445217 - RNA, 22 nt, Human
ugacagcagcauagugagcaau

SEQ ID NO: 445218 - RNA, 22 nt, Human
agaaggcagaaaguccagguau

SEQ ID NO: 445219 - RNA, 19 nt, Human
cugucaggggcuggauguu

SEQ ID NO: 445220 - RNA, 22 nt, Human
gagagcaggaggcagcgggacg

SEQ ID NO: 445221 - RNA, 21 nt, Human
cuccucaggaccagccacagg

SEQ ID NO: 445222 - RNA, 20 nt, Human
auuuauguauagcuuguugu

SEQ ID NO: 445223 - RNA, 22 nt, Human
cguuuauuuugaagauuccacu

SEQ ID NO: 445224 - RNA, 22 nt, Human
uuccaugacaccgagggaaguc

SEQ ID NO: 445225 - RNA, 22 nt, Human
ccuuggcugaggagggagcuga

SEQ ID NO: 445226 - RNA, 22 nt, Human
gcuauucauggagcauguacug

SEQ ID NO: 445227 - RNA, 23 nt, Human
ggacacagagauaagugagacaa

SEQ ID NO: 445228 - RNA, 21 nt, Human
agagaccagcuguuacuccca

SEQ ID NO: 445229 - RNA, 22 nt, Human
cucuggcuggcaccugaucuga

SEQ ID NO: 445230 - RNA, 22 nt, Human
aacaucaucaugaacaacuaau

SEQ ID NO: 445231 - RNA, 22 nt, Human
acaggcaaacacagaaaguagg

SEQ ID NO: 445232 - RNA, 22 nt, Human
cacauguucuugaagccaacuc

SEQ ID NO: 445233 - RNA, 22 nt, Human
agcagcuguacuuucaucuguu

SEQ ID NO: 445234 - RNA, 22 nt, Human
aggaggcacucacucucagggu

SEQ ID NO: 445235 - RNA, 19 nt, Human
ucccagagucuagagguug

SEQ ID NO: 445236 - RNA, 22 nt, Human
uuugcaaaguccauugaaguua

SEQ ID NO: 445237 - RNA, 22 nt, Human
gcuuugcuuccuguucuagccu

SEQ ID NO: 445238 - RNA, 22 nt, Human
gaucuuuucagaauuuaucagu

SEQ ID NO: 445239 - RNA, 22 nt, Human
cagcuguuacugaaguaaaaug

SEQ ID NO: 445240 - RNA, 22 nt, Human
guuagagacaucucugguuucu

SEQ ID NO: 445241 - RNA, 22 nt, Human
aaaggucauugaaaaggaggaa

SEQ ID NO: 445242 - RNA, 22 nt, Human
agaggcugugcccaccaggcaa

SEQ ID NO: 445243 - RNA, 22 nt, Human
ucaggcugugggcacuggccau

SEQ ID NO: 445244 - RNA, 22 nt, Human
uggcucagagccuugagagcug

SEQ ID NO: 445245 - RNA, 22 nt, Human
cugaagcugggcacuuccuuuu

SEQ ID NO: 445246 - RNA, 22 nt, Human
ugguacaagcagacucagcaga

SEQ ID NO: 445247 - RNA, 22 nt, Human
acuuugcacuucaauauaacuu

SEQ ID NO: 445248 - RNA, 22 nt, Human
uugcuagcugguguaugcauug

SEQ ID NO: 445249 - RNA, 22 nt, Human
cuggcccuaugagccuccugau

SEQ ID NO: 445250 - RNA, 22 nt, Human
agcugcagucaagcugggccac

SEQ ID NO: 445251 - RNA, 23 nt, Human
uugaggcaaacucuuuucugaaa

SEQ ID NO: 445252 - RNA, 22 nt, Human
aacauguaccuacaaucagaau

SEQ ID NO: 445253 - RNA, 22 nt, Human
gcuaggcucggaagcagcaggg

SEQ ID NO: 445254 - RNA, 22 nt, Human
agucaacagaguggccgcagcg

SEQ ID NO: 445255 - RNA, 22 nt, Human
uugcuuuagggcaaauauuuca

SEQ ID NO: 445256 - RNA, 22 nt, Human
guuaacauaggcuuagggguuu

SEQ ID NO: 445257 - RNA, 22 nt, Human
ggcagggacaggauaggguuuu

SEQ ID NO: 445258 - RNA, 22 nt, Human
aaagacauggcaagagaugggg

SEQ ID NO: 445259 - RNA, 22 nt, Human
cccucccaagcacucugacaua

SEQ ID NO: 445260 - RNA, 20 nt, Human
cuggguggcaagcaaggggg

SEQ ID NO: 445261 - RNA, 22 nt, Human
cacaggaaugaacagggaaaga

SEQ ID NO: 445262 - RNA, 22 nt, Human
augcccuggacuucuaguauuc

SEQ ID NO: 445263 - RNA, 22 nt, Human
uuucuuauacuauauugucauc

SEQ ID NO: 445264 - RNA, 22 nt, Human
uaccaguaauguaacuuugcaa

SEQ ID NO: 445265 - RNA, 22 nt, Human
cuggcaccuccagcucauggcc

SEQ ID NO: 445266 - RNA, 22 nt, Human
aauugcccuuacaguaaucaga

SEQ ID NO: 445267 - RNA, 22 nt, Human
cuggggauccuuuuugcaucua

SEQ ID NO: 445268 - RNA, 22 nt, Human
cccaggagagaggggauaaagc

SEQ ID NO: 445269 - RNA, 22 nt, Human
ugaagcugugggcaguggagcc

SEQ ID NO: 445270 - RNA, 23 nt, Human
gugcucugcggucugcuagucug

SEQ ID NO: 445271 - RNA, 22 nt, Human
gacagcagggacauguaggaag

SEQ ID NO: 445272 - RNA, 22 nt, Human
gagacagaguuucacucuuguu

SEQ ID NO: 445273 - RNA, 20 nt, Human
ucuuggcugugugaggacac

SEQ ID NO: 445274 - RNA, 22 nt, Human
uaucagcaccgcggacagcauc

SEQ ID NO: 445275 - RNA, 22 nt, Human
uugcauugaaaauauauuuuaa

SEQ ID NO: 445276 - RNA, 19 nt, Human
gcaggccaggaggcggagg

SEQ ID NO: 445277 - RNA, 22 nt, Human
guuuccugacccuggcccagca

SEQ ID NO: 445278 - RNA, 22 nt, Human
acugaagucucuuuuguucucu

SEQ ID NO: 445279 - RNA, 22 nt, Human
gggcugcuuauacugaugauaa

SEQ ID NO: 445280 - RNA, 22 nt, Human
cucagcuccaggugugcaucuu

SEQ ID NO: 445281 - RNA, 22 nt, Human
agacauaggauuccacauagca

SEQ ID NO: 445282 - RNA, 21 nt, Human
agcuggcucucucuggagaga

SEQ ID NO: 445283 - RNA, 22 nt, Human
gauucaaaaauaagcuccuauu

SEQ ID NO: 445284 - RNA, 22 nt, Human
uaaguguugaucugagugcuaa

SEQ ID NO: 445285 - RNA, 21 nt, Human
agacagagugcagucuacaua

SEQ ID NO: 445286 - RNA, 22 nt, Human
ggcugugcgggcagccguggga

SEQ ID NO: 445287 - RNA, 22 nt, Human
ggaggggcauaguucaccauca

SEQ ID NO: 445288 - RNA, 22 nt, Human
acagagguggaccucagcaggc

SEQ ID NO: 445289 - RNA, 22 nt, Human
aagaagagaaaugugcugcugg

SEQ ID NO: 445290 - RNA, 22 nt, Human
uuucaaacauuccugggagacu

SEQ ID NO: 445291 - RNA, 22 nt, Human
cgugagggcauggcagugagga

SEQ ID NO: 445292 - RNA, 22 nt, Human
ucagaauucagagggagugggg

SEQ ID NO: 445293 - RNA, 22 nt, Human
gugccagaggcagugaggaguu

SEQ ID NO: 445294 - RNA, 22 nt, Human
ggccccagggaagaaggugguc

SEQ ID NO: 445295 - RNA, 22 nt, Human
guagaaauuccauuuacuuuga

SEQ ID NO: 445296 - RNA, 22 nt, Human
uauagagcuuuggcauugauua

SEQ ID NO: 445297 - RNA, 22 nt, Human
ugagccguggucucugagggug

SEQ ID NO: 445298 - RNA, 22 nt, Human
uuuauuguuuagaagggggcug

SEQ ID NO: 445299 - RNA, 22 nt, Human
aaauuuuccugguaaagaugga

SEQ ID NO: 445300 - RNA, 22 nt, Human
ucaauagauaaagcuacauaaa

SEQ ID NO: 445301 - RNA, 22 nt, Human
guccugcggccucaguggugag

SEQ ID NO: 445302 - RNA, 22 nt, Human
uuugggcauuagaauauucuuu

SEQ ID NO: 445303 - RNA, 22 nt, Human
cauuuguaguuaaaaaugucuc

SEQ ID NO: 445304 - RNA, 22 nt, Human
gagcuggaagucuguggucaga

SEQ ID NO: 445305 - RNA, 23 nt, Human
aacacauugcuaauuacauucaa

SEQ ID NO: 445306 - RNA, 22 nt, Human
uccagcagaaaagagguaggga

SEQ ID NO: 445307 - RNA, 22 nt, Human
uuuaagacuuaggaaagaggau

SEQ ID NO: 445308 - RNA, 22 nt, Human
acacagaguaucuuuugccuag

SEQ ID NO: 445309 - RNA, 22 nt, Human
ccuggcagcgugccgagcugcg

SEQ ID NO: 445310 - RNA, 22 nt, Human
acauucuacaguuaaccauuag

SEQ ID NO: 445311 - RNA, 22 nt, Human
agcacugcuuuagagccucugc

SEQ ID NO: 445312 - RNA, 22 nt, Human
ggaagaggcucucauugagggc

SEQ ID NO: 445313 - RNA, 22 nt, Human
gcgagggcacgcgguugaaggc

SEQ ID NO: 445314 - RNA, 22 nt, Human
gagcaaagcuuuuagggccuuu

SEQ ID NO: 445315 - RNA, 22 nt, Human
aucuucaauugaaaacuagccu

SEQ ID NO: 445316 - RNA, 18 nt, Human
ucagucuauuguauaaga

SEQ ID NO: 445317 - RNA, 22 nt, Human
aaacugcacaagggugcauagc

SEQ ID NO: 445318 - RNA, 22 nt, Human
cucagccccaauuugcccucuu

SEQ ID NO: 445319 - RNA, 22 nt, Human
caaagauuuuagaauuugcaau

SEQ ID NO: 445320 - RNA, 22 nt, Human
uuuauugucaaucuauucccag

SEQ ID NO: 445321 - RNA, 22 nt, Human
ucauacaacuaagaguuucaga

SEQ ID NO: 445322 - RNA, 19 nt, Human
gcagucuguugaagggcag

SEQ ID NO: 445323 - RNA, 22 nt, Human
ggaggcaggaaagacagguuca

SEQ ID NO: 445324 - RNA, 19 nt, Human
gucaggcacgugagagcau

SEQ ID NO: 445325 - RNA, 21 nt, Human
ucacaacuuugaauuucaaua

SEQ ID NO: 445326 - RNA, 22 nt, Human
uggagaauucuauguugagggg

SEQ ID NO: 445327 - RNA, 22 nt, Human
gugcagggcuggcaccggaggc

SEQ ID NO: 445328 - RNA, 22 nt, Human
agacagacauucuagagccacc

SEQ ID NO: 445329 - RNA, 21 nt, Human
auggaaaaacagguagagcau

SEQ ID NO: 445330 - RNA, 22 nt, Human
agagaaaugggguaaucuuuca

SEQ ID NO: 445331 - RNA, 22 nt, Human
ggccccagccucaguccccuga

SEQ ID NO: 445332 - RNA, 22 nt, Human
guggcagagugcgguucugacc

SEQ ID NO: 445333 - RNA, 22 nt, Human
uagaaaagauaacauucugugc

SEQ ID NO: 445334 - RNA, 22 nt, Human
agugacacggagagacagcaug

SEQ ID NO: 445335 - RNA, 22 nt, Human
acagauggcacuuuuuaggacu

SEQ ID NO: 445336 - RNA, 22 nt, Human
gagcagcagguggggcuggcuu

SEQ ID NO: 445337 - RNA, 22 nt, Human
aacacaggggguuacaaauugu

SEQ ID NO: 445338 - RNA, 22 nt, Human
agcucccaggcagucaugagga

SEQ ID NO: 445339 - RNA, 22 nt, Human
gagugcaggccugagcaccauc

SEQ ID NO: 445340 - RNA, 22 nt, Human
uacaggaaguaaguaaugaaau

SEQ ID NO: 445341 - RNA, 22 nt, Human
caggugcccagcuccugcugug

SEQ ID NO: 445342 - RNA, 22 nt, Human
ucccacuuaacugugacuucuc

SEQ ID NO: 445343 - RNA, 22 nt, Human
ugcauauaucuuauuuuucugu

SEQ ID NO: 445344 - RNA, 22 nt, Human
cuacagagaacucagcugcccu

SEQ ID NO: 445345 - RNA, 22 nt, Human
ccacugucugcaggccucagca

SEQ ID NO: 445346 - RNA, 22 nt, Human
cagcugguggcugaugaccguc

SEQ ID NO: 445347 - RNA, 22 nt, Human
ggagaggcuuccagagucgugc

SEQ ID NO: 445348 - RNA, 21 nt, Human
gcuccuggugcugcguggcgc

SEQ ID NO: 445349 - RNA, 22 nt, Human
ucagcaggucugaggcggggcc

SEQ ID NO: 445350 - RNA, 22 nt, Human
aggcugccaaagcuucugucuc

SEQ ID NO: 445351 - RNA, 21 nt, Human
uuugggcaaaauuaaaugaga

SEQ ID NO: 445352 - RNA, 22 nt, Human
uuuauucagcagcagcaguggu

SEQ ID NO: 445353 - RNA, 18 nt, Human
ugcacagcugugggcugg

SEQ ID NO: 445354 - RNA, 22 nt, Human
gauucaaaaguuugagcuccaa

SEQ ID NO: 445355 - RNA, 21 nt, Human
acagcagacaggcuuaggacc

SEQ ID NO: 445356 - RNA, 22 nt, Human
gccuggaggggccaggguggua

SEQ ID NO: 445357 - RNA, 22 nt, Human
ucucagagauguuagggaagag

SEQ ID NO: 445358 - RNA, 22 nt, Human
gcuggucacucugggagcugcu

SEQ ID NO: 445359 - RNA, 22 nt, Human
auccaugaagguacuucucagg

SEQ ID NO: 445360 - RNA, 22 nt, Human
guguccagagaaacucacagcu

SEQ ID NO: 445361 - RNA, 22 nt, Human
cagcccuucuuccaaccagcuu

SEQ ID NO: 445362 - RNA, 23 nt, Human
cacaccaggagccgucugggcca

SEQ ID NO: 445363 - RNA, 22 nt, Human
ugacacagggcaugcagcagaa

SEQ ID NO: 445364 - RNA, 23 nt, Human
aggaagcuaaguguggcugcgga

SEQ ID NO: 445365 - RNA, 22 nt, Human
uagcauaacagguaagagugag

SEQ ID NO: 445366 - RNA, 22 nt, Human
agcagaagaaagccacaugacu

SEQ ID NO: 445367 - RNA, 19 nt, Human
ccagcagcuuugauucucu

SEQ ID NO: 445368 - RNA, 22 nt, Human
gaagagagagugggguucugcg

SEQ ID NO: 445369 - RNA, 22 nt, Human
agccuggaguucccaggagaag

SEQ ID NO: 445370 - RNA, 22 nt, Human
uuacagcaaagugcgcagaccu

SEQ ID NO: 445371 - RNA, 22 nt, Human
ccugagagagaagcgaccuggu

SEQ ID NO: 445372 - RNA, 22 nt, Human
ugagcuguagcagaugcuguug

SEQ ID NO: 445373 - RNA, 22 nt, Human
cauagaaaagaguagguaaugu

SEQ ID NO: 445374 - RNA, 18 nt, Human
ucaguacugcagagagaa

SEQ ID NO: 445375 - RNA, 22 nt, Human
ugggcccugacuucaagcaucc

SEQ ID NO: 445376 - RNA, 22 nt, Human
uuuauacuucauaaugucuauu

SEQ ID NO: 445377 - RNA, 22 nt, Human
ggaugcugggagacagcaggca

SEQ ID NO: 445378 - RNA, 22 nt, Human
uuugagaagauguaauguuaag

SEQ ID NO: 445379 - RNA, 22 nt, Human
aagguccuguagccacagagcc

SEQ ID NO: 445380 - RNA, 22 nt, Human
aagagcuggagcugcuacagga

SEQ ID NO: 445381 - RNA, 22 nt, Human
uggagcaggaagucuauggcug

SEQ ID NO: 445382 - RNA, 22 nt, Human
cccagccucagcuuuacuucca

SEQ ID NO: 445383 - RNA, 22 nt, Human
gcuggcugccuuacuuugugga

SEQ ID NO: 445384 - RNA, 22 nt, Human
ugcugaggcccaggagcacuuu

SEQ ID NO: 445385 - RNA, 17 nt, Human
ugagacagggcaggccc

SEQ ID NO: 445386 - RNA, 22 nt, Human
aagaugaaucaguauguguccu

SEQ ID NO: 445387 - RNA, 22 nt, Human
uacaggaaccagauuguucagc

SEQ ID NO: 445388 - RNA, 22 nt, Human
agacagcaugagccugcugaug

SEQ ID NO: 445389 - RNA, 22 nt, Human
uacaaucaggauaauaauagug

SEQ ID NO: 445390 - RNA, 22 nt, Human
gcaggagcagucaggggcagcu

SEQ ID NO: 445391 - RNA, 22 nt, Human
ucagaggaaacaaucuuuagua

SEQ ID NO: 445392 - RNA, 19 nt, Human
ucucccaugccugugucua

SEQ ID NO: 445393 - RNA, 22 nt, Human
caggacaguuugcuuugcccug

SEQ ID NO: 445394 - RNA, 21 nt, Human
ugcaggcuacuucugacucua

SEQ ID NO: 445395 - RNA, 22 nt, Human
ucucugggacacugggucaguu

SEQ ID NO: 445396 - RNA, 22 nt, Human
cuaauauuuuuagaaaucacga

SEQ ID NO: 445397 - RNA, 22 nt, Human
ccuguucacccuccaugcacag

SEQ ID NO: 445398 - RNA, 22 nt, Human
cuguacaaaguagcugcuggga

SEQ ID NO: 445399 - RNA, 22 nt, Human
cuuugcuaguguuucaguagac

SEQ ID NO: 445400 - RNA, 23 nt, Human
ccuggcagcaaacgaggagguua

SEQ ID NO: 445401 - RNA, 22 nt, Human
ccagcagcagcguccaaggaga

SEQ ID NO: 445402 - RNA, 22 nt, Human
uggcagcuauuacaaggaaguc

SEQ ID NO: 445403 - RNA, 22 nt, Human
uauucaaagugcgaggucaggg

SEQ ID NO: 445404 - RNA, 22 nt, Human
ucagggacugcagagggaagcu

SEQ ID NO: 445405 - RNA, 22 nt, Human
gcacccagccagcaucucagag

SEQ ID NO: 445406 - RNA, 22 nt, Human
cauaauuaggcaguugaucauu

SEQ ID NO: 445407 - RNA, 20 nt, Human
ucuuauacagaaaacauuuu

SEQ ID NO: 445408 - RNA, 22 nt, Human
uuugggcaaagguagaaggaga

SEQ ID NO: 445409 - RNA, 22 nt, Human
aagauuuucucaacuguauuug

SEQ ID NO: 445410 - RNA, 22 nt, Human
caggauggucagaugcauuguc

SEQ ID NO: 445411 - RNA, 22 nt, Human
ugcacacaggucuaggacaugg

SEQ ID NO: 445412 - RNA, 22 nt, Human
acagaauugauggaaaucucag

SEQ ID NO: 445413 - RNA, 22 nt, Human
uauacaguuaaguuucuucagu

SEQ ID NO: 445414 - RNA, 22 nt, Human
aacaauaacuagacaugccaug

SEQ ID NO: 445415 - RNA, 22 nt, Human
acaggcagguugagaaacauuu

SEQ ID NO: 445416 - RNA, 20 nt, Human
ugcccacaauucacaaugcc

SEQ ID NO: 445417 - RNA, 22 nt, Human
uuuauccaucaucugcugaagg

SEQ ID NO: 445418 - RNA, 22 nt, Human
caggccuccuaugagcacuagc

SEQ ID NO: 445419 - RNA, 22 nt, Human
cccuggcaugcaugucccuggc

SEQ ID NO: 445420 - RNA, 22 nt, Human
gcagggucugaggccacagagg

SEQ ID NO: 445421 - RNA, 22 nt, Human
aauuuuaugccuugcacguugg

SEQ ID NO: 445422 - RNA, 22 nt, Human
ugggccacaagccaugggacca

SEQ ID NO: 445423 - RNA, 22 nt, Human
gcagcagaguuugggagauggu

SEQ ID NO: 445424 - RNA, 23 nt, Human
uccuuccuuugagaggcuccauc

SEQ ID NO: 445425 - RNA, 22 nt, Human
cugcccuguggcucugagucau

SEQ ID NO: 445426 - RNA, 22 nt, Human
gggcuaaguggaucagucagga

SEQ ID NO: 445427 - RNA, 22 nt, Human
ucaucugaggcaccagagcaua

SEQ ID NO: 445428 - RNA, 20 nt, Human
guggaugaucaguguagugg

SEQ ID NO: 445429 - RNA, 22 nt, Human
caaggcugcugcgggucgcacc

SEQ ID NO: 445430 - RNA, 22 nt, Human
cgcaggcuccggggugcccugg

SEQ ID NO: 445431 - RNA, 22 nt, Human
ucugggaguggguccaaggaau

SEQ ID NO: 445432 - RNA, 18 nt, Human
ucaaacugucauugguga

SEQ ID NO: 445433 - RNA, 22 nt, Human
augcaguuuaucuccaaaucau

SEQ ID NO: 445434 - RNA, 22 nt, Human
auuuuacuacuccaauuaauga

SEQ ID NO: 445435 - RNA, 22 nt, Human
cacagaggaaaggcaguuggua

SEQ ID NO: 445436 - RNA, 19 nt, Human
agacagagcucaguggguu

SEQ ID NO: 445437 - RNA, 22 nt, Human
aggaaaggugagagcggccgcg

SEQ ID NO: 445438 - RNA, 22 nt, Human
acagcaggauuuggcgauguug

SEQ ID NO: 445439 - RNA, 22 nt, Human
gugcugagcaucaugaggcacu

SEQ ID NO: 445440 - RNA, 22 nt, Human
uagcugagagcucacuugagga

SEQ ID NO: 445441 - RNA, 22 nt, Human
uuagugucuucuucauccucug

SEQ ID NO: 445442 - RNA, 22 nt, Human
ggggacagucgaucuagugauu

SEQ ID NO: 445443 - RNA, 21 nt, Human
ugugucacuaacuagaggcua

SEQ ID NO: 445444 - RNA, 18 nt, Human
ugaggcagucagugaugg

SEQ ID NO: 445445 - RNA, 22 nt, Human
aggagguugccagucugggggu

SEQ ID NO: 445446 - RNA, 22 nt, Human
ugugugccagccuacgaggagc

SEQ ID NO: 445447 - RNA, 22 nt, Human
cuuuacaaacuauaaagugcgg

SEQ ID NO: 445448 - RNA, 22 nt, Human
uggaaaccuacugauacaggag

SEQ ID NO: 445449 - RNA, 22 nt, Human
gccccagccaaggugacacgaa

SEQ ID NO: 445450 - RNA, 22 nt, Human
aaaugugaguuauagcaauaga

SEQ ID NO: 445451 - RNA, 22 nt, Human
auuuuguugaugguggaguagc

SEQ ID NO: 445452 - RNA, 23 nt, Human
cccagaggagcagggcgugagau

SEQ ID NO: 445453 - RNA, 22 nt, Human
ccagcucugccaagcgucagcu

SEQ ID NO: 445454 - RNA, 22 nt, Human
gcccagaaagcaucauugugga

SEQ ID NO: 445455 - RNA, 22 nt, Human
caggacacagaauaaggcaguu

SEQ ID NO: 445456 - RNA, 22 nt, Human
aagcccagaugggagcauuuca

SEQ ID NO: 445457 - RNA, 22 nt, Human
acacugcuucucuggcagagcc

SEQ ID NO: 445458 - RNA, 22 nt, Human
agcugcccuucucuugcccuug

SEQ ID NO: 445459 - RNA, 17 nt, Human
ccagaugcccugucucc

SEQ ID NO: 445460 - RNA, 22 nt, Human
ucccagccuggacccugccagu

SEQ ID NO: 445461 - RNA, 22 nt, Human
gcaaacauccacugcccuugua

SEQ ID NO: 445462 - RNA, 22 nt, Human
ugcagcaaaaggucagagggag

SEQ ID NO: 445463 - RNA, 22 nt, Human
ggccugagcagacagcaugaug

SEQ ID NO: 445464 - RNA, 22 nt, Human
uuagcaaauaucuugaaacagg

SEQ ID NO: 445465 - RNA, 22 nt, Human
gagguggcuccuucagggaaua

SEQ ID NO: 445466 - RNA, 22 nt, Human
aacauugaguucuacuuccauu

SEQ ID NO: 445467 - RNA, 22 nt, Human
ccagccugguucagaauuggcu

SEQ ID NO: 445468 - RNA, 22 nt, Human
ucaagguugccaggaaggaaga

SEQ ID NO: 445469 - RNA, 22 nt, Human
aggaugggccugggauaugcuu

SEQ ID NO: 445470 - RNA, 19 nt, Human
gggcccagcauggaggguu

SEQ ID NO: 445471 - RNA, 22 nt, Human
cagacauggaaauuuaguguua

SEQ ID NO: 445472 - RNA, 21 nt, Human
ucaggcugaugucgauguuag

SEQ ID NO: 445473 - RNA, 22 nt, Human
cagcuccccaugguuccugaag

SEQ ID NO: 445474 - RNA, 22 nt, Human
aagugauuuagucuuauaaagg

SEQ ID NO: 445475 - RNA, 22 nt, Human
acugcagggcauccuggccaag

SEQ ID NO: 445476 - RNA, 23 nt, Human
ugacagagcaagacuuggucuca

SEQ ID NO: 445477 - RNA, 22 nt, Human
agcaggugagcacagccaggcu

SEQ ID NO: 445478 - RNA, 22 nt, Human
ucccagccuuccuuguggugaa

SEQ ID NO: 445479 - RNA, 22 nt, Human
cacagaggugauaguggucaag

SEQ ID NO: 445480 - RNA, 22 nt, Human
ccagaggcagacuuacacucca

SEQ ID NO: 445481 - RNA, 22 nt, Human
ccuggcaguuuugcccaggauu

SEQ ID NO: 445482 - RNA, 22 nt, Human
uuuccaaauaaggucacacuca

SEQ ID NO: 445483 - RNA, 22 nt, Human
ugcaggcucacccuggagcuga

SEQ ID NO: 445484 - RNA, 22 nt, Human
guuauugacucucuuguggcuu

SEQ ID NO: 445485 - RNA, 22 nt, Human
aacaucucuguauuuuauagac

SEQ ID NO: 445486 - RNA, 22 nt, Human
ccaggguggcguagaugcuggg

SEQ ID NO: 445487 - RNA, 22 nt, Human
uccuucuuucaccucauaguca

SEQ ID NO: 445488 - RNA, 22 nt, Human
ucuuugcauggacauguguuuu

SEQ ID NO: 445489 - RNA, 23 nt, Human
cugcagucgccggccugggugcc

SEQ ID NO: 445490 - RNA, 22 nt, Human
acaggccauaaaggcaggcccu

SEQ ID NO: 445491 - RNA, 22 nt, Human
acauuucugcuagaauagguga

SEQ ID NO: 445492 - RNA, 17 nt, Human
cagacaggcugucaccc

SEQ ID NO: 445493 - RNA, 22 nt, Human
aucuggugacacgaggagcugg

SEQ ID NO: 445494 - RNA, 22 nt, Human
acagugaaugcccaagaaaagu

SEQ ID NO: 445495 - RNA, 22 nt, Human
ggaacauuuuuuaaggcagaaa

SEQ ID NO: 445496 - RNA, 20 nt, Human
uuuauucagccuacccucuu

SEQ ID NO: 445497 - RNA, 22 nt, Human
agcaggacaauaugggaucagg

SEQ ID NO: 445498 - RNA, 22 nt, Human
agagcuguuuggacaucugagu

SEQ ID NO: 445499 - RNA, 22 nt, Human
ggccccaggucugaacacgcug

SEQ ID NO: 445500 - RNA, 22 nt, Human
aaaugacaauaaaaguccaugc

SEQ ID NO: 445501 - RNA, 22 nt, Human
cuccuguauguugggcuucaca

SEQ ID NO: 445502 - RNA, 22 nt, Human
aaagagcuaacauugccgagau

SEQ ID NO: 445503 - RNA, 22 nt, Human
cagacagacagccguggccacc

SEQ ID NO: 445504 - RNA, 22 nt, Human
gccuggagagcacugugcgcuu

SEQ ID NO: 445505 - RNA, 22 nt, Human
ugaagcuauauaaguuacagca

SEQ ID NO: 445506 - RNA, 22 nt, Human
cacaggaagcugacugcuggca

SEQ ID NO: 445507 - RNA, 22 nt, Human
cuuguuuuggcuaguaugaugu

SEQ ID NO: 445508 - RNA, 22 nt, Human
uuuucaugucauguccuugagg

SEQ ID NO: 445509 - RNA, 22 nt, Human
aaagacauggaacuagagaugg

SEQ ID NO: 445510 - RNA, 22 nt, Human
agaaagcaucuccauuguaggu

SEQ ID NO: 445511 - RNA, 22 nt, Human
caaguucacuugucuacaaggg

SEQ ID NO: 445512 - RNA, 22 nt, Human
cagcaagauuaagggcagaaaa

SEQ ID NO: 445513 - RNA, 22 nt, Human
gccuucugauaucucuuggcau

SEQ ID NO: 445514 - RNA, 22 nt, Human
acugauuucagggaugagaaga

SEQ ID NO: 445515 - RNA, 22 nt, Human
ucaggcugagaaaaucuggacc

SEQ ID NO: 445516 - RNA, 22 nt, Human
aacaguacuugauaauuugcac

SEQ ID NO: 445517 - RNA, 22 nt, Human
uuccuuccccuagcugagaaac

SEQ ID NO: 445518 - RNA, 22 nt, Human
cuuauagauggcgaucuucuug

SEQ ID NO: 445519 - RNA, 22 nt, Human
cuggagccugcaguuuucacuu

SEQ ID NO: 445520 - RNA, 22 nt, Human
ugugcucugaagagugcauguc

SEQ ID NO: 445521 - RNA, 22 nt, Human
ucagaauuuaaaauguguagau

SEQ ID NO: 445522 - RNA, 22 nt, Human
cccaggcacagauuaucccaau

SEQ ID NO: 445523 - RNA, 22 nt, Human
cagacaggaaguucagaagaaa

SEQ ID NO: 445524 - RNA, 22 nt, Human
ucagcaggggccguugggugga

SEQ ID NO: 445525 - RNA, 22 nt, Human
gaaaugaaacaggcuuuuaagg

SEQ ID NO: 445526 - RNA, 20 nt, Human
auguuaaauagcauuuagag

SEQ ID NO: 445527 - RNA, 22 nt, Human
uaaauuuuuguuaacagccucu

SEQ ID NO: 445528 - RNA, 22 nt, Human
gcaggccugucuugcucgcccu

SEQ ID NO: 445529 - RNA, 22 nt, Human
agcaggcugaugggcaugcuug

SEQ ID NO: 445530 - RNA, 22 nt, Human
aagccagccagugccagucuua

SEQ ID NO: 445531 - RNA, 22 nt, Human
gagcacagaacuaaaugcuggu

SEQ ID NO: 445532 - RNA, 22 nt, Human
uggauugauaagagacaaguga

SEQ ID NO: 445533 - RNA, 22 nt, Human
guuuauuauacaacaaaagcua

SEQ ID NO: 445534 - RNA, 22 nt, Human
guccccucagccacccaugggg

SEQ ID NO: 445535 - RNA, 20 nt, Human
agagccuggaaaaagacauc

SEQ ID NO: 445536 - RNA, 22 nt, Human
augugcuuauggucucugguug

SEQ ID NO: 445537 - RNA, 21 nt, Human
ccagaggccucucuuggccac

SEQ ID NO: 445538 - RNA, 22 nt, Human
ccagagaauuuuagacaaaaau

SEQ ID NO: 445539 - RNA, 22 nt, Human
ugggccugggcuccuguccucu

SEQ ID NO: 445540 - RNA, 20 nt, Human
agacccuguguccuguggcc

SEQ ID NO: 445541 - RNA, 22 nt, Human
cugugggccuagucuggccuag

SEQ ID NO: 445542 - RNA, 22 nt, Human
uaugugcacauuagagagaugg

SEQ ID NO: 445543 - RNA, 22 nt, Human
cucugcccgugccuuucccagu

SEQ ID NO: 445544 - RNA, 17 nt, Human
gagugcugguggagcuc

SEQ ID NO: 445545 - RNA, 22 nt, Human
caggcagacuuugagaaugaug

SEQ ID NO: 445546 - RNA, 22 nt, Human
cugcucugcagcuuggacuccc

SEQ ID NO: 445547 - RNA, 22 nt, Human
aggcuggaguacaguggcuauu

SEQ ID NO: 445548 - RNA, 22 nt, Human
gugagagguuccuguuagaacu

SEQ ID NO: 445549 - RNA, 20 nt, Human
cagcccuuuauccuccuaug

SEQ ID NO: 445550 - RNA, 22 nt, Human
acagagguguguguaggacagu

SEQ ID NO: 445551 - RNA, 22 nt, Human
gugcaaaaguaauuacaguuuu

SEQ ID NO: 445552 - RNA, 22 nt, Human
auugcaaaugagucuuaauaua

SEQ ID NO: 445553 - RNA, 22 nt, Human
acuucauugcuaagaacaaggu

SEQ ID NO: 445554 - RNA, 22 nt, Human
ugagcugagaacacuugggcua

SEQ ID NO: 445555 - RNA, 22 nt, Human
gcaaggcugggagaugaggccu

SEQ ID NO: 445556 - RNA, 22 nt, Human
caggcagccugagggaucuggg

SEQ ID NO: 445557 - RNA, 22 nt, Human
ucccuggggaagggcaagcaag

SEQ ID NO: 445558 - RNA, 22 nt, Human
uaaaugccauucguuucauaca

SEQ ID NO: 445559 - RNA, 22 nt, Human
ccaggcccaggguacugaccaa

SEQ ID NO: 445560 - RNA, 22 nt, Human
ggucccaggcucccucuugucc

SEQ ID NO: 445561 - RNA, 22 nt, Human
uacuauaacuucgaaguccugg

SEQ ID NO: 445562 - RNA, 22 nt, Human
gagguagggcagaggcugaaug

SEQ ID NO: 445563 - RNA, 22 nt, Human
agcagcaacugcuagaguggca

SEQ ID NO: 445564 - RNA, 20 nt, Human
gaaggcaaugguuuggcaca

SEQ ID NO: 445565 - RNA, 22 nt, Human
aguacuuuuuguucaauugugc

SEQ ID NO: 445566 - RNA, 22 nt, Human
agaucaaggugucagcaggcuu

SEQ ID NO: 445567 - RNA, 22 nt, Human
gaugauuuucuguguuagaaga

SEQ ID NO: 445568 - RNA, 22 nt, Human
gcagcagugcgggcagcuacag

SEQ ID NO: 445569 - RNA, 22 nt, Human
uggucaaugaagauacacuauu

SEQ ID NO: 445570 - RNA, 22 nt, Human
uuugucaaucccuugaaaaccu

SEQ ID NO: 445571 - RNA, 22 nt, Human
ggagauggcuggcagguagaug

SEQ ID NO: 445572 - RNA, 22 nt, Human
acuguacacgugucauuuacag

SEQ ID NO: 445573 - RNA, 22 nt, Human
cuguuucaugaaugcaauuuca

SEQ ID NO: 445574 - RNA, 22 nt, Human
cagaggcugggaccucaggcau

SEQ ID NO: 445575 - RNA, 22 nt, Human
caggcugaucagggcugggaug

SEQ ID NO: 445576 - RNA, 22 nt, Human
ugaaaaaacaaguuggcccauu

SEQ ID NO: 445577 - RNA, 22 nt, Human
cugcagcuuuuugugcuuguaa

SEQ ID NO: 445578 - RNA, 21 nt, Human
aggcagcucaggcccagagag

SEQ ID NO: 445579 - RNA, 22 nt, Human
uucuugauucuuccuugaagga

SEQ ID NO: 445580 - RNA, 21 nt, Human
cccuucuuacucaagcucauu

SEQ ID NO: 445581 - RNA, 22 nt, Human
ucagaauuuucuggaauggagc

SEQ ID NO: 445582 - RNA, 22 nt, Human
uuccugaaucccaaggagagcu

SEQ ID NO: 445583 - RNA, 20 nt, Human
ggcagggcaucaacagcucu

SEQ ID NO: 445584 - RNA, 22 nt, Human
ucugccuguucaagucuucuag

SEQ ID NO: 445585 - RNA, 20 nt, Human
aggcagcugggaaaugaggg

SEQ ID NO: 445586 - RNA, 18 nt, Human
agcauggcacaggcuccc

SEQ ID NO: 445587 - RNA, 22 nt, Human
acuugcaucuuagagacucacc

SEQ ID NO: 445588 - RNA, 22 nt, Human
caggaaggcccaccuguccugu

SEQ ID NO: 445589 - RNA, 22 nt, Human
uugcaaaaccauccuaaguaaa

SEQ ID NO: 445590 - RNA, 22 nt, Human
ggcacagccacuuuggagaacu

SEQ ID NO: 445591 - RNA, 22 nt, Human
ucacagcuccagacugcaacuc

SEQ ID NO: 445592 - RNA, 22 nt, Human
gaaguauaugucuuuaaucuau

SEQ ID NO: 445593 - RNA, 22 nt, Human
cuuccugcccacuuccugcugg

SEQ ID NO: 445594 - RNA, 22 nt, Human
gcuaaugauagcaagauaaaca

SEQ ID NO: 445595 - RNA, 22 nt, Human
gaaugaauucagcacauggaau

SEQ ID NO: 445596 - RNA, 22 nt, Human
agagcagucaggcuaggacacu

SEQ ID NO: 445597 - RNA, 22 nt, Human
aaauucuuucauggcuaauaag

SEQ ID NO: 445598 - RNA, 22 nt, Human
gaggcuggcagaaaagcacagg

SEQ ID NO: 445599 - RNA, 22 nt, Human
cagcagcagauucagcgucugg

SEQ ID NO: 445600 - RNA, 22 nt, Human
ucaggcucccugcugggcucug

SEQ ID NO: 445601 - RNA, 22 nt, Human
cuugggcaagcagcauucagaa

SEQ ID NO: 445602 - RNA, 22 nt, Human
aaggaaagaguaugcaccuugu

SEQ ID NO: 445603 - RNA, 22 nt, Human
uugggcugaacccugcagcuga

SEQ ID NO: 445604 - RNA, 22 nt, Human
cagcacagugcagaugcugacu

SEQ ID NO: 445605 - RNA, 22 nt, Human
ggcagccaugucccagggcuuc

SEQ ID NO: 445606 - RNA, 17 nt, Human
uagcagcaguaauugug

SEQ ID NO: 445607 - RNA, 22 nt, Human
aauguaaaauaucuuguacuug

SEQ ID NO: 445608 - RNA, 22 nt, Human
cagagugaaauaggggaucaag

SEQ ID NO: 445609 - RNA, 22 nt, Human
ccagagcugauuccugggacuu

SEQ ID NO: 445610 - RNA, 22 nt, Human
uaggaauuuugcaugggaauuu

SEQ ID NO: 445611 - RNA, 20 nt, Human
uuaagaaaagcacauccugc

SEQ ID NO: 445612 - RNA, 22 nt, Human
cagcagcugauggggaagugau

SEQ ID NO: 445613 - RNA, 22 nt, Human
aaguccugccagcaaauguaua

SEQ ID NO: 445614 - RNA, 22 nt, Human
gcagcgcuacucacagcucuga

SEQ ID NO: 445615 - RNA, 18 nt, Human
ccacuuugcagccuggcc

SEQ ID NO: 445616 - RNA, 17 nt, Human
cuggagccaagagggcc

SEQ ID NO: 445617 - RNA, 22 nt, Human
aucuaauuuucacucauuugcu

SEQ ID NO: 445618 - RNA, 19 nt, Human
ggcagcuggacgcuguuca

SEQ ID NO: 445619 - RNA, 22 nt, Human
gccccagcucugccacaacuag

SEQ ID NO: 445620 - RNA, 22 nt, Human
cauguacaugcaugggcacugu

SEQ ID NO: 445621 - RNA, 22 nt, Human
uugggagguaauggagccaagu

SEQ ID NO: 445622 - RNA, 19 nt, Human
uccccagcaccucugaguc

SEQ ID NO: 445623 - RNA, 22 nt, Human
uuucagagagaucaacauagcu

SEQ ID NO: 445624 - RNA, 22 nt, Human
uauuaaauauaucuguuaguug

SEQ ID NO: 445625 - RNA, 22 nt, Human
gaaagaaugcuauagugacuuc

SEQ ID NO: 445626 - RNA, 23 nt, Human
uuuuuugucuugcuaggcugccc

SEQ ID NO: 445627 - RNA, 22 nt, Human
uguuuucauggagaugguggcg

SEQ ID NO: 445628 - RNA, 22 nt, Human
cucacagaugcugugggucagg

SEQ ID NO: 445629 - RNA, 22 nt, Human
aggcuccacccuacagagcucc

SEQ ID NO: 445630 - RNA, 22 nt, Human
aggccucugggucuccucugac

SEQ ID NO: 445631 - RNA, 20 nt, Human
ggccuuggguuucgccuguu

SEQ ID NO: 445632 - RNA, 22 nt, Human
uucagggacuuugauguaucag

SEQ ID NO: 445633 - RNA, 22 nt, Human
auccuuuaguccuacaacucga

SEQ ID NO: 445634 - RNA, 22 nt, Human
gugugugugcaucucuuuuauu

SEQ ID NO: 445635 - RNA, 23 nt, Human
agaggccagccuuuggagacacc

SEQ ID NO: 445636 - RNA, 22 nt, Human
uuggagagaggcugcucaggcu

SEQ ID NO: 445637 - RNA, 21 nt, Human
aguguguguggaaugagaaua

SEQ ID NO: 445638 - RNA, 22 nt, Human
ucccauugccauagauaggaca

SEQ ID NO: 445639 - RNA, 22 nt, Human
gcaggcaggaaggacuaaguaa

SEQ ID NO: 445640 - RNA, 22 nt, Human
aagcuaaggguguuuaagcagg

SEQ ID NO: 445641 - RNA, 22 nt, Human
ugagcagagcaauaggacucuc

SEQ ID NO: 445642 - RNA, 22 nt, Human
ugcauauuauaaagagaauuag

SEQ ID NO: 445643 - RNA, 22 nt, Human
ccagggcaggggcuggaguuca

SEQ ID NO: 445644 - RNA, 22 nt, Human
uaauuauucuagucacauagca

SEQ ID NO: 445645 - RNA, 23 nt, Human
acaaugcacuuuaaaugguuccc

SEQ ID NO: 445646 - RNA, 22 nt, Human
ggugcaggcgguggggcaagua

SEQ ID NO: 445647 - RNA, 22 nt, Human
acaguacugcuguucuuguccu

SEQ ID NO: 445648 - RNA, 22 nt, Human
auaaaugugaauuagagcuuug

SEQ ID NO: 445649 - RNA, 22 nt, Human
cugcaggcugagcgccugccgg

SEQ ID NO: 445650 - RNA, 22 nt, Human
auaaauuaggaucugggguucc

SEQ ID NO: 445651 - RNA, 22 nt, Human
aguuuacacuuuugauucuuau

SEQ ID NO: 445652 - RNA, 22 nt, Human
ggugggcaggcgaggcccaggu

SEQ ID NO: 445653 - RNA, 22 nt, Human
uuuagacauagcugaaaucauu

SEQ ID NO: 445654 - RNA, 22 nt, Human
cccagcagauggcuaugugcua

SEQ ID NO: 445655 - RNA, 22 nt, Human
aggccagccuuguaaaugccuc

SEQ ID NO: 445656 - RNA, 22 nt, Human
ccagcagcauccugcagcacuu

SEQ ID NO: 445657 - RNA, 22 nt, Human
uuaaaggcugaucuuaauauua

SEQ ID NO: 445658 - RNA, 22 nt, Human
cacaguuugguauagaagugau

SEQ ID NO: 445659 - RNA, 20 nt, Human
auguauauuacuggcuguga

SEQ ID NO: 445660 - RNA, 22 nt, Human
uggagcagcuaagccucugaga

SEQ ID NO: 445661 - RNA, 18 nt, Human
ucugggcuucccgaggcu

SEQ ID NO: 445662 - RNA, 22 nt, Human
ugacagagacagauugaagcuu

SEQ ID NO: 445663 - RNA, 22 nt, Human
aagaacaugaguuaugaugauu

SEQ ID NO: 445664 - RNA, 22 nt, Human
gcugccaugguccaggcuccag

SEQ ID NO: 445665 - RNA, 22 nt, Human
ggccccacgggggaguccuagu

SEQ ID NO: 445666 - RNA, 22 nt, Human
gaagcacauggcugugagcaac

SEQ ID NO: 445667 - RNA, 22 nt, Human
uggcagauaaacaugugauaaa

SEQ ID NO: 445668 - RNA, 22 nt, Human
gagcccugaacaacagcaggaa

SEQ ID NO: 445669 - RNA, 22 nt, Human
aaauuuuaaggcuggaacuuaa

SEQ ID NO: 445670 - RNA, 22 nt, Human
cugugggcgccugucagccuca

SEQ ID NO: 445671 - RNA, 22 nt, Human
cagagacauguggccugcacgu

SEQ ID NO: 445672 - RNA, 22 nt, Human
cuggcucccagcuuucagggag

SEQ ID NO: 445673 - RNA, 22 nt, Human
uaggaaauucucuugcuaaguu

SEQ ID NO: 445674 - RNA, 22 nt, Human
agcccaaggcuucccugcuggc

SEQ ID NO: 445675 - RNA, 22 nt, Human
cuggaagggucagagugaugag

SEQ ID NO: 445676 - RNA, 22 nt, Human
ccugggcuccacuccaagagca

SEQ ID NO: 445677 - RNA, 22 nt, Human
aggucacccguuugacuaucca

SEQ ID NO: 445678 - RNA, 22 nt, Human
cacuggcuugauggguaaugcc

SEQ ID NO: 445679 - RNA, 22 nt, Human
gugcccugcaugccccggguau

SEQ ID NO: 445680 - RNA, 22 nt, Human
ccuggcuccgguucaagggaaa

SEQ ID NO: 445681 - RNA, 22 nt, Human
auaaagcaaauaggacuauugc

SEQ ID NO: 445682 - RNA, 22 nt, Human
cagcaggcuguggaaauccugg

SEQ ID NO: 445683 - RNA, 22 nt, Human
aagcagccuggcaugaugcuuu

SEQ ID NO: 445684 - RNA, 22 nt, Human
agguccuggucuugagucuuaa

SEQ ID NO: 445685 - RNA, 22 nt, Human
augcagcagccccuugaggugc

SEQ ID NO: 445686 - RNA, 22 nt, Human
cugcuggggucagagcacuggg

SEQ ID NO: 445687 - RNA, 22 nt, Human
aucuaacugggcuauuuuauug

SEQ ID NO: 445688 - RNA, 22 nt, Human
ugcccaggauugugaggucagg

SEQ ID NO: 445689 - RNA, 22 nt, Human
uuugcuuugggagguugucugg

SEQ ID NO: 445690 - RNA, 22 nt, Human
uucaaguaggccagcugcaugg

SEQ ID NO: 445691 - RNA, 22 nt, Human
cucuguuuggcgcugcuccuuc

SEQ ID NO: 445692 - RNA, 22 nt, Human
aaugccuuggagagccuagagg

SEQ ID NO: 445693 - RNA, 22 nt, Human
aaauauuugucugaggcgguug

SEQ ID NO: 445694 - RNA, 22 nt, Human
auagaaauggcagcuggugcua

SEQ ID NO: 445695 - RNA, 22 nt, Human
acagagcacauagauuggaguu

SEQ ID NO: 445696 - RNA, 22 nt, Human
agagccugugggagaugcagcu

SEQ ID NO: 445697 - RNA, 22 nt, Human
ucuccucaccaccagcagcaga

SEQ ID NO: 445698 - RNA, 22 nt, Human
ccucacagaggggcagccaucu

SEQ ID NO: 445699 - RNA, 22 nt, Human
cugcaaaucaaguucuuauaau

SEQ ID NO: 445700 - RNA, 22 nt, Human
cccaggagaauauaauguucuu

SEQ ID NO: 445701 - RNA, 22 nt, Human
ugcaaauacaaaaugguacagc

SEQ ID NO: 445702 - RNA, 22 nt, Human
ggugcauggaaagaguaaguaa

SEQ ID NO: 445703 - RNA, 22 nt, Human
uuuugguagaaucaacaaugua

SEQ ID NO: 445704 - RNA, 22 nt, Human
gcugccugucccaggaugagga

SEQ ID NO: 445705 - RNA, 22 nt, Human
acagagcuguacaugugccaug

SEQ ID NO: 445706 - RNA, 22 nt, Human
uuuggcaaagaucaacauguua

SEQ ID NO: 445707 - RNA, 22 nt, Human
cgggcagauugggaagguucau

SEQ ID NO: 445708 - RNA, 22 nt, Human
aagggcaggcacccacccucac

SEQ ID NO: 445709 - RNA, 22 nt, Human
ccagagcuccagggcuacagaa

SEQ ID NO: 445710 - RNA, 22 nt, Human
gcaggaugggagcuucacucug

SEQ ID NO: 445711 - RNA, 21 nt, Human
gcccagaguuaagcccaccca

SEQ ID NO: 445712 - RNA, 22 nt, Human
cuuggcugggaacugugauuca

SEQ ID NO: 445713 - RNA, 22 nt, Human
gacauucauuaagccuuucugu

SEQ ID NO: 445714 - RNA, 22 nt, Human
aaacugcaugaagcugauuuua

SEQ ID NO: 445715 - RNA, 22 nt, Human
gagauauaagaucuagaaagga

SEQ ID NO: 445716 - RNA, 22 nt, Human
cacaggcaggagguucuccagu

SEQ ID NO: 445717 - RNA, 19 nt, Human
uugugugucagucagaguu

SEQ ID NO: 445718 - RNA, 22 nt, Human
ucccagaggaaauggcagcuga

SEQ ID NO: 445719 - RNA, 22 nt, Human
ucuuugcaggccaaauuguuaa

SEQ ID NO: 445720 - RNA, 22 nt, Human
agcaggagcugugggaagaugg

SEQ ID NO: 445721 - RNA, 22 nt, Human
auugcuuucuuuggggaacugu

SEQ ID NO: 445722 - RNA, 22 nt, Human
gaaauacaaagccagccauuuu

SEQ ID NO: 445723 - RNA, 21 nt, Human
caucaugcuuguguuggagaa

SEQ ID NO: 445724 - RNA, 22 nt, Human
aguuauauaacuaucuagaugc

SEQ ID NO: 445725 - RNA, 22 nt, Human
gcccugcagugcggagguggca

SEQ ID NO: 445726 - RNA, 22 nt, Human
agcagacauggcuuggaugugg

SEQ ID NO: 445727 - RNA, 22 nt, Human
aggauuuguauagcuuucuuuu

SEQ ID NO: 445728 - RNA, 22 nt, Human
uccuuuccaugcuucuagaggc

SEQ ID NO: 445729 - RNA, 20 nt, Human
ugcuuuuauaccuauaauga

SEQ ID NO: 445730 - RNA, 21 nt, Human
aaauucaccuaguaaaacuuc

SEQ ID NO: 445731 - RNA, 22 nt, Human
uucuuuuaauuucugucugcag

SEQ ID NO: 445732 - RNA, 22 nt, Human
gugcacagauuuaauuuuauuc

SEQ ID NO: 445733 - RNA, 18 nt, Human
cucucuggucuggauccc

SEQ ID NO: 445734 - RNA, 22 nt, Human
aauuuuguuuaagugaucugcu

SEQ ID NO: 445735 - RNA, 22 nt, Human
ggaagcuccccaagccugcccu

SEQ ID NO: 445736 - RNA, 22 nt, Human
uaguugaagagaugaaugacca

SEQ ID NO: 445737 - RNA, 22 nt, Human
agcccagguugaggcugcagug

SEQ ID NO: 445738 - RNA, 22 nt, Human
acagaauacucauaagaagggg

SEQ ID NO: 445739 - RNA, 22 nt, Human
acaauacuauuuucaguauccu

SEQ ID NO: 445740 - RNA, 22 nt, Human
agacccugcauuuuccaggguu

SEQ ID NO: 445741 - RNA, 22 nt, Human
agccagcaucccuucagucucc

SEQ ID NO: 445742 - RNA, 22 nt, Human
cauguucaccuguggcacuagu

SEQ ID NO: 445743 - RNA, 19 nt, Human
ucaugcaguggggggugug

SEQ ID NO: 445744 - RNA, 20 nt, Human
ggcaggcuuuauauggaggg

SEQ ID NO: 445745 - RNA, 22 nt, Human
ucagcagggccuccuugugcag

SEQ ID NO: 445746 - RNA, 22 nt, Human
auggcugagaugggcuccaggc

SEQ ID NO: 445747 - RNA, 22 nt, Human
augaggcaugugaggagaaggg

SEQ ID NO: 445748 - RNA, 22 nt, Human
ugagaaggugaaaguguggaga

SEQ ID NO: 445749 - RNA, 22 nt, Human
agaaaagguugaaaguaggauu

SEQ ID NO: 445750 - RNA, 22 nt, Human
gccuggagcucuccacuugggg

SEQ ID NO: 445751 - RNA, 22 nt, Human
cagucuaaguuaauuuccacaa

SEQ ID NO: 445752 - RNA, 22 nt, Human
uuucaacaggaugauaauaggc

SEQ ID NO: 445753 - RNA, 22 nt, Human
uuugcugacuggaugcaguugg

SEQ ID NO: 445754 - RNA, 22 nt, Human
acagaauuaaugaaaauuacaa

SEQ ID NO: 445755 - RNA, 22 nt, Human
ugugcccauuccacuugaguac

SEQ ID NO: 445756 - RNA, 22 nt, Human
uacagcacggugcauuuacuac

SEQ ID NO: 445757 - RNA, 22 nt, Human
guuccugagaaauaaagagaga

SEQ ID NO: 445758 - RNA, 22 nt, Human
ugcaggugccucuugagcuugu

SEQ ID NO: 445759 - RNA, 22 nt, Human
acaucaugagagacuuaaauug

SEQ ID NO: 445760 - RNA, 22 nt, Human
uuuaagacucuuguaguacaca

SEQ ID NO: 445761 - RNA, 22 nt, Human
ggcaauaaaugacuucugcauu

SEQ ID NO: 445762 - RNA, 22 nt, Human
gggacaauggaggccucucucc

SEQ ID NO: 445763 - RNA, 22 nt, Human
cuguuucaauuugaggaucagc

SEQ ID NO: 445764 - RNA, 22 nt, Human
aggaauuguguuguaguggaga

SEQ ID NO: 445765 - RNA, 22 nt, Human
cuguuucaaaacuaguacaaca

SEQ ID NO: 445766 - RNA, 22 nt, Human
aacuaaaccaugacauuauauu

SEQ ID NO: 445767 - RNA, 22 nt, Human
aaguggacuaauacaaggacua

SEQ ID NO: 445768 - RNA, 22 nt, Human
cauuuguaguaucuguuuauau

SEQ ID NO: 445769 - RNA, 23 nt, Human
cacuggugggguuuaaaagaagc

SEQ ID NO: 445770 - RNA, 22 nt, Human
aggagcagcccacuccuguccu

SEQ ID NO: 445771 - RNA, 22 nt, Human
ccugcugcuaugaaggugacag

SEQ ID NO: 445772 - RNA, 22 nt, Human
cuauuauuuccucaucuauaaa

SEQ ID NO: 445773 - RNA, 22 nt, Human
ugcccagccaguuuaugguaau

SEQ ID NO: 445774 - RNA, 22 nt, Human
ugacauucuguuaagucucaua

SEQ ID NO: 445775 - RNA, 19 nt, Human
cugaaaaacauucucagga

SEQ ID NO: 445776 - RNA, 17 nt, Human
agcagcuggcacaggag

SEQ ID NO: 445777 - RNA, 22 nt, Human
ggaggggcagccauggaacucc

SEQ ID NO: 445778 - RNA, 22 nt, Human
uuugcaaaaugucuuguguuag

SEQ ID NO: 445779 - RNA, 22 nt, Human
aaacacuugcaaaaugguuccu

SEQ ID NO: 445780 - RNA, 22 nt, Human
cccuguauagauacaggucaua

SEQ ID NO: 445781 - RNA, 22 nt, Human
ucagcagggagaggagaaugca

SEQ ID NO: 445782 - RNA, 22 nt, Human
caggaagcugugaaggagacgg

SEQ ID NO: 445783 - RNA, 22 nt, Human
agcuccuguucugagagcagga

SEQ ID NO: 445784 - RNA, 22 nt, Human
guuuccucugcugguuuucauu

SEQ ID NO: 445785 - RNA, 22 nt, Human
cucugggcuuguugaccugcac

SEQ ID NO: 445786 - RNA, 22 nt, Human
gggaaggccgguccagucaggu

SEQ ID NO: 445787 - RNA, 22 nt, Human
ggcugaauguuggacacuuacg

SEQ ID NO: 445788 - RNA, 22 nt, Human
uucagcaaaauaucucagauag

SEQ ID NO: 445789 - RNA, 22 nt, Human
gacaggcacgaaauugggcugg

SEQ ID NO: 445790 - RNA, 22 nt, Human
aaggggccucacagaugggcuu

SEQ ID NO: 445791 - RNA, 22 nt, Human
ccagggagcggggcugggucuc

SEQ ID NO: 445792 - RNA, 22 nt, Human
agagcugaaaaagcugacccgg

SEQ ID NO: 445793 - RNA, 22 nt, Human
gcagcagaggcccuacucuuug

SEQ ID NO: 445794 - RNA, 22 nt, Human
ggcaccagcacuugggauggcu

SEQ ID NO: 445795 - RNA, 22 nt, Human
gacaagacuauguagaaaguau

SEQ ID NO: 445796 - RNA, 22 nt, Human
aaagcacauaguagaaggauuu

SEQ ID NO: 445797 - RNA, 22 nt, Human
gguaaauuuuaugugaugaaac

SEQ ID NO: 445798 - RNA, 22 nt, Human
uauuuuacuauuuggcaaaguc

SEQ ID NO: 445799 - RNA, 22 nt, Human
gaaauauugggacucagagcuu

SEQ ID NO: 445800 - RNA, 19 nt, Human
acagcagggauuuuuggag

SEQ ID NO: 445801 - RNA, 22 nt, Human
guuauuguccagcacaguuggg

SEQ ID NO: 445802 - RNA, 22 nt, Human
uacagaggguaauugaucaagg

SEQ ID NO: 445803 - RNA, 22 nt, Human
uucuuaauggcaaaggauuuua

SEQ ID NO: 445804 - RNA, 22 nt, Human
ccucagucugucugaucugcca

SEQ ID NO: 445805 - RNA, 22 nt, Human
ugcuuucaaugaauuguauacu

SEQ ID NO: 445806 - RNA, 22 nt, Human
aaggcugguggauuaugagguc

SEQ ID NO: 445807 - RNA, 22 nt, Human
auuagcaaguuuuccagcuaau

SEQ ID NO: 445808 - RNA, 22 nt, Human
cagcuggcagcccuggcccugc

SEQ ID NO: 445809 - RNA, 22 nt, Human
agccaggccuuuucucaagguu

SEQ ID NO: 445810 - RNA, 22 nt, Human
uuuuccucaggaaugcuaagcu

SEQ ID NO: 445811 - RNA, 22 nt, Human
caggcuuggagggcaguggcau

SEQ ID NO: 445812 - RNA, 22 nt, Human
ugcagcagccaagguucugugc

SEQ ID NO: 445813 - RNA, 22 nt, Human
cucaguacuuuauguauaugau

SEQ ID NO: 445814 - RNA, 22 nt, Human
cuugaugaaauuuuucaauugu

SEQ ID NO: 445815 - RNA, 21 nt, Human
gcaaccagaccacagggcagu

SEQ ID NO: 445816 - RNA, 22 nt, Human
aaggaagagaauccuucucaga

SEQ ID NO: 445817 - RNA, 22 nt, Human
acauuuaaugauccuacuguga

SEQ ID NO: 445818 - RNA, 22 nt, Human
cagcugguacucaguucuuguc

SEQ ID NO: 445819 - RNA, 22 nt, Human
aguuuccuuggauucaauuugg

SEQ ID NO: 445820 - RNA, 21 nt, Human
uggcugccuacaugcugcagg

SEQ ID NO: 445821 - RNA, 22 nt, Human
cuccuucccuaccaucaauguu

SEQ ID NO: 445822 - RNA, 22 nt, Human
ggaacaggaaaggagggaugcu

SEQ ID NO: 445823 - RNA, 22 nt, Human
ggaagaaaaugggcaacaggug

SEQ ID NO: 445824 - RNA, 22 nt, Human
agccuguguuuuuucuauugca

SEQ ID NO: 445825 - RNA, 22 nt, Human
cuuuugcaccuuuuaaguaaug

SEQ ID NO: 445826 - RNA, 22 nt, Human
gaaggcugcauggaggcugugg

SEQ ID NO: 445827 - RNA, 22 nt, Human
agcugguggagccuuucuguuu

SEQ ID NO: 445828 - RNA, 22 nt, Human
uuugggcacacaaauauuuuau

SEQ ID NO: 445829 - RNA, 22 nt, Human
gcuuccaggcuuccuaccuuug

SEQ ID NO: 445830 - RNA, 22 nt, Human
acacagaguuugacacauggga

SEQ ID NO: 445831 - RNA, 17 nt, Human
uccuggcaguccccugg

SEQ ID NO: 445832 - RNA, 22 nt, Human
ggcagacaccuuuaugucuaau

SEQ ID NO: 445833 - RNA, 22 nt, Human
aggaggccgcugaugggcuccc

SEQ ID NO: 445834 - RNA, 22 nt, Human
cagcuccagcccaggcagcucc

SEQ ID NO: 445835 - RNA, 22 nt, Human
uaauagaauaguggaaacauug

SEQ ID NO: 445836 - RNA, 22 nt, Human
uacagcacaaagggccuuuacc

SEQ ID NO: 445837 - RNA, 22 nt, Human
ucuaacuugugaguauagauga

SEQ ID NO: 445838 - RNA, 22 nt, Human
uauauucauuuuaaagccaucu

SEQ ID NO: 445839 - RNA, 22 nt, Human
uugaagauuauucuauuaaaag

SEQ ID NO: 445840 - RNA, 22 nt, Human
gcucagagaugucugcugccuu

SEQ ID NO: 445841 - RNA, 22 nt, Human
agaagcagaaggaagcagggcc

SEQ ID NO: 445842 - RNA, 22 nt, Human
gucuggccauuugcccauugug

SEQ ID NO: 445843 - RNA, 22 nt, Human
ucagcagccgcagcugacucag

SEQ ID NO: 445844 - RNA, 22 nt, Human
ucuaacagaaauucugacaaaa

SEQ ID NO: 445845 - RNA, 22 nt, Human
ugaugaggacccaucaccuggu

SEQ ID NO: 445846 - RNA, 22 nt, Human
cugguucccagcaggaguguag

SEQ ID NO: 445847 - RNA, 22 nt, Human
uggaaagacauucagccgcugg

SEQ ID NO: 445848 - RNA, 22 nt, Human
ccugggcuugcaucugugcugg

SEQ ID NO: 445849 - RNA, 22 nt, Human
uaacaucuaagggagagaaagu

SEQ ID NO: 445850 - RNA, 22 nt, Human
gcccaagguauaucagagacag

SEQ ID NO: 445851 - RNA, 22 nt, Human
cacagaggacuguagcggggag

SEQ ID NO: 445852 - RNA, 22 nt, Human
agcuaaggaaucagaagagguu

SEQ ID NO: 445853 - RNA, 22 nt, Human
agacaauggagggaaauacuuc

SEQ ID NO: 445854 - RNA, 22 nt, Human
gcaggcugugaggcucagaugg

SEQ ID NO: 445855 - RNA, 22 nt, Human
cucuaauacugaccaagucacc

SEQ ID NO: 445856 - RNA, 22 nt, Human
uuggaaaauguauuucuagaag

SEQ ID NO: 445857 - RNA, 22 nt, Human
cuggugccuccucccugugcuu

SEQ ID NO: 445858 - RNA, 22 nt, Human
aagcccuggcccaaccuugauu

SEQ ID NO: 445859 - RNA, 22 nt, Human
cagcaggcugcgauugcucauu

SEQ ID NO: 445860 - RNA, 22 nt, Human
gcaaauauuucuaauuccugaa

SEQ ID NO: 445861 - RNA, 22 nt, Human
cugaggugagcuucccugggcu

SEQ ID NO: 445862 - RNA, 22 nt, Human
gaaggcuagaaacgaugcuuau

SEQ ID NO: 445863 - RNA, 22 nt, Human
ggcucuggugaggguaggagau

SEQ ID NO: 445864 - RNA, 22 nt, Human
ucccagccuuaucuccccuggc

SEQ ID NO: 445865 - RNA, 23 nt, Human
caucaugcaaucuugggauuucu

SEQ ID NO: 445866 - RNA, 22 nt, Human
gcugccacuuggucaugucaug

SEQ ID NO: 445867 - RNA, 22 nt, Human
cccaggcuggagugcaauggug

SEQ ID NO: 445868 - RNA, 22 nt, Human
agacagagauacuauguuguca

SEQ ID NO: 445869 - RNA, 22 nt, Human
agacacagugcugggugcugag

SEQ ID NO: 445870 - RNA, 22 nt, Human
agcauccagaugccugauguca

SEQ ID NO: 445871 - RNA, 22 nt, Human
cugcucagaggaaggaaugucu

SEQ ID NO: 445872 - RNA, 22 nt, Human
gcaaguuuagcuaacuggccca

SEQ ID NO: 445873 - RNA, 22 nt, Human
ucaacacucuuuggcacaguua

SEQ ID NO: 445874 - RNA, 22 nt, Human
cacugccugugagcugugugcc

SEQ ID NO: 445875 - RNA, 22 nt, Human
ugaugaggaccuggucucugcu

SEQ ID NO: 445876 - RNA, 22 nt, Human
ggcuccuguccccucagcugcu

SEQ ID NO: 445877 - RNA, 22 nt, Human
ucccaggacaggccacauggaa

SEQ ID NO: 445878 - RNA, 22 nt, Human
cugagagaucaagccacaggau

SEQ ID NO: 445879 - RNA, 17 nt, Human
ggugagaccucccacuc

SEQ ID NO: 445880 - RNA, 22 nt, Human
auuuaucaccaguuagcugacu

SEQ ID NO: 445881 - RNA, 22 nt, Human
aauauuauacagucaaccucuu

SEQ ID NO: 445882 - RNA, 22 nt, Human
aggcccugcauuguacugaggg

SEQ ID NO: 445883 - RNA, 22 nt, Human
agacagcaauaugggagacgga

SEQ ID NO: 445884 - RNA, 22 nt, Human
gagcuaaguuucuggaggcaga

SEQ ID NO: 445885 - RNA, 22 nt, Human
agccucuuccagcuccuuucua

SEQ ID NO: 445886 - RNA, 22 nt, Human
cacaauuuggacuucacugguu

SEQ ID NO: 445887 - RNA, 22 nt, Human
uuucaaagcaacugaaaaggaa

SEQ ID NO: 445888 - RNA, 22 nt, Human
uugcagcucugauccagggacc

SEQ ID NO: 445889 - RNA, 22 nt, Human
cuggccugggagcugcuagcgu

SEQ ID NO: 445890 - RNA, 22 nt, Human
auguggauuugggagugaucag

SEQ ID NO: 445891 - RNA, 22 nt, Human
ucaggaaaguguucucagagga

SEQ ID NO: 445892 - RNA, 22 nt, Human
cugaggcuuguccucucagcuu

SEQ ID NO: 445893 - RNA, 22 nt, Human
uucaauagcauacuuuugcucu

SEQ ID NO: 445894 - RNA, 22 nt, Human
ugggccuccgcauggcccagcg

SEQ ID NO: 445895 - RNA, 22 nt, Human
aagccacagaucguucugucac

SEQ ID NO: 445896 - RNA, 22 nt, Human
uccaagaucuacagcaguuuag

SEQ ID NO: 445897 - RNA, 22 nt, Human
aaacagcucaagaaguuacucu

SEQ ID NO: 445898 - RNA, 22 nt, Human
ccaggaaauagugcugugaucu

SEQ ID NO: 445899 - RNA, 22 nt, Human
ucucacaagcucaaggauuagu

SEQ ID NO: 445900 - RNA, 22 nt, Human
agacaauggagagcagaguacu

SEQ ID NO: 445901 - RNA, 22 nt, Human
uugugucccccuuugagagcca

SEQ ID NO: 445902 - RNA, 22 nt, Human
aacugcauuuaacaaauacucu

SEQ ID NO: 445903 - RNA, 22 nt, Human
gaggauuugauggcuuucuccc

SEQ ID NO: 445904 - RNA, 23 nt, Human
cauguacacacagcuguacagug

SEQ ID NO: 445905 - RNA, 22 nt, Human
gcugaggucaggagcugugggg

SEQ ID NO: 445906 - RNA, 19 nt, Human
ugcacacagauaaguaucu

SEQ ID NO: 445907 - RNA, 22 nt, Human
ccuggagcucacugggagccgg

SEQ ID NO: 445908 - RNA, 18 nt, Human
aacuaaagaucuuuaagc

SEQ ID NO: 445909 - RNA, 22 nt, Human
uuuuauacuuaagacagaguuu

SEQ ID NO: 445910 - RNA, 22 nt, Human
aggccuccuggcuccaggccuu

SEQ ID NO: 445911 - RNA, 22 nt, Human
aaacacuucaaggacuucuguc

SEQ ID NO: 445912 - RNA, 21 nt, Human
uuuaaggccagcaggagguga

SEQ ID NO: 445913 - RNA, 22 nt, Human
cucuccuggggagcacacacac

SEQ ID NO: 445914 - RNA, 22 nt, Human
aagacauuggcauugacuguaa

SEQ ID NO: 445915 - RNA, 22 nt, Human
cccaggagguggagguugcagu

SEQ ID NO: 445916 - RNA, 22 nt, Human
agccucuguagaaagcagugug

SEQ ID NO: 445917 - RNA, 22 nt, Human
ccugagacaugaaccaggcucc

SEQ ID NO: 445918 - RNA, 22 nt, Human
gugccagggggcacugaacaga

SEQ ID NO: 445919 - RNA, 22 nt, Human
aauuucaagucuugaagaagua

SEQ ID NO: 445920 - RNA, 22 nt, Human
augcuuuuaugucacaugguca

SEQ ID NO: 445921 - RNA, 22 nt, Human
uccugccuguuuaccuguacuu

SEQ ID NO: 445922 - RNA, 22 nt, Human
ucucccagaaguccucaguaca

SEQ ID NO: 445923 - RNA, 22 nt, Human
uccagccuugccacuuuucugu

SEQ ID NO: 445924 - RNA, 21 nt, Human
guggcccugccgcagugucca

SEQ ID NO: 445925 - RNA, 22 nt, Human
aacugcauuguacuaaacuugu

SEQ ID NO: 445926 - RNA, 22 nt, Human
agccugggaauuuagaguucgg

SEQ ID NO: 445927 - RNA, 22 nt, Human
ucaaggugcugugcugugcuag

SEQ ID NO: 445928 - RNA, 22 nt, Human
agacauuggcuaaaaguagugu

SEQ ID NO: 445929 - RNA, 22 nt, Human
cccuggcagaaugucucugggc

SEQ ID NO: 445930 - RNA, 22 nt, Human
guccugugugagugcaccaccu

SEQ ID NO: 445931 - RNA, 22 nt, Human
ugcucagggacaauggagaggg

SEQ ID NO: 445932 - RNA, 22 nt, Human
agcucccagaguccucugccca

SEQ ID NO: 445933 - RNA, 20 nt, Human
agaaauauugaguucagagg

SEQ ID NO: 445934 - RNA, 22 nt, Human
agggcacagccuaaagccuaug

SEQ ID NO: 445935 - RNA, 22 nt, Human
aauuaaauugguuuagagagga

SEQ ID NO: 445936 - RNA, 22 nt, Human
uuuucuaaaagaagucacugau

SEQ ID NO: 445937 - RNA, 22 nt, Human
aagcacaucuccugugcagaac

SEQ ID NO: 445938 - RNA, 22 nt, Human
aagauacaaaugucaauauugg

SEQ ID NO: 445939 - RNA, 22 nt, Human
cugggcugcaucaaagaggcau

SEQ ID NO: 445940 - RNA, 18 nt, Human
caauuuuacccagucccu

SEQ ID NO: 445941 - RNA, 22 nt, Human
ggcaggcuugguggcaccgguu

SEQ ID NO: 445942 - RNA, 22 nt, Human
ugggcagaaugugggauccaga

SEQ ID NO: 445943 - RNA, 22 nt, Human
uuuucuccagggaacaagguga

SEQ ID NO: 445944 - RNA, 22 nt, Human
aaggcaauuggcuuguauaaga

SEQ ID NO: 445945 - RNA, 22 nt, Human
ucagccuuugaagggcugcagg

SEQ ID NO: 445946 - RNA, 22 nt, Human
uggccagcuuugacuguaaacc

SEQ ID NO: 445947 - RNA, 22 nt, Human
uaaaaugacuuccuccaacauc

SEQ ID NO: 445948 - RNA, 22 nt, Human
ugaggcccagccgcccugagag

SEQ ID NO: 445949 - RNA, 22 nt, Human
uguuugcaacaacuagauggag

SEQ ID NO: 445950 - RNA, 22 nt, Human
agcaagcauugcugguuagguc

SEQ ID NO: 445951 - RNA, 22 nt, Human
ucagcagggccaugcucucucu

SEQ ID NO: 445952 - RNA, 22 nt, Human
aucuuucagagcuccaucaggg

SEQ ID NO: 445953 - RNA, 22 nt, Human
gggcuccagccacuggcugagg

SEQ ID NO: 445954 - RNA, 22 nt, Human
ccacagaggacaacugccuggc

SEQ ID NO: 445955 - RNA, 22 nt, Human
gaagcuaaugagauaaaugcca

SEQ ID NO: 445956 - RNA, 22 nt, Human
ugaacgcagguccacauggcuc

SEQ ID NO: 445957 - RNA, 22 nt, Human
ugauuuucaugggugaucuuug

SEQ ID NO: 445958 - RNA, 22 nt, Human
cacaaggagguccugaggaagc

SEQ ID NO: 445959 - RNA, 22 nt, Human
agaagccaacagggcaggagag

SEQ ID NO: 445960 - RNA, 22 nt, Human
ucagagguaaaaacucacugua

SEQ ID NO: 445961 - RNA, 22 nt, Human
acagaguuaaaguggaguuuaa

SEQ ID NO: 445962 - RNA, 22 nt, Human
gagcaacacgcaguaguauacg

SEQ ID NO: 445963 - RNA, 22 nt, Human
agcuggugugccaguuccaguu

SEQ ID NO: 445964 - RNA, 20 nt, Human
ucacauccucucccaacaug

SEQ ID NO: 445965 - RNA, 22 nt, Human
ucugcagcuugcacaggcaggc

SEQ ID NO: 445966 - RNA, 22 nt, Human
acacuuuguuguggcauauacg

SEQ ID NO: 445967 - RNA, 22 nt, Human
uugaugauguuucugccuugcc

SEQ ID NO: 445968 - RNA, 22 nt, Human
agcaaggcagcuuucacugcuu

SEQ ID NO: 445969 - RNA, 22 nt, Human
uggaaggagacugggaagugug

SEQ ID NO: 445970 - RNA, 20 nt, Human
aaagugcacagauacagcuc

SEQ ID NO: 445971 - RNA, 22 nt, Human
uagcaacaccaucuggugagaa

SEQ ID NO: 445972 - RNA, 19 nt, Human
uagaagcagggaagcugag

SEQ ID NO: 445973 - RNA, 22 nt, Human
agcccagccugauucuacaccc

SEQ ID NO: 445974 - RNA, 22 nt, Human
agucugagucuaaaggcuugag

SEQ ID NO: 445975 - RNA, 22 nt, Human
cacauuuaugggcugggaggca

SEQ ID NO: 445976 - RNA, 22 nt, Human
auaaaugccucagaaucauccc

SEQ ID NO: 445977 - RNA, 22 nt, Human
gggagguucuguucgcacuuga

SEQ ID NO: 445978 - RNA, 22 nt, Human
uaguucaaccgucuucuccccu

SEQ ID NO: 445979 - RNA, 22 nt, Human
uccucuccaugucucacgccac

SEQ ID NO: 445980 - RNA, 22 nt, Human
agaauauucaucuguauucuua

SEQ ID NO: 445981 - RNA, 22 nt, Human
aggucccugcagcagacugcca

SEQ ID NO: 445982 - RNA, 22 nt, Human
guuucagaaauguucuccugcu

SEQ ID NO: 445983 - RNA, 22 nt, Human
gcaccugcaggaugagccaggg

SEQ ID NO: 445984 - RNA, 22 nt, Human
agcucaggucauuccagggaug

SEQ ID NO: 445985 - RNA, 22 nt, Human
ccaggccuuccaguacgcagaa

SEQ ID NO: 445986 - RNA, 22 nt, Human
ugggccugggucuuugcugcca

SEQ ID NO: 445987 - RNA, 22 nt, Human
cagcaugguggagcugcucuuu

SEQ ID NO: 445988 - RNA, 22 nt, Human
agcacugugauuuauaacauuu

SEQ ID NO: 445989 - RNA, 22 nt, Human
ugaggcagaguaagauacauga

SEQ ID NO: 445990 - RNA, 22 nt, Human
auuuauguaucuguguagauca

SEQ ID NO: 445991 - RNA, 22 nt, Human
guauaucucuuacauacacaca

SEQ ID NO: 445992 - RNA, 22 nt, Human
uugcccugucucacuauguuaa

SEQ ID NO: 445993 - RNA, 22 nt, Human
gagcacagggaauagacagaua

SEQ ID NO: 445994 - RNA, 22 nt, Human
cucccugggcagauguggcucu

SEQ ID NO: 445995 - RNA, 22 nt, Human
gccagccugugcuuggccaggc

SEQ ID NO: 445996 - RNA, 22 nt, Human
cugguccccagacugggcuuag

SEQ ID NO: 445997 - RNA, 22 nt, Human
caugagauaauuuuucuccagu

SEQ ID NO: 445998 - RNA, 22 nt, Human
ugacagaaagaauaugucaauc

SEQ ID NO: 445999 - RNA, 22 nt, Human
uuuaacagaugcuaugucuacc

SEQ ID NO: 446000 - RNA, 22 nt, Human
uauuuaucaagguaggagaaua

SEQ ID NO: 446001 - RNA, 22 nt, Human
gagcccagguucugcuuccagc

SEQ ID NO: 446002 - RNA, 22 nt, Human
ccagcugucuugagaggaggca

SEQ ID NO: 446003 - RNA, 22 nt, Human
cccaggaggguggccucugccc

SEQ ID NO: 446004 - RNA, 22 nt, Human
ucagcagggcauacugagccua

SEQ ID NO: 446005 - RNA, 23 nt, Human
ugggccuggaaagccuuagagag

SEQ ID NO: 446006 - RNA, 22 nt, Human
gcaugugucuccccaguggagg

SEQ ID NO: 446007 - RNA, 22 nt, Human
aaggaaagcugugguucugaga

SEQ ID NO: 446008 - RNA, 22 nt, Human
cagcccuugaugauaauuuauc

SEQ ID NO: 446009 - RNA, 22 nt, Human
gccugagagucuccagaccuug

SEQ ID NO: 446010 - RNA, 22 nt, Human
gagcagagucuauuuccacacu

SEQ ID NO: 446011 - RNA, 22 nt, Human
ucuaugaaucaauuuuaacauc

SEQ ID NO: 446012 - RNA, 22 nt, Human
cagcagccuacaaugcacagaa

SEQ ID NO: 446013 - RNA, 17 nt, Human
aggagucucagaugagc

SEQ ID NO: 446014 - RNA, 22 nt, Human
agagaaggaaagcugacauggg

SEQ ID NO: 446015 - RNA, 22 nt, Human
ucuuugcagccccaggaagugg

SEQ ID NO: 446016 - RNA, 22 nt, Human
gcugagucuugagcacugagca

SEQ ID NO: 446017 - RNA, 22 nt, Human
cuauucaacuugacuguuucac

SEQ ID NO: 446018 - RNA, 22 nt, Human
ccaggccugauugggaaucuug

SEQ ID NO: 446019 - RNA, 22 nt, Human
ugucagaacucuauugaugucc

SEQ ID NO: 446020 - RNA, 23 nt, Human
uacagcaaggacaacauaggugg

SEQ ID NO: 446021 - RNA, 22 nt, Human
uggccuuccuggugacucauga

SEQ ID NO: 446022 - RNA, 22 nt, Human
ggcacagcaggagcuaugugaa

SEQ ID NO: 446023 - RNA, 22 nt, Human
aaggcaaugucauggcucuugc

SEQ ID NO: 446024 - RNA, 22 nt, Human
cacagacagugucccuuuguug

SEQ ID NO: 446025 - RNA, 22 nt, Human
cugccaggccuccgcugucccc

SEQ ID NO: 446026 - RNA, 22 nt, Human
gcucagggucccuuggugcugg

SEQ ID NO: 446027 - RNA, 22 nt, Human
acagaccaaguuuccagcaggu

SEQ ID NO: 446028 - RNA, 22 nt, Human
uuuagcaacgaagcacucgaca

SEQ ID NO: 446029 - RNA, 23 nt, Human
cauggaaaacugaaagcugaccu

SEQ ID NO: 446030 - RNA, 22 nt, Human
aagucacauucugagguauugg

SEQ ID NO: 446031 - RNA, 22 nt, Human
gugcaugugucuuuauaguaga

SEQ ID NO: 446032 - RNA, 22 nt, Human
cugagaggcagccagagaaaau

SEQ ID NO: 446033 - RNA, 19 nt, Human
agcaggcagguggcccagg

SEQ ID NO: 446034 - RNA, 22 nt, Human
caggccaggcugcauuugcccc

SEQ ID NO: 446035 - RNA, 20 nt, Human
ugcugcaguuucaugggacu

SEQ ID NO: 446036 - RNA, 22 nt, Human
uaaagccacuucauucuagucu

SEQ ID NO: 446037 - RNA, 22 nt, Human
ucauaggaguagcagugagagg

SEQ ID NO: 446038 - RNA, 22 nt, Human
cagggcucaucugugugaccag

SEQ ID NO: 446039 - RNA, 22 nt, Human
gcugagggcuguaacagcagag

SEQ ID NO: 446040 - RNA, 22 nt, Human
gagcacugagcuggaauuggag

SEQ ID NO: 446041 - RNA, 22 nt, Human
cuggggugugcucagagcaggg

SEQ ID NO: 446042 - RNA, 22 nt, Human
cucuaaauccacgguauaguug

SEQ ID NO: 446043 - RNA, 22 nt, Human
gcugagaggcagccagacccuc

SEQ ID NO: 446044 - RNA, 21 nt, Human
ugagccaggcugacggcugug

SEQ ID NO: 446045 - RNA, 22 nt, Human
uaggccucaggaccccagggcu

SEQ ID NO: 446046 - RNA, 22 nt, Human
cagggagccugaauguuccagg

SEQ ID NO: 446047 - RNA, 21 nt, Human
gcacagugccaggcacacagu

SEQ ID NO: 446048 - RNA, 17 nt, Human
uagagcugguucaggag

SEQ ID NO: 446049 - RNA, 22 nt, Human
guucaaauucuaugaaauaugu

SEQ ID NO: 446050 - RNA, 20 nt, Human
gugggcagaugugugcaugg

SEQ ID NO: 446051 - RNA, 22 nt, Human
aggcugcagaacagucaggugc

SEQ ID NO: 446052 - RNA, 22 nt, Human
aggcccucucauuccagaggca

SEQ ID NO: 446053 - RNA, 22 nt, Human
uuugcaaauauguguuucuauu

SEQ ID NO: 446054 - RNA, 22 nt, Human
auuucagacuguguuggaaaau

SEQ ID NO: 446055 - RNA, 23 nt, Human
aaagaucaaaguggcaggccugu

SEQ ID NO: 446056 - RNA, 22 nt, Human
uccuguggagaggacuggaggu

SEQ ID NO: 446057 - RNA, 22 nt, Human
cugcaggcccccuuccuggagu

SEQ ID NO: 446058 - RNA, 20 nt, Human
agcacagcgcgguguuccuu

SEQ ID NO: 446059 - RNA, 19 nt, Human
acuuugcaugugugucuaa

SEQ ID NO: 446060 - RNA, 22 nt, Human
caccacugcuuccugccaucug

SEQ ID NO: 446061 - RNA, 22 nt, Human
gcuaaggccuuaacucauggag

SEQ ID NO: 446062 - RNA, 22 nt, Human
gaagcccuaauacacaguaccu

SEQ ID NO: 446063 - RNA, 22 nt, Human
gagguccucuguguccgcgggc

SEQ ID NO: 446064 - RNA, 22 nt, Human
cauuuguaggaugcuucuuguu

SEQ ID NO: 446065 - RNA, 22 nt, Human
uccagagccuauauguucaacu

SEQ ID NO: 446066 - RNA, 22 nt, Human
uauagcaaaauaguuuccacac

SEQ ID NO: 446067 - RNA, 22 nt, Human
ccagggugagugucauggguua

SEQ ID NO: 446068 - RNA, 22 nt, Human
auuaaauuagcaaacugugaaa

SEQ ID NO: 446069 - RNA, 22 nt, Human
gaggaaaauauucagggagguu

SEQ ID NO: 446070 - RNA, 22 nt, Human
uucaaacucuugcucugcuagu

SEQ ID NO: 446071 - RNA, 21 nt, Human
ugaauuucgguauggcuauaa

SEQ ID NO: 446072 - RNA, 22 nt, Human
cagcuguugcagcacugagaga

SEQ ID NO: 446073 - RNA, 22 nt, Human
ucacagccuggacaguugccug

SEQ ID NO: 446074 - RNA, 22 nt, Human
uacuccacacgcuauuauaaug

SEQ ID NO: 446075 - RNA, 18 nt, Human
uccugccugugccccagg

SEQ ID NO: 446076 - RNA, 22 nt, Human
ugacacagggaaagcggaucca

SEQ ID NO: 446077 - RNA, 22 nt, Human
cuaaugaagcugcuuucuauga

SEQ ID NO: 446078 - RNA, 22 nt, Human
gcaaacaugugcucauuuugug

SEQ ID NO: 446079 - RNA, 22 nt, Human
uucauacuguuuaaguucuguu

SEQ ID NO: 446080 - RNA, 22 nt, Human
ucccagaguucaaugggaaggu

SEQ ID NO: 446081 - RNA, 22 nt, Human
uccagcagggaauuaguagucu

SEQ ID NO: 446082 - RNA, 22 nt, Human
auggagagugaaagucucucua

SEQ ID NO: 446083 - RNA, 22 nt, Human
cagggcucagaagacagaccuc

SEQ ID NO: 446084 - RNA, 22 nt, Human
acaggccucaagacacccaggu

SEQ ID NO: 446085 - RNA, 22 nt, Human
aagccauuuguuguccuucagg

SEQ ID NO: 446086 - RNA, 22 nt, Human
cucuggcuuugcucaugcaucc

SEQ ID NO: 446087 - RNA, 22 nt, Human
aacuaaaucuggcauuuagagc

SEQ ID NO: 446088 - RNA, 22 nt, Human
aaugauggucauggcaacuuuu

SEQ ID NO: 446089 - RNA, 22 nt, Human
ugguccagaugccuuggcuuua

SEQ ID NO: 446090 - RNA, 22 nt, Human
gagcggaggcuuggaggccagc

SEQ ID NO: 446091 - RNA, 22 nt, Human
acaguaaccucuccucugaagg

SEQ ID NO: 446092 - RNA, 22 nt, Human
uuucagagaugcagaauucagg

SEQ ID NO: 446093 - RNA, 22 nt, Human
gaagccccaaacccucgccauc

SEQ ID NO: 446094 - RNA, 18 nt, Human
ucagcuggggcugcagcc

SEQ ID NO: 446095 - RNA, 22 nt, Human
ugggagcagccaacauggccuu

SEQ ID NO: 446096 - RNA, 22 nt, Human
gccacaugcaauugcagcacgu

SEQ ID NO: 446097 - RNA, 22 nt, Human
cucccucaggccuuagcccugc

SEQ ID NO: 446098 - RNA, 22 nt, Human
gaugauuucuccauucccuucu

SEQ ID NO: 446099 - RNA, 22 nt, Human
gccugccuguuggcugaggugc

SEQ ID NO: 446100 - RNA, 22 nt, Human
ggcuccagggucucuccuugug

SEQ ID NO: 446101 - RNA, 22 nt, Human
gugggcaaggucccugccagcu

SEQ ID NO: 446102 - RNA, 22 nt, Human
agcuccugcccaggaaggcucu

SEQ ID NO: 446103 - RNA, 20 nt, Human
cagcaggaaaagugccucag

SEQ ID NO: 446104 - RNA, 22 nt, Human
gagcuucccucugcagucccug

SEQ ID NO: 446105 - RNA, 22 nt, Human
gcagacuguaccuggaagaggg

SEQ ID NO: 446106 - RNA, 23 nt, Human
aaacugcaucucugagccucagc

SEQ ID NO: 446107 - RNA, 19 nt, Human
ccaggccaucccaguuccc

SEQ ID NO: 446108 - RNA, 22 nt, Human
agggcagaaauauugauacugu

SEQ ID NO: 446109 - RNA, 19 nt, Human
ugguacaaaccaagagaga

SEQ ID NO: 446110 - RNA, 22 nt, Human
ccugaaaaucaagguaguuugg

SEQ ID NO: 446111 - RNA, 22 nt, Human
gccagcagggcggagccaucua

SEQ ID NO: 446112 - RNA, 22 nt, Human
ugucccagacacaguaugcgcu

SEQ ID NO: 446113 - RNA, 22 nt, Human
auuuucucuuuguauaugcuag

SEQ ID NO: 446114 - RNA, 22 nt, Human
cagagcagccuccagggggagc

SEQ ID NO: 446115 - RNA, 22 nt, Human
uaggguaguaccaugcugccag

SEQ ID NO: 446116 - RNA, 22 nt, Human
caggguggaagcuguagagugg

SEQ ID NO: 446117 - RNA, 22 nt, Human
acagaauugaagcugaguaaau

SEQ ID NO: 446118 - RNA, 22 nt, Human
cagagaacaaagcugaggguuu

SEQ ID NO: 446119 - RNA, 22 nt, Human
uauuuauaccaggugaucggag

SEQ ID NO: 446120 - RNA, 22 nt, Human
gaaggcaagugcuccuuggguc

SEQ ID NO: 446121 - RNA, 22 nt, Human
ucucuaaaguagaaaagacccc

SEQ ID NO: 446122 - RNA, 22 nt, Human
ucuccacaccagaaggagcuga

SEQ ID NO: 446123 - RNA, 20 nt, Human
uuugggcacggcuagauuuu

SEQ ID NO: 446124 - RNA, 22 nt, Human
acagccaggagccaugggcagg

SEQ ID NO: 446125 - RNA, 22 nt, Human
uagccucuggaauccuuucucu

SEQ ID NO: 446126 - RNA, 22 nt, Human
ccuuucucuggcagcaggacag

SEQ ID NO: 446127 - RNA, 22 nt, Human
ggcuccuucaagccugucacug

SEQ ID NO: 446128 - RNA, 22 nt, Human
guauucuuaaggauugagcaaa

SEQ ID NO: 446129 - RNA, 22 nt, Human
ccugucugaggaggugcucuuu

SEQ ID NO: 446130 - RNA, 22 nt, Human
uucuggauguuguagucugaga

SEQ ID NO: 446131 - RNA, 22 nt, Human
gagcuagggaggaggcuugcuc

SEQ ID NO: 446132 - RNA, 22 nt, Human
acaggccuugguccugaccuaa

SEQ ID NO: 446133 - RNA, 21 nt, Human
ggccuuggcgggggccgaauu

SEQ ID NO: 446134 - RNA, 21 nt, Human
ugcaguucaagucaaucuacu

SEQ ID NO: 446135 - RNA, 22 nt, Human
uauguacaccggggaagguggg

SEQ ID NO: 446136 - RNA, 22 nt, Human
gcaguggggcgcugggaguugg

SEQ ID NO: 446137 - RNA, 22 nt, Human
ggaauaaagaaucugguucccc

SEQ ID NO: 446138 - RNA, 22 nt, Human
caggucagaggcgcagccccca

SEQ ID NO: 446139 - RNA, 22 nt, Human
cuggcuccauccuugagcucug

SEQ ID NO: 446140 - RNA, 22 nt, Human
ccuggcucugguucccucagcu

SEQ ID NO: 446141 - RNA, 22 nt, Human
uagaaauaaaucugcagcuggg

SEQ ID NO: 446142 - RNA, 22 nt, Human
auagcuuucuuaaauauauaaa

SEQ ID NO: 446143 - RNA, 19 nt, Human
aggcagaggcuuggcuagc

SEQ ID NO: 446144 - RNA, 22 nt, Human
uuagcauucucauuugcauaaa

SEQ ID NO: 446145 - RNA, 22 nt, Human
uugcccuggggcuggccuggca

SEQ ID NO: 446146 - RNA, 22 nt, Human
ugggccacggggguggagagcu

SEQ ID NO: 446147 - RNA, 22 nt, Human
augacagaaggccucccugaca

SEQ ID NO: 446148 - RNA, 22 nt, Human
ugugugugcaggagagcaggug

SEQ ID NO: 446149 - RNA, 22 nt, Human
gcaggggcaggagaucucaggc

SEQ ID NO: 446150 - RNA, 23 nt, Human
ugccagcagggaaugggaaggac

SEQ ID NO: 446151 - RNA, 22 nt, Human
aggcaaggugcuacagacagug

SEQ ID NO: 446152 - RNA, 22 nt, Human
uuuuaacacucagcacuaucuc

SEQ ID NO: 446153 - RNA, 22 nt, Human
aaauuauuuucagaauggagaa

SEQ ID NO: 446154 - RNA, 22 nt, Human
uggagguugggaugcuugugau

SEQ ID NO: 446155 - RNA, 18 nt, Human
uuccaugauuccuuucac

SEQ ID NO: 446156 - RNA, 22 nt, Human
gugacccagguagguaagcaau

SEQ ID NO: 446157 - RNA, 22 nt, Human
ggccucgcggcuucugguggcu

SEQ ID NO: 446158 - RNA, 22 nt, Human
cugggcuguucugccccugggu

SEQ ID NO: 446159 - RNA, 22 nt, Human
ugaggcugacaaaagaugaggu

SEQ ID NO: 446160 - RNA, 19 nt, Human
ugcagcugucucuauauua

SEQ ID NO: 446161 - RNA, 22 nt, Human
uuuccucaacugucaaaugggg

SEQ ID NO: 446162 - RNA, 22 nt, Human
uggcuccuucauucuccugcca

SEQ ID NO: 446163 - RNA, 21 nt, Human
uuuauuaacaacuguggacgu

SEQ ID NO: 446164 - RNA, 22 nt, Human
ugauucuguucuccuugagaau

SEQ ID NO: 446165 - RNA, 22 nt, Human
uauguacacacacaugcaugua

SEQ ID NO: 446166 - RNA, 22 nt, Human
uggaugugagaaggaucaggcu

SEQ ID NO: 446167 - RNA, 22 nt, Human
ugcacuccaggcugggugacag

SEQ ID NO: 446168 - RNA, 22 nt, Human
augauccaaagccacaggggca

SEQ ID NO: 446169 - RNA, 22 nt, Human
uauuugaagggagaaagugcca

SEQ ID NO: 446170 - RNA, 21 nt, Human
ccagcuguuccucguccgaug

SEQ ID NO: 446171 - RNA, 21 nt, Human
agaaaauggcguuuuagauuu

SEQ ID NO: 446172 - RNA, 22 nt, Human
aagacaagcaucaaaucaggca

SEQ ID NO: 446173 - RNA, 22 nt, Human
ugcaauuuuuaucaauucagca

SEQ ID NO: 446174 - RNA, 22 nt, Human
ucaggaaauggaauucuugugu

SEQ ID NO: 446175 - RNA, 22 nt, Human
cagaaggcagcaaaugaaaacc

SEQ ID NO: 446176 - RNA, 22 nt, Human
gcucagaguuaauuggaugggu

SEQ ID NO: 446177 - RNA, 22 nt, Human
uaacaugcuaauuugcagauag

SEQ ID NO: 446178 - RNA, 22 nt, Human
cuccuacaguguuugaguccag

SEQ ID NO: 446179 - RNA, 22 nt, Human
uuguguguagacucagccauug

SEQ ID NO: 446180 - RNA, 22 nt, Human
ugugggaggucuggaaggcucc

SEQ ID NO: 446181 - RNA, 22 nt, Human
ucagaauucuagcucuucccuu

SEQ ID NO: 446182 - RNA, 22 nt, Human
uuuacagcuacuguccuauuuc

SEQ ID NO: 446183 - RNA, 22 nt, Human
uugaacagcuguuacauuguua

SEQ ID NO: 446184 - RNA, 22 nt, Human
ugaggaagugguuguaugguuu

SEQ ID NO: 446185 - RNA, 22 nt, Human
aguucagaguaaauguugaagg

SEQ ID NO: 446186 - RNA, 22 nt, Human
uuccuuuuacaaauagccuccu

SEQ ID NO: 446187 - RNA, 22 nt, Human
cagcccuuaagagucaucccuc

SEQ ID NO: 446188 - RNA, 22 nt, Human
uaaagcccucugaucacacugg

SEQ ID NO: 446189 - RNA, 22 nt, Human
uugugaucuguguugauggccu

SEQ ID NO: 446190 - RNA, 22 nt, Human
ugcccagcacugugccagucac

SEQ ID NO: 446191 - RNA, 22 nt, Human
caggaaagagcugccaggcagg

SEQ ID NO: 446192 - RNA, 22 nt, Human
ccagaggcuggguucaccucag

SEQ ID NO: 446193 - RNA, 22 nt, Human
ccagucacucugugagagcuac

SEQ ID NO: 446194 - RNA, 22 nt, Human
aaaggaagaugccaggacucug

SEQ ID NO: 446195 - RNA, 22 nt, Human
gagcccuguaggaaucucucaa

SEQ ID NO: 446196 - RNA, 22 nt, Human
ucaggcugugucuuuaaacaau

SEQ ID NO: 446197 - RNA, 22 nt, Human
guuaacauuucuaggugcaggg

SEQ ID NO: 446198 - RNA, 22 nt, Human
caguccugaauacuggacggug

SEQ ID NO: 446199 - RNA, 22 nt, Human
uuucaucauguuggcagauugg

SEQ ID NO: 446200 - RNA, 22 nt, Human
guucuaggcuaggggaguaaga

SEQ ID NO: 446201 - RNA, 22 nt, Human
gaacccaguccaggugcagccu

SEQ ID NO: 446202 - RNA, 22 nt, Human
ucccuguacuuacacagcgucc

SEQ ID NO: 446203 - RNA, 22 nt, Human
uaccaaaagcuuguuucauaca

SEQ ID NO: 446204 - RNA, 22 nt, Human
uuugcuuucuugauucagauua

SEQ ID NO: 446205 - RNA, 22 nt, Human
guauucuugguuaucaaaauac

SEQ ID NO: 446206 - RNA, 22 nt, Human
ucagcccuagaaagucuaagca

SEQ ID NO: 446207 - RNA, 22 nt, Human
ccugggcagguguggcuucccc

SEQ ID NO: 446208 - RNA, 22 nt, Human
uucaagguaugguagcugguca

SEQ ID NO: 446209 - RNA, 22 nt, Human
cagucccaucucccagguggcu

SEQ ID NO: 446210 - RNA, 22 nt, Human
aggccaggcaacauucugaagu

SEQ ID NO: 446211 - RNA, 22 nt, Human
cagcugagaguagaaauggagg

SEQ ID NO: 446212 - RNA, 20 nt, Human
ugcucuggggguggagagac

SEQ ID NO: 446213 - RNA, 22 nt, Human
ugcaaaaauugcuggaaucuuu

SEQ ID NO: 446214 - RNA, 22 nt, Human
cagugucaccaggcgagucucc

SEQ ID NO: 446215 - RNA, 22 nt, Human
ugcccacaucugcuuauuucau

SEQ ID NO: 446216 - RNA, 22 nt, Human
ugagacaguuggugaaaucuaa

SEQ ID NO: 446217 - RNA, 22 nt, Human
aguuuacaacaguagcuaugga

SEQ ID NO: 446218 - RNA, 22 nt, Human
uugcacauuuccuagaauuuca

SEQ ID NO: 446219 - RNA, 23 nt, Human
aucuagaaaccugaugacucugu

SEQ ID NO: 446220 - RNA, 22 nt, Human
uuccugagaacauggcagcuua

SEQ ID NO: 446221 - RNA, 22 nt, Human
gcacagagcuggcccuccaggc

SEQ ID NO: 446222 - RNA, 22 nt, Human
cccaggagauggagguugcagu

SEQ ID NO: 446223 - RNA, 22 nt, Human
ucuggacauccuggagaaugac

SEQ ID NO: 446224 - RNA, 22 nt, Human
ggcagccagagggcagcuggau

SEQ ID NO: 446225 - RNA, 19 nt, Human
cagcugccuuuucuuugca

SEQ ID NO: 446226 - RNA, 22 nt, Human
cugggcugugguguggcccaaa

SEQ ID NO: 446227 - RNA, 22 nt, Human
augcaugugcauggcucuaucu

SEQ ID NO: 446228 - RNA, 22 nt, Human
aagcccuggaacuuuccuagcc

SEQ ID NO: 446229 - RNA, 22 nt, Human
acaauauuguacccagaaguuu

SEQ ID NO: 446230 - RNA, 18 nt, Human
gagcagcaggaucaagaa

SEQ ID NO: 446231 - RNA, 19 nt, Human
uuugugaagaaaaugaugc

SEQ ID NO: 446232 - RNA, 22 nt, Human
ugggccuggguuccuccugggc

SEQ ID NO: 446233 - RNA, 23 nt, Human
uaguguauaucaacauuuguccc

SEQ ID NO: 446234 - RNA, 22 nt, Human
aaaugcacagaaaggaugugga

SEQ ID NO: 446235 - RNA, 22 nt, Human
ugcaugauagagaugguauuag

SEQ ID NO: 446236 - RNA, 22 nt, Human
cagcagagcugugugggaaggg

SEQ ID NO: 446237 - RNA, 22 nt, Human
uggcacagacagcacagcaaug

SEQ ID NO: 446238 - RNA, 22 nt, Human
uuuccaaauaaggucacauucu

SEQ ID NO: 446239 - RNA, 22 nt, Human
ugauacagagcaagcaucuuuu

SEQ ID NO: 446240 - RNA, 22 nt, Human
agcugagcacauucaaacaggu

SEQ ID NO: 446241 - RNA, 22 nt, Human
caggccucaggggcucaggcug

SEQ ID NO: 446242 - RNA, 22 nt, Human
gcaaggcagcauccuuuugagg

SEQ ID NO: 446243 - RNA, 22 nt, Human
uaucauuuaacagaaucauugc

SEQ ID NO: 446244 - RNA, 22 nt, Human
gcagacagggcuacagagguac

SEQ ID NO: 446245 - RNA, 22 nt, Human
ucauuguugcguuaaugucuuc

SEQ ID NO: 446246 - RNA, 22 nt, Human
cagcugaguuuccaagucugcc

SEQ ID NO: 446247 - RNA, 19 nt, Human
cauacaauuaccauaggau

SEQ ID NO: 446248 - RNA, 22 nt, Human
ucagaauuggaacgugaagauu

SEQ ID NO: 446249 - RNA, 22 nt, Human
gagaagaaaauuccgugaacac

SEQ ID NO: 446250 - RNA, 22 nt, Human
gaauuucaaagagguuaagagg

SEQ ID NO: 446251 - RNA, 22 nt, Human
agcuguuuuacugguuguauaa

SEQ ID NO: 446252 - RNA, 22 nt, Human
gugucccagcagcacauuggcu

SEQ ID NO: 446253 - RNA, 22 nt, Human
aagagacuauggugucuaugaa

SEQ ID NO: 446254 - RNA, 20 nt, Human
ggggacccagaaucacagcu

SEQ ID NO: 446255 - RNA, 22 nt, Human
uagcugcccaucuuuccuuuag

SEQ ID NO: 446256 - RNA, 22 nt, Human
cucagggaauugaaucuccuug

SEQ ID NO: 446257 - RNA, 22 nt, Human
cacaggcacgccucuggccagg

SEQ ID NO: 446258 - RNA, 20 nt, Human
cugcuugggacacugccaga

SEQ ID NO: 446259 - RNA, 22 nt, Human
uauggcuuuucuuuccuagugu

SEQ ID NO: 446260 - RNA, 23 nt, Human
gguggcaggaguggaugcugagc

SEQ ID NO: 446261 - RNA, 22 nt, Human
gugcuugggggaaguaacagac

SEQ ID NO: 446262 - RNA, 22 nt, Human
ugaugcauugccgacuuacugg

SEQ ID NO: 446263 - RNA, 20 nt, Human
ugagaaggggucagcuguac

SEQ ID NO: 446264 - RNA, 22 nt, Human
cauuucuagacaaguccuggag

SEQ ID NO: 446265 - RNA, 22 nt, Human
acugcauugagguuucauacuu

SEQ ID NO: 446266 - RNA, 22 nt, Human
uuccaugaaggagacugagaag

SEQ ID NO: 446267 - RNA, 18 nt, Human
uaacaucggcuaugcauc

SEQ ID NO: 446268 - RNA, 17 nt, Human
acaagcaguggccaugg

SEQ ID NO: 446269 - RNA, 22 nt, Human
cucagggauggugaagcaccca

SEQ ID NO: 446270 - RNA, 22 nt, Human
gagcugccugugugccaugaug

SEQ ID NO: 446271 - RNA, 22 nt, Human
cagcagcuggugagacacagcc

SEQ ID NO: 446272 - RNA, 22 nt, Human
cuuucucuugagcaagagcugu

SEQ ID NO: 446273 - RNA, 22 nt, Human
ucugggcucugggaauuaggga

SEQ ID NO: 446274 - RNA, 22 nt, Human
augcauauuuucuguuggugac

SEQ ID NO: 446275 - RNA, 22 nt, Human
ugggcacuguagcuggugcugg

SEQ ID NO: 446276 - RNA, 18 nt, Human
gagcugccauauuuaguu

SEQ ID NO: 446277 - RNA, 22 nt, Human
guaggcagauaggagugcagcc

SEQ ID NO: 446278 - RNA, 22 nt, Human
agggagcagcagccacaggaug

SEQ ID NO: 446279 - RNA, 22 nt, Human
cuguccucuguccucagcagga

SEQ ID NO: 446280 - RNA, 22 nt, Human
agaaggcagaugggacggagca

SEQ ID NO: 446281 - RNA, 22 nt, Human
ucugagagccucuagccuaagu

SEQ ID NO: 446282 - RNA, 22 nt, Human
agggguggagaguguugccagu

SEQ ID NO: 446283 - RNA, 22 nt, Human
acccccaaacaucaagggcuga

SEQ ID NO: 446284 - RNA, 22 nt, Human
uaaaggcuuuauuuuccaguca

SEQ ID NO: 446285 - RNA, 22 nt, Human
agguggcauuuacaccauggga

SEQ ID NO: 446286 - RNA, 23 nt, Human
uaauuuuagccuuacaggacccu

SEQ ID NO: 446287 - RNA, 22 nt, Human
cugcagcugccagugauuucag

SEQ ID NO: 446288 - RNA, 22 nt, Human
auucaaacaggccaauugaccu

SEQ ID NO: 446289 - RNA, 22 nt, Human
gcacugaaauuauaugcauuug

SEQ ID NO: 446290 - RNA, 22 nt, Human
aagagagacaauagguagcauu

SEQ ID NO: 446291 - RNA, 22 nt, Human
acauucaaaaagcaucugucac

SEQ ID NO: 446292 - RNA, 22 nt, Human
cuggggcagagcccagcaauuu

SEQ ID NO: 446293 - RNA, 22 nt, Human
uggcacagaaaaaugcuccauu

SEQ ID NO: 446294 - RNA, 22 nt, Human
ucuuugcaugaguucccucugu

SEQ ID NO: 446295 - RNA, 22 nt, Human
uuugcaaaugcucugcagagcu

SEQ ID NO: 446296 - RNA, 22 nt, Human
guccacagagggcugggcaggc

SEQ ID NO: 446297 - RNA, 22 nt, Human
cugccugugcaugcagucagaa

SEQ ID NO: 446298 - RNA, 22 nt, Human
gaggcacauauauacagagccc

SEQ ID NO: 446299 - RNA, 22 nt, Human
gcaggagccaggccgagcuggu

SEQ ID NO: 446300 - RNA, 22 nt, Human
aggcagcuuaagcccuggccca

SEQ ID NO: 446301 - RNA, 22 nt, Human
auucaaguacaguuuucuucuu

SEQ ID NO: 446302 - RNA, 22 nt, Human
ggcugagcacuuuaggcaggag

SEQ ID NO: 446303 - RNA, 22 nt, Human
agacauagauaggcacugauug

SEQ ID NO: 446304 - RNA, 22 nt, Human
auuugcugauggcauuugagcu

SEQ ID NO: 446305 - RNA, 22 nt, Human
ggaagaaagguggacaacaggu

SEQ ID NO: 446306 - RNA, 22 nt, Human
uaugcauuuuauagugcaaagc

SEQ ID NO: 446307 - RNA, 22 nt, Human
ccugggagguggagguugcagu

SEQ ID NO: 446308 - RNA, 22 nt, Human
agcccugcgugccaggggacug

SEQ ID NO: 446309 - RNA, 22 nt, Human
uucccagugaggaagcaaugca

SEQ ID NO: 446310 - RNA, 22 nt, Human
ggcagggugccuggcuccuguu

SEQ ID NO: 446311 - RNA, 22 nt, Human
aaggaagguucauagucaaaga

SEQ ID NO: 446312 - RNA, 22 nt, Human
gaacagagaagcuuuacuaaag

SEQ ID NO: 446313 - RNA, 22 nt, Human
uugcaaauauuccccuaggucu

SEQ ID NO: 446314 - RNA, 22 nt, Human
guucuuuaggggcccaauuucc

SEQ ID NO: 446315 - RNA, 22 nt, Human
cccaggcugaguuagagguguc

SEQ ID NO: 446316 - RNA, 22 nt, Human
uagaacagaggguugcccagau

SEQ ID NO: 446317 - RNA, 22 nt, Human
ccuccagcgcgauccacuccgg

SEQ ID NO: 446318 - RNA, 22 nt, Human
auaggagacuguucuuggcuuc

SEQ ID NO: 446319 - RNA, 19 nt, Human
agcagcagcuaccacuugu

SEQ ID NO: 446320 - RNA, 22 nt, Human
ugguccaggguguaguacagag

SEQ ID NO: 446321 - RNA, 19 nt, Human
auaaggcaauuggauuugg

SEQ ID NO: 446322 - RNA, 22 nt, Human
ucuggcagcuauccucuggcca

SEQ ID NO: 446323 - RNA, 23 nt, Human
agacccagagacuggcucugcuc

SEQ ID NO: 446324 - RNA, 22 nt, Human
gcagagugagccgaggcugcuc

SEQ ID NO: 446325 - RNA, 22 nt, Human
uuuauagaugucuguauuauaa

SEQ ID NO: 446326 - RNA, 23 nt, Human
gccugccugaccugugcaaaguc

SEQ ID NO: 446327 - RNA, 22 nt, Human
aaauucagauggcuuucuuuuc

SEQ ID NO: 446328 - RNA, 22 nt, Human
gaggcugcaggcaaugcugccc

SEQ ID NO: 446329 - RNA, 22 nt, Human
gggaugccaguccuggcccugc

SEQ ID NO: 446330 - RNA, 22 nt, Human
aaagacauuagauuaacguaca

SEQ ID NO: 446331 - RNA, 22 nt, Human
ucugaggguuguagagagggac

SEQ ID NO: 446332 - RNA, 22 nt, Human
aagcucugcucagcagacuagg

SEQ ID NO: 446333 - RNA, 22 nt, Human
gcugucuugcucacucuugcag

SEQ ID NO: 446334 - RNA, 22 nt, Human
aaggcaaugguuucugugccuu

SEQ ID NO: 446335 - RNA, 22 nt, Human
aggcaacaugacucacuugcac

SEQ ID NO: 446336 - RNA, 19 nt, Human
agccagcaggccucugagc

SEQ ID NO: 446337 - RNA, 22 nt, Human
cacugcucgcugcagcauggcc

SEQ ID NO: 446338 - RNA, 22 nt, Human
cccaggaggccaagguugcagu

SEQ ID NO: 446339 - RNA, 22 nt, Human
accaccccagaauuuuucaagg

SEQ ID NO: 446340 - RNA, 22 nt, Human
gagccugaaauacaggucacug

SEQ ID NO: 446341 - RNA, 22 nt, Human
ucaggcuguauaucuugcacuc

SEQ ID NO: 446342 - RNA, 22 nt, Human
caguggguaggaaaggcucuuc

SEQ ID NO: 446343 - RNA, 22 nt, Human
ggagagagaccuccaugcccag

SEQ ID NO: 446344 - RNA, 22 nt, Human
ucauugaauuugguucaauaug

SEQ ID NO: 446345 - RNA, 22 nt, Human
ccuggccaguuuccaggcccug

SEQ ID NO: 446346 - RNA, 22 nt, Human
ccagcccuugagauggaaggga

SEQ ID NO: 446347 - RNA, 21 nt, Human
acaguacuugagaucuuuuga

SEQ ID NO: 446348 - RNA, 22 nt, Human
gcugacacuuagaagugcccug

SEQ ID NO: 446349 - RNA, 22 nt, Human
uguguguguuucugcucauaca

SEQ ID NO: 446350 - RNA, 22 nt, Human
cugugugugucugcagcauacu

SEQ ID NO: 446351 - RNA, 22 nt, Human
acugcuuuaucugagaaguccu

SEQ ID NO: 446352 - RNA, 22 nt, Human
cagaauuuuucgaauguacugu

SEQ ID NO: 446353 - RNA, 22 nt, Human
caggcuugauuauucagacaau

SEQ ID NO: 446354 - RNA, 22 nt, Human
ucuggcucucauacucgccagu

SEQ ID NO: 446355 - RNA, 19 nt, Human
gcuggggaauggauauuga

SEQ ID NO: 446356 - RNA, 22 nt, Human
uugcaaaaaccacaauuacuuu

SEQ ID NO: 446357 - RNA, 22 nt, Human
guggagcccugguagggacccc

SEQ ID NO: 446358 - RNA, 22 nt, Human
acccagagucagacagccaugg

SEQ ID NO: 446359 - RNA, 22 nt, Human
ugggcacuauggcucugugcac

SEQ ID NO: 446360 - RNA, 22 nt, Human
cugcauuucacauuuaaacuuu

SEQ ID NO: 446361 - RNA, 22 nt, Human
aggcccugagaaaaucccugca

SEQ ID NO: 446362 - RNA, 22 nt, Human
agugaaaucagguuuugacugc

SEQ ID NO: 446363 - RNA, 22 nt, Human
ugucccuggaacuauggcucca

SEQ ID NO: 446364 - RNA, 22 nt, Human
cccuggagcuagucugagcaga

SEQ ID NO: 446365 - RNA, 22 nt, Human
ccacagagacaggguccuugcu

SEQ ID NO: 446366 - RNA, 22 nt, Human
gucuggaaauuuaagguaugag

SEQ ID NO: 446367 - RNA, 22 nt, Human
auugcaaagcauugugagcgca

SEQ ID NO: 446368 - RNA, 22 nt, Human
cccucagcuccacccucagcag

SEQ ID NO: 446369 - RNA, 22 nt, Human
guuuguuuauacaaaagauccu

SEQ ID NO: 446370 - RNA, 22 nt, Human
acuuucuauggcuuauuaugag

SEQ ID NO: 446371 - RNA, 22 nt, Human
cagaauuugaaguaauauucca

SEQ ID NO: 446372 - RNA, 21 nt, Human
guucaaauccugacacuacac

SEQ ID NO: 446373 - RNA, 22 nt, Human
uuuuuauaggucagggcaaguc

SEQ ID NO: 446374 - RNA, 21 nt, Human
gcagaaaggaaucuuaggucc

SEQ ID NO: 446375 - RNA, 22 nt, Human
acacaugauaagaaaguuuaaa

SEQ ID NO: 446376 - RNA, 22 nt, Human
agcuguguguuuccacugagcu

SEQ ID NO: 446377 - RNA, 22 nt, Human
cuccugggaaaugaaggggcag

SEQ ID NO: 446378 - RNA, 19 nt, Human
gggcuuggggcugaagccu

SEQ ID NO: 446379 - RNA, 22 nt, Human
agcaaauucagaagcagaaugg

SEQ ID NO: 446380 - RNA, 22 nt, Human
uucuagucuauggcuagauagu

SEQ ID NO: 446381 - RNA, 22 nt, Human
cugcagcugcucauguuacuug

SEQ ID NO: 446382 - RNA, 22 nt, Human
gcuggccacacugcugauggag

SEQ ID NO: 446383 - RNA, 19 nt, Human
ugaggccaaggucacagau

SEQ ID NO: 446384 - RNA, 22 nt, Human
ugcccugucuaagcugucagua

SEQ ID NO: 446385 - RNA, 22 nt, Human
ggagacagcaggaagaaauauc

SEQ ID NO: 446386 - RNA, 22 nt, Human
aacaucuuuguaguguucuccu

SEQ ID NO: 446387 - RNA, 22 nt, Human
caggccugguugagcccugaga

SEQ ID NO: 446388 - RNA, 22 nt, Human
gccagcugucuaagagaguaaa

SEQ ID NO: 446389 - RNA, 22 nt, Human
uccaggcaucccccaggacaga

SEQ ID NO: 446390 - RNA, 22 nt, Human
aacuuuuucugggauggagggu

SEQ ID NO: 446391 - RNA, 22 nt, Human
cucaggagaugacagaagguau

SEQ ID NO: 446392 - RNA, 18 nt, Human
cagagcagagguggagcg

SEQ ID NO: 446393 - RNA, 22 nt, Human
ugcaaauucuuuacucugugau

SEQ ID NO: 446394 - RNA, 19 nt, Human
uguuuuguuaaagcagucc

SEQ ID NO: 446395 - RNA, 22 nt, Human
gcacugaugcaaaaaucacuca

SEQ ID NO: 446396 - RNA, 22 nt, Human
aagcccuggcucagcucaccag

SEQ ID NO: 446397 - RNA, 17 nt, Human
agcagcuggguugaucu

SEQ ID NO: 446398 - RNA, 17 nt, Human
ugugagcaucuauagaa

SEQ ID NO: 446399 - RNA, 22 nt, Human
ucuuucuucagcccuguaagau

SEQ ID NO: 446400 - RNA, 22 nt, Human
aaaauucauagaacuguacgcu

SEQ ID NO: 446401 - RNA, 22 nt, Human
cagcccagacaccaucauucua

SEQ ID NO: 446402 - RNA, 22 nt, Human
gcauaucaugacuucuaucuua

SEQ ID NO: 446403 - RNA, 22 nt, Human
uguuuuguuuaugagagcacag

SEQ ID NO: 446404 - RNA, 22 nt, Human
cacaugaacaugcuggaaaagc

SEQ ID NO: 446405 - RNA, 22 nt, Human
ugcacagagagaugagacacgu

SEQ ID NO: 446406 - RNA, 22 nt, Human
agcccuggagcaaaggugucuu

SEQ ID NO: 446407 - RNA, 22 nt, Human
ugggcagacuaaggucaaagcu

SEQ ID NO: 446408 - RNA, 22 nt, Human
cagagucccagaugccccuccu

SEQ ID NO: 446409 - RNA, 22 nt, Human
auuuucucacaauccuaugggg

SEQ ID NO: 446410 - RNA, 22 nt, Human
gggcuggcucccagguguugaa

SEQ ID NO: 446411 - RNA, 22 nt, Human
agguuccuuauggggauggcua

SEQ ID NO: 446412 - RNA, 22 nt, Human
agagggcuuugauucucaguuc

SEQ ID NO: 446413 - RNA, 22 nt, Human
acacagaaccucauagccucuc

SEQ ID NO: 446414 - RNA, 22 nt, Human
agaaacagcauuagcaucaauu

SEQ ID NO: 446415 - RNA, 22 nt, Human
uuggaaaggagauucuauugug

SEQ ID NO: 446416 - RNA, 22 nt, Human
ugauuuucuccauuguaaauuc

SEQ ID NO: 446417 - RNA, 22 nt, Human
agcuaagguguccuggaggccc

SEQ ID NO: 446418 - RNA, 18 nt, Human
ugagccgguagauggggu

SEQ ID NO: 446419 - RNA, 22 nt, Human
uuccuuuugcaagguccucuag

SEQ ID NO: 446420 - RNA, 19 nt, Human
ccagcccugucacuucuug

SEQ ID NO: 446421 - RNA, 22 nt, Human
cuggaugcuuccucucugcuag

SEQ ID NO: 446422 - RNA, 22 nt, Human
ugaaagucucuguuauagagaa

SEQ ID NO: 446423 - RNA, 22 nt, Human
gccuggagggucccucucugga

SEQ ID NO: 446424 - RNA, 22 nt, Human
cagcuggugucaggcacugcag

SEQ ID NO: 446425 - RNA, 22 nt, Human
cauauuuuaguugcugaacagc

SEQ ID NO: 446426 - RNA, 22 nt, Human
uggcacuuagaucagguugggu

SEQ ID NO: 446427 - RNA, 22 nt, Human
acaaagauguuuaaagcauuua

SEQ ID NO: 446428 - RNA, 22 nt, Human
gaguuacauuuggugacacuuc

SEQ ID NO: 446429 - RNA, 22 nt, Human
gccuguccacuaaacagccaag

SEQ ID NO: 446430 - RNA, 22 nt, Human
cccagagccucauucuguuggg

SEQ ID NO: 446431 - RNA, 22 nt, Human
aauugcuugucuucuucccuac

SEQ ID NO: 446432 - RNA, 22 nt, Human
ucaggguaaaccuucacuguga

SEQ ID NO: 446433 - RNA, 22 nt, Human
gggcaguggguggcugcagccu

SEQ ID NO: 446434 - RNA, 22 nt, Human
cucuccagggaagcaguguacu

SEQ ID NO: 446435 - RNA, 22 nt, Human
cagcccagcgcaaacaacuggc

SEQ ID NO: 446436 - RNA, 22 nt, Human
uuuaucuuuaggacuuugcaga

SEQ ID NO: 446437 - RNA, 22 nt, Human
uccugccuagcaggugaccuau

SEQ ID NO: 446438 - RNA, 22 nt, Human
uuguuucuucauuuagaagcuu

SEQ ID NO: 446439 - RNA, 22 nt, Human
gaggccaggacaugaaagcuga

SEQ ID NO: 446440 - RNA, 20 nt, Human
uugcaaauaucgugggucag

SEQ ID NO: 446441 - RNA, 22 nt, Human
ccugggucuugguucaugcucu

SEQ ID NO: 446442 - RNA, 22 nt, Human
uuauacauguguuuugagauga

SEQ ID NO: 446443 - RNA, 22 nt, Human
ucuguggcacgauugcacugca

SEQ ID NO: 446444 - RNA, 23 nt, Human
gugagcagcccacuaggaaugcc

SEQ ID NO: 446445 - RNA, 22 nt, Human
cauuuguagcuauuuacuguau

SEQ ID NO: 446446 - RNA, 22 nt, Human
aaacaagagcuuacauggcugc

SEQ ID NO: 446447 - RNA, 22 nt, Human
acauucaaccaauguuugcuau

SEQ ID NO: 446448 - RNA, 22 nt, Human
cuugacacugucacucaggcca

SEQ ID NO: 446449 - RNA, 17 nt, Human
acugaagcauuuaugau

SEQ ID NO: 446450 - RNA, 22 nt, Human
gcagagcucaagguguucagcu

SEQ ID NO: 446451 - RNA, 22 nt, Human
gccuggguccacugaucaugcu

SEQ ID NO: 446452 - RNA, 22 nt, Human
gucucccaauccgggacagccu

SEQ ID NO: 446453 - RNA, 22 nt, Human
aucuuuuaugagcguucugaca

SEQ ID NO: 446454 - RNA, 22 nt, Human
gacagacaggugugguaggcac

SEQ ID NO: 446455 - RNA, 22 nt, Human
auugcccaauaauaaaauggua

SEQ ID NO: 446456 - RNA, 22 nt, Human
aacaucaucagaugggugcuug

SEQ ID NO: 446457 - RNA, 22 nt, Human
caguacuuaacuuauaggagag

SEQ ID NO: 446458 - RNA, 22 nt, Human
ugagacaguaauuguauaguuu

SEQ ID NO: 446459 - RNA, 22 nt, Human
gugcaaaaguaauugcaguuuu

SEQ ID NO: 446460 - RNA, 22 nt, Human
ugcccagcacccagcaugaugc

SEQ ID NO: 446461 - RNA, 22 nt, Human
acagcagcuugucuguucuuua

SEQ ID NO: 446462 - RNA, 22 nt, Human
uacacaaucuguuuuuccauuu

SEQ ID NO: 446463 - RNA, 22 nt, Human
uucaauaggaugcaugauauaa

SEQ ID NO: 446464 - RNA, 17 nt, Human
ugccagccugucccagg

SEQ ID NO: 446465 - RNA, 22 nt, Human
caaaugaagguggugggucauu

SEQ ID NO: 446466 - RNA, 23 nt, Human
gcccagagaggcucaccaggaau

SEQ ID NO: 446467 - RNA, 22 nt, Human
caaugcacauggacaucaggcu

SEQ ID NO: 446468 - RNA, 21 nt, Human
guucaaauggguagauucaca

SEQ ID NO: 446469 - RNA, 22 nt, Human
uggaugagaaacucuggugacu

SEQ ID NO: 446470 - RNA, 20 nt, Human
cuccccucuacagagggcug

SEQ ID NO: 446471 - RNA, 22 nt, Human
uucucacaauucuuguauuugc

SEQ ID NO: 446472 - RNA, 22 nt, Human
agccacagagcaggagaccuuu

SEQ ID NO: 446473 - RNA, 22 nt, Human
gugaauaacuuucuauguuaau

SEQ ID NO: 446474 - RNA, 22 nt, Human
cuuuguuuuacucagaggcaug

SEQ ID NO: 446475 - RNA, 22 nt, Human
caggcagcugcgacaagagagc

SEQ ID NO: 446476 - RNA, 21 nt, Human
aagcaggacauaugaugcccu

SEQ ID NO: 446477 - RNA, 22 nt, Human
uccugccuaccuugcggaggug

SEQ ID NO: 446478 - RNA, 22 nt, Human
ucagaggauugccucagcgagc

SEQ ID NO: 446479 - RNA, 22 nt, Human
uacauauuugucuuuguacugu

SEQ ID NO: 446480 - RNA, 22 nt, Human
cuggugccauucuguggccuag

SEQ ID NO: 446481 - RNA, 22 nt, Human
caguggccaugguggcaggggu

SEQ ID NO: 446482 - RNA, 22 nt, Human
gacuuugcccuaaugaggucuc

SEQ ID NO: 446483 - RNA, 22 nt, Human
gcagggaagacccggagcagcg

SEQ ID NO: 446484 - RNA, 22 nt, Human
ccacugucuuuuccaggcugaa

SEQ ID NO: 446485 - RNA, 22 nt, Human
cuccuuccaacaagagaaagag

SEQ ID NO: 446486 - RNA, 19 nt, Human
uugcuucaggcugugugcu

SEQ ID NO: 446487 - RNA, 22 nt, Human
cagcauuuaaugcagugcuucc

SEQ ID NO: 446488 - RNA, 17 nt, Human
uuauuuuuugggcugag

SEQ ID NO: 446489 - RNA, 20 nt, Human
gagguagggcuuaaggcaag

SEQ ID NO: 446490 - RNA, 22 nt, Human
cauuccaaggccaagucuaaga

SEQ ID NO: 446491 - RNA, 22 nt, Human
ucagaguguggugagaugugca

SEQ ID NO: 446492 - RNA, 22 nt, Human
cuggcaggcggagguugcagug

SEQ ID NO: 446493 - RNA, 22 nt, Human
ccagccuggguguuagaagaca

SEQ ID NO: 446494 - RNA, 22 nt, Human
gcagacuggucuucagccuugg

SEQ ID NO: 446495 - RNA, 22 nt, Human
uggccuggcccugaggcccugu

SEQ ID NO: 446496 - RNA, 22 nt, Human
uuuacuacuucauugacuuacg

SEQ ID NO: 446497 - RNA, 22 nt, Human
augcauaugcaaugcacaauuu

SEQ ID NO: 446498 - RNA, 22 nt, Human
uugcccugucuuaagcuggcaa

SEQ ID NO: 446499 - RNA, 22 nt, Human
ggcccacacugacagcugagcu

SEQ ID NO: 446500 - RNA, 22 nt, Human
cauuuguaucauauguaucuua

SEQ ID NO: 446501 - RNA, 22 nt, Human
gcagcuggcccugacacgcaga

SEQ ID NO: 446502 - RNA, 22 nt, Human
aacacuuuccguagguuuagua

SEQ ID NO: 446503 - RNA, 20 nt, Human
caggccagagguuugauggc

SEQ ID NO: 446504 - RNA, 22 nt, Human
gcuuccucccugcugcucacua

SEQ ID NO: 446505 - RNA, 22 nt, Human
ccagaagaggacacagugugga

SEQ ID NO: 446506 - RNA, 23 nt, Human
uuuaaccuuggucaagaauuucc

SEQ ID NO: 446507 - RNA, 22 nt, Human
ggccccagcagugcuuguuuau

SEQ ID NO: 446508 - RNA, 22 nt, Human
uggugagaugcagcaacagaca

SEQ ID NO: 446509 - RNA, 22 nt, Human
uggacuccagugucuguguucu

SEQ ID NO: 446510 - RNA, 22 nt, Human
ugacaaauguuaauucagugga

SEQ ID NO: 446511 - RNA, 22 nt, Human
aggcugagccacggggcuggcu

SEQ ID NO: 446512 - RNA, 22 nt, Human
cccuaggcugggcucuuggcuu

SEQ ID NO: 446513 - RNA, 22 nt, Human
gucuggaaggaggagauggagc

SEQ ID NO: 446514 - RNA, 20 nt, Human
uaaaugcaugaauguaaggc

SEQ ID NO: 446515 - RNA, 22 nt, Human
ggcagcugaagaggaacuuugg

SEQ ID NO: 446516 - RNA, 22 nt, Human
ugugaauauccauuuguuucag

SEQ ID NO: 446517 - RNA, 21 nt, Human
cuuuggcaagggagaagucac

SEQ ID NO: 446518 - RNA, 22 nt, Human
cugccacuagcuuucacaucuu

SEQ ID NO: 446519 - RNA, 23 nt, Human
cucugcaggagagugggcagggc

SEQ ID NO: 446520 - RNA, 22 nt, Human
cccagcuccuuggaugggcagg

SEQ ID NO: 446521 - RNA, 22 nt, Human
ugcaggcuauccuuugcugcaa

SEQ ID NO: 446522 - RNA, 22 nt, Human
ugagcccagucugucugacaug

SEQ ID NO: 446523 - RNA, 22 nt, Human
cuggagcucuguguguuccuga

SEQ ID NO: 446524 - RNA, 21 nt, Human
uguucacauggagcagaaugu

SEQ ID NO: 446525 - RNA, 22 nt, Human
ggcagccacccugggaggcaga

SEQ ID NO: 446526 - RNA, 22 nt, Human
uucagaauauuuguuuuacaug

SEQ ID NO: 446527 - RNA, 22 nt, Human
ucugcugcugaccaacacugug

SEQ ID NO: 446528 - RNA, 22 nt, Human
gcaggcugugguauguugggca

SEQ ID NO: 446529 - RNA, 22 nt, Human
gcacuuuguggauuguauuucc

SEQ ID NO: 446530 - RNA, 22 nt, Human
gcuuagcagucacacauuguuc

SEQ ID NO: 446531 - RNA, 22 nt, Human
ugagcaggcgcagcaggagguc

SEQ ID NO: 446532 - RNA, 22 nt, Human
ugagccuggccugcagagacca

SEQ ID NO: 446533 - RNA, 22 nt, Human
cccagcagaccgcugugauggc

SEQ ID NO: 446534 - RNA, 22 nt, Human
uuuggcagagucauuucagaaa

SEQ ID NO: 446535 - RNA, 22 nt, Human
ggcaauuucaugugguuuaaac

SEQ ID NO: 446536 - RNA, 22 nt, Human
uaguugacaucaucagccugga

SEQ ID NO: 446537 - RNA, 22 nt, Human
gcccaagggcaucaaguucuac

SEQ ID NO: 446538 - RNA, 22 nt, Human
aucugcaucagacuuugcauga

SEQ ID NO: 446539 - RNA, 22 nt, Human
cacaauuuggugcuaaagaaag

SEQ ID NO: 446540 - RNA, 22 nt, Human
gcacccagcccagggcgugaug

SEQ ID NO: 446541 - RNA, 22 nt, Human
cuggccuaaaauugcuucugca

SEQ ID NO: 446542 - RNA, 22 nt, Human
ggccuugggauguggcugcagc

SEQ ID NO: 446543 - RNA, 22 nt, Human
aggcaggcucaggcccaugcuu

SEQ ID NO: 446544 - RNA, 22 nt, Human
auagaauuuguacuuguagaac

SEQ ID NO: 446545 - RNA, 22 nt, Human
guuugacacugagauaaauaaa

SEQ ID NO: 446546 - RNA, 22 nt, Human
aagacagaccacgugacagggc

SEQ ID NO: 446547 - RNA, 22 nt, Human
aacaucucauggacuacauucu

SEQ ID NO: 446548 - RNA, 22 nt, Human
acaaaacaguguuccugccccu

SEQ ID NO: 446549 - RNA, 22 nt, Human
cacauuuaauugguuuagggug

SEQ ID NO: 446550 - RNA, 22 nt, Human
uugggcaaaguguuucuggagc

SEQ ID NO: 446551 - RNA, 22 nt, Human
cugugcagcuuggcuucaggcc

SEQ ID NO: 446552 - RNA, 22 nt, Human
agcagcagaaaguugauggcag

SEQ ID NO: 446553 - RNA, 22 nt, Human
cagcugcccauccugggaaaug

SEQ ID NO: 446554 - RNA, 22 nt, Human
uacagggauuccugccgcucgc

SEQ ID NO: 446555 - RNA, 22 nt, Human
aaucuggucuaagugaggauag

SEQ ID NO: 446556 - RNA, 17 nt, Human
aagacaagacaaaugca

SEQ ID NO: 446557 - RNA, 22 nt, Human
auuccaaagacagaagcagcug

SEQ ID NO: 446558 - RNA, 22 nt, Human
gggcuggagccagcuguggcug

SEQ ID NO: 446559 - RNA, 22 nt, Human
cacaguuauauguucacaagga

SEQ ID NO: 446560 - RNA, 22 nt, Human
ugcaggcuuggaucacaucucc

SEQ ID NO: 446561 - RNA, 20 nt, Human
gcugaggucauuaugccuca

SEQ ID NO: 446562 - RNA, 22 nt, Human
guuuguuuuaagauaggaugga

SEQ ID NO: 446563 - RNA, 22 nt, Human
gcagcugagcgugaggaagagu

SEQ ID NO: 446564 - RNA, 22 nt, Human
agcaggcugagcacccaggggg

SEQ ID NO: 446565 - RNA, 22 nt, Human
gagcccugauuugcagcauuug

SEQ ID NO: 446566 - RNA, 22 nt, Human
aggcuaggaacagcccggcccu

SEQ ID NO: 446567 - RNA, 22 nt, Human
agucacaugaguuucucuuuau

SEQ ID NO: 446568 - RNA, 22 nt, Human
uugcucaguggcagggcuggua

SEQ ID NO: 446569 - RNA, 22 nt, Human
caggcugaggguuaggccuuag

SEQ ID NO: 446570 - RNA, 22 nt, Human
cuuagaaaugcagauucucagg

SEQ ID NO: 446571 - RNA, 22 nt, Human
gcccagcaccucucucaggguu

SEQ ID NO: 446572 - RNA, 22 nt, Human
gucaggaaaaauugauaauuuu

SEQ ID NO: 446573 - RNA, 22 nt, Human
ugcagcugugggagaaucucug

SEQ ID NO: 446574 - RNA, 22 nt, Human
gcuccccauugaucugcaggcu

SEQ ID NO: 446575 - RNA, 22 nt, Human
cugugggcucccagcuucucuc

SEQ ID NO: 446576 - RNA, 22 nt, Human
acagcaguggugcacugagcca

SEQ ID NO: 446577 - RNA, 22 nt, Human
cucccuggcacagcgagagguu

SEQ ID NO: 446578 - RNA, 22 nt, Human
gugcccugggccuucagggcca

SEQ ID NO: 446579 - RNA, 22 nt, Human
acuugauuuuuauaauaaaugg

SEQ ID NO: 446580 - RNA, 22 nt, Human
ucccagagugugggcaucaagg

SEQ ID NO: 446581 - RNA, 20 nt, Human
agaaaauguuuucagcugga

SEQ ID NO: 446582 - RNA, 22 nt, Human
guucuauguugagauagcuaau

SEQ ID NO: 446583 - RNA, 22 nt, Human
agaggguaacaagaggccugga

SEQ ID NO: 446584 - RNA, 23 nt, Human
agggaagaaacaugaagggcugu

SEQ ID NO: 446585 - RNA, 22 nt, Human
uggagagaacagugucugaaag

SEQ ID NO: 446586 - RNA, 22 nt, Human
agagcucaagacgcucacagua

SEQ ID NO: 446587 - RNA, 22 nt, Human
gcuaaggcacaaauagcuuugc

SEQ ID NO: 446588 - RNA, 22 nt, Human
augauacaucuuguuuauuuca

SEQ ID NO: 446589 - RNA, 19 nt, Human
ucacagcaucugucugaac

SEQ ID NO: 446590 - RNA, 22 nt, Human
gcuggugauugccucaggaggc

SEQ ID NO: 446591 - RNA, 18 nt, Human
acaggcugugggaauggu

SEQ ID NO: 446592 - RNA, 22 nt, Human
ccagccucacuggcaucaccua

SEQ ID NO: 446593 - RNA, 22 nt, Human
cggccuucucccugggcaucac

SEQ ID NO: 446594 - RNA, 22 nt, Human
cucuuuuagagaugaaaauugg

SEQ ID NO: 446595 - RNA, 22 nt, Human
cauaggaaugaggacaauuagc

SEQ ID NO: 446596 - RNA, 22 nt, Human
cagggccucauccucagagauu

SEQ ID NO: 446597 - RNA, 22 nt, Human
aaaugccuauuuguuccuucag

SEQ ID NO: 446598 - RNA, 22 nt, Human
uugcagggaccugcagaaagcu

SEQ ID NO: 446599 - RNA, 22 nt, Human
ugcagcugugaaagggaaccaa

SEQ ID NO: 446600 - RNA, 22 nt, Human
augcauauuuucuacuauaucg

SEQ ID NO: 446601 - RNA, 22 nt, Human
uggcagggaauacagauguuua

SEQ ID NO: 446602 - RNA, 22 nt, Human
gcagggcugcugaaacuuguuu

SEQ ID NO: 446603 - RNA, 22 nt, Human
agugacaacaaguugacuagaa

SEQ ID NO: 446604 - RNA, 22 nt, Human
aaggaaagauucucucucuaga

SEQ ID NO: 446605 - RNA, 22 nt, Human
agaauuuuugcaguuuagccau

SEQ ID NO: 446606 - RNA, 22 nt, Human
acaggaggagcuguuucaggga

SEQ ID NO: 446607 - RNA, 22 nt, Human
uagagacaccaguaccauucug

SEQ ID NO: 446608 - RNA, 22 nt, Human
aagauucacagagugaaugaaa

SEQ ID NO: 446609 - RNA, 22 nt, Human
uuauuuaaaauguagguuggga

SEQ ID NO: 446610 - RNA, 22 nt, Human
ugcaguuuuggccauugaaggc

SEQ ID NO: 446611 - RNA, 22 nt, Human
caggaggacauacuggcucaca

SEQ ID NO: 446612 - RNA, 22 nt, Human
cuuguuuuggaacagagugaau

SEQ ID NO: 446613 - RNA, 22 nt, Human
gcaaggaacaaaugcucugcuu

SEQ ID NO: 446614 - RNA, 22 nt, Human
cauuauugaugcaacagcccuu

SEQ ID NO: 446615 - RNA, 22 nt, Human
ugcauugaucauauccuuccug

SEQ ID NO: 446616 - RNA, 22 nt, Human
cagggagaucuuggcuccuggu

SEQ ID NO: 446617 - RNA, 22 nt, Human
aaggcuggggugcagacggccu

SEQ ID NO: 446618 - RNA, 22 nt, Human
uguggcuuuugcuagcuuugca

SEQ ID NO: 446619 - RNA, 22 nt, Human
cucaggccauucuuccagcugc

SEQ ID NO: 446620 - RNA, 22 nt, Human
aagcagaaaaacugagcuccaa

SEQ ID NO: 446621 - RNA, 22 nt, Human
uggcucucuuguaagguaguag

SEQ ID NO: 446622 - RNA, 22 nt, Human
ucagugcagaauagugaugcau

SEQ ID NO: 446623 - RNA, 22 nt, Human
gugcauauuuugcacacagaug

SEQ ID NO: 446624 - RNA, 22 nt, Human
cuucaaauccuguguagggcua

SEQ ID NO: 446625 - RNA, 22 nt, Human
ccauuacuuuccaauauaucag

SEQ ID NO: 446626 - RNA, 22 nt, Human
acacauuauagagaguauaaua

SEQ ID NO: 446627 - RNA, 21 nt, Human
agcaaaggcaggagagguuuc

SEQ ID NO: 446628 - RNA, 22 nt, Human
uggugcugacaguucugagugc

SEQ ID NO: 446629 - RNA, 22 nt, Human
agaaguaggcagggcuguauca

SEQ ID NO: 446630 - RNA, 22 nt, Human
uguacaaaguuaaaccuauaua

SEQ ID NO: 446631 - RNA, 22 nt, Human
agcuguuuaaaugacuuacuuu

SEQ ID NO: 446632 - RNA, 22 nt, Human
agagggaucacccuguuucugg

SEQ ID NO: 446633 - RNA, 22 nt, Human
caggcuggaguuaccuuuaggg

SEQ ID NO: 446634 - RNA, 22 nt, Human
cccagggcccuggacagcuaca

SEQ ID NO: 446635 - RNA, 18 nt, Human
auuaaggcuuugauagua

SEQ ID NO: 446636 - RNA, 22 nt, Human
caggcaagauuagagaugagca

SEQ ID NO: 446637 - RNA, 22 nt, Human
auuucucagugaaaugacaggc

SEQ ID NO: 446638 - RNA, 22 nt, Human
acaacauucuuaaauacacuga

SEQ ID NO: 446639 - RNA, 22 nt, Human
cacaggaaggccuucucacaau

SEQ ID NO: 446640 - RNA, 22 nt, Human
ccaggcaucacgggcauguggc

SEQ ID NO: 446641 - RNA, 22 nt, Human
cagcugagaaggucugaucagg

SEQ ID NO: 446642 - RNA, 23 nt, Human
ggggacagagggcagcccgcauc

SEQ ID NO: 446643 - RNA, 22 nt, Human
gucagcaguggcagcucccggg

SEQ ID NO: 446644 - RNA, 22 nt, Human
ggaaggggagcuggaaagggua

SEQ ID NO: 446645 - RNA, 22 nt, Human
aaggcagcaggauuuggugacu

SEQ ID NO: 446646 - RNA, 22 nt, Human
aggaauuugggguuacaugaug

SEQ ID NO: 446647 - RNA, 22 nt, Human
ggcagggacuauguuucaugga

SEQ ID NO: 446648 - RNA, 22 nt, Human
ucugcugcuacagacucucuag

SEQ ID NO: 446649 - RNA, 22 nt, Human
cagcagcaucaggucugugguu

SEQ ID NO: 446650 - RNA, 22 nt, Human
gcagacgucaccgagucgaugg

SEQ ID NO: 446651 - RNA, 22 nt, Human
cagcuguugugauuuccaggag

SEQ ID NO: 446652 - RNA, 22 nt, Human
aaggcuggagaugguuggaaug

SEQ ID NO: 446653 - RNA, 22 nt, Human
gcagaagaccaugguggaaaga

SEQ ID NO: 446654 - RNA, 22 nt, Human
acucugggccccagguggagcu

SEQ ID NO: 446655 - RNA, 22 nt, Human
cccuggagggcagacagaugcc

SEQ ID NO: 446656 - RNA, 22 nt, Human
ucugggcuggcuuuaugcugac

SEQ ID NO: 446657 - RNA, 22 nt, Human
caacauucuuaucacuauaagc

SEQ ID NO: 446658 - RNA, 17 nt, Human
aggcuccuccuaagguc

SEQ ID NO: 446659 - RNA, 22 nt, Human
acagcagcauaaacugacuaag

SEQ ID NO: 446660 - RNA, 22 nt, Human
agucccagcucugccacuuacu

SEQ ID NO: 446661 - RNA, 22 nt, Human
uugcagcucucugaagguugca

SEQ ID NO: 446662 - RNA, 22 nt, Human
uacagaguuuuccugccaagaa

SEQ ID NO: 446663 - RNA, 22 nt, Human
gaaugauauauuagcagauuuu

SEQ ID NO: 446664 - RNA, 22 nt, Human
acagagcuuaauucaggagcuu

SEQ ID NO: 446665 - RNA, 22 nt, Human
ugcuucaggagaugucaccaug

SEQ ID NO: 446666 - RNA, 23 nt, Human
gggggccguccuggggauuauag

SEQ ID NO: 446667 - RNA, 22 nt, Human
ucagaauuauguaggccugguu

SEQ ID NO: 446668 - RNA, 22 nt, Human
acagagcacugcccugugccgc

SEQ ID NO: 446669 - RNA, 22 nt, Human
aaguucagccugguuuuaaugc

SEQ ID NO: 446670 - RNA, 22 nt, Human
caggcugcugacaggcuuggag

SEQ ID NO: 446671 - RNA, 22 nt, Human
gcccagcuuuuugaggcaggca

SEQ ID NO: 446672 - RNA, 22 nt, Human
ggcugguuugacaaacugacaa

SEQ ID NO: 446673 - RNA, 22 nt, Human
auuguuaauguugcacuaaggu

SEQ ID NO: 446674 - RNA, 22 nt, Human
ucugucucaaguucuugcacuc

SEQ ID NO: 446675 - RNA, 22 nt, Human
cagcaguggaacuacccaggga

SEQ ID NO: 446676 - RNA, 22 nt, Human
uagccggguguugugucaugca

SEQ ID NO: 446677 - RNA, 22 nt, Human
caaggcaggccaguuucaaggc

SEQ ID NO: 446678 - RNA, 22 nt, Human
cccaggucuaugccagcucuga

SEQ ID NO: 446679 - RNA, 22 nt, Human
accuccccauuaggucacccac

SEQ ID NO: 446680 - RNA, 22 nt, Human
ugggccucaugcccagccaccc

SEQ ID NO: 446681 - RNA, 22 nt, Human
aucugaagggaaguggaaggca

SEQ ID NO: 446682 - RNA, 22 nt, Human
ugucccagauacuggacauaga

SEQ ID NO: 446683 - RNA, 22 nt, Human
aaagggaaguugcacauguucc

SEQ ID NO: 446684 - RNA, 22 nt, Human
auuccucauuuguugagaacca

SEQ ID NO: 446685 - RNA, 22 nt, Human
caggcagauuugcugcccucca

SEQ ID NO: 446686 - RNA, 21 nt, Human
uccugccuuaguccagagcag

SEQ ID NO: 446687 - RNA, 22 nt, Human
uuggaaauggcuguaguuauga

SEQ ID NO: 446688 - RNA, 17 nt, Human
ggccuguguggcugcag

SEQ ID NO: 446689 - RNA, 22 nt, Human
uugcaaaaacugcaauuacuuu

SEQ ID NO: 446690 - RNA, 23 nt, Human
ucagagaaguuguaggcugggga

SEQ ID NO: 446691 - RNA, 22 nt, Human
gcaggcaguugcaguuuucuag

SEQ ID NO: 446692 - RNA, 22 nt, Human
uuggccagguguccagcccagg

SEQ ID NO: 446693 - RNA, 22 nt, Human
gaggccucaggaaugucgugug

SEQ ID NO: 446694 - RNA, 22 nt, Human
aggcugcaggucugggucaugu

SEQ ID NO: 446695 - RNA, 22 nt, Human
aggcaggauugcugacaacaau

SEQ ID NO: 446696 - RNA, 22 nt, Human
uuugagguuagcuagcagauca

SEQ ID NO: 446697 - RNA, 22 nt, Human
ugacacaguaucaaacaugauu

SEQ ID NO: 446698 - RNA, 22 nt, Human
ugcauuugucuugucucaugaa

SEQ ID NO: 446699 - RNA, 22 nt, Human
cuuugcaaaaguuaauuguuga

SEQ ID NO: 446700 - RNA, 22 nt, Human
aagacaauaauuuuugggcagg

SEQ ID NO: 446701 - RNA, 20 nt, Human
cagcuuggaugagaggcuga

SEQ ID NO: 446702 - RNA, 22 nt, Human
cugccaggcacugggcucugca

SEQ ID NO: 446703 - RNA, 22 nt, Human
uuauacagcauugcuagugaug

SEQ ID NO: 446704 - RNA, 22 nt, Human
gaauuuuagaauaugugggcuu

SEQ ID NO: 446705 - RNA, 22 nt, Human
uuggcacuucacgagacagcua

SEQ ID NO: 446706 - RNA, 22 nt, Human
ccagagaauccggagaguccau

SEQ ID NO: 446707 - RNA, 22 nt, Human
ugacuucaaaggcucuacuccu

SEQ ID NO: 446708 - RNA, 22 nt, Human
uauuuccagcaguaagaagaca

SEQ ID NO: 446709 - RNA, 21 nt, Human
ucagcuugaaucuagagauag

SEQ ID NO: 446710 - RNA, 22 nt, Human
ugcagaagcagagccgguggcc

SEQ ID NO: 446711 - RNA, 22 nt, Human
ugacccugcuucuuggugcagg

SEQ ID NO: 446712 - RNA, 22 nt, Human
gaggaaggcuaaggggcuuaga

SEQ ID NO: 446713 - RNA, 22 nt, Human
uagcagcaauucaggugugaug

SEQ ID NO: 446714 - RNA, 22 nt, Human
uccaggcucagcacuugcuacu

SEQ ID NO: 446715 - RNA, 22 nt, Human
uaacacugguuaucccugugca

SEQ ID NO: 446716 - RNA, 22 nt, Human
agcaggaaagaaaaaucugugu

SEQ ID NO: 446717 - RNA, 22 nt, Human
ugcaggcauuggugagagaagc

SEQ ID NO: 446718 - RNA, 22 nt, Human
acaaguuuauuugauuagaaca

SEQ ID NO: 446719 - RNA, 22 nt, Human
ucagcucugcacuccacugugg

SEQ ID NO: 446720 - RNA, 22 nt, Human
cugaggccuaagacaugaauga

SEQ ID NO: 446721 - RNA, 22 nt, Human
cagguggcuucucccuaggcca

SEQ ID NO: 446722 - RNA, 22 nt, Human
cauuagagcagauaauaugugu

SEQ ID NO: 446723 - RNA, 22 nt, Human
ugugcaguuucuauguugucca

SEQ ID NO: 446724 - RNA, 22 nt, Human
agccuggccugggcaggcacau

SEQ ID NO: 446725 - RNA, 22 nt, Human
cacacaugcauguaagaccucu

SEQ ID NO: 446726 - RNA, 22 nt, Human
gccugccuucggugcgcagcgg

SEQ ID NO: 446727 - RNA, 19 nt, Human
ucagaauucugucucuuga

SEQ ID NO: 446728 - RNA, 22 nt, Human
cagugcaguugguggcaggggu

SEQ ID NO: 446729 - RNA, 22 nt, Human
ggagccugguuacuagagccug

SEQ ID NO: 446730 - RNA, 22 nt, Human
uuuccuuugcccaauacauguc

SEQ ID NO: 446731 - RNA, 21 nt, Human
ucaagacagcauauuuaagaa

SEQ ID NO: 446732 - RNA, 22 nt, Human
agccaggauggucucgaucggc

SEQ ID NO: 446733 - RNA, 22 nt, Human
cagcuggugagcuuaguagggu

SEQ ID NO: 446734 - RNA, 22 nt, Human
uucaaguagaaaguauugauga

SEQ ID NO: 446735 - RNA, 22 nt, Human
ucuuugcaugcauuuucccuua

SEQ ID NO: 446736 - RNA, 18 nt, Human
auauucaagaagacagag

SEQ ID NO: 446737 - RNA, 22 nt, Human
gccuggcuccuaagagcacaac

SEQ ID NO: 446738 - RNA, 22 nt, Human
guccugggccugcugaggcuga

SEQ ID NO: 446739 - RNA, 22 nt, Human
aaguguuucuuggaauguugcg

SEQ ID NO: 446740 - RNA, 22 nt, Human
ugucacauaauuuaucuguagg

SEQ ID NO: 446741 - RNA, 22 nt, Human
ucauucaauguaagcauauaua

SEQ ID NO: 446742 - RNA, 22 nt, Human
ugccuucucccuuggacccuga

SEQ ID NO: 446743 - RNA, 22 nt, Human
acagaguuuauguguguacaaa

SEQ ID NO: 446744 - RNA, 22 nt, Human
uuucagaguuauguaagaaaau

SEQ ID NO: 446745 - RNA, 22 nt, Human
gcuggccaggugcuuugguucu

SEQ ID NO: 446746 - RNA, 21 nt, Human
ggcagcugugguuaauugaac

SEQ ID NO: 446747 - RNA, 22 nt, Human
uggagcagggcaucacugugcg

SEQ ID NO: 446748 - RNA, 22 nt, Human
uuuuccucugcagagcaguuag

SEQ ID NO: 446749 - RNA, 22 nt, Human
agcauuauguccaugcuaaauu

SEQ ID NO: 446750 - RNA, 20 nt, Human
caaguucaccuucuccucuc

SEQ ID NO: 446751 - RNA, 22 nt, Human
ugcacacacggagauaggcuuu

SEQ ID NO: 446752 - RNA, 22 nt, Human
aguuaaguaaacauuucccaga

SEQ ID NO: 446753 - RNA, 22 nt, Human
auuuugaaaccaaguuauuucc

SEQ ID NO: 446754 - RNA, 22 nt, Human
ucucugcugagaagggcuggca

SEQ ID NO: 446755 - RNA, 22 nt, Human
ucuuugcauuuuaugccguuau

SEQ ID NO: 446756 - RNA, 22 nt, Human
ugccugggccuucccaccucug

SEQ ID NO: 446757 - RNA, 22 nt, Human
gcuguucugcgucccaggcugg

SEQ ID NO: 446758 - RNA, 22 nt, Human
uuuugcaaaguacauuaucagg

SEQ ID NO: 446759 - RNA, 22 nt, Human
gcagcuggagcaucuucucauc

SEQ ID NO: 446760 - RNA, 22 nt, Human
uuucuuaugugcagagugagua

SEQ ID NO: 446761 - RNA, 22 nt, Human
augauggaggccgugauggacg

SEQ ID NO: 446762 - RNA, 23 nt, Human
agaauuucaaaguccagcacauu

SEQ ID NO: 446763 - RNA, 22 nt, Human
ggagguagucugagucauaggc

SEQ ID NO: 446764 - RNA, 22 nt, Human
cucagaauaauguuucuaaagg

SEQ ID NO: 446765 - RNA, 22 nt, Human
cugcccuggguuuuaugggagu

SEQ ID NO: 446766 - RNA, 22 nt, Human
gcagauggugccaugucuugug

SEQ ID NO: 446767 - RNA, 22 nt, Human
aaggaagcagcaaugcaugauu

SEQ ID NO: 446768 - RNA, 23 nt, Human
aaucuggcugauguuuuuucucu

SEQ ID NO: 446769 - RNA, 22 nt, Human
uuuaacaugugaauuuuggaag

SEQ ID NO: 446770 - RNA, 22 nt, Human
aaggcaaugcuaagagguuugg

SEQ ID NO: 446771 - RNA, 22 nt, Human
ucuuuauuuuaugcuugugcaa

SEQ ID NO: 446772 - RNA, 22 nt, Human
agccucugacugucagcaaggu

SEQ ID NO: 446773 - RNA, 22 nt, Human
uacagcaaugguucuaagaguc

SEQ ID NO: 446774 - RNA, 22 nt, Human
cagcccugcugccuuagugccu

SEQ ID NO: 446775 - RNA, 22 nt, Human
ucagccugcgucauggugacac

SEQ ID NO: 446776 - RNA, 22 nt, Human
acagccugcugccugcuucuug

SEQ ID NO: 446777 - RNA, 22 nt, Human
cagaggaagggugcugcgaaag

SEQ ID NO: 446778 - RNA, 22 nt, Human
cccuggaggaccccaauguggc

SEQ ID NO: 446779 - RNA, 22 nt, Human
uuccagaggagugauucagagg

SEQ ID NO: 446780 - RNA, 22 nt, Human
auugcaaaggucccauucaaga

SEQ ID NO: 446781 - RNA, 22 nt, Human
uggccagccagaaagaagccuu

SEQ ID NO: 446782 - RNA, 22 nt, Human
acauaguucagagcagcagacc

SEQ ID NO: 446783 - RNA, 22 nt, Human
uccagccaacugccuagggagc

SEQ ID NO: 446784 - RNA, 22 nt, Human
ucccagagccaagcuauggaug

SEQ ID NO: 446785 - RNA, 22 nt, Human
gaggcugggaaguccaagauca

SEQ ID NO: 446786 - RNA, 22 nt, Human
ccagagcuucggggcggcugua

SEQ ID NO: 446787 - RNA, 22 nt, Human
uuugggcagaagcugaaugucu

SEQ ID NO: 446788 - RNA, 22 nt, Human
gcucugucuucagcacacagua

SEQ ID NO: 446789 - RNA, 22 nt, Human
caguccugggcacagcccuggg

SEQ ID NO: 446790 - RNA, 22 nt, Human
ugggcagggaucucuuuugcaa

SEQ ID NO: 446791 - RNA, 22 nt, Human
ugcagacagagaaaugaggccc

SEQ ID NO: 446792 - RNA, 22 nt, Human
agccuggcccugcugaacucug

SEQ ID NO: 446793 - RNA, 22 nt, Human
aggacuuagaacauuauguacu

SEQ ID NO: 446794 - RNA, 22 nt, Human
gugcacagaaacauacaaugug

SEQ ID NO: 446795 - RNA, 22 nt, Human
ugggcagacauugaguuuguuc

SEQ ID NO: 446796 - RNA, 22 nt, Human
acucagagcagagcagccugag

SEQ ID NO: 446797 - RNA, 22 nt, Human
aagcauuugguucugaagacuc

SEQ ID NO: 446798 - RNA, 22 nt, Human
auaugccagcuccaaguaagag

SEQ ID NO: 446799 - RNA, 22 nt, Human
ggccccagguagaagauauaga

SEQ ID NO: 446800 - RNA, 22 nt, Human
gcaggaacuugggugaagucag

SEQ ID NO: 446801 - RNA, 22 nt, Human
gggcucugggucgugucuccau

SEQ ID NO: 446802 - RNA, 22 nt, Human
uuaguugauagccaaaauuuau

SEQ ID NO: 446803 - RNA, 17 nt, Human
aggcaggcagagcggga

SEQ ID NO: 446804 - RNA, 22 nt, Human
uggcagcaccagcaguguccuu

SEQ ID NO: 446805 - RNA, 22 nt, Human
aaauggaucuuuuuauaaugca

SEQ ID NO: 446806 - RNA, 22 nt, Human
agccaagcaccacuggcacucg

SEQ ID NO: 446807 - RNA, 22 nt, Human
uuugggcagaaacaugcgcccc

SEQ ID NO: 446808 - RNA, 22 nt, Human
ugacagaaugugacucucagau

SEQ ID NO: 446809 - RNA, 22 nt, Human
uauauuaaaugaccaguuuuaa

SEQ ID NO: 446810 - RNA, 22 nt, Human
caggaguccugaaaucugauga

SEQ ID NO: 446811 - RNA, 22 nt, Human
aggcccuguuaugagccacugu

SEQ ID NO: 446812 - RNA, 22 nt, Human
uuauguguguacaugcauaugu

SEQ ID NO: 446813 - RNA, 20 nt, Human
ucugaggcugagcucuacuu

SEQ ID NO: 446814 - RNA, 22 nt, Human
uccugucagugaggcagaugaa

SEQ ID NO: 446815 - RNA, 22 nt, Human
gaaggcaguaaauggcuguuuu

SEQ ID NO: 446816 - RNA, 21 nt, Human
agcugggccucagccugcagu

SEQ ID NO: 446817 - RNA, 22 nt, Human
ucagggcaagucucagaagguu

SEQ ID NO: 446818 - RNA, 22 nt, Human
ugcauauucuccuuuauuuugu

SEQ ID NO: 446819 - RNA, 22 nt, Human
uacugcaugguggaguggagcu

SEQ ID NO: 446820 - RNA, 22 nt, Human
aagcagcugauuucacagcuca

SEQ ID NO: 446821 - RNA, 22 nt, Human
agccaagcugaucuccugcuga

SEQ ID NO: 446822 - RNA, 22 nt, Human
aaagugcagaacuguucucacu

SEQ ID NO: 446823 - RNA, 22 nt, Human
ggggcagauggaacagagcaca

SEQ ID NO: 446824 - RNA, 22 nt, Human
ccaggccucaccugcccaccua

SEQ ID NO: 446825 - RNA, 21 nt, Human
gucuuuuaagugaagagaggc

SEQ ID NO: 446826 - RNA, 22 nt, Human
uagugaauaguccaaucccgca

SEQ ID NO: 446827 - RNA, 22 nt, Human
ugucacagagcaacuauuucuu

SEQ ID NO: 446828 - RNA, 22 nt, Human
uuguuuugcuaaagggucauca

SEQ ID NO: 446829 - RNA, 18 nt, Human
aaagaaggauuggagagc

SEQ ID NO: 446830 - RNA, 22 nt, Human
uucuggcuccagaugcuucugu

SEQ ID NO: 446831 - RNA, 22 nt, Human
auucuuuacauuggcuucuucc

SEQ ID NO: 446832 - RNA, 22 nt, Human
guugcuuuuuugauagguggaa

SEQ ID NO: 446833 - RNA, 22 nt, Human
gccaggcuggggggagaugucu

SEQ ID NO: 446834 - RNA, 21 nt, Human
agcagcagaucuggugagggc

SEQ ID NO: 446835 - RNA, 22 nt, Human
agcagcuggggccugugacgau

SEQ ID NO: 446836 - RNA, 22 nt, Human
aacucacuuuguggcuucugaa

SEQ ID NO: 446837 - RNA, 22 nt, Human
gcuccaggguggaugacaauuc

SEQ ID NO: 446838 - RNA, 22 nt, Human
caggaggcaucauggagcggac

SEQ ID NO: 446839 - RNA, 22 nt, Human
ggcucugcugcaagucuuccuc

SEQ ID NO: 446840 - RNA, 22 nt, Human
agggcccaguggagagcugagc

SEQ ID NO: 446841 - RNA, 22 nt, Human
caguauguuuauuagaacugca

SEQ ID NO: 446842 - RNA, 22 nt, Human
caguacuugggggguucuaagu

SEQ ID NO: 446843 - RNA, 22 nt, Human
gccuggugaaaggcagagagcg

SEQ ID NO: 446844 - RNA, 22 nt, Human
ugcagcugugccugaaaaguac

SEQ ID NO: 446845 - RNA, 22 nt, Human
gcagacaggcccaguggaggga

SEQ ID NO: 446846 - RNA, 22 nt, Human
uccagcucuaacaugcugggcc

SEQ ID NO: 446847 - RNA, 22 nt, Human
gugcaauaaauaaauagauugu

SEQ ID NO: 446848 - RNA, 22 nt, Human
caggagcucuuaaggaugugau

SEQ ID NO: 446849 - RNA, 22 nt, Human
cugcccugcccaggccuugggc

SEQ ID NO: 446850 - RNA, 22 nt, Human
uucaguaaaacacugcaauguc

SEQ ID NO: 446851 - RNA, 22 nt, Human
ccaggcugcuguugguguccgc

SEQ ID NO: 446852 - RNA, 22 nt, Human
ucaggagggcuaagacuguagc

SEQ ID NO: 446853 - RNA, 22 nt, Human
gacagcaggugcuugggaaagg

SEQ ID NO: 446854 - RNA, 23 nt, Human
aaauucaguccuucaacucugag

SEQ ID NO: 446855 - RNA, 22 nt, Human
ccagcucuuuuggcugagugag

SEQ ID NO: 446856 - RNA, 22 nt, Human
aggaaaggccucagcagaaacc

SEQ ID NO: 446857 - RNA, 22 nt, Human
uccucagacuucccuuugugua

SEQ ID NO: 446858 - RNA, 22 nt, Human
agaggcugagaaacccucuucu

SEQ ID NO: 446859 - RNA, 22 nt, Human
ggggcagagaauaaaaaccuaa

SEQ ID NO: 446860 - RNA, 22 nt, Human
aaggcagccgugugacugcaug

SEQ ID NO: 446861 - RNA, 22 nt, Human
uagcaggcaucucagagauaau

SEQ ID NO: 446862 - RNA, 22 nt, Human
gcccagccuccaagcuccaagg

SEQ ID NO: 446863 - RNA, 22 nt, Human
augugcauuaaaugucaauguu

SEQ ID NO: 446864 - RNA, 22 nt, Human
ucaggccuagggagccacacca

SEQ ID NO: 446865 - RNA, 21 nt, Human
cuccugggcuaagauauagug

SEQ ID NO: 446866 - RNA, 22 nt, Human
ccagcagcaggccaggcccucc

SEQ ID NO: 446867 - RNA, 22 nt, Human
aaucacuuugcacucuuauuug

SEQ ID NO: 446868 - RNA, 20 nt, Human
uauuggaucuaagaaauggg

SEQ ID NO: 446869 - RNA, 22 nt, Human
ggacugaaugccagucuaugga

SEQ ID NO: 446870 - RNA, 22 nt, Human
acagaugauuuuuaugaaaaca

SEQ ID NO: 446871 - RNA, 22 nt, Human
gagcccgagcgcguacccggcg

SEQ ID NO: 446872 - RNA, 22 nt, Human
uccacaguuuugccacuagcug

SEQ ID NO: 446873 - RNA, 22 nt, Human
aaggcagaggaaggucuaguuu

SEQ ID NO: 446874 - RNA, 22 nt, Human
agagcugggacuuggacucaau

SEQ ID NO: 446875 - RNA, 22 nt, Human
caauaguucgguccugaaggcc

SEQ ID NO: 446876 - RNA, 22 nt, Human
gcacccagaggucagcagugcu

SEQ ID NO: 446877 - RNA, 22 nt, Human
ucuucaaaaauacagguuuuca

SEQ ID NO: 446878 - RNA, 22 nt, Human
ggaggcagaacuucccgucagu

SEQ ID NO: 446879 - RNA, 22 nt, Human
ggagcaagucccaggcacuagu

SEQ ID NO: 446880 - RNA, 22 nt, Human
cugccacuuacuaggcauggug

SEQ ID NO: 446881 - RNA, 22 nt, Human
ccccagcucagugcagggacau

SEQ ID NO: 446882 - RNA, 22 nt, Human
aucuuauugcuguugccagaua

SEQ ID NO: 446883 - RNA, 22 nt, Human
cugccuggcauggagaagagaa

SEQ ID NO: 446884 - RNA, 22 nt, Human
auggaugaaggcgaggaugagg

SEQ ID NO: 446885 - RNA, 22 nt, Human
cagacaggcaggugcugcuuug

SEQ ID NO: 446886 - RNA, 22 nt, Human
uugugaauggugccgcaauaaa

SEQ ID NO: 446887 - RNA, 19 nt, Human
uggaccugugcccauggcu

SEQ ID NO: 446888 - RNA, 22 nt, Human
ccagccagccuugaucugagua

SEQ ID NO: 446889 - RNA, 18 nt, Human
uuauucagacgcauauga

SEQ ID NO: 446890 - RNA, 22 nt, Human
agccccacacucucucugagaa

SEQ ID NO: 446891 - RNA, 22 nt, Human
gagacacagcagauauucaauc

SEQ ID NO: 446892 - RNA, 22 nt, Human
gcuugacuaggcucuggcgaca

SEQ ID NO: 446893 - RNA, 22 nt, Human
gcagcaccaaccagggccuguu

SEQ ID NO: 446894 - RNA, 22 nt, Human
gcucccagaaccaaggcugggg

SEQ ID NO: 446895 - RNA, 22 nt, Human
aacauucuacuguacugcauug

SEQ ID NO: 446896 - RNA, 22 nt, Human
caggcagcauuuacucugauga

SEQ ID NO: 446897 - RNA, 22 nt, Human
gcuccacuugcagcuaggcuug

SEQ ID NO: 446898 - RNA, 22 nt, Human
guccuggggauacagaagugaa

SEQ ID NO: 446899 - RNA, 22 nt, Human
uccaccccugggaaugucaaua

SEQ ID NO: 446900 - RNA, 22 nt, Human
aaucacaaaugcaaguugucac

SEQ ID NO: 446901 - RNA, 17 nt, Human
ugcauuguuggaaauuu

SEQ ID NO: 446902 - RNA, 22 nt, Human
agagaucuguggauucauuguc

SEQ ID NO: 446903 - RNA, 22 nt, Human
ugggccugccccaggcuucagc

SEQ ID NO: 446904 - RNA, 22 nt, Human
cuucugcaggcccugucugacc

SEQ ID NO: 446905 - RNA, 22 nt, Human
uuuauucacuucagugccaaag

SEQ ID NO: 446906 - RNA, 22 nt, Human
uaugcaaaucauuagauuuccu

SEQ ID NO: 446907 - RNA, 22 nt, Human
gacagcaagagacagagcaucc

SEQ ID NO: 446908 - RNA, 22 nt, Human
gaagccacguuaaauuggcugu

SEQ ID NO: 446909 - RNA, 19 nt, Human
ccucucccaugcuuaccuc

SEQ ID NO: 446910 - RNA, 22 nt, Human
uuacaguagauacaaugaguaa

SEQ ID NO: 446911 - RNA, 22 nt, Human
gccacaggcuuaggagggaggu

SEQ ID NO: 446912 - RNA, 22 nt, Human
aagcacagacacaaaaggcuuu

SEQ ID NO: 446913 - RNA, 22 nt, Human
ugaggcacauccaggccagcuc

SEQ ID NO: 446914 - RNA, 22 nt, Human
ugugccagaaaauaugcugagg

SEQ ID NO: 446915 - RNA, 23 nt, Human
gccuggagaaaagcugcaguuca

SEQ ID NO: 446916 - RNA, 22 nt, Human
cuccuuccccuacucagcaucc

SEQ ID NO: 446917 - RNA, 22 nt, Human
cuacccaggcuggagugcagua

SEQ ID NO: 446918 - RNA, 22 nt, Human
ucccccaaaugaaugaggaaua

SEQ ID NO: 446919 - RNA, 22 nt, Human
uauguacaguccuuaacuuaaa

SEQ ID NO: 446920 - RNA, 22 nt, Human
auaaauggcuuucauuccuagg

SEQ ID NO: 446921 - RNA, 22 nt, Human
uguaugugcuugagaagguggg

SEQ ID NO: 446922 - RNA, 22 nt, Human
gcagcccuagcgacaaauugau

SEQ ID NO: 446923 - RNA, 22 nt, Human
uuuauuuggcauccagggagaa

SEQ ID NO: 446924 - RNA, 22 nt, Human
ugagagcacacagaaauauuuu

SEQ ID NO: 446925 - RNA, 22 nt, Human
aaaauugaggcucauguuaaau

SEQ ID NO: 446926 - RNA, 22 nt, Human
acugaguguaggacuuugaguu

SEQ ID NO: 446927 - RNA, 22 nt, Human
accagggcggcuugaggaggca

SEQ ID NO: 446928 - RNA, 19 nt, Human
gacuccaacuuuaagcaug

SEQ ID NO: 446929 - RNA, 22 nt, Human
caggaaugacugcagauggggc

SEQ ID NO: 446930 - RNA, 22 nt, Human
acaugcaugaaauccauaaaca

SEQ ID NO: 446931 - RNA, 22 nt, Human
uauuacaaauuauaaugggaga

SEQ ID NO: 446932 - RNA, 22 nt, Human
cagagcugcagauugaaggcau

SEQ ID NO: 446933 - RNA, 19 nt, Human
gcuuccagcacugcaggag

SEQ ID NO: 446934 - RNA, 21 nt, Human
ggccccagcccauggguucuc

SEQ ID NO: 446935 - RNA, 22 nt, Human
uauugugaguauaacugcauuu

SEQ ID NO: 446936 - RNA, 22 nt, Human
aaguauuucuggccugugaaag

SEQ ID NO: 446937 - RNA, 22 nt, Human
ccaggaaguaugacccaacaga

SEQ ID NO: 446938 - RNA, 22 nt, Human
ugauacagaauugauaucugag

SEQ ID NO: 446939 - RNA, 22 nt, Human
gcccagaguggccacuuggcuc

SEQ ID NO: 446940 - RNA, 22 nt, Human
agcuggcuauacuugaaaaguc

SEQ ID NO: 446941 - RNA, 22 nt, Human
ccucugggcagguagcagcagc

SEQ ID NO: 446942 - RNA, 19 nt, Human
caguggccuggaggucucu

SEQ ID NO: 446943 - RNA, 22 nt, Human
ucaggccugcaggcuuccugga

SEQ ID NO: 446944 - RNA, 22 nt, Human
guucugcugugucucagcaggu

SEQ ID NO: 446945 - RNA, 22 nt, Human
guucaaguucauaucucuuaac

SEQ ID NO: 446946 - RNA, 21 nt, Human
agcugagguaaggcaagagag

SEQ ID NO: 446947 - RNA, 22 nt, Human
acagagcaugcucaguguguga

SEQ ID NO: 446948 - RNA, 22 nt, Human
ccuuugcaacagaaagaccuga

SEQ ID NO: 446949 - RNA, 22 nt, Human
augcauauauacauacacaguc

SEQ ID NO: 446950 - RNA, 22 nt, Human
cagcugaggaauacuagaugua

SEQ ID NO: 446951 - RNA, 22 nt, Human
ggcagcuggggcagugcccugu

SEQ ID NO: 446952 - RNA, 22 nt, Human
uuucucaaaagacagaagugaa

SEQ ID NO: 446953 - RNA, 22 nt, Human
gacagcugugcaggagaagggg

SEQ ID NO: 446954 - RNA, 22 nt, Human
cagcuccaaagccccacugucc

SEQ ID NO: 446955 - RNA, 22 nt, Human
gugcacagauucagagguuuug

SEQ ID NO: 446956 - RNA, 22 nt, Human
agcugaagcucagcccaguagu

SEQ ID NO: 446957 - RNA, 22 nt, Human
guuccucacguggacagaugau

SEQ ID NO: 446958 - RNA, 22 nt, Human
accagagaaaacacagcaggcu

SEQ ID NO: 446959 - RNA, 22 nt, Human
aagggcaggagaagacggauau

SEQ ID NO: 446960 - RNA, 22 nt, Human
agccacagcaacaagugcaauu

SEQ ID NO: 446961 - RNA, 22 nt, Human
uuggccagugaaccaggccugg

SEQ ID NO: 446962 - RNA, 20 nt, Human
ucuccagaugcagaugacau

SEQ ID NO: 446963 - RNA, 20 nt, Human
aagauucauuguaauuaggg

SEQ ID NO: 446964 - RNA, 22 nt, Human
aagcacugagcacaguggcuga

SEQ ID NO: 446965 - RNA, 22 nt, Human
auguuauuuuggaaaauacaaa

SEQ ID NO: 446966 - RNA, 18 nt, Human
uuuguuggguugccuuua

SEQ ID NO: 446967 - RNA, 22 nt, Human
acaggggcuccgaaggugaggg

SEQ ID NO: 446968 - RNA, 22 nt, Human
ucugccuggaugauggcagggc

SEQ ID NO: 446969 - RNA, 22 nt, Human
uaugugcaugcugacuugagga

SEQ ID NO: 446970 - RNA, 22 nt, Human
gcuuccagggcucagucacugc

SEQ ID NO: 446971 - RNA, 22 nt, Human
ugcacacacaugaaguagcaug

SEQ ID NO: 446972 - RNA, 22 nt, Human
ucaggccugcaaaugaauggua

SEQ ID NO: 446973 - RNA, 22 nt, Human
accacaggacccaugagucagu

SEQ ID NO: 446974 - RNA, 20 nt, Human
cagcaguggaugagaguuuu

SEQ ID NO: 446975 - RNA, 22 nt, Human
uacauugcuagaaauguauuuu

SEQ ID NO: 446976 - RNA, 23 nt, Human
gccuggccaccccagggcugcuu

SEQ ID NO: 446977 - RNA, 22 nt, Human
uccagaggugaacacccaggca

SEQ ID NO: 446978 - RNA, 22 nt, Human
cagcccugcuuccccgcuaguu

SEQ ID NO: 446979 - RNA, 20 nt, Human
ccugccuguguuugugauga

SEQ ID NO: 446980 - RNA, 22 nt, Human
aauccuggaauacaagagugaa

SEQ ID NO: 446981 - RNA, 22 nt, Human
auaaaaaggacagauguggucu

SEQ ID NO: 446982 - RNA, 22 nt, Human
uugcccugaagaacgucccaga

SEQ ID NO: 446983 - RNA, 22 nt, Human
aaaugcauuucacuaauguuuc

SEQ ID NO: 446984 - RNA, 22 nt, Human
gaguccaguuagugaggcuggg

SEQ ID NO: 446985 - RNA, 18 nt, Human
ugccauccccagucaagu

SEQ ID NO: 446986 - RNA, 22 nt, Human
aaguguauuuuuguacuaacau

SEQ ID NO: 446987 - RNA, 22 nt, Human
cugugggcugaaagugcucccg

SEQ ID NO: 446988 - RNA, 22 nt, Human
augaagcugaccuugucuugcu

SEQ ID NO: 446989 - RNA, 22 nt, Human
augcacaauuaggauauagcuu

SEQ ID NO: 446990 - RNA, 22 nt, Human
caggacagcugggccaccacca

SEQ ID NO: 446991 - RNA, 22 nt, Human
uuacaguaacauuuucagucug

SEQ ID NO: 446992 - RNA, 22 nt, Human
auuacagaagauaugcucaaca

SEQ ID NO: 446993 - RNA, 19 nt, Human
ugaggcacaugauaagaac

SEQ ID NO: 446994 - RNA, 22 nt, Human
uguguguguuuauaaaucuaaa

SEQ ID NO: 446995 - RNA, 22 nt, Human
ugcagcugacccacuccagucc

SEQ ID NO: 446996 - RNA, 22 nt, Human
ucaggaggccugaguagcucua

SEQ ID NO: 446997 - RNA, 22 nt, Human
ccugucagaugaaguaauugug

SEQ ID NO: 446998 - RNA, 22 nt, Human
auagaaauguauuuuggacuag

SEQ ID NO: 446999 - RNA, 22 nt, Human
cagaucuguaguaaaagaucuc

SEQ ID NO: 447000 - RNA, 22 nt, Human
ccugggcucaagugaugguccc

SEQ ID NO: 447001 - RNA, 22 nt, Human
gaggcagcaugguaccuuggag

SEQ ID NO: 447002 - RNA, 18 nt, Human
ccuuugcaaaggggguua

SEQ ID NO: 447003 - RNA, 22 nt, Human
uggagaugaacauggugauguu

SEQ ID NO: 447004 - RNA, 22 nt, Human
gaaaaugugucaucccuacugu

SEQ ID NO: 447005 - RNA, 22 nt, Human
ugguggcaacauugcuggagug

SEQ ID NO: 447006 - RNA, 20 nt, Human
uaacaguuguagaggguuuu

SEQ ID NO: 447007 - RNA, 22 nt, Human
cucuggcuuguuaaugcauauu

SEQ ID NO: 447008 - RNA, 22 nt, Human
aagccaaugauacgggugaucu

SEQ ID NO: 447009 - RNA, 22 nt, Human
ucuuugcaguggugaauaaaga

SEQ ID NO: 447010 - RNA, 22 nt, Human
ucaggaaauggacaucuuugcu

SEQ ID NO: 447011 - RNA, 22 nt, Human
ugacauaauaauccaaacauac

SEQ ID NO: 447012 - RNA, 22 nt, Human
gccugucugcgucacgcuuauu

SEQ ID NO: 447013 - RNA, 22 nt, Human
agaaaaggauugauggaucaga

SEQ ID NO: 447014 - RNA, 22 nt, Human
acugguacuguucugcggauca

SEQ ID NO: 447015 - RNA, 19 nt, Human
acagagcucucugcuucug

SEQ ID NO: 447016 - RNA, 22 nt, Human
augcuuuacgacaaaaaacuca

SEQ ID NO: 447017 - RNA, 22 nt, Human
cuacacaguucugccuaauggc

SEQ ID NO: 447018 - RNA, 21 nt, Human
ugcugccaucaugcagagaug

SEQ ID NO: 447019 - RNA, 22 nt, Human
uugcaaaugugaguuuagacug

SEQ ID NO: 447020 - RNA, 22 nt, Human
gcagcagcucagccgggcacug

SEQ ID NO: 447021 - RNA, 22 nt, Human
gcugccucaggcaccuccuggc

SEQ ID NO: 447022 - RNA, 22 nt, Human
uuuacagacaacuuaauagggg

SEQ ID NO: 447023 - RNA, 19 nt, Human
caagugaagccugggaugg

SEQ ID NO: 447024 - RNA, 22 nt, Human
augacccaagcucauggcuccc

SEQ ID NO: 447025 - RNA, 22 nt, Human
cagaacagucgccugcauggau

SEQ ID NO: 447026 - RNA, 22 nt, Human
gcaggacacagaugcaaggcca

SEQ ID NO: 447027 - RNA, 22 nt, Human
ucaggcuggggugcuaaggugu

SEQ ID NO: 447028 - RNA, 22 nt, Human
cccagccugugacagccguccu

SEQ ID NO: 447029 - RNA, 22 nt, Human
auuugaagaaaguuuucuagau

SEQ ID NO: 447030 - RNA, 23 nt, Human
acuuugcagagccccuugaaaca

SEQ ID NO: 447031 - RNA, 22 nt, Human
acacaggaacucugagaggugg

SEQ ID NO: 447032 - RNA, 22 nt, Human
aaggcagagauauucuugaucu

SEQ ID NO: 447033 - RNA, 22 nt, Human
caggaugagguagaggcagaua

SEQ ID NO: 447034 - RNA, 22 nt, Human
cagagcagggugcaccuugggc

SEQ ID NO: 447035 - RNA, 22 nt, Human
ugggcuggcccaccacaccucg

SEQ ID NO: 447036 - RNA, 22 nt, Human
ugucagugguagacccagaggu

SEQ ID NO: 447037 - RNA, 22 nt, Human
acaggggugcauggugcauggu

SEQ ID NO: 447038 - RNA, 22 nt, Human
cccauggcuuaggagggagugu

SEQ ID NO: 447039 - RNA, 22 nt, Human
ccuggccacucagguguggggc

SEQ ID NO: 447040 - RNA, 22 nt, Human
aagcuuuugacuugguagggaa

SEQ ID NO: 447041 - RNA, 22 nt, Human
aacaccuaaaaaucauuguuga

SEQ ID NO: 447042 - RNA, 22 nt, Human
aaaucacuuaaauggcuuauuu

SEQ ID NO: 447043 - RNA, 19 nt, Human
cagaggcaccagguauaga

SEQ ID NO: 447044 - RNA, 22 nt, Human
aaggcaggaugcggacccaucu

SEQ ID NO: 447045 - RNA, 22 nt, Human
ggcugccagugagugcagaccg

SEQ ID NO: 447046 - RNA, 22 nt, Human
aaggaagauauaucaagcuuaa

SEQ ID NO: 447047 - RNA, 22 nt, Human
gcauuauuaauagcugcaugag

SEQ ID NO: 447048 - RNA, 22 nt, Human
gucaauaucuugguuguacuau

SEQ ID NO: 447049 - RNA, 22 nt, Human
caugagauuugggaggggccag

SEQ ID NO: 447050 - RNA, 22 nt, Human
ucuaaauuacuuugggcaguau

SEQ ID NO: 447051 - RNA, 22 nt, Human
agggagccaggggccagcuauu

SEQ ID NO: 447052 - RNA, 22 nt, Human
ugcagccaucuuucuuggagga

SEQ ID NO: 447053 - RNA, 22 nt, Human
cacuuaagcaguuaauuuaucu

SEQ ID NO: 447054 - RNA, 19 nt, Human
auaaggcagugacuuuuuu

SEQ ID NO: 447055 - RNA, 22 nt, Human
ccccagcacuaccagaagccag

SEQ ID NO: 447056 - RNA, 22 nt, Human
aggacagcccuugagagcacau

SEQ ID NO: 447057 - RNA, 22 nt, Human
uacuauaaagucuuaaugaguc

SEQ ID NO: 447058 - RNA, 22 nt, Human
cccaggagguggagcuugcagu

SEQ ID NO: 447059 - RNA, 22 nt, Human
caguaugucuacuggacaaagu

SEQ ID NO: 447060 - RNA, 22 nt, Human
gccuuggcugaugugcgaauga

SEQ ID NO: 447061 - RNA, 21 nt, Human
cccuguguuccacagcagaca

SEQ ID NO: 447062 - RNA, 19 nt, Human
auuucaagagguuuauugg

SEQ ID NO: 447063 - RNA, 22 nt, Human
ggagaagaggagcuggaagccu

SEQ ID NO: 447064 - RNA, 22 nt, Human
ucauuuguugaacuuuagugcg

SEQ ID NO: 447065 - RNA, 22 nt, Human
ucaggaagggcucagucugugc

SEQ ID NO: 447066 - RNA, 19 nt, Human
cugugagucuuguggccuc

SEQ ID NO: 447067 - RNA, 22 nt, Human
auuuugaaaagcauuugaguaa

SEQ ID NO: 447068 - RNA, 21 nt, Human
agcaggaggcagucacagcuc

SEQ ID NO: 447069 - RNA, 19 nt, Human
agcagcuggagguggagug

SEQ ID NO: 447070 - RNA, 22 nt, Human
acaguuuuuucaacauuggaau

SEQ ID NO: 447071 - RNA, 22 nt, Human
ugugcacauucuaggacuagua

SEQ ID NO: 447072 - RNA, 22 nt, Human
agcugcucaggagagccagguc

SEQ ID NO: 447073 - RNA, 22 nt, Human
gcccucagaggacagcugacuu

SEQ ID NO: 447074 - RNA, 22 nt, Human
cagguccuggcaucaggcaggu

SEQ ID NO: 447075 - RNA, 22 nt, Human
ucccuggcugggggcugccuug

SEQ ID NO: 447076 - RNA, 22 nt, Human
uaaggcagcauaauuaggccac

SEQ ID NO: 447077 - RNA, 22 nt, Human
uuuaacauguaauugcugcuuu

SEQ ID NO: 447078 - RNA, 22 nt, Human
uggccagguugggcuuugcagc

SEQ ID NO: 447079 - RNA, 22 nt, Human
gccuggcuaguuagugucaggu

SEQ ID NO: 447080 - RNA, 22 nt, Human
aggguggagggagucccugagc

SEQ ID NO: 447081 - RNA, 22 nt, Human
caagggaagaggacagggaccu

SEQ ID NO: 447082 - RNA, 22 nt, Human
cacuucaaggaauaucuagaaa

SEQ ID NO: 447083 - RNA, 18 nt, Human
uaaaggaagugggagagg

SEQ ID NO: 447084 - RNA, 22 nt, Human
aggaaaaagaguugcugccuuc

SEQ ID NO: 447085 - RNA, 22 nt, Human
caucagugagccccuugaugag

SEQ ID NO: 447086 - RNA, 22 nt, Human
gacuguguccaugugcuggauu

SEQ ID NO: 447087 - RNA, 22 nt, Human
ggguccagcuacaucagggugg

SEQ ID NO: 447088 - RNA, 22 nt, Human
acucaacagggaacaagaucag

SEQ ID NO: 447089 - RNA, 22 nt, Human
cuggcuggucaucagcaguacg

SEQ ID NO: 447090 - RNA, 22 nt, Human
gaauuuuaucuuauuacuugca

SEQ ID NO: 447091 - RNA, 22 nt, Human
aaauaacuuaugaucgucuggc

SEQ ID NO: 447092 - RNA, 20 nt, Human
ugccuuggagcagccaaggu

SEQ ID NO: 447093 - RNA, 22 nt, Human
uuuucuccuuucuaggucacau

SEQ ID NO: 447094 - RNA, 19 nt, Human
ugcagccccuaccacauuc

SEQ ID NO: 447095 - RNA, 22 nt, Human
aacaugcaaagcuaugauguau

SEQ ID NO: 447096 - RNA, 22 nt, Human
aggacacagacugauugcagca

SEQ ID NO: 447097 - RNA, 22 nt, Human
gugggcuggacccuccugcucc

SEQ ID NO: 447098 - RNA, 22 nt, Human
ccaggaaagaggaagaacgcau

SEQ ID NO: 447099 - RNA, 22 nt, Human
uggaaaaacugagacuuagaca

SEQ ID NO: 447100 - RNA, 22 nt, Human
auaaaggcagaguagggaggaa

SEQ ID NO: 447101 - RNA, 22 nt, Human
cuggccuggucuggccucucca

SEQ ID NO: 447102 - RNA, 22 nt, Human
ucacuggucuuuggcuucucag

SEQ ID NO: 447103 - RNA, 22 nt, Human
cuccugagcucugaggaagcuu

SEQ ID NO: 447104 - RNA, 22 nt, Human
aggacugacuuuugccaugaaa

SEQ ID NO: 447105 - RNA, 22 nt, Human
uauguacaccggggaagguggg

SEQ ID NO: 447106 - RNA, 22 nt, Human
agcugccaucugaagaacugca

SEQ ID NO: 447107 - RNA, 22 nt, Human
ugcugucuguuuacuggcuaua

SEQ ID NO: 447108 - RNA, 22 nt, Human
cagggccacacggaagggaaca

SEQ ID NO: 447109 - RNA, 22 nt, Human
cagcugcccugccuugcccuua

SEQ ID NO: 447110 - RNA, 22 nt, Human
ugugugccagccuacgaggagc

SEQ ID NO: 447111 - RNA, 22 nt, Human
gggaccuggcaccuuugcucug

SEQ ID NO: 447112 - RNA, 22 nt, Human
ugcccacauggugccauggcca

SEQ ID NO: 447113 - RNA, 22 nt, Human
gcucccacgcaauucuuuucag

SEQ ID NO: 447114 - RNA, 22 nt, Human
cggcugagacggccauagacac

SEQ ID NO: 447115 - RNA, 21 nt, Human
uucuccccagcgaauccucgg

SEQ ID NO: 447116 - RNA, 22 nt, Human
ccugcagcuccggauuucuggg

SEQ ID NO: 447117 - RNA, 22 nt, Human
uuugaaagacagaauauuuuug

SEQ ID NO: 447118 - RNA, 22 nt, Human
cccugccuacaggguuuucuuu

SEQ ID NO: 447119 - RNA, 22 nt, Human
caugaagcacagcucucuuuuu

SEQ ID NO: 447120 - RNA, 22 nt, Human
cugcagcuauauuuucccacag

SEQ ID NO: 447121 - RNA, 22 nt, Human
ccugcaguuuguugugaccccg

SEQ ID NO: 447122 - RNA, 22 nt, Human
aagaagagaaaugugcugcugg

SEQ ID NO: 447123 - RNA, 22 nt, Human
cucugggcaccaaagagcagcu

SEQ ID NO: 447124 - RNA, 22 nt, Human
uauuuucuguggaggaccagau

SEQ ID NO: 447125 - RNA, 21 nt, Human
gcucagaguauugcacuguuu

SEQ ID NO: 447126 - RNA, 22 nt, Human
ggggugggguuacucauugugc

SEQ ID NO: 447127 - RNA, 22 nt, Human
uggcagagaaccugggcuuugu

SEQ ID NO: 447128 - RNA, 22 nt, Human
ggcagggagagcaugcugauaa

SEQ ID NO: 447129 - RNA, 22 nt, Human
aggcugagcuggcccuugaaau

SEQ ID NO: 447130 - RNA, 23 nt, Human
cugaggccugcugcguucagguu

SEQ ID NO: 447131 - RNA, 22 nt, Human
uggcacuggaaucguagccuug

SEQ ID NO: 447132 - RNA, 22 nt, Human
caguggagaggcaugcuuggca

SEQ ID NO: 447133 - RNA, 22 nt, Human
cagagcaugaauaaaaguuaca

SEQ ID NO: 447134 - RNA, 22 nt, Human
aggcagaggagaaugaucuucc

SEQ ID NO: 447135 - RNA, 22 nt, Human
guaguucugcagugucaccuga

SEQ ID NO: 447136 - RNA, 22 nt, Human
gguccuggaaauugacggaaag

SEQ ID NO: 447137 - RNA, 22 nt, Human
acaugauauuaaugucuuauuu

SEQ ID NO: 447138 - RNA, 17 nt, Human
aaaauucuguaaagagg

SEQ ID NO: 447139 - RNA, 18 nt, Human
aggcacuggaauuaaggg

SEQ ID NO: 447140 - RNA, 22 nt, Human
cugccuggccugaucuccacgc

SEQ ID NO: 447141 - RNA, 22 nt, Human
gggggcucugacucccucagcu

SEQ ID NO: 447142 - RNA, 20 nt, Human
auuccauaguuggcacuuuu

SEQ ID NO: 447143 - RNA, 22 nt, Human
ucauguaaguauagaaagcagu

SEQ ID NO: 447144 - RNA, 22 nt, Human
auggacaggcugagcuuccuca

SEQ ID NO: 447145 - RNA, 22 nt, Human
gcagauggacuguaugaccuga

SEQ ID NO: 447146 - RNA, 22 nt, Human
gcuuccucgcugggcagaggca

SEQ ID NO: 447147 - RNA, 22 nt, Human
uaaacaugugagugugcauaua

SEQ ID NO: 447148 - RNA, 22 nt, Human
ugggaccugcuccuggaaugag

SEQ ID NO: 447149 - RNA, 22 nt, Human
agcugaggcauggacaggcugc

SEQ ID NO: 447150 - RNA, 22 nt, Human
cagcccuguccagcagagggug

SEQ ID NO: 447151 - RNA, 22 nt, Human
gcagaagcuguucgaaggccgc

SEQ ID NO: 447152 - RNA, 22 nt, Human
gugcaggagguaacauagcaaa

SEQ ID NO: 447153 - RNA, 22 nt, Human
ggcugcuggcauugagguaggu

SEQ ID NO: 447154 - RNA, 22 nt, Human
agcugguggauuaugcuguaca

SEQ ID NO: 447155 - RNA, 17 nt, Human
cucugcagugcauggcu

SEQ ID NO: 447156 - RNA, 22 nt, Human
guauuuuaagugacuacuaggu

SEQ ID NO: 447157 - RNA, 23 nt, Human
aaagacugcugagaauuuuagga

SEQ ID NO: 447158 - RNA, 22 nt, Human
cuggcucagugccuucagaagu

SEQ ID NO: 447159 - RNA, 22 nt, Human
cccuggcaugcaugucccuggc

SEQ ID NO: 447160 - RNA, 22 nt, Human
gggcucucgauuagacccuggg

SEQ ID NO: 447161 - RNA, 22 nt, Human
agugaaauagcauuuaugaagc

SEQ ID NO: 447162 - RNA, 22 nt, Human
gggaggucagggugccugcugg

SEQ ID NO: 447163 - RNA, 22 nt, Human
acauuucugucuuagggacugu

SEQ ID NO: 447164 - RNA, 22 nt, Human
ugccaggggaccuagggauguc

SEQ ID NO: 447165 - RNA, 22 nt, Human
ucagccagguaauguggagaug

SEQ ID NO: 447166 - RNA, 22 nt, Human
cagagccugccaccuuucuccc

SEQ ID NO: 447167 - RNA, 22 nt, Human
uggcagcuguguccagguagaa

SEQ ID NO: 447168 - RNA, 22 nt, Human
ugggaggaaugucacugagcca

SEQ ID NO: 447169 - RNA, 22 nt, Human
aggcagcagccacaaggccuga

SEQ ID NO: 447170 - RNA, 21 nt, Human
uaaaacuguaacuuuguccug

SEQ ID NO: 447171 - RNA, 22 nt, Human
uccagccaugacucggacagug

SEQ ID NO: 447172 - RNA, 22 nt, Human
gcaugggcuuucucagaguucu

SEQ ID NO: 447173 - RNA, 17 nt, Human
ugcauuguaggcuagcc

SEQ ID NO: 447174 - RNA, 22 nt, Human
agccacagcccacaggacucuu

SEQ ID NO: 447175 - RNA, 22 nt, Human
gaacaguaaauuuaugcagcac

SEQ ID NO: 447176 - RNA, 22 nt, Human
agaggcaggaagagcugauuuu

SEQ ID NO: 447177 - RNA, 22 nt, Human
agggcagccugagugcuggccc

SEQ ID NO: 447178 - RNA, 22 nt, Human
cagagcggccacuagagggcgc

SEQ ID NO: 447179 - RNA, 22 nt, Human
cugaggcucugggugucacugu

SEQ ID NO: 447180 - RNA, 22 nt, Human
aggaaaaucgagucuggaggca

SEQ ID NO: 447181 - RNA, 22 nt, Human
uugaucagguugcuguggugua

SEQ ID NO: 447182 - RNA, 22 nt, Human
ggagaagcaggugcuuuggguc

SEQ ID NO: 447183 - RNA, 22 nt, Human
uauuuugacuauuaaaccaaca

SEQ ID NO: 447184 - RNA, 22 nt, Human
aagggagguaaagcuauuuaaa

SEQ ID NO: 447185 - RNA, 22 nt, Human
ucaucaguguccuuaucacuua

SEQ ID NO: 447186 - RNA, 22 nt, Human
uggccugguccuugucaaggca

SEQ ID NO: 447187 - RNA, 22 nt, Human
agcuuuguggcuuugcaagacu

SEQ ID NO: 447188 - RNA, 22 nt, Human
ucauuacagagauauaaucuac

SEQ ID NO: 447189 - RNA, 22 nt, Human
agccuggaauuaaggaaaugca

SEQ ID NO: 447190 - RNA, 22 nt, Human
aaggcauagucuuuaaguucug

SEQ ID NO: 447191 - RNA, 22 nt, Human
ugccaaggguaugggcaagaua

SEQ ID NO: 447192 - RNA, 22 nt, Human
uuucacauuuuauacuuaagcc

SEQ ID NO: 447193 - RNA, 22 nt, Human
uggugccuugggccuacagcgc

SEQ ID NO: 447194 - RNA, 22 nt, Human
uugcugaaguuaaugcuugcaa

SEQ ID NO: 447195 - RNA, 22 nt, Human
auguuacaauucaaaaugcugc

SEQ ID NO: 447196 - RNA, 22 nt, Human
aaaugugucaguuucauucucu

SEQ ID NO: 447197 - RNA, 22 nt, Human
aguguguguuugggcgguuuau

SEQ ID NO: 447198 - RNA, 22 nt, Human
uggcagcuccuggggccagcac

SEQ ID NO: 447199 - RNA, 22 nt, Human
cccugagagugagugccaccuu

SEQ ID NO: 447200 - RNA, 22 nt, Human
ucacagacacagggagaagcau

SEQ ID NO: 447201 - RNA, 22 nt, Human
gaaggcugucagagaggagggc

SEQ ID NO: 447202 - RNA, 22 nt, Human
ccagaagagaucacaguucuug

SEQ ID NO: 447203 - RNA, 22 nt, Human
cugggcagagcuaacaccugag

SEQ ID NO: 447204 - RNA, 22 nt, Human
gcugaagcugcagcaggaggaa

SEQ ID NO: 447205 - RNA, 22 nt, Human
agcucugacauugauucucagc

SEQ ID NO: 447206 - RNA, 22 nt, Human
ccagucuggcaggagggggaac

SEQ ID NO: 447207 - RNA, 22 nt, Human
accugagcaugccaggagagug

SEQ ID NO: 447208 - RNA, 22 nt, Human
ucugugaacaucacauugacag

SEQ ID NO: 447209 - RNA, 22 nt, Human
gaggcugguucugaaguacugu

SEQ ID NO: 447210 - RNA, 22 nt, Human
uacaagaaauuucugcauauau

SEQ ID NO: 447211 - RNA, 22 nt, Human
cuggagcuaauaauccaucuga

SEQ ID NO: 447212 - RNA, 22 nt, Human
gcugagcucccagcaguaucug

SEQ ID NO: 447213 - RNA, 22 nt, Human
cugcugugaguuuggaggucua

SEQ ID NO: 447214 - RNA, 22 nt, Human
ucucaggagccacagcgggagu

SEQ ID NO: 447215 - RNA, 22 nt, Human
ggcugccugaggcagugagaga

SEQ ID NO: 447216 - RNA, 21 nt, Human
gcagccacugccuucaacaau

SEQ ID NO: 447217 - RNA, 22 nt, Human
ucugggcucugucagcaccucu

SEQ ID NO: 447218 - RNA, 22 nt, Human
ugugugacccccagugaagccu

SEQ ID NO: 447219 - RNA, 22 nt, Human
caggcugccgugaagcaggccu

SEQ ID NO: 447220 - RNA, 22 nt, Human
augcaacaaaugcuacgaaucg

SEQ ID NO: 447221 - RNA, 22 nt, Human
auguccuuccauuuugaucugu

SEQ ID NO: 447222 - RNA, 22 nt, Human
uaaguucaaugaacucaguucu

SEQ ID NO: 447223 - RNA, 22 nt, Human
aucaaguuuucuuaguugacug

SEQ ID NO: 447224 - RNA, 22 nt, Human
uuagaaaauuugcuucuuugga

SEQ ID NO: 447225 - RNA, 22 nt, Human
cucacugucuguacuagcugau

SEQ ID NO: 447226 - RNA, 22 nt, Human
ugugaaagcaagucuaguucuc

SEQ ID NO: 447227 - RNA, 22 nt, Human
acacaucuuagacugaaauaug

SEQ ID NO: 447228 - RNA, 22 nt, Human
gggaccuggacaugugugugcu

SEQ ID NO: 447229 - RNA, 22 nt, Human
ccagccaguccagcauuggugu

SEQ ID NO: 447230 - RNA, 18 nt, Human
ucacagugcucuugccua

SEQ ID NO: 447231 - RNA, 20 nt, Human
ugaaggccagcagcauaggg

SEQ ID NO: 447232 - RNA, 22 nt, Human
ccuggccuccuggccuucucau

SEQ ID NO: 447233 - RNA, 22 nt, Human
acagagccaaaaggacauagua

SEQ ID NO: 447234 - RNA, 20 nt, Human
aggcucagcugagcucuugg

SEQ ID NO: 447235 - RNA, 22 nt, Human
aggcugaggcuggcagcuccag

SEQ ID NO: 447236 - RNA, 22 nt, Human
cugagagccuccuguuggcuag

SEQ ID NO: 447237 - RNA, 22 nt, Human
ugagccuguccugugcauguga

SEQ ID NO: 447238 - RNA, 22 nt, Human
cacaugggugugccuggaggaa

SEQ ID NO: 447239 - RNA, 22 nt, Human
auagucuuagucuauaguuuug

SEQ ID NO: 447240 - RNA, 22 nt, Human
cagagggcacaugguuuccuca

SEQ ID NO: 447241 - RNA, 23 nt, Human
uucuuauuuacuuuggaaucucc

SEQ ID NO: 447242 - RNA, 22 nt, Human
cugccacuagcuuucacaucuu

SEQ ID NO: 447243 - RNA, 22 nt, Human
gaaucauuggaaccacauccaa

SEQ ID NO: 447244 - RNA, 22 nt, Human
uuugaaaauuuaagugcuacac

SEQ ID NO: 447245 - RNA, 19 nt, Human
ugaaauggcaguugcuaaa

SEQ ID NO: 447246 - RNA, 22 nt, Human
cauugcacuucugcuuuuccuc

SEQ ID NO: 447247 - RNA, 22 nt, Human
uccaguggcacuggagacuaga

SEQ ID NO: 447248 - RNA, 22 nt, Human
cugagccaaggggacagugaca

SEQ ID NO: 447249 - RNA, 22 nt, Human
gccucugcugcaagccugguug

SEQ ID NO: 447250 - RNA, 22 nt, Human
caggcacucauucagagaggug

SEQ ID NO: 447251 - RNA, 22 nt, Human
cugucuguucagauucauuacu

SEQ ID NO: 447252 - RNA, 22 nt, Human
ggcaggugcaccugagccaucu

SEQ ID NO: 447253 - RNA, 22 nt, Human
gccacccugagcugggccaggg

SEQ ID NO: 447254 - RNA, 22 nt, Human
ccagaggacuugggggcugaau

SEQ ID NO: 447255 - RNA, 22 nt, Human
ugagccuggcggaagcagcgug

SEQ ID NO: 447256 - RNA, 22 nt, Human
ucgggguagacgccagcucgga

SEQ ID NO: 447257 - RNA, 22 nt, Human
cucagagcccaggguacacccg

SEQ ID NO: 447258 - RNA, 19 nt, Human
cuguggcugaccucuggcc

SEQ ID NO: 447259 - RNA, 23 nt, Human
ucagugauguugaaccuagcagu

SEQ ID NO: 447260 - RNA, 22 nt, Human
ggcagcugaccuagcaccaucc

SEQ ID NO: 447261 - RNA, 22 nt, Human
ugaagccaucccucagauggcc

SEQ ID NO: 447262 - RNA, 22 nt, Human
gaagaacacuucaugauucauu

SEQ ID NO: 447263 - RNA, 22 nt, Human
uccucaggauguggaguagaau

SEQ ID NO: 447264 - RNA, 22 nt, Human
agcagggcucugccaugggccc

SEQ ID NO: 447265 - RNA, 22 nt, Human
gaauuguacgcuuuacauaggu

SEQ ID NO: 447266 - RNA, 22 nt, Human
ugagccaggcucaagugauccu

SEQ ID NO: 447267 - RNA, 22 nt, Human
ucagacaguuugcagugugccu

SEQ ID NO: 447268 - RNA, 22 nt, Human
ugacagggugauuaugagagcu

SEQ ID NO: 447269 - RNA, 22 nt, Human
cuguugucuccucucagauuau

SEQ ID NO: 447270 - RNA, 22 nt, Human
ugggccuguggcuuggcucuag

SEQ ID NO: 447271 - RNA, 22 nt, Human
gagcacagccaaaguaagaagg

SEQ ID NO: 447272 - RNA, 22 nt, Human
uaaaucucacuggguauauugg

SEQ ID NO: 447273 - RNA, 22 nt, Human
uuucaauguaacauuuccaggc

SEQ ID NO: 447274 - RNA, 22 nt, Human
agcagccauccuuagagaaaga

SEQ ID NO: 447275 - RNA, 22 nt, Human
aggcugcagaacagucaggugc

SEQ ID NO: 447276 - RNA, 22 nt, Human
aagcagccucauuugugguaag

SEQ ID NO: 447277 - RNA, 22 nt, Human
acccaggaggcagagguugcag

SEQ ID NO: 447278 - RNA, 22 nt, Human
aagccagguuccauggaggagc

SEQ ID NO: 447279 - RNA, 22 nt, Human
cucaggaggaggaaguucauug

SEQ ID NO: 447280 - RNA, 22 nt, Human
gagccugccucuagucucuaga

SEQ ID NO: 447281 - RNA, 22 nt, Human
agguggggccaaaugcuacagu

SEQ ID NO: 447282 - RNA, 22 nt, Human
ugcagggcagcuagggagcuuu

SEQ ID NO: 447283 - RNA, 19 nt, Human
cagagcugcuggccucguc

SEQ ID NO: 447284 - RNA, 22 nt, Human
cagcaggcccagaguuucaugg

SEQ ID NO: 447285 - RNA, 22 nt, Human
aguguuguaugggaugacugcu

SEQ ID NO: 447286 - RNA, 22 nt, Human
gcagggcagaccuccagccuau

SEQ ID NO: 447287 - RNA, 22 nt, Human
gccagguguaguggccacaccu

SEQ ID NO: 447288 - RNA, 22 nt, Human
ucagagaugcagugccaccuac

SEQ ID NO: 447289 - RNA, 22 nt, Human
agucuucccugugccagagugu

SEQ ID NO: 447290 - RNA, 22 nt, Human
cuggcugcaggaugaggcugcc

SEQ ID NO: 447291 - RNA, 22 nt, Human
aggugucuucagggugagacag

SEQ ID NO: 447292 - RNA, 22 nt, Human
uacauauuugucuuuguacugu

SEQ ID NO: 447293 - RNA, 22 nt, Human
ggagaugguggaagcuggugca

SEQ ID NO: 447294 - RNA, 17 nt, Human
gauuuccugaaguucuu

SEQ ID NO: 447295 - RNA, 22 nt, Human
gccagagcaugcacugccugca

SEQ ID NO: 447296 - RNA, 22 nt, Human
cacauugaaaugacccaauaau

SEQ ID NO: 447297 - RNA, 22 nt, Human
cugaggugcuauggaggauacg

SEQ ID NO: 447298 - RNA, 18 nt, Human
agcagagcccaugcauuc

SEQ ID NO: 447299 - RNA, 22 nt, Human
auguaacauugaauuauauagu

SEQ ID NO: 447300 - RNA, 22 nt, Human
cagccugcucucagauguugag

SEQ ID NO: 447301 - RNA, 22 nt, Human
ggguguccugugccaagcuggg

SEQ ID NO: 447302 - RNA, 22 nt, Human
aagacugugucuauggcuacuc

SEQ ID NO: 447303 - RNA, 22 nt, Human
ugcauuaucuuuaauguucuca

SEQ ID NO: 447304 - RNA, 22 nt, Human
uucuuuccaaccagauauuggu

SEQ ID NO: 447305 - RNA, 22 nt, Human
uauucuugucuuuuccagaaau

SEQ ID NO: 447306 - RNA, 22 nt, Human
auaaggcagaaauagggaaagu

SEQ ID NO: 447307 - RNA, 22 nt, Human
ucaggcacugcuuucugauaug

SEQ ID NO: 447308 - RNA, 22 nt, Human
guucuccauucagcuuccugug

SEQ ID NO: 447309 - RNA, 22 nt, Human
cagagcuggggacuguuggaug

SEQ ID NO: 447310 - RNA, 22 nt, Human
ucucagagcaucauuuucuuag

SEQ ID NO: 447311 - RNA, 22 nt, Human
agaauucuguucuucgggugug

SEQ ID NO: 447312 - RNA, 22 nt, Human
cagguggggcagcugugggagc

SEQ ID NO: 447313 - RNA, 22 nt, Human
acugcagacucuacaguuauaa

SEQ ID NO: 447314 - RNA, 22 nt, Human
gcagcuuucugcaaugucaucc

SEQ ID NO: 447315 - RNA, 22 nt, Human
gccccucccagucaggagcacu

SEQ ID NO: 447316 - RNA, 22 nt, Human
ccugugugcugaugacgacaga

SEQ ID NO: 447317 - RNA, 22 nt, Human
cacagguguaugaauaugucca

SEQ ID NO: 447318 - RNA, 22 nt, Human
gugcagggcuggcaccggaggc

SEQ ID NO: 447319 - RNA, 19 nt, Human
uggcagaggacaaggacuu

SEQ ID NO: 447320 - RNA, 22 nt, Human
uaaauguguguagccaucugug

SEQ ID NO: 447321 - RNA, 22 nt, Human
aagcccagcugaaagcauuuuu

SEQ ID NO: 447322 - RNA, 22 nt, Human
agugucauuccagggacccucg

SEQ ID NO: 447323 - RNA, 22 nt, Human
ugaugaauaaacuugagaguca

SEQ ID NO: 447324 - RNA, 22 nt, Human
agauacauuguucuaagcauug

SEQ ID NO: 447325 - RNA, 22 nt, Human
gaacuguaguuaauacuacaca

SEQ ID NO: 447326 - RNA, 22 nt, Human
acagugugguuugagcacuggg

SEQ ID NO: 447327 - RNA, 22 nt, Human
agcagggccucuggcacugguc

SEQ ID NO: 447328 - RNA, 22 nt, Human
ccagcuccgggaguugcugcug

SEQ ID NO: 447329 - RNA, 22 nt, Human
ccaaggcuucccagagaugcuc

SEQ ID NO: 447330 - RNA, 22 nt, Human
agauacauugaguuuccuccug

SEQ ID NO: 447331 - RNA, 22 nt, Human
cuuauuuugcugaugacccagg

SEQ ID NO: 447332 - RNA, 22 nt, Human
ugcagaagaaaacagcugugug

SEQ ID NO: 447333 - RNA, 22 nt, Human
gaggcgagaagcuggagauggu

SEQ ID NO: 447334 - RNA, 22 nt, Human
acauuguagacuuuucauaugu

SEQ ID NO: 447335 - RNA, 21 nt, Human
agccugggaggcggagguugc

SEQ ID NO: 447336 - RNA, 22 nt, Human
uugcucuguaauaaucuggggu

SEQ ID NO: 447337 - RNA, 22 nt, Human
ccugggaggcugugggucugcu

SEQ ID NO: 447338 - RNA, 22 nt, Human
caggugccucaggaugagacaa

SEQ ID NO: 447339 - RNA, 22 nt, Human
uccuucagaaaaccucagucuu

SEQ ID NO: 447340 - RNA, 22 nt, Human
ccugucuggccuuccacggggg

SEQ ID NO: 447341 - RNA, 22 nt, Human
agcagggcuuugucucugugaa

SEQ ID NO: 447342 - RNA, 22 nt, Human
ugcagcagguuccaaaggguua

SEQ ID NO: 447343 - RNA, 22 nt, Human
ucagaggaauaaugcugcauuu

SEQ ID NO: 447344 - RNA, 22 nt, Human
aguggagacaggacagucgaua

SEQ ID NO: 447345 - RNA, 22 nt, Human
ggcccuguuagagcucccacaa

SEQ ID NO: 447346 - RNA, 22 nt, Human
uggcucagcuuuccccaucugg

SEQ ID NO: 447347 - RNA, 21 nt, Human
cagaggccucaugcucugugc

SEQ ID NO: 447348 - RNA, 22 nt, Human
gcucuggaagcaucugagagga

SEQ ID NO: 447349 - RNA, 22 nt, Human
gcccagcuggcuuccagcacau

SEQ ID NO: 447350 - RNA, 19 nt, Human
ccugggaggcggagguugc

SEQ ID NO: 447351 - RNA, 22 nt, Human
gcccugugcgacucuagagguu

SEQ ID NO: 447352 - RNA, 22 nt, Human
cagagcuguugcggggcuuggc

SEQ ID NO: 447353 - RNA, 19 nt, Human
acauggcaucccaggaggu

SEQ ID NO: 447354 - RNA, 19 nt, Human
uuacaucugcaacacuggu

SEQ ID NO: 447355 - RNA, 22 nt, Human
auauuugucaauucacuguuca

SEQ ID NO: 447356 - RNA, 22 nt, Human
gcuuuuucaaaugaaagcuggu

SEQ ID NO: 447357 - RNA, 22 nt, Human
cacagcugaaguagccaugugg

SEQ ID NO: 447358 - RNA, 22 nt, Human
aaagggcugucaaauaagcaac

SEQ ID NO: 447359 - RNA, 22 nt, Human
ggggcagagagaaggaagcuug

SEQ ID NO: 447360 - RNA, 22 nt, Human
uguguugugacauucuuggaug

SEQ ID NO: 447361 - RNA, 22 nt, Human
cuuggucauuuggggcugcuau

SEQ ID NO: 447362 - RNA, 22 nt, Human
ucuggcuccaccuccuuuacua

SEQ ID NO: 447363 - RNA, 22 nt, Human
gcagagccaggcuggggcaggu

SEQ ID NO: 447364 - RNA, 22 nt, Human
cagagccaaaccucagggcccg

SEQ ID NO: 447365 - RNA, 22 nt, Human
augaggcaggauuaagcuauca

SEQ ID NO: 447366 - RNA, 22 nt, Human
uaaggaaagugccaugauuucu

SEQ ID NO: 447367 - RNA, 22 nt, Human
ugugccugaguuggcugaguac

SEQ ID NO: 447368 - RNA, 22 nt, Human
cagcccagcagggucuggcccu

SEQ ID NO: 447369 - RNA, 22 nt, Human
acauguuagaaaugcagaaucu

SEQ ID NO: 447370 - RNA, 22 nt, Human
gaaggcugagcagacaggccaa

SEQ ID NO: 447371 - RNA, 22 nt, Human
aaugggaggauuuucucucuug

SEQ ID NO: 447372 - RNA, 23 nt, Human
gaggcagcuccugcagugcccug

SEQ ID NO: 447373 - RNA, 21 nt, Human
cacuauuuauauaugccagcu

SEQ ID NO: 447374 - RNA, 22 nt, Human
cagaaauguucuaaugauucag

SEQ ID NO: 447375 - RNA, 22 nt, Human
ccugaggggcugcaggccagcu

SEQ ID NO: 447376 - RNA, 21 nt, Human
agaauaaugguaucauuugcu

SEQ ID NO: 447377 - RNA, 22 nt, Human
ugagguggcuagggaggcacuc

SEQ ID NO: 447378 - RNA, 22 nt, Human
cacugcuuucacaguuuguucc

SEQ ID NO: 447379 - RNA, 22 nt, Human
gaggcucagagaagucauggua

SEQ ID NO: 447380 - RNA, 22 nt, Human
cauuucuguacauguuuuggug

SEQ ID NO: 447381 - RNA, 22 nt, Human
cuggcagguuuggugucuggug

SEQ ID NO: 447382 - RNA, 20 nt, Human
cuuugccuauucucugccug

SEQ ID NO: 447383 - RNA, 22 nt, Human
cccugcagccuugcaugccuuc

SEQ ID NO: 447384 - RNA, 22 nt, Human
augaaaaguucgaucuagaagg

SEQ ID NO: 447385 - RNA, 23 nt, Human
uugaaagguagcuggcagcuaga

SEQ ID NO: 447386 - RNA, 22 nt, Human
ucugggugaugaaaugcacugu

SEQ ID NO: 447387 - RNA, 22 nt, Human
ugcaggugguuuggacacugcu

SEQ ID NO: 447388 - RNA, 22 nt, Human
gggacagacccaugggccaggu

SEQ ID NO: 447389 - RNA, 21 nt, Human
gcucuuggaaggggcucagcu

SEQ ID NO: 447390 - RNA, 22 nt, Human
auguccagaguguccuggaaag

SEQ ID NO: 447391 - RNA, 20 nt, Human
cucaguguggccugaguguu

SEQ ID NO: 447392 - RNA, 22 nt, Human
uagggcaguuauaacauuagug

SEQ ID NO: 447393 - RNA, 22 nt, Human
ggcugccuucagacuccagcuu

SEQ ID NO: 447394 - RNA, 22 nt, Human
agugcauauaugaagaguauga

SEQ ID NO: 447395 - RNA, 22 nt, Human
ugggcagauguggcucuccuug

SEQ ID NO: 447396 - RNA, 22 nt, Human
gagggaccccaggcuggcccuu

SEQ ID NO: 447397 - RNA, 22 nt, Human
uugcaaaggggaauaaagcaau

SEQ ID NO: 447398 - RNA, 22 nt, Human
gaggaguguauuccacaccacu

SEQ ID NO: 447399 - RNA, 22 nt, Human
gagggcugugaaggagcggguu

SEQ ID NO: 447400 - RNA, 22 nt, Human
uggagaaggccggccaggagug

SEQ ID NO: 447401 - RNA, 22 nt, Human
uccaugccaggcagucgaugca

SEQ ID NO: 447402 - RNA, 22 nt, Human
gccagcagggcccaaaugcugg

SEQ ID NO: 447403 - RNA, 22 nt, Human
gggagccacaguuuauagugau

SEQ ID NO: 447404 - RNA, 22 nt, Human
auguuuuauauuuugcagcagu

SEQ ID NO: 447405 - RNA, 22 nt, Human
ggcugagcacuuuaggcaggag

SEQ ID NO: 447406 - RNA, 22 nt, Human
uucuacacucacccagcuguaa

SEQ ID NO: 447407 - RNA, 22 nt, Human
cagccagguaugggcgugcggg

SEQ ID NO: 447408 - RNA, 22 nt, Human
aaguaugacauuuaagacaauu

SEQ ID NO: 447409 - RNA, 22 nt, Human
gcaggagagucugugccagguu

SEQ ID NO: 447410 - RNA, 22 nt, Human
ucaacacuauccaggcaaucuu

SEQ ID NO: 447411 - RNA, 20 nt, Human
caggccagagguuugauggc

SEQ ID NO: 447412 - RNA, 22 nt, Human
cauucugugauucuaaaucccu

SEQ ID NO: 447413 - RNA, 22 nt, Human
ucagggcaaugucccucagaag

SEQ ID NO: 447414 - RNA, 23 nt, Human
cagaggcaucggauucaacauca

SEQ ID NO: 447415 - RNA, 19 nt, Human
uuagggacaugaauucuag

SEQ ID NO: 447416 - RNA, 22 nt, Human
agagcccucucauuggcuuauu

SEQ ID NO: 447417 - RNA, 23 nt, Human
gccugggacucaggaggagcuca

SEQ ID NO: 447418 - RNA, 18 nt, Human
cauuaugugguuauagaa

SEQ ID NO: 447419 - RNA, 22 nt, Human
ggagagagaugccgccuugcuc

SEQ ID NO: 447420 - RNA, 22 nt, Human
ccaggcucugagccucacucuu

SEQ ID NO: 447421 - RNA, 22 nt, Human
uuucuucucgacaccuuauccc

SEQ ID NO: 447422 - RNA, 22 nt, Human
ucagaggucccuagcaggagug

SEQ ID NO: 447423 - RNA, 22 nt, Human
gagagcugucagcguagcaccg

SEQ ID NO: 447424 - RNA, 22 nt, Human
ccagagaguaucauggagagua

SEQ ID NO: 447425 - RNA, 22 nt, Human
gugggcagugguuugcgcgguc

SEQ ID NO: 447426 - RNA, 22 nt, Human
gaugcaggauagcuucacccag

SEQ ID NO: 447427 - RNA, 22 nt, Human
aaggugaaacuggaagcuggcc

SEQ ID NO: 447428 - RNA, 22 nt, Human
agugugaguaauucagggaggg

SEQ ID NO: 447429 - RNA, 22 nt, Human
cugaggcucccucgggucugcu

SEQ ID NO: 447430 - RNA, 22 nt, Human
ugcuuaauauugugauguaaua

SEQ ID NO: 447431 - RNA, 22 nt, Human
uuguggaaauacagacuccaag

SEQ ID NO: 447432 - RNA, 22 nt, Human
cugcaggcugagcgccugccgg

SEQ ID NO: 447433 - RNA, 22 nt, Human
gaggcucagagggagcaugguc

SEQ ID NO: 447434 - RNA, 21 nt, Human
cgggcuggccgggcccucacc

SEQ ID NO: 447435 - RNA, 22 nt, Human
ugggcuccguugccuggggcag

SEQ ID NO: 447436 - RNA, 22 nt, Human
aaguaaaagcuuuaccaugcgc

SEQ ID NO: 447437 - RNA, 22 nt, Human
uucucagugaaguuuagaacau

SEQ ID NO: 447438 - RNA, 17 nt, Human
ugaagaugcauggcagc

SEQ ID NO: 447439 - RNA, 22 nt, Human
cucuguccuaugcuugauagaa

SEQ ID NO: 447440 - RNA, 22 nt, Human
accucugcaguagggcugugcc

SEQ ID NO: 447441 - RNA, 22 nt, Human
acuguacaaccucugccccugu

SEQ ID NO: 447442 - RNA, 22 nt, Human
gagaaagauggaaucuuacagg

SEQ ID NO: 447443 - RNA, 22 nt, Human
cacccagcauuggcuaagagag

SEQ ID NO: 447444 - RNA, 22 nt, Human
ugcuggaggaguuuacuguggc

SEQ ID NO: 447445 - RNA, 22 nt, Human
cccagcucaucaggagccgccc

SEQ ID NO: 447446 - RNA, 22 nt, Human
aaaggugacugcagcagcuauu

SEQ ID NO: 447447 - RNA, 22 nt, Human
ucagcuccucaugcaggggaua

SEQ ID NO: 447448 - RNA, 20 nt, Human
agugucugggccucaggccc

SEQ ID NO: 447449 - RNA, 20 nt, Human
gugcaauggcgcaaucucgg

SEQ ID NO: 447450 - RNA, 22 nt, Human
gucccuggucuaccguggcuuc

SEQ ID NO: 447451 - RNA, 22 nt, Human
ugguggccuugauggcaucugc

SEQ ID NO: 447452 - RNA, 22 nt, Human
cugggguggauggguccaaguu

SEQ ID NO: 447453 - RNA, 23 nt, Human
cacugcagcguggucuggcagga

SEQ ID NO: 447454 - RNA, 22 nt, Human
gcuccuggucuggagcuucaag

SEQ ID NO: 447455 - RNA, 20 nt, Human
cauuuguuagcuuucuacug

SEQ ID NO: 447456 - RNA, 22 nt, Human
aagacagagggaagcaaugaug

SEQ ID NO: 447457 - RNA, 22 nt, Human
gagcccuccauggagccaggca

SEQ ID NO: 447458 - RNA, 23 nt, Human
agucaguguaaguuuggaaugca

SEQ ID NO: 447459 - RNA, 22 nt, Human
cccaggcacacugaagugacau

SEQ ID NO: 447460 - RNA, 19 nt, Human
ugcucauggggacuucucc

SEQ ID NO: 447461 - RNA, 22 nt, Human
accccaagacaguagaagagaa

SEQ ID NO: 447462 - RNA, 22 nt, Human
cucugcauuuuaacagaugauu

SEQ ID NO: 447463 - RNA, 22 nt, Human
uuguuucaggaugguuuguuac

SEQ ID NO: 447464 - RNA, 22 nt, Human
aggcugcaggucugggucaugu

SEQ ID NO: 447465 - RNA, 22 nt, Human
agaguccaugaagacagcugag

SEQ ID NO: 447466 - RNA, 22 nt, Human
aggcugcagugcagguaggauu

SEQ ID NO: 447467 - RNA, 22 nt, Human
cagcuccugcagcugcugccgu

SEQ ID NO: 447468 - RNA, 22 nt, Human
gcauggcaagaucaggagacca

SEQ ID NO: 447469 - RNA, 22 nt, Human
ccagcugagaaguguaaaguga

SEQ ID NO: 447470 - RNA, 22 nt, Human
agcacaggaccaaggaagcugu

SEQ ID NO: 447471 - RNA, 22 nt, Human
ugccaggcugaacagggucuua

SEQ ID NO: 447472 - RNA, 22 nt, Human
gucagcaggguccccuugagug

SEQ ID NO: 447473 - RNA, 22 nt, Human
aggcagaaaauagucauccaaa

SEQ ID NO: 447474 - RNA, 22 nt, Human
cucugcaggggaggcaugcacu

SEQ ID NO: 447475 - RNA, 22 nt, Human
uguggccuugcagccuggaggu

SEQ ID NO: 447476 - RNA, 22 nt, Human
uggaccugcuggaugggcaggu

SEQ ID NO: 447477 - RNA, 22 nt, Human
cccugcagaaccacagacaaac

SEQ ID NO: 447478 - RNA, 22 nt, Human
aguggcagaagccaagucugca

SEQ ID NO: 447479 - RNA, 18 nt, Human
acauuucuccuucugacc

SEQ ID NO: 447480 - RNA, 22 nt, Human
agaccauggccauccuaggaaa

SEQ ID NO: 447481 - RNA, 22 nt, Human
aagggcaggugggcauuucugg

SEQ ID NO: 447482 - RNA, 22 nt, Human
agugaccauuuucagcuagagg

SEQ ID NO: 447483 - RNA, 22 nt, Human
uggcccugcuuaugucucucuu

SEQ ID NO: 447484 - RNA, 22 nt, Human
ccucuggguaucuguggaagua

SEQ ID NO: 447485 - RNA, 22 nt, Human
ugggggugacuaucucgggaau

SEQ ID NO: 447486 - RNA, 22 nt, Human
agcagggggccacagucacagc

SEQ ID NO: 447487 - RNA, 22 nt, Human
gcaggauggugcccuuucugcc

SEQ ID NO: 447488 - RNA, 22 nt, Human
cuccaggcucguccaagaucga

SEQ ID NO: 447489 - RNA, 22 nt, Human
ucucugaaggggagcuguuuaa

SEQ ID NO: 447490 - RNA, 22 nt, Human
ucccaggacaggccacauggaa

SEQ ID NO: 447491 - RNA, 20 nt, Human
uggcaucucucaauuguagg

SEQ ID NO: 447492 - RNA, 19 nt, Human
cacaucagcagggcugugg

SEQ ID NO: 447493 - RNA, 22 nt, Human
gggagggaggugaugcuuggcu

SEQ ID NO: 447494 - RNA, 22 nt, Human
cucuguagaaacagggcagaag

SEQ ID NO: 447495 - RNA, 22 nt, Human
uuucuucucacccaggacagag

SEQ ID NO: 447496 - RNA, 22 nt, Human
gaagcagcgaaguggaagggac

SEQ ID NO: 447497 - RNA, 22 nt, Human
aagaagguguggaaagaugcuc

SEQ ID NO: 447498 - RNA, 22 nt, Human
uccucagaaaccccugugaggu

SEQ ID NO: 447499 - RNA, 22 nt, Human
acagagagggagugauaaaucc

SEQ ID NO: 447500 - RNA, 22 nt, Human
gcaaggcugagcacauuugcau

SEQ ID NO: 447501 - RNA, 19 nt, Human
guccaguguuuuccaguca

SEQ ID NO: 447502 - RNA, 22 nt, Human
aagauuuagggccaguuuacau

SEQ ID NO: 447503 - RNA, 22 nt, Human
aguguuugucccguuagaaaug

SEQ ID NO: 447504 - RNA, 22 nt, Human
acagagccuccaggagugcugg

SEQ ID NO: 447505 - RNA, 22 nt, Human
aggcuggcgacaucuggcgggc

SEQ ID NO: 447506 - RNA, 22 nt, Human
ggucucuguugccuccaucaag

SEQ ID NO: 447507 - RNA, 22 nt, Human
cugcuguguuggcauuggauag

SEQ ID NO: 447508 - RNA, 19 nt, Human
aguguguacugaaagcacu

SEQ ID NO: 447509 - RNA, 22 nt, Human
cucuggagcaccgggcuaucca

SEQ ID NO: 447510 - RNA, 22 nt, Human
agaugcugcuccacaggccagg

SEQ ID NO: 447511 - RNA, 22 nt, Human
cucccaggguagggagagacua

SEQ ID NO: 447512 - RNA, 22 nt, Human
ucugggagagcacguggcugac

SEQ ID NO: 447513 - RNA, 22 nt, Human
cagaggcucuuccucacugccc

SEQ ID NO: 447514 - RNA, 22 nt, Human
cccuggagugccggaaucaaga

SEQ ID NO: 447515 - RNA, 20 nt, Human
aaaagcagccagagauggua

SEQ ID NO: 447516 - RNA, 22 nt, Human
gugugccaccagucaaggugaa

SEQ ID NO: 447517 - RNA, 22 nt, Human
uuccucaguuagugccugaggc

SEQ ID NO: 447518 - RNA, 22 nt, Human
auucaagagcccauguuuccug

SEQ ID NO: 447519 - RNA, 22 nt, Human
cugggcagguauacaaaaaaug

SEQ ID NO: 447520 - RNA, 22 nt, Human
aagaaauauugggccuuauaaa

SEQ ID NO: 447521 - RNA, 22 nt, Human
ucucugguggcuccaucaguag

SEQ ID NO: 447522 - RNA, 22 nt, Human
aggcagggucuugcuauguugc

SEQ ID NO: 447523 - RNA, 21 nt, Human
auugaaagucaacaaucaguu

SEQ ID NO: 447524 - RNA, 22 nt, Human
ugcagggccccucugcaugagu

SEQ ID NO: 447525 - RNA, 22 nt, Human
gcagacuggucuucagccuugg

SEQ ID NO: 447526 - RNA, 22 nt, Human
ucugggcacugcugagccugua

SEQ ID NO: 447527 - RNA, 21 nt, Human
gagugucuaauccaggcuguc

SEQ ID NO: 447528 - RNA, 22 nt, Human
uccagcagaccaucaaggcuca

SEQ ID NO: 447529 - RNA, 22 nt, Human
gggauggacuuggggacuccag

SEQ ID NO: 447530 - RNA, 22 nt, Human
ccugccuggagcugagugugga

SEQ ID NO: 447531 - RNA, 22 nt, Human
cuccaguggcaaguccgggcgg

SEQ ID NO: 447532 - RNA, 22 nt, Human
guggcagcggcccaggccgucu

SEQ ID NO: 447533 - RNA, 22 nt, Human
gauuuagagaauguuuuguaag

SEQ ID NO: 447534 - RNA, 22 nt, Human
ucagagugugagacauauugga

SEQ ID NO: 447535 - RNA, 22 nt, Human
aagaggaacugggggcugaguc

SEQ ID NO: 447536 - RNA, 22 nt, Human
uaagcauaacuaaaaaugauuu

SEQ ID NO: 447537 - RNA, 22 nt, Human
uuccacuuaguggaagggcaug

SEQ ID NO: 447538 - RNA, 22 nt, Human
ccugccugcaccuucucugggg

SEQ ID NO: 447539 - RNA, 22 nt, Human
uggcagcauuuuuuccagaaca

SEQ ID NO: 447540 - RNA, 19 nt, Human
ucugugcugggaggcagca

SEQ ID NO: 447541 - RNA, 22 nt, Human
caccagguggaaaugucacagc

SEQ ID NO: 447542 - RNA, 22 nt, Human
ugaggaggucagagucuggcug

SEQ ID NO: 447543 - RNA, 22 nt, Human
acagucuugcuguauggucagg

SEQ ID NO: 447544 - RNA, 22 nt, Human
cugcuuuagacaacugcuggga

SEQ ID NO: 447545 - RNA, 22 nt, Human
ucaaagucucugcuucuguaac

SEQ ID NO: 447546 - RNA, 22 nt, Human
ugcucuguauucuauggcaguu

SEQ ID NO: 447547 - RNA, 22 nt, Human
cauuacauuucaaaauguuucc

SEQ ID NO: 447548 - RNA, 22 nt, Human
uuugucuugaggcuggggaagu

SEQ ID NO: 447549 - RNA, 22 nt, Human
aaggagcuuguucgccuuccuc

SEQ ID NO: 447550 - RNA, 22 nt, Human
gaguuauuuguagggauuauau

SEQ ID NO: 447551 - RNA, 22 nt, Human
ugcuuuauuuauaaaauagcaa

SEQ ID NO: 447552 - RNA, 22 nt, Human
aggguggggugcuacaucuuua

SEQ ID NO: 447553 - RNA, 22 nt, Human
aagacaaagggguccuuggaug

SEQ ID NO: 447554 - RNA, 22 nt, Human
cagaaugagauaacccagauug

SEQ ID NO: 447555 - RNA, 22 nt, Human
uuucacauucagauauagacuu

SEQ ID NO: 447556 - RNA, 22 nt, Human
uggcugaggucuggggcuucug

SEQ ID NO: 447557 - RNA, 22 nt, Human
caccagggcagcagccuagucu

SEQ ID NO: 447558 - RNA, 22 nt, Human
ucaguuuuuacggucacaggga

SEQ ID NO: 447559 - RNA, 22 nt, Human
agggcugacaaauggcagugac

SEQ ID NO: 447560 - RNA, 22 nt, Human
agagggcccauguugggcugcu

SEQ ID NO: 447561 - RNA, 22 nt, Human
agugggcagcccaggaggucuu

SEQ ID NO: 447562 - RNA, 22 nt, Human
ugaccugcguaggugguuucug

SEQ ID NO: 447563 - RNA, 22 nt, Human
cuugaaagcacuccuuugacug

SEQ ID NO: 447564 - RNA, 22 nt, Human
gccaggcuccccggaucccugg

SEQ ID NO: 447565 - RNA, 22 nt, Human
gucucaguaagaaaggcuccug

SEQ ID NO: 447566 - RNA, 21 nt, Human
ggucagggggugccuccaggu

SEQ ID NO: 447567 - RNA, 23 nt, Human
ugucccagagggagggauaggcu

SEQ ID NO: 447568 - RNA, 22 nt, Human
aagggccuccuggggagccugg

SEQ ID NO: 447569 - RNA, 22 nt, Human
cugggagcuagcucugagcuga

SEQ ID NO: 447570 - RNA, 22 nt, Human
aagagaaggauucugagccugg

SEQ ID NO: 447571 - RNA, 22 nt, Human
caggcacugugcugagcucugc

SEQ ID NO: 447572 - RNA, 22 nt, Human
uuagagccaguuacaaggucaa

SEQ ID NO: 447573 - RNA, 22 nt, Human
ccucuuugugccugcaggcugc

SEQ ID NO: 447574 - RNA, 22 nt, Human
ccacagggugucaucagcuuga

SEQ ID NO: 447575 - RNA, 20 nt, Human
gacaggagaguuagguaggu

SEQ ID NO: 447576 - RNA, 22 nt, Human
gagggucccgagcccugucaga

SEQ ID NO: 447577 - RNA, 22 nt, Human
acagucucuccacacugcaggg

SEQ ID NO: 447578 - RNA, 22 nt, Human
cucuccaggacuuuggcccaau

SEQ ID NO: 447579 - RNA, 22 nt, Human
caggaaugaggucguaaguguc

SEQ ID NO: 447580 - RNA, 22 nt, Human
aagggacuuugucagcuuucca

SEQ ID NO: 447581 - RNA, 22 nt, Human
gaaaacacuuugaucugaaagu

SEQ ID NO: 447582 - RNA, 22 nt, Human
gaagcccagggcguggccgggc

SEQ ID NO: 447583 - RNA, 22 nt, Human
agucaguuaaccucacagcauc

SEQ ID NO: 447584 - RNA, 22 nt, Human
ugccaggcugcccuccagucug

SEQ ID NO: 447585 - RNA, 22 nt, Human
agauacaaaagauaagauuuag

SEQ ID NO: 447586 - RNA, 22 nt, Human
ggaaagaaucaagugauccugu

SEQ ID NO: 447587 - RNA, 19 nt, Human
gaagaagcuugagaaguag

SEQ ID NO: 447588 - RNA, 22 nt, Human
aaauuaguacauugcaaagucc

SEQ ID NO: 447589 - RNA, 22 nt, Human
ucccacacagcccgcucaccgg

SEQ ID NO: 447590 - RNA, 22 nt, Human
gcugucugcaucucuagagcuu

SEQ ID NO: 447591 - RNA, 22 nt, Human
cugggagguggagguugcauug

SEQ ID NO: 447592 - RNA, 22 nt, Human
ggauggcaggacaaggacccag

SEQ ID NO: 447593 - RNA, 22 nt, Human
gagucacauuaauuuaauuuua

SEQ ID NO: 447594 - RNA, 22 nt, Human
ugggcagacauugaguuuguuc

SEQ ID NO: 447595 - RNA, 22 nt, Human
gagcuggcuaauacugacuuau

SEQ ID NO: 447596 - RNA, 22 nt, Human
ucaggcugguccccacagugga

SEQ ID NO: 447597 - RNA, 22 nt, Human
gggagagguuacccgagcaacu

SEQ ID NO: 447598 - RNA, 18 nt, Human
ccagcaugccagaggcug

SEQ ID NO: 447599 - RNA, 22 nt, Human
cagugggugaugaguccugggg

SEQ ID NO: 447600 - RNA, 22 nt, Human
agugaaaacacuaguucuugcc

SEQ ID NO: 447601 - RNA, 21 nt, Human
uuguucuuccagaagcaaagu

SEQ ID NO: 447602 - RNA, 19 nt, Human
agacacacuugauaugugu

SEQ ID NO: 447603 - RNA, 21 nt, Human
auuauuauuucuguguccagc

SEQ ID NO: 447604 - RNA, 22 nt, Human
ugaagccauaggacagaggaua

SEQ ID NO: 447605 - RNA, 22 nt, Human
cugagauggaguuucgcucuuc

SEQ ID NO: 447606 - RNA, 19 nt, Human
guggccucggagcgcgcgg

SEQ ID NO: 447607 - RNA, 22 nt, Human
auauuagguuggugcaaaagua

SEQ ID NO: 447608 - RNA, 22 nt, Human
cccaguuguugccggcucugga

SEQ ID NO: 447609 - RNA, 22 nt, Human
ugucagagagcaggcaguagaa

SEQ ID NO: 447610 - RNA, 22 nt, Human
ugggcuguccagcaccugggcu

SEQ ID NO: 447611 - RNA, 22 nt, Human
cuggccacuggagguggcaccc

SEQ ID NO: 447612 - RNA, 22 nt, Human
gaggccugggagccuguccucc

SEQ ID NO: 447613 - RNA, 22 nt, Human
agagguagagguugcagugagc

SEQ ID NO: 447614 - RNA, 18 nt, Human
auccuugaugagaggucu

SEQ ID NO: 447615 - RNA, 22 nt, Human
uccugccuugccugggacauca

SEQ ID NO: 447616 - RNA, 22 nt, Human
uuucugcucgcucucaaucagg

SEQ ID NO: 447617 - RNA, 22 nt, Human
caaaugcauagaaagaugaaac

SEQ ID NO: 447618 - RNA, 22 nt, Human
uaccuuuugcuuauuaugacac

SEQ ID NO: 447619 - RNA, 20 nt, Human
cagggccacgcuccaaggca

SEQ ID NO: 447620 - RNA, 22 nt, Human
aacaaauguguggcaguguggg

SEQ ID NO: 447621 - RNA, 22 nt, Human
caagugucuauaucagugcuug

SEQ ID NO: 447622 - RNA, 22 nt, Human
ggcuggguuauuuauggccaag

SEQ ID NO: 447623 - RNA, 22 nt, Human
caguguguggauccucccagga

SEQ ID NO: 447624 - RNA, 22 nt, Human
cccuggccagcucaugucugag

SEQ ID NO: 447625 - RNA, 22 nt, Human
gcagcaggagaguuuguccugc

SEQ ID NO: 447626 - RNA, 22 nt, Human
cugggaugucuauagaacacuu

SEQ ID NO: 447627 - RNA, 22 nt, Human
gcagugcugaucccauggcaga

SEQ ID NO: 447628 - RNA, 18 nt, Human
cagcugugcccuguuugg

SEQ ID NO: 447629 - RNA, 22 nt, Human
gcagauggcugagccugcagau

SEQ ID NO: 447630 - RNA, 22 nt, Human
cuggcucccguuguccuugaag

SEQ ID NO: 447631 - RNA, 22 nt, Human
ccugucuguauugguuugcuau

SEQ ID NO: 447632 - RNA, 22 nt, Human
uuuacaaccucauauucugaug

SEQ ID NO: 447633 - RNA, 22 nt, Human
auaaggcagucacuggaauguu

SEQ ID NO: 447634 - RNA, 22 nt, Human
gggcugccaagccugccugccu

SEQ ID NO: 447635 - RNA, 22 nt, Human
cuuugcauacaauuuuuagaaa

SEQ ID NO: 447636 - RNA, 22 nt, Human
gggcagguguuuccaaggugag

SEQ ID NO: 447637 - RNA, 22 nt, Human
acacacaacucauuguguaaua

SEQ ID NO: 447638 - RNA, 22 nt, Human
gggcacugugcuaggugcugag

SEQ ID NO: 447639 - RNA, 22 nt, Human
ucaauucaacacaugcacauug

SEQ ID NO: 447640 - RNA, 22 nt, Human
gagcacccuuugcacaucaguc

SEQ ID NO: 447641 - RNA, 22 nt, Human
cucugugcccuacugcucagcu

SEQ ID NO: 447642 - RNA, 22 nt, Human
aucuggcugcugugcuuaagcu

SEQ ID NO: 447643 - RNA, 22 nt, Human
agagucuuccaggcagccugag

SEQ ID NO: 447644 - RNA, 22 nt, Human
agagcagcacguuguccccaca

SEQ ID NO: 447645 - RNA, 22 nt, Human
ugguuacacagcauguggacuu

SEQ ID NO: 447646 - RNA, 22 nt, Human
cugggccuuggauugacacugu

SEQ ID NO: 447647 - RNA, 22 nt, Human
uugcagagugguugugaggauu

SEQ ID NO: 447648 - RNA, 22 nt, Human
ggagcauguggggugagcaggg

SEQ ID NO: 447649 - RNA, 22 nt, Human
ccauaaucuggcuuugagagag

SEQ ID NO: 447650 - RNA, 22 nt, Human
ucuguacaguaccagauaguaa

SEQ ID NO: 447651 - RNA, 22 nt, Human
ugugggaggaauuagaauggga

SEQ ID NO: 447652 - RNA, 22 nt, Human
ucaggaaagaagaugcucagug

SEQ ID NO: 447653 - RNA, 21 nt, Human
ugucagaaauaagcaugugau

SEQ ID NO: 447654 - RNA, 22 nt, Human
gcuggccugggcucaagaccag

SEQ ID NO: 447655 - RNA, 22 nt, Human
aaguggaggccgaguucacgca

SEQ ID NO: 447656 - RNA, 22 nt, Human
caccagggacaaugcuaggggu

SEQ ID NO: 447657 - RNA, 20 nt, Human
ccucaagcagacugacagcu

SEQ ID NO: 447658 - RNA, 19 nt, Human
aggcagucauuggaauaua

SEQ ID NO: 447659 - RNA, 22 nt, Human
uaagaacaagcuggggguucca

SEQ ID NO: 447660 - RNA, 22 nt, Human
ugggcagauguccucugaagug

SEQ ID NO: 447661 - RNA, 22 nt, Human
cuggguggaaagugcugagaau

SEQ ID NO: 447662 - RNA, 22 nt, Human
uguaugcaaauuuauuagcaca

SEQ ID NO: 447663 - RNA, 22 nt, Human
cuggagaggccccaagauauuu

SEQ ID NO: 447664 - RNA, 22 nt, Human
acaaaaagcuccauuacugucc

SEQ ID NO: 447665 - RNA, 22 nt, Human
uuugucaucccuuuugaaacug

SEQ ID NO: 447666 - RNA, 22 nt, Human
cucaggaugaaagucaugguga

SEQ ID NO: 447667 - RNA, 22 nt, Human
acaaaauuguguuaaacuuuau

SEQ ID NO: 447668 - RNA, 22 nt, Human
aaagaucagucugaagcaacau

SEQ ID NO: 447669 - RNA, 22 nt, Human
gauuuccuugcauauugguaau

SEQ ID NO: 447670 - RNA, 22 nt, Human
auuaauuuccaggcacugugcu

SEQ ID NO: 447671 - RNA, 22 nt, Human
gggcagccucggugccugcugc

SEQ ID NO: 447672 - RNA, 22 nt, Human
ggggaugguggcauuuguaaaa

SEQ ID NO: 447673 - RNA, 22 nt, Human
cccuggagggauuucucaauca

SEQ ID NO: 447674 - RNA, 22 nt, Human
gaguguggugaacaggagcacc

SEQ ID NO: 447675 - RNA, 22 nt, Human
aggagagagaacacuugggucc

SEQ ID NO: 447676 - RNA, 21 nt, Human
ucucuggaauuagaccauguu

SEQ ID NO: 447677 - RNA, 22 nt, Human
uacaaacuuguuuuaaguaagu

SEQ ID NO: 447678 - RNA, 22 nt, Human
acuguacacagugguguacugu

SEQ ID NO: 447679 - RNA, 22 nt, Human
ucauacauaacuuguacaguga

SEQ ID NO: 447680 - RNA, 22 nt, Human
ugugaaggcagagccagugaaa

SEQ ID NO: 447681 - RNA, 22 nt, Human
ugggggagauuagagcuucuua

SEQ ID NO: 447682 - RNA, 22 nt, Human
ggcagugaugucaaacagugaa

SEQ ID NO: 447683 - RNA, 22 nt, Human
ucuggcucaucucuccagguaa

SEQ ID NO: 447684 - RNA, 22 nt, Human
gcaggcaguuauuuaguagaau

SEQ ID NO: 447685 - RNA, 19 nt, Human
uggcagcauugguaccuug

SEQ ID NO: 447686 - RNA, 22 nt, Human
uaguggagaggauguggagaaa

SEQ ID NO: 447687 - RNA, 22 nt, Human
ggucaggguauaaucaagugag

SEQ ID NO: 447688 - RNA, 20 nt, Human
uaugaguauuacuuucagga

SEQ ID NO: 447689 - RNA, 22 nt, Human
uauguacacauacacuuguaau

SEQ ID NO: 447690 - RNA, 22 nt, Human
ucugucauugcaauaaaauuuc

SEQ ID NO: 447691 - RNA, 20 nt, Human
ggcugccuccuuccuuuccu

SEQ ID NO: 447692 - RNA, 22 nt, Human
cccuggggcugagggauggccg

SEQ ID NO: 447693 - RNA, 22 nt, Human
gccuaauaacuagcuguguaac

SEQ ID NO: 447694 - RNA, 22 nt, Human
aaggucauggcaaauuacuuuu

SEQ ID NO: 447695 - RNA, 22 nt, Human
uuugcauuaguuuagauuucaa

SEQ ID NO: 447696 - RNA, 22 nt, Human
ccuccugggcuccugucugcac

SEQ ID NO: 447697 - RNA, 22 nt, Human
auguuacacauaggcauaaaug

SEQ ID NO: 447698 - RNA, 22 nt, Human
uggcaggguggcaacuuuuggu

SEQ ID NO: 447699 - RNA, 22 nt, Human
gcaggcagagagggguuuccag

SEQ ID NO: 447700 - RNA, 22 nt, Human
uggccugguuauauugcuauca

SEQ ID NO: 447701 - RNA, 22 nt, Human
agggcugagacuaaggccagau

SEQ ID NO: 447702 - RNA, 22 nt, Human
ggcucagguuuaaagugcuuua

SEQ ID NO: 447703 - RNA, 22 nt, Human
caagggcuucaaguggccaaga

SEQ ID NO: 447704 - RNA, 21 nt, Human
cagagcugaaggguguagugu

SEQ ID NO: 447705 - RNA, 22 nt, Human
ggccagaggccauccuccugcu

SEQ ID NO: 447706 - RNA, 22 nt, Human
gagccagcugagcugcacuguc

SEQ ID NO: 447707 - RNA, 22 nt, Human
agcugccuccauggucaaagau

SEQ ID NO: 447708 - RNA, 22 nt, Human
uucaggaucauuuguuuuaucu

SEQ ID NO: 447709 - RNA, 22 nt, Human
uggcucagagagggagugugga

SEQ ID NO: 447710 - RNA, 22 nt, Human
ucagguguuagaagaaauuuca

SEQ ID NO: 447711 - RNA, 22 nt, Human
gcccugagacugagcauggguu

SEQ ID NO: 447712 - RNA, 22 nt, Human
uauguacaucguugaauucaaa

SEQ ID NO: 447713 - RNA, 20 nt, Human
gccaggcacuguucucaaua

SEQ ID NO: 447714 - RNA, 20 nt, Human
agagccuugaggaagaugau

SEQ ID NO: 447715 - RNA, 22 nt, Human
auuauaaagaacaugugugugg

SEQ ID NO: 447716 - RNA, 22 nt, Human
uggccacagccucugccaguuc

SEQ ID NO: 447717 - RNA, 22 nt, Human
ucuggccuacuggaguccauga

SEQ ID NO: 447718 - RNA, 22 nt, Human
ugagcagaacacgggauccaug

SEQ ID NO: 447719 - RNA, 22 nt, Human
ucucagugacacucuucauaca

SEQ ID NO: 447720 - RNA, 22 nt, Human
auugaaagauauacuguucuca

SEQ ID NO: 447721 - RNA, 22 nt, Human
aaggcagccgugugacugcaug

SEQ ID NO: 447722 - RNA, 22 nt, Human
gauggcagcagcagccagggau

SEQ ID NO: 447723 - RNA, 22 nt, Human
ggaugcuggggaccaaucucug

SEQ ID NO: 447724 - RNA, 22 nt, Human
gcagggaccugccacugcuguc

SEQ ID NO: 447725 - RNA, 22 nt, Human
ucagggcaaaagggaaaccauu

SEQ ID NO: 447726 - RNA, 20 nt, Human
cccugcagccaugggagugg

SEQ ID NO: 447727 - RNA, 22 nt, Human
aggcccugcccagagcuccucg

SEQ ID NO: 447728 - RNA, 22 nt, Human
gacucugcuacaggccgagguu

SEQ ID NO: 447729 - RNA, 22 nt, Human
agggccuggcgcguggccgccg

SEQ ID NO: 447730 - RNA, 22 nt, Human
ugggcagccaucccagccucuc

SEQ ID NO: 447731 - RNA, 22 nt, Human
ugcccuuggguaacuugcugau

SEQ ID NO: 447732 - RNA, 21 nt, Human
ggcacugagccagauggacuc

SEQ ID NO: 447733 - RNA, 22 nt, Human
ggcaguggguggaucucaggga

SEQ ID NO: 447734 - RNA, 22 nt, Human
uguccucagauaugucuacucu

SEQ ID NO: 447735 - RNA, 22 nt, Human
uugcuuccucgaggccagcgug

SEQ ID NO: 447736 - RNA, 22 nt, Human
cagauggccagaggcagcugca

SEQ ID NO: 447737 - RNA, 22 nt, Human
ggucagccuuggauuugguagc

SEQ ID NO: 447738 - RNA, 22 nt, Human
uuuccaaauaaggucacauucu

SEQ ID NO: 447739 - RNA, 22 nt, Human
uggcagcagccauggaaggccc

SEQ ID NO: 447740 - RNA, 22 nt, Human
aaggcuuucagcuaacuugauu

SEQ ID NO: 447741 - RNA, 22 nt, Human
ucuuggagacucuuguauauuu

SEQ ID NO: 447742 - RNA, 22 nt, Human
aggaagccuggcauuaaaaagc

SEQ ID NO: 447743 - RNA, 22 nt, Human
ugggcucucuggcaggaaggcu

SEQ ID NO: 447744 - RNA, 22 nt, Human
gcucugcuggagggaaagagaa

SEQ ID NO: 447745 - RNA, 22 nt, Human
ugcuggccaauggcagaggcgg

SEQ ID NO: 447746 - RNA, 22 nt, Human
caagauggacauaaggagagaa

SEQ ID NO: 447747 - RNA, 23 nt, Human
ugcugggguaguuuguggcacag

SEQ ID NO: 447748 - RNA, 22 nt, Human
gcugcuucucugauggagucca

SEQ ID NO: 447749 - RNA, 22 nt, Human
gcuggcuguuggagguaccugc

SEQ ID NO: 447750 - RNA, 20 nt, Human
cccaggugucugaagcucug

SEQ ID NO: 447751 - RNA, 22 nt, Human
uccuuuggagcuugacugguag

SEQ ID NO: 447752 - RNA, 22 nt, Human
uccuggauucugcccugaaggc

SEQ ID NO: 447753 - RNA, 17 nt, Human
ucagcaaagacaaagga

SEQ ID NO: 447754 - RNA, 22 nt, Human
aaacaacuucugcacuaugggu

SEQ ID NO: 447755 - RNA, 22 nt, Human
agauguggauccuaggguagaa

SEQ ID NO: 447756 - RNA, 22 nt, Human
caguuucuuggaugccaauuuc

SEQ ID NO: 447757 - RNA, 22 nt, Human
aagcugccaccagcccagggca

SEQ ID NO: 447758 - RNA, 22 nt, Human
gacauaaaauucaauaauuugu

SEQ ID NO: 447759 - RNA, 22 nt, Human
ccagagccugcugagccccauu

SEQ ID NO: 447760 - RNA, 18 nt, Human
ccuggagcuccacagcaa

SEQ ID NO: 447761 - RNA, 22 nt, Human
gugcaggguagcgacggcagga

SEQ ID NO: 447762 - RNA, 22 nt, Human
cucacugcaaguuccaccuacc

SEQ ID NO: 447763 - RNA, 22 nt, Human
ugccugagugauguggcagcca

SEQ ID NO: 447764 - RNA, 22 nt, Human
ucugccugcuaacuccugcacc

SEQ ID NO: 447765 - RNA, 22 nt, Human
aggaaagggguagguguggacg

SEQ ID NO: 447766 - RNA, 22 nt, Human
ucagcuuucucagaggccuaac

SEQ ID NO: 447767 - RNA, 22 nt, Human
cacugagaggucucauuuccaa

SEQ ID NO: 447768 - RNA, 22 nt, Human
gaauucugggagagaucugaca

SEQ ID NO: 447769 - RNA, 22 nt, Human
aagacugucugggacaagauga

SEQ ID NO: 447770 - RNA, 22 nt, Human
ugucuuuagagucacaaaacca

SEQ ID NO: 447771 - RNA, 22 nt, Human
cagcaggguauacagggaauuu

SEQ ID NO: 447772 - RNA, 22 nt, Human
cagcugcccaagccccagaugu

SEQ ID NO: 447773 - RNA, 22 nt, Human
aaaagcagagacucuggagcua

SEQ ID NO: 447774 - RNA, 22 nt, Human
agucccagagaggucggggcca

SEQ ID NO: 447775 - RNA, 22 nt, Human
ucccagccggugccuggguccc

SEQ ID NO: 447776 - RNA, 22 nt, Human
uggcugcuagccagagcuucag

SEQ ID NO: 447777 - RNA, 22 nt, Human
acaguaccugcucucaagcaaa

SEQ ID NO: 447778 - RNA, 20 nt, Human
gccuggaggcagagauaaag

SEQ ID NO: 447779 - RNA, 22 nt, Human
aagacauugucauuuuauaauu

SEQ ID NO: 447780 - RNA, 22 nt, Human
caggggcuuaagugacagaagg

SEQ ID NO: 447781 - RNA, 22 nt, Human
uucgaguuggcuuuauuaaacu

SEQ ID NO: 447782 - RNA, 22 nt, Human
aucuaagauguauugagcacuu

SEQ ID NO: 447783 - RNA, 22 nt, Human
uccaagaagucaucuaaacugu

SEQ ID NO: 447784 - RNA, 22 nt, Human
aaggaaccuggaguagagggag

SEQ ID NO: 447785 - RNA, 22 nt, Human
gccucugcaggugcgguuaucc

SEQ ID NO: 447786 - RNA, 22 nt, Human
agggcuggcuaggugcguuccc

SEQ ID NO: 447787 - RNA, 22 nt, Human
ucuggccauggcaagccgagug

SEQ ID NO: 447788 - RNA, 22 nt, Human
cucaggauggaagccuacagga

SEQ ID NO: 447789 - RNA, 22 nt, Human
gagguuagaggucagugcaguc

SEQ ID NO: 447790 - RNA, 22 nt, Human
uucuuuuacauuaagauuucag

SEQ ID NO: 447791 - RNA, 22 nt, Human
ucuuugcaugcauuuucccuua

SEQ ID NO: 447792 - RNA, 22 nt, Human
aaaugguaagacaacacauuau

SEQ ID NO: 447793 - RNA, 22 nt, Human
gcagaugguggggcaggaaaau

SEQ ID NO: 447794 - RNA, 22 nt, Human
cacucugcgcugggcgccagcg

SEQ ID NO: 447795 - RNA, 22 nt, Human
cccaggagagaggccaguuggc

SEQ ID NO: 447796 - RNA, 22 nt, Human
gaagcagcuaggaucuucauuu

SEQ ID NO: 447797 - RNA, 22 nt, Human
uauaucuuauaugugcagguac

SEQ ID NO: 447798 - RNA, 22 nt, Human
aggcugaggcagguggaucauu

SEQ ID NO: 447799 - RNA, 19 nt, Human
ucuggagcugaugcaggug

SEQ ID NO: 447800 - RNA, 22 nt, Human
guguacauauugagucugcuga

SEQ ID NO: 447801 - RNA, 22 nt, Human
ugcugugggcaguacauaagcu

SEQ ID NO: 447802 - RNA, 22 nt, Human
aggcucaggugccucauucaca

SEQ ID NO: 447803 - RNA, 22 nt, Human
ugauuuccucuacuagcaauua

SEQ ID NO: 447804 - RNA, 19 nt, Human
uggcugggcgugccuccgu

SEQ ID NO: 447805 - RNA, 22 nt, Human
ccgggcgggggcucucgucacc

SEQ ID NO: 447806 - RNA, 22 nt, Human
caugggcaguuggcagggcuca

SEQ ID NO: 447807 - RNA, 22 nt, Human
aaguuauaucaucucauugacg

SEQ ID NO: 447808 - RNA, 22 nt, Human
aggagccccucuucaguccugg

SEQ ID NO: 447809 - RNA, 22 nt, Human
ccucacucugcacccugcagca

SEQ ID NO: 447810 - RNA, 23 nt, Human
ccagccucugggucuucauccag

SEQ ID NO: 447811 - RNA, 22 nt, Human
agggaggugguuccccagugga

SEQ ID NO: 447812 - RNA, 20 nt, Human
ucagugauuuugaagaggaa

SEQ ID NO: 447813 - RNA, 22 nt, Human
gugccugguuuggggaauguuc

SEQ ID NO: 447814 - RNA, 21 nt, Human
gugguucuagagaaacagaau

SEQ ID NO: 447815 - RNA, 22 nt, Human
uuguaacagcugcuuaauagag

SEQ ID NO: 447816 - RNA, 22 nt, Human
aaauguaguauguugcauguau

SEQ ID NO: 447817 - RNA, 22 nt, Human
cuggccaggcuugggacagaca

SEQ ID NO: 447818 - RNA, 22 nt, Human
uguuacuuaucucacgugaugc

SEQ ID NO: 447819 - RNA, 23 nt, Human
gaguguucauagcaggcucuugc

SEQ ID NO: 447820 - RNA, 18 nt, Human
cccagcuuagcgccccuc

SEQ ID NO: 447821 - RNA, 22 nt, Human
uaacagaagagcaggcagcccu

SEQ ID NO: 447822 - RNA, 22 nt, Human
gugagaguguuuggaaauagaa

SEQ ID NO: 447823 - RNA, 22 nt, Human
ggcucaggccuguaauccuagc

SEQ ID NO: 447824 - RNA, 21 nt, Human
ggauggauagggaagagauuu

SEQ ID NO: 447825 - RNA, 22 nt, Human
cacaagacuuauuuguguagaa

SEQ ID NO: 447826 - RNA, 22 nt, Human
ccugggagguggagguugcagc

SEQ ID NO: 447827 - RNA, 22 nt, Human
acuguggaugccaaaggggagg

SEQ ID NO: 447828 - RNA, 22 nt, Human
agacagcaggggagucugguuu

SEQ ID NO: 447829 - RNA, 22 nt, Human
agcaggugggcaugaaagcuga

SEQ ID NO: 447830 - RNA, 22 nt, Human
cagcagugugcaggugugcugg

SEQ ID NO: 447831 - RNA, 22 nt, Human
uggcacagacagaucaggaguc

SEQ ID NO: 447832 - RNA, 22 nt, Human
cuauuuuaagaggccauuaggu

SEQ ID NO: 447833 - RNA, 22 nt, Human
cagcccagcacuaaguagauuu

SEQ ID NO: 447834 - RNA, 22 nt, Human
ugauucuauggaaggcauaagg

SEQ ID NO: 447835 - RNA, 22 nt, Human
agagcuggauggucaagauggc

SEQ ID NO: 447836 - RNA, 22 nt, Human
gagugcagaugaacagaagauu

SEQ ID NO: 447837 - RNA, 22 nt, Human
uaaauucugaucaaguuccuuc

SEQ ID NO: 447838 - RNA, 22 nt, Human
agcgggugcugugucagcccuc

SEQ ID NO: 447839 - RNA, 22 nt, Human
ucucccagugucuggcagucag

SEQ ID NO: 447840 - RNA, 22 nt, Human
aaagaacuuauccuagaauuug

SEQ ID NO: 447841 - RNA, 22 nt, Human
cccaagaucuuucgugcacuaa

SEQ ID NO: 447842 - RNA, 22 nt, Human
ggagugggcagcacugcccugu

SEQ ID NO: 447843 - RNA, 19 nt, Human
ugucuuaauuaacucagag

SEQ ID NO: 447844 - RNA, 22 nt, Human
gugucauggaaaauugcaaugg

SEQ ID NO: 447845 - RNA, 22 nt, Human
gcagauggugggggaggaguac

SEQ ID NO: 447846 - RNA, 22 nt, Human
cagcuuugcaggcuggucagug

SEQ ID NO: 447847 - RNA, 22 nt, Human
gcacacaggcaguuuccagcca

SEQ ID NO: 447848 - RNA, 20 nt, Human
aguguuccggaagacuggca

SEQ ID NO: 447849 - RNA, 17 nt, Human
aggcuggcucacaggga

SEQ ID NO: 447850 - RNA, 19 nt, Human
uuuggcacucugaaguguu

SEQ ID NO: 447851 - RNA, 22 nt, Human
aagcaauauacugauaugauua

SEQ ID NO: 447852 - RNA, 22 nt, Human
cagggacugagauccagacugu

SEQ ID NO: 447853 - RNA, 22 nt, Human
uaggaaaagcacaggauguucu

SEQ ID NO: 447854 - RNA, 22 nt, Human
cccaccaguacagaugguagau

SEQ ID NO: 447855 - RNA, 22 nt, Human
uucaggauccccuugaugggcu

SEQ ID NO: 447856 - RNA, 22 nt, Human
ggcuggcauccagggaaaucca

SEQ ID NO: 447857 - RNA, 22 nt, Human
uuuauuagauuaucaaagaggu

SEQ ID NO: 447858 - RNA, 21 nt, Human
ggagucauuagucauuuccuu

SEQ ID NO: 447859 - RNA, 22 nt, Human
gggcagugguuacacagcugag

SEQ ID NO: 447860 - RNA, 22 nt, Human
aagaaaguggguaauaugauuu

SEQ ID NO: 447861 - RNA, 23 nt, Human
uccugagaugagacagugcugcc

SEQ ID NO: 447862 - RNA, 19 nt, Human
aggcagaggcuuggcuagc

SEQ ID NO: 447863 - RNA, 22 nt, Human
gcagagaggauauuauugucca

SEQ ID NO: 447864 - RNA, 22 nt, Human
caggcugaggcaguaggguuug

SEQ ID NO: 447865 - RNA, 19 nt, Human
ccaguagagacagcugcag

SEQ ID NO: 447866 - RNA, 22 nt, Human
ccagagacgucggucagggcgc

SEQ ID NO: 447867 - RNA, 22 nt, Human
gucaggauuauaauccccaugg

SEQ ID NO: 447868 - RNA, 22 nt, Human
uuaagaauggaaugaggaauuu

SEQ ID NO: 447869 - RNA, 22 nt, Human
ggagccugugggaugagaugug

SEQ ID NO: 447870 - RNA, 22 nt, Human
gcuggugagcaaaggagaagga

SEQ ID NO: 447871 - RNA, 22 nt, Human
ucaggcagaccaccgugggcag

SEQ ID NO: 447872 - RNA, 18 nt, Human
uccugccugcgggcuccc

SEQ ID NO: 447873 - RNA, 22 nt, Human
aggcagcaugggccccagcucc

SEQ ID NO: 447874 - RNA, 22 nt, Human
ucuuugcaucccuuccauaguu

SEQ ID NO: 447875 - RNA, 22 nt, Human
gaaaguuugccucucucuugag

SEQ ID NO: 447876 - RNA, 22 nt, Human
gcucugggcugcccucuggaca

SEQ ID NO: 447877 - RNA, 21 nt, Human
ccuccaggugauuccgugcuc

SEQ ID NO: 447878 - RNA, 22 nt, Human
cagugaggaagcugucuggacc

SEQ ID NO: 447879 - RNA, 22 nt, Human
agacuguagggauagaggucuu

SEQ ID NO: 447880 - RNA, 22 nt, Human
caggccugagacaucugagaua

SEQ ID NO: 447881 - RNA, 22 nt, Human
ugaaggaaagagggaacauccc

SEQ ID NO: 447882 - RNA, 22 nt, Human
ucaggcugaaucauccuagcuu

SEQ ID NO: 447883 - RNA, 22 nt, Human
ugggccugacucaccugccucc

SEQ ID NO: 447884 - RNA, 19 nt, Human
gcuucccaccagccagccc

SEQ ID NO: 447885 - RNA, 22 nt, Human
acauuucuggaguuucucaaca

SEQ ID NO: 447886 - RNA, 22 nt, Human
uuagccaugcccuagaagagga

SEQ ID NO: 447887 - RNA, 23 nt, Human
auacauacagucuuacugacuuu

SEQ ID NO: 447888 - RNA, 22 nt, Human
guagggacuguucucaccugag

SEQ ID NO: 447889 - RNA, 22 nt, Human
caggagccccaggcugacaaua

SEQ ID NO: 447890 - RNA, 22 nt, Human
ucagagaggcaauacuguuuaa

SEQ ID NO: 447891 - RNA, 22 nt, Human
augcuauacauaugacaucaca

SEQ ID NO: 447892 - RNA, 22 nt, Human
aggucaaaccacagcucuaggc

SEQ ID NO: 447893 - RNA, 21 nt, Human
uccugccuuaguccagagcag

SEQ ID NO: 447894 - RNA, 22 nt, Human
cugcuguguuccuccugcaucu

SEQ ID NO: 447895 - RNA, 23 nt, Human
uuugcaaauuggacacaaccaca

SEQ ID NO: 447896 - RNA, 22 nt, Human
agaugugguaguugaagggaag

SEQ ID NO: 447897 - RNA, 22 nt, Human
auaaacagaguaguugcuacug

SEQ ID NO: 447898 - RNA, 22 nt, Human
aggcugucaucuuugcaggcag

SEQ ID NO: 447899 - RNA, 22 nt, Human
gucccagggaagaaggcagcac

SEQ ID NO: 447900 - RNA, 22 nt, Human
ggccugcuucucagugagcuug

SEQ ID NO: 447901 - RNA, 22 nt, Human
cugccugugccaaugcuccuuu

SEQ ID NO: 447902 - RNA, 22 nt, Human
uggcucagcuuacuuuugaggg

SEQ ID NO: 447903 - RNA, 22 nt, Human
gcagagcucuguucuuaucucc

SEQ ID NO: 447904 - RNA, 22 nt, Human
cagcuuuaggacucauaauaaa

SEQ ID NO: 447905 - RNA, 22 nt, Human
uagacagauuucuuguuagaca

SEQ ID NO: 447906 - RNA, 17 nt, Human
uuucuccuuccaucuca

SEQ ID NO: 447907 - RNA, 22 nt, Human
gcaucuaaauaaacgugggagu

SEQ ID NO: 447908 - RNA, 22 nt, Human
uuaaguccuugguaauuuucuu

SEQ ID NO: 447909 - RNA, 22 nt, Human
aaggcugaggagggccugcagg

SEQ ID NO: 447910 - RNA, 18 nt, Human
ggcugccuguuccugaag

SEQ ID NO: 447911 - RNA, 22 nt, Human
ggccuguccagccugccuggcu

SEQ ID NO: 447912 - RNA, 22 nt, Human
uccagaccuagggcaccccagu

SEQ ID NO: 447913 - RNA, 22 nt, Human
gaauguaauagucaguagaaca

SEQ ID NO: 447914 - RNA, 17 nt, Human
uuucagauucacuuucu

SEQ ID NO: 447915 - RNA, 22 nt, Human
ugaguagcggcuauguguaacu

SEQ ID NO: 447916 - RNA, 22 nt, Human
uauaagaaacaaggcaaauuuu

SEQ ID NO: 447917 - RNA, 22 nt, Human
cagcuuuaguaacccacugcuc

SEQ ID NO: 447918 - RNA, 22 nt, Human
ucucugagcccaauguagcaau

SEQ ID NO: 447919 - RNA, 22 nt, Human
gcagaggagcaagcuggacacc

SEQ ID NO: 447920 - RNA, 22 nt, Human
cuguugucccugggagcucagc

SEQ ID NO: 447921 - RNA, 22 nt, Human
uagcacauaacuuagaauaguu

SEQ ID NO: 447922 - RNA, 21 nt, Human
ugaggccugccagucucagaa

SEQ ID NO: 447923 - RNA, 22 nt, Human
uacaaaguuugggguccucaaa

SEQ ID NO: 447924 - RNA, 22 nt, Human
caggggcuguuugccucaggcc

SEQ ID NO: 447925 - RNA, 22 nt, Human
aaagaugucauacacauuaaga

SEQ ID NO: 447926 - RNA, 22 nt, Human
cagcuuuggcccagucgggagg

SEQ ID NO: 447927 - RNA, 18 nt, Human
uacaugcauaaaugaagc

SEQ ID NO: 447928 - RNA, 22 nt, Human
auggcagccugagcagaggaau

SEQ ID NO: 447929 - RNA, 22 nt, Human
aagugguagacaaagauaauug

SEQ ID NO: 447930 - RNA, 22 nt, Human
cacugaagcuuucauucucuug

SEQ ID NO: 447931 - RNA, 22 nt, Human
uggcaguguauagguggcuccu

SEQ ID NO: 447932 - RNA, 22 nt, Human
guagaagugaugucauguuaua

SEQ ID NO: 447933 - RNA, 22 nt, Human
gaggggaagacuucuggacagu

SEQ ID NO: 447934 - RNA, 20 nt, Human
gccugcagguuggaugggau

SEQ ID NO: 447935 - RNA, 22 nt, Human
cccaggaggcagagcuugcagu

SEQ ID NO: 447936 - RNA, 18 nt, Human
gccugccuagagcuugcc

SEQ ID NO: 447937 - RNA, 22 nt, Human
caagacaagaucuaagcaugcu

SEQ ID NO: 447938 - RNA, 22 nt, Human
uggucucuucuuccaagauggc

SEQ ID NO: 447939 - RNA, 19 nt, Human
agcagccauagacaauaug

SEQ ID NO: 447940 - RNA, 22 nt, Human
cagcuccccaugguuccugaag

SEQ ID NO: 447941 - RNA, 22 nt, Human
uggagcaggccggaaguggcuu

SEQ ID NO: 447942 - RNA, 22 nt, Human
cccaaggccucuccuuggcuug

SEQ ID NO: 447943 - RNA, 22 nt, Human
cagagcagggguuucccagguu

SEQ ID NO: 447944 - RNA, 15 nt, Human
aaucuggcggcaagu

SEQ ID NO: 447945 - RNA, 18 nt, Human
uggcucagauggcuuuaa

SEQ ID NO: 447946 - RNA, 22 nt, Human
uggugcuguggaggggcagaag

SEQ ID NO: 447947 - RNA, 22 nt, Human
gagcuggaagucuguggucaga

SEQ ID NO: 447948 - RNA, 22 nt, Human
ugggccacaagccaugggacca

SEQ ID NO: 447949 - RNA, 22 nt, Human
agcuggccuuagugagcaccug

SEQ ID NO: 447950 - RNA, 22 nt, Human
aaaucaguucacguucugaggu

SEQ ID NO: 447951 - RNA, 22 nt, Human
cccucaggagaugucagcugga

SEQ ID NO: 447952 - RNA, 22 nt, Human
aaaaucugguaauuugaaugug

SEQ ID NO: 447953 - RNA, 22 nt, Human
ccuggagguggagguugcagug

SEQ ID NO: 447954 - RNA, 22 nt, Human
ccagcagcccucuuccaagacu

SEQ ID NO: 447955 - RNA, 22 nt, Human
uuuguaaauagcaguacucaug

SEQ ID NO: 447956 - RNA, 22 nt, Human
agaugaagauaucugcaggggc

SEQ ID NO: 447957 - RNA, 20 nt, Human
uccugcagucgcuagcgccc

SEQ ID NO: 447958 - RNA, 22 nt, Human
gcugccucaggcaccuccuggc

SEQ ID NO: 447959 - RNA, 22 nt, Human
auaguacacauccuacaauguu

SEQ ID NO: 447960 - RNA, 22 nt, Human
uugacaauugggagauauaaag

SEQ ID NO: 447961 - RNA, 17 nt, Human
gcugagaggcagcacag

SEQ ID NO: 447962 - RNA, 22 nt, Human
agggcacaagacucugagcccc

SEQ ID NO: 447963 - RNA, 21 nt, Human
agagagaaggccauauggucc

SEQ ID NO: 447964 - RNA, 22 nt, Human
gaagucugcugcucaggaguuu

SEQ ID NO: 447965 - RNA, 23 nt, Human
agaugagccaacaccuccaugcc

SEQ ID NO: 447966 - RNA, 22 nt, Human
caguggccugagccaggcuucc

SEQ ID NO: 447967 - RNA, 22 nt, Human
agggacaguuacaucaucagac

SEQ ID NO: 447968 - RNA, 22 nt, Human
ugagaagcaguuucaguaagaa

SEQ ID NO: 447969 - RNA, 22 nt, Human
ucccagagccaagcuauggaug

SEQ ID NO: 447970 - RNA, 22 nt, Human
acaugaaaagacuaucugauua

SEQ ID NO: 447971 - RNA, 20 nt, Human
ggccuuggccucuuugcagc

SEQ ID NO: 447972 - RNA, 22 nt, Human
ccugccugacagagaagguuca

SEQ ID NO: 447973 - RNA, 22 nt, Human
gcagcugagcgugaggaagagu

SEQ ID NO: 447974 - RNA, 22 nt, Human
ugugaagguaaggaggggcaag

SEQ ID NO: 447975 - RNA, 22 nt, Human
gagccucguggcggccacugcg

SEQ ID NO: 447976 - RNA, 22 nt, Human
uagcuuuaggcacguuugaauu

SEQ ID NO: 447977 - RNA, 22 nt, Human
cacugaaggcuaggauuagaug

SEQ ID NO: 447978 - RNA, 22 nt, Human
uguaaaaccaaaucaaucuagu

SEQ ID NO: 447979 - RNA, 22 nt, Human
ucacaagauacaguuagaagca

SEQ ID NO: 447980 - RNA, 20 nt, Human
ugucagugccugaggcacag

SEQ ID NO: 447981 - RNA, 22 nt, Human
cuggcuggcaaguagaacacaa

SEQ ID NO: 447982 - RNA, 22 nt, Human
aagaauguuaguuucugauaca

SEQ ID NO: 447983 - RNA, 22 nt, Human
aggcugaggcagguggaucacc

SEQ ID NO: 447984 - RNA, 22 nt, Human
aggcccaguagugcugccuuua

SEQ ID NO: 447985 - RNA, 22 nt, Human
gcugaggcuccucgggaggaca

SEQ ID NO: 447986 - RNA, 22 nt, Human
gggagccuugggagugccagcc

SEQ ID NO: 447987 - RNA, 22 nt, Human
uucuacaugguugcucagaggg

SEQ ID NO: 447988 - RNA, 22 nt, Human
cagggccuccccggcagucuuu

SEQ ID NO: 447989 - RNA, 22 nt, Human
augggcagacagggagcucacg

SEQ ID NO: 447990 - RNA, 22 nt, Human
agggaaaggcugaugcuguggg

SEQ ID NO: 447991 - RNA, 22 nt, Human
cugccgaguacagccauagaaa

SEQ ID NO: 447992 - RNA, 22 nt, Human
augugguugaagaauuacaucu

SEQ ID NO: 447993 - RNA, 22 nt, Human
ugccaggccaaugaaggcaggg

SEQ ID NO: 447994 - RNA, 18 nt, Human
ggagccagucugucucug

SEQ ID NO: 447995 - RNA, 22 nt, Human
ggguggaggagaacaggcccca

SEQ ID NO: 447996 - RNA, 22 nt, Human
guaaaguucuauuugaauuuag

SEQ ID NO: 447997 - RNA, 22 nt, Human
acccagagcugggcuuggcaaa

SEQ ID NO: 447998 - RNA, 22 nt, Human
uucuaucauacuugaauacauu

SEQ ID NO: 447999 - RNA, 22 nt, Human
cagcuucucagaaagcugaggu

SEQ ID NO: 448000 - RNA, 20 nt, Human
ucauuacagugcuaagaugu

SEQ ID NO: 448001 - RNA, 22 nt, Human
acauuugacauuuaguaucagc

SEQ ID NO: 448002 - RNA, 22 nt, Human
gcuguccucugaucucuggagg

SEQ ID NO: 448003 - RNA, 19 nt, Human
ggcccaaguacugagugcc

SEQ ID NO: 448004 - RNA, 22 nt, Human
aaucagaaaauucaguggaauu

SEQ ID NO: 448005 - RNA, 22 nt, Human
gacccagccugguuuuuauagg

SEQ ID NO: 448006 - RNA, 22 nt, Human
uggucaacaggcagggaugaaa

SEQ ID NO: 448007 - RNA, 22 nt, Human
uucagagacagcaaccaggaca

SEQ ID NO: 448008 - RNA, 22 nt, Human
guggagccaggggcuguaggua

SEQ ID NO: 448009 - RNA, 22 nt, Human
ggcaggagauaaaauauuaguu

SEQ ID NO: 448010 - RNA, 22 nt, Human
caagagcuacccugugccauau

SEQ ID NO: 448011 - RNA, 22 nt, Human
ggcagcuuuuaucccugacaga

SEQ ID NO: 448012 - RNA, 22 nt, Human
cccagccugucuuucccaauga

SEQ ID NO: 448013 - RNA, 22 nt, Human
ucugagagguuaagcaauuuga

SEQ ID NO: 448014 - RNA, 22 nt, Human
cagggcucagaagacagaccuc

SEQ ID NO: 448015 - RNA, 22 nt, Human
auuacacauagacauucguuca

SEQ ID NO: 448016 - RNA, 22 nt, Human
acagagaaagugggcugaagau

SEQ ID NO: 448017 - RNA, 22 nt, Human
ugggccuguugggguugaguua

SEQ ID NO: 448018 - RNA, 22 nt, Human
cucccagagaccaagcugagaa

SEQ ID NO: 448019 - RNA, 22 nt, Human
agagggcaugcuugguggccug

SEQ ID NO: 448020 - RNA, 22 nt, Human
aguaaaaauugaggugcaaaau

SEQ ID NO: 448021 - RNA, 19 nt, Human
gggaccugacuaauuggca

SEQ ID NO: 448022 - RNA, 22 nt, Human
aucaguuugauaauaaggcuug

SEQ ID NO: 448023 - RNA, 22 nt, Human
ggcuuuaucaaaugagacccug

SEQ ID NO: 448024 - RNA, 22 nt, Human
cccauuuaucccaagguuacuc

SEQ ID NO: 448025 - RNA, 22 nt, Human
agggagguccaucccugcagag

SEQ ID NO: 448026 - RNA, 22 nt, Human
aggaccaacauagcagcagugg

SEQ ID NO: 448027 - RNA, 22 nt, Human
cagggccucauccucagagauu

SEQ ID NO: 448028 - RNA, 20 nt, Human
uccagccacuuccgcugguc

SEQ ID NO: 448029 - RNA, 22 nt, Human
uagcagggguagauagagugug

SEQ ID NO: 448030 - RNA, 22 nt, Human
ugggcccaagagagucuccaac

SEQ ID NO: 448031 - RNA, 17 nt, Human
ugcugccaagucccaac

SEQ ID NO: 448032 - RNA, 22 nt, Human
agcaguggcuggauggugugcu

SEQ ID NO: 448033 - RNA, 22 nt, Human
gcucccagauuucagccuugug

SEQ ID NO: 448034 - RNA, 22 nt, Human
gccugccucaaaaucccaguuc

SEQ ID NO: 448035 - RNA, 22 nt, Human
uuguuuuggaagaacuuacucu

SEQ ID NO: 448036 - RNA, 22 nt, Human
auguuauuuuggaaaauacaaa

SEQ ID NO: 448037 - RNA, 22 nt, Human
gaaugaauucagcacauggaau

SEQ ID NO: 448038 - RNA, 22 nt, Human
ggcugagcaauuuugaugacau

SEQ ID NO: 448039 - RNA, 22 nt, Human
gggcacagaagucuaagacauc

SEQ ID NO: 448040 - RNA, 22 nt, Human
uucuacuuuagcaugcucauuc

SEQ ID NO: 448041 - RNA, 22 nt, Human
ucccaggcuggcaggcagcagu

SEQ ID NO: 448042 - RNA, 22 nt, Human
uggagccagagcgcagccuggg

SEQ ID NO: 448043 - RNA, 22 nt, Human
acauacauaugacaacuuuccu

SEQ ID NO: 448044 - RNA, 22 nt, Human
uagagcuguaucaaagagccuu

SEQ ID NO: 448045 - RNA, 22 nt, Human
cagagccagcccacuguucccg

SEQ ID NO: 448046 - RNA, 18 nt, Human
gaucgggggcgccccaag

SEQ ID NO: 448047 - RNA, 22 nt, Human
ccugucaggguuugccucagaa

SEQ ID NO: 448048 - RNA, 22 nt, Human
agccuggaguucccaggagaag

SEQ ID NO: 448049 - RNA, 22 nt, Human
gugggcagacagugcuuugcag

SEQ ID NO: 448050 - RNA, 22 nt, Human
ggcugggccagggccuguggac

SEQ ID NO: 448051 - RNA, 22 nt, Human
agcagccagagaaugaugcagu

SEQ ID NO: 448052 - RNA, 22 nt, Human
uucacaggaggguggaugcaug

SEQ ID NO: 448053 - RNA, 22 nt, Human
aucuggcuuaccuagggugccu

SEQ ID NO: 448054 - RNA, 22 nt, Human
auacauauaugguacuuccugg

SEQ ID NO: 448055 - RNA, 22 nt, Human
aacuuucuuucacagaaguauc

SEQ ID NO: 448056 - RNA, 22 nt, Human
uugaggcugcacaguacaggcu

SEQ ID NO: 448057 - RNA, 22 nt, Human
aggagcugagggagcgcccuug

SEQ ID NO: 448058 - RNA, 22 nt, Human
ugaagcaaacgcuucuguuccu

SEQ ID NO: 448059 - RNA, 22 nt, Human
ccaggcugcucacaagcugccc

SEQ ID NO: 448060 - RNA, 22 nt, Human
agggcugccugacuccagagcc

SEQ ID NO: 448061 - RNA, 21 nt, Human
ccugggccaaauucccuggac

SEQ ID NO: 448062 - RNA, 22 nt, Human
cuuuauguccuugaagaguugu

SEQ ID NO: 448063 - RNA, 22 nt, Human
uggcagcuuccugcucauagga

SEQ ID NO: 448064 - RNA, 22 nt, Human
acugcaggagacacagcugcug

SEQ ID NO: 448065 - RNA, 22 nt, Human
cauuuguauguuccuccuuagg

SEQ ID NO: 448066 - RNA, 22 nt, Human
gcaggccuccccugcuggagcu

SEQ ID NO: 448067 - RNA, 22 nt, Human
ugcagaagaauguaggcauaag

SEQ ID NO: 448068 - RNA, 21 nt, Human
uagggcucuauuuuuauuuca

SEQ ID NO: 448069 - RNA, 22 nt, Human
caggcagccaggggaccugucc

SEQ ID NO: 448070 - RNA, 20 nt, Human
ugcagggcucugcuucucuc

SEQ ID NO: 448071 - RNA, 19 nt, Human
ucaaaggcaaggaggaacu

SEQ ID NO: 448072 - RNA, 22 nt, Human
agggcccauagaucgucagcuu

SEQ ID NO: 448073 - RNA, 22 nt, Human
agcaccugcacaguggaggaaa

SEQ ID NO: 448074 - RNA, 22 nt, Human
gggggcuggaauauccaucaac

SEQ ID NO: 448075 - RNA, 22 nt, Human
ggagccaguauuuaguggucuu

SEQ ID NO: 448076 - RNA, 22 nt, Human
uacauucuggaaaggcacagac

SEQ ID NO: 448077 - RNA, 22 nt, Human
uacauuaucuuguuaucuuuca

SEQ ID NO: 448078 - RNA, 22 nt, Human
agccuggaggaggaguugagca

SEQ ID NO: 448079 - RNA, 22 nt, Human
cugcuuuguaaaauagacauaa

SEQ ID NO: 448080 - RNA, 21 nt, Human
acauuuucuguuuuaggaagu

SEQ ID NO: 448081 - RNA, 22 nt, Human
gagagcccugcuccuaucccag

SEQ ID NO: 448082 - RNA, 22 nt, Human
gcaaugauauugaagugaugaa

SEQ ID NO: 448083 - RNA, 22 nt, Human
agucccagaugacccagcuacu

SEQ ID NO: 448084 - RNA, 22 nt, Human
cuuucagagguuacucaggaaa

SEQ ID NO: 448085 - RNA, 22 nt, Human
gaggcagcugaaggagugacag

SEQ ID NO: 448086 - RNA, 22 nt, Human
uuccucagaaaauacuguccaa

SEQ ID NO: 448087 - RNA, 22 nt, Human
ccuuucagaugggcauggaccg

SEQ ID NO: 448088 - RNA, 22 nt, Human
ccagcagcccacaggcgucccu

SEQ ID NO: 448089 - RNA, 21 nt, Human
aauuagggugccucuuauaau

SEQ ID NO: 448090 - RNA, 22 nt, Human
aggcacugaagaacucuuuuug

SEQ ID NO: 448091 - RNA, 22 nt, Human
cagacacagcaauucuguguug

SEQ ID NO: 448092 - RNA, 22 nt, Human
gcaggggaguggaugauggauu

SEQ ID NO: 448093 - RNA, 22 nt, Human
cuuugcaauagaggcacacaug

SEQ ID NO: 448094 - RNA, 22 nt, Human
gcccagagagaugcuguagacc

SEQ ID NO: 448095 - RNA, 22 nt, Human
guccucuguagggcugggccac

SEQ ID NO: 448096 - RNA, 22 nt, Human
gcucuuccauuucucuugaacu

SEQ ID NO: 448097 - RNA, 22 nt, Human
uugaggagucaggggcacggaa

SEQ ID NO: 448098 - RNA, 22 nt, Human
uggcagaguaggauggcccugu

SEQ ID NO: 448099 - RNA, 22 nt, Human
cacaagagagugcgcguugcaa

SEQ ID NO: 448100 - RNA, 23 nt, Human
cuuuucauugccuuagcgcagag

SEQ ID NO: 448101 - RNA, 22 nt, Human
uaguggagaaguggagucugug

SEQ ID NO: 448102 - RNA, 22 nt, Human
gcugagccccccugcguggguc

SEQ ID NO: 448103 - RNA, 22 nt, Human
uccagucaagcuugagaauuuc

SEQ ID NO: 448104 - RNA, 22 nt, Human
agauggggcugaaaguuccaau

SEQ ID NO: 448105 - RNA, 23 nt, Human
ggagugcaauggcgccaucucgg

SEQ ID NO: 448106 - RNA, 22 nt, Human
gcccagcaccucucucaggguu

SEQ ID NO: 448107 - RNA, 20 nt, Human
gcagagcuguucugugggga

SEQ ID NO: 448108 - RNA, 22 nt, Human
ucaccgccuugcccggccgggc

SEQ ID NO: 448109 - RNA, 22 nt, Human
caauuucugggccucacacaag

SEQ ID NO: 448110 - RNA, 22 nt, Human
aacaggcaggagaauucugccu

SEQ ID NO: 448111 - RNA, 22 nt, Human
ugucccagcagcuggguucucu

SEQ ID NO: 448112 - RNA, 22 nt, Human
auccuugaaugacucugcccuc

SEQ ID NO: 448113 - RNA, 22 nt, Human
uuguaacaggcacucugugcca

SEQ ID NO: 448114 - RNA, 22 nt, Human
caaaagaagcucuuggggcuag

SEQ ID NO: 448115 - RNA, 22 nt, Human
ugcagcaggagccaggccuggu

SEQ ID NO: 448116 - RNA, 22 nt, Human
guugaaagaucauguggcugcc

SEQ ID NO: 448117 - RNA, 22 nt, Human
uagaaaucuacuuagacuuucu

SEQ ID NO: 448118 - RNA, 22 nt, Human
cuggcucaggaaaguugcugcu

SEQ ID NO: 448119 - RNA, 22 nt, Human
ucuggcuccguguccgcuccca

SEQ ID NO: 448120 - RNA, 22 nt, Human
ggcagccauacucagaccuggg

SEQ ID NO: 448121 - RNA, 20 nt, Human
gcauccagacacccagcugc

SEQ ID NO: 448122 - RNA, 22 nt, Human
uguaucaaggguuuauguaagc

SEQ ID NO: 448123 - RNA, 22 nt, Human
acauuucucauucuccccuaac

SEQ ID NO: 448124 - RNA, 19 nt, Human
ucucacaucagcuccuagc

SEQ ID NO: 448125 - RNA, 22 nt, Human
uggccuggggaagaccaugggc

SEQ ID NO: 448126 - RNA, 22 nt, Human
ucucccagaaguccucaguaca

SEQ ID NO: 448127 - RNA, 22 nt, Human
cugggaggugaacagaaaaacu

SEQ ID NO: 448128 - RNA, 22 nt, Human
aauacagauauucagugguacu

SEQ ID NO: 448129 - RNA, 22 nt, Human
auaaaacuuauuagaauugugu

SEQ ID NO: 448130 - RNA, 22 nt, Human
cccuggagggcagacagaugcc
